United States Patent 7,510,834 (GENE MAPPING METHOD USING MICROSATELLITE GENETIC POLYMORPHISM MARKERS) - sequence listing, part 3

SEQ ID NO: 11042 - DNA, 427 bp, Homo sapiens
  chr6.fa.O7frz.146911792
  Located on chromosome 6
  Distance between a terminus base of telomere on chromosomal short arm and 5'-terminus of this base sequence : 144668943
  Distance between 3'-terminus of neighbour sequence of sequence listing upward to telomere on chrosomal short arm and 5'-terminus of this base sequence : 120207
aaagtggagaatcattggttagaaagtggccagcacctggaagataacagtgatggtttttgcagctgtggtatggcctctgagaaacactgtgtacttgggtcttttccatgtcccattggaagtgctgcttatgttctgttagaaacatcacggaaagactgctgatggggctatttactttctcattaagggaattgtgtgtgtgtgtgtgtgtgtgtgtgtgtgtgtgtgtgtgtgtgattccacctaaaaataggggccacataaagtttttacacctgctaagctaaacaattcatatactttagctgccaggcaattctctcagcaagataagattgttttcgttccacagatataaagtgcaaagttcaagaacacacagctaataagcagtttgccctgattctaaaccagaaaggcc

SEQ ID NO: 11043 - DNA, 313 bp, Homo sapiens
  chr6.fa.O7frz.147034330
  Located on chromosome 6
  Distance between a terminus base of telomere on chromosomal short arm and 5'-terminus of this base sequence : 144791584
  Distance between 3'-terminus of neighbour sequence of sequence listing upward to telomere on chrosomal short arm and 5'-terminus of this base sequence : 122214
aaggtaagactcattagccaatgacttcctttgagaatgagtccaacacatacattctacatgaagaacatgccaaacatttatttccaggacaactaagtacgtgtgtgtgtgtgtgtgtgtgtgtgtgtgtgtaaatgtttagtttataatgtcatatacctgacaggaaatcatgtgtgggttaatactgatcatgctacattgaagaggcatttattgtttcaattatacaatgccattttcatcactagtttttaccaggaaattctataaacagctgcttaacctgtacctgttatcagaattgtct

SEQ ID NO: 11044 - DNA, 348 bp, Homo sapiens
  chr6.fa.O7frz.147131370
  Located on chromosome 6
  Distance between a terminus base of telomere on chromosomal short arm and 5'-terminus of this base sequence : 144889395
  Distance between 3'-terminus of neighbour sequence of sequence listing upward to telomere on chrosomal short arm and 5'-terminus of this base sequence : 97498
gatctgagcagtacctgtaactccattgccttagctgcagactaaggtggtagtgtaatttcagggaagggaataaggtcatctttgacttttagtcccatcatcaagcatggtgattggccttcagtaggtggtcaggtagtgcttgttgggtggatgggtggatggatggatagatggatggatggatggatggatggatggatggatggatggacggacggacggacggacggatagatgatattgtgaaagagacttttgctgtgccacaaaggaaaggtatatgtgttatttttatcctgctatgattttgcccaattccacctgtagaggacgtctgacatc

SEQ ID NO: 11045 - DNA, 310 bp, Homo sapiens
  chr6.fa.O7frz.147214434
  Located on chromosome 6
  Distance between a terminus base of telomere on chromosomal short arm and 5'-terminus of this base sequence : 144939255
  Distance between 3'-terminus of neighbour sequence of sequence listing upward to telomere on chrosomal short arm and 5'-terminus of this base sequence : 49512
gaaatgtatgccactagaaataagttatgtctgctgggattcttcattatgtgattttggccttgggccttgagaccaaaataggctgggcatatatcctggtttggcattatttgaaagccagaaatccgatcaatcgctgcttttctgtccttttcttttcttcattttcttttattttctttctttcttcctttttctttttctctttcttctttctttctttctttctttctttctttctttctttctttctgtctgtttgcctgtctctgcttttcaaagtttctgttcaaactgatccaaataa

SEQ ID NO: 11046 - DNA, 304 bp, Homo sapiens
  AL023582.1_34409
  Located on chromosome 6
  Distance between a terminus base of telomere on chromosomal short arm and 5'-terminus of this base sequence : 145083482
  Distance between 3'-terminus of neighbour sequence of sequence listing upward to telomere on chrosomal short arm and 5'-terminus of this base sequence : 143917
ctacatgttcaatgcattcaacaggaaaagaaggaaagaaaggaaaagaaaaaagaaagaaagagagaggggaaggaaggaagggagggaggaagggagggagggagggaagaaaaagaaaaagaaaaaagagagagaaagaaagagagagagagagagagagagagaaagaaagagagagaaagaaagaggaagaaagaaagagaaagaaagaaagaaagaaagaggccgggcgcagtggctcacgcctgtaatcccagcactttgggaggccaaggcgggtggatcacgaggtcaggagatc

SEQ ID NO: 11047 - DNA, 222 bp, Homo sapiens
  D6S1587
  Located on chromosome 6
  Distance between a terminus base of telomere on chromosomal short arm and 5'-terminus of this base sequence : 145120711
  Distance between 3'-terminus of neighbour sequence of sequence listing upward to telomere on chrosomal short arm and 5'-terminus of this base sequence : 36925
tcaaaggcagactgtccatctttatctaatacgaacacaagtttgtctttcattactattttatataccagatttgtgtgtgtgtgtgtgtgtgtgtgtgtgtgtgtaagtgtatgggagagagtagaaaggattcttattgtcaactctcattctctggattgagaccacaaaagcattcagtactccaggtaaatagatgctgcgtttctgtgtaggaaa

SEQ ID NO: 11048 - DNA, 189 bp, Homo sapiens
  AL031433.4_100362
  Located on chromosome 6
  Distance between a terminus base of telomere on chromosomal short arm and 5'-terminus of this base sequence : 145167999
  Distance between 3'-terminus of neighbour sequence of sequence listing upward to telomere on chrosomal short arm and 5'-terminus of this base sequence : 47066
tacagtttaaagcatagtgagcacttctgtaactactgctaagctattcttctgaagccctttagcattcttctcattattttcccctcattgccctcatcgcgtgggtaactaagttttctggatttgcgctattgtgtgtgtgtgtgtgtgtgtgtgtgtgtgtgtgacaaagtctcattcttgtca

SEQ ID NO: 11049 - DNA, 273 bp, Homo sapiens
  AL031433.4_71189
  Located on chromosome 6
  Distance between a terminus base of telomere on chromosomal short arm and 5'-terminus of this base sequence : 145197211
  Distance between 3'-terminus of neighbour sequence of sequence listing upward to telomere on chrosomal short arm and 5'-terminus of this base sequence : 29023
tgagaaatccactgttagtctaatggggttttctttataggtgactagatgcttttctcttgctgattttaaaattctttcacttttactttatttatttatttatttatttatttatttatttatttatattttttttgagacacggtcatgctctgtcacccaggctggagtgcagtggagcaatctcagctcactgcaacctctgcctcccagattcaagcaatcctcccacctcagcctccctgtagctaggactacaggcatatgtca

SEQ ID NO: 11050 - DNA, 105 bp, Homo sapiens
  DISO7_10002246
  Located on chromosome 6
  Distance between a terminus base of telomere on chromosomal short arm and 5'-terminus of this base sequence : 145290636
  Distance between 3'-terminus of neighbour sequence of sequence listing upward to telomere on chrosomal short arm and 5'-terminus of this base sequence : 93152
atgtctgagctctaacttcaggaattttacgtagacacacacacacacacacacacacacacacacacacatatatatatctgggctctagccatttctgagatc

SEQ ID NO: 11051 - DNA, 133 bp, Homo sapiens
  DISD22_0004311
  Located on chromosome 6
  Distance between a terminus base of telomere on chromosomal short arm and 5'-terminus of this base sequence : 145519309
  Distance between 3'-terminus of neighbour sequence of sequence listing upward to telomere on chrosomal short arm and 5'-terminus of this base sequence : 228568
cctattacgctgtttcacactctaatttcttcacacaaaagaacgaaggacctaaaacacacacatggacacacacacacacacacacacacagacacacagggacatatacacatatggaaacatatgcaca

SEQ ID NO: 11052 - DNA, 189 bp, Homo sapiens
  DISD22_0004312
  Located on chromosome 6
  Distance between a terminus base of telomere on chromosomal short arm and 5'-terminus of this base sequence : 145589459
  Distance between 3'-terminus of neighbour sequence of sequence listing upward to telomere on chrosomal short arm and 5'-terminus of this base sequence : 70017
gctgtcactgcatgatggttgtgtgtatatgtgtgtgtgtgtgtgtgtgtgtgtgagagagagagagagaaagagagcgagagagaaaaagagagagagcgagagagtggggaggagggagagtttttggcaatctgtgtaaatcaaaaaatgttaatgtaagttaggggggttgcggaataaactgaa

SEQ ID NO: 11053 - DNA, 130 bp, Homo sapiens
  D6S1569
  Located on chromosome 6
  Distance between a terminus base of telomere on chromosomal short arm and 5'-terminus of this base sequence : 145752855
  Distance between 3'-terminus of neighbour sequence of sequence listing upward to telomere on chrosomal short arm and 5'-terminus of this base sequence : 163207
agtatgcaagaaactgctagattatatgtatgtgtgtgtgtgtgtgtgtgtgtgtgtgtgtaatcagttgttcctctaaaggaattttttttatttttttaagacagggtcttgctttgtcacccaggct

SEQ ID NO: 11054 - DNA, 300 bp, Homo sapiens
  chr6.fa.O7frz.148015744
  Located on chromosome 6
  Distance between a terminus base of telomere on chromosomal short arm and 5'-terminus of this base sequence : 145824588
  Distance between 3'-terminus of neighbour sequence of sequence listing upward to telomere on chrosomal short arm and 5'-terminus of this base sequence : 71603
ctttctgatttgtcatctaacaagtgtccctgtatacctgggtctattttggagtttctcttctgttccacaggttttgttgtctgtccccaaactaatacctttattatcttattactacagctttatagtaagtcttggtatctagaaacacagctcccttccttgtttatcaagactactggttttggcactttaaagttccataaatattttagaatcagctttgaagttttaaacacacacacacacacacacacacacacaatatttcttggaatttgttactgagattgcatt

SEQ ID NO: 11055 - DNA, 455 bp, Homo sapiens
  AC074296.3_134801
  Located on chromosome 6
  Distance between a terminus base of telomere on chromosomal short arm and 5'-terminus of this base sequence : 145983178
  Distance between 3'-terminus of neighbour sequence of sequence listing upward to telomere on chrosomal short arm and 5'-terminus of this base sequence : 158290
acagtcctaaagtatagctccatataactttattgtattttaaagaacaaacttctaagttcagcattcaagattctccataatgtataaccccaatcttcctccccaaacttactttggccaacctagattgggctatcctacctctgggtgacacagcaagactctatctcgaaataactaactaactaactaactaaataaataaataaataataaaattacacccttccttcattcatgatacatcttaagacctacttccttcctgtaacattttctatccatcccactccataaccaaatgatcttttctttctctgtgctagtacccgaacttttaccatttgagttactagtattatccatgtattatgttaaccacaccacacattccgtacccacattcccttccactaagctccttgggggcaggactatggcttaggtacact

SEQ ID NO: 11056 - DNA, 389 bp, Homo sapiens
  AL031772.6_26950
  Located on chromosome 6
  Distance between a terminus base of telomere on chromosomal short arm and 5'-terminus of this base sequence : 146113214
  Distance between 3'-terminus of neighbour sequence of sequence listing upward to telomere on chrosomal short arm and 5'-terminus of this base sequence : 129581
cttggaagtattcaacgtacacaaggagaattaactcctttcctcctttctttctttctttctttctttctttctttctttcttttctttctttcttttctttctttctttcttttccttccttccctccttccttccttccttccttccttccttccttccttccttctttctttctttctttctttctttctttctttctttctttctttctttctttctttctttctttctttctttctttctttctttctttcttttcttgacagtcttgctgtgttgcccaggctggagtgcactggtgcaatctcagctcactgtaacctccacctcccaggttcaagcaattctcctgcctcagcctcccgagtagctaggattacaggcac

SEQ ID NO: 11057 - DNA, 145 bp, Homo sapiens
  D6S1699
  Located on chromosome 6
  Distance between a terminus base of telomere on chromosomal short arm and 5'-terminus of this base sequence : 146117256
  Distance between 3'-terminus of neighbour sequence of sequence listing upward to telomere on chrosomal short arm and 5'-terminus of this base sequence : 3653
agaattcaatggactaggtggtagaaggatgacaaatgtgtactcagtctgccatcttaaagtattcaagaactttccaagtgtgtgtgtgtgtgtgtgtgtgtgtgtgtgtgtgtgtgtaaaacaaacttgctttccatgaaag

SEQ ID NO: 11058 - DNA, 231 bp, Homo sapiens
  AL031772.6_47119
  Located on chromosome 6
  Distance between a terminus base of telomere on chromosomal short arm and 5'-terminus of this base sequence : 146133469
  Distance between 3'-terminus of neighbour sequence of sequence listing upward to telomere on chrosomal short arm and 5'-terminus of this base sequence : 16068
agtgacagtagaggcctcaaggccccagggagcttaatgcttgtgtgtgtgtgtgtgtgtgtgtgtgtgtgtgtgtgtgtgttgtgcatgttcctgatgatctttctgtttgagccacgaagaaatcaaccacttttctgttttgcccccaggataaataccagaacagcctatcagaggtagaaaaacaagagaagataagatcttaactatcataatgaggacaggcac

SEQ ID NO: 11059 - DNA, 175 bp, Homo sapiens
  AL031772.6_86273
  Located on chromosome 6
  Distance between a terminus base of telomere on chromosomal short arm and 5'-terminus of this base sequence : 146172643
  Distance between 3'-terminus of neighbour sequence of sequence listing upward to telomere on chrosomal short arm and 5'-terminus of this base sequence : 38943
aaactgtattgaagcattggatgtgtgtgtgtgtgtgtgtgtgtgtgtagcttccatgtttattttgacagagtggtttgcctgagtaaaagcttttcgtttaaatcctactgtaagcaaagaaaaacatgtttaactgaatgtaattgccttgtgctcaatttgctactcactt

SEQ ID NO: 11060 - DNA, 206 bp, Homo sapiens
  DISD22_0004329
  Located on chromosome 6
  Distance between a terminus base of telomere on chromosomal short arm and 5'-terminus of this base sequence : 146428520
  Distance between 3'-terminus of neighbour sequence of sequence listing upward to telomere on chrosomal short arm and 5'-terminus of this base sequence : 255702
gactaatgtgatcttagtcaaatgctaattaaaaagaaactgattgagacagtttctttttaaacagaacggtcttaatttttttccagtaagctagtgtgtatgtgtgtgtgtgtgtgtgtgtgtgtgtgtgtgtctgtgtgtgtgtgtgtgtgtgtgtctataggataacaatatatttctggatttgaatgttaagacattga

SEQ ID NO: 11061 - DNA, 110 bp, Homo sapiens
  D6S471
  Located on chromosome 6
  Distance between a terminus base of telomere on chromosomal short arm and 5'-terminus of this base sequence : 146835920
  Distance between 3'-terminus of neighbour sequence of sequence listing upward to telomere on chrosomal short arm and 5'-terminus of this base sequence : 407194
atatctctggggtgctatgaccttctcccccccccagggcacatgtgcacttgcgcgcaggcacacacacacacacacacacacacacaaatatgtatacccagggccgg

SEQ ID NO: 11062 - DNA, 275 bp, Homo sapiens
  AL034451.26_21830
  Located on chromosome 6
  Distance between a terminus base of telomere on chromosomal short arm and 5'-terminus of this base sequence : 146841830
  Distance between 3'-terminus of neighbour sequence of sequence listing upward to telomere on chrosomal short arm and 5'-terminus of this base sequence : 5800
acatcaggttatgaggcttaacctttccccaccggggaaaatttcttggctccttttgggcaaaagggaagaagataagctcagatttcctttttccttccttccttccttccttccttccttccttccttccttccttccttccttccttccttctttccttctttccctccctccctccctccctccctccttccttcctctctctctctctctctctctctttctttcttcagggtctcactgtcacccaggtttgagtggcactatcttgg

SEQ ID NO: 11063 - DNA, 269 bp, Homo sapiens
  AL034451.26_21864
  Located on chromosome 6
  Distance between a terminus base of telomere on chromosomal short arm and 5'-terminus of this base sequence : 146841834
  Distance between 3'-terminus of neighbour sequence of sequence listing upward to telomere on chrosomal short arm and 5'-terminus of this base sequence : -271
caggttatgaggcttaacctttccccaccggggaaaatttcttggctccttttgggcaaaagggaagaagataagctcagatttcctttttccttccttccttccttccttccttccttccttccttccttccttccttccttccttccttctttccttctttccctccctccctccctccctccctccttccttcctctctctctctctctctctctctttctttcttcagggtctcactgtcacccaggtttgagtggcactatctt

SEQ ID NO: 11064 - DNA, 317 bp, Homo sapiens
  AL034451.26_59961
  Located on chromosome 6
  Distance between a terminus base of telomere on chromosomal short arm and 5'-terminus of this base sequence : 146880039
  Distance between 3'-terminus of neighbour sequence of sequence listing upward to telomere on chrosomal short arm and 5'-terminus of this base sequence : 37936
ccattgtgatcacagaagttacttaatattgtttcaatttttttgaatttttaaagactggttttgcggcctaacatatatatggttcatctatctatctatctatctatctatctatctatctatctatcatctatcatctatctacctacctacttatctatctctatctatatccataacatatatatggtttatccatatataggataatccgtgtgctgaggagaagaaagtgtattctacagccattggatgaaatgtgaatatctattacatccatttggtctatagtgcagattaagtacaatgtttct

SEQ ID NO: 11065 - DNA, 337 bp, Homo sapiens
  AL034451.26_105516
  Located on chromosome 6
  Distance between a terminus base of telomere on chromosomal short arm and 5'-terminus of this base sequence : 146925578
  Distance between 3'-terminus of neighbour sequence of sequence listing upward to telomere on chrosomal short arm and 5'-terminus of this base sequence : 45222
aacagtgcagaaagtaaatgtctccctcccctcaccactccttcctccttttcccaattctcttagacttcccaacagcagaagtgttgtgatgggaggagggagtgtgtgtgtgtgtgtgtgtgtgtgtgtgtgtgtgcgcgcgcgcatgagagagacagagaaaattggagagaaattcttgatgccatcttatttttgatttaagaagaaaatatgtatcacacacagagatcccttcatctccccaccctactctccccaccaaaaaaacctctgctgtttagaactctaagagaattactggtcaaaaatctttcagattaagctcattcca

SEQ ID NO: 11066 - DNA, 226 bp, Homo sapiens
  D6S1675
  Located on chromosome 6
  Distance between a terminus base of telomere on chromosomal short arm and 5'-terminus of this base sequence : 147004863
  Distance between 3'-terminus of neighbour sequence of sequence listing upward to telomere on chrosomal short arm and 5'-terminus of this base sequence : 78948
ttacccaaaattctatgaagtaggaagaagtgtatgtatgtatgtgtgtgtgtgtgtgtgtgtgtgtgtgtgtgtgtatgtttctgtgtgtttttttgtttgtttgttttgcaaagctttcttctgtttaaactgttctccttagggagaacaatttccccccactgcaaaaaataccttaattgtactatgaatagtgggctaaaggtcctggtgtcagtgtaga

SEQ ID NO: 11067 - DNA, 251 bp, Homo sapiens
  D6S314
  Located on chromosome 6
  Distance between a terminus base of telomere on chromosomal short arm and 5'-terminus of this base sequence : 147011061
  Distance between 3'-terminus of neighbour sequence of sequence listing upward to telomere on chrosomal short arm and 5'-terminus of this base sequence : 5972
gtgggtagcaacactgtggcatagagagagagagagagagagagtgtgtgtgtgtgtgtgtgtgtgtgtgtgtgtgtaaaaaattatgcaattcctaatcctaggtcaaggaagtggattagtggtatacaggttataaaggtgcttttgaatttattaatattttaaaatttcaaagtgcaaatctaaaataaataagaacgatgtttattaagtacatttataagtagcccacccaaagaagtcatttt

SEQ ID NO: 11068 - DNA, 264 bp, Homo sapiens
  D6S1684
  Located on chromosome 6
  Distance between a terminus base of telomere on chromosomal short arm and 5'-terminus of this base sequence : 147180904
  Distance between 3'-terminus of neighbour sequence of sequence listing upward to telomere on chrosomal short arm and 5'-terminus of this base sequence : 169592
caactggattcaaaatagatgtctcctgttatttaaacatgtaaatcacacacacacacacacacacacacacacacacacacacacgcacacacacactcactgtggcatagattgccttttccaataacttctgatcaaaatttccccatttatcacaaatgtgcctacacattaatcttggagtaaccccaaggcaatgatctctctgagccactttatccctacaaacctgtttccaaaactcacatagcctgctgccat

SEQ ID NO: 11069 - DNA, 332 bp, Homo sapiens
  AL050338.12_99558
  Located on chromosome 6
  Distance between a terminus base of telomere on chromosomal short arm and 5'-terminus of this base sequence : 147189018
  Distance between 3'-terminus of neighbour sequence of sequence listing upward to telomere on chrosomal short arm and 5'-terminus of this base sequence : 7850
ctgacatgtttactgaactctttccttccttccttccttccttccttccttccttccttccttccttccttccttctctctctctctttctttctgtttttttgagacacgttctcactctgttgcccaggctggagtgcaggtgaccttatctcagctcagtgcaacctccccgtcctgggctcaagcaattttccagcttcggcctccagtgtagccgggactacaagctcgagccaccaatgcccagctaatttttgtattttttgtagagccagggtttctctgcattgcccaggctggtcttgaactcctgagctcaaagtgatcca

SEQ ID NO: 11070 - DNA, 479 bp, Homo sapiens
  chr6.fa.O7frz.149263732
  Located on chromosome 6
  Distance between a terminus base of telomere on chromosomal short arm and 5'-terminus of this base sequence : 147381753
  Distance between 3'-terminus of neighbour sequence of sequence listing upward to telomere on chrosomal short arm and 5'-terminus of this base sequence : 192403
tttgcctaatcaaagttatctaatcagggaaacaacactacataaaaaatcatggaatatatatatatatattccatatatattttatatatatgtatactccatatatatggaatatatggtcattatatatatatatacacacacattttatatatgtgtgtgtgtgtgtatatatatatatatatatatatatatataaaattccatagctggaatactgaggaaagcatttagctttcctcagtaaaagagcatgtgttgataactctttatcgtgtgtgtgtgtgtatataaagttcagtgcttaatatcattgtgaaatatagacttctagttgttagtacatgtaacaacagcagaaatggtaaaatcattacaataaagctgtgaaggatgtgttcttgcagcaaagcacacgggggatcttggttcctagcagaaaaacaccactgctgctatttacttcatcagtgaat

SEQ ID NO: 11071 - DNA, 327 bp, Homo sapiens
  AL022477.1_27793
  Located on chromosome 6
  Distance between a terminus base of telomere on chromosomal short arm and 5'-terminus of this base sequence : 147495027
  Distance between 3'-terminus of neighbour sequence of sequence listing upward to telomere on chrosomal short arm and 5'-terminus of this base sequence : 112795
cactttgttagaggtcagacactgacctgggttatcaaagtgttattaatacttaaaaagttcctccatttatttttattttatgtatgtatgtatgtatgtatgtatgtatgtatgtatgtatttatttatttttgagacagagtcttgctctttcacccaggctggagtggaatggtgtgatcttggttcactgtaacctctgcctcccaggttcaagcgattctcctgcatcagcctcttgagtagctgagactacaggcatcaccatcatgcttgactaatttttgcatttttgtagagacagggtttcaccatgttggctag

SEQ ID NO: 11072 - DNA, 194 bp, Homo sapiens
  AL031771.1_947
  Located on chromosome 6
  Distance between a terminus base of telomere on chromosomal short arm and 5'-terminus of this base sequence : 147591394
  Distance between 3'-terminus of neighbour sequence of sequence listing upward to telomere on chrosomal short arm and 5'-terminus of this base sequence : 96040
ccttaatttctgcttagaaacaactagaggtgcctttgtttagaaagaaaaccaaatacctgtttttgcgtaattttaaagtgtatatatatgtgtgtgtgtgtgtgtgtgtgtgtgtgtgtgtgtaggtgtgtgtatgtgtcaatctagaaggggaaaactgtcagccaatcacagtactgtccaatttaaca

SEQ ID NO: 11073 - DNA, 387 bp, Homo sapiens
  AL031771.1_13513
  Located on chromosome 6
  Distance between a terminus base of telomere on chromosomal short arm and 5'-terminus of this base sequence : 147603846
  Distance between 3'-terminus of neighbour sequence of sequence listing upward to telomere on chrosomal short arm and 5'-terminus of this base sequence : 12258
taacaaatggtttagaactcagactgagagcagtgtctgttatttattgggctctgtatgttttagaataaaagcataattcttgggaaattgaacaagcttgctttctttttctttttctcttttatttctctcttatttccttccttccttccttccttccttccttccttccttccttccttccttccttccttcctttcttcctccctccctccctccctccctcccttccttccttccttccacaaggtctcacttgtcatccatgctgtagtgcagtggtgtgatcataactcactgcagcgtcaaacttctgggttcaagcagttctcctacttcaacctcccacatggctgaacaagctatttctaagcctccatcaag

SEQ ID NO: 11074 - DNA, 401 bp, Homo sapiens
  AL031771.1_41664
  Located on chromosome 6
  Distance between a terminus base of telomere on chromosomal short arm and 5'-terminus of this base sequence : 147631905
  Distance between 3'-terminus of neighbour sequence of sequence listing upward to telomere on chrosomal short arm and 5'-terminus of this base sequence : 27672
cttaagaccatcaaatctcatgagaactccctcactatcatgagaactccctcactatcatgagaacagcatgggggaaaccaccaccatgatccaatcacctctcaccaggtccctccctcaacatgtggggactacaattcgagatgagatttgggtggggacatagaggcaaaccatatcagtgcatgtatgtatatgcatatgtgatacgtttatatatcattatatacttgtgtgtgtacatatatgtatatatataaaaaaatgtagagagatatatagctataggtataagtgtgtgtgtgtgtgtgtgtgtgtgtgtgtgtgtggagagaggtaacctgagaaaaagagagaaagaaattgagagaggaaggaagcagaatggaaagcttatt

SEQ ID NO: 11075 - DNA, 253 bp, Homo sapiens
  AL031771.1_80780
  Located on chromosome 6
  Distance between a terminus base of telomere on chromosomal short arm and 5'-terminus of this base sequence : 147671183
  Distance between 3'-terminus of neighbour sequence of sequence listing upward to telomere on chrosomal short arm and 5'-terminus of this base sequence : 38877
ttcctcatttgctttatctcagcataaaacaattttctagttatattatggtatagcccattgatcaataacactgatctgcctctctctctctctctctctgtgtgtgtgtgtgtgtgtgtgtatgtgtgtgtttgtgtgtgtgtgtgtgtgtgtgtgtgtgattgctttcgatattttgtttggtcagagaaagagggcagtacacatagtgggctagtgaacattctgtacttagctccaagtgccttat

SEQ ID NO: 11076 - DNA, 474 bp, Homo sapiens
  chr6.fa.O7frz.149815666
  Located on chromosome 6
  Distance between a terminus base of telomere on chromosomal short arm and 5'-terminus of this base sequence : 147895743
  Distance between 3'-terminus of neighbour sequence of sequence listing upward to telomere on chrosomal short arm and 5'-terminus of this base sequence : 224307
ttcagtggcatgtaggatatacccctatttaatattttatgctatctagtagtatcatttttatatttcattttcaaattgtccttttttatgtcctgcaaccttgctaaacttccttattatttagtttggtaggtgtcattgcattttttcctctctttctgtatgtatatatatatatatatatatgtatatatgtatatgtgtgtgtgtatatgtgtgtgtacatatatgtgtgtatatatacatacatatatacacacataggtaaacatgtagtcagcaaataaggattatttcttctcttaaaatctggatgaattttatttttttgtcttgtcttattgtactggctaaaactttaagttcaatcttgaaaagaaacagtgaaatcagacatgtttttctgtttctgatcttagggtaagagcattcagtcatttacaatcattgttcatgactgctctttatcag

SEQ ID NO: 11077 - DNA, 365 bp, Homo sapiens
  AL035446.4_9086
  Located on chromosome 6
  Distance between a terminus base of telomere on chromosomal short arm and 5'-terminus of this base sequence : 148088189
  Distance between 3'-terminus of neighbour sequence of sequence listing upward to telomere on chrosomal short arm and 5'-terminus of this base sequence : 191972
tagctaatgcctgcaacttaataagcaattgcaaactttcataacatcttggtaatatagagattaaattttcatgttgaaaaatttaagaatcacaagaagtgacaaaagcagtacagagagtccctggaccctacacccatgtttttacaatgatgatgttgtacttacccaggggtcatttcaaaaccaggacatcaacattggtacaaaatgattaactaaattacagattttttcagaattcataggttgttacatacactttgtgtgtgtgtgtgtgtgtgtgtgtgtgtgtgtgtgtgtgtgtgtgtgtgagagagagagagagtatgtgtgtggtccaggaatgtagtactatggaa

SEQ ID NO: 11078 - DNA, 310 bp, Homo sapiens
  AL035446.4_24052
  Located on chromosome 6
  Distance between a terminus base of telomere on chromosomal short arm and 5'-terminus of this base sequence : 148103357
  Distance between 3'-terminus of neighbour sequence of sequence listing upward to telomere on chrosomal short arm and 5'-terminus of this base sequence : 14803
aggcttactccttaatttctgaactgattgccagagagtcagggatatacacatacattatatatacacacacacacacacacacacacacacacacacacacacacatatatatatacacacacatacatatatatatatacacacacatacatatacatatatgggagattatatctatatctatatctatgtctatccctcccatgttatttcctgcttttctactacttgttccactttccccaggtcttttgaaactaaaaataaaattatcacctcactgtaagtatcatgtcttctgcttcag

SEQ ID NO: 11079 - DNA, 308 bp, Homo sapiens
  AL035446.4_100351
  Located on chromosome 6
  Distance between a terminus base of telomere on chromosomal short arm and 5'-terminus of this base sequence : 148179530
  Distance between 3'-terminus of neighbour sequence of sequence listing upward to telomere on chrosomal short arm and 5'-terminus of this base sequence : 75863
agccatgtcaacataatgagaccccatccccatttttttttaattagctgagtgtgcagcacatgcctgtagtcccagccactcaggaaggaggctgaagtgggaggatcatttccaccgaggaggttgaggctgcaataagctgtgatcatgccactgaactcgagccagggtaacagagtaaacaccttacacacacacacacacacacacacaccacacacacacacacaaaagagagagagaaaagagaaaaaaaactttttgacattttaactatattaaaatgttcagtgtaggctttgttt

SEQ ID NO: 11080 - DNA, 199 bp, Homo sapiens
  D6S308
  Located on chromosome 6
  Distance between a terminus base of telomere on chromosomal short arm and 5'-terminus of this base sequence : 148253254
  Distance between 3'-terminus of neighbour sequence of sequence listing upward to telomere on chrosomal short arm and 5'-terminus of this base sequence : 73416
gtctaatcactgccccaaagccctacattctactaccatcaccttggggattagaatttcaacatatgaattttgaggtaacaaaaacatttagaccataatgcatatatatatatatgtgtgtgtgtgtgtgtgtgtgtgtgtgtattgaagaaacagttttgtgtgtgtgtgtgtgtttatgtacgtgaattctctc

SEQ ID NO: 11081 - DNA, 182 bp, Homo sapiens
  D6S453
  Located on chromosome 6
  Distance between a terminus base of telomere on chromosomal short arm and 5'-terminus of this base sequence : 148377723
  Distance between 3'-terminus of neighbour sequence of sequence listing upward to telomere on chrosomal short arm and 5'-terminus of this base sequence : 124270
gaggtagtgcaaaactctccaaaacttaactatggctactaattgtgacttcctttcaaagagtacagtatgggaaaaagaaaaaaaaaagggtttttttgttttgtgtgtgtgtgtgtgtgtgtgtgtgtgtgtgtgtagaaacctacagtcctacctcagccaggttctcaaagttggca

SEQ ID NO: 11082 - DNA, 177 bp, Homo sapiens
  Z24213.1_162
  Located on chromosome 6
  Distance between a terminus base of telomere on chromosomal short arm and 5'-terminus of this base sequence : 148377767
  Distance between 3'-terminus of neighbour sequence of sequence listing upward to telomere on chrosomal short arm and 5'-terminus of this base sequence : -138
gtgacttcctttcaaagagtacagtatgggaaaaagaaaaaaaaaagggtttttttgttttgtgtgtgtgtgtgtgtgtgtgtgtgtgtgtgtgtagaaacctacagtcctacctcagccaggttctcaaagttggcataaacagtggtaagcatgctggtagcatgtactatgata

SEQ ID NO: 11083 - DNA, 334 bp, Homo sapiens
  HUMUT1901
  Located on chromosome 6
  Distance between a terminus base of telomere on chromosomal short arm and 5'-terminus of this base sequence : 148505941
  Distance between 3'-terminus of neighbour sequence of sequence listing upward to telomere on chrosomal short arm and 5'-terminus of this base sequence : 127997
gttaagcagaattggttcttggtttctttccttccttccttccttccctccttccttccttccttccctccttccttccttcctccctccctccttttctttttttctttctttctttctttctttctttctttcttttctttctttctttttttcctctctctctctcttccttccttccttccttccttccttccttccttccttccttcctctctctctttctttctttcttttttcttgacatggggttttgctcttgttgcccaggctggagtgcaatggcgcgatctaagctcactgtcttctccgcctcctgggttcaggagattct

SEQ ID NO: 11084 - DNA, 409 bp, Homo sapiens
  chr6.fa.O7frz.150635830
  Located on chromosome 6
  Distance between a terminus base of telomere on chromosomal short arm and 5'-terminus of this base sequence : 148707271
  Distance between 3'-terminus of neighbour sequence of sequence listing upward to telomere on chrosomal short arm and 5'-terminus of this base sequence : 200996
agtaacatcaaagatcagtgatctcagatcaccataatggatgtaataataatgaaaaactttaaagtaatatgttgtcaaaatgtgacacagagacatgaagtgagcacatgccattggaaaaatgttgctggtagacttgcttaatggagggttgccacagaccttcaatttttaaaaatcatgatgtctgcgaacataatatctgtgaagcacaagaaagcaaacagcacttaaaacaaggtacacctgtgtatataagtatctgtatagtgcatatatgtatatttatataatttatgtctacctgtctctatctacctctctctctctctctctctctctatccacctatctatccatccacatatctatctatcttttcggtcctactggtgagtattcaact

SEQ ID NO: 11085 - DNA, 455 bp, Homo sapiens
  chr6.fa.O7frz.150946742
  Located on chromosome 6
  Distance between a terminus base of telomere on chromosomal short arm and 5'-terminus of this base sequence : 148896894
  Distance between 3'-terminus of neighbour sequence of sequence listing upward to telomere on chrosomal short arm and 5'-terminus of this base sequence : 189214
gcctagctaacatggtgtaaccccatctctagtaaaaatacaaaaaaaaaaaaaaattagccgggcatggtggcacatgcctgtaatcctggctactcaggagcctgaggcaggagaatctcttgaacctgggaggtggaggttgcagtgagcagagatcgtgccactgccctccagcctgggcgatagagactctgtctcaaaacaataaataaaaaaataaagaaatgcttgaagttctcacataaatgaatgaataatacattgactttcttcttgttcctctagagtttctttctttctttctttctttctttctttctttctttctttctttctttctttctttctttcttaatctttgggccttcacattgctgtaccatctgcaaagaatattcttacacatatctccttcacatcttttaatcattcaactatcacttgaaacatct

SEQ ID NO: 11086 - DNA, 223 bp, Homo sapiens
  D6S1648
  Located on chromosome 6
  Distance between a terminus base of telomere on chromosomal short arm and 5'-terminus of this base sequence : 149073467
  Distance between 3'-terminus of neighbour sequence of sequence listing upward to telomere on chrosomal short arm and 5'-terminus of this base sequence : 176118
tgcacagaaggtaataccagtaggtatcaagtgtgtgtgtgtgtgtatgtgtgtgtgtgtgtgtgtgaaagagagagaaagagaaagagagagagagagagagagagagagagagagagcatgtgagctcagagagaaaaatctccctataaatgtgtcattgaatgatttgaatcattgacatatacgtagtaattaaagccatggacatggatgagattgc

SEQ ID NO: 11087 - DNA, 358 bp, Homo sapiens
  AL049823.14_100572
  Located on chromosome 6
  Distance between a terminus base of telomere on chromosomal short arm and 5'-terminus of this base sequence : 149076089
  Distance between 3'-terminus of neighbour sequence of sequence listing upward to telomere on chrosomal short arm and 5'-terminus of this base sequence : 2399
tcttagaggtaatttgaccatgagggctatgacctaataaatggattaatgtcattatcacgggagtaagtgagttctcacaggagtatgctcctgataagcctggccctgttcctctctctctctctctctgtctctgtctctgtctctctctcttcctctctcatttcctctctctctctctctctctctcgcgggcatgtgcccatgcttcctcaccatgtgatgtcttctgccatgggattacactgtccagctgctggtgctatttttttggagtgagacaaattaacttctgttctttgtaaactacccagtgtgtggtattttcttatagtagctgaacttggacttgaac

SEQ ID NO: 11088 - DNA, 336 bp, Homo sapiens
  AL049823.14_93460
  Located on chromosome 6
  Distance between a terminus base of telomere on chromosomal short arm and 5'-terminus of this base sequence : 149083252
  Distance between 3'-terminus of neighbour sequence of sequence listing upward to telomere on chrosomal short arm and 5'-terminus of this base sequence : 6805
gcttactgtcaaagcatctgtcaccctgacactgatgtgtttttgagtgattataagcttattaaatatatatgtatacatacacaatacacacacatatgtgtgtatatgtgtgtgtgtgtgtgtgtgtgtgtgtgtgtgtatttgaaaaacgctttcaacatcttgtatttataattttggagaaaagaggacttacccagcagcaaagtatacataaagccagcagctctgttacaaagatagaaaatataccctgcaatcattataacttctgataaatataattctgatttttaaaaatggctctaaagctaaatgattatgaaggtggca

SEQ ID NO: 11089 - DNA, 154 bp, Homo sapiens
  AL049823.14_77895
  Located on chromosome 6
  Distance between a terminus base of telomere on chromosomal short arm and 5'-terminus of this base sequence : 149098828
  Distance between 3'-terminus of neighbour sequence of sequence listing upward to telomere on chrosomal short arm and 5'-terminus of this base sequence : 15240
tataaacatggtgcattagtcagtgttctccaaagaaacaggaccagtaggatatggacatatatatgtgtgcacatgtctgtgtgtgtgtgtgtgtgtgtgtgtgtgtgtgtgtgtgtgtgtgtgtgtgtagttataaggaaatggctcctgt

SEQ ID NO: 11090 - DNA, 171 bp, Homo sapiens
  D6S310
  Located on chromosome 6
  Distance between a terminus base of telomere on chromosomal short arm and 5'-terminus of this base sequence : 149098862
  Distance between 3'-terminus of neighbour sequence of sequence listing upward to telomere on chrosomal short arm and 5'-terminus of this base sequence : -120
gaaacaggaccagtaggatatggacatatatatgtgtgcacatgtctgtgtgtgtgtgtgtgtgtgtgtgtgtgtgtgtgtgtgtgtgtgtgtgtgtagttataaggaaatggctcctgtgattatggaagggctaggaagtgctatgatctgccttctgcaatctggatc

SEQ ID NO: 11091 - DNA, 315 bp, Homo sapiens
  chr6.fa.O7frz.151273324
  Located on chromosome 6
  Distance between a terminus base of telomere on chromosomal short arm and 5'-terminus of this base sequence : 149286614
  Distance between 3'-terminus of neighbour sequence of sequence listing upward to telomere on chrosomal short arm and 5'-terminus of this base sequence : 187581
taccttatgatcatattagccaattcaccctaataaactcccttttatatatacatatatcccatttatgctgtccctctagagaaccctgactaatacagattttagccatggaaatcttgaagaaaaagagaaagaggaagagaagggggaggaccaagaggtggaggaaaagtaggtggcaggggaatgcagcaatgattgaggagaaaaaaatgggaaagatggaaggaaggaaggaaggaaggaaggaaggaagggagggaaggaggattgccagccatcattccagaggtcacaagatacgctacttcc

SEQ ID NO: 11092 - DNA, 201 bp, Homo sapiens
  Z66907
  Located on chromosome 6
  Distance between a terminus base of telomere on chromosomal short arm and 5'-terminus of this base sequence : 149632607
  Distance between 3'-terminus of neighbour sequence of sequence listing upward to telomere on chrosomal short arm and 5'-terminus of this base sequence : 345678
gaagacctccttagcctacagtccaatcatggagtgtgtgtgtgtgtgtgtgtgtgtgtgtgtgtgttatacagtctattttgttttgtgcacatagttttaattgttttacctgtaaagtttcttctgtgtacttccaattttagcgggtacttttaataatgaactagacctagaggttgggcgggtaactttcttgga

SEQ ID NO: 11093 - DNA, 328 bp, Homo sapiens
  chr6.fa.O7frz.151700362
  Located on chromosome 6
  Distance between a terminus base of telomere on chromosomal short arm and 5'-terminus of this base sequence : 149731515
  Distance between 3'-terminus of neighbour sequence of sequence listing upward to telomere on chrosomal short arm and 5'-terminus of this base sequence : 98707
tacctgttctttactgcatcagtgaaacctgaaactaacccacatttctttatcacacacacacacacacacacacacacacacacacacaacttaaggcctgtgtgtgagtagcagattttattggcattttgatgacagttaaaggcaatttacatatagaaggaaaaatcataaacattttctccataatttaaaacctaaaagtttacgctagatattcaatacatcccttctgtaagaacactccattttttaacatctacataaaggaggtacttttctcctccaaccaggattgagtgagtggtcttacctcaagatttat

SEQ ID NO: 11094 - DNA, 220 bp, Homo sapiens
  Z67728
  Located on chromosome 6
  Distance between a terminus base of telomere on chromosomal short arm and 5'-terminus of this base sequence : 149905733
  Distance between 3'-terminus of neighbour sequence of sequence listing upward to telomere on chrosomal short arm and 5'-terminus of this base sequence : 173890
tcaaagaagcccagtgaacctcacacaatataacttacagataaagacacacacacacacacacacacacacacacacacacagccctacctttgcgcatcatagtcaaactggatatgataaaggattaaaaaaaatcttgaaggaagtcagaaaaaaaaatgacagtgcacaacaggaagtgacagaagaatgatggttgtattagtctgttctcaca

SEQ ID NO: 11095 - DNA, 145 bp, Homo sapiens
  HUMUT2427
  Located on chromosome 6
  Distance between a terminus base of telomere on chromosomal short arm and 5'-terminus of this base sequence : 149927587
  Distance between 3'-terminus of neighbour sequence of sequence listing upward to telomere on chrosomal short arm and 5'-terminus of this base sequence : 21634
ccagttcccaaaagaaattccttctcatatatttatatatgagagagaaagatagattagatagatagatagatagatagatagatagatagatagatagatagatgatagatagatagataggaagacagacggatggatggag

SEQ ID NO: 11096 - DNA, 201 bp, Homo sapiens
  HUMUT525
  Located on chromosome 6
  Distance between a terminus base of telomere on chromosomal short arm and 5'-terminus of this base sequence : 150068105
  Distance between 3'-terminus of neighbour sequence of sequence listing upward to telomere on chrosomal short arm and 5'-terminus of this base sequence : 140373
acccagctactcaggatgctgagatgggagaatcacttgaacctgggaggcggaggttgcagtgagctgagatagcaccactgcactccagcctggcctgcagtaagactctcaaataaataaataaataaataaataaataaataaataaaaataaaaataaatgcccactatcgtacccagttcatagttggcactcaa

SEQ ID NO: 11097 - DNA, 264 bp, Homo sapiens
  AL023584.1_11376
  Located on chromosome 6
  Distance between a terminus base of telomere on chromosomal short arm and 5'-terminus of this base sequence : 150068286
  Distance between 3'-terminus of neighbour sequence of sequence listing upward to telomere on chrosomal short arm and 5'-terminus of this base sequence : -20
agttcatagttggcactcaataacttttatgaatgaatgaatgactgaataaatgagtgatgaattaggtagaggaggaaacagagtaatttgatttggcctgggatcaccaacacacacacacacacacacacacacacacacacacgcacgcacacatcaatgaggaatatgacacacaaatcaccctacataatcaaaagattcttcttggtaagagacagatattagagtgtctgtgttgacctttaaatcacctttgta

SEQ ID NO: 11098 - DNA, 129 bp, Homo sapiens
  D6S1055
  Located on chromosome 6
  Distance between a terminus base of telomere on chromosomal short arm and 5'-terminus of this base sequence : 150074402
  Distance between 3'-terminus of neighbour sequence of sequence listing upward to telomere on chrosomal short arm and 5'-terminus of this base sequence : 5852
cgaaccatgcgtagtagaccctcaaaaattcagtagatactgaataaatggataaaagataccttatctatctatctatctatctatctatctatctatctatctatccgtccatccatctgtcttaaa

SEQ ID NO: 11099 - DNA, 174 bp, Homo sapiens
  HUMUT7700
  Located on chromosome 6
  Distance between a terminus base of telomere on chromosomal short arm and 5'-terminus of this base sequence : 150074403
  Distance between 3'-terminus of neighbour sequence of sequence listing upward to telomere on chrosomal short arm and 5'-terminus of this base sequence : -128
gaaccatgcgtagtagaccctcaaaaattcagtagatactgaataaatggataaaagataccttatctatctatctatctatctatctatctatctatctatctatccgtccatccatctgtcttaaaattaaaactaacaggggcactggagcacttctacctccttctcatc

SEQ ID NO: 11100 - DNA, 442 bp, Homo sapiens
  AL023584.1_70228
  Located on chromosome 6
  Distance between a terminus base of telomere on chromosomal short arm and 5'-terminus of this base sequence : 150127157
  Distance between 3'-terminus of neighbour sequence of sequence listing upward to telomere on chrosomal short arm and 5'-terminus of this base sequence : 52580
ccagaacagtatttggcacacacttggctcttaataaagacttctttgtaagtacttcattttagaagtacttagctaatattctgggttttctgtttgtttgtttgtttgtttgtttgttttgagatggggtctcactctgtcagccaggctggagtgcagtggcacgatctcagctcactgtaacctctgcctccctagttcaagtgattctcctgcctcagcctcccaagtatctgggattacaggtgcccaccaccatgtcctgctaattttttgtatttttagtagagacggggtttcaccatgttggcaggctggtcttgaactcctgacctcaagtgatccacctgccacagcctcccagagtgctgagattacaggcatgagccactgtgcccggcccaatattctaatttttaaacatctaccaggtacaatc

SEQ ID NO: 11101 - DNA, 280 bp, Homo sapiens
  AL023584.1_77520
  Located on chromosome 6
  Distance between a terminus base of telomere on chromosomal short arm and 5'-terminus of this base sequence : 150134411
  Distance between 3'-terminus of neighbour sequence of sequence listing upward to telomere on chrosomal short arm and 5'-terminus of this base sequence : 6812
gaaaccattaatcctgtacagaaggaactgagtttactgccaatgagttgttcaaatactaagatagattctggttctatatgaatttttatttaagttccctataaaaatgtttgtaatagcaccagagggtgtgtgtgtgtgtgtgtgtgtgtgtacatatacatatacacacaaacacgctatctctctctctcaaagtggggaggagtgggtgttgaagaatgacagctccttgaggacaggacacacttttgttcaactcgacttgaactgtatt

SEQ ID NO: 11102 - DNA, 341 bp, Homo sapiens
  AL023584.1_80944
  Located on chromosome 6
  Distance between a terminus base of telomere on chromosomal short arm and 5'-terminus of this base sequence : 150137909
  Distance between 3'-terminus of neighbour sequence of sequence listing upward to telomere on chrosomal short arm and 5'-terminus of this base sequence : 3218
gtacgaagactgattaattgtccttatcaccactactttaccaggctcgctctctcttctctctctctctctctctctctctgtatcctcaccacctcccctccctctcttccagtttaaaaatataattgggatttttctgttttggttggtattggtggtggtatatcatactctgaaatatccagatctatttttgatgtctttcaatggcccaaacattttcagatctggaggagaccccatgaagtttgggacagcatccacgaaggaaaaggttgcttcctgctgattactcagttatagctgtttaaacagacgttcatgaattcaagtcttac

SEQ ID NO: 11103 - DNA, 341 bp, Homo sapiens
  AL023584.1_85934
  Located on chromosome 6
  Distance between a terminus base of telomere on chromosomal short arm and 5'-terminus of this base sequence : 150142731
  Distance between 3'-terminus of neighbour sequence of sequence listing upward to telomere on chrosomal short arm and 5'-terminus of this base sequence : 4481
cttcctaacaatttacatgagcacaatgaacattttccatggagcctgcccttcacacttagaagcttagaggaaggatatttcctagacatctggattaagggactgactcccacagtaatccatatcagtatttgtttaaagatctctatggggtcttgattttcatgttttaaatagagaaataattttagaggttttgcagacacatactaaagtccaattacacacacacacacacacacacacacatcacatacccccaaaagcacgaggctgagtggtgaaacagtgaagggttgagttgcttgcccaagctctgcaagctattctatgaaatt

SEQ ID NO: 11104 - DNA, 269 bp, Homo sapiens
  AL023584.1_137503
  Located on chromosome 6
  Distance between a terminus base of telomere on chromosomal short arm and 5'-terminus of this base sequence : 150194400
  Distance between 3'-terminus of neighbour sequence of sequence listing upward to telomere on chrosomal short arm and 5'-terminus of this base sequence : 51328
taagacataggtcaggagtggtggctcacatctgtaatcccagcactttgggaggccgagggaggtgggttgcttgagcccaagagtttaaggccagcctgggcaacgtggccaaatcccatcttcacacacacacacacacacacacacaaacacaaaatgcaaacattagttgagcgtggtggcatgggcctatagtcgcagctactcaggaggctgaagtgagaggatcacttgagcccagggggttgagattgcagtaagctgag

SEQ ID NO: 11105 - DNA, 379 bp, Homo sapiens
  AL023581.1_37475
  Located on chromosome 6
  Distance between a terminus base of telomere on chromosomal short arm and 5'-terminus of this base sequence : 150355676
  Distance between 3'-terminus of neighbour sequence of sequence listing upward to telomere on chrosomal short arm and 5'-terminus of this base sequence : 161007
gtcttgtattcaatagtgtccaacctattgttaaactcatatattgagtttttaaatttaattttgaaataatttactttgaaatatttttatcagaaaagttgcaagaacagtagaatgaactcccacattctcttcatccagattcctcagttaatagtttcatattttctccatctctttttgtaaagatgatagatagatagatagatagatagatagatagatagatagatagatgtgtattttcaaggatatgataccttttttgaatattttgagagcaagttaagcaagttgaaacctttatgtcctatcatctgtaaatattcctattactacttctcccaaagacactctcctacagagtaattgccaa

SEQ ID NO: 11106 - DNA, 222 bp, Homo sapiens
  AL023581.1_60392
  Located on chromosome 6
  Distance between a terminus base of telomere on chromosomal short arm and 5'-terminus of this base sequence : 150378718
  Distance between 3'-terminus of neighbour sequence of sequence listing upward to telomere on chrosomal short arm and 5'-terminus of this base sequence : 22663
tgacgttcattgatctggtaaggccgtcccctccccctgctcgccccgcaccccgtgcctgtgtgtgcgtgtgtgtgtgtgtgtgtgtgtgtgtgtgtggatgcgcgagcacctgcgcacgtgcgcgcctccagcatccacccgtgtcctcgcctcttccccagtgattgcgtgtgaaggcctggctgcccccgcagcggcaccttctgaaccactcaccgt

SEQ ID NO: 11107 - DNA, 172 bp, Homo sapiens
  D6S409
  Located on chromosome 6
  Distance between a terminus base of telomere on chromosomal short arm and 5'-terminus of this base sequence : 150513925
  Distance between 3'-terminus of neighbour sequence of sequence listing upward to telomere on chrosomal short arm and 5'-terminus of this base sequence : 134985
tttgcacatttctggaggggaggagagagaatctttaaaataatctcccatttgtgccttctcatttgtcagcacatcaaaagcaacaaaagcaacacacacacacacacacacacacacacacacacacacacacacaccccaatttgataagttggaaaactggctgcac

SEQ ID NO: 11108 - DNA, 438 bp, Homo sapiens
  AC009472.4_14735
  Located on chromosome 6
  Distance between a terminus base of telomere on chromosomal short arm and 5'-terminus of this base sequence : 150649441
  Distance between 3'-terminus of neighbour sequence of sequence listing upward to telomere on chrosomal short arm and 5'-terminus of this base sequence : 135344
cattgataacgcaggttctcaggtatagatccccaggtttcctgccaaaaatgaggtacatgtgtaggtaatgtttattattattattattattattattattattattattattttgagaccaagtctcactttgtcacccaggctggagtgcagtggtgtgatctcagctcactgcaacctctgcctcccagggtcaagtgatgcttgtgcctcagcctcccgagtagctgggattacaggcgcgcaccaccacgcccagctaatttttgtatttttaatagagatggggtttcgccatgttggccaggctggtcttgaactcctgacctcaggtgacccaccctcctcagcctccgaaagtgctgagattacagatgtgagccactgcaccctgtcagtaatatttatatgtagataaaccacttagagtgaagc

SEQ ID NO: 11109 - DNA, 392 bp, Homo sapiens
  AL031320.6_45361
  Located on chromosome 6
  Distance between a terminus base of telomere on chromosomal short arm and 5'-terminus of this base sequence : 150743203
  Distance between 3'-terminus of neighbour sequence of sequence listing upward to telomere on chrosomal short arm and 5'-terminus of this base sequence : 93324
agacaagtaaatgtaatgctggaccctagactggacctgggattatagggtagtgggagaacttctttacaggacattattgggtcagctgacaaaactgtaatacaaatgatagattcaagtatatcaatgttaaatttacttaagtcaataactatactgaagcatttcggggtaaagggccatggtgtgttgtgtttgtgtgtgtgtgtgtgtgtgtgtgtgtgtgtgtgtgtgtgtgtgtattttatatatatatacttttcccagtaaaaagtttaaagaaaaattaagagttcttgcctacactgaagctcttggccatctattttctctccatgatactccaaatacaacacaggaagagatggttgtgccaagtaacaagaaag

SEQ ID NO: 11110 - DNA, 292 bp, Homo sapiens
  D6S279
  Located on chromosome 6
  Distance between a terminus base of telomere on chromosomal short arm and 5'-terminus of this base sequence : 150743227
  Distance between 3'-terminus of neighbour sequence of sequence listing upward to telomere on chrosomal short arm and 5'-terminus of this base sequence : -368
cctagactggacctgggattatagggtagtgggagaacttctttacaggacattattgggtcagctgacaaaactgtaatacaaatgatagattcaagtatatcaatgttaaatttacttaagtcaataactatactgaagcatttcggggtaaagggccatggtgtgttgtgtttgtgtgtgtgtgtgtgtgtgtgtgtgtgtgtgtgtgtgtgtgtgtattttatatatatatacttttcccagtaaaaagtttaaagaaaaattaagagttcttgcctacactgaagct

SEQ ID NO: 11111 - DNA, 380 bp, Homo sapiens
  AL031320.6_46724
  Located on chromosome 6
  Distance between a terminus base of telomere on chromosomal short arm and 5'-terminus of this base sequence : 150744463
  Distance between 3'-terminus of neighbour sequence of sequence listing upward to telomere on chrosomal short arm and 5'-terminus of this base sequence : 944
taagatgctcagccagacttactgggtggtactctagagaggcaaaactccaggttggttgtcctacaaataatccccaagaaaatgatatgaacacaataaatgcaatgaaatctgcttgcaggaaagcataagaagccagaaatgaattacgaccaactgcaaaaaggaacaaactagtagaagcactaaaattcaatgagaagataatttttaaagtggatgaaattgaaggtgcatgtaacattatcacagatttaaaatcatgcatattctccataaaacttttcaaatgcagttaaacacacacacacacacacacacacacacacacacacacaaaaccaagcaattataagtcctctgaagcatgtaactgt

SEQ ID NO: 11112 - DNA, 223 bp, Homo sapiens
  AL031320.6_132404
  Located on chromosome 6
  Distance between a terminus base of telomere on chromosomal short arm and 5'-terminus of this base sequence : 150830314
  Distance between 3'-terminus of neighbour sequence of sequence listing upward to telomere on chrosomal short arm and 5'-terminus of this base sequence : 85471
atgatctgagacaggtgaaaccagtggaatgaatgtttaagaaacctgcaagcttgggaaaaaaggccagcaacttggaaagattaatcaaaaggatatttgggaagcttatcacctccacctcttgtttggtttgtttgtttgtttgtttgtttgtttgtttgtttgtttttgagacagagtctcgctctctcgcccaggcttgagtgcagtaacatgatct

SEQ ID NO: 11113 - DNA, 278 bp, Homo sapiens
  D6S1704
  Located on chromosome 6
  Distance between a terminus base of telomere on chromosomal short arm and 5'-terminus of this base sequence : 150878512
  Distance between 3'-terminus of neighbour sequence of sequence listing upward to telomere on chrosomal short arm and 5'-terminus of this base sequence : 47975
aactctgggggattgggatataaaatgcaaagcagaggggtgtgtgtgtgtgtgtgtgtgtgtgtgtgtgtgtgtgtgtgtgttaggtaggagagttggaggagggtaatgtcaagagttgacaggagttctaggcttagaaccagcaaggactctggggggctttaagtaataaactggccagactcctgaagctggctgctgggctgggctgattagtcttaggacaagataggcttcactggctgccagcctgggccaggccccacacacctcaa

SEQ ID NO: 11114 - DNA, 254 bp, Homo sapiens
  AL078593.9_18380
  Located on chromosome 6
  Distance between a terminus base of telomere on chromosomal short arm and 5'-terminus of this base sequence : 151021717
  Distance between 3'-terminus of neighbour sequence of sequence listing upward to telomere on chrosomal short arm and 5'-terminus of this base sequence : 142927
tattcacttcatggtaagtccatcatgggtgtgtgtgtgtgtgtgtctgtgtgtgtgtgtgtgtgtgtgtgtgtggtggagggatgtttggaatctcttctttgtgtattgtttacacagtaactgtggatgtatacctcctgatgcgtgctggagctgggcccattgtctaccattttgcaaggtgttgaatactacttaccttatctggatccatcatgtgctaaaaagtgttgaaacagccatttaaatgt

SEQ ID NO: 11115 - DNA, 369 bp, Homo sapiens
  AL078593.9_66076
  Located on chromosome 6
  Distance between a terminus base of telomere on chromosomal short arm and 5'-terminus of this base sequence : 151069322
  Distance between 3'-terminus of neighbour sequence of sequence listing upward to telomere on chrosomal short arm and 5'-terminus of this base sequence : 47351
ttctttaagctgacaactacgttttgagttttctctttcctttgctctcgtgagatgtgttgacttgggccgcttattgtcacctgccatccagctcagcatcttcttgccttcctttgctctgcttgtattttacttacacacacacacacacacacacacacacacacactatatcaaggatttaacttattttaattctaaaacaacttccttaacactcaatactagaaagccttttcaatatacacaccagctaattaataactttacttcccctctgttttgttcttgaattccatatttatcacaaatgtgtctcttttttctacaattattttcatactaactagctttatttcatgcctc

SEQ ID NO: 11116 - DNA, 353 bp, Homo sapiens
  AL049844.7_101169
  Located on chromosome 6
  Distance between a terminus base of telomere on chromosomal short arm and 5'-terminus of this base sequence : 151236692
  Distance between 3'-terminus of neighbour sequence of sequence listing upward to telomere on chrosomal short arm and 5'-terminus of this base sequence : 167001
gatctgtttagcagatctgtcatcaggtctttttttgggaacagttgtgttgattttttttctttgaaggtgctatacttttctttttctttgtctggcttgtcattttctttgttgtaaattggacatttggacctaataatatgtaactgtggaaattagatattctcccttctgcagggtttgctattctctgtgtgtgtgtgtgtgtgtgtgtgtgtgtgtgtgtgtgtgtgtgtgtgtatgtgactgtctctgtgccaaggatcagtcttaggtgtcaacttaaggtcttctcagtatttttgagcttgtgcctttctctgggtgtgtcatgttcaccttctaatttc

SEQ ID NO: 11117 - DNA, 277 bp, Homo sapiens
  AL031390.4_91930
  Located on chromosome 6
  Distance between a terminus base of telomere on chromosomal short arm and 5'-terminus of this base sequence : 151372380
  Distance between 3'-terminus of neighbour sequence of sequence listing upward to telomere on chrosomal short arm and 5'-terminus of this base sequence : 135335
taacaaacctgcacgttgtacccatgtatcccggagcataaaagaaaaagaaaaactaaaaaagagtgtgtgtgtgtgtgtgtgtgtgtgtgtgtgtgtgtgtgtgtgtgttcatgtgtaaggtgtactagagctattttccttacaaaagtatttctagcaaaattatttctttcctaaactttaaatttgtaaaggaaatgcaacatataaataatagaaatttaatgccattttattctgtacttaacacaggtcagtgtttggacatgtacaa

SEQ ID NO: 11118 - DNA, 454 bp, Homo sapiens
  chr6.fa.O7frz.153559350
  Located on chromosome 6
  Distance between a terminus base of telomere on chromosomal short arm and 5'-terminus of this base sequence : 151457822
  Distance between 3'-terminus of neighbour sequence of sequence listing upward to telomere on chrosomal short arm and 5'-terminus of this base sequence : 85165
gtgagttcactgctcagacttcaacctgtttactctgccatttttggtcaattcacatatatatatatatatatatatatatatatatatatatatatatatttatttatttattttttgagaaagaatctcactctgtcacccaggctggagtgcagtggcacaatcttggctcactgcaacttctgcttcttgggttcaagcgattctcctgcctcagcctcctgaatagctgggactacaggcgcacgccaccacgcctggctaatttttgtatttttagtagagatggggtttcgccgtgttggccaggctgatcttgaaatcctgacctcaagtgatcctcccatcttggcctcccaaagtgctgggattacaggcatgaaccatcatgcctggcccaattcatcatttgaaacaacttgtttttttttggtgccagtattgcactttc

SEQ ID NO: 11119 - DNA, 405 bp, Homo sapiens
  chr6.fa.O7frz.153657146
  Located on chromosome 6
  Distance between a terminus base of telomere on chromosomal short arm and 5'-terminus of this base sequence : 151510132
  Distance between 3'-terminus of neighbour sequence of sequence listing upward to telomere on chrosomal short arm and 5'-terminus of this base sequence : 51856
cctatagccaactctttagacatatccactcttctgtatctcagcatcccataatgtttgatagagggtaaaaataacagagtatacacacacacacacacacacacacacacacacacacagaatctaccatcgtccccatcccctgctccttctgtctatcttaacttgcaaatggcaggatcaatcaactgccacctgcccaggtcagacaattatcctctcttgcttccattacttcagcagcttttaattggcctctggcctctagtcttatcctctccagtctaatctctgtacaatgctatagtacagccacagtgcctttttgttgttgttgtcattacgctgttgtttttaattgcagtattatatacatgacttaaacttaccatcctaaccatt

SEQ ID NO: 11120 - DNA, 306 bp, Homo sapiens
  D6S1003
  Located on chromosome 6
  Distance between a terminus base of telomere on chromosomal short arm and 5'-terminus of this base sequence : 151590828
  Distance between 3'-terminus of neighbour sequence of sequence listing upward to telomere on chrosomal short arm and 5'-terminus of this base sequence : 80291
caaccttctcttccaatccatctattgagttttcatttttacaacgtttaaatttattttttgttctctgtaaatttattttgtttcattaatttttgtttcattaattttaaatcttcgaatacctctctctctctattattattattattattattattattattattattattgaaagatggggggaaacagccaggcacagtggctcttgtctgtaatcccagcactttgggaggctaaggtgagtggattgcttgagctcaggagttcaagaccagcctgggctacatgacgaaaccctgt

SEQ ID NO: 11121 - DNA, 385 bp, Homo sapiens
  AL024474.1_38438
  Located on chromosome 6
  Distance between a terminus base of telomere on chromosomal short arm and 5'-terminus of this base sequence : 151611462
  Distance between 3'-terminus of neighbour sequence of sequence listing upward to telomere on chrosomal short arm and 5'-terminus of this base sequence : 20328
tgaacagatcatacatgatctcagtagaggtaactaaattagggtatatccataaagtagaagattaagcattcataaaaagtgatacagatgtgtgtgatgtgtgtgtgtgtgtgtgtgtgtatgaatatagaaatgtgttcttgatatagtaagtaaacaagtatgtattatatgaagtcatttatatgaaaaatgttttttaaaaatttagtgaagtatacaataaatgttaatagtggtcatcttggcatttgagattattacttttttttttgctgatttatattttctaaagttcttcaatgaacccacattactgagttcttatatttttaaagattatcaaattgcttagagtgtttagatgccaaggttatgacta

SEQ ID NO: 11122 - DNA, 244 bp, Homo sapiens
  AL024474.1_81738
  Located on chromosome 6
  Distance between a terminus base of telomere on chromosomal short arm and 5'-terminus of this base sequence : 151654731
  Distance between 3'-terminus of neighbour sequence of sequence listing upward to telomere on chrosomal short arm and 5'-terminus of this base sequence : 42884
cacttctgtttagaagcaacactgccagtgagaaaccctgccacacacaacacacacagacacacacacacagactcacacacagagacacacacacacagacacacacacacagacacacacacacacaccacacacacacacacacacacacacatgtgagaggagggccaccctgggaggaaaccctgaattctcccctcttagcacactccttctatctactccttctatctcctggtag

SEQ ID NO: 11123 - DNA, 396 bp, Homo sapiens
  AL024474.1_86886
  Located on chromosome 6
  Distance between a terminus base of telomere on chromosomal short arm and 5'-terminus of this base sequence : 151659713
  Distance between 3'-terminus of neighbour sequence of sequence listing upward to telomere on chrosomal short arm and 5'-terminus of this base sequence : 4738
agtcctgattctagaaatgacatttttgggctatggataaaagatgggtttcgatagccattaaggaaatgcaaatcaaaccacagtgaaatgtcacttcatacccagcaggatggcaataataaaaaagacaaataataacaaatattggtgaggatgtggagaaatgggtatccacatacactgctagtgggaatgtaaaaggatgcaactttggaaagctgtctggcagttcttccaaaggttaagcatagggttgccatatgactcagcaattctacttctgggtacacacatacacacacacacacacacacacacacacacacccgccacacccaagagacatgaaaatgtatgcccacatcaaaaacgtgtacacaaatgctcatagca

SEQ ID NO: 11124 - DNA, 370 bp, Homo sapiens
  chr6.fa.O7frz.153937262
  Located on chromosome 6
  Distance between a terminus base of telomere on chromosomal short arm and 5'-terminus of this base sequence : 151868601
  Distance between 3'-terminus of neighbour sequence of sequence listing upward to telomere on chrosomal short arm and 5'-terminus of this base sequence : 208492
acctatccgaataatcatttctacttaacagattacaaaggctgacttagaacagcgccatcctcagctggattatgtttttacattggcacagaatttgaaaaataaagcttccagttcagatatgagaacagcaattacagaaaaatgtaagttttttaaaaaaagttatgtattatcatccactttccctgcaaatggtgacacacacacacacacacacacacacacacacaaacacattttcaaagattattcaactagaaagtaatagtgtttaatatttgttactctttatttatacagaaatgtagctttcccttgtttttatgttttgtgaacattgttacaataaccttatgaagtcctt

SEQ ID NO: 11125 - DNA, 279 bp, Homo sapiens
  chr6.fa.O7frz.154014408
  Located on chromosome 6
  Distance between a terminus base of telomere on chromosomal short arm and 5'-terminus of this base sequence : 151987441
  Distance between 3'-terminus of neighbour sequence of sequence listing upward to telomere on chrosomal short arm and 5'-terminus of this base sequence : 118470
accattcttatgaccttctgtcatcatagctcagctcccacttataagtgagaacatacgatgtttgattttccattcctgacttacttcacttagaataatggtctccaactctatccaggtttctgtgaacgccattatttcattcctttttatgcctgagtagtattgtagtattccatggtgtgtgtgtgtgtgtgtgtgtgtgtgtgtgtgtatacatatatgtttacattttctttatccacttgttgactgattggtatttgtactggttcc

SEQ ID NO: 11126 - DNA, 480 bp, Homo sapiens
  chr6.fa.O7frz.154231787
  Located on chromosome 6
  Distance between a terminus base of telomere on chromosomal short arm and 5'-terminus of this base sequence : 152143480
  Distance between 3'-terminus of neighbour sequence of sequence listing upward to telomere on chrosomal short arm and 5'-terminus of this base sequence : 155760
gtgacgtggaaatagtattgactaatactatgttgttttattgttattgtatctattttacacatatgtaaattaagtttactgacagtatagatattctgacaaacagtctggataaatgcctggttctgcagtgagaacacatggacacaggaaggggaacatcacacaccggagactgttgtggggtggggggaggggagagggatagcattaggagatatacctaatgctaaatgatgagttaatgggtgcagcacaccaacatggcacatgtatacatatgtaacaaacctgcatgttgtgcacatgtaccctaaaacttaaagtataataataataaaagaaaaaataaataaataaataaataaataaatgcctggttctgaaaatagatctgaagagtcttagtttttcatcccaataagataatgttcaaaagtctttgctgtgcaggcatcaacctgcacttcactatag

SEQ ID NO: 11127 - DNA, 201 bp, Homo sapiens
  AL050334.12_33070
  Located on chromosome 6
  Distance between a terminus base of telomere on chromosomal short arm and 5'-terminus of this base sequence : 152463961
  Distance between 3'-terminus of neighbour sequence of sequence listing upward to telomere on chrosomal short arm and 5'-terminus of this base sequence : 320001
atgaatcatatggactacaccaacacaaactttatttcatatatttggaaaatagacatgtgtgtgtgtgtgtgtgtgtgtatttctatgtatgtgtctttattgatatgaatctgggcagatgaataaatgagtttttcaaaaagcaggtaggaatagataaaaaaaaaaaaaagaagtgattgaatggtatagcactga

SEQ ID NO: 11128 - DNA, 237 bp, Homo sapiens
  D6S1010
  Located on chromosome 6
  Distance between a terminus base of telomere on chromosomal short arm and 5'-terminus of this base sequence : 152486493
  Distance between 3'-terminus of neighbour sequence of sequence listing upward to telomere on chrosomal short arm and 5'-terminus of this base sequence : 22331
gatccaaaaaggcaagatgaaagaaatgaaggcagattaactcctacgcttatgaaggataagagtgactcatatattctatatataaatctatgtaaaaatctataaatctataatatctctatctatcatctatctatctatctatctatctatctatctatctatctatctatctatcatctatcttccagaggtaattaaaagaaataaaatggaggaggccatgtgtaagaa

SEQ ID NO: 11129 - DNA, 267 bp, Homo sapiens
  AL023283.6_41042
  Located on chromosome 6
  Distance between a terminus base of telomere on chromosomal short arm and 5'-terminus of this base sequence : 152544115
  Distance between 3'-terminus of neighbour sequence of sequence listing upward to telomere on chrosomal short arm and 5'-terminus of this base sequence : 57385
tctagcatttccaaagtggtatggaatgtttggattgttctgggactgtagtaaaatatacaagaatataaagttattctaaacacacacacacacacacacacacacacacacacgcagagctccctcaaataggaatttacaggcaaagatttataaacaagtttacatttgacctgcgcttggaggaaaagcagggttttgactgataggatgataggatgagaaatagagggaactgggaaatgctagttgtgttcaggaaac

SEQ ID NO: 11130 - DNA, 279 bp, Homo sapiens
  AL023283.6_50102
  Located on chromosome 6
  Distance between a terminus base of telomere on chromosomal short arm and 5'-terminus of this base sequence : 152553152
  Distance between 3'-terminus of neighbour sequence of sequence listing upward to telomere on chrosomal short arm and 5'-terminus of this base sequence : 8770
aacagtcaatgagatgacctctacttttatttaactcagcatccaagggcaaaatgcaacatcgctgagaaaagagcaatagcacaatagccctgaaccaatgccatatatatatatatatatatatatatatatatatatatatatatgtatctgtgtgtgtgtgtgtatgtatatgtatgtgtctgctgtatggtctcattacaataaacaattgagagagctagggtttttttcaggtaaaaattagcatattgaacacggcaactagtgattaga

SEQ ID NO: 11131 - DNA, 364 bp, Homo sapiens
  AL023283.6_94530
  Located on chromosome 6
  Distance between a terminus base of telomere on chromosomal short arm and 5'-terminus of this base sequence : 152597391
  Distance between 3'-terminus of neighbour sequence of sequence listing upward to telomere on chrosomal short arm and 5'-terminus of this base sequence : 43960
caagtttcataggctcatgaataaatgcagggacatggatttagcacatatttcttatttagtgtttatgtgcttgtccatctgttgcttgatcattgcattatagaagagcatttatacagctaaaagaaagacttattttacttccaaatctgttttcacaaaacaatagatccattttcaaaggctcgtatattatcatggaaggttgttttgggacaggtaacatacaagaagcaaattcactttcttgttcttccttcactttttatttcattcacataccccctacagacacacacacacacacacacacacacttcacacatgggtaataagaaggtccatgctattccagctatta

SEQ ID NO: 11132 - DNA, 279 bp, Homo sapiens
  AL023283.6_110253
  Located on chromosome 6
  Distance between a terminus base of telomere on chromosomal short arm and 5'-terminus of this base sequence : 152613336
  Distance between 3'-terminus of neighbour sequence of sequence listing upward to telomere on chrosomal short arm and 5'-terminus of this base sequence : 15581
tgtattagtcaaggctttccagaaaaacaaaaccaacaggagatgtgtgtgtgtgtatatatatatatatatagagagagagagagagagagagagagagagaaatttattttaaggaattggtttatgtgattgtggaggcttagtaaatccaaaatttgcgacatagactagcaagctggagaccaagggaaaagttgcagttcaagcccacaggcagtttgctggctgagttcatttttgcttgggagaggtcggtctttgttctagtcaggcctt

SEQ ID NO: 11133 - DNA, 243 bp, Homo sapiens
  D6S1049
  Located on chromosome 6
  Distance between a terminus base of telomere on chromosomal short arm and 5'-terminus of this base sequence : 152652735
  Distance between 3'-terminus of neighbour sequence of sequence listing upward to telomere on chrosomal short arm and 5'-terminus of this base sequence : 39120
tatcctatttctctttcaacctattatctatctatcatctatctatcttctatatctatctatcatctatctctatttagctatctatcatctatctatatctatctatctattatctatctatctatctatctatctatctatctatctatctatctatctgtctatctatctatccatccctccatccatctgcaggattgagggtgggaataaacagtgtaggcttctatttggccatct

SEQ ID NO: 11134 - DNA, 464 bp, Homo sapiens
  chr6.fa.O7frz.154748472
  Located on chromosome 6
  Distance between a terminus base of telomere on chromosomal short arm and 5'-terminus of this base sequence : 152752874
  Distance between 3'-terminus of neighbour sequence of sequence listing upward to telomere on chrosomal short arm and 5'-terminus of this base sequence : 99896
ggaagcaatatgaagtataaggtataaatgagtaaaaatcctaacataccctatagaaagtaaattgatttatcaagaggaatattattttcacatgagaagataaataccagaacaaacagttaaaaacaaagtgattcttctagcaaatggcacaaatcaatgaaatgggacaaatcaatgagagaaaagagtgaagaatttatatatatatatatatatatatgttttatagaagtatttaacaattattttcatgtaatactttcaccataattttttaaattttaataatcaagaaataatgaaaaataaaaataggttataaattataggcaactgcagagaatgtgggaattattctgattttttttaatttattttttttaattatactttaagttgtagggtacctgtgctttttaaataaattacccagtctcaggtatttctgtatagcaatg

SEQ ID NO: 11135 - DNA, 459 bp, Homo sapiens
  AL031119.1_76739
  Located on chromosome 6
  Distance between a terminus base of telomere on chromosomal short arm and 5'-terminus of this base sequence : 152871978
  Distance between 3'-terminus of neighbour sequence of sequence listing upward to telomere on chrosomal short arm and 5'-terminus of this base sequence : 118640
ctcaatgtaccagatacctgacctgaagctctgtattagtgaggatcttcctgaaaaacagaaccaatcagatggatggataaatagatagataatagagagatagatagatgatagatagatagatagatagatagatagatagatagatagatagatacatagacagagagacagattgatttactttaaggaattggtgtcctagttcatgttctgttgctacaacagaataccacagactggataattaataaacagaaatttatttagctcatggttctggaggctaggaggtccaatacaaagcagccagttctggcaagggcttccttgctttctcctgatatagcagaaggcatcacaaggtgagagaggaagaatgtgctcctcatatagccaccagtctcatcatgcgggcctatctgatcttatctaatcctaattaccttcctaagg

SEQ ID NO: 11136 - DNA, 376 bp, Homo sapiens
  AL023806.1_98340
  Located on chromosome 6
  Distance between a terminus base of telomere on chromosomal short arm and 5'-terminus of this base sequence : 153014345
  Distance between 3'-terminus of neighbour sequence of sequence listing upward to telomere on chrosomal short arm and 5'-terminus of this base sequence : 141908
tgataaggaagttagaatttggaggatcaggaaagaaaatatcaaatatgatagtatgatcctagtaatgaatcaaacatctggcacaggtaggggtatgtgtgtgtgtgtgtgtgtgtgtgtgtgtgtgtgtgtgtgtgtgtgtgtgtggtgtgtttcaaggtagaaaactgattactatgattattgttattttgatgacaaataatattgtgaaattttggatacatgagcaccagcctttctgtacatctgtatatgtaaacttggctagctcttttagtcaaaaaatgagccacacagcctaagacaattactgcacagaattatggtagaattacaactcagtgggctcataacttggtgcataataggt

SEQ ID NO: 11137 - DNA, 157 bp, Homo sapiens
  D6S1703
  Located on chromosome 6
  Distance between a terminus base of telomere on chromosomal short arm and 5'-terminus of this base sequence : 153014426
  Distance between 3'-terminus of neighbour sequence of sequence listing upward to telomere on chrosomal short arm and 5'-terminus of this base sequence : -295
tggcacaggtaggggtatgtgtgtgtgtgtgtgtgtgtgtgtgtgtgtgtgtgtgtgtgtgtgtgtgtggtgtgtttcaaggtagaaaactgattactatgattattgttattttgatgacaaataatattgtgaaattttggatacatgagcacca

SEQ ID NO: 11138 - DNA, 227 bp, Homo sapiens
  AL023806.1_62930
  Located on chromosome 6
  Distance between a terminus base of telomere on chromosomal short arm and 5'-terminus of this base sequence : 153049806
  Distance between 3'-terminus of neighbour sequence of sequence listing upward to telomere on chrosomal short arm and 5'-terminus of this base sequence : 35223
acagtgcaactaacataggagttcgattgttttctttaaagtctcaggtttacagctaagacttgtgtgtgtgtgtgtgtgtgtgtgtgtgtgtgtgtgcgcgccaaagtaaggaagggagaggaatgtgtaagtaagctatttttcttatcctctcatataggggtaacttcctgcataataggattatgagaatgaactttctatgtaacagaaagtcaacggtc

SEQ ID NO: 11139 - DNA, 218 bp, Homo sapiens
  AL023806.1_62734
  Located on chromosome 6
  Distance between a terminus base of telomere on chromosomal short arm and 5'-terminus of this base sequence : 153050009
  Distance between 3'-terminus of neighbour sequence of sequence listing upward to telomere on chrosomal short arm and 5'-terminus of this base sequence : -24
ctatgtaacagaaagtcaacggtcaatattttatataaaactgatacatatatcagaaacacacacacacatatatatatatatatatatatcagaaagccatatattagtgaaaagtgaaaattagaacaggaatcctaattcttcaaggaaaaaattctatttccaagaaataagcaatatgcattcatcaagtagtgcaattaagctaggacatt

SEQ ID NO: 11140 - DNA, 274 bp, Homo sapiens
  AL023806.1_9092
  Located on chromosome 6
  Distance between a terminus base of telomere on chromosomal short arm and 5'-terminus of this base sequence : 153103539
  Distance between 3'-terminus of neighbour sequence of sequence listing upward to telomere on chrosomal short arm and 5'-terminus of this base sequence : 53312
tggcaggttgattacattagacctaatagacacttactcaaggtatgtatttgtcttctctgcatgcaatattctgttaaaagtatcatctgtggacttacagaatgcttatatatatatatatatcctattatatttatttgtattactttatatatgtatgtatacacacacacacacacacacacacacacacacacacactaaggggagtttattattaacttacacgatcacaatgtcccacaataggctgtctgcaagcttgagaagc

SEQ ID NO: 11141 - DNA, 299 bp, Homo sapiens
  AL096867.15_82101
  Located on chromosome 6
  Distance between a terminus base of telomere on chromosomal short arm and 5'-terminus of this base sequence : 153361250
  Distance between 3'-terminus of neighbour sequence of sequence listing upward to telomere on chrosomal short arm and 5'-terminus of this base sequence : 257437
attggtaatgagaacattgcattttctgtttatctcttgcctaccaggaagctcaaaactaaaattaatgctcaatcacagaatatattctagcttatgtgcatagatactagcttcttccaccttacttcaatggcattaatttatacttttttataattgtaaaatatctcaactctatttttggaaagagtcaggtgatatatatatatatatatatatatatataaagggaagtgacctcctcgtaggtgtatatctcaaccagaatttctgtatgctatgaagcagatggtaat

SEQ ID NO: 11142 - DNA, 249 bp, Homo sapiens
  HUMUT7693
  Located on chromosome 6
  Distance between a terminus base of telomere on chromosomal short arm and 5'-terminus of this base sequence : 153367271
  Distance between 3'-terminus of neighbour sequence of sequence listing upward to telomere on chrosomal short arm and 5'-terminus of this base sequence : 5722
caacctccataattgcatgagccaattcccatatgaaacctcctttcatatctatctatctatctatctatctatctatctatctatctatctatctatcatctcatgttggttctgtccctctagagaatcttgactaacaaaattattattattaaaaaataacaacgatggcagtaccatggagtgagtatttattgtgtgccaaacactgtgcaattgttcaatgttcattgcttcatttggtcc

SEQ ID NO: 11143 - DNA, 276 bp, Homo sapiens
  AL096867.15_59117
  Located on chromosome 6
  Distance between a terminus base of telomere on chromosomal short arm and 5'-terminus of this base sequence : 153384316
  Distance between 3'-terminus of neighbour sequence of sequence listing upward to telomere on chrosomal short arm and 5'-terminus of this base sequence : 16796
tgaactaatttacattccaccaacagtgtaaatgtgctcccttttggaggaagtttttaagcagaggtctaaatcactccttagagaacaggttttacataataatagacagacaggcagagagagagagagagagagagagagagaacacagtaaatgcatagtaaatatgcctaaatctatgacttctacaaatgtgggacatttagggaaagagctcagatctttgagaacttgctctgttattaatggttgtatgatactcaatcttccaaa

SEQ ID NO: 11144 - DNA, 276 bp, Homo sapiens
  AL031769.1_88742
  Located on chromosome 6
  Distance between a terminus base of telomere on chromosomal short arm and 5'-terminus of this base sequence : 153531205
  Distance between 3'-terminus of neighbour sequence of sequence listing upward to telomere on chrosomal short arm and 5'-terminus of this base sequence : 146613
actagttcagtgcttgaaatacagtaggcattgatttattaatgtattctttcatttcattccatatgcattagtcacttaactgctgtgttagtcagtttctccaaagaaagaaccaataggagatagatagatagatggaaagattagatagatagatagatagatagatagatagatagatagatagatagatagatggatgaaaggagatttattgggggaattgggtcacatgaccagggaggctgcaaagtctcatgagaagctgtctgc

SEQ ID NO: 11145 - DNA, 147 bp, Homo sapiens
  D6S1042
  Located on chromosome 6
  Distance between a terminus base of telomere on chromosomal short arm and 5'-terminus of this base sequence : 153531300
  Distance between 3'-terminus of neighbour sequence of sequence listing upward to telomere on chrosomal short arm and 5'-terminus of this base sequence : -181
cagtttctccaaagaaagaaccaataggagatagatagatagatggaaagattagatagatagatagatagatagatagatagatagatagatagatagatagatggatgaaaggagatttattgggggaattgggtcacatgacca

SEQ ID NO: 11146 - DNA, 271 bp, Homo sapiens
  AL031769.1_82547
  Located on chromosome 6
  Distance between a terminus base of telomere on chromosomal short arm and 5'-terminus of this base sequence : 153537431
  Distance between 3'-terminus of neighbour sequence of sequence listing upward to telomere on chrosomal short arm and 5'-terminus of this base sequence : 5984
gaatgtgaattaatggtaggacaggggctttctttggggaagaataaagctaagagtttataaaccctttccatctctctggcaaaaacttcagtgaattctaccttgttacaaatacctccaataaaatgaatcttgttgttttgtgtgtgtgtgtgtgtgtgtgtgtatgcacttgtgcacacatatgggagtgtataagcttagtattaggaacagggaaggtatcaaggaggtagaaaagaacagatgaccgtgagtacgtagaatt

SEQ ID NO: 11147 - DNA, 392 bp, Homo sapiens
  AL031769.1_66734
  Located on chromosome 6
  Distance between a terminus base of telomere on chromosomal short arm and 5'-terminus of this base sequence : 153553180
  Distance between 3'-terminus of neighbour sequence of sequence listing upward to telomere on chrosomal short arm and 5'-terminus of this base sequence : 15478
gatttcaattatgcatgttaggttgtttggtgtttttttcacagattttgaatattctgtttttttcttccttgtgttcagtttgattgacttttatcctttatctccaattttacaattttaccttcaatttcacttcagttttcagtctaatgatgagccatcaaagacattttcatctctgttaccgtgtgtgtgtgtgtgtgtgtgtgtgtgtgtgtgtgtgtgtgtgtttcggtggtggtgttagcattttcacttgatttcttccttatagtttcatctctttgatgaaatgatctatctgatcatgtctgttgtccacctttttcactagagccctttacatatgtatcatcattaaattaatcttcctgttggatagtgacaac

SEQ ID NO: 11148 - DNA, 298 bp, Homo sapiens
  AL035698.12_533
  Located on chromosome 6
  Distance between a terminus base of telomere on chromosomal short arm and 5'-terminus of this base sequence : 153620441
  Distance between 3'-terminus of neighbour sequence of sequence listing upward to telomere on chrosomal short arm and 5'-terminus of this base sequence : 66869
tcatttgaattcatagcagaacatctggcacacagtgactgctaggaacacacagaagtagcaaagaaaagaagaaagaaaaaagaaagaaggaagaaggaaagaaggaaggaacgaagggaggaagggagggagggaggaaggaaggaaggaaggaaggaaggatctatacaaaaagagtctctaccctagtggatttggaagcatataaaaaatacattctctgatgtggctggctagactctactgtagctcaaagtccctttagttctgggtcaggttaagtcagctatacctt

SEQ ID NO: 11149 - DNA, 132 bp, Homo sapiens
  D6S1649
  Located on chromosome 6
  Distance between a terminus base of telomere on chromosomal short arm and 5'-terminus of this base sequence : 153751165
  Distance between 3'-terminus of neighbour sequence of sequence listing upward to telomere on chrosomal short arm and 5'-terminus of this base sequence : 130426
tcctccatcagttgggagtttttcaaaagtgtgtgtgtgtgtgtgtgtgtgtgtgtgtgtgtcagagagagacagagggagagggagagagtgcaacggagaaaaaagagaggtttgtgaaatcttagacct

SEQ ID NO: 11150 - DNA, 446 bp, Homo sapiens
  AL035698.12_171952
  Located on chromosome 6
  Distance between a terminus base of telomere on chromosomal short arm and 5'-terminus of this base sequence : 153791800
  Distance between 3'-terminus of neighbour sequence of sequence listing upward to telomere on chrosomal short arm and 5'-terminus of this base sequence : 40503
tctagcatcaattcaaacttctacttctcagtaactcctgccgtcacccagagctgcagcattgcatggctccaggggacataattcacactgtgttttatgtggataagatatcttggagttatgcagcatgacagcctttctctgacctccctgcaaggcaaagtctgagtaggacatgtctgtctgtctgtctgtctatctatctatctatctatctatctatctatctatctatctatcatctatctatctacctatctatctatatctatctgcctgcctacctactttagtctgcaaaaggctaaatacctgagactgggtggtttaaatgttaaactttttttttttcacagttcttgaggcttgacatccaagatcaaggtgccattagggatggtttctggtgaagcctctcttcctagcttgtagatggctacctt

SEQ ID NO: 11151 - DNA, 196 bp, Homo sapiens
  D6S978
  Located on chromosome 6
  Distance between a terminus base of telomere on chromosomal short arm and 5'-terminus of this base sequence : 153849465
  Distance between 3'-terminus of neighbour sequence of sequence listing upward to telomere on chrosomal short arm and 5'-terminus of this base sequence : 57219
tgccaatctaccttgcagattctggacctgcagattttggagttgctagcctgtacaattacatgagccaattccttaaaatctctctctctaccttccaataggatgtatataaaaccaataggacacacacacacacacacacacacacacacacacacaccctgtcgcttctttctctggagatgctgactaa

SEQ ID NO: 11152 - DNA, 417 bp, Homo sapiens
  chr6.fa.O7frz.156056472
  Located on chromosome 6
  Distance between a terminus base of telomere on chromosomal short arm and 5'-terminus of this base sequence : 154083871
  Distance between 3'-terminus of neighbour sequence of sequence listing upward to telomere on chrosomal short arm and 5'-terminus of this base sequence : 234210
cttgagactaggagttcgagaccagcctggccaacatggtagagaaaccctttctttattaaaaatacaaaaaattagccaggcatggtggcaggtgtctgtaatcccagctacttcagaggctgaggcatgagaaccgcttgaacctgggaggcggaggttacagcgagccgagattgtaccactgcattccaggctgggcgacagagcgaggctctgtctcagtaaaattaaattaaattaaattaaattaaattaaattaaattaaactaaattaaacctgggggtgagggggaaacacataacttcctgagggtgggggagaggagaaatcgcagagttgattcacaagaaaatagaaaatctgaataaaacagtaaagaataataaaattgaaacgataattcaaagtcctc

SEQ ID NO: 11153 - DNA, 201 bp, Homo sapiens
  chr6.fa.O7frz.156156409
  Located on chromosome 6
  Distance between a terminus base of telomere on chromosomal short arm and 5'-terminus of this base sequence : 154222089
  Distance between 3'-terminus of neighbour sequence of sequence listing upward to telomere on chrosomal short arm and 5'-terminus of this base sequence : 137801
gataatgttgagtgcatgtgtatattctgtatccgtgtgtgtgtgtgtgtgtgtgtgtgtgtgtgtgtgtgttgagggaaataagagatttgttctctgggaaatagctgatccagaaactgtcattaattcataggccaaaaagccaaactcctattttgcagccctttccccatggacttaaggagtctgaggattaaa

SEQ ID NO: 11154 - DNA, 442 bp, Homo sapiens
  chr6.fa.O7frz.156443906
  Located on chromosome 6
  Distance between a terminus base of telomere on chromosomal short arm and 5'-terminus of this base sequence : 154416633
  Distance between 3'-terminus of neighbour sequence of sequence listing upward to telomere on chrosomal short arm and 5'-terminus of this base sequence : 194343
caactaacagcttctcagtgaggactttcccaagtagggcaaattgcaacctccccctgtccatgaggaagcttctcagccttccctgatttatttctctccatagctcttacattttctaataagctacatgatgtacatatttgtttattgcctgtttattttttccaatagaaataaaattaggaatttatgtttctttcatccttctgctctatctgcagatccccagctcatagtaggtgctcaagaaaaatgagtagtataaatgggaatgatcggtgcaacttagttgggtaaagttgctgtgccacttagcagggctcaaatctgtggacttcttccatcttccttctgcacacacacacacacacacacacacacacacacacacacaaatttaatcaccctgtgtctaattacagttatccatgaattccta

SEQ ID NO: 11155 - DNA, 308 bp, Homo sapiens
  chr6.fa.O7frz.156553174
  Located on chromosome 6
  Distance between a terminus base of telomere on chromosomal short arm and 5'-terminus of this base sequence : 154522895
  Distance between 3'-terminus of neighbour sequence of sequence listing upward to telomere on chrosomal short arm and 5'-terminus of this base sequence : 105820
tagcgttctgtaattcagaaagaatgatgcagcgaattaagtcaccagctgcttaatgagaaacacaaacttgcctcggttttaatacctgcctttctcataaatagccatgtatttgtatgtcagagttaattaaaagtgtgcatatatatatatatatatatatatataggtctaatgccctaaaatgattatggccttaatagtaaattgcaaaaatgtatgttgtactcatcttcattctgttacaagtgtaaaatgttgggatagaggtttgattattgctctactgaatgcttgactaaagt

SEQ ID NO: 11156 - DNA, 364 bp, Homo sapiens
  chr6.fa.O7frz.156668740
  Located on chromosome 6
  Distance between a terminus base of telomere on chromosomal short arm and 5'-terminus of this base sequence : 154637971
  Distance between 3'-terminus of neighbour sequence of sequence listing upward to telomere on chrosomal short arm and 5'-terminus of this base sequence : 114768
gcagtattaagaacactgcctttgcagcagcagaaaagaaaatgcatcccctgggcagacttgctcccaaatgaacacaggttgaggggaaaatgagagggctacattaattatttccatatttaccggctacatagggactctaccattcctgggatagagttagaaagagggtagagagaagcccaggagttccactgacactcaagaaaatacaacagatgtggagaagcagtcctgctaatttgagtgtgtgtgtgtgtgtgtgtgtgtgtgtgtgtgtgtgtgtgtacacatgcttgatttttgtttttggcagccatggggggtggtttggctggtcacataaatgcaaattcttact

SEQ ID NO: 11157 - DNA, 307 bp, Homo sapiens
  chr6.fa.O7frz.156776936
  Located on chromosome 6
  Distance between a terminus base of telomere on chromosomal short arm and 5'-terminus of this base sequence : 154745495
  Distance between 3'-terminus of neighbour sequence of sequence listing upward to telomere on chrosomal short arm and 5'-terminus of this base sequence : 107160
cgtctcagatttgacgtaatacagtctgtatgcatagtacatcgaccaaataaaagccaaaagagacacaacagtttactaacttagcttgagaagcctcgtgtttaaaggatgagaaagtccatagggagactaacaaaaaagaaaaaaaaaaaggctgaacgtaaaaagcacacacacacacacacacacacacacacacacacacacacacaatataatgtttcatttctgtgaaatacatgtgtttacaagaaactatactgaaaaagagatatgtctaagattaacttgtatgaatgtccat

SEQ ID NO: 11158 - DNA, 172 bp, Homo sapiens
  DISO7_10002247
  Located on chromosome 6
  Distance between a terminus base of telomere on chromosomal short arm and 5'-terminus of this base sequence : 154869440
  Distance between 3'-terminus of neighbour sequence of sequence listing upward to telomere on chrosomal short arm and 5'-terminus of this base sequence : 123638
ttggagaccttattcttaaatgtgattcttatatatatgttatatatatatatatatatatatatgtatatatgtattttaacattttaatttatatatatgtaatatttttaaacctgaaaaaccagtgtttgggtttgtattctatgtcacacagaggaagctcctatca

SEQ ID NO: 11159 - DNA, 398 bp, Homo sapiens
  AL034350.2_123756
  Located on chromosome 6
  Distance between a terminus base of telomere on chromosomal short arm and 5'-terminus of this base sequence : 154961249
  Distance between 3'-terminus of neighbour sequence of sequence listing upward to telomere on chrosomal short arm and 5'-terminus of this base sequence : 91637
taccacttatttaccaatcagaagttattttaagttgcggttttctgctccagtaaagtgtatagtctgaagtattttgttactcagaatttggtgtattttatggaagactttactaaaaggaaagagacagaaaagagggaaagagaaagagggaaggaaagaaggaaggaaggaaggaaggaaggaaggaaggaaggaaggaaggaaggaaagagagagagagagaaagaaagaaagaatgtcctaaggtaaagaagagtctttactaaaaaggatggaaggaagggaggcaggaaagaaagaaatgataagttcctaatacatgagcaagggtttgtctgggatctcaacttgcctggggttaactagtgttgtaggtccaaagtaactggatt

SEQ ID NO: 11160 - DNA, 306 bp, Homo sapiens
  AL034350.2_126038
  Located on chromosome 6
  Distance between a terminus base of telomere on chromosomal short arm and 5'-terminus of this base sequence : 154963596
  Distance between 3'-terminus of neighbour sequence of sequence listing upward to telomere on chrosomal short arm and 5'-terminus of this base sequence : 1949
gatcattaccagtggcttagtatatgtcaagttctgtgtcaactgttatctttgtctctatttctatatctgtctgtctgtctatgtatctatctatgtatctatctatctatctatctatctatctatctatctatctatctatctagtcttatctattcacagttgacccttgaacaatatgggggttagaggtgccaaccccctgtgcagtcaaaaattcaagtatagctttgactccctcaaaacttaaagtaccaatactctactggtgactggaaggaagccttactgataacatgagta

SEQ ID NO: 11161 - DNA, 353 bp, Homo sapiens
  AL033504.3_58510
  Located on chromosome 6
  Distance between a terminus base of telomere on chromosomal short arm and 5'-terminus of this base sequence : 155182836
  Distance between 3'-terminus of neighbour sequence of sequence listing upward to telomere on chrosomal short arm and 5'-terminus of this base sequence : 218934
gcaggtatgtcaagacttattcacacagagtgttgggtttcaccatatatgatagacacagactgtgatgtgtgtgtgtgtgtatgtgtgtaggtacatgtaggtatataagtgtgtgtatatgtatgtacatgtaggtatataagtgtgtgtgtgtgtgtgtgtgtgtgtgtgtgtgtgtgtgtgtgtgtcatagaaagagggagagagatagagagggcaaagaaaaggggaaaaaaaggaaagatgaattggccccggatcaggccacctgattgtttgaacctaggatttatataacagctgcatagatgtaacacatttgcaggctttgcctctttattccaatagta

SEQ ID NO: 11162 - DNA, 295 bp, Homo sapiens
  AL033504.3_63646
  Located on chromosome 6
  Distance between a terminus base of telomere on chromosomal short arm and 5'-terminus of this base sequence : 155187974
  Distance between 3'-terminus of neighbour sequence of sequence listing upward to telomere on chrosomal short arm and 5'-terminus of this base sequence : 4785
agcatgagcttagtattctcagaggccttcccttattttcttccatccccattccctgcctccaagacagaaggttgctcttttctatgccacagaagcactctattttccctacatcccctttggtgtgtgtgtgtgtgtgagtgtgtgtgtgtgtgtgtgtgtgtgtgtgtgtgtatatatatatgtatatattgctattaatacagcatcataattatgtctttacaatattctccttggcaaattttaagcatcttggggacagggttggtgccttattcatgtcaatttc

SEQ ID NO: 11163 - DNA, 372 bp, Homo sapiens
  AL033504.3_71120
  Located on chromosome 6
  Distance between a terminus base of telomere on chromosomal short arm and 5'-terminus of this base sequence : 155195291
  Distance between 3'-terminus of neighbour sequence of sequence listing upward to telomere on chrosomal short arm and 5'-terminus of this base sequence : 7022
atcagtagactttgagtaaagcagattactctccatcatgtgggtagtctttatccaatcagttgaaggccttaagaaaaaagactgaggtttgtgcaagaagaaaggaattctacctccaactcaagactgccagcctgccctgcagattttgggcttgtaagcccctacaatcactgaaccagttccttaaagtctctttccctctctccttttatataaatacacacacacacacacacacacacacacacacacgatagatagatagctagatagatagatagctagctagctagctagatagatagatagatagatagactctgtcactcagggtggacatcagtggtaagatcattatctcactgt

SEQ ID NO: 11164 - DNA, 219 bp, Homo sapiens
  AL033504.3_71044
  Located on chromosome 6
  Distance between a terminus base of telomere on chromosomal short arm and 5'-terminus of this base sequence : 155195464
  Distance between 3'-terminus of neighbour sequence of sequence listing upward to telomere on chrosomal short arm and 5'-terminus of this base sequence : -199
tcactgaaccagttccttaaagtctctttccctctctccttttatataaatacacacacacacacacacacacacacacacacacgatagatagatagctagatagatagatagctagctagctagctagatagatagatagatagatagactctgtcactcagggtggacatcagtggtaagatcattatctcactgtaacctcaaactccttaagtg

SEQ ID NO: 11165 - DNA, 489 bp, Homo sapiens
  HUMUT8172B
  Located on chromosome 6
  Distance between a terminus base of telomere on chromosomal short arm and 5'-terminus of this base sequence : 155226868
  Distance between 3'-terminus of neighbour sequence of sequence listing upward to telomere on chrosomal short arm and 5'-terminus of this base sequence : 31185
acaacaacaaaaaaactaggccttgatgtggagggggtaggaaccatcaatctgtgaatgtgtttatttgaatcttggaggctgcttttgtacagtaaagtccttgaagaatctacactaaattcgagtcagtaatgttgatctcactgaaaatgaaaacccattgtatttgtatggtattacacacctttgaaaatgtttacatggtagtttctgaaaacctgtggggtacataaactgctaatgtctccacttgacacaggagaagagagtcaagaaaattaaataaaacataattattaaatgggaaaagagctcaaacggggaacaggtactggcaaactgtgaccatccatcttttttctttctttctttctttctttctttctttctttctttctttctttctttctttctttctttctttctttctctttcttgtcttttgtaccatctgtcctcataaataaagtttgattggagctttag

SEQ ID NO: 11166 - DNA, 356 bp, Homo sapiens
  AL033504.3_114471
  Located on chromosome 6
  Distance between a terminus base of telomere on chromosomal short arm and 5'-terminus of this base sequence : 155238830
  Distance between 3'-terminus of neighbour sequence of sequence listing upward to telomere on chrosomal short arm and 5'-terminus of this base sequence : 11473
gctagcaagaaattacagtcaaacgggaaaaccactgactgtggttgtctataaaattcattcagtcacaataccagagaacactttcttaaaacaaaagagagagtataaaacacacacacacacacacacacacacacacacacacacacttcaaaaccagaagaagaagaaacaggtaagtcttaccaaaggagagccaaggaaacatgttcgtattagaatagttgttgtgtaggagtctatgagagattagtgccgccaccacagccctcacagctagtgcagcagttttcacttcttgaaagggttaaatagtctcatgactacactagtgtcaactcatggagttaagg

SEQ ID NO: 11167 - DNA, 101 bp, Homo sapiens
  DISO7_10002251
  Located on chromosome 6
  Distance between a terminus base of telomere on chromosomal short arm and 5'-terminus of this base sequence : 155354664
  Distance between 3'-terminus of neighbour sequence of sequence listing upward to telomere on chrosomal short arm and 5'-terminus of this base sequence : 115478
ctgaagcctacctctggcatccagtcccataaagcacacacacacacacacacacacacacacacacacacacacacaaccttcgacggtatagtttcatt

SEQ ID NO: 11168 - DNA, 283 bp, Homo sapiens
  chr6.fa.O7frz.157902965
  Located on chromosome 6
  Distance between a terminus base of telomere on chromosomal short arm and 5'-terminus of this base sequence : 155447654
  Distance between 3'-terminus of neighbour sequence of sequence listing upward to telomere on chrosomal short arm and 5'-terminus of this base sequence : 92889
ataatttctgaccggtaatatttcagcaagagctggtaccagccacacacagccattctctggtttccagcaatggagtagaatctgggtcacaattttagtaacgggggctgtgcctctgtctttgtcaccaccagaaatgggagcaaccccaggggctacaggtcttcttagtttatacacgtgtgtgtgtgtgtgtgtatgtgtgtgtgtgtgtgtgtgtgtgtgttttcaatatctggagtgcccatgtgggatgcacatctacctgtacacgcagact

SEQ ID NO: 11169 - DNA, 413 bp, Homo sapiens
  chr6.fa.O7frz.157776313
  Located on chromosome 6
  Distance between a terminus base of telomere on chromosomal short arm and 5'-terminus of this base sequence : 155490992
  Distance between 3'-terminus of neighbour sequence of sequence listing upward to telomere on chrosomal short arm and 5'-terminus of this base sequence : 43055
ccagttatcctggattaggtcccactcagtgatttatttcatttaaacttgattacctctataaaaatcctatattcagccagatgcagcagctcatgcttataatcccagcactttgggaggccgagtcacgtggatcacttgaggtcaggagttcgagggctccaaacaagaagaaggagaaggagaagaagaaggggaagaaggggggaggaggaggaggaggaagaggaggggggaagaggggaaggaggaggaggagaaggaggaggaggaggaggaggaggaggaggaaaaaatgtatatcgaaataaggccacagtgtgaagtagtaagggttaagactccaacccatcctttttaaggaagacacaattccccataacaacccctaaaccaaacactatgcaaga

SEQ ID NO: 11170 - DNA, 421 bp, Homo sapiens
  AL033378.12_291
  Located on chromosome 6
  Distance between a terminus base of telomere on chromosomal short arm and 5'-terminus of this base sequence : 155738536
  Distance between 3'-terminus of neighbour sequence of sequence listing upward to telomere on chrosomal short arm and 5'-terminus of this base sequence : 247131
aggtcaggagttcgagactagcctggccaacatggcaaaaccccgtctctattaaaaatacacaaaaattagctgggtgtgttggcgcgtgcctgtaatcccagctactcagggtggctgaggcaggagaatcacttgaacctgggaggcggaggttgtgatgagccgagattccgccactgcactccagtctgggtgacagagtgagaccctgtctccaaaaaaagaaaagaaaagaaaagaaaggaaaagaaaggaagaaaggaaggaaggaaggaaggaagaaagaaagaaagaaagaaagaaagaaagaaagaaagaaagaaagaaagaaagaaagaaagaaagaaaaagaaagaaagaaggaagtgactatgaacatctttaaatgtgtatctttaccttaagagttcactgtctc

SEQ ID NO: 11171 - DNA, 222 bp, Homo sapiens
  AL033378.12_27260
  Located on chromosome 6
  Distance between a terminus base of telomere on chromosomal short arm and 5'-terminus of this base sequence : 155765705
  Distance between 3'-terminus of neighbour sequence of sequence listing upward to telomere on chrosomal short arm and 5'-terminus of this base sequence : 26748
atccacagacttgaggtgaagtggcctggtacttggcctctacaccccctggactctcctgcttctattgcagtggagagagtgtgtgtgtgtgtgtgtgtgtgtatgtgtgtgtgtgcgtgcgtgcgtgcgttgtcaccttccaccctgaactccttgagccctagatcttttgcttctctcctggcacacagaagatattccataatgttgaataaatcg

SEQ ID NO: 11172 - DNA, 241 bp, Homo sapiens
  D6S1637
  Located on chromosome 6
  Distance between a terminus base of telomere on chromosomal short arm and 5'-terminus of this base sequence : 155828866
  Distance between 3'-terminus of neighbour sequence of sequence listing upward to telomere on chrosomal short arm and 5'-terminus of this base sequence : 62939
cctctggactcagtaggaagtgagaagtcaacacctctccatcaatatcatggatgcagcaatacattcttgggataggttgttgaactcaagtaacttctaggctgacttctaggttaattttctattacacacacacacacacacacacacacacacacacacacacacacacacaccttggatgacctggattttatattgcatttttcttcgtataaattgtgccgcatctatcttg

SEQ ID NO: 11173 - DNA, 254 bp, Homo sapiens
  AL033378.12_116921
  Located on chromosome 6
  Distance between a terminus base of telomere on chromosomal short arm and 5'-terminus of this base sequence : 155855315
  Distance between 3'-terminus of neighbour sequence of sequence listing upward to telomere on chrosomal short arm and 5'-terminus of this base sequence : 26208
aaagtcctgctttcaaagaatcccattcccttctcttctttcccaaggtaactgctccccaggcaatgctatgtgcctttgggtaccactaccttttgatgttggaatattcataggtgtcttagcatattctgtgtgtgtgtgtgtgtgtgtgtgtgtgtgtgtgtgtgtgtgtgtgtgtgtgtgtggttggtgaggctggaggcagagagagcttagcccaagcagagtcccttcaggtcaaagttcaggtc

SEQ ID NO: 11174 - DNA, 375 bp, Homo sapiens
  AL033378.12_121996
  Located on chromosome 6
  Distance between a terminus base of telomere on chromosomal short arm and 5'-terminus of this base sequence : 155860352
  Distance between 3'-terminus of neighbour sequence of sequence listing upward to telomere on chrosomal short arm and 5'-terminus of this base sequence : 4783
gaccatggtcaatatcttcagtagtagcactaggctgatgatctttatgtaacaacaataatatcctacaaatgcatagcatgttggtgtttatcagtgtggaacatacaggtggacagggtcaaagcacacaacaaacatgttatcaaccaaaaatgtaacaagggacagtgtgtgtgtgtgtgtgtgtgtgtgtgtgcgcgcgcacatgtaagtactgatgagaacaaagcattcagcacattgtctggcccatgaattgtaagttcttggcaaagcttatccaacagcagcagtttagtatcaactaccagtcgtcagataagtagattatgtctggttgatagttcagttatcagtctggcagttgtaact

SEQ ID NO: 11175 - DNA, 325 bp, Homo sapiens
  chr6.fa.O7frz.158759963
  Located on chromosome 6
  Distance between a terminus base of telomere on chromosomal short arm and 5'-terminus of this base sequence : 156021515
  Distance between 3'-terminus of neighbour sequence of sequence listing upward to telomere on chrosomal short arm and 5'-terminus of this base sequence : 160788
gaatgactagtgactacagcaaacccttttgcaggtcacgtggctcctattcttggctttcaaccaaagtgaaggaggatctaatctagttatcccctcaggtagatcaccaacagatcactatgggatttagaaagatgttaaagaagcgtgtgacacggctataactaaacactctccattcctgtctgttaaagcgaacaaggttattttatatatatatatatatataaaaatataatgaataaataggaataaaattgaaatcagtgaaatttacttatagacaaggccctattcactgtatttatgatcaaattccact

SEQ ID NO: 11176 - DNA, 234 bp, Homo sapiens
  D6S1564
  Located on chromosome 6
  Distance between a terminus base of telomere on chromosomal short arm and 5'-terminus of this base sequence : 156114726
  Distance between 3'-terminus of neighbour sequence of sequence listing upward to telomere on chrosomal short arm and 5'-terminus of this base sequence : 92886
tgaggcattgttgaatacacacacacacacacacacacacacacacacacacacacacatatatatgtacgtatgtatgtatttttgaaagccattttatttgtaaaattctgtgctatagcaccgactctttataaagagtcatacccatgttaaaatgtcttcttgatatcattaatatccttcttcttgatatttattattcatactttgatatggtttggctgtgtcccc

SEQ ID NO: 11177 - DNA, 456 bp, Homo sapiens
  chr6.fa.O7frz.158929598
  Located on chromosome 6
  Distance between a terminus base of telomere on chromosomal short arm and 5'-terminus of this base sequence : 156191852
  Distance between 3'-terminus of neighbour sequence of sequence listing upward to telomere on chrosomal short arm and 5'-terminus of this base sequence : 76892
atccatttctaagaccagattatctattccatttcattcatacaaaaaggcacctctctgggccacagtcaaattcacacatgcattgctctctggagggtagttgtgatcatacacacacacacacacacacacacacacacacacacacagagctaaattttttaaatctattaaatggaacaagacactgaagggattattaaaaaggaaagggagtgtgaagacaccaaatgttagaatgcctataaaaatcccactacatctgtccttataaaaatagaaatacctttgaagttcatattttgggaaatatcacctcaacagcagagcatgggcaatggctgctgggcaagtgttggactttcgcacagctcatcatgcaaacctgtgatgacatcattgcatttatgccctaaaactagatttcaggtcttaagctggcttaaattatct

SEQ ID NO: 11178 - DNA, 377 bp, Homo sapiens
  chr6.fa.O7frz.159002192
  Located on chromosome 6
  Distance between a terminus base of telomere on chromosomal short arm and 5'-terminus of this base sequence : 156265123
  Distance between 3'-terminus of neighbour sequence of sequence listing upward to telomere on chrosomal short arm and 5'-terminus of this base sequence : 72815
caggtatccagtatttcagtgtgtgaatgtaccataatttctcttaaaaccaatcccccgttcgtgaacatgtaaattctgccatattttgttgtaataaataaactcattgcagcaatgaatatccatatatacacacacacacacacacacacacacacacacacacacatctgtcagtgtcaaactcttcttagaaaggtatttcaggtctagtgtcttgcattttaatgggttttcatacacaatgagatgctcttaatcaccctcaccacatggctggacagacatatgcacccccctattcacttctcatatgttcctccctggaaactgcacctccgcctctcatggtaaactcaagtgcttgagtactc

SEQ ID NO: 11179 - DNA, 392 bp, Homo sapiens
  AL031056.1_91738
  Located on chromosome 6
  Distance between a terminus base of telomere on chromosomal short arm and 5'-terminus of this base sequence : 156466712
  Distance between 3'-terminus of neighbour sequence of sequence listing upward to telomere on chrosomal short arm and 5'-terminus of this base sequence : 201212
gtgacaaccagatagttaaaggacatacagaacacttcccaaaattcaaaccactgcagagcccagaagcttcacagttagaaaatctctgttctcaatgaggcaaggccaccatttcccatagttgtgccaaatccgcttccagggttaacttttgcttaccaagtgtttcatattttaacatttgtgtgtgtgtgtgtgtgtgtgtgtgtgtgtgtgtgtactgggacaagtatataagtaaacagtgtcacactttataactaacaactgtatgtgttattaccccattttacagataaggaaactaaggtcaaacttaagagactagtttgcccagattgcccgctagtaaagtggccttattgagataccaactgagttattgttca

SEQ ID NO: 11180 - DNA, 288 bp, Homo sapiens
  AL031056.1_81662
  Located on chromosome 6
  Distance between a terminus base of telomere on chromosomal short arm and 5'-terminus of this base sequence : 156476843
  Distance between 3'-terminus of neighbour sequence of sequence listing upward to telomere on chrosomal short arm and 5'-terminus of this base sequence : 9739
catgcagtgtcagtaactaaacacaagaataaggctgaaactgtcaacagtgcaacgtaaaaccctgaactggcaccgtgcttctactaacaaagaaaacgtgtgctccatgcagatggcacccagcaaacctttaaagacgtgtgtgtgtgtgtgtgtgtgtgtgtttgtgtgtgtgtaatttttttcttttattttaaggggtgaggggctgctgacaacagtggggagtctgcacaattgatcatggcaaaatgtttttctcctgatatctgcagacctacactg

SEQ ID NO: 11181 - DNA, 461 bp, Homo sapiens
  AC016733.3_38779
  Located on chromosome 6
  Distance between a terminus base of telomere on chromosomal short arm and 5'-terminus of this base sequence : 156488074
  Distance between 3'-terminus of neighbour sequence of sequence listing upward to telomere on chrosomal short arm and 5'-terminus of this base sequence : 10943
aactccagtgtaaataaggtcaggtggatcagaatgttctgtaaagtgttataaaactgtagaataatagcatcatcatcatcatcattataaaaggatagtgataacatcttaggcttgctgcctagagagattcaagaacaattactttatttttctactctttctactatatttttattctgtctttatggtagtataatttgcatataatgaacatgttttaagtgtaatgtctgtccaattttgtttattatttttgggctaacataaagtcaaatatattttaaagtacaataaaatcaaatggctatattttaactaatataaatatgtagagctacaaatttaattatgacacgtgttatggattaaatggtcatgcccctcccctaaatgcatatgttgaagccctaaccccaaatgtgacaatatttggagataaggcctttatggaggta

SEQ ID NO: 11182 - DNA, 274 bp, Homo sapiens
  D6S1654
  Located on chromosome 6
  Distance between a terminus base of telomere on chromosomal short arm and 5'-terminus of this base sequence : 156505862
  Distance between 3'-terminus of neighbour sequence of sequence listing upward to telomere on chrosomal short arm and 5'-terminus of this base sequence : 17327
atttgccgctttctatggtgtaaatactcccaccatggctaatttcaagtcattcagtgatgtcactgaacatgaacttaggaaaatatagacacacaatggctctcacatgccagagtgagccccctccagtgcatgactgcctacacacacacacacacacacacacacacacacacacacttctcacataaatacacttttacttttgtatgattctgtcctatacctaagggaagaagactgttcctcctgtccagtaactgaacataca

SEQ ID NO: 11183 - DNA, 224 bp, Homo sapiens
  AL031056.1_52627
  Located on chromosome 6
  Distance between a terminus base of telomere on chromosomal short arm and 5'-terminus of this base sequence : 156505911
  Distance between 3'-terminus of neighbour sequence of sequence listing upward to telomere on chrosomal short arm and 5'-terminus of this base sequence : -225
tcattcagtgatgtcactgaacatgaacttaggaaaatatagacacacaatggctctcacatgccagagtgagccccctccagtgcatgactgcctacacacacacacacacacacacacacacacacacacacttctcacataaatacacttttacttttgtatgattctgtcctatacctaagggaagaagactgttcctcctgtccagtaactgaacatac

SEQ ID NO: 11184 - DNA, 217 bp, Homo sapiens
  AL031056.1_51708
  Located on chromosome 6
  Distance between a terminus base of telomere on chromosomal short arm and 5'-terminus of this base sequence : 156506876
  Distance between 3'-terminus of neighbour sequence of sequence listing upward to telomere on chrosomal short arm and 5'-terminus of this base sequence : 741
tctgttcacagtgcagacatagaaaggctgcctatagcacgctccctctacacacacacacacacacacacacacacacacacacacatacacacaatctgggagagggctctgcaaagcctagggaagcagtttgagtctcactgagaaacatatagatgttagggggcttatatctgtcactttgtcccaactcttctgtcagaatgttccatct

SEQ ID NO: 11185 - DNA, 324 bp, Homo sapiens
  AL031056.1_26387
  Located on chromosome 6
  Distance between a terminus base of telomere on chromosomal short arm and 5'-terminus of this base sequence : 156532084
  Distance between 3'-terminus of neighbour sequence of sequence listing upward to telomere on chrosomal short arm and 5'-terminus of this base sequence : 24991
gcctatcacgagcacatattacgtgctcaacaagagcttttttagttagttttgaggatgctttcaggactaagaggaggtcgcatctaataaaaaattagatctaattttcactctgagtaaattcatatctaccacagaatgatctctttacacacacacacacacacacacacacacacacacacacacacacacacaagaatataaacaatctatcccaactcatgggcagttgcctgaagggcataccttatttatccatctagctgctacactgctagaaaaactaccctaaattaacatctaaagaactgcctcttt

SEQ ID NO: 11186 - DNA, 341 bp, Homo sapiens
  AL138727.10_41331
  Located on chromosome 6
  Distance between a terminus base of telomere on chromosomal short arm and 5'-terminus of this base sequence : 156581129
  Distance between 3'-terminus of neighbour sequence of sequence listing upward to telomere on chrosomal short arm and 5'-terminus of this base sequence : 48721
tagatggtagatgtataggccaagtttctcttcagtatttttatatacctttccacttttgagctttacaagacaaaaatacccttagcccttactattccaatgcagatttaaatattaggagattgggtatttttaaaaccatatattcttttatttccagatccatagtgtgtgtgtgtgtgtgtgtgtgtgtgtgtgtgtgtgtctatgtgtctgtgtgtacagatacatatattgtgttagtccatggcaaattagtaaagtttgtaaaaagaatgtctttctctggtattgttgacaccaacatagtaagaatgtttaagtgctttgcattaagc

SEQ ID NO: 11187 - DNA, 444 bp, Homo sapiens
  AL138727.10_16404
  Located on chromosome 6
  Distance between a terminus base of telomere on chromosomal short arm and 5'-terminus of this base sequence : 156606062
  Distance between 3'-terminus of neighbour sequence of sequence listing upward to telomere on chrosomal short arm and 5'-terminus of this base sequence : 24592
ggcatctactgcgactaattagaagttcatcaatctagttattcctttgtagattatggctcttttctctctgattgttttaaagataaaatatttgtctttggtactctgcagtttcactacaatacatctaggtgcagatttctttttatttttctcttcagaactctgtgtgtgtgtgtgtgtgtgtgtgtgtgtgtgttttcagtatattataaagaaacattgtcagtttctcaaccattatctctttgaattttgcctttcccttattctttcatatctttctacaagtcctctattagatgcagtagtattttcattctgtttctcattttctcttccatatattccattgctttataagctctgctgctttctggttgctattctcttatccatcttccagttcacctttctctgtagtctcaagtaccttctgct

SEQ ID NO: 11188 - DNA, 211 bp, Homo sapiens
  AL138727.10_6397
  Located on chromosome 6
  Distance between a terminus base of telomere on chromosomal short arm and 5'-terminus of this base sequence : 156616118
  Distance between 3'-terminus of neighbour sequence of sequence listing upward to telomere on chrosomal short arm and 5'-terminus of this base sequence : 9612
gagcagttctatagcatgattgtcgccacttaaattattttaaatgtcctttactcatttctagtactttctctcctgcaacccatttatagaaacactacttttgaatgcgaaaatttgtgtgtgtgtgtgtgtgtgtgtgtgtgtgtgtgtttacacagaaatacttttggaaaatctacaatgcaaataacttgatgttggcagtgat

SEQ ID NO: 11189 - DNA, 356 bp, Homo sapiens
  AL031133.1_44829
  Located on chromosome 6
  Distance between a terminus base of telomere on chromosomal short arm and 5'-terminus of this base sequence : 156697380
  Distance between 3'-terminus of neighbour sequence of sequence listing upward to telomere on chrosomal short arm and 5'-terminus of this base sequence : 81051
gctcagctggtacagtagaaagcctattctggaaactgccatgatggatggctaataaaatattggagatacttaacccttagccaaacagtatgtgtctgtgtggtgtgtgtgagtatgtacatgtatgatagactgtgtgtgtgtgtgtgtgtgtgtgtgtgtgtttgtgtggtgggggtatgtgtgtgaaggccccagaaggtggccctgggacaaagcgctcctaccacttgtccccagcataggacagccacacaattcagagcacaggagagcccacacctggaggctgggctgcccttgcgggtggggttagcaatagctaacatgaaaacttccagatagcaaacctc

SEQ ID NO: 11190 - DNA, 230 bp, Homo sapiens
  D6S1553
  Located on chromosome 6
  Distance between a terminus base of telomere on chromosomal short arm and 5'-terminus of this base sequence : 156697398
  Distance between 3'-terminus of neighbour sequence of sequence listing upward to telomere on chrosomal short arm and 5'-terminus of this base sequence : -338
aaagcctattctggaaactgccatgatggatggctaataaaatattggagatacttaacccttagccaaacagtatgtgtctgtgtggtgtgtgtgagtatgtacatgtatgatagactgtgtgtgtgtgtgtgtgtgtgtgtgtgtgtttgtgtggtgggggtatgtgtgtgaaggccccagaaggtggccctgggacaaagcgctcctaccacttgtccccagcatag

SEQ ID NO: 11191 - DNA, 322 bp, Homo sapiens
  AL031133.1_38500
  Located on chromosome 6
  Distance between a terminus base of telomere on chromosomal short arm and 5'-terminus of this base sequence : 156703648
  Distance between 3'-terminus of neighbour sequence of sequence listing upward to telomere on chrosomal short arm and 5'-terminus of this base sequence : 6020
ctggctaacatggtgaaactccatctctactaaaaatacaaaaaattagccaggcatggtggtgcgtgcctataatctcagctactcgggaggctgaggcaggagaattgcttgaacctgggaggcagagtttgcagtgagccaagattgagccactgcactccagcctgggtgacagagcaagactccatctcaaaaaataaaataaaataaaataaaataaaataagacaaaaacctgaaataagtgaaaagcaatacaacaaagtacagatcttttccatgatgactatttcaatattctgaagtatgcaattctgttt

SEQ ID NO: 11192 - DNA, 140 bp, Homo sapiens
  DISD22_0004736
  Located on chromosome 6
  Distance between a terminus base of telomere on chromosomal short arm and 5'-terminus of this base sequence : 156955065
  Distance between 3'-terminus of neighbour sequence of sequence listing upward to telomere on chrosomal short arm and 5'-terminus of this base sequence : 251095
gccatttagtgtagagcatctctctttatttatttatttatttatttagagatggggtctcactctgccacccagggtggagtgcagtggcatgatcttatgaatccagcacttgaacagggctgttggaggagtcttga

SEQ ID NO: 11193 - DNA, 133 bp, Homo sapiens
  DISD22_0004738
  Located on chromosome 6
  Distance between a terminus base of telomere on chromosomal short arm and 5'-terminus of this base sequence : 157101461
  Distance between 3'-terminus of neighbour sequence of sequence listing upward to telomere on chrosomal short arm and 5'-terminus of this base sequence : 146256
ctggattatagaggatgcaggtaaaaaagtgtgtgtgtgtgtgtgtgtgtgtgtgtatacacacatatataaaactgatataactatatgaaggaaggggataggtttgtgttgtgtaaatactcatccatct

SEQ ID NO: 11194 - DNA, 154 bp, Homo sapiens
  HUMUT5779
  Located on chromosome 6
  Distance between a terminus base of telomere on chromosomal short arm and 5'-terminus of this base sequence : 157242324
  Distance between 3'-terminus of neighbour sequence of sequence listing upward to telomere on chrosomal short arm and 5'-terminus of this base sequence : 140730
tacggcggggaggaaaaatgattttcatgaaaaaaacaaacaaacaggagtttattatctatctatctatctatctatctatctatctatctatctatctatctatctatctatctatcgtctcttgtatatacacaggaaacacctggagaaa

SEQ ID NO: 11195 - DNA, 235 bp, Homo sapiens
  chr6.fa.O7frz.160061718
  Located on chromosome 6
  Distance between a terminus base of telomere on chromosomal short arm and 5'-terminus of this base sequence : 157348580
  Distance between 3'-terminus of neighbour sequence of sequence listing upward to telomere on chrosomal short arm and 5'-terminus of this base sequence : 106102
gctgtcttcatatggtttgactgagcctagggcgcaccatggccaggaaaatcttgcctttgttattgttgttgtcattattattattattattattttattatttttgacggaatcttgtactgttgcccgggctggtatgcagtggcacaatcttcgttcactgcaacctccacctccttggttcaagtgattctcctgcctcagccttctcagtagctaggattacaaacac

SEQ ID NO: 11196 - DNA, 307 bp, Homo sapiens
  AL096708.34_36442
  Located on chromosome 6
  Distance between a terminus base of telomere on chromosomal short arm and 5'-terminus of this base sequence : 157553723
  Distance between 3'-terminus of neighbour sequence of sequence listing upward to telomere on chrosomal short arm and 5'-terminus of this base sequence : 204908
ctgttcttggagctaatgtcagcgaggatagtgtatcatattccttgacttcctcagtatactggggtcctcacttttgtgttgtaacacacacacacacacacacacacacacacacacaagaggttgagtactattactgaataaatgcactttagtaggaaggaaacattcagaaagtcagcctcttctgggaagccaagacaaacagctcttggagccaagacacagagaggccacacccagggaatgcccgggtgtccccagtgtccccatgtacacctttctctctagctcctgcagatgc

SEQ ID NO: 11197 - DNA, 291 bp, Homo sapiens
  AL096708.34_59709
  Located on chromosome 6
  Distance between a terminus base of telomere on chromosomal short arm and 5'-terminus of this base sequence : 157576928
  Distance between 3'-terminus of neighbour sequence of sequence listing upward to telomere on chrosomal short arm and 5'-terminus of this base sequence : 22898
caggagtttactgaagacaggaccttttcattgttttccgtgagagggtaaaacttcacctgcagtgtgacagcggccacatccaaagactcagaggagccagcatgaggaggaggagctgaaagcggagggaggtggttggtgccactgtgtgtgtgtgtgtgtgtgtgtgtgcgcgtgtgtgtgtttagccaggagggagctgttgggaaatgccacctaaggaatgttttcaagtgcaattctagcacttcatgatgtgaagaataaatacgatctcctttgtagtcc

SEQ ID NO: 11198 - DNA, 407 bp, Homo sapiens
  AL096708.34_88491
  Located on chromosome 6
  Distance between a terminus base of telomere on chromosomal short arm and 5'-terminus of this base sequence : 157605618
  Distance between 3'-terminus of neighbour sequence of sequence listing upward to telomere on chrosomal short arm and 5'-terminus of this base sequence : 28399
aggtgaagcgaatactgttattttttaaaaaaattattgtccccttatagatgaagaatttaaagctcaaagacaattttaggccttcctgaaatttttgaagggcccagatctggtatgtgataaatctgagactcagggccaaatcttaaaaattacttaatcctatgattttttttttttttaactagaccattggttgtattggtcagggttctccagagaaacagaaccaataggacacacacacacacacacacacacacacacacacacacacacacacacttatgtgtatttataaaaatgtattattttaaggaattggctcatgtgagtgtgggactggaaagtccaaaatctgtagggcagtctgggaggctggaaactcaggtgagtgctaatga

SEQ ID NO: 11199 - DNA, 460 bp, Homo sapiens
  chr6.fa.O7frz.160504785
  Located on chromosome 6
  Distance between a terminus base of telomere on chromosomal short arm and 5'-terminus of this base sequence : 157789353
  Distance between 3'-terminus of neighbour sequence of sequence listing upward to telomere on chrosomal short arm and 5'-terminus of this base sequence : 183328
tgtgaccttggacaacttatcttctctctgcctcagttttcttacctctaaactagataaagggctgggcacggtggctcacacctgtaatcccagaactttgggaggctgaggcaggtggatcacctgaggtcaggagtttgagaccagcctggccaacatgatgaaacctcgtctctactaaaaatataaaaattggcagggcgtggtggcgggagcctataatcccagctacttggggggctgaggcaggagaattgcttgaacctgggaggcggaggttgcaatgaactgagatcatgccactgcactccagcctgggaaaacagagtgagactctgttctcaaaataaataaataaataaataaataaataaataaataaagagttatgaggacaaaatgcattaataactgcgaaggttatagagcagaactggcataaagtctatgtaagtgt

SEQ ID NO: 11200 - DNA, 105 bp, Homo sapiens
  DISO7_10002255
  Located on chromosome 6
  Distance between a terminus base of telomere on chromosomal short arm and 5'-terminus of this base sequence : 157923096
  Distance between 3'-terminus of neighbour sequence of sequence listing upward to telomere on chrosomal short arm and 5'-terminus of this base sequence : 133283
accgccaagacataatgtctgtgtgtgtgtgtgtgtgtgtgtgtgtgtgtgtgtgagagatgtggcttttttttttttttagatcagacataaacactccaaggc

SEQ ID NO: 11201 - DNA, 130 bp, Homo sapiens
  DISO7_10002254
  Located on chromosome 6
  Distance between a terminus base of telomere on chromosomal short arm and 5'-terminus of this base sequence : 157968940
  Distance between 3'-terminus of neighbour sequence of sequence listing upward to telomere on chrosomal short arm and 5'-terminus of this base sequence : 45739
gagtcctcagcaaatggacatttgttttgggatggtatgtagataggaaaacacacacacacacacacacacacacacacacacacacacacacacacaccccgtccttgccctcctgcactgaaccctc

SEQ ID NO: 11202 - DNA, 129 bp, Homo sapiens
  D6S1687
  Located on chromosome 6
  Distance between a terminus base of telomere on chromosomal short arm and 5'-terminus of this base sequence : 158042967
  Distance between 3'-terminus of neighbour sequence of sequence listing upward to telomere on chrosomal short arm and 5'-terminus of this base sequence : 73897
aaagggcattgggaacctctcaccatcagcagtacttctcattttgttttggggtgtgtgtgtgtgtgtgtgtgtgtgtgtgtgtgtacttatatatatgtcatccagtacccaaattgtacccttcta

SEQ ID NO: 11203 - DNA, 425 bp, Homo sapiens
  chr6.fa.O7frz.161073835
  Located on chromosome 6
  Distance between a terminus base of telomere on chromosomal short arm and 5'-terminus of this base sequence : 158111547
  Distance between 3'-terminus of neighbour sequence of sequence listing upward to telomere on chrosomal short arm and 5'-terminus of this base sequence : 68451
gtttaaatctttacgtgtctcctaatttaaagaaaaataagaatgagggtgggcatggtagcttacacctgtaatcccagcactttgggaggccgaagtgggtggatcacttgaggtcaggagttcaagaccagcctggccagcatggcaagaccctatctctactaaaaaatacaaataaaattagctgggtgttgtggcacatgcctgtaatcccagctacttgggaggctgaggcaggagaatcacttgaacccgggaggtggaggttgcagtgagccgagatcgcgccactgcactccagcctgggcaacagagtgagactccatcttgaatgaatgaatgaatgaatgaatgaacgaacgaacgagttggcaagaagagatctttgcagtggacccccgtctgcagaagttagatgactg

SEQ ID NO: 11204 - DNA, 315 bp, Homo sapiens
  HUMUT1670
  Located on chromosome 6
  Distance between a terminus base of telomere on chromosomal short arm and 5'-terminus of this base sequence : 158334304
  Distance between 3'-terminus of neighbour sequence of sequence listing upward to telomere on chrosomal short arm and 5'-terminus of this base sequence : 222332
cagcaaaactttaagcaagtctcacctcttctaaattagaattgtaaccttgactttagtctcagagttaacattgtgcagaaaaagaaaacactgcgcagtgttgaagcagtttgcaaactgaaatgatacaaatgaaaaatgctatgatgtttctcagtagtctctgtatttgcaaatgagtcagttaggattagttttacccacaaataacaacaacagtaaaaaaaaaaaaaaaagaaagaaagaaagaaagtgacccagcactataatacaagtttatttctctctcacatcaaggaagttcagggtagc

SEQ ID NO: 11205 - DNA, 316 bp, Homo sapiens
  AL133260.12_93757
  Located on chromosome 6
  Distance between a terminus base of telomere on chromosomal short arm and 5'-terminus of this base sequence : 158380161
  Distance between 3'-terminus of neighbour sequence of sequence listing upward to telomere on chrosomal short arm and 5'-terminus of this base sequence : 45542
aaggtcaggagttcgagacctgcctggccaaaatggtgaaaccccatcactactaaaaatacaaaaatttgccgggcggggtggtgggcacctataatcccagctgctcaggaggctgaggcaggagaatcgcttgaacccgggaggcagaagttgcagtaagccaagattgcgccattgcacttcagcctgggtgacagagcaagacttcatctctaaatacatacatacatacatacatacatacatgcatacatgcatacatgcatacatagaatggcctcagtgatggccactttactcctgagctttagct

SEQ ID NO: 11206 - DNA, 298 bp, Homo sapiens
  AL133260.12_64423
  Located on chromosome 6
  Distance between a terminus base of telomere on chromosomal short arm and 5'-terminus of this base sequence : 158409617
  Distance between 3'-terminus of neighbour sequence of sequence listing upward to telomere on chrosomal short arm and 5'-terminus of this base sequence : 29140
atcataagtacagccacctcagcctcatgactttttagccacggcttcattccaaagtgaccacagtcataaggcccaaaactatcttctctctctttctctctctctctctctctctctctctctccctccctctctctgtcatagggacctccctaatcctccaggttgtacagccaggaagggtaaggtattgtcaaaaacaagtgaggtacccccttgatagctcagtgggccagagggcctctggatgctggctgatcatggcaaaaactaaatacagaatccatacagtgga

SEQ ID NO: 11207 - DNA, 180 bp, Homo sapiens
  G08536
  Located on chromosome 6
  Distance between a terminus base of telomere on chromosomal short arm and 5'-terminus of this base sequence : 158612929
  Distance between 3'-terminus of neighbour sequence of sequence listing upward to telomere on chrosomal short arm and 5'-terminus of this base sequence : 203014
ctttgccttcctgtttttcatgagatgatagatagatagatagatagatagatagatagatagatagatagagatggagtctcactctgtctcccaggctggagtgcagttgtatgatctcggctcactgcaacctcggctcactgcaacctctgcctcctgggtttgagtgattttcct

SEQ ID NO: 11208 - DNA, 420 bp, Homo sapiens
  chr6.fa.O7frz.161847399
  Located on chromosome 6
  Distance between a terminus base of telomere on chromosomal short arm and 5'-terminus of this base sequence : 158734833
  Distance between 3'-terminus of neighbour sequence of sequence listing upward to telomere on chrosomal short arm and 5'-terminus of this base sequence : 121724
atagttccagtgagacttggacaatgagcagaaaaaatttttttttgagacgaggtgtcgctgtgtcgcccaggctggagtgcagcggcgcgatatctgctcactgcaacctctgcctcctgggttcaagcgattctcatgcctcagcctcccaagtagctgggactacaggtgcccgccaccacacccggctaattttttgtatttttttttttttagtagagacggggtttcgcagtgttagccaggatggtctcgatctcctgacctcgtgatccacccgcctcggccttccaaagtgctgggattacaggtgtgagccattgtgcccagctcagaaaatttaatagtactagatctcgtgtgtgtgtgtgtgtgtgtgtgcgcgcgcttaggttgaaggtggaatttaacattgat

SEQ ID NO: 11209 - DNA, 224 bp, Homo sapiens
  G09389
  Located on chromosome 6
  Distance between a terminus base of telomere on chromosomal short arm and 5'-terminus of this base sequence : 158849542
  Distance between 3'-terminus of neighbour sequence of sequence listing upward to telomere on chrosomal short arm and 5'-terminus of this base sequence : 114289
aaaaaatcccatttgggaagagttctaaaatctttaacatgtggaaagatctctttctctctctctctctcccccctttcgctctctctgtctcatctatctatctatgtatctatctatctatctatctatctatctatctatctatgaatgataatgatgaataaagtgtctcatctcgttgtcaacagggacttctcattccaccattcctttctcagtgg

SEQ ID NO: 11210 - DNA, 367 bp, Homo sapiens
  AL035695.17_117832
  Located on chromosome 6
  Distance between a terminus base of telomere on chromosomal short arm and 5'-terminus of this base sequence : 158980851
  Distance between 3'-terminus of neighbour sequence of sequence listing upward to telomere on chrosomal short arm and 5'-terminus of this base sequence : 131085
aatccaatgtcatgaagatttatgtctttctttctttttctttccttctttctctttttctttctttctctttctttctttctttctctttccccttccttccttccttccttccttccttccttccttccttccttccttccttcctatctcgcgctctctttctttctctctctgtctctctcttttttttaggcaaggtcttattatgttgcccaggtgggtcataaactcctgggttcaaaagtgatactttcatctcagcctcctgagtagctgggactacaggcatatgacactgtgcctggattaagagttttataattttagcttttgcccttaggtctttgatctgttttgagttaaa

SEQ ID NO: 11211 - DNA, 377 bp, Homo sapiens
  AL035695.17_25844
  Located on chromosome 6
  Distance between a terminus base of telomere on chromosomal short arm and 5'-terminus of this base sequence : 159072830
  Distance between 3'-terminus of neighbour sequence of sequence listing upward to telomere on chrosomal short arm and 5'-terminus of this base sequence : 91612
aaggacttagtgatcgttgctaattgaagttattctgtttatgagcaagcaacactatttctttgatgaaaaccagaaaggatttacgtgtcggtaaatagggttcctttatgtttgtgtatgtgtgtgtgtttgtgtgtgtgtgtgtgtgtgtgtgattttatgaggtttgtctcattcttctatgctagtgagtgttgattagttggattgccttttcagttgacctattgctttttaagagcatttttggatatagtcccttaacccagaattaacttctatgataaaaacgctttttgggttgtcagagaggctaataggggatatatgggcagggagttttttaccagccgtcagatctcatcttgcagact

SEQ ID NO: 11212 - DNA, 386 bp, Homo sapiens
  X62462.1_1622
  Located on chromosome 6
  Distance between a terminus base of telomere on chromosomal short arm and 5'-terminus of this base sequence : 159146758
  Distance between 3'-terminus of neighbour sequence of sequence listing upward to telomere on chrosomal short arm and 5'-terminus of this base sequence : 73551
acagtaagcttggcatttagatagaccatgaacacttcgtcagatactctgttgggtgtttgggatagcaattaaaacaaagtattgatagttgtatcagagtctattaggctgcagcaaaggaagtttattcaaaagtataaactatccaagattatagacgcatgatatacttcacctattttttgtctccttaatatgtatatatatatatatatatatatatatacacatatatgtgtgtgtgtatgtgcgtgtgcatgtttaacttttaattcagttaaaaacttttttctatttgtttttcatctggatatttgattctgcatatcctagcccaagtgaaccgagaagatcgagttgtaggactaaaggatagacatgca

SEQ ID NO: 11213 - DNA, 392 bp, Homo sapiens
  chr6.fa.O7frz.162253962
  Located on chromosome 6
  Distance between a terminus base of telomere on chromosomal short arm and 5'-terminus of this base sequence : 159221988
  Distance between 3'-terminus of neighbour sequence of sequence listing upward to telomere on chrosomal short arm and 5'-terminus of this base sequence : 74844
gaggaacattgcttctagtcttggatagccttcagtgtagtggaagagaacaagtagaaaatgtgtaattaaaataaagtcatgaggctgaggtgggcagatcatctgaggtcaggagttcgagaccagcttggccaacaaggtgaaaccctgtctctattgaaaatacaaaaattagctgggtatggtggcgagtgccagtaggcccagctacttgggaggtggaggcaggagaatcacttgaacctggcaggtggagggggcagtgaactgagatggcgccactgcactccagcctgggtgatagagtgagactctgtctcaataaataaataaataaataaataaataaataaataaataaataaataaagtaacggattcatttagtg

SEQ ID NO: 11214 - DNA, 360 bp, Homo sapiens
  AL049821.6_40852
  Located on chromosome 6
  Distance between a terminus base of telomere on chromosomal short arm and 5'-terminus of this base sequence : 159342483
  Distance between 3'-terminus of neighbour sequence of sequence listing upward to telomere on chrosomal short arm and 5'-terminus of this base sequence : 120103
ccgtttcgacattctgaacttaagtagaaaatgggaatataagcctcttgttttttgctcttaatccattccagaactataagtccctgggttcttggcaacaacaggtgttcctctagattttaaatcaagtgtgtgtgtgtgtgtgtgtgtgtgtgtgtgtgtgtggaatatctcactaaaacgacagtgttgtcatcaattttggcttcatggagggtcttgagctgggtggagatgggaggaagctatccttgtccatgcggtttggagacttgctctaaaaaagagaccgtctacttccctcgtagtttttgttttgaagacatttgtagtgtttaccaggagcatacagttatc

SEQ ID NO: 11215 - DNA, 372 bp, Homo sapiens
  AL049821.6_42007
  Located on chromosome 6
  Distance between a terminus base of telomere on chromosomal short arm and 5'-terminus of this base sequence : 159343491
  Distance between 3'-terminus of neighbour sequence of sequence listing upward to telomere on chrosomal short arm and 5'-terminus of this base sequence : 648
gcttattgtcatgacaaccatctcttcataaaccaaggctctgagtgtaatacagatggggctggtaacaaggtaggattgccatctgctttgttttctctaagggacattatttttttgtgatccccaagtctcatcctcaaatctgaaagtcttgacttatttttctttctggagtcagatagagctgtgagattaattcttttctcctgacaaactacttcctcacctgtcatcaaacaacttacttgttaaatggagggaaaaaagggtaattatgtgtgtgtgtgtgtgtgtgtgtgtgtgtgtgaaaacaaatatacatattttaatgatttatttatctgtctactttgcaaagtctcctatgag

SEQ ID NO: 11216 - DNA, 271 bp, Homo sapiens
  D6S440
  Located on chromosome 6
  Distance between a terminus base of telomere on chromosomal short arm and 5'-terminus of this base sequence : 159352391
  Distance between 3'-terminus of neighbour sequence of sequence listing upward to telomere on chrosomal short arm and 5'-terminus of this base sequence : 8528
gctaaggataactttctgctagacattacctcagaagaattctattatttctaatacacacacacacacacacacacacacacactcacactctctctctctctctctctgtcattatgaatggtaattttctaactccatcttcaacttgtatcatataaaaattataataacctctctttaattaaaatctgttgttgcttcttgtacatccataccacaatagcctattcattttcttctccaattttcccatccgtaaaatgaagaa

SEQ ID NO: 11217 - DNA, 298 bp, Homo sapiens
  AL049821.6_72957
  Located on chromosome 6
  Distance between a terminus base of telomere on chromosomal short arm and 5'-terminus of this base sequence : 159374602
  Distance between 3'-terminus of neighbour sequence of sequence listing upward to telomere on chrosomal short arm and 5'-terminus of this base sequence : 21940
gatacacctaatgtaaatgacgagttaatgggtgcagcacaccaacatggcacatgtatgcatatgtaacaaacctgcccattgtgcacatgtaccctaaaacttaaagtacaataaaaataaataaataaataaataaataaatactagtttggctgcattgctttgattttcttctttaggggcctgttcatacatacaaaggataccatttacctgtcttctatatgactttctcttaaatcctttcattcttttgttttaatttttatcttcacatcctttatttctgtcactg

SEQ ID NO: 11218 - DNA, 163 bp, Homo sapiens
  Z23670.1_132
  Located on chromosome 6
  Distance between a terminus base of telomere on chromosomal short arm and 5'-terminus of this base sequence : 159494774
  Distance between 3'-terminus of neighbour sequence of sequence listing upward to telomere on chrosomal short arm and 5'-terminus of this base sequence : 119874
tttggtgactcaagaccagtactactcttcactgtgtaattagaaatgaattataatgaaaatgttttattccattctagagtcaactcttttatcaaatacacacacacacacacacacacacacacacacacacacactgcgattaggtaaagaaaataca

SEQ ID NO: 11219 - DNA, 188 bp, Homo sapiens
  D6S420
  Located on chromosome 6
  Distance between a terminus base of telomere on chromosomal short arm and 5'-terminus of this base sequence : 159494828
  Distance between 3'-terminus of neighbour sequence of sequence listing upward to telomere on chrosomal short arm and 5'-terminus of this base sequence : -109
aatgaaaatgttttattccattctagagtcaactcttttatcaaatacacacacacacacacacacacacacacacacacacacactgcgattaggtaaagaaaatacaaaaatgtatgtggaaggtagatttttatggtttaaaaaaatcatattttaatcttagaaaagatggttgactgtggaat

SEQ ID NO: 11220 - DNA, 422 bp, Homo sapiens
  chr6.fa.O7frz.162634557
  Located on chromosome 6
  Distance between a terminus base of telomere on chromosomal short arm and 5'-terminus of this base sequence : 159581689
  Distance between 3'-terminus of neighbour sequence of sequence listing upward to telomere on chrosomal short arm and 5'-terminus of this base sequence : 86673
aataaatcatgaagctttggacaaaaacgtctgggaaaaaataggaacgacaatttgaaaaagacaaaaaaaacccacctttacaagccaccagagagctacacaatggtagaagattttaaacttctataacccaatgggatttttttagtttccctacaggaaattcccatagtctagaaggctgggtttctggactggcaaaattgctttcgtaatcattgccaataatgcaagagctgtgtgtgtgtgtgtgtgtgtgtgtgtgtgaaatacgcattcttctaccatggagtagtgtccaacctgagcttggctgtggcacacaatgatggagtgatttcgggcctcccaagtttgattacatagtaaacggccttgctgttcccagggagaaagtctgaagtctacagcaactagag

SEQ ID NO: 11221 - DNA, 313 bp, Homo sapiens
  AL049548.6_45142
  Located on chromosome 6
  Distance between a terminus base of telomere on chromosomal short arm and 5'-terminus of this base sequence : 159757709
  Distance between 3'-terminus of neighbour sequence of sequence listing upward to telomere on chrosomal short arm and 5'-terminus of this base sequence : 175598
gaggtcaggagatcgaaaccatcctggctaacacggtgaaaccccgtctctactaagagtacaaaaaattatccaggcgtggtggtgggcgcctgtagtcccagctactcgggaggctgaggcaggagaatggcatgaacccgggaggcggagcttgcagtgagccaagattgcaccactgcactccagcctgggaaacagtgtaaaactccgtctcaaacaaacaaacaaacaaacaaacaaacacaactctgttttggaactatgtaattaattctgtgaaaaaaatttctttgtggatagaaattgttag

SEQ ID NO: 11222 - DNA, 393 bp, Homo sapiens
  chr6.fa.O7frz.163054737
  Located on chromosome 6
  Distance between a terminus base of telomere on chromosomal short arm and 5'-terminus of this base sequence : 159926934
  Distance between 3'-terminus of neighbour sequence of sequence listing upward to telomere on chrosomal short arm and 5'-terminus of this base sequence : 168912
taactaatgataggtttgccataccacttctaattatttttgttatttatttgtacccaattatattggctggtatgtgactactgactttggtgggaatgttcttaaaacttagcactgatgctggctatatacaaacatactctcatacacacacacacacacacacacacacaccactatgaagattttatacaaatcagaattaagtgcaaatttcatagaacttattttgcatttggatgggtacagagtttcttctttgggttattactaagataaattatattaatataattcataatattgaattatccctacattcctagaagactcccccatttggtaacacattactgtattaacaaactgctaagtctattctaggtcaca

SEQ ID NO: 11223 - DNA, 263 bp, Homo sapiens
  D6S290
  Located on chromosome 6
  Distance between a terminus base of telomere on chromosomal short arm and 5'-terminus of this base sequence : 160103603
  Distance between 3'-terminus of neighbour sequence of sequence listing upward to telomere on chrosomal short arm and 5'-terminus of this base sequence : 176276
gtttgctggatgagtgggagagtaaataactaggaaaatatgtttcttatacttagagtccagtgatgactgaggtaacttagaaaaatgggtcaaattaagtagtccaagattattttttattattttgaaaacttaatgaaaactagggacctttttccagaaatacatatgtgtatatacacacacatgcaaacacacacacacacacacacacacacacacacacacacatataatactttcagagcattcaccaaatc

SEQ ID NO: 11224 - DNA, 425 bp, Homo sapiens
  AL358992.8_117222
  Located on chromosome 6
  Distance between a terminus base of telomere on chromosomal short arm and 5'-terminus of this base sequence : 160128328
  Distance between 3'-terminus of neighbour sequence of sequence listing upward to telomere on chrosomal short arm and 5'-terminus of this base sequence : 24462
gtcgaatgtacagattgtgaagattttttctcactctgtgggttgtctgttaactctgcgattattattattattattattatatgctgtgcaaaagctttttattttaattaagtctcatctatttatctgtgtttttattgcatttgcttttgggttcttgatcataaagtctttgcctaagccaatgtctagaagggtttttccaatgttatctgttagaatctttatggtttcaggttttacatttaagtctttgatccatcttgagttgattttttaataaagtgagaggtgaggatctagtttcattcttctacatgtggcttgccaattatctcagcaccatttgttgaatagggtgtcctttctccacttgatgcttttatttgctatgtcaacagtcagttggctgtaagtatttg

SEQ ID NO: 11225 - DNA, 191 bp, Homo sapiens
  AL133269.17_3050
  Located on chromosome 6
  Distance between a terminus base of telomere on chromosomal short arm and 5'-terminus of this base sequence : 160194077
  Distance between 3'-terminus of neighbour sequence of sequence listing upward to telomere on chrosomal short arm and 5'-terminus of this base sequence : 65324
tgtcaccagtaatggttagtatgagaagcaagtatctgtatgtgttcattgtgcatatctagaattatatatttttaaatttcattaaactgaattatgcaatgttctaatgtctgtgtgtgtgtgtgtgtgtgtgtgtgtgtgtgtacacagagagaaagcgagtgccttaaggctagcgaacatagcta

SEQ ID NO: 11226 - DNA, 346 bp, Homo sapiens
  AC015703.3_69133
  Located on chromosome 6
  Distance between a terminus base of telomere on chromosomal short arm and 5'-terminus of this base sequence : 160450613
  Distance between 3'-terminus of neighbour sequence of sequence listing upward to telomere on chrosomal short arm and 5'-terminus of this base sequence : 256345
tgctgttaagtttcctctagttactcttctcctctccgtagttcttttaaacaacgagtccacattcaaagagatgtttggctcacttcctagtctatctccagtctttcctttcctggttctagtttcctcttcaattctgatgagcttctctctaccagcacctctgcttttacatttgtatgtcagcaacttgctttatactttaggcaattttgatggactctttactgccaacatacacacacacacacacacacacacacacacacttcaatataataagggttttgtttttagctaccaggaagggtcataaaaggatgcattgactaatgactcttag

SEQ ID NO: 11227 - DNA, 135 bp, Homo sapiens
  DISO7_10002256
  Located on chromosome 6
  Distance between a terminus base of telomere on chromosomal short arm and 5'-terminus of this base sequence : 160479150
  Distance between 3'-terminus of neighbour sequence of sequence listing upward to telomere on chrosomal short arm and 5'-terminus of this base sequence : 28191
gcacaatgccttctaaatacacacaaattctctctctctctctctctcacacacacacagacacacacacacacaccacatacacacaacacacaatagaaccagaactcaaccccttgctttctacagaccttg

SEQ ID NO: 11228 - DNA, 101 bp, Homo sapiens
  DISO7_10002257
  Located on chromosome 6
  Distance between a terminus base of telomere on chromosomal short arm and 5'-terminus of this base sequence : 160569598
  Distance between 3'-terminus of neighbour sequence of sequence listing upward to telomere on chrosomal short arm and 5'-terminus of this base sequence : 90313
tgctagtgaagaataggctggggtgtctgtgtgtgtgtgtgtgtgtgtgtgtgtgtgtgtgaatgattctgaggtaggagaaggttctgatgtacgggaag

SEQ ID NO: 11229 - DNA, 296 bp, Homo sapiens
  DISO7_10002258
  Located on chromosome 6
  Distance between a terminus base of telomere on chromosomal short arm and 5'-terminus of this base sequence : 160572958
  Distance between 3'-terminus of neighbour sequence of sequence listing upward to telomere on chrosomal short arm and 5'-terminus of this base sequence : 3259
ggaatgatgtgaagtaataggtacctatgacttctaaacttattgtgtatgaatttattcacatctatcatcatttatacaaaaaacacttaaaatttcacaatctctcctgttcccacaatttataacagaaaaaaatgaggaaaacaattaataggaaaaattactgttagacaatacaatacaatacaatacaatacaatacaatacaatacaatacaatacaatgcaatgcaatgcaatacagtacaatgcatgcttctgcaaattttgtagagaacatatgtgatgacagc

SEQ ID NO: 11230 - DNA, 211 bp, Homo sapiens
  DISO7_10002260
  Located on chromosome 6
  Distance between a terminus base of telomere on chromosomal short arm and 5'-terminus of this base sequence : 160612923
  Distance between 3'-terminus of neighbour sequence of sequence listing upward to telomere on chrosomal short arm and 5'-terminus of this base sequence : 39669
ctaatttagaattggacagcagtcatattttggcataggttagtaaaataaatttgatccttccttccttccttccttccttccttccttccttccttccctccctccctccctccctccctccttccctccttccttccctccctcgctctctccctccctccctccctgtgcttttgagattttaaagaagttattcctctggtggttt

SEQ ID NO: 11231 - DNA, 109 bp, Homo sapiens
  DISO7_10002263
  Located on chromosome 6
  Distance between a terminus base of telomere on chromosomal short arm and 5'-terminus of this base sequence : 160681298
  Distance between 3'-terminus of neighbour sequence of sequence listing upward to telomere on chrosomal short arm and 5'-terminus of this base sequence : 68164
ttgatacagacagcctcccctctcccactctttctctctctctctctctctctctctctctgtttcttcttttaacacttttggttctgcgcccatgacaattgacatt

SEQ ID NO: 11232 - DNA, 417 bp, Homo sapiens
  chr6.fa.O7frz.163906492
  Located on chromosome 6
  Distance between a terminus base of telomere on chromosomal short arm and 5'-terminus of this base sequence : 160763680
  Distance between 3'-terminus of neighbour sequence of sequence listing upward to telomere on chrosomal short arm and 5'-terminus of this base sequence : 82273
accatcttcctttcttactgacagctttatggattttggattgtttaaccatccattacaattgtgtaagttaattccttgtaataaatcatctatctatcatctatctatctatctatctatctatctatctatctatctatccacatatcctgcaagttctgcttctctggttgaacccagcttggttcattaatgtctcctctaagaaattattctctacctccatattacaaagtcattctcctatattttcttctagaaactttatggcttcagcttatacatttaagcttatgacccatcttgaatttttttgtgaatattgtagtgtaattttttccctatttgggtattcccttttccagtaatgtttattgaaaagtctttgttgttgatactgaattaccttgtcat

SEQ ID NO: 11233 - DNA, 166 bp, Homo sapiens
  Z23924.1_81
  Located on chromosome 6
  Distance between a terminus base of telomere on chromosomal short arm and 5'-terminus of this base sequence : 160833585
  Distance between 3'-terminus of neighbour sequence of sequence listing upward to telomere on chrosomal short arm and 5'-terminus of this base sequence : 69488
gtagtccttggacaaattgattaggaagtaaagtctttgtttctgttttattttcccttgtgttaattccctgtgtgtgtgtgtgtgtgtgtgtgtgtgtgtgttttaaagaagaacaaacatgcatagcagagaaatgaatattaattcctttaacagtcaccaa

SEQ ID NO: 11234 - DNA, 166 bp, Homo sapiens
  D6S441
  Located on chromosome 6
  Distance between a terminus base of telomere on chromosomal short arm and 5'-terminus of this base sequence : 160833593
  Distance between 3'-terminus of neighbour sequence of sequence listing upward to telomere on chrosomal short arm and 5'-terminus of this base sequence : -158
tggacaaattgattaggaagtaaagtctttgtttctgttttattttcccttgtgttaattccctgtgtgtgtgtgtgtgtgtgtgtgtgtgtgtgttttaaagaagaacaaacatgcatagcagagaaatgaatattaattcctttaacagtcaccaaatattgtt

SEQ ID NO: 11235 - DNA, 361 bp, Homo sapiens
  AL118517.17_65789
  Located on chromosome 6
  Distance between a terminus base of telomere on chromosomal short arm and 5'-terminus of this base sequence : 160891186
  Distance between 3'-terminus of neighbour sequence of sequence listing upward to telomere on chrosomal short arm and 5'-terminus of this base sequence : 57427
tttcctaagacagaaaggcttccaccacagatcatgtaggatatattagaaaatactcagaaatgatgaatggagcagggttgctgagttaccaacaagctttagataaaagtattcttttatgttctaaatgaatttggtttacatatatattacaaaagccaaaatattttatgtacatatattaaaatccatatatatgtatatataaaagctatatgtatattgctatatgaatatatatatatatatatatatatgtatacacatatgcacacatatatctcatagcctaaatcttccacaaccattttgtagcttaaatccttgagaacctaagtcagttgtaagctgttcacct

SEQ ID NO: 11236 - DNA, 365 bp, Homo sapiens
  chr6.fa.O7frz.164161418
  Located on chromosome 6
  Distance between a terminus base of telomere on chromosomal short arm and 5'-terminus of this base sequence : 161037778
  Distance between 3'-terminus of neighbour sequence of sequence listing upward to telomere on chrosomal short arm and 5'-terminus of this base sequence : 146231
ttaaattcatccatttaaactcaccctcaccttgcataaatttatcatatctctgcaaatcatgcctatacccaaagtttccttgatcagtaagcaaagtaattttattttattttattttattttattttattttattttattttattttattttatttttgccagtccgataacaactccttctctgacctctggcttatgtttgccttgtttcttctgatatctacaatgaatcaacaatgagttcacaacacaaggaaataacttggctctgtccagaaaacatcaggtgtctgattgactgtgtctattattgttggttgtagctttgttgtttcttagtttaacaaggtttctatgcct

SEQ ID NO: 11237 - DNA, 180 bp, Homo sapiens
  HUMUT5033
  Located on chromosome 6
  Distance between a terminus base of telomere on chromosomal short arm and 5'-terminus of this base sequence : 161155505
  Distance between 3'-terminus of neighbour sequence of sequence listing upward to telomere on chrosomal short arm and 5'-terminus of this base sequence : 117362
ggcaaatctaagagctatctgcagataacctgtcacaggacttttcagccttcataaacatgtgagtcaattaccctaataagtcccctttcatctatctatctatctatctatctatctatctatctatcttattggtggtgtctttctgaaaaatcctgactaatacaacccactctt

SEQ ID NO: 11238 - DNA, 184 bp, Homo sapiens
  G10083
  Located on chromosome 6
  Distance between a terminus base of telomere on chromosomal short arm and 5'-terminus of this base sequence : 161155539
  Distance between 3'-terminus of neighbour sequence of sequence listing upward to telomere on chrosomal short arm and 5'-terminus of this base sequence : -146
acaggacttttcagccttcataaacatgtgagtcaattaccctaataagtcccctttcatctatctatctatctatctatctatctatctatctatcttattggtggtgtctttctgaaaaatcctgactaatacaacccactcttttgttataacagtgcggtattagtcagggttctctaaa

SEQ ID NO: 11239 - DNA, 229 bp, Homo sapiens
  AL136094.13_84256
  Located on chromosome 6
  Distance between a terminus base of telomere on chromosomal short arm and 5'-terminus of this base sequence : 161229368
  Distance between 3'-terminus of neighbour sequence of sequence listing upward to telomere on chrosomal short arm and 5'-terminus of this base sequence : 73645
atttaaagttctgcacttcatgactcatcatagaagagataaaatgatttctctctctctctctctctctgtgtgtgtgtgtgtgtgtgtgtgtgtgtgtgtgtgtgtgtgtgtgtgtggtgactgttctaaattgctaaaatggtttattaccaatgtttggtttgtcaaacccataacactgggaagacagtcaaaattttaggtacatttctgctaactgggtaga

SEQ ID NO: 11240 - DNA, 235 bp, Homo sapiens
  Z67059
  Located on chromosome 6
  Distance between a terminus base of telomere on chromosomal short arm and 5'-terminus of this base sequence : 161302403
  Distance between 3'-terminus of neighbour sequence of sequence listing upward to telomere on chrosomal short arm and 5'-terminus of this base sequence : 72806
ctccagatgtaatcttctgtgatccagcaaatatgacagttcaggattaagagacctttaatgttaatttcattactttttatgttgtaattgaaagtcacataaaaatgtactctgcttcctagaaactttgccacagatacacacacacacacacacacacacacacacacacacacacaccactcatacaaaatgatacaaaattatgataagtatttggttactttcattt

SEQ ID NO: 11241 - DNA, 428 bp, Homo sapiens
  AL132774.20_6907
  Located on chromosome 6
  Distance between a terminus base of telomere on chromosomal short arm and 5'-terminus of this base sequence : 161450071
  Distance between 3'-terminus of neighbour sequence of sequence listing upward to telomere on chrosomal short arm and 5'-terminus of this base sequence : 147433
gtggtccgtgaatgagaagctctatagacaagtgttaggaaatgtggcctaccttattttggtcatggggactgataatatgtataagcatttaaaaggctgtgaaaagccctactctctctccctctctctctctctctctctctctctgtgtgtgtgtgtgtgtgtgtgtgtgtgtgtgtgtgtgtgttgcatacatacacatttcattttctaagccaaagttcagttctccagttcatctgagctcaggcccagtttttcaagggacaccttataacatctcacagaataaaggtttcactaagcaatgtttaaaagccactgtagatcatcagtcccagttaggcatgaatctattcaaaattcaatgtttcactggaataattggcaaggtctcataattctaggcattaatcagaatccta

SEQ ID NO: 11242 - DNA, 190 bp, Homo sapiens
  AL132774.20_26992
  Located on chromosome 6
  Distance between a terminus base of telomere on chromosomal short arm and 5'-terminus of this base sequence : 161470234
  Distance between 3'-terminus of neighbour sequence of sequence listing upward to telomere on chrosomal short arm and 5'-terminus of this base sequence : 19735
ctttgcattttaagcgtactttaccaccgacaccctccccccccagcacacacacacacacacacacacacacacacacaacatagtgaaatggacccgtgggaattatatgatagttgtaatcaaaataaaatgcaatcaatactaaaatacaatttaccaaaggcttacctccttatttgaaactcca

SEQ ID NO: 11243 - DNA, 401 bp, Homo sapiens
  AL132774.20_49436
  Located on chromosome 6
  Distance between a terminus base of telomere on chromosomal short arm and 5'-terminus of this base sequence : 161492491
  Distance between 3'-terminus of neighbour sequence of sequence listing upward to telomere on chrosomal short arm and 5'-terminus of this base sequence : 22067
ctattcacgaagctgaagaacaagaattgcttgaccctgggaggcagaggttgcagtgagccaagatcgcgccactgcactccagccaacagtgagactttgaaaacaaaaaaaaaaaagaaagagagagagagagagaaagaaagaaggaagaaagaacgaaaaagaaagagaaaagaaaaagaagaaagaaaagaaagaaagaaaaagaaaaggaaagaaaaggaagagagaagaaagaaagaaagaaagaaagaaagaaagaaagaaagaaagaaagaaaggaaagaaagaaagaaagaaagaaagaaagaaagaaagaaagaaagagaaatagtgttcaggttgtggttacacaggtcaggaccaatgaaattctgtatttatccatgcatttcaac

SEQ ID NO: 11244 - DNA, 279 bp, Homo sapiens
  AL132774.20_77525
  Located on chromosome 6
  Distance between a terminus base of telomere on chromosomal short arm and 5'-terminus of this base sequence : 161520727
  Distance between 3'-terminus of neighbour sequence of sequence listing upward to telomere on chrosomal short arm and 5'-terminus of this base sequence : 27835
tcaaacttaggtcagctacctaactagttagactcaagaaaggagacatatatatatatatactgagctagtttaacaacaacaactatatatatatatatatatatatatatattttttttttaaacatgatccttcttggtgacattagcaaatgagacaaaacaacatttttagccaacagttataagttcactcctttccaagaccctgccaaatgaatgtgctgctcccttctcctcctcttccataccccagtctattgtctgctctgacagc

SEQ ID NO: 11245 - DNA, 359 bp, Homo sapiens
  AL132774.20_89457
  Located on chromosome 6
  Distance between a terminus base of telomere on chromosomal short arm and 5'-terminus of this base sequence : 161532520
  Distance between 3'-terminus of neighbour sequence of sequence listing upward to telomere on chrosomal short arm and 5'-terminus of this base sequence : 11514
cattatgcctgcacttctctaggggtatacacctggaagtggaactgctggccatgatgtatgcctatcttcaactttactagatgatgacaaattgctttctaaattggttccaccaaaatatatctcttcagcatgggtgagcactctcaataccccacaccctcacaagtaatttgctggctgatttctgtttcttgacccaaatggtggccacgtggttactgtgtgtgtgtgtgtgtgtgtgtgtgtgtgtgtgtatgcatgtgtgtgtatttatggagtattttagatagagagagaacactcttctatgtatatgatacttttcagtataattaacaatttccatgaaacag

SEQ ID NO: 11246 - DNA, 427 bp, Homo sapiens
  AL132774.20_95770
  Located on chromosome 6
  Distance between a terminus base of telomere on chromosomal short arm and 5'-terminus of this base sequence : 161538813
  Distance between 3'-terminus of neighbour sequence of sequence listing upward to telomere on chrosomal short arm and 5'-terminus of this base sequence : 5934
cctatgctactcattcacctctagaaataggttggtttgccagactttatttactccagttcttctaatctagatagttggcctaaataaaggggagaagtataagaaaaatgccatcagaggccaggcaggtctgtgtaaagcatctttaggtaaggcctcagagagtggtgacaactgttataacttggagaattagttaccaggctgagtaatgaaatttacatacttttaaaatattacatacacacacacacacacacacacacacacacacaacttgttctgcagttgtgatccttgggcaaattacgctgataccaaaaattaaattagcagggtacccatctgaaatttgagaacttaaagaaacattccctgattaggctagaggagaggagagagcagtcatctatgtcattagaca

SEQ ID NO: 11247 - DNA, 192 bp, Homo sapiens
  AC073982.1_128912
  Located on chromosome 6
  Distance between a terminus base of telomere on chromosomal short arm and 5'-terminus of this base sequence : 161576048
  Distance between 3'-terminus of neighbour sequence of sequence listing upward to telomere on chrosomal short arm and 5'-terminus of this base sequence : 36808
tgaagttatcaaatacttcaggaactttcaaatctcttcaagctgttttcatgagtttcgtctgtactattaaaatacaccaccaccaccactaagaaaatctggttcaaaaatggcaaaagacatttctcccaagaagatatggaaatggccaataagcacatgcgaaagttgctcaaggtcactagtcat

SEQ ID NO: 11248 - DNA, 148 bp, Homo sapiens
  D6S425
  Located on chromosome 6
  Distance between a terminus base of telomere on chromosomal short arm and 5'-terminus of this base sequence : 161662749
  Distance between 3'-terminus of neighbour sequence of sequence listing upward to telomere on chrosomal short arm and 5'-terminus of this base sequence : 86509
cctgggcaaaatggtgaggccctgcctctacaaaaagtttaaaaattttaaacacacacacacacacacacacacacacacccctatgtttgggaacaatgcaaatgatgtgctatcacatacttctgctatcatcgtactggcagca

SEQ ID NO: 11249 - DNA, 305 bp, Homo sapiens
  AL033376.17_70119
  Located on chromosome 6
  Distance between a terminus base of telomere on chromosomal short arm and 5'-terminus of this base sequence : 161722621
  Distance between 3'-terminus of neighbour sequence of sequence listing upward to telomere on chrosomal short arm and 5'-terminus of this base sequence : 59724
caaatcctatttcaattctgctacccttgaaaagggtggccgggcacagtggctcacgcctgtaatcccagcacttcgggaggctgaggcggatagatcacgaggtcagaagatcgagaccaccttggccaacacggtgaaaacccgcctctactaaacacacacacacacacacacacacacacacacacaaatagccagcgtggtggtgtgcgcctgtaatcccagctacttaggaagctgaggcaggagaatcacttgaacctgggaggtggagcttgcagtgagccaagattataccactg

SEQ ID NO: 11250 - DNA, 242 bp, Homo sapiens
  chr6.fa.O7frz.165086899
  Located on chromosome 6
  Distance between a terminus base of telomere on chromosomal short arm and 5'-terminus of this base sequence : 161753394
  Distance between 3'-terminus of neighbour sequence of sequence listing upward to telomere on chrosomal short arm and 5'-terminus of this base sequence : 30468
taaatgagccagattgtctagttttatcaacatatataaatatgtgagttgataaaaataagcctagatcacacctaaatcatcctgtacactctatataccaccctcattataccatacagtattcaagttagccatgaagaaagcaactatctttttaagaatttatggtacacacacacacacacacacacacacacacacacacaaatatgaaatgttcatacctacactcacaaggt

SEQ ID NO: 11251 - DNA, 151 bp, Homo sapiens
  Z67389
  Located on chromosome 6
  Distance between a terminus base of telomere on chromosomal short arm and 5'-terminus of this base sequence : 161889478
  Distance between 3'-terminus of neighbour sequence of sequence listing upward to telomere on chrosomal short arm and 5'-terminus of this base sequence : 135842
tttgcagagacaggatcttgctttttgcccaggctttgatcaagtcttaacctccctacacacacacacacacacacacacacacacacacacacacacaacaatgctgaatccattttcccaccccttctggggacttctttatcaatca

SEQ ID NO: 11252 - DNA, 165 bp, Homo sapiens
  Z24122.1_145
  Located on chromosome 6
  Distance between a terminus base of telomere on chromosomal short arm and 5'-terminus of this base sequence : 162088217
  Distance between 3'-terminus of neighbour sequence of sequence listing upward to telomere on chrosomal short arm and 5'-terminus of this base sequence : 198588
gaccacgtgcagatactattttaggcactaggattcaacagtacaaaacagaccaaatgaaaaaccaaaacaagcctctgccttcatggagtttacatttcatttctgtgtgtgtgtgtgtgtgtgtgtgtgtgtgtgtgtgtgtgtactagaaatgcatgtttg

SEQ ID NO: 11253 - DNA, 175 bp, Homo sapiens
  D6S448
  Located on chromosome 6
  Distance between a terminus base of telomere on chromosomal short arm and 5'-terminus of this base sequence : 162088283
  Distance between 3'-terminus of neighbour sequence of sequence listing upward to telomere on chrosomal short arm and 5'-terminus of this base sequence : -99
aaaacaagcctctgccttcatggagtttacatttcatttctgtgtgtgtgtgtgtgtgtgtgtgtgtgtgtgtgtgtgtgtactagaaatgcatgtttgtttttcctcatttagtgccattttatttattgaaagttgtttacattttaattgcagagaggattcttgttgggaa

SEQ ID NO: 11254 - DNA, 101 bp, Homo sapiens
  DISO7_10017677
  Located on chromosome 6
  Distance between a terminus base of telomere on chromosomal short arm and 5'-terminus of this base sequence : 162136756
  Distance between 3'-terminus of neighbour sequence of sequence listing upward to telomere on chrosomal short arm and 5'-terminus of this base sequence : 48298
aatgattcagcattgcaatcctgttctctctctctctctctctctctctctctctctctctctgtctctctctttttctgaccctcaaattcacgctatcc

SEQ ID NO: 11255 - DNA, 184 bp, Homo sapiens
  D6S473
  Located on chromosome 6
  Distance between a terminus base of telomere on chromosomal short arm and 5'-terminus of this base sequence : 162264994
  Distance between 3'-terminus of neighbour sequence of sequence listing upward to telomere on chrosomal short arm and 5'-terminus of this base sequence : 128137
agaacttggtatttcctgccagtgcttttgaacttcagactacctcttctctctctctctctcatgctcacacacacacacacacacacacacacacacacacacacctcctttcctcaggaggccacagacagcatttccacaagcctcactagcaatcctaatgaaaactcctcaaggtggc

SEQ ID NO: 11256 - DNA, 117 bp, Homo sapiens
  D6S1556
  Located on chromosome 6
  Distance between a terminus base of telomere on chromosomal short arm and 5'-terminus of this base sequence : 162315631
  Distance between 3'-terminus of neighbour sequence of sequence listing upward to telomere on chrosomal short arm and 5'-terminus of this base sequence : 50453
gacaaattggcccgctttgtgttttgtgtggacactgaattctaatgtgtgtgtgtgtgtgtgtgtgtgtgtgtgtgtgtgtgttgagtaattcctttgttgattgactacagtagg

SEQ ID NO: 11257 - DNA, 356 bp, Homo sapiens
  AL136228.8_87011
  Located on chromosome 6
  Distance between a terminus base of telomere on chromosomal short arm and 5'-terminus of this base sequence : 162354232
  Distance between 3'-terminus of neighbour sequence of sequence listing upward to telomere on chrosomal short arm and 5'-terminus of this base sequence : 38484
gtctttcctaagtgctgagtaagtataattgaaacttggattctaattattattgctgggttagaaagcattgaagatactgttaggcagatatatgtctatgtatctgtctacacacacacacacacacacacacacacacacacacctgagatggggtagatcattgtatttttgtgtctaccagcaagaaaaggaaggaaaaactaaggtgatgtgtatttttagtagagatcttccataatttaaagtcattttgttattttctttgctttcacacaaaaaatatgtggaccttttctgtgtaccttactccagtaaatctattttgtctgttctcatgctactcatttgta

SEQ ID NO: 11258 - DNA, 160 bp, Homo sapiens
  D6S1577
  Located on chromosome 6
  Distance between a terminus base of telomere on chromosomal short arm and 5'-terminus of this base sequence : 162451664
  Distance between 3'-terminus of neighbour sequence of sequence listing upward to telomere on chrosomal short arm and 5'-terminus of this base sequence : 97076
tgacattaggaggcactggagagtaaagcgcttcatggaaagtgtccatatattcttggaatacacacacacacacacacacacacacacacacacacacactctccgttgaaaattgataggatgatcacaaatgtatccaaacagccagacaagttaa

SEQ ID NO: 11259 - DNA, 210 bp, Homo sapiens
  AL031773.1_38269
  Located on chromosome 6
  Distance between a terminus base of telomere on chromosomal short arm and 5'-terminus of this base sequence : 162750699
  Distance between 3'-terminus of neighbour sequence of sequence listing upward to telomere on chrosomal short arm and 5'-terminus of this base sequence : 298875
cagtgatgttctataaggccagtgtgtgtgtgtgtgtgtgtgtgcgcacgcatgtgtgtgtatgtgtgatgtacatacacagagcattcatttgtaaatgtagtgattaatgtcaatctcccaggctcaaatacactttccttaaaagtatatatcaataatagctgctgattagaatatatattgtgtaacctagtaatcacttcgttg

SEQ ID NO: 11260 - DNA, 374 bp, Homo sapiens
  AL031773.1_54957
  Located on chromosome 6
  Distance between a terminus base of telomere on chromosomal short arm and 5'-terminus of this base sequence : 162767198
  Distance between 3'-terminus of neighbour sequence of sequence listing upward to telomere on chrosomal short arm and 5'-terminus of this base sequence : 16289
aaagcatgtcagctactgagtaaccagtactgagttcttcttgggggactggttgaaatgctatctggtttgtgaaggggaagggtggttgatagaacagataagtgtatacacacagggcagaagccagttagcaaaaaggatgaaaacttttgccttggcgatgccaaggggagagcagggaccgagaaagcagttagacactgtggcgtgtgtgtgtgtgtgtgtgtgtgtgtgtgtgtgtgtgtgtgtgtgctgggggggttggtgagggtgggggtgctgtgcagtgcatctacttttatttttgattttaggcatttgctctgcactctgaaccttaaaattttattacattgcttcctttccattat

SEQ ID NO: 11261 - DNA, 375 bp, Homo sapiens
  AL031773.1_59386
  Located on chromosome 6
  Distance between a terminus base of telomere on chromosomal short arm and 5'-terminus of this base sequence : 162771710
  Distance between 3'-terminus of neighbour sequence of sequence listing upward to telomere on chrosomal short arm and 5'-terminus of this base sequence : 4138
gccaaagtcaaagctacattactcacccaacacaggacataagaaattacattttaaaatctcaaatagtaattttttgggccaagaatgcatcacaactacagggtctgcctgaataaacacagaaacacacacacacacacacacacacacacacacacagttatttggagtaaaatataaagtcaatttcctggcaccttaaatttaagtttatctaatcacagcaaaaggctcaataattgtctagagaattgtgatggtgaaaatgtccattttaaacaaatcagatgctatgttaacttttgatgagtataatgtgcattactgatgatcaatttaccagcaggctattgtatcaggagctctgtacaa

SEQ ID NO: 11262 - DNA, 259 bp, Homo sapiens
  D6S442
  Located on chromosome 6
  Distance between a terminus base of telomere on chromosomal short arm and 5'-terminus of this base sequence : 162771721
  Distance between 3'-terminus of neighbour sequence of sequence listing upward to telomere on chrosomal short arm and 5'-terminus of this base sequence : -364
agctacattactcacccaacacaggacataagaaattacattttaaaatctcaaatagtaattttttgggccaagaatgcatcacaactacagggtctgcctgaataaacacagaaacacacacacacacacacacacacacacacacacagttatttggagtaaaatataaagtcaatttcctggcaccttaaatttaagtttatctaatcacagcaaaaggctcaataattgtctagagaattgtgatggtgaaaat

SEQ ID NO: 11263 - DNA, 432 bp, Homo sapiens
  AL133474.9_63821
  Located on chromosome 6
  Distance between a terminus base of telomere on chromosomal short arm and 5'-terminus of this base sequence : 162841177
  Distance between 3'-terminus of neighbour sequence of sequence listing upward to telomere on chrosomal short arm and 5'-terminus of this base sequence : 69197
atttgaggacatgctttataacagccttttctccactaagaatcacaatgcaatttagcatattaaagattctgagaagtcttgacatgaggaaattggttttattttgtttaattcactattgtcttaattaatttgataatgaactctctctctgtgtgtgtgtgtgtgtgtgtgtgtgtgtgtgtatctagtactaaaggtggtactacataaatgtgaccaagatttagatttactaggttattcttttcttatttagcatgggctatttaaagtcttggaatatactttggatttgatttattctgcacatttcacattcaaattctacatttttatagggcttgattatctggaaatgtcattaacttattctcactgtccttctgcttcctccgatctatttataaggtcagttcctgaagctta

SEQ ID NO: 11264 - DNA, 277 bp, Homo sapiens
  AL133474.9_33793
  Located on chromosome 6
  Distance between a terminus base of telomere on chromosomal short arm and 5'-terminus of this base sequence : 162871179
  Distance between 3'-terminus of neighbour sequence of sequence listing upward to telomere on chrosomal short arm and 5'-terminus of this base sequence : 29570
ccaatgtcttcctttacctctttaaagtatcatggaaaataaaaaggagatacaaaaaagtgcttagaaattttcaagatccttgaatcaaaacagaactatctttctatattttatatatctgaaaatgtttttgattgtcatgtatagttatatttgcttcatcacataccaacacacacacacacacacacacacacacacacacacacactcctgcagttattcagttcccttttctcatctcatattcctgtcattaaatgagttgtacggc

SEQ ID NO: 11265 - DNA, 281 bp, Homo sapiens
  AL133474.9_27147
  Located on chromosome 6
  Distance between a terminus base of telomere on chromosomal short arm and 5'-terminus of this base sequence : 162877782
  Distance between 3'-terminus of neighbour sequence of sequence listing upward to telomere on chrosomal short arm and 5'-terminus of this base sequence : 6326
agtaacaggtgctttgaggactgtgtcactgcaaaggttttaaaaagggaaaactgtatcacagaattgcatgcaccttcaaacaaaaatattattgaaggatattccctaaagataatttttttctttccctaattgtttgaagtgttgccaggttcctggcaaaaagaacatgaaaggaaaatactgaataacatacacagtatacatatttataacacttctatacacacacacacacacacacacacacacacgcctccttctagtgcttattgctg

SEQ ID NO: 11266 - DNA, 266 bp, Homo sapiens
  chr6.fa.O7frz.166445661
  Located on chromosome 6
  Distance between a terminus base of telomere on chromosomal short arm and 5'-terminus of this base sequence : 162979331
  Distance between 3'-terminus of neighbour sequence of sequence listing upward to telomere on chrosomal short arm and 5'-terminus of this base sequence : 101268
tcttctgtaatgcaacctacagtgtgcaggcatcagttggacctctccacttcaccccgggttattcagtttctccagagagacaaaaccaatagtaccccactgtgcgtgcacacacacacacacacacacacactcacacgcacacacacagacacacacgatttattaggggaattggctcatgcaattatggatgctgagaagtacaattggccatctgcaggctggacactctgggatgctggtagtttgactcagttcaa

SEQ ID NO: 11267 - DNA, 432 bp, Homo sapiens
  chr6.fa.O7frz.166313861
  Located on chromosome 6
  Distance between a terminus base of telomere on chromosomal short arm and 5'-terminus of this base sequence : 163081980
  Distance between 3'-terminus of neighbour sequence of sequence listing upward to telomere on chrosomal short arm and 5'-terminus of this base sequence : 102383
aggaatagatggtgttccttatgacctgggcaaaagctacttttagaagggggtttagaaataatgccagagccaggtgcagtggctcacacctgtaaccccagcactttgggaggccaaggcggatggatcaaggggtcaagagattgagaccatcctggccaacatagtgaaaccccatctgtactataaatacaaaaattagctgggtgtggtagcgagcacctgtaatcccagctactctggaggcggaggcaggagaattgcttgaacccgggaggcggaggttgcagtgagccgagatcgcgccactgcactgcagcctagtgacagagtgagactctgtctcaaaacaaaacaaaacaaaacaaaacaaaaacaaacaaacaaacaaaatcaaataatgccagagagaccagttggttaaggaat

SEQ ID NO: 11268 - DNA, 172 bp, Homo sapiens
  D6S1708
  Located on chromosome 6
  Distance between a terminus base of telomere on chromosomal short arm and 5'-terminus of this base sequence : 163196962
  Distance between 3'-terminus of neighbour sequence of sequence listing upward to telomere on chrosomal short arm and 5'-terminus of this base sequence : 114550
gtggcagaatctccaaggatacattgttaggagaaataaggaaaaatatgtctctgtgtgtgtgtgtgtgtgtgtgtgtgtgtgtgtgtgtgtgtgtgtatgattgtatttggagggtaagatggggaaaatacacacacttatttttgtgcaaagccccattggaattgca

SEQ ID NO: 11269 - DNA, 241 bp, Homo sapiens
  Z67268
  Located on chromosome 6
  Distance between a terminus base of telomere on chromosomal short arm and 5'-terminus of this base sequence : 163466454
  Distance between 3'-terminus of neighbour sequence of sequence listing upward to telomere on chrosomal short arm and 5'-terminus of this base sequence : 269320
ccctgagtgccaaaaattctgctttcatatctctgaaatttgccaaactataaaaacctcagatctcagtttgggtttttatccccctcgccaaaaaggcaaaaaattactttccacactttcaaagtaagaatatcagtcacacacacacacacacacacacacacacacataaaaatctcagttcacaaatccagtaagtcttttacggtgtgtccccctgtttggactaatgggctgc

SEQ ID NO: 11270 - DNA, 312 bp, Homo sapiens
  chr6.fa.O7frz.166891536
  Located on chromosome 6
  Distance between a terminus base of telomere on chromosomal short arm and 5'-terminus of this base sequence : 163773368
  Distance between 3'-terminus of neighbour sequence of sequence listing upward to telomere on chrosomal short arm and 5'-terminus of this base sequence : 306673
ccacctattcatcctttaagacccaacccatatggcccctccatgggagaccctcccattacatatttgtcccacctgcaacactgaattaaatgtagatttatatgtatataatatatacatatattatatatatattatatatataatatatatatatatatatatatatatatatatatatatacacacacatatactttaagttctagggtacttgtgcacaacgtgcaggtttgttacatatgtatacatgtgccaggttggtgtgctgcacccattaacttgtcattaacattaggtatttctcct

SEQ ID NO: 11271 - DNA, 445 bp, Homo sapiens
  chr6.fa.O7frz.167020388
  Located on chromosome 6
  Distance between a terminus base of telomere on chromosomal short arm and 5'-terminus of this base sequence : 163899155
  Distance between 3'-terminus of neighbour sequence of sequence listing upward to telomere on chrosomal short arm and 5'-terminus of this base sequence : 125475
gtcaatttgccagacttatttatgtgtcaagtgcctttaatgataaaaaaggattgatcctgcattcaagaatgactcaaaggtgatgatggaggctgccctggtgatggcctcatcctggcaggacagatctgcctgctgctgttagaggcaaagtggtggctaggcacaatggctcacacttggaatcccagcactttgggaggctgagggaggagaatcacttcagcccaggagtttgagaccagcctaggcaacatggtgaaacaacatctctacaaaaaaagaaagacagaaagagaaagaaagaaagagagagagagagagagagaaagaaagaaagaaagaaagaaagaaagaaagaaagaaagaaagaaagaaagaaagttagttttaattatctgggcatggtggtgcattcctgtagtcctagtactcacgaggc

SEQ ID NO: 11272 - DNA, 239 bp, Homo sapiens
  HUMUT7908
  Located on chromosome 6
  Distance between a terminus base of telomere on chromosomal short arm and 5'-terminus of this base sequence : 163899362
  Distance between 3'-terminus of neighbour sequence of sequence listing upward to telomere on chrosomal short arm and 5'-terminus of this base sequence : -238
tgagggaggagaatcacttcagcccaggagtttgagaccagcctaggcaacatggtgaaacaacatctctacaaaaaaagaaagacagaaagagaaagaaagaaagagagagagagagagagagaaagaaagaaagaaagaaagaaagaaagaaagaaagaaagaaagaaagaaagaaagttagttttaattatctgggcatggtggtgcattcctgtagtcctagtactcacgaggct

SEQ ID NO: 11273 - DNA, 467 bp, Homo sapiens
  chr6.fa.O7frz.167146523
  Located on chromosome 6
  Distance between a terminus base of telomere on chromosomal short arm and 5'-terminus of this base sequence : 164025273
  Distance between 3'-terminus of neighbour sequence of sequence listing upward to telomere on chrosomal short arm and 5'-terminus of this base sequence : 125672
gagttcactgcacactatcaacctgtccacctgatctcacctacacaagatccctgattcctgaagattgcagctgggtcctaggagggaatgtcccaagagtgagcattccaagagtcccaagtagaagcagcaagattcttataatctagccttgaacgtcataaagcatcaatccagctacagtccagattcaaggcggggacacatcagagtgtgaataaaggagtcagggcttctgggtgggagaaatcttaggagaaggaacaagataggcagatagatagatagatagatagatagatagatagatagatagatagaacataaaatttatagatatatttagatacattatatatgtatttagatatatatgtatatatagccagatattgcacattacacagtgtgctttatgagcatttcattcacaaaagtgagtcctggtagctagatataagcat

SEQ ID NO: 11274 - DNA, 402 bp, Homo sapiens
  chr6.fa.O7frz.167367756
  Located on chromosome 6
  Distance between a terminus base of telomere on chromosomal short arm and 5'-terminus of this base sequence : 164245581
  Distance between 3'-terminus of neighbour sequence of sequence listing upward to telomere on chrosomal short arm and 5'-terminus of this base sequence : 219841
gcctttgtctgtaatatgagttattaactccagaggactggaatcaatagaatagaataatagaatagaatcaattgtgctcacatatgcacgcacacacacacacacacacacacacacacacagatttattataaggaattggctcatatgcttatggagttttgcatttccgaaacctgcagtatgggctggcaggtggtaagccgatggtctgatgaagtcaaagacagcttgctggagaattccttcttgcttaggtggggctggtcttttgattatagttaggacttcaaactaaatggataaggcccacccacattatggaaaacaatctgttattctcagagtctccgttgaaattgttaattccatttacagtaccttccaagatcacatgta

SEQ ID NO: 11275 - DNA, 267 bp, Homo sapiens
  AL049820.23_168327
  Located on chromosome 6
  Distance between a terminus base of telomere on chromosomal short arm and 5'-terminus of this base sequence : 164501718
  Distance between 3'-terminus of neighbour sequence of sequence listing upward to telomere on chrosomal short arm and 5'-terminus of this base sequence : 255735
actggcttgttgaaattacattattttgccaccagaattgctaatgcagctgttgttgcaggcacgctggtggattagccacaccaaaaattgaccagggcttgacggtcttattttctgttttgattgtgtgtgtgtatatatatatatatatatatattttggcgggggggcacatagtagttttccctcttaaaatattaaatttaaaataacctcgactgagtctctccttctcagtactgctttggaagagtcaccatgtaa

SEQ ID NO: 11276 - DNA, 137 bp, Homo sapiens
  D6S419
  Located on chromosome 6
  Distance between a terminus base of telomere on chromosomal short arm and 5'-terminus of this base sequence : 164708551
  Distance between 3'-terminus of neighbour sequence of sequence listing upward to telomere on chrosomal short arm and 5'-terminus of this base sequence : 206566
agctgaggtcgtgccactgcactccagcctaggcaacagagcaagactccatcacacacacacacacacacacacacacacacacacacacacacactgatgctatgccatcccagggctccctggctaagataaaa

SEQ ID NO: 11277 - DNA, 175 bp, Homo sapiens
  AL117344.12_24739
  Located on chromosome 6
  Distance between a terminus base of telomere on chromosomal short arm and 5'-terminus of this base sequence : 164743163
  Distance between 3'-terminus of neighbour sequence of sequence listing upward to telomere on chrosomal short arm and 5'-terminus of this base sequence : 34475
catgactggatccataattaagagaaagatgtgtgtgtgtgtgtgtgtgtgtgtgtgttcatcccccttgactccaatccttctatctgtagaagttagctgatctttaatttaggtctgtttttgcctttacctccttgtcacttcatagctggagctaacataccattacagt

SEQ ID NO: 11278 - DNA, 274 bp, Homo sapiens
  AL117344.12_77199
  Located on chromosome 6
  Distance between a terminus base of telomere on chromosomal short arm and 5'-terminus of this base sequence : 164795557
  Distance between 3'-terminus of neighbour sequence of sequence listing upward to telomere on chrosomal short arm and 5'-terminus of this base sequence : 52219
caattctgaccatgtagacagagtccaggctggggaagggaccacaagggaaacacctggtgactctggcatgggtcttagcactgccagatattacacacacacacacacacacacacacacacacacacacactcttcatatctatctatctatcatcatcatcatcatcatcatcattttatatatataaaaacctgttgaaaataatagctctgaattattggagataaatgaatgtttccaaaagagatggaaagattcaaagagttaa

SEQ ID NO: 11279 - DNA, 367 bp, Homo sapiens
  AL117344.12_83092
  Located on chromosome 6
  Distance between a terminus base of telomere on chromosomal short arm and 5'-terminus of this base sequence : 164801278
  Distance between 3'-terminus of neighbour sequence of sequence listing upward to telomere on chrosomal short arm and 5'-terminus of this base sequence : 5447
catccttggattgtaaatagtcactggctaaggcaagtgtacaaagagaaataaactgaaagcagcctgggcttcccataaatattatctatgaaattcttcagccatatttcctcaaggcacaaatccgtagttggccttttaataatattttaccttgattttaacttctcactgcatcatagatgtctttgtataaaaacattttagtgtttttaataattatcatcaatggtgggataaattttgatgtcaaaagtctggtcttgtgtgtgtgtgtgtgtgtgtgtgtgtgtgtgtctgtggaggctgattgtgttctttatggatgagatctgaccgcttgtcaaggtaagatgttgagacg

SEQ ID NO: 11280 - DNA, 417 bp, Homo sapiens
  AL117344.12_85882
  Located on chromosome 6
  Distance between a terminus base of telomere on chromosomal short arm and 5'-terminus of this base sequence : 164804101
  Distance between 3'-terminus of neighbour sequence of sequence listing upward to telomere on chrosomal short arm and 5'-terminus of this base sequence : 2456
ttcactagctatccttgacttcaccttcattcatacagtgaatgtttattgaacatccttgacttcagtgtcattcattcagtaggtatttcttgagcatctactttgtcccagacacagcgctaggtgctggaggtgcagcatctttcctttgaagaccagatgggtgactacctggtccacctgaacttctattagattttattcattctaaggccattgttttttgtgttttgtgtgtgtgtgtgtgtgtgtgtgtgtgtttgaccatggatgactccacatgtaatatgtgtctgctttacttctggtggccgataccttcttttttattctgcctctgaaaataagcctcctgattaattggcagctgttgttcaaaaccttcttaatgtttatcttgaagcctttaggtgt

SEQ ID NO: 11281 - DNA, 263 bp, Homo sapiens
  D6S415
  Located on chromosome 6
  Distance between a terminus base of telomere on chromosomal short arm and 5'-terminus of this base sequence : 164804197
  Distance between 3'-terminus of neighbour sequence of sequence listing upward to telomere on chrosomal short arm and 5'-terminus of this base sequence : -321
gcatctactttgtcccagacacagcgctaggtgctggaggtgcagcatctttcctttgaagaccagatgggtgactacctggtccacctgaacttctattagattttattcattctaaggccattgttttttgtgttttgtgtgtgtgtgtgtgtgtgtgtgtgtgtttgaccatggatgactccacatgtaatatgtgtctgctttacttctggtggccgataccttcttttttattctgcctctgaaaataagcctcctga

SEQ ID NO: 11282 - DNA, 376 bp, Homo sapiens
  AL117344.12_136877
  Located on chromosome 6
  Distance between a terminus base of telomere on chromosomal short arm and 5'-terminus of this base sequence : 164855296
  Distance between 3'-terminus of neighbour sequence of sequence listing upward to telomere on chrosomal short arm and 5'-terminus of this base sequence : 50836
aattgctaaagactacatgcagtaaaataccatgtgttttgttttgttttgttttgttttgttttgttttgttttgtttgagattgagtctcactctgttgaccaggctggaatgtaatggtgcagtctcggctcaccacaacctttgcctcctgggttcaagcgattctgctgcctcagcctctggagtagctgggattacaggtgagcgccaccacacccggctaattttgtatttttagtagagatggggtttcaccctgttggccatgctggtcttgaacacctgacctcaagtgatccacccgcctgggcctcccaaagtgttgggattacaggcatgagccaccatgtctggccaataacatgtttataa

SEQ ID NO: 11283 - DNA, 289 bp, Homo sapiens
  D6S1007
  Located on chromosome 6
  Distance between a terminus base of telomere on chromosomal short arm and 5'-terminus of this base sequence : 164992394
  Distance between 3'-terminus of neighbour sequence of sequence listing upward to telomere on chrosomal short arm and 5'-terminus of this base sequence : 136722
gtggtgcaagctgaagttctagctttatttttttctaaatgtttaatgaagtgtcccaactccacttactatttcattattctgttccagcaagtctcaaactttttggtctcaagactcctttacacattgaaaaattattaaggaccgccaaagagcttttgtgtatattttgaagatagatagatagatagatagatagatagatagatagatagatagttatcatgttggaaattagaactaaaaaaattttaaaacacaagaatgcacaagcccacattgtatt

SEQ ID NO: 11284 - DNA, 117 bp, Homo sapiens
  D6S1612
  Located on chromosome 6
  Distance between a terminus base of telomere on chromosomal short arm and 5'-terminus of this base sequence : 165060935
  Distance between 3'-terminus of neighbour sequence of sequence listing upward to telomere on chrosomal short arm and 5'-terminus of this base sequence : 68252
accaatccagtgaattaaggcctcgtccttaggacctcttttaaacatttgtgtgtgtgtgtgtgtgtgtgtgtgtgtgtgagagagagagagagagatggagtttcactctgtcgc

SEQ ID NO: 11285 - DNA, 462 bp, Homo sapiens
  AL035634.7_25556
  Located on chromosome 6
  Distance between a terminus base of telomere on chromosomal short arm and 5'-terminus of this base sequence : 165263711
  Distance between 3'-terminus of neighbour sequence of sequence listing upward to telomere on chrosomal short arm and 5'-terminus of this base sequence : 202659
aatctactgctagtaaatgcaaagtttgcaatgctttagtacaatgatggtgtctagactcattgttctgttcaagtccactttttaggtaataaaagttttttgatatgtaggtgcataatactatctatctatattttatttatttatttatttatttatttttggagacggtctcactctgccacccagcctggagtgcagtggcacaatcatagctcactgcagccttgacctcttggactcaagtgatcctcccacgtagctgggattataggtgcacgccaccattgcctggcttatactcataatttctaaaggaaagttcaggtttcattttttaaattttatttttaaacttaggtacagtaaattcactctttttggtgtacagttctgagttttgacagctaccactgcagtcctgcaaccaccactacatttcatgatacagaacagctc

SEQ ID NO: 11286 - DNA, 385 bp, Homo sapiens
  AL035634.7_18902
  Located on chromosome 6
  Distance between a terminus base of telomere on chromosomal short arm and 5'-terminus of this base sequence : 165270386
  Distance between 3'-terminus of neighbour sequence of sequence listing upward to telomere on chrosomal short arm and 5'-terminus of this base sequence : 6213
ctccagattctgagtttacctctctgaaggttgttgtttctgctttttatttgttaagtaacttgcctaagattaaatctctgaagtctgtctccctggaagttcagttattgctgtttgtttgtttgtttgtttgtttgttttatatttgtcttcctagagtttgctcctgtgtctgtggattggtagtaagcctttgattgactgacagaggttgtacccaaccacctcaggccagtaagttggggctcctgtcctctgtcaatgtaactgtaactcgatgtaactcattcaaagctcaggtcatttttaagttgccctggcttttactttctaccagacccttttgtgtctcctttacttgtatgtacagcctcagagttga

SEQ ID NO: 11287 - DNA, 296 bp, Homo sapiens
  HUMUT5619
  Located on chromosome 6
  Distance between a terminus base of telomere on chromosomal short arm and 5'-terminus of this base sequence : 165376453
  Distance between 3'-terminus of neighbour sequence of sequence listing upward to telomere on chrosomal short arm and 5'-terminus of this base sequence : 105682
acaccattgcactccagcttgggcaacaagagtaaaactctgtctcaaaaaataaataaataaataatacatgcatacatacatacatacgtacatacatacatacatacagggtacagcaaactaatccgattggaaactgccggactttggggctagatggagcatgggcttaaagtgaaacctacattttggctccaacacagactagctgtgtgcttgggcgggtgattcagcttccctgggggacagtcatgcgtgtgtgaaatggcagtggtagccctgagacagcagca

SEQ ID NO: 11288 - DNA, 415 bp, Homo sapiens
  chr6.fa.O7frz.168565998
  Located on chromosome 6
  Distance between a terminus base of telomere on chromosomal short arm and 5'-terminus of this base sequence : 165493663
  Distance between 3'-terminus of neighbour sequence of sequence listing upward to telomere on chrosomal short arm and 5'-terminus of this base sequence : 116914
cactcatctagctctgtttgaggtaaggaagccagcaactgtctgagctcttcttcagtggaagaatcctgaaataaaaggaaaggaaattcttcataaatactcaacaactgagtacaacaaaaaatatccaaagactcaaagccaatatttgccatatatatcaaagccatatattatgtgtgcatgtctctctctctctctctctctctctctctctctctctctctctatatatatatatatatatatatatatacacacacacatatatatatgatatagagatctagggaaagagatatcagagattaattactgctttcagtcttgaaaacagtcacccacccaggtaaataaacaatcatttaattttgaattctatactttcatgtctgctacttcaaactgacag

SEQ ID NO: 11289 - DNA, 460 bp, Homo sapiens
  chr6.fa.O7frz.168477401
  Located on chromosome 6
  Distance between a terminus base of telomere on chromosomal short arm and 5'-terminus of this base sequence : 165564846
  Distance between 3'-terminus of neighbour sequence of sequence listing upward to telomere on chrosomal short arm and 5'-terminus of this base sequence : 70768
gcagtctgatatgacatggtactgaatgcgttattccagtaggaggagctctcagcaagagtttaaaagcacagacacagagcccagcccgcctgcagtctcagctacttgggcggctagagtgggaggatagcttcagcccagcagttcaaggctgtagggcacaatgaatagccactgctccagcctgggcaacatagtgagactctgtctcaaaaaaacaaaacaaaacaaaacaaaacaaaacaaaaacatcgataaggtccctgggggagccagaccttccatgtctctagaatttgtccttacttagctctctgtgtcatggtagggcaataaggaaataaaatgctgctacaaactatctatctatctatctatctatctatctatctatctatctatctatcatctatctatctatctatctttttcccttagaagcagtacattggaataa

SEQ ID NO: 11290 - DNA, 410 bp, Homo sapiens
  chr6.fa.O7frz.168445622
  Located on chromosome 6
  Distance between a terminus base of telomere on chromosomal short arm and 5'-terminus of this base sequence : 165594354
  Distance between 3'-terminus of neighbour sequence of sequence listing upward to telomere on chrosomal short arm and 5'-terminus of this base sequence : 29048
atatggttacatcctgtcatttagttattagctgaaataggtgtgtgtgtgtgtgtgtgtgtgtgtgtgtgtgtgtgtgtagaaattctcctttgtcaattatttggttaccttgaggtatagagtgtataggaagggtttgaaaagtgtctgattatttcccttgatttaccagttttcaaagttatgatttggtcccctagcatcctccagtggtgatggttgagggttttaaattttttcgcataacattatgaacgcctattttagcatacgtggtgtgtttcagtccattgcagttactgtcctttcgatgctcaaattgctccctctttgggcagtgtaggcttatttaggctggcacctgagtccttctgacacgtctctagtaatctcatagcttccttgct

SEQ ID NO: 11291 - DNA, 422 bp, Homo sapiens
  AL161721.2_79197
  Located on chromosome 6
  Distance between a terminus base of telomere on chromosomal short arm and 5'-terminus of this base sequence : 165751483
  Distance between 3'-terminus of neighbour sequence of sequence listing upward to telomere on chrosomal short arm and 5'-terminus of this base sequence : 156719
ggtgttctaggctatgtactcaagtaagtaagcagaaaatagcttttctggattaagaagataaaacctgcaggtatttccaggttggccgccttttatgtttgtttgggttttttgttgttgttgttgttgttgttgttgttgttgttttgttgttttgagacaggttctcttgtacctgggctgtagtgaagtggcatgatcacggctcactgcagcctggacatcatgagctcaagtcatcctcccacctcagcctcccaagtagctgggattacaggcacgcaccaccatgcccaactaattttggtattttttgtagagacggggtttcaccgtgttgcccaggctggtctcgaactcctgggctcaagcgagctgtcagcctcggcctcccaaagtggtagaattacaggcatgag

SEQ ID NO: 11292 - DNA, 283 bp, Homo sapiens
  chr6.fa.O7frz.168075407
  Located on chromosome 6
  Distance between a terminus base of telomere on chromosomal short arm and 5'-terminus of this base sequence : 165894604
  Distance between 3'-terminus of neighbour sequence of sequence listing upward to telomere on chrosomal short arm and 5'-terminus of this base sequence : 142699
agatagcagactgatagtgcagctgtgtctggatcagggtggctccgtctccccggcagaggtgtctgaaaccttcactgtgtcacctgagttgcctgaggtttctcaggtgcaaattggagagagtgtgtgtgtgtgtgtgtgtgtgtgtgtgtgtgtgttggggtgagggagagtatgcaatgaaggcagaggaaacaggctctggcctagctcaggagctgttgggtcagagatatggtgctcagcgcatcctggcttgaaagtctagtgttccaggaaa

SEQ ID NO: 11293 - DNA, 284 bp, Homo sapiens
  chr6.fa.O7frz.168156747
  Located on chromosome 6
  Distance between a terminus base of telomere on chromosomal short arm and 5'-terminus of this base sequence : 165912883
  Distance between 3'-terminus of neighbour sequence of sequence listing upward to telomere on chrosomal short arm and 5'-terminus of this base sequence : 17996
taacctgacttgtttgagctacagggctgcacggagttgagactctcatgctcacatgttgctttggtcttactttagcatttctctgcaaatttaaataaggctgtttttgtgtgtgtgtgtgtgtgtgtgtgtgtgtcttgcttggcacgtgaagccattttttagtgtgtattttatgtgtctttttcatcctgggggcatttcaatgtagaagtgtattaattagaaccaccttcggctagcagcaaagcatggcacagacaaattaagtatcctggagc

SEQ ID NO: 11294 - DNA, 423 bp, Homo sapiens
  chr6.fa.O7frz.167986903
  Located on chromosome 6
  Distance between a terminus base of telomere on chromosomal short arm and 5'-terminus of this base sequence : 166054324
  Distance between 3'-terminus of neighbour sequence of sequence listing upward to telomere on chrosomal short arm and 5'-terminus of this base sequence : 141157
ctttcatatgtcctgtgaactaagagtgggttttatattattatcattattattattattattattattattattattttgagatggagtctcattctatctcccaggctggagtgcagtggtgtaatctgggctcactgcaacctttgcctcttgagttcagcctcccgagtagctgcgattacaagcgtgtgacctcatgcccggctaggctaatctttgtatttttagtagagacgaggtttcatcatgttggccaggctagtctcgaacttctggcctcaagtgatccgcctgcctcagcctcccaaagtgctgggattacagatgtgagccaccacacctggccgggttttacatttttaaatggttaaaaaaaaaaacaaaagaataatctttgtgacacattcaaatttcagtgcc

SEQ ID NO: 11295 - DNA, 85 bp, Homo sapiens
  D6S1614
  Located on chromosome 6
  Distance between a terminus base of telomere on chromosomal short arm and 5'-terminus of this base sequence : 166125195
  Distance between 3'-terminus of neighbour sequence of sequence listing upward to telomere on chrosomal short arm and 5'-terminus of this base sequence : 70448
ttcaagagatggacttatcatcaaacacacacacacacacacacacacacacacacacacacacacgcacaaacattctgaaaca

SEQ ID NO: 11296 - DNA, 431 bp, Homo sapiens
  AC023785.3_66771
  Located on chromosome 6
  Distance between a terminus base of telomere on chromosomal short arm and 5'-terminus of this base sequence : 166183388
  Distance between 3'-terminus of neighbour sequence of sequence listing upward to telomere on chrosomal short arm and 5'-terminus of this base sequence : 58108
agacttctgatagcgatcctacctattcgaattgaatccagctctttatgttttaattacttcttgttattctcattttcttttccccatcatcctaatgtgtttaacatgtctgtttatatgtattttccataaagtatatattatttaacgtacacatgctttcaatttatttatttatttatttatttatttatttatttatttattttgagatggagcctcactgtgtcacccaggctggagtacagtggtgcgatctctgctcactgcaacctccgcctctcaggttcaagccattctcctgcttcagcctcccgagtagctgggactacaggcgcactccaccatgcatggctaatttttgtatttttagtagagatgggggtttctacgtgttggtcaggctggtctcgaactcatgacctcag

SEQ ID NO: 11297 - DNA, 260 bp, Homo sapiens
  AL035530.11_19360
  Located on chromosome 6
  Distance between a terminus base of telomere on chromosomal short arm and 5'-terminus of this base sequence : 166400856
  Distance between 3'-terminus of neighbour sequence of sequence listing upward to telomere on chrosomal short arm and 5'-terminus of this base sequence : 217037
acaaacttgtcttgaacctaagagccagctgtatgtccacggggcgtctgttttttgtgagagagctcagctctccacaaatgccccttggaagatccctaaacacttgaaggtgagcttccttgaccaccacctgcaagaacactcggggtgtgtgtgtgtgtgtgtgtgtgtgtgtgtgtaacattatcctttcatgatgcatgtttaccatgtacaaatgaccaggtcgacagagtaaataaggcgttagttgaatc

SEQ ID NO: 11298 - DNA, 275 bp, Homo sapiens
  Z66961
  Located on chromosome 6
  Distance between a terminus base of telomere on chromosomal short arm and 5'-terminus of this base sequence : 166400991
  Distance between 3'-terminus of neighbour sequence of sequence listing upward to telomere on chrosomal short arm and 5'-terminus of this base sequence : -125
gcaagaacactcggggtgtgtgtgtgtgtgtgtgtgtgtgtgtgtgtaacattatcctttcatgatgcatgtttaccatgtacaaatgaccaggtcgacagagtaaataaggcgttagttgaatctctctgacaattgagaaaaggcagtttaaagtttaaatatcagtccttctcaaacttggctgcacgtgagaatcccctgggaagctttttaagaataatcaatgcccacacctaatctttgaccaataaaatggaaatttctgaagacgg

SEQ ID NO: 11299 - DNA, 408 bp, Homo sapiens
  AL035530.11_17442
  Located on chromosome 6
  Distance between a terminus base of telomere on chromosomal short arm and 5'-terminus of this base sequence : 166402837
  Distance between 3'-terminus of neighbour sequence of sequence listing upward to telomere on chrosomal short arm and 5'-terminus of this base sequence : 1571
gtgattcagcgatctagaattaattcagggaggaggctttgccttgtgactagccactccaacttttatcagttcctcatattatacacacacacacacacacacacacacacacacacgcacacacacgtctgctggggctgccacaacaaaataccacagactggatggcttaaacaataggaatgtgttccttccagtcctggggtctaggagtgaccaaggtgtgggcagggttgctttctccgaggcctctctcctcggcttgcagatggccatcctcactgcaccccgccttagtcttccctccgtgtgcacattcctggggtctctcgtgaccacattccctcttataggggcgccagtcggactggagtaggacacactctaactgcctcaccttaactt

SEQ ID NO: 11300 - DNA, 182 bp, Homo sapiens
  chr6.fa.O7frz.169922804
  Located on chromosome 6
  Distance between a terminus base of telomere on chromosomal short arm and 5'-terminus of this base sequence : 166616793
  Distance between 3'-terminus of neighbour sequence of sequence listing upward to telomere on chrosomal short arm and 5'-terminus of this base sequence : 213548
catccattatctacctattcatatctatctatctatctatctatctatctatctatctatctatccatctatcatctatctatctatctatctatctatctatctatccatccatccatctatcctatctatttatctaactatctatctatctatctatccatttgtttatctaggtatcc

SEQ ID NO: 11301 - DNA, 380 bp, Homo sapiens
  chr6.fa.O7frz.170083279
  Located on chromosome 6
  Distance between a terminus base of telomere on chromosomal short arm and 5'-terminus of this base sequence : 166751241
  Distance between 3'-terminus of neighbour sequence of sequence listing upward to telomere on chrosomal short arm and 5'-terminus of this base sequence : 134266
tacctaatgctaaatgacgagttaatgggtgcagcacacaagcatggcacatatatacatatgtaactaacctgcacattgtgcacatgtaccctaaaacttaaagtataataataaaataaaaagagaaaaaaaaagaaagatgcacacacacacacacacacacacaaaacagtgccgaccggctcgcttcccttggggttagctcgcttcccttggggttagctcgcttcccttgggttgccttcaatgacattcaatgaacccctgaagtccctccttatccttcacagccctacaaagccagctggtggatacagctacttttgttgatttttatatgaactaaactaattaactaaacagatacttgatcaacg

SEQ ID NO: 11302 - DNA, 460 bp, Homo sapiens
  chr6.fa.O7frz.170178258
  Located on chromosome 6
  Distance between a terminus base of telomere on chromosomal short arm and 5'-terminus of this base sequence : 166848530
  Distance between 3'-terminus of neighbour sequence of sequence listing upward to telomere on chrosomal short arm and 5'-terminus of this base sequence : 96909
gataaatcttagagtccatagcaagcaagatgtcagattacttctttgcaaaatgataaaatacttgtaaataatgagacaaagcaataaatttcaagagacattaatgctccttcccagaaattccatcagcataccccccaccacccaccaccccacttcacactgcctcccccagccaataaacaacttaagtaaaactagatgtttgttatggaaatacagcacacacacacacacacacacacacacacacacacacacacacacacggggacagagaaagaaagaaaacaaatgtggcaaaatgttaacatttaggggatctaagtaaaggtatatggaaattctttgtactattcttgcaacttttctgtaaatctgaaaatcatttcaaaataaaaaagtaaaaacaaaaccaaagcaacaatgaaaaatcttgaggcttccatctatactt

SEQ ID NO: 11303 - DNA, 383 bp, Homo sapiens
  AL078604.10_7922
  Located on chromosome 6
  Distance between a terminus base of telomere on chromosomal short arm and 5'-terminus of this base sequence : 166941242
  Distance between 3'-terminus of neighbour sequence of sequence listing upward to telomere on chrosomal short arm and 5'-terminus of this base sequence : 92252
gaaactaggctaacaaatgaaatatatgcccaatatacatattttggaagctctttaccaccagaaaacacaccaggaattgaagtgggaacttgagttttgttttttgtttgtttgtttgtttgtttgagatagggtcttgctctgggtctcgctctgtcacccaggctgaagtgcagtggcatgaccatagttctctgcagcctttaactcccaggctcaagcgatcctcccacctcagcttcctgaataactgggactaaaggtgtggaaacttgagtgatgtttgtgtttgtgttttcactggagttttgtggaaggccagataagatgtctatattccaaatgctgagagattgtattctgtagctgaaactcctagt

SEQ ID NO: 11304 - DNA, 137 bp, Homo sapiens
  D6S1035
  Located on chromosome 6
  Distance between a terminus base of telomere on chromosomal short arm and 5'-terminus of this base sequence : 166953711
  Distance between 3'-terminus of neighbour sequence of sequence listing upward to telomere on chrosomal short arm and 5'-terminus of this base sequence : 12086
aaaactcaagctcagaaaggctatttatttactttttattattattattattattattattattattattattattattattagagatgggatctcactgtgttgcccaggctggtcctgaatgcctggattcaagt

SEQ ID NO: 11305 - DNA, 469 bp, Homo sapiens
  chr6.fa.O7frz.170463645
  Located on chromosome 6
  Distance between a terminus base of telomere on chromosomal short arm and 5'-terminus of this base sequence : 166993585
  Distance between 3'-terminus of neighbour sequence of sequence listing upward to telomere on chrosomal short arm and 5'-terminus of this base sequence : 39737
actgatgctgttaatttgaattagattggtttcataactttgtttggattaaatgatacattaatcttattttacaattgaagaagatctgtgtaaatagagatgtataggtttgtatttttacatattcatattaaatacaataaaaaataatttaaggttaaaaaaaaacagctaattgagtctcctgaattctttcatttacacacacacacacacacacacacacacacacaataggtttcttattaaaatttaccatttctctgaaatttcaccacaaattagcagagtgggaaattccagacaactgctaaatcatggcctaacccaggctccatggcctgcatcttgctagcacaaaatgcagtcttacgacatattcttaaatacacagattttcatccaacaatatgtctgcttatagctctccaaacagaggtttcataacataggttctggcattaag

SEQ ID NO: 11306 - DNA, 227 bp, Homo sapiens
  D6S1581
  Located on chromosome 6
  Distance between a terminus base of telomere on chromosomal short arm and 5'-terminus of this base sequence : 167203441
  Distance between 3'-terminus of neighbour sequence of sequence listing upward to telomere on chrosomal short arm and 5'-terminus of this base sequence : 209387
aggctcatccatgtttctgtgaatgacaagatttcattctttttatggttgaatagtatcccgttatacacacactctcacacacacacacacacacacacacacacacacatatttatctatcttagatatgtaatctttcttaactcattcatctgttaatggacatttatgttgattccgtatcttagtattgtgaatagtgctgcagtaaatgtgggaatgca

SEQ ID NO: 11307 - DNA, 219 bp, Homo sapiens
  AL035691_114566
  Located on chromosome 6
  Distance between a terminus base of telomere on chromosomal short arm and 5'-terminus of this base sequence : 167245997
  Distance between 3'-terminus of neighbour sequence of sequence listing upward to telomere on chrosomal short arm and 5'-terminus of this base sequence : 42329
ttctcaaactggttgtgaaggttggcctgcctcacaggctctccaacaaccactcactgtcctgtaaagttgaggggtttggtagaacagtgatttccagactcctcctcctcctcctcctcctcctcctccttcttcctcctcctccctcctcctccctcctcctgcctcttcctcctcctacctcctcttccttttccctgttcctccttcctcttc

SEQ ID NO: 11308 - DNA, 256 bp, Homo sapiens
  AL035691.17_104542
  Located on chromosome 6
  Distance between a terminus base of telomere on chromosomal short arm and 5'-terminus of this base sequence : 167255960
  Distance between 3'-terminus of neighbour sequence of sequence listing upward to telomere on chrosomal short arm and 5'-terminus of this base sequence : 9744
ggttgcggcaatagtctatacctccttggtctgctgtgaagatgaaatgagaagatgaggcttgtaaagcacctggcacattgtggatgttcaacaaatatcagtctctcctcactcccttcaatggtagacaagatataaatttttgttttgtaaagcacacacacacacacacacacacacacacacacacagctctatcatgtacagaagttattatgtgtttttacatgttgaatgtaaatttacgaaggtc

SEQ ID NO: 11309 - DNA, 301 bp, Homo sapiens
  AL035691.17_92823
  Located on chromosome 6
  Distance between a terminus base of telomere on chromosomal short arm and 5'-terminus of this base sequence : 167267691
  Distance between 3'-terminus of neighbour sequence of sequence listing upward to telomere on chrosomal short arm and 5'-terminus of this base sequence : 11475
tcaccaaggagcttaaatgttttaaaataaacaaaatgtcgttatgcaccctacctccctccgcagtttggagcccttccttttccagaatgatgcagcccaggtccccctaccctttgttctcagcagcaagtctccggagaggttatatatatatatatatatatatatatatatatataaacaaataaatgatttacctttttgccttcctgtgtaccacattcagattttgcttttgaaaattccatcaaggcagctatgatgtccatgtttaatctacttatgtctgcatcaactg

SEQ ID NO: 11310 - DNA, 177 bp, Homo sapiens
  AL035691.17_63354
  Located on chromosome 6
  Distance between a terminus base of telomere on chromosomal short arm and 5'-terminus of this base sequence : 167297202
  Distance between 3'-terminus of neighbour sequence of sequence listing upward to telomere on chrosomal short arm and 5'-terminus of this base sequence : 29210
caatcttggtgtacttcttggtacacatatgggatcgagttgctcttagaataagtacatcattaaaaattctaatcatcagtggtcacgagatggatcctttgaattataataacatatatatatatatatatatatatgtatatatgatctctcattctaaacaaattgcctatt

SEQ ID NO: 11311 - DNA, 156 bp, Homo sapiens
  AL353625.5_9028
  Located on chromosome 6
  Distance between a terminus base of telomere on chromosomal short arm and 5'-terminus of this base sequence : 167369553
  Distance between 3'-terminus of neighbour sequence of sequence listing upward to telomere on chrosomal short arm and 5'-terminus of this base sequence : 72174
ggcactattcacagtagcaaagatacggaataaacgttaagtgcccaccaacggatgactaggtaaagaacacacacacacacacacacacacacacgtctatcatggaataccactcagccgtaaggcagaatgaaatcctatgttttggagtaa

SEQ ID NO: 11312 - DNA, 178 bp, Homo sapiens
  AL353625.5_55080
  Located on chromosome 6
  Distance between a terminus base of telomere on chromosomal short arm and 5'-terminus of this base sequence : 167415606
  Distance between 3'-terminus of neighbour sequence of sequence listing upward to telomere on chrosomal short arm and 5'-terminus of this base sequence : 45897
agtgagcctaatagtttcctgaactattatgttcagggaagttatgttgttgctgattctgatggggggtgtgtgtgtgtgtgtgtgtgtgtgtgtgtgtgtgtgtgtgtgacagagacagagagaagtcgagtctaaagttctgtcaggcttagactatgcctgaatacttgaacgt

SEQ ID NO: 11313 - DNA, 362 bp, Homo sapiens
  chr6.fa.O7frz.170887834
  Located on chromosome 6
  Distance between a terminus base of telomere on chromosomal short arm and 5'-terminus of this base sequence : 167525772
  Distance between 3'-terminus of neighbour sequence of sequence listing upward to telomere on chrosomal short arm and 5'-terminus of this base sequence : 109988
ttagcaataaccatgaaaacatgttcaacctcactcctcaaagaaattcagataaaatggccaggagatattattttgtgtgtgtgtgagtgtgttgtgtatgtgcatgtgtgagacagagagagagaaagagagagagagagagagagagagatgagaagggagagggagagggagggagggaaggagagagagagagcgcgagagagcgagagagagcgctgtgtgtgtgtggcaaagaagacatgaaaaagccacactctggcattgtgttggtgaaattaatttgtaacacattttgaaggacaagctgatgtttatagcaaaagtcttaaaatgttccagcacatagtaaagagtaa

SEQ ID NO: 11314 - DNA, 163 bp, Homo sapiens
  DISO7_10002267
  Located on chromosome 6
  Distance between a terminus base of telomere on chromosomal short arm and 5'-terminus of this base sequence : 167823997
  Distance between 3'-terminus of neighbour sequence of sequence listing upward to telomere on chrosomal short arm and 5'-terminus of this base sequence : 297863
tggagcttagaacccagtgtgttcacacaggtgtatatatataactatatataactatatatatatatacacacacacacatagttatattatgtgtgtgtgtgtgtgtgtgtgtgtcctgcagattgtatagctatatagcctgcagctgtgcagactatag

SEQ ID NO: 11315 - DNA, 147 bp, Homo sapiens
  D6S1579
  Located on chromosome 6
  Distance between a terminus base of telomere on chromosomal short arm and 5'-terminus of this base sequence : 168023827
  Distance between 3'-terminus of neighbour sequence of sequence listing upward to telomere on chrosomal short arm and 5'-terminus of this base sequence : 199667
cttcctacccacatgcaggaaatctttttatattttcccgcctgtctgtgaggatcagtggatttcattttttagtatttgtggaggtgtgtgtgtgtgtgtgtgtgtgtgtgcgtgcatgtttctaagcctgtgcatgtgtgagta

SEQ ID NO: 11316 - DNA, 408 bp, Homo sapiens
  AC010893.5_153660
  Located on chromosome 6
  Distance between a terminus base of telomere on chromosomal short arm and 5'-terminus of this base sequence : 168177458
  Distance between 3'-terminus of neighbour sequence of sequence listing upward to telomere on chrosomal short arm and 5'-terminus of this base sequence : 153484
atccattcatcaatccttctacccattatctatcatctgtgtctatctatctatctatctatctatctatctatctatctatctatcatctatcatccatctacctattatctgcctatctaccatttgtgtgtcatctgtcttcctatccagctacagagagggactgcctttggttttagttttttataaatactctaacacattgttgagtgatgtttcactttgtaatcagtcttgaaaacctgcctatgccattccatctagacagacctgacgtcagcctcctcactctgtagagtaagccacactgttaatcccctgctgctgcacgtcccagcgatttccactttcccacgtcagcagttcctgcctttagatcacttctgagtcttagcaccttacatg

SEQ ID NO: 11317 - DNA, 373 bp, Homo sapiens
  chr6.fa.O7frz.173224066
  Located on chromosome 6
  Distance between a terminus base of telomere on chromosomal short arm and 5'-terminus of this base sequence : 168294200
  Distance between 3'-terminus of neighbour sequence of sequence listing upward to telomere on chrosomal short arm and 5'-terminus of this base sequence : 116334
accaacctaacaaatgtagctctgagccttggatatcagaattttaaatcccattaattaaacacttatgatatgtccacattaaaattaatattatttgaaatcccattattaaaatgtaagacaaatcaacaatggtgtgcgtgtatataacgatatatataataaaaaattaacctacaacacatacacacatacttacacacagtgcacacacacacacacacacacacacatagttgaacatctgtaatcatccttccatatctttgggttccacatccatggattcagcaaaccacagatcaaaaatattttttaaccaaatgaatggttggaatggttgcatctgtactgaccatgtacagatttt

SEQ ID NO: 11318 - DNA, 175 bp, Homo sapiens
  AL109942.13_60974
  Located on chromosome 6
  Distance between a terminus base of telomere on chromosomal short arm and 5'-terminus of this base sequence : 168591062
  Distance between 3'-terminus of neighbour sequence of sequence listing upward to telomere on chrosomal short arm and 5'-terminus of this base sequence : 296489
tccaaggttaaccattatgaacagtttggaaaatagtcttatagttttttcccctaggcatttatacacatgcgcgtgcacacgtgcgcgcgcgcacacacacacacacacacacacacacacacacatacacatatactcaaaaagctttgcctttagttgaatggcttaccag

SEQ ID NO: 11319 - DNA, 434 bp, Homo sapiens
  AL109942.13_123610
  Located on chromosome 6
  Distance between a terminus base of telomere on chromosomal short arm and 5'-terminus of this base sequence : 168653658
  Distance between 3'-terminus of neighbour sequence of sequence listing upward to telomere on chrosomal short arm and 5'-terminus of this base sequence : 62421
aatgatttagtgaaggtacacgagggctcaactttgaggctatcagtaaatacaaataactaggaaggtaagaaaactacccccaccacaccctggtcacacacacagagacacatagacacacacacaaacaccacacacacacacacacacacacacacacacacacagatacacacatccttaagtgttctcaaatcagaaagaaactcaacacatacatacagttagactcacagtcctgtaatcagtctccagctcaaaacagaataatgaaatgactttacagtttgggaaataaaagctttcctttgaggaaaatggcaggagtttcaaatactctgatgaaaaggaaagctgtgagcagcggactcgcttttcctggaagcagaagagcctggcagactaccccaggaagacgtctaatgttacga

SEQ ID NO: 11320 - DNA, 174 bp, Homo sapiens
  AL109942.13_171620
  Located on chromosome 6
  Distance between a terminus base of telomere on chromosomal short arm and 5'-terminus of this base sequence : 168701771
  Distance between 3'-terminus of neighbour sequence of sequence listing upward to telomere on chrosomal short arm and 5'-terminus of this base sequence : 47679
agaatgacatgcaagatgtttcatgatctggctctctctctctctctctctctctctagtttcatctcttatctctttccatactgtctgagtccgtttttcactgctataaccggttactacagactggatcacttataaagaacaggggtttacttggctcacagttctaga

SEQ ID NO: 11321 - DNA, 461 bp, Homo sapiens
  chr6.fa.O7frz.172729035
  Located on chromosome 6
  Distance between a terminus base of telomere on chromosomal short arm and 5'-terminus of this base sequence : 168788706
  Distance between 3'-terminus of neighbour sequence of sequence listing upward to telomere on chrosomal short arm and 5'-terminus of this base sequence : 86761
cttcctgtcattatcaagtcacatgctacaaagagggctaagggactaaggctaagatgctgtcatggagatctggaagtccccggggacttttgagagcacagttttcaaacagcttgtggccaggcgcagtggctcacacctgtaatcccagcactctgggaggccagtgcgacggtcaggagttcaagaccagcctgcgaaacatggtgaaaccctgtctctactaaaaatacatataatatttatatatatgtatatatttatatatatttatatatatttgtatatatatttatatatatttgtatatatatttgtatatatatttgtgtatatatatagcaacctcagtcttgatatatatatatatatatatatatatgctgggcctggtggcgcacacatatagtcccagctactcaggaggttgaggcatgagaatcacttgaatccagaag

SEQ ID NO: 11322 - DNA, 128 bp, Homo sapiens
  D6S1550
  Located on chromosome 6
  Distance between a terminus base of telomere on chromosomal short arm and 5'-terminus of this base sequence : 168918190
  Distance between 3'-terminus of neighbour sequence of sequence listing upward to telomere on chrosomal short arm and 5'-terminus of this base sequence : 129023
tcaagggtacaattctcaagtctgtgtgtgtgcacagtgcttacatgtctctctctctctctctctctctcacacacacacacacacacaccatatcccacttacagactgaatactttgcaccacaa

SEQ ID NO: 11323 - DNA, 296 bp, Homo sapiens
  AL035697.19_61952
  Located on chromosome 6
  Distance between a terminus base of telomere on chromosomal short arm and 5'-terminus of this base sequence : 168969703
  Distance between 3'-terminus of neighbour sequence of sequence listing upward to telomere on chrosomal short arm and 5'-terminus of this base sequence : 51385
cagattgagctttcaaactgactgcaaatttcagccaaagggttaggagctacagtgcatgggatttcttgcttaaccagtttcagtaaaataatgcatgtgtgtgtgtgtgtgtgtgtgtagggggagggagagggccacggggttgataggggaggacgaatatggttcaatgcagtaaaagtctaccaaattcaactggcaagacatataagtgtgtttactttttgcttttttgtcttcagaaaatagattttccaaagttttgtattttataagatcgcttctaccaactg

SEQ ID NO: 11324 - DNA, 365 bp, Homo sapiens
  AL035697.19_63572
  Located on chromosome 6
  Distance between a terminus base of telomere on chromosomal short arm and 5'-terminus of this base sequence : 168971140
  Distance between 3'-terminus of neighbour sequence of sequence listing upward to telomere on chrosomal short arm and 5'-terminus of this base sequence : 1141
aacatctatgacgtaagctaggagcttatgtcaacatctatgcaaaagatggcactggcttgaaccgggaaggtagtgctggaggtaggatgagtgtttgaattctgggtataaattaaagggagaagttgcagaattttcagtcaggttggatgcctggtgtgagaggaaaagaggagtcaactgtgagtggagtgtagttccccgtttcctgagaagacaggaggcgggtaggggtggggacaactgtggtagaagaaagggtatgtgtgtgtgtgcacgtgtgtgtgtgtgtgtgtgtgtgtagggagttgaggcatgaaataattatttctattgtgctcgtgttcagtttgataagctat

SEQ ID NO: 11325 - DNA, 239 bp, Homo sapiens
  AL035697.19_67237
  Located on chromosome 6
  Distance between a terminus base of telomere on chromosomal short arm and 5'-terminus of this base sequence : 168974915
  Distance between 3'-terminus of neighbour sequence of sequence listing upward to telomere on chrosomal short arm and 5'-terminus of this base sequence : 3410
ataccatcactgtgcctatgatttctgaaaacttcaaatatgttttcatatgctctactcattctcccacaaaatttttaaaataattatactgtatccacactgttaacacatgcggccatttcgaactatgctgtctttctcttaaccttcatgttatcttacttctatacacacacacacacacacacacacacacgcatgcaggcacaaccatcagtacttatgttgatggttga

SEQ ID NO: 11326 - DNA, 430 bp, Homo sapiens
  AL035697.19_93875
  Located on chromosome 6
  Distance between a terminus base of telomere on chromosomal short arm and 5'-terminus of this base sequence : 169001530
  Distance between 3'-terminus of neighbour sequence of sequence listing upward to telomere on chrosomal short arm and 5'-terminus of this base sequence : 26376
tgtcaaagctgaagattatcctaggaaaaactttcatctatctgtgtttgtgtatttacaacttcctctatcatccagacatggtggctcacacctgtaatcccagcactttgggaggccaaggcagatggatcaccttaggtcaggagtttgagaccagcctggccaacacagtgaaatcctgtctctactaaacacacacacacacacacacacacacacacacacaaaatagccaggcgtggtggcatgcccttgtaatcccagctactggggaggtttgaacctgggaggcagaggttgcagtgagccgagattgtgccactgcaccagcctgggcaacagagtgagactctgtctcaaaaaaaaaaaaaaagtttctctatgtatcaatttttattttaagaactttcataggcatgagtaaagc

SEQ ID NO: 11327 - DNA, 353 bp, Homo sapiens
  AL035697.19_95805
  Located on chromosome 6
  Distance between a terminus base of telomere on chromosomal short arm and 5'-terminus of this base sequence : 169003485
  Distance between 3'-terminus of neighbour sequence of sequence listing upward to telomere on chrosomal short arm and 5'-terminus of this base sequence : 1525
gagctgtcgtcttatgactcagatccatgttcacccaggttgggaagctcaatgctgcatccatgtagctgatcccagcataggcctgacataggaaaaagactatgggagcccttgtgccagtgactaaattccaaccagcatctttccagtgagatggcctattccaacacacacacacacacacacacacacacacacacacacacacacacacacatacacattttgtaagatcttgaaaaccataaaccaaaatagatccatgatttactggttaattttttgatgatgaactatagagcattaccaaaaagcctaaaatgtttttctgtttgactttcatgccttac

SEQ ID NO: 11328 - DNA, 224 bp, Homo sapiens
  AL035697.19_123326
  Located on chromosome 6
  Distance between a terminus base of telomere on chromosomal short arm and 5'-terminus of this base sequence : 169031013
  Distance between 3'-terminus of neighbour sequence of sequence listing upward to telomere on chrosomal short arm and 5'-terminus of this base sequence : 27175
taaggtccttcagcaccaccaaaatacgtacctctaaaaattacgggcaaaacagaaacagggcaggtatttcgttggttgattgacccacttatttattaatttattcaataaatatatattaatatataactaagaaaaatgtatatgtatattaataatacacacacacacacacacacacacacacacacacacaaatttaagaacctctatggaccagg

SEQ ID NO: 11329 - DNA, 157 bp, Homo sapiens
  D6S411
  Located on chromosome 6
  Distance between a terminus base of telomere on chromosomal short arm and 5'-terminus of this base sequence : 169031088
  Distance between 3'-terminus of neighbour sequence of sequence listing upward to telomere on chrosomal short arm and 5'-terminus of this base sequence : -149
tggttgattgacccacttatttattaatttattcaataaatatatattaatatataactaagaaaaatgtatatgtatattaataatacacacacacacacacacacacacacacacacacacaaatttaagaacctctatggaccaggcactgtga

SEQ ID NO: 11330 - DNA, 434 bp, Homo sapiens
  AL078583.15_118764
  Located on chromosome 6
  Distance between a terminus base of telomere on chromosomal short arm and 5'-terminus of this base sequence : 169052296
  Distance between 3'-terminus of neighbour sequence of sequence listing upward to telomere on chrosomal short arm and 5'-terminus of this base sequence : 21051
ggctatgaggaatttattggacagttttcattcaatggggagataaaaacgctttttgaaatgtcttgctatctgtagttagaggaatatcctcctcttcttacatttctatttcattttctatatgcagttgctaggggtacgcacacacccagacaaacacacacacacacacacacaccccacacacacacattcctcagggctttttattcattggaaatttgccatagctaaacacagccactgaaataaaaacatatcctgacatgcattcttacccaatttatcccatttaggactgtagaaagtatctgggaagaaaaactaataaaaaaatgtgtaagtcgttaactatttcttgttgagttcttttccccccagcagtacattaaaatggtctgtacaaattgatagcttcagcattcaaagtg

SEQ ID NO: 11331 - DNA, 306 bp, Homo sapiens
  AL078583.15_415
  Located on chromosome 6
  Distance between a terminus base of telomere on chromosomal short arm and 5'-terminus of this base sequence : 169170665
  Distance between 3'-terminus of neighbour sequence of sequence listing upward to telomere on chrosomal short arm and 5'-terminus of this base sequence : 117935
attgcgtttgttatgagaactaactcctttatataggaatagcccagttgaagcaataccacttgactggatattttcaattcataggatattaatggatatagcacacataggacatatatatatatatatatatacacacacacacacacacacacacatatataaattagtacaaaattgttttgcctcctaacttgcaaggcctgtaaacccattcttttttctttttacatagatatgttgagatttttacatcttggcaaaatataggctgtaatttaattgacttagcaacactaccaa

SEQ ID NO: 11332 - DNA, 226 bp, Homo sapiens
  D6S305
  Located on chromosome 6
  Distance between a terminus base of telomere on chromosomal short arm and 5'-terminus of this base sequence : 169194964
  Distance between 3'-terminus of neighbour sequence of sequence listing upward to telomere on chrosomal short arm and 5'-terminus of this base sequence : 23993
caccagcgttagagactgctgtgtgttgacagcccgtttgctttttctccttggcacagggccagatcctgtttcctcccccatcctttctactccctgagcacacacacacacacacacacacacacacacacacacacacacacacacacggcgtggctaggcagggccatgtggctgagttctggtacaaggaacgtggaaataagtgacatgctccatttgc

SEQ ID NO: 11333 - DNA, 464 bp, Homo sapiens
  chr6.fa.O7frz.174162928
  Located on chromosome 6
  Distance between a terminus base of telomere on chromosomal short arm and 5'-terminus of this base sequence : 169454665
  Distance between 3'-terminus of neighbour sequence of sequence listing upward to telomere on chrosomal short arm and 5'-terminus of this base sequence : 259475
aactggtcctaattaaatcaattcagataatgtagtataaacgatctttgggaatacagtatcataatgtttgaaagttatgaaaaataaaggggagcagcaaatatgcatttttaaaagctatacacaaaattggcctcgctcacagggtcattcaattgtgtgtgtgtgtgtgtgtacacatacatatatatatatatatatagagagagagagagagagagagagagagagagagtgtctactacatgtcaggtactatattagttactttatatatttagcacctcagagcttgctgaaaacaacccttatggaagatgctattattattccctatgttaaaagtgcagaaactgttttcaaggtcactcaaaaagtagtgctggtaaaacagctagaaactgggtgtttcttgctccaatgcctttaaggctatactgtgctgtcttcataaattgatc

SEQ ID NO: 11334 - DNA, 149 bp, Homo sapiens
  HUMUT1349
  Located on chromosome 6
  Distance between a terminus base of telomere on chromosomal short arm and 5'-terminus of this base sequence : 169543342
  Distance between 3'-terminus of neighbour sequence of sequence listing upward to telomere on chrosomal short arm and 5'-terminus of this base sequence : 88213
gccttagtggtggtgtcagtaggtgacaacatttggatagcctggggctcaatctgttctatctatctatctatctatctatctatctatctatctatctctgatatatatttgaattcttatatatgcgctgacccagcaaccaatat

SEQ ID NO: 11335 - DNA, 432 bp, Homo sapiens
  chr6.fa.O7frz.174369213
  Located on chromosome 6
  Distance between a terminus base of telomere on chromosomal short arm and 5'-terminus of this base sequence : 169723579
  Distance between 3'-terminus of neighbour sequence of sequence listing upward to telomere on chrosomal short arm and 5'-terminus of this base sequence : 180088
taccaacctcattgaacattatcataatgctaagggcctatgggtgagtattatatgccttaaacatacacacacacacacacacacacacacacacacacacagacacacacacttcccagagaaagcagttacgtgacttttggaaacataaccaaactgtcaaaagaacataaaactagttactcatatttggaaaggtaattcagtactatttgttctgctatggtgtaaaaaaaatccacaatattttaatggcaatagttattaaatagtgaaaatctagcagcatttacatcaactaatgttaagttccataagtactatgcccaaatattattttatcccttatcatgttaattcctgccattgaaacttacacccagttttcaaagaactttgatttttgcctcacctaagacagcaagtcta

SEQ ID NO: 11336 - DNA, 308 bp, Homo sapiens
  AL008631.1_75162
  Located on chromosome 6
  Distance between a terminus base of telomere on chromosomal short arm and 5'-terminus of this base sequence : 169808032
  Distance between 3'-terminus of neighbour sequence of sequence listing upward to telomere on chrosomal short arm and 5'-terminus of this base sequence : 84021
ttcttaagctcaatttacaagcacaaattctctaatcttattgtgagaaggctgttacgaataatttttgttgttcatacagagaaattgagaaacaacgataataattgctcaaattattgaagttaagaagaaaataaaaattaatggtctagtgtttattcttataaaccctcctcacaacacacacacacacacacacacacagagagagagagagagagagagagagagagagagagagagagagagagagagaaattttccacttgtctgcaaatagtccctaaggttcttagccaaggtgt

SEQ ID NO: 11337 - DNA, 307 bp, Homo sapiens
  AL008631.1_75110
  Located on chromosome 6
  Distance between a terminus base of telomere on chromosomal short arm and 5'-terminus of this base sequence : 169808033
  Distance between 3'-terminus of neighbour sequence of sequence listing upward to telomere on chrosomal short arm and 5'-terminus of this base sequence : -307
tcttaagctcaatttacaagcacaaattctctaatcttattgtgagaaggctgttacgaataatttttgttgttcatacagagaaattgagaaacaacgataataattgctcaaattattgaagttaagaagaaaataaaaattaatggtctagtgtttattcttataaaccctcctcacaacacacacacacacacacacacacagagagagagagagagagagagagagagagagagagagagagagagagagagaaattttccacttgtctgcaaatagtccctaaggttcttagccaaggtgt

SEQ ID NO: 11338 - DNA, 131 bp, Homo sapiens
  D6S1599
  Located on chromosome 6
  Distance between a terminus base of telomere on chromosomal short arm and 5'-terminus of this base sequence : 169839247
  Distance between 3'-terminus of neighbour sequence of sequence listing upward to telomere on chrosomal short arm and 5'-terminus of this base sequence : 30907
cttcagatgtaggctccacgaaaaagtgatgaagagagagggacagacagtgtgtgtgtgtgtgtgtgtgtgtgtgtgtgtgtgtatgcgtgtgtgttgaggggggggatggctggaacctgtggaaaaca

SEQ ID NO: 11339 - DNA, 347 bp, Homo sapiens
  chr6.fa.O7frz.174747020
  Located on chromosome 6
  Distance between a terminus base of telomere on chromosomal short arm and 5'-terminus of this base sequence : 170040181
  Distance between 3'-terminus of neighbour sequence of sequence listing upward to telomere on chrosomal short arm and 5'-terminus of this base sequence : 200803
agacagcctcttaactaatgattcgcattaaaaaggaaaattatgactttaacacatgcgtattggtgccactaccagattgcacgggaaatgaacctgactgaatctggacatttttgtgttcttagaatattttacttacaaatataacagttgtataaaaagtaataatacagaagtgttggtatctatcctttcactttttccactcacacacacacacacacacacactaccgcagataggcaagcaggccgactgaagcatgttgaataaatcatacttctattcttactgttctgctgcttttttcactaagcaatgtatgatggacatctttgataaag

SEQ ID NO: 11340 - DNA, 305 bp, Homo sapiens
  chr6.fa.O7frz.174838183
  Located on chromosome 6
  Distance between a terminus base of telomere on chromosomal short arm and 5'-terminus of this base sequence : 170130841
  Distance between 3'-terminus of neighbour sequence of sequence listing upward to telomere on chrosomal short arm and 5'-terminus of this base sequence : 90313
tttagaagtctggttaagcctcacataggctgctgcttgaaagccacagtaaatgtgccttgttgattaacacggagctgctgtccctctcatactacctgatccctcccttccctctattctgaactcagctgctttaaggagaaggatgactgggctgggtttaagatctccctatccccaggggacagaaagcccctggcaccccctacaaacacacacacacacacacacacacacacacacacacacacaactgtttggtatgatgaggaagaaaggaactcaactgttatgagtccaag

SEQ ID NO: 11341 - DNA, 441 bp, Homo sapiens
  chr6.fa.O7frz.175004430
  Located on chromosome 6
  Distance between a terminus base of telomere on chromosomal short arm and 5'-terminus of this base sequence : 170272538
  Distance between 3'-terminus of neighbour sequence of sequence listing upward to telomere on chrosomal short arm and 5'-terminus of this base sequence : 141392
tggtgtccatctacctatcttatgtaagagagtgaaaagtatagaaggaaaaagaaagaaaagagaaaagaaaagaaaggaagggagaaaggaagggaggaaggaaggaagggaaaagagaaaagaaaagggagggagggagggagggaggaaggaaggaaggaaggaaggaaggaaggaaagatggaaagctccatcctggataaattttgtcattagaagtattactaatgcataactttcagaacacctgttgttaaccagcaggcttgtccacaagtaaatctgaaccatgatgactctagaacccagggcttgatccttctccgtctcagaggggctacaattcaatccagtttttttgtgatcagcttcccccagaactggtgattgcctccatctgactagagtagggtggggtttaagtattcctatgcgtcc

SEQ ID NO: 11342 - DNA, 472 bp, Homo sapiens
  chr6.fa.O7frz.175092098
  Located on chromosome 6
  Distance between a terminus base of telomere on chromosomal short arm and 5'-terminus of this base sequence : 170359940
  Distance between 3'-terminus of neighbour sequence of sequence listing upward to telomere on chrosomal short arm and 5'-terminus of this base sequence : 86961
ggatcaaggacttaaatctaagacctgaaactataaaaaacctagaagataacattggaaaaacccttctgacattgacctaagcaaggatttcatgaccaagagcccaaaagcaaatgcaataaaaacaaagataaatagctgagacttaattaaactaaagagctattgcagccatttacatccagtatctcatttgggcccagagccaacctgatgaggactcaaagattatttcaagggagggaaaagcacaggtaatgaggctttcttctttttggtgtttttctttattccttactcttcttgctcttctctacttctttcatctcatctctcctatcttttttcctcctttctcctattctttgttctccttattccttttccattaattttacatctcctgtatttgacgtgtgtgtgtgtgtgtgtgtgtgtgtcacttagctgattctagcatgttctggta

SEQ ID NO: 11343 - DNA, 397 bp, Homo sapiens
  chr6.fa.O7frz.175192852
  Located on chromosome 6
  Distance between a terminus base of telomere on chromosomal short arm and 5'-terminus of this base sequence : 170457408
  Distance between 3'-terminus of neighbour sequence of sequence listing upward to telomere on chrosomal short arm and 5'-terminus of this base sequence : 96996
tttgcagaaatttccacacactaaagtagaggacacttgatccagagagggtggagtgaattaactaaagagcaatttatttactcttttatttatccatccatccatccatccacctatccatccagctatccatccatccatccatccatccatccatccatccatccatccatccatccatccattcacccaggtctctgtgacagaccctgagccatgctaagttctgggccagatataaagcagaaataaagaaagatagacctaacgagagaggcgaattgtaaacaagtgtgtgtgtgcatgcatgtgtgtacatgtgcctatatgtggtgttgggaacaaatgcctcaatgtgcaaaacactgtaaccctctttgtcatccgtaactgt

SEQ ID NO: 11344 - DNA, 224 bp, Homo sapiens
  AL078585_40002
  Located on chromosome 6
  Distance between a terminus base of telomere on chromosomal short arm and 5'-terminus of this base sequence : 170596380
  Distance between 3'-terminus of neighbour sequence of sequence listing upward to telomere on chrosomal short arm and 5'-terminus of this base sequence : 138575
catcaaggagtgtgagtccagggagatctgagcagcacctgtcaaaggaggaggaggaggaggaggaggaggaggaggaggagctctgcttctcaggctcaatttccactgaggaatcccagcatttttaactcataacccaagcttttgcctctgggtcatagtggatcaaaagataaatgggccttttcaattttgtatttccaatctcagatactcgaatc

SEQ ID NO: 11345 - DNA, 273 bp, Homo sapiens
  AL031121.5_114468
  Located on chromosome 6
  Distance between a terminus base of telomere on chromosomal short arm and 5'-terminus of this base sequence : 170740007
  Distance between 3'-terminus of neighbour sequence of sequence listing upward to telomere on chrosomal short arm and 5'-terminus of this base sequence : 143403
aataagccagacgtagtgtcagcagcctgtaatcccagctactcgggaggctgaggtgagagaattgcttaaacctggaggcagaggttgcagtaagctgagactgcatcattgcactccagcctgagcaacaagagcaaaactccatctcaaatatatacatatatatatatatatatatatatatatatatatatatatatatatatatacatagagagagagagagagagagttaaaaaactctgtgaaatggttacatccttaggaaat

SEQ ID NO: 11346 - DNA, 246 bp, Homo sapiens
  DISO7_00035600
  Located on chromosome 6
  Distance between a terminus base of telomere on chromosomal short arm and 5'-terminus of this base sequence : 170817388
  Distance between 3'-terminus of neighbour sequence of sequence listing upward to telomere on chrosomal short arm and 5'-terminus of this base sequence : 77108
gggaactgcttggtgagtgccgaaggaggatctgacaaagctgattgtgtgtgtgtgtgtgtgtgtgtgtgtgtgtgtgtgtgtgtgcaggtgcgtgtgtgtgtgcatgtgcgtgcctggtttctgtgtcggtgtgtgcaggcacgcattaattaacgtaattcctcaacatccaacaagagcgcatcagaaacccgggagaaaaagcctcatgcatatttagatgagacttctaccttccaaccg

SEQ ID NO: 11347 - DNA, 179 bp, Homo sapiens
  chr6.fa.O7frz.175794627
  Located on chromosome 6
  Distance between a terminus base of telomere on chromosomal short arm and 5'-terminus of this base sequence : 171040574
  Distance between 3'-terminus of neighbour sequence of sequence listing upward to telomere on chrosomal short arm and 5'-terminus of this base sequence : 222940
gacaatggcctttagctttcttctggggtcacggacccctttgagattctcatggaagctatgatttcccttacagaaaaatacacacacacacacacacacacacacactttaccactctaatatcaccttgaatctcatattgttttctagaattttagatgcaaatcgacatagac

SEQ ID NO: 11348 - DNA, 299 bp, Homo sapiens
  AL078602.13_6526
  Located on chromosome 6
  Distance between a terminus base of telomere on chromosomal short arm and 5'-terminus of this base sequence : 171234291
  Distance between 3'-terminus of neighbour sequence of sequence listing upward to telomere on chrosomal short arm and 5'-terminus of this base sequence : 193538
gattccagtctgaaacatcaagcctcttcattttaaaattcaattgagaagagtggtcaatttagagattaaaatggattccagccataaggggccagttaagttctttaaatcaattaaatcaattaataatcaatagatatgtgtgtgtgtgtgtgtgtgtgtgtatatgtatctcccttgagatatgtgtgtgtgtgtgtatatatatatatttaattcaccattgctgccttgaaaccttgatattttgatgcaggtggcctatgattaaaattagaatagcaacagacatccat

SEQ ID NO: 11349 - DNA, 281 bp, Homo sapiens
  AL078602.13_7522
  Located on chromosome 6
  Distance between a terminus base of telomere on chromosomal short arm and 5'-terminus of this base sequence : 171235339
  Distance between 3'-terminus of neighbour sequence of sequence listing upward to telomere on chrosomal short arm and 5'-terminus of this base sequence : 749
attcctgaataaaagcaaggagttgccccatgactttgacatttaatattaggctgatcttttcaggccattttcttcccacatatctatacacacacacacacacacacacacacacacacacacacttttttgtattattctgcagtcctcacagtcatagttaaaggtttgggatggagtcccagagctatgctagttcaagcccctgcctcaagcaatgctagccagctgaatcgtaaagatggcaataaatcctattagtgcagatttcaaggact

SEQ ID NO: 11350 - DNA, 300 bp, Homo sapiens
  G08564
  Located on chromosome 6
  Distance between a terminus base of telomere on chromosomal short arm and 5'-terminus of this base sequence : 171301035
  Distance between 3'-terminus of neighbour sequence of sequence listing upward to telomere on chrosomal short arm and 5'-terminus of this base sequence : 65415
aagacagtgtctaagctgtcacagaacttacaagtggatacacaatagaaagacagatagatagatagatagatagatagatagatagatacatacatacatacatacatacatacatacatacatagatggcttcctttgttgttagcagggttaagttcttaagcttataataagtattggtcctatttgttccctaattacatccacaggcttttattctacttaacgtcagttgtttaaagagaatgacccactttcagtccctcccaggccctgtgctgtcttaccctgcagtgt

SEQ ID NO: 11351 - DNA, 270 bp, Homo sapiens
  AL078602.13_98814
  Located on chromosome 6
  Distance between a terminus base of telomere on chromosomal short arm and 5'-terminus of this base sequence : 171326592
  Distance between 3'-terminus of neighbour sequence of sequence listing upward to telomere on chrosomal short arm and 5'-terminus of this base sequence : 25257
gataatccaaattgatgccaccctttggttaaaaatacctgtggattttgtttctctccccacctactcacccttgccacaaaaatggaactgttgcatcatggccccactgctttgtaacctgctttttgtgtgtgtgtgtgtgtgtgtgctaaaaagtgcatatatttttatttaatattattttgaagattgaatcacatcccataaaattgatgtactataattcatttacgtgatccttaagtttggacataaagtttagacgtt

SEQ ID NO: 11352 - DNA, 443 bp, Homo sapiens
  AL118518.13_4169
  Located on chromosome 6
  Distance between a terminus base of telomere on chromosomal short arm and 5'-terminus of this base sequence : 171425879
  Distance between 3'-terminus of neighbour sequence of sequence listing upward to telomere on chrosomal short arm and 5'-terminus of this base sequence : 99017
taggctgtaggaaacgtgtaatacagaacaaggaagtgaatgactactcttactaaagaattaggctccattttaggggaaataatattttcaaatttaattttgcacataggagtgcaatcttaatattaaaaaatcattaccaaaggcttctctcgcttgtgataggaaatttttaccattattttatgtgtctctgtatgtgcttggcttgcactgctaatacaccattctaaatggatcagttctcggagaattaattagagtttaagacatgcacacaccacaccacacacacacacacacacacacacacacaatgagaaatattgtagttggtcaaatcaataatccatgtatccaagttttctgcgctagaagaagtaccaagagattttgaaatgtaaaagaatatggttgtttaagatgacatcggtatcaat

SEQ ID NO: 11353 - DNA, 392 bp, Homo sapiens
  Z97205.1_66078
  Located on chromosome 6
  Distance between a terminus base of telomere on chromosomal short arm and 5'-terminus of this base sequence : 171555678
  Distance between 3'-terminus of neighbour sequence of sequence listing upward to telomere on chrosomal short arm and 5'-terminus of this base sequence : 129356
tgattgtgatggttaatactgagtgtcaacttgattggattgaaggatacaaagaattgattctgggtgtgtctgtgagggtgttgccaaaggagattaacatttgagtcagtgggctgggaaaggcagatccacccttaactggggtgggcacaatctaatcggctgccagtgaggctagaatataagcaggcagaccttgtgatcatgtgagttaatacttaaaaaactcctttatatatatatatatatatatctatatctatatctacatatatatatatatatatatatatatatatatctattccattagttctgtccctctagagaaccctgactaatacaaagatttacatatatttctgtttaatgtttatagttccaaaggc

SEQ ID NO: 11354 - DNA, 315 bp, Homo sapiens
  Z97205.1_121672
  Located on chromosome 6
  Distance between a terminus base of telomere on chromosomal short arm and 5'-terminus of this base sequence : 171611438
  Distance between 3'-terminus of neighbour sequence of sequence listing upward to telomere on chrosomal short arm and 5'-terminus of this base sequence : 55368
aatcttaagctgaaccatgataaatcaggggctgtctgtatatgtatatatatctatctgtgtatctgctgtctgtctttatatctatctatcatctctatctatcatctatctatctatctatctatctatctatctatctgtctataatctatatctacctatcatctatatctatctatctatatctatccatctatctatctatctatctatctatctatctatctatctatctatcatctatctctatcctatctatgtatctatctatccatccatctaatttttctctgaatgacttcagatctttaa

SEQ ID NO: 11355 - DNA, 296 bp, Homo sapiens
  chr6.fa.O7frz.176538975
  Located on chromosome 6
  Distance between a terminus base of telomere on chromosomal short arm and 5'-terminus of this base sequence : 171731349
  Distance between 3'-terminus of neighbour sequence of sequence listing upward to telomere on chrosomal short arm and 5'-terminus of this base sequence : 119596
cctgtcaatattgcagaaatagaaagcattacccaattaatagtgggaaggaaaggtgggatgggtgaaggaatgatcacttataggatacttgtttggtgccagatactatgaaaattatattacttgtactatttcttcataagatattttattagattcccatgctacaaggaaggatgtagaggaaaaaaacattatctatttatctatctatctatctatctatctatctatctacctcttcatttaatagtggcaatgggaggaatgaaaacataacagtctgcttcatg

SEQ ID NO: 11356 - DNA, 181 bp, Homo sapiens
  DISO7_10002269
  Located on chromosome 6
  Distance between a terminus base of telomere on chromosomal short arm and 5'-terminus of this base sequence : 171782298
  Distance between 3'-terminus of neighbour sequence of sequence listing upward to telomere on chrosomal short arm and 5'-terminus of this base sequence : 50653
aatgaaggcttctttcacatctttgagtcttttctatttcactgaaatatatatatatatatatatatatatatatacactctatcatatgcttaaatacaatattagagataattataataaacatttaattagatcacaaagtatggaagtattagaacaatgttaacagacttgctta

SEQ ID NO: 11357 - DNA, 168 bp, Homo sapiens
  DISO7_10002270
  Located on chromosome 6
  Distance between a terminus base of telomere on chromosomal short arm and 5'-terminus of this base sequence : 171862882
  Distance between 3'-terminus of neighbour sequence of sequence listing upward to telomere on chrosomal short arm and 5'-terminus of this base sequence : 80403
gaccaagtccatatgcagccacgatccattgttttgtaccttttcacaattaaacatccagaaatgattttctatgcttactttctctactcaaccctcatcccatcaactcccaaacacacacacacacacacacacacacatccactgataccattcttgttagga

SEQ ID NO: 11358 - DNA, 369 bp, Homo sapiens
  chr6.fa.O7frz.177003659
  Located on chromosome 6
  Distance between a terminus base of telomere on chromosomal short arm and 5'-terminus of this base sequence : 172121981
  Distance between 3'-terminus of neighbour sequence of sequence listing upward to telomere on chrosomal short arm and 5'-terminus of this base sequence : 258931
cagctacagtcattaacagagtaacatattgtcatatggatagacaattagaacaggggaacagaaggtctgaaacagtcacgcatttatgtggtcagctgatttataccaaaggtgcaaactagaagtaggtagaaaaaccagccttttcagtaaagtttcgagaagatccttcacacacacacagagagagagagagagagagagagagagacgatatgcaaatgaacagtcaacatataaaaatatactcaactttattataaacaaggggatgcaatttaaaactctcataggatatccctatataaccaatagagtagctaaaatgggaaaagacagatactaccaaatttagcaaagatatga

SEQ ID NO: 11359 - DNA, 159 bp, Homo sapiens
  chr6.fa.O7frz.177224498
  Located on chromosome 6
  Distance between a terminus base of telomere on chromosomal short arm and 5'-terminus of this base sequence : 172381529
  Distance between 3'-terminus of neighbour sequence of sequence listing upward to telomere on chrosomal short arm and 5'-terminus of this base sequence : 259179
tcttatttctgatcgcaaatagtattagggttagccaccaagcacgttttgctttaaatagcaatgggatgtcaaagcgcgcgcacacacacacacacacacacgagacaaaagtttgctgccacttagaatctttagataagctagttctaggctcca

SEQ ID NO: 11360 - DNA, 412 bp, Homo sapiens
  AL023579.1_5542
  Located on chromosome 6
  Distance between a terminus base of telomere on chromosomal short arm and 5'-terminus of this base sequence : 172442399
  Distance between 3'-terminus of neighbour sequence of sequence listing upward to telomere on chrosomal short arm and 5'-terminus of this base sequence : 60711
tgaataccagatggtaccaaagaaatatctttattttttgataaatgtgataaagacattatggttaagtaaggaaatgtccacatatttagaggtagatatactaaatttatagcagtaaaatcataaaacatctggaaatttgctttaaaatacctcagtagtgtgtatgtgagtgagaatctgtgtgtgtgtgtgtgtgtgtgtgtgtgtgtgtgtatgaaagagagagagagagacatagagggagaaagggactacatgcaaagaacacatagagagaccacaagtatggctaaatctagaccttatttggatttaagatatatggaacttctttgaaaatgttcattaaacatgtaattctaaaaattgagtagtcactgctggctagctatgatggagcaatacg

SEQ ID NO: 11361 - DNA, 376 bp, Homo sapiens
  AL023579.1_8243
  Located on chromosome 6
  Distance between a terminus base of telomere on chromosomal short arm and 5'-terminus of this base sequence : 172445119
  Distance between 3'-terminus of neighbour sequence of sequence listing upward to telomere on chrosomal short arm and 5'-terminus of this base sequence : 2308
ttgaaagctaagtttctgtgactccaaaaattttttgtgtttttaaaatttctaatcattttacagaatccctcgaaaatcaggatcaaaacaaggttcaatacagtattagaattagaattctccagagaaaaagaatcaatagtatagataggtagataaagaagatagatagatagatagatagatagatagatagatagatagatacacacacataaagagatttattataaggaattgactcacccaattatggaggttggcaagcacaaaatgtacaactgctcttgccaaatatcaaggttaacccttgtaggtatatctgagcccatcaagctaccacttggtttcaagctgccaagtattctttact

SEQ ID NO: 11362 - DNA, 440 bp, Homo sapiens
  AL023579.1_19978
  Located on chromosome 6
  Distance between a terminus base of telomere on chromosomal short arm and 5'-terminus of this base sequence : 172456833
  Distance between 3'-terminus of neighbour sequence of sequence listing upward to telomere on chrosomal short arm and 5'-terminus of this base sequence : 11338
aacagctaaaagctccttatttagcatgaatcctatatacagtacagttttacaacttatattcctcatgctgtgccttagatcttgagagtcattcatcctacagctgccattttgtgtcctttgagctacatctcccctcttttcccctgcctctggtagccactgttttgctctctatttctgtgtatgtatgtatgtatgtatgtatgtatgtatgtatatatatatataatatatatttaattccacatataaatgagatcatgcaaccattttctttatgtgtctggctcatttgacatagcatatctcctaggctaacccatgttgtggcaaatggtgagatcttgttctttttcagggccaaataatattccattgtgtatatgtactacagcttctttatccattcatccctcaatggacacttaggttgt

SEQ ID NO: 11363 - DNA, 243 bp, Homo sapiens
  AL023579.1_59106
  Located on chromosome 6
  Distance between a terminus base of telomere on chromosomal short arm and 5'-terminus of this base sequence : 172496046
  Distance between 3'-terminus of neighbour sequence of sequence listing upward to telomere on chrosomal short arm and 5'-terminus of this base sequence : 38773
acaactcaagttgagatttggttggggacacagtcaaaccatatcaatgggcatagatacaaatgtacatattgacatatacatttacaattgatatcatggtgtgtgtgtgtgtgtgtgtgtgtgtgtgtctgtttcctggctctggttcctatctgctgagaggaactaaaagcaataacatctagcagcaattggcatatctagtgcccaaaccttggctttcaaacaccatcctcacta

SEQ ID NO: 11364 - DNA, 422 bp, Homo sapiens
  chr6.fa.O7frz.177655172
  Located on chromosome 6
  Distance between a terminus base of telomere on chromosomal short arm and 5'-terminus of this base sequence : 172597121
  Distance between 3'-terminus of neighbour sequence of sequence listing upward to telomere on chrosomal short arm and 5'-terminus of this base sequence : 100832
tagaaatgattaatcattcctgacatttactaaggtaaaaatgtcacagataaatagacggatggatggatagataggtagatagagatagatagatagatagatagatagatagatagatagatagatagataatagatatataaagcagttaaactacagacagaacaaaaaaacattcaaggtgaacattttatttagttatttcatttgttgacttatcactattattctgtctcttctacaaagagaaccaggaatcaaaatttctgaaaattcactctctgctcatcatctatgggcacgcattttcaaaaggtgttctaaaaaatgaataccttattgattactagaaattcagcctcaaacctctataatccctgccaatgtggtaatgtgggtcagaccaagaaatcttgatt

SEQ ID NO: 11365 - DNA, 420 bp, Homo sapiens
  chr6.fa.O7frz.177529605
  Located on chromosome 6
  Distance between a terminus base of telomere on chromosomal short arm and 5'-terminus of this base sequence : 172622578
  Distance between 3'-terminus of neighbour sequence of sequence listing upward to telomere on chrosomal short arm and 5'-terminus of this base sequence : 25035
gtcacttctgaaattaggttacagaagacattgtgattccatcttctctctttctgtctctctctttcacacagacacacacatgcatgcgcacacacacacacacacacacacaccttttctcagatcactcattctagggaaagccagatgccaggtgataagcagccccagccccatggagaggcccacatggtaagcaactgtggctcctgccaatagccccgggatcttccagccccctcaggtcttcaggtgactgaagtctcagccaacagcttgcctgctcatgagaaactgagccagaagtgcccagctatacccagaaccccaccctcacaaaacgtgacagataattcatgggcattgtcttcagctgctaggttttagagcaatgaggtaccaacagacacctcgtac

SEQ ID NO: 11366 - DNA, 260 bp, Homo sapiens
  AL117345.21_53237
  Located on chromosome 6
  Distance between a terminus base of telomere on chromosomal short arm and 5'-terminus of this base sequence : 172801319
  Distance between 3'-terminus of neighbour sequence of sequence listing upward to telomere on chrosomal short arm and 5'-terminus of this base sequence : 178321
cctatcactgtgaccaaggtcaaggcaagctgtgagcaaatacccacttcctgcttttccctaccatgagtaacgtgtgtgtgtatgtgtgagtgagtgtgtgtgtgtgtgtgtgtgtgtgtgtgtgtgtgtgtatgggggggggcgactaaaggttagcttttcaagtctattgtattattctccttgcttgctgttgtcactgtgttagccagcagtactcttctgaatgccctgcttatccagtagataccactggc

SEQ ID NO: 11367 - DNA, 375 bp, Homo sapiens
  AL117345.21_31645
  Located on chromosome 6
  Distance between a terminus base of telomere on chromosomal short arm and 5'-terminus of this base sequence : 172822757
  Distance between 3'-terminus of neighbour sequence of sequence listing upward to telomere on chrosomal short arm and 5'-terminus of this base sequence : 21178
tgtacctagcatctaggagtgattaatgcttatgtgtggaacgaacaaatgtccatgtcagttataaattttataaccttataaccaaaagaagaaaaaaaaagactgaactcggctgaaattagttatctataaacttgtagacttggagaagtattaaacttttattttcatgtaaccccaaaaataattcagtttaagaattgttattcattagtatctaagagtattcaaattcaagatgagggaaaaggatgtgtgtgtgtgtgtgtgtgtgtgtgtgtgtgtttctgtgtgtgatcatgtcaccactaacaggagatagttgaattttaggagataactttgtgactcaatgcactggtataagatgta

SEQ ID NO: 11368 - DNA, 204 bp, Homo sapiens
  AL136130.7_58742
  Located on chromosome 6
  Distance between a terminus base of telomere on chromosomal short arm and 5'-terminus of this base sequence : 172865433
  Distance between 3'-terminus of neighbour sequence of sequence listing upward to telomere on chrosomal short arm and 5'-terminus of this base sequence : 42301
acactaaatctagaaatgccatttataacatagggtaccacaaaccaaagccaaaggaaacacacacacacacacacacacacacacacgattttatgcctaaatgttgccatgtcagtaaaattcttgactggtaataaccaaatatagaaacaaaacacaaaatgatttaaatgaaaagtacttaatcatgaaatgtcggtt

SEQ ID NO: 11369 - DNA, 285 bp, Homo sapiens
  chr6.fa.O7frz.177928483
  Located on chromosome 6
  Distance between a terminus base of telomere on chromosomal short arm and 5'-terminus of this base sequence : 172960580
  Distance between 3'-terminus of neighbour sequence of sequence listing upward to telomere on chrosomal short arm and 5'-terminus of this base sequence : 94943
atacgtaatgccactaaattgtacgcttaaaacagcatttaaaatggtaaaaaaacaccatttttcatatatacgtgtgtgtgtgtgtgtgtgtatgaccacaataaaaaagaatgcagttagtttagcaattttaaactacagatattacatcatgttacatagctgtttctagcaataaatttcagagttacatatgaaccaatgccaagaaccaatgctgtacattaaggcttacagagtacttattttttcggtatatagttaccacagatttagtggtca

SEQ ID NO: 11370 - DNA, 459 bp, Homo sapiens
  chr6.fa.O7frz.178164610
  Located on chromosome 6
  Distance between a terminus base of telomere on chromosomal short arm and 5'-terminus of this base sequence : 173156981
  Distance between 3'-terminus of neighbour sequence of sequence listing upward to telomere on chrosomal short arm and 5'-terminus of this base sequence : 196116
tgaaatgaacctaagtgtcaacagacagatgaatgggtaaagaaaatgtgacatatattcacatatatgtatgtacatacacatatacaatggaatacatatatatatatggagagaaagagagagagagagagagagagagagagaggagagatggagtttcactctgtcacccaggctggagtgcagtggtgtgatctcagctcactgcaacctccgtcccccaggttcaagcaattctcctgcctcagcctcctgagtagctgggactacaggtatgtgccaccacgtgctcggctaatttttttgtatttttagtacagacgggttttcactgtgttagcgaggataatctccatctcctgacctcgtgatccacctgcctcaccctcccaaagtgctgggattacaagtgtgagccaccactcctggcctgtgtgatggaatattactcagcct

SEQ ID NO: 11371 - DNA, 110 bp, Homo sapiens
  DISD22_0004747
  Located on chromosome 6
  Distance between a terminus base of telomere on chromosomal short arm and 5'-terminus of this base sequence : 173274450
  Distance between 3'-terminus of neighbour sequence of sequence listing upward to telomere on chrosomal short arm and 5'-terminus of this base sequence : 117010
caatgtgatttcaacagttccgtgtgtgtgtgtgtgtgtgtgtgtgtgtgtgtgtgtgtgaagaatgattgtgctctttggggcaacaaaacagattagggcaatgcatc

SEQ ID NO: 11372 - DNA, 187 bp, Homo sapiens
  DISD22_0004757
  Located on chromosome 6
  Distance between a terminus base of telomere on chromosomal short arm and 5'-terminus of this base sequence : 173425592
  Distance between 3'-terminus of neighbour sequence of sequence listing upward to telomere on chrosomal short arm and 5'-terminus of this base sequence : 151032
atgagcactcccttcgtccccttaaggaggaccgcacagtgtgtgtgtatgtgtgtgtgtgtgagtgcgcgcgcgcgctcatgtgtgcatgtgcctgtgtgtgcatgtgtgtatgtgcgtgtgtgcatgtgtgtgtgcatatatgcgtatatgcgtgcgtgtgtgtggcgcgcacatacgtaagcac

SEQ ID NO: 11373 - DNA, 403 bp, Homo sapiens
  chr6.fa.O7frz.178481107
  Located on chromosome 6
  Distance between a terminus base of telomere on chromosomal short arm and 5'-terminus of this base sequence : 173608269
  Distance between 3'-terminus of neighbour sequence of sequence listing upward to telomere on chrosomal short arm and 5'-terminus of this base sequence : 182490
aaactattaactcagctggcttaggcctgtaatccttgcactttgggaggctgaggcaggtagatcacttgaggtcaggagttcgagaccagcctggccgacatggtgaaataccatctctactaaaactacaaaaattagccaggtgtggtggtgtgcacctgtaatcctagctacttgggaggctgagccaggagaatctcttgaacccaggaggcagaggttgcagtgagccgagatcgcaccactgcactccagcctaggtggcagagtgagacgctgtctaaaaaataaataaataaataaataaataaataaataaataaataaataaataaaaacattaactgttcatttcactcaacctggaaagcactccaaatagataagcaggtgttgacaa

SEQ ID NO: 11374 - DNA, 122 bp, Homo sapiens
  D6S264
  Located on chromosome 6
  Distance between a terminus base of telomere on chromosomal short arm and 5'-terminus of this base sequence : 173712465
  Distance between 3'-terminus of neighbour sequence of sequence listing upward to telomere on chrosomal short arm and 5'-terminus of this base sequence : 103793
ttttccatgcccttctatcaggtctgcagtagcagaagtgtgtgtgtgtgtgtgtgtgtgtgtgtgtgtgtgtgtgtgtgtttgtgttggggcggggtgggaggaacagcataaagtcagct

SEQ ID NO: 11375 - DNA, 280 bp, Homo sapiens
  AL022069.1_169639
  Located on chromosome 6
  Distance between a terminus base of telomere on chromosomal short arm and 5'-terminus of this base sequence : 173763875
  Distance between 3'-terminus of neighbour sequence of sequence listing upward to telomere on chrosomal short arm and 5'-terminus of this base sequence : 51288
ctagtgaacttctggaattaccaccctttgcccattggttgatgcaaagagagagagagagagagtgtgtgtgtgtgtgtgtgtgtgtgtgtgagagagagagagggagagagagagaaaatggaaaagaagtggtgcctgaactgaaggagctgatcctatggggagaagcccatcccaccatcccacaggactggcataaacactgaaggtcatctctggttgaaagccaacagcctccctcctaagtgtctacactgagtgcttaacacagaatgac

SEQ ID NO: 11376 - DNA, 337 bp, Homo sapiens
  AL022069.1_99251
  Located on chromosome 6
  Distance between a terminus base of telomere on chromosomal short arm and 5'-terminus of this base sequence : 173834076
  Distance between 3'-terminus of neighbour sequence of sequence listing upward to telomere on chrosomal short arm and 5'-terminus of this base sequence : 69921
agtcgacttgagtaaagcagttaccctgcacaatgtgggtcagcctcatccaatcagtggaaggcctccttaggaaaaagactgctcccctgaggaagagggaattctgtggcagatagcctgtggtgggcaactgccccatccatttctccttggggctccagcctgccggctgccctgcagtcacagacttccccgtccccacaatcacgtgagccaatttcttacaaataaatctctctctctatacacacacacacacacacacacacacacacacgcacgcatgttctgtttgtttctttggagaaccctgcataagataccaagatagtgg

SEQ ID NO: 11377 - DNA, 263 bp, Homo sapiens
  Z98049.1_119872
  Located on chromosome 6
  Distance between a terminus base of telomere on chromosomal short arm and 5'-terminus of this base sequence : 173949482
  Distance between 3'-terminus of neighbour sequence of sequence listing upward to telomere on chrosomal short arm and 5'-terminus of this base sequence : 115069
taccatcaccgacagttaatattcatctctgggagatgtgtggagtgtgagagagagagagagagagtgtgtgtgtgtgtgtgtgtgtccccaaagctggataaacaagcttgtggtgaagccctggggcgatagctggggcatcacccttacgcacactgtggtgggagacacaggcacaagcccttctccgggctcaggatcccatggctcttgctggcagacccactgtagccctggaagttactgcacatggaaggact

SEQ ID NO: 11378 - DNA, 334 bp, Homo sapiens
  AL023775.1_121648
  Located on chromosome 6
  Distance between a terminus base of telomere on chromosomal short arm and 5'-terminus of this base sequence : 174076941
  Distance between 3'-terminus of neighbour sequence of sequence listing upward to telomere on chrosomal short arm and 5'-terminus of this base sequence : 127196
gtaatcagtgctattgttctggtccattttttctaatgtgtaagtctgcctcctgtatctcattgtgtgtgtgcatgtgtgtgtgtgtgcatgtgtgtgtgtgcgggttggtgtgtgcgtgcgtgtgtgcatgtgtgtgcatgtgtatgggcatgcgtgcgtgtgtgtgtgtgtgtgtgtgtgtgagagagagagaagaagggagggaggagagagattactgaacaaatatttgagtgtctgcctgtcacacaagacatcatgccaggcatagccttcctagggacacagtgacaaccaagataaacacagctcctgcctcataaggataaat

SEQ ID NO: 11379 - DNA, 184 bp, Homo sapiens
  D6S1585
  Located on chromosome 6
  Distance between a terminus base of telomere on chromosomal short arm and 5'-terminus of this base sequence : 174113675
  Distance between 3'-terminus of neighbour sequence of sequence listing upward to telomere on chrosomal short arm and 5'-terminus of this base sequence : 36400
tgccaactgcacagatctttggacttgtctgcctccatagttgtacgaaccaattccttacaataaaatctgtgtgtgtatatatatgtgtgtgtgtgtgtgtgtgtgtatttgtatgtgtgtatatgtgtgtgtgtatggatacaaatatagatatagatacatatcctatcggttttgtttc

SEQ ID NO: 11380 - DNA, 182 bp, Homo sapiens
  AL023775.1_84990
  Located on chromosome 6
  Distance between a terminus base of telomere on chromosomal short arm and 5'-terminus of this base sequence : 174113712
  Distance between 3'-terminus of neighbour sequence of sequence listing upward to telomere on chrosomal short arm and 5'-terminus of this base sequence : -147
tagttgtacgaaccaattccttacaataaaatctgtgtgtgtatatatatgtgtgtgtgtgtgtgtgtgtgtatttgtatgtgtgtatatgtgtgtgtgtatggatacaaatatagatatagatacatatcctatcggttttgtttctctggtgaaccctaatacaccagctacagaggaaa

SEQ ID NO: 11381 - DNA, 309 bp, Homo sapiens
  AL023775.1_71560
  Located on chromosome 6
  Distance between a terminus base of telomere on chromosomal short arm and 5'-terminus of this base sequence : 174126985
  Distance between 3'-terminus of neighbour sequence of sequence listing upward to telomere on chrosomal short arm and 5'-terminus of this base sequence : 13091
catgctttagcctttaatcagttatattggacagatcatcctcaaacactgctctcagcaccctgatgtcctcccaccataatgtactttgttctgtactctttgatatatttttttgtaaaatatgtatatatgcatgcacgagtgtgtgtgtgtatgtgtacggtgtttgtggggtatatgtgtatggtatgtgttgtgtgagtgtgtgtgtgtgtgtgtgtgtgtggtgtgtgtgtgttatgtgtggtgtgtatgtgtgtttgcattgtgtgtctgtgtgtgtgtctatgccatcaaatactatct

SEQ ID NO: 11382 - DNA, 308 bp, Homo sapiens
  AL023775.1_54720
  Located on chromosome 6
  Distance between a terminus base of telomere on chromosomal short arm and 5'-terminus of this base sequence : 174143948
  Distance between 3'-terminus of neighbour sequence of sequence listing upward to telomere on chrosomal short arm and 5'-terminus of this base sequence : 16654
gaattgaaagtaatgcagtttacatcatattattatatcgcatcttataattatagatcatacttaaacaaacaaacacacacacacacacacacacacacacacagctgtaatgcaatatatgctgtaatgtgttaccagttcctgaggtttggaagatgggtcatgaaggttgtgatgcctggtggcagtgctgctcctaaaacaacaccagggccagcacccagaacatcagcaccctcaggtatcagcaccctaagcaccggcactgtaatgtgccagcaccctaaggtaccagaatcctcagg

SEQ ID NO: 11383 - DNA, 168 bp, Homo sapiens
  Z94721.1_78704
  Located on chromosome 6
  Distance between a terminus base of telomere on chromosomal short arm and 5'-terminus of this base sequence : 174438875
  Distance between 3'-terminus of neighbour sequence of sequence listing upward to telomere on chrosomal short arm and 5'-terminus of this base sequence : 294619
ctttgaaagtttgccatgttaggaatcctggggatggagtgatgaattgtggcattgctctgcagttcacgctgctgagagctgccccaacacacacacacacacacacacacacacacacacacaaaggttgcacacacacaggtttgattatgctcatgagacttc

SEQ ID NO: 11384 - DNA, 449 bp, Homo sapiens
  Z94721.1_24918
  Located on chromosome 6
  Distance between a terminus base of telomere on chromosomal short arm and 5'-terminus of this base sequence : 174492648
  Distance between 3'-terminus of neighbour sequence of sequence listing upward to telomere on chrosomal short arm and 5'-terminus of this base sequence : 53605
gtgctgagattacaggcatgagccactgcacccgaccatctcatgtttttagaaacatacttgctaggtatttttttctgttagagaaaagggatctacctgtctccctgtcttccttccttccttccttccttccttctttccttccatcctcccttcctccctccctccttccttccttccttactcccttccttcctctctccctccctccctcacttccttccttcctctctccctccctccccctttccttccttccttccttccatcctctctccctccctcccctttccttctttccttccttcctttttttgcttcaaatgacatgagaagaatgatttagtgttccatcgaacgtttatccaaaagtagcagagagttatatttaaatggcaacattagttcaccatttctgcccagtagaacttgttcaaagacatcag

SEQ ID NO: 11385 - DNA, 477 bp, Homo sapiens
  chr6.fa.O7frz.171928499
  Located on chromosome 6
  Distance between a terminus base of telomere on chromosomal short arm and 5'-terminus of this base sequence : 174589855
  Distance between 3'-terminus of neighbour sequence of sequence listing upward to telomere on chrosomal short arm and 5'-terminus of this base sequence : 96758
aacaaagaatcataattcactgaccatctttatctggttatattatatggactaactcataataaacactacttaataagaataaagctgtggccaggcatggtagcttatacctgtaatcccagcactttgggaggccgaggcaggtgaatcacttgagcccaggagtttgagaccagtctggtgaaaccccatctctactaaaaataccaaaattagccaagtgtggtggcacgcacctgtagtcccagctacatcagaagctgaggcaggaggatcacctgagctcatgaagttgaagcttcagtgaagtgagatcatgccacttcactccagcctggatgacagagtgagactctgccaaaaaaaaaaataaaaataaataaaaattaaaaaagaaagaaagaaagaaagaaagaaagaaagaaagaaagaaagaaagaaagaaagaaaaaggctgcggtagtcctgtttatc

SEQ ID NO: 11386 - DNA, 271 bp, Homo sapiens
  AL021331.1_24288
  Located on chromosome 6
  Distance between a terminus base of telomere on chromosomal short arm and 5'-terminus of this base sequence : 174702609
  Distance between 3'-terminus of neighbour sequence of sequence listing upward to telomere on chrosomal short arm and 5'-terminus of this base sequence : 112277
caattctatgtccagtgaagagttagttttctttctctctctctctctctctctctatatatatatatatatatacacacacacacacaatgagcctataatacattttgtatatatgcatgtctatatatacatgtctctatttatattcacatatggctatatgaatatatatacatatcttatattcacatatgtatatatggacatgcatatatacaaaatgtgtatatgcatttttagtcaaaacttaagcaataaccttcaatgc

SEQ ID NO: 11387 - DNA, 220 bp, Homo sapiens
  AL021331.1_76805
  Located on chromosome 6
  Distance between a terminus base of telomere on chromosomal short arm and 5'-terminus of this base sequence : 174754985
  Distance between 3'-terminus of neighbour sequence of sequence listing upward to telomere on chrosomal short arm and 5'-terminus of this base sequence : 52105
tacatgctagatgcaacacaacacacatgacacacatgcatgccatatgcaacacacaatacactcacacaacacacaacatacagacaacacataccacatgtgacacacaatacacacaacatgcacagacaacacagaaacaacaaacacactcaacaggcacaacatagtcacacacacacacacacacacactgcttgaaacttattgatagcat

SEQ ID NO: 11388 - DNA, 146 bp, Homo sapiens
  D6S1697
  Located on chromosome 6
  Distance between a terminus base of telomere on chromosomal short arm and 5'-terminus of this base sequence : 174847573
  Distance between 3'-terminus of neighbour sequence of sequence listing upward to telomere on chrosomal short arm and 5'-terminus of this base sequence : 92368
ggagagttgacttactttacacatgtctctgtgtgtgtgtgtgtgtgtgtgtgagagtgtgtatggtgttgggctttttgtattgttttgttttagagacagggtctcactgtgttacccaggctggagtgcactggtgggatctc

SEQ ID NO: 11389 - DNA, 385 bp, Homo sapiens
  AL009178.4_146964
  Located on chromosome 6
  Distance between a terminus base of telomere on chromosomal short arm and 5'-terminus of this base sequence : 175063525
  Distance between 3'-terminus of neighbour sequence of sequence listing upward to telomere on chrosomal short arm and 5'-terminus of this base sequence : 215806
cgagtgaaaacaaagaacttctacttttttcttcctcttcctttctccctttctctccctctctctctctctctctctctctctctctctctctctctctctctctctctctttaatatttattagttcaggctgggtgcagtagctcatgactgtaatcccatcactttgggaggctgaggcaggagggtcgcttgaggacagtagttcaagacttgtctgggcaacacggcaagacctcgtctctaaaataataatttaaaaatgaattagctgggcatggtggtggatgcctgtagtctcagctactcaggaggctgaggagagaggatagcttgagcccaggagtttgagactgcagttagctatgatcatgctactgaac

SEQ ID NO: 11390 - DNA, 347 bp, Homo sapiens
  AB016897.1_6928
  Located on chromosome 6
  Distance between a terminus base of telomere on chromosomal short arm and 5'-terminus of this base sequence : 175071756
  Distance between 3'-terminus of neighbour sequence of sequence listing upward to telomere on chrosomal short arm and 5'-terminus of this base sequence : 7846
aagtggcataagaaatttctacacataaaaattagccgggcgtggtggcgggcgcctgtagtcccagctactcgggaggctgaggcaggagaatagcttgaacctgggaggcggaggttgcagtgagctgagatcacatcattgcactccagcctgggtgacagagcgagaatccatctgagagagagagagagagagagagagagagaggcagggagggagggagagagagacagagagagagaaaaggaagaagggaggaagggaggaaggaaacttcaaaatctatttatgatactcagttcctataaaatctacaaaataaaaatttggctaaagaaacgatc

SEQ ID NO: 11391 - DNA, 470 bp, Homo sapiens
  AB016897.1_88757
  Located on chromosome 6
  Distance between a terminus base of telomere on chromosomal short arm and 5'-terminus of this base sequence : 175154196
  Distance between 3'-terminus of neighbour sequence of sequence listing upward to telomere on chrosomal short arm and 5'-terminus of this base sequence : 82093
gtcaagtaggtaatgtgctcaggcaccaccagctcatttcccagcttctggacaggtgactgtggcttaacagcttccagtctccagcagagactgccactcagtgtccccagcaaagctctggagttcatctggaacctgaagggcaaacaatccagagagacagagagagagagagagaggaaggaaggaaggaaggaaggaaggaaggaaggaaggaaggaaggaaggaaggaaggtaggtctgtcctctttaataacaagggataatttgggctaaattttgcctatgttgctgcacttagtgtcaccttcagcagtaactttaaccattctggaatattattgacacctgttccaatggaaggaatggaaggaattgacatctgttccaatggaagtctctgataaagaagtctttatcaatatctaagcaagttttcaccttctattgaatgccaagttgtaag

SEQ ID NO: 11392 - DNA, 470 bp, Homo sapiens; identical to SEQ ID NO: 11391
  AL009178.4_56166
  Located on chromosome 6
  Distance between a terminus base of telomere on chromosomal short arm and 5'-terminus of this base sequence : 175154196
  Distance between 3'-terminus of neighbour sequence of sequence listing upward to telomere on chrosomal short arm and 5'-terminus of this base sequence : -470

SEQ ID NO: 11393 - DNA, 294 bp, Homo sapiens
  AL009178.4_17623
  Located on chromosome 6
  Distance between a terminus base of telomere on chromosomal short arm and 5'-terminus of this base sequence : 175192857
  Distance between 3'-terminus of neighbour sequence of sequence listing upward to telomere on chrosomal short arm and 5'-terminus of this base sequence : 38191
gaagatagtgcaaagcaattctccaacacagtaaaaggtaagtgacccatgtttacggtataatccccttctaataccttccatacacacacacacacacacacacacacacacacacacaaccatttcatttctttgcattcagtgtgtattagtccattccattcttgcattgctataaagaaatacctgagactaggtaatttataaagaaaagaggtttaattggctcatggttctgcaggctgtacaggaagcatggctggggaggcctcaggaaacttacaatcatgg

SEQ ID NO: 11394 - DNA, 294 bp, Homo sapiens; identical to SEQ ID NO: 11393
  AB016897.1_127353
  Located on chromosome 6
  Distance between a terminus base of telomere on chromosomal short arm and 5'-terminus of this base sequence : 175192857
  Distance between 3'-terminus of neighbour sequence of sequence listing upward to telomere on chrosomal short arm and 5'-terminus of this base sequence : -294

SEQ ID NO: 11395 - DNA, 395 bp, Homo sapiens
  AB011399.1_66337
  Located on chromosome 6
  Distance between a terminus base of telomere on chromosomal short arm and 5'-terminus of this base sequence : 175262198
  Distance between 3'-terminus of neighbour sequence of sequence listing upward to telomere on chrosomal short arm and 5'-terminus of this base sequence : 69047
ggacaaagatgagtattcagaaaccaaatttagtgtatggacaattttaaattattttaatccctaaaatttttttttccaagataactttagtaaaatagttactctaccaacaatgacaaattggtatttacctagggcagatttcataaaggggtgtgtgtgtgtgtgtgtgtgtgtgtgtgtgtgtgtgtgtggctgttgtttctgatgcatggacagtgtctaaaaagaatatctttaaattttatatctaagaaacccatcttagtaagaggaaggctatttgattttaaagtaacagactacatttattttcacatgagtcctctaagtgttttttttgtagaactcttaatacactaaagctgtcgtttcaggttagccattgagta

SEQ ID NO: 11396 - DNA, 395 bp, Homo sapiens; identical to SEQ ID NO: 11395
  AL049698.3_86882
  Located on chromosome 6
  Distance between a terminus base of telomere on chromosomal short arm and 5'-terminus of this base sequence : 175262198
  Distance between 3'-terminus of neighbour sequence of sequence listing upward to telomere on chrosomal short arm and 5'-terminus of this base sequence : -395

SEQ ID NO: 11397 - DNA, 217 bp, Homo sapiens
  AB016897.1_255494
  Located on chromosome 6
  Distance between a terminus base of telomere on chromosomal short arm and 5'-terminus of this base sequence : 175320964
  Distance between 3'-terminus of neighbour sequence of sequence listing upward to telomere on chrosomal short arm and 5'-terminus of this base sequence : 58371
atgcttgattcagacctcatagtgatcatgtttatctgagtagactcctttcatatgtgccatttctcagattttagactagccctttggaaaaagtatactcatttttctctgtgtctgtgtgtgtgtgtgtgtgtgtgtgtcatttctctctgtctctcacagacacacacacacatacccctacctttgtgttcaacacatttgtagcaataca

SEQ ID NO: 11398 - DNA, 217 bp, Homo sapiens; identical to SEQ ID NO: 11397
  AL049698.3_27910
  Located on chromosome 6
  Distance between a terminus base of telomere on chromosomal short arm and 5'-terminus of this base sequence : 175320964
  Distance between 3'-terminus of neighbour sequence of sequence listing upward to telomere on chrosomal short arm and 5'-terminus of this base sequence : -217

SEQ ID NO: 11399 - DNA, 361 bp, Homo sapiens
  AB016897.1_269706
  Located on chromosome 6
  Distance between a terminus base of telomere on chromosomal short arm and 5'-terminus of this base sequence : 175335156
  Distance between 3'-terminus of neighbour sequence of sequence listing upward to telomere on chrosomal short arm and 5'-terminus of this base sequence : 13975
gtctttccttcaggatttctaaacacagagcaagaagattcaatgaaaaattgggctcagggcagtaattggggctggcatttattcttaagagttttctccctcaaaaggtgaaggagtgacattgcgtattcactctgtgtgtgtgtgtgtgtgtgtgtgtgtgtgtgtgtgtgtgtgtgtgtgtagctctagagggagtagggagaaaatacaggatgaaattgaaaacagggactaacaacttttcactgaatgccagcaagctctctaaaattagttttctttggttgaacaaatttacaattcattgtacttcatttcacagcattaaacatttactcgaggcagtttattctgt

SEQ ID NO: 11400 - DNA, 470 bp, Homo sapiens
  chr6.fa.O7frz.180512679
  Located on chromosome 6
  Distance between a terminus base of telomere on chromosomal short arm and 5'-terminus of this base sequence : 175885944
  Distance between 3'-terminus of neighbour sequence of sequence listing upward to telomere on chrosomal short arm and 5'-terminus of this base sequence : 550427
cctatggaaagcaaaacttaaggctcaaaggggtgaaaacatgcattgtgaatgcaatttaaactcccaaagtccacgcgaaatacatcttctaaatccggcagctgcccctgctcactctgaagcaatttccttgttccactgtcacaaaaagaaagctctactgacacccatcgccccccacacacatacacacacacaaacacacacacacacccatccacacacacatacacacactcacacacaaacacacacacccatccacacacacacatacacacacactcacacaaacacacacacacccatccacacacacacactcacacacacacccatacacacatatacacacacactcacacacacacatacacacatgggttttctccagatcagactgctttacttatcctcacttttcaaattacatttctttataaggatacagaattccacagcttatg

SEQ ID NO: 11401 - DNA, 417 bp, Homo sapiens
  chr4.fa.O7frz.151276861
  Located on chromosome 6
  Distance between a terminus base of telomere on chromosomal short arm and 5'-terminus of this base sequence : 175936873
  Distance between 3'-terminus of neighbour sequence of sequence listing upward to telomere on chrosomal short arm and 5'-terminus of this base sequence : 50459
ctgtccttatcacctgcacccacttccttccctctgccgaaataaaaattgtcttggtttatttttccattctttttcaaaataggagtgaatggtacacacacacacacacacacacacacacacacacatacacacacacacatccccttctctcttttccaatcaaggctgtggcctggtaggaccatcgcaccccactgcttggacacactgatctgctgtccaggtgatggctgagaggagcccctggtgatctggaaggcatgccgaaatctggagctgcctggggtcaccaggcccagctagtccccattgtttaggaacagaaatggatgcttcctgcctagtttcactgcttcacagcctagcttggcttcagacccataggttataaagacctcactaggaacttct

SEQ ID NO: 11402 - DNA, 449 bp, Homo sapiens
  chr6.fa.O7frz.180587762
  Located on chromosome 6
  Distance between a terminus base of telomere on chromosomal short arm and 5'-terminus of this base sequence : 176025844
  Distance between 3'-terminus of neighbour sequence of sequence listing upward to telomere on chrosomal short arm and 5'-terminus of this base sequence : 88554
gagtacatgtaactggaaatgttactctaaaagcttacactcatccaataattgacactttgtgaagaacgttgtcccatgagctctgaatagtcataagagcatgttttctgcctcattctgccacatgcgaaggctattttctggaaacatggacgccttctccagaaacaggatgaaagcatctgaaacatgggattaaggtgcctgtaagaataaaaaacccactttacactctgtacccttctctcctaaaacatgacagagccctctctctgtgccctgcagacatgatctcctgtgtcctcacagaatccctgccaggcagctcgcgctctctctctgtctctctctgtctctgtctctctctctctctctctctctctctctccctccctctctgggtgtatattttctaggtttttgtaaacatcttaggctaaggaaac

SEQ ID NO: 11403 - DNA, 168 bp, Homo sapiens
  HUMUT617
  Located on chromosome 6
  Distance between a terminus base of telomere on chromosomal short arm and 5'-terminus of this base sequence : 176125973
  Distance between 3'-terminus of neighbour sequence of sequence listing upward to telomere on chrosomal short arm and 5'-terminus of this base sequence : 99680
gcacctaaacttaatttgacattcttgtaaatgattttactggaaatatactttattttatttatttatttatttatttatttatttatttatttatttattttgagagaaagtcttgctctgtcacccaggctggcgagcagcagcacaatcttggctcactgtaac

SEQ ID NO: 11404 - DNA, 171 bp, Homo sapiens
  DISD22_0004796
  Located on chromosome 6
  Distance between a terminus base of telomere on chromosomal short arm and 5'-terminus of this base sequence : 176471045
  Distance between 3'-terminus of neighbour sequence of sequence listing upward to telomere on chrosomal short arm and 5'-terminus of this base sequence : 344904
tgttcctccagataactgttatatgtctctctctctctctctctctctctctctctctctctctctctctctctctctgtgtgtgtgtgtgtatgtgtgttaggagtacggtagtagttctacaaaagaacaactacaaaagaaaactcatagctgttatctcaaacaagg

SEQ ID NO: 11405 - DNA, 451 bp, Homo sapiens
  chr6.fa.O7frz.181071509
  Located on chromosome 6
  Distance between a terminus base of telomere on chromosomal short arm and 5'-terminus of this base sequence : 176547011
  Distance between 3'-terminus of neighbour sequence of sequence listing upward to telomere on chrosomal short arm and 5'-terminus of this base sequence : 75795
gataaatacaaatcattggtgaacctcaaaatgatagtatgatgttcctaactttgtcctttataaaaattcctcttttctgactcaagtcacacatgtttgatagaggtggagactcttgtttctttaatattttttttaatcccaatcctaggcctttcactgcaagaggtctatagaaatttcatgtttaatgtaggcacatctgaggattccaaacctaacacattttctcactctgcaatctctacacaacttgatttcctgcattcccatgatctcagttataacctgtaattgaatctcccaaatctatatcccccaaagcatacacacacacacacacacacacacacacatatatatatatatattctctacatgtttaaacaacccatatgaagattcatggtttgttatatttgtttttaatagccaaatcgacttttaa

SEQ ID NO: 11406 - DNA, 293 bp, Homo sapiens
  chr6.fa.O7frz.181163080
  Located on chromosome 6
  Distance between a terminus base of telomere on chromosomal short arm and 5'-terminus of this base sequence : 176638697
  Distance between 3'-terminus of neighbour sequence of sequence listing upward to telomere on chrosomal short arm and 5'-terminus of this base sequence : 91235
tcacgtatttaccaatttgaagagctgttgagtaacgttaaccatagaaaagtcgatgtggggccaacatgcacagaacctcggggtctcaccaaagaattggagtggagtgaagacagttagtgaagaaagaaagaaagaaagagagaaagagagaaagagagaaagagagaaagagagaaagagagaaagagagagagagagagagagagagaaagaaagaaaagaaagaaagaaagaaagaaagagaaaagaaagaaaaagagagcccaaggtttagcgtgaacttaact

SEQ ID NO: 11407 - DNA, 360 bp, Homo sapiens
  chr6.fa.O7frz.181250731
  Located on chromosome 6
  Distance between a terminus base of telomere on chromosomal short arm and 5'-terminus of this base sequence : 176726423
  Distance between 3'-terminus of neighbour sequence of sequence listing upward to telomere on chrosomal short arm and 5'-terminus of this base sequence : 87433
ccgcatattcaatgtatacaacttaatgggtttggaaataagtagacagctttgaagccatcactacaatcatgccctaagcctttctattacttccaaaagtctcttcccactcgatgatgctgctgctgctgctgctgatgatgatgatgatgatgatgatgatgttggcaataagcacacttcactgtatgctctgtgctgaactgtagagttctagggcttcttcatctttcattaacacctccctgtttccctctcctccaagcccctggcaaccgcccttctactctctgcttctgtaagtttcattgttttaaattcattacatacatggtatctatcaagcagtatttgtcc

SEQ ID NO: 11408 - DNA, 124 bp, Homo sapiens
  DISO7_10000310
  Located on chromosome 6
  Distance between a terminus base of telomere on chromosomal short arm and 5'-terminus of this base sequence : 177082947
  Distance between 3'-terminus of neighbour sequence of sequence listing upward to telomere on chrosomal short arm and 5'-terminus of this base sequence : 356164
cttccaggcagagctgaggagctggccgcaggagagcactcctgacggaggaggaggaggaggaggaggaggaggaggaggtggtggtggtgccaggaatccaccccacccagatagcaactgt

SEQ ID NO: 11409 - DNA, 323 bp, Homo sapiens
  AL031315.1_101136
  Located on chromosome 6
  Distance between a terminus base of telomere on chromosomal short arm and 5'-terminus of this base sequence : 177158805
  Distance between 3'-terminus of neighbour sequence of sequence listing upward to telomere on chrosomal short arm and 5'-terminus of this base sequence : 75734
caccaactggtaatggttctcaagaaggtaagcctgtgtgtgtgtgtgtgtgtgtgtgtgcacatgtgcacgtgtatgcatacatgtgcctgtgtgcatgtgtattctgcctaactgccctaactagaacatccaatacaatgatgaacagaagtggtgagaatgaacatccttgtttttcctcatcttggggaaagcacccagccgaaaaccattaagactgctgctagtcacagggttcacaggtggctttattaggttaaggaagcccccttccatttgctgctgttgctgttgctaagtgtttgtatcacggatggttg

SEQ ID NO: 11410 - DNA, 246 bp, Homo sapiens
  AL031315.1_51444
  Located on chromosome 6
  Distance between a terminus base of telomere on chromosomal short arm and 5'-terminus of this base sequence : 177208395
  Distance between 3'-terminus of neighbour sequence of sequence listing upward to telomere on chrosomal short arm and 5'-terminus of this base sequence : 49267
tgcttcctactcatcagcttagaatttgagcaattcaaatacttagattttttatagctgttgataaataagttcctctttaattgtgtgtgtgtgtgtgtatatatacatatatatatatatatgtatatatacacacacacacacacacacacacacacataaaattctggatatatatccagaattgccatcaaatagtttattttggagacaaaatctgttatcagataccattctgatgga

SEQ ID NO: 11411 - DNA, 209 bp, Homo sapiens
  D6S281
  Located on chromosome 6
  Distance between a terminus base of telomere on chromosomal short arm and 5'-terminus of this base sequence : 177222763
  Distance between 3'-terminus of neighbour sequence of sequence listing upward to telomere on chrosomal short arm and 5'-terminus of this base sequence : 14122
ctggtagtgtcaggcatggcacttgaccctccatggccctaaagttttcaagtttttatctctacatccctgcaatatcaaaaaaaagttctgccaatttttatgcacaacttcacctcttaccattcatacacacacacacacacacacacacacacacacacacacacagatgcatccctctgtatggcctttgcctgaaacatagg

SEQ ID NO: 11412 - DNA, 348 bp, Homo sapiens
  AL031315.1_27561
  Located on chromosome 6
  Distance between a terminus base of telomere on chromosomal short arm and 5'-terminus of this base sequence : 177232217
  Distance between 3'-terminus of neighbour sequence of sequence listing upward to telomere on chrosomal short arm and 5'-terminus of this base sequence : 9245
ataactaccgttcatttcagaaaccccactgctgggtatctaccaaaagaaaaagaagtcatgatttcaaaaagacacatgcactcatatgtttattgcaacactgtttataataccaaagacatggaatcaatctaagtgcccattaacaggcgactgaataaagaaaatgtagtatacttgtgtgtgtatacacacacacacacacacacacacacacacatataatataatattattcagccatgaaaaaaatgaaatcatgtcttttgcagcacatggatggaagtagagggcattatcttaagtgaaacaactcagaaacagaacgacaaataccacatgttc

SEQ ID NO: 11413 - DNA, 158 bp, Homo sapiens
  DISO7_10000309
  Located on chromosome 6
  Distance between a terminus base of telomere on chromosomal short arm and 5'-terminus of this base sequence : 177445379
  Distance between 3'-terminus of neighbour sequence of sequence listing upward to telomere on chrosomal short arm and 5'-terminus of this base sequence : 212814
gcctctaagtggctaaattcccaccaaaacaaacaaacaaacaaacaacaaaaaagtggtatggagagggtagaaaaatggctagtgaaaggaagaaaaggaaagatttttgattttgactacttaaggggctttatttacataacaaggccaccctt

SEQ ID NO: 11414 - DNA, 89 bp, Homo sapiens
  D6S1693
  Located on chromosome 6
  Distance between a terminus base of telomere on chromosomal short arm and 5'-terminus of this base sequence : 177721780
  Distance between 3'-terminus of neighbour sequence of sequence listing upward to telomere on chrosomal short arm and 5'-terminus of this base sequence : 276243
tgtttccgttagccttctctattgtgtgtgtgtgtgtgtgtgtgtgtgtgtgtgtgcattgtgtgttttgcttgcttgctttctgtgtt

SEQ ID NO: 11415 - DNA, 249 bp, Homo sapiens
  DISO7_10000306
  Located on chromosome 6
  Distance between a terminus base of telomere on chromosomal short arm and 5'-terminus of this base sequence : 177787661
  Distance between 3'-terminus of neighbour sequence of sequence listing upward to telomere on chrosomal short arm and 5'-terminus of this base sequence : 65792
cctcccggtttagaccaggaaaattaatttgtaaatgctctagaaataaatgagagagagagagagagagacagagagagagagacagagacagagagacagagacagagagaccgagagacagagagacagagacagagagagagagacacagagagagagagacagagagagacagagagacacagagagagagagagagagagagagagagagagagagagaagccaacactaaccctagctgctt

SEQ ID NO: 11416 - DNA, 409 bp, Homo sapiens
  AL078605.30_110306
  Located on chromosome 6
  Distance between a terminus base of telomere on chromosomal short arm and 5'-terminus of this base sequence : 177890282
  Distance between 3'-terminus of neighbour sequence of sequence listing upward to telomere on chrosomal short arm and 5'-terminus of this base sequence : 102372
gcaatcactaccataaggaacccgggcttagcggggggcaaagcggcaaatgaggggtcagcccacagggagcccgtgcggtcctgctgagccagcaggcgggacgcgcttagagacggggctgcccaccgacgggaagcggaggagcagcttccgtgactcccacgccccgtctggggccatgttggcgtcaaacggcgacaaaatcatgacagctgtgacccactgggtacaaaataactcacaagtctacactgacatgaatgaatgaatgaatgaatgaatgaatgaatgaatgaggaacgctcattctttctgcggaaagaactaataaatgcatggggggatggaattagaaaatcgcggctgcttcatgcgcgtgcctgctcttaccaagtcacctcatgat

SEQ ID NO: 11417 - DNA, 438 bp, Homo sapiens
  AL078605.30_105400
  Located on chromosome 6
  Distance between a terminus base of telomere on chromosomal short arm and 5'-terminus of this base sequence : 177895318
  Distance between 3'-terminus of neighbour sequence of sequence listing upward to telomere on chrosomal short arm and 5'-terminus of this base sequence : 4627
agataagagtggacagctggtatgcagggtgccagggcaggacagctgctccattgtctgtcctccacggcagctgccccagcgcaacaatgccggcctcccccgcgcccccggccccacctcctcacacacacccctcgcgtgtacacacacacacacacacacacacgcacacgcaccccttccgccaatgggagccggcgggtgtccctgcgcctatccccggagagatctaatctatggcacgcgcgagctgggggcggggagagacttcagtgtttgaagaaaaaagtttaagtttctggctaccctgtggtgaagagaggcagggaggaagggtgggaggcagcagactggccagaggctcccgcagggcagggagtagacagtgggcttgaggcttggagctggctcttgctgcctggttatgaaactcat

SEQ ID NO: 11418 - DNA, 427 bp, Homo sapiens
  AL078605.30_57652
  Located on chromosome 6
  Distance between a terminus base of telomere on chromosomal short arm and 5'-terminus of this base sequence : 177943059
  Distance between 3'-terminus of neighbour sequence of sequence listing upward to telomere on chrosomal short arm and 5'-terminus of this base sequence : 47303
tcatttgctatcaaacagttgtagtggctttcttgttcacctcctcttacatacactgttgaaggttttcatctgatccttgttgcaaggtcagtcaagaaagtgctcaacaagtcttggaggtttctgtgagtggtaaaaggaagctggtgtgtgtgtgtgtgtgtgtgtgtgtgcacatgcccttaaggaagctgggtgtgtgtgtgcctgcccttggtgaggctctgctcatgtggctgccagtgtctgaaactgccccgaccattgcagatcaacataaattggttaaaatctcaaaagcagtttttcaccaacttgtaaaaaatagtgtgaagctttgtcaaatgtgttaacaaattcacattagagtcacaagggttaaattttgcattactactttttatagccactttcactgttgaat

SEQ ID NO: 11419 - DNA, 322 bp, Homo sapiens
  AL008628.1_84252
  Located on chromosome 6
  Distance between a terminus base of telomere on chromosomal short arm and 5'-terminus of this base sequence : 178059437
  Distance between 3'-terminus of neighbour sequence of sequence listing upward to telomere on chrosomal short arm and 5'-terminus of this base sequence : 115951
cagtggcgttctaaatattctaagggatctgctgaggctcaggaattgcagccctttctttatggtgagaatgtgtaattagtaaattgaatagatttcaacactattttgggaaactgttgaaggggcaattgcaatgctgcggtgcttgggtctcattttgtgtgtgtgtgtgtgtgtgtgtgtgtgtgtgttaattacatactcaacagcagctgctgaggcaagatgagccagtgtttttcttccttctcctcccaggagacacggactagctgtcacaaagatgcggcagaagtttgtgagtgtccatttggagttt

SEQ ID NO: 11420 - DNA, 217 bp, Homo sapiens
  D6S1590
  Located on chromosome 6
  Distance between a terminus base of telomere on chromosomal short arm and 5'-terminus of this base sequence : 178059437
  Distance between 3'-terminus of neighbour sequence of sequence listing upward to telomere on chrosomal short arm and 5'-terminus of this base sequence : -322
cagtggcgttctaaatattctaagggatctgctgaggctcaggaattgcagccctttctttatggtgagaatgtgtaattagtaaattgaatagatttcaacactattttgggaaactgttgaaggggcaattgcaatgctgcggtgcttgggtctcattttgtgtgtgtgtgtgtgtgtgtgtgtgtgtgtgttaattacatactcaacagcagct

SEQ ID NO: 11421 - DNA, 213 bp, Homo sapiens
  AL008628.1_8416
  Located on chromosome 6
  Distance between a terminus base of telomere on chromosomal short arm and 5'-terminus of this base sequence : 178135281
  Distance between 3'-terminus of neighbour sequence of sequence listing upward to telomere on chrosomal short arm and 5'-terminus of this base sequence : 75627
tcttgactgataattgtttccttcaaatttgtgaaaaacatgagagaaaacgtgtttgtatctcatttttaagtgtggacacttggcattgctcacggcttccaacggaataaaatagggcttagttgttttccattagctttttcctttgtgtgtgtgtgtgtgtgtgtgtgtgtgtgtgtgtgttgtgtgtacatattggctctaagcatt

SEQ ID NO: 11422 - DNA, 428 bp, Homo sapiens
  AL031259.1_38139
  Located on chromosome 6
  Distance between a terminus base of telomere on chromosomal short arm and 5'-terminus of this base sequence : 178219293
  Distance between 3'-terminus of neighbour sequence of sequence listing upward to telomere on chrosomal short arm and 5'-terminus of this base sequence : 83799
tgcttgcacgtacctgtagtcccagctacccaggaggctgaagtgggaggattgcttgagtccagaagtttgaggctgcaatgagccagccatgatcgcaccactgcactccagcctgggcgacagagtgagaccctgtctctctctctctctctctctctctctctctctgtcacacacacacacacacacgttaaatttgttggattatatatttagggggttgagcacttttggttataaaatatttatgattgtgggaacaagttaataaagacacgaaacttatttaaatgtcccagaactttaagaacaaaaagcattcttagtttaaaaataagttttactttaaaggtaatagtacacacataaattgttgttaaaatcgacagtaacaaagagaagtaacaatactaatggcctgtcac

SEQ ID NO: 11423 - DNA, 126 bp, Homo sapiens
  DISD22_0004805
  Located on chromosome 7
  Distance between a terminus base of telomere on chromosomal short arm and 5'-terminus of this base sequence : 15915
  Distance between 3'-terminus of neighbour sequence of sequence listing upward to telomere on chrosomal short arm and 5'-terminus of this base sequence : 0
attcactcctggtctgccaggcaccaggaggccctcgcacaccgctgcctctccctggcatgcatggagcctggggtccctaaccctaaccctaaccctaaccctaagggtcttgttgcacgtcac

SEQ ID NO: 11424 - DNA, 102 bp, Homo sapiens
  DISD22_0004812
  Located on chromosome 7
  Distance between a terminus base of telomere on chromosomal short arm and 5'-terminus of this base sequence : 353837
  Distance between 3'-terminus of neighbour sequence of sequence listing upward to telomere on chrosomal short arm and 5'-terminus of this base sequence : 337796
aatggagccagtcctatttcatttcacctccacccacttcacacagacacacacacacacacacacacacacagaggatggaagcaaatctcagatacagca

SEQ ID NO: 11425 - DNA, 149 bp, Homo sapiens
  D7S2474
  Located on chromosome 7
  Distance between a terminus base of telomere on chromosomal short arm and 5'-terminus of this base sequence : 606921
  Distance between 3'-terminus of neighbour sequence of sequence listing upward to telomere on chrosomal short arm and 5'-terminus of this base sequence : 252982
gtaggaggatcacttgagcccaggggtggaggttgcagtgagccgagatggcacgactacactccagcctgggtgtcacagaccctgtcacacacacacacacacacacacacacacacacacacacacacaatatggagacatgacct

SEQ ID NO: 11426 - DNA, 353 bp, Homo sapiens
  chr7.fa.O7frz.1098596
  Located on chromosome 7
  Distance between a terminus base of telomere on chromosomal short arm and 5'-terminus of this base sequence : 862339
  Distance between 3'-terminus of neighbour sequence of sequence listing upward to telomere on chrosomal short arm and 5'-terminus of this base sequence : 255269
gaggtcaggagatcaagactatcctggccaacatgatgaaaccccgtctctactaaaaatacaaaaattagccaggtgtggcagcgcatgcctgtaatcccagctactctggaggctgaggcagaagaatcgcttgaacccgggaggcggaggttgcagtgagctgagatcgcgccactgcactccagcctggacgacagagctagactctgtctcagtaaataaataaataaataaataaataaataaataaataaaataattagccaggcatcgtggcttatgcctatcatctcagcactttgggaggccgaggcaggagaattgcttgagaagttcttgagaattggtct

SEQ ID NO: 11427 - DNA, 102 bp, Homo sapiens
  DISD22_0004828
  Located on chromosome 7
  Distance between a terminus base of telomere on chromosomal short arm and 5'-terminus of this base sequence : 1263886
  Distance between 3'-terminus of neighbour sequence of sequence listing upward to telomere on chrosomal short arm and 5'-terminus of this base sequence : 401194
gcgcaattaactgcttaattacaaacaggagcgtgcgcgcgcgggcacacacacacacacacacacacacacatgcacacacagggcaagaaagtcagcagg

SEQ ID NO: 11428 - DNA, 337 bp, Homo sapiens
  HUMUT5912
  Located on chromosome 7
  Distance between a terminus base of telomere on chromosomal short arm and 5'-terminus of this base sequence : 1421661
  Distance between 3'-terminus of neighbour sequence of sequence listing upward to telomere on chrosomal short arm and 5'-terminus of this base sequence : 157673
atttgccctctgtagctcttctttgatgaaatgtctccttacatcttttttccctttctcttccttccttccttctttccttcctttcttctttctttttttctttctttcctttctttctttctctttctttctctttcctttcttccttccttccttccttccttccttccttccttccttccttcctttccttctttctcttttttgacagaatctcactctgtcacccgggctggagtgctgtggcatgatctcagctcactgcaacctctgccttcctggttcaagcaagtctcctgccccaggctcccgagtagatgggattataggcacc

SEQ ID NO: 11429 - DNA, 164 bp, Homo sapiens
  DISO7_00036057
  Located on chromosome 7
  Distance between a terminus base of telomere on chromosomal short arm and 5'-terminus of this base sequence : 1665737
  Distance between 3'-terminus of neighbour sequence of sequence listing upward to telomere on chrosomal short arm and 5'-terminus of this base sequence : 243739
ctcgtgacatgttaacaatgacactgatacacgtatgcgcgtgcatgcacacacacacacgtgcacacacgcacacacacccacagacgcgcgcgcgcgcgcgcgcgcgcacacacacacacacacacacacacacacacacaggcttgtaaggcctttgcagt

SEQ ID NO: 11430 - DNA, 443 bp, Homo sapiens
  chr7.fa.O7frz.2739119
  Located on chromosome 7
  Distance between a terminus base of telomere on chromosomal short arm and 5'-terminus of this base sequence : 2025138
  Distance between 3'-terminus of neighbour sequence of sequence listing upward to telomere on chrosomal short arm and 5'-terminus of this base sequence : 359237
aaggtcgaagtaggagtatcacttgacccaggagtttgagacaagcctggacaaccatactgagaccccatctctaccaaaaatttaaaaatcagctgggcgtggtggaggacacctgtagtcccagctggaaggctgaggcaggaggactgcttaagtccgggacatcaaggctactgtgagctataatgggaccactgtactccagtgagagagagagagagagagaaaaggaaggaaggaaggaaggaaggaaggagggaaggagggaaagaaggaagggaaggaagaaaagaaagaaagagaaagaaaggaaggaaggaaggcagggagggagggaaaaagagagagagagaaagaaagagaaagaaagaaagaaaagaaagaaagaaaaaagggaaagaaaggagagagagagggaacaaacttggagaattcttact

SEQ ID NO: 11431 - DNA, 195 bp, Homo sapiens
  DISO7_10002276
  Located on chromosome 7
  Distance between a terminus base of telomere on chromosomal short arm and 5'-terminus of this base sequence : 2126685
  Distance between 3'-terminus of neighbour sequence of sequence listing upward to telomere on chrosomal short arm and 5'-terminus of this base sequence : 101104
atgtggaagggaatgctggagtaaaatatcccctctcccctccgcccgcccacccgcccgcccgctcgcccgctcgcccgctcctgtggtttttctgagcgtgcgggcgccgggaggggatgctgaggctgatggagctgcctccagggctagggccactcaccggaggagggcggggcctgcacttgaagtcag

SEQ ID NO: 11432 - DNA, 154 bp, Homo sapiens
  DISD22_0004834
  Located on chromosome 7
  Distance between a terminus base of telomere on chromosomal short arm and 5'-terminus of this base sequence : 2257673
  Distance between 3'-terminus of neighbour sequence of sequence listing upward to telomere on chrosomal short arm and 5'-terminus of this base sequence : 130793
agatagtgcttgaaggaggcggaacagattggccattttgtgtgagtgcatgtgtgcgtgtgtgtgcgtgtgtgtgtgtgagtgcatgtgtgcatgtgtgtgagtgtgtgtgtgtgtgtgtgtgctgtgtatggttgtattctgctgactgcag

SEQ ID NO: 11433 - DNA, 106 bp, Homo sapiens
  DISD22_0004841
  Located on chromosome 7
  Distance between a terminus base of telomere on chromosomal short arm and 5'-terminus of this base sequence : 2433162
  Distance between 3'-terminus of neighbour sequence of sequence listing upward to telomere on chrosomal short arm and 5'-terminus of this base sequence : 175335
ctctgcactcccaagctccatggctgggctgggctgggctgggctgggctgggccgggcgtgcggagcctgtggagccagcagctgcagaggcctaggagggagtt

SEQ ID NO: 11434 - DNA, 214 bp, Homo sapiens
  HUMUT626
  Located on chromosome 7
  Distance between a terminus base of telomere on chromosomal short arm and 5'-terminus of this base sequence : 2684329
  Distance between 3'-terminus of neighbour sequence of sequence listing upward to telomere on chrosomal short arm and 5'-terminus of this base sequence : 251061
aatccatagatgcagaacaagcagctatgaggggctgagagtgtgtgtgtgtgtgtgtgtgtgtgtgtgtatacataatttattaattacatataaaaaaatctcctactggttttgtttctctggagaacccccaactaatacagtactagttatgcctctcccagctaaggtcccaggaagtacaattctacccattacccttaagacatca

SEQ ID NO: 11435 - DNA, 233 bp, Homo sapiens
  chr7.fa.O7frz.1937934
  Located on chromosome 7
  Distance between a terminus base of telomere on chromosomal short arm and 5'-terminus of this base sequence : 2689806
  Distance between 3'-terminus of neighbour sequence of sequence listing upward to telomere on chrosomal short arm and 5'-terminus of this base sequence : 5263
aactcctgagcttaggtgatccacttgcgtcagactcccaaagtgctgggattaaaggtgtgagccactgtgcccagcctataaatattcatatatatacacacacacacacacacacacacacatatatatgtatatacatgtaaaattttttttttgagacagaatcttgctctgttgcccaggctggagtgcagtggtgcaatcccagctaactgctttctgtgttcaag

SEQ ID NO: 11436 - DNA, 161 bp, Homo sapiens
  D7S2484
  Located on chromosome 7
  Distance between a terminus base of telomere on chromosomal short arm and 5'-terminus of this base sequence : 2767716
  Distance between 3'-terminus of neighbour sequence of sequence listing upward to telomere on chrosomal short arm and 5'-terminus of this base sequence : 77677
catcatcaagcaaaataagtggttgacagaccccagttctatatgtcatagattcacagcttaagaaccatgccactactgaggacacacacacacacacacacacacacagacacacacacacacacgcccctcctcttagagtccagatgttcccaatg

SEQ ID NO: 11437 - DNA, 130 bp, Homo sapiens
  D7S2521
  Located on chromosome 7
  Distance between a terminus base of telomere on chromosomal short arm and 5'-terminus of this base sequence : 2880415
  Distance between 3'-terminus of neighbour sequence of sequence listing upward to telomere on chrosomal short arm and 5'-terminus of this base sequence : 112538
gcactgccaatgggggggcacacacagagcaaaattaaaacaagagcagccaaacacaccctctctccctctctctctctctttcacacacacacacacacacacacacaccccgctttggttttcagca

SEQ ID NO: 11438 - DNA, 240 bp, Homo sapiens
  D7S531
  Located on chromosome 7
  Distance between a terminus base of telomere on chromosomal short arm and 5'-terminus of this base sequence : 3004712
  Distance between 3'-terminus of neighbour sequence of sequence listing upward to telomere on chrosomal short arm and 5'-terminus of this base sequence : 124167
aaactagagtcctggcctgagggtgccaaaatgagatggaaaatgactctgtgtgtgtgtgtgtgtgtgtgtgtgtgtgtgtgtgtttagaggagtgcgggactgacagaggggcaggacccttaggctcagcctgagtctcaaggcttagcccccctcctcccctctccccacctcctgttccagcctctaattcaccactcatcttccccaggatgggatcagccaggaccacagttt

SEQ ID NO: 11439 - DNA, 418 bp, Homo sapiens
  chr7.fa.O7frz.4047806
  Located on chromosome 7
  Distance between a terminus base of telomere on chromosomal short arm and 5'-terminus of this base sequence : 3225698
  Distance between 3'-terminus of neighbour sequence of sequence listing upward to telomere on chrosomal short arm and 5'-terminus of this base sequence : 220746
tatggagactcagtatcctatcagctttttgatgtaaaatggtacagtagttactacctaagagaatagtctatttccatgctggttgctcacttgtgtgctcttctgaaagagtgagggcactgtgcgtctgactggatactggggtactctgtttccaagctgcattacagggatttgaaatatcttacatatatatatatatatatatatatatatatatatatatatatataatatatatatttatttatattatatatatatttatttattccatatacaggcataccttggagatattgcaggttagggtccagaccattgcaataaagtgaatcacacaaattttgtggtttcccagtgcatataaaagttgtgtttatgctattttgtagtctgttaagtgagcaatagc

SEQ ID NO: 11440 - DNA, 413 bp, Homo sapiens
  chr7.fa.O7frz.3968199
  Located on chromosome 7
  Distance between a terminus base of telomere on chromosomal short arm and 5'-terminus of this base sequence : 3330896
  Distance between 3'-terminus of neighbour sequence of sequence listing upward to telomere on chrosomal short arm and 5'-terminus of this base sequence : 104780
tcagtaggtgctcaataagtatttggggatggataaatgaaggaatgaatgatattataggaagtgagtattttattcagtgcaggatttagtttgtttttctgctcttaaaggataaacatatctgcactgttttaatagaatgttctagtaatatctgtggcagtgatggtgggtcatagcaggcaggcagcagttgtgaactcagcatatcagggcagcctaaggaaggtggggtgtgtgtgtgtgtgtgcgtgtgtgtgtgtgtatgtatgtacatgcgtgtgatactcagacacacagacatccatccatcttaaggtgtcagaatattaagtaagattaagttgtgttagacaatggagtcttacacagtgacttgacccccaggataccacttctgttacagatgc

SEQ ID NO: 11441 - DNA, 362 bp, Homo sapiens
  AC004984.1_107756
  Located on chromosome 7
  Distance between a terminus base of telomere on chromosomal short arm and 5'-terminus of this base sequence : 3563923
  Distance between 3'-terminus of neighbour sequence of sequence listing upward to telomere on chrosomal short arm and 5'-terminus of this base sequence : 232614
gacctatctttggatgctcatatatgtgcacttagagaatcaaaagcaatatccaggtatcttgaccataagcccaataccctgtctatttttttgagtggcaatttgtgttcccatattgtagtgtgcatatatatatatatatatatatatatgctgtatttttaaactgattttagaattagcgcttaaaatagaaaagacagagcacaaatttggggggggagcagtttaaattttgttttcatacatctggttgtattaaattctctgttcctctttttttttttacccccatttctttgcccttctttcttccctttcctccccaatgttttccgtatctctggcaaagttcatga

SEQ ID NO: 11442 - DNA, 305 bp, Homo sapiens
  AC004984.1_79800
  Located on chromosome 7
  Distance between a terminus base of telomere on chromosomal short arm and 5'-terminus of this base sequence : 3591930
  Distance between 3'-terminus of neighbour sequence of sequence listing upward to telomere on chrosomal short arm and 5'-terminus of this base sequence : 27645
ataggtactaattgatgctcagctgaaagtcaaacactcagattttctcagtgttatttgtacttattgtctgtgtgtgtgtgtgtgtgtgtgtgtgtgtgtgtatttacggctatgtaattttaccacatgtgtaagttcacatatccctactacagtctccattcatggagaataggttactggttatgaggagtgagggagatgagacagggccgaaagtggtgaatgtatttataaaagggcaacagaagggatccttgcggtgatggaactgttctgtatctggactgtatccgtttcta

SEQ ID NO: 11443 - DNA, 166 bp, Homo sapiens
  AC004984.1_62582
  Located on chromosome 7
  Distance between a terminus base of telomere on chromosomal short arm and 5'-terminus of this base sequence : 3609130
  Distance between 3'-terminus of neighbour sequence of sequence listing upward to telomere on chrosomal short arm and 5'-terminus of this base sequence : 16895
ggttggaaataggaaatgagacttgacaatatattcgtgtcactaaaattctttattccagaaaagacttagtattgaaatcacacacacacacacacacacacacacacacacacacacactcccatacagaaaacttttctcagtggactattgccgttagtct

SEQ ID NO: 11444 - DNA, 453 bp, Homo sapiens
  chr7.fa.O7frz.4572601
  Located on chromosome 7
  Distance between a terminus base of telomere on chromosomal short arm and 5'-terminus of this base sequence : 3846958
  Distance between 3'-terminus of neighbour sequence of sequence listing upward to telomere on chrosomal short arm and 5'-terminus of this base sequence : 237662
ccgcattatgtggaatagaaaagacatgggcgtgcttctcactctgccgccgtagagggtgggtttgcagtggtttctgagcactttggactgcggtgcacaatgagaactctattttgcattcacacacacacacacacacacacacacacacacaaacagagcatccatggaacaatagtgactctcccagtgtatgtgtactttggtattttctgttctattccattctgtttcattctttaaaacaatgctgctgtgaccacggaattgatttccctatccacgagtgtatttgtgacctacagtttgaaaaatcctgaattccagcaatacagcaacactgtttggtttgactgattcttgcctccctttcggaaaaagcttccgccgaacagaggattcatcagggtctcggctatgaagcctgtcttatcctttcaactgtaaaga

SEQ ID NO: 11445 - DNA, 469 bp, Homo sapiens
  chr7.fa.O7frz.4672793
  Located on chromosome 7
  Distance between a terminus base of telomere on chromosomal short arm and 5'-terminus of this base sequence : 3946749
  Distance between 3'-terminus of neighbour sequence of sequence listing upward to telomere on chrosomal short arm and 5'-terminus of this base sequence : 99338
aaatcttgcaattaaatgtcataggttgcattattgtgcaagccccccaccatgttactttctgtcttcagactaactaacagtgctaccctctcagtctctgtgtaatgaggaagtctgaatgtctgaaggaatagatgagtgaatggatggatggataggtgatgggcgaatggatggatgggtggatggtagatgaatggatgggtggatggatggatggatggatggatgggtgggtagatggatggatagatggatggatggatgggtgatgggtggatgattggatgtatggatggatgatagatggatgagtgaatggatggatgggtaaatggatggatgaatgaatagatggatggatggatgggtaatgggtggatggatggatggatggatgatggatggatgagtgaatggatggatgggtgaatggatggatggaaagatggaatgatcgatttat

SEQ ID NO: 11446 - DNA, 297 bp, Homo sapiens
  AC004887.2_6099
  Located on chromosome 7
  Distance between a terminus base of telomere on chromosomal short arm and 5'-terminus of this base sequence : 4102967
  Distance between 3'-terminus of neighbour sequence of sequence listing upward to telomere on chrosomal short arm and 5'-terminus of this base sequence : 155749
caagaatatggagtctgaccacaatggaatcaaacctcaaatcaataacagaaaaataaaaggaaattctccaaacattaaaaatctggaaaacaaaattctgaataaacgatgggtcaaagagaaagtcttcagggaattaaatatatatatatatatatatatatatatatatatatctatgtgtgtgtgtacattactagactaatatatatatattactgaactaaaatgaaaatacaaatcaattggtgagttgaagctaaaatagttctgagaaggaaatttctagcacta

SEQ ID NO: 11447 - DNA, 292 bp, Homo sapiens
  HUMUT7081
  Located on chromosome 7
  Distance between a terminus base of telomere on chromosomal short arm and 5'-terminus of this base sequence : 4205988
  Distance between 3'-terminus of neighbour sequence of sequence listing upward to telomere on chrosomal short arm and 5'-terminus of this base sequence : 102724
ggggaaaacactgtgaactgcaggcattacatccatcaggatttgaagaacagttatcttgccagtcaggggcgcagtgatccctgattcttttatgtatgtgtgtatgtatgtatgtatgtatgtatgtatgtatgtatgtatgtatgtatttatttatttatttagtgagacagagtgttgctctgttgcccaggctggagtgcaatggcacgatctcggctcactgcaacctccgcctcccaggttcaagcagttctcctgcctcagcctcccgagtagctgggattac

SEQ ID NO: 11448 - DNA, 359 bp, Homo sapiens
  AC004887.2_142784
  Located on chromosome 7
  Distance between a terminus base of telomere on chromosomal short arm and 5'-terminus of this base sequence : 4239571
  Distance between 3'-terminus of neighbour sequence of sequence listing upward to telomere on chrosomal short arm and 5'-terminus of this base sequence : 33291
acctttctgagctcagagtctttacgtttcaataactagacacgcaatttttttcttttgtaatctcccggactatcttgagattcagttttgttctgagttttcttttccttccagatggaaaatctctctcttgctggacaccatagggtagggaaagaaaaagaaatggaggcatgaacttgaagatgtggggtgtgatccccatgctggcatgctctggctgtgtgtgtgtgtgtgtgtgtgtgtgtgtgtgtgtgtgtgtgctcctgggaaagttattatctttggacaatgttctctttgtgtgtaacatgaagataatatccacctgaaggttttcatgcagattacaggag

SEQ ID NO: 11449 - DNA, 171 bp, Homo sapiens
  D7S1819
  Located on chromosome 7
  Distance between a terminus base of telomere on chromosomal short arm and 5'-terminus of this base sequence : 4275471
  Distance between 3'-terminus of neighbour sequence of sequence listing upward to telomere on chrosomal short arm and 5'-terminus of this base sequence : 35541
caatagccctgaccttatgcaatagacatagataaatgatagatgatagatagatagatagatagatagatagatagatagatatgataggcaggtacatagagggaaaagagagagagagagagatctcatcagctctgaccttatgccatagaggtaggtaggtaggta

SEQ ID NO: 11450 - DNA, 253 bp, Homo sapiens
  D7S517
  Located on chromosome 7
  Distance between a terminus base of telomere on chromosomal short arm and 5'-terminus of this base sequence : 4280472
  Distance between 3'-terminus of neighbour sequence of sequence listing upward to telomere on chrosomal short arm and 5'-terminus of this base sequence : 4830
tggagaagccatgtgagtgagagatgaccttttgttagattaagcacctcagatttggggctgttaccaaatcaaatctatgtgaaagcacagcctttcctgactcacacagtatgttagacttcgagtttaaaagggagggattcactctctctctcattctttcaacacacacatacacacacacacacacacacacacacacacacacacacaccccctctgtttttcaaaccagcaactaattacagct

SEQ ID NO: 11451 - DNA, 221 bp, Homo sapiens
  D7S511
  Located on chromosome 7
  Distance between a terminus base of telomere on chromosomal short arm and 5'-terminus of this base sequence : 4449577
  Distance between 3'-terminus of neighbour sequence of sequence listing upward to telomere on chrosomal short arm and 5'-terminus of this base sequence : 168852
agtgatctgcccaccgtggcctctcaaaatgatgggattacaggtgtgagccaccatgcccagccaaaactaaaatctgcgctaaagtgtgtgtgtgtgtgtgtgtgtgtgtgtgtgtgtgtgtgtgtgtgtgagacagagtctcactctgttacccaggatggagttcagtgacacgatctcggctcaccgcaacctttgcctcctgggctcaagcaagt

SEQ ID NO: 11452 - DNA, 405 bp, Homo sapiens
  chr7.fa.O7frz.5360178
  Located on chromosome 7
  Distance between a terminus base of telomere on chromosomal short arm and 5'-terminus of this base sequence : 4686996
  Distance between 3'-terminus of neighbour sequence of sequence listing upward to telomere on chrosomal short arm and 5'-terminus of this base sequence : 237198
atctcagcatgtaacatgttaatcccaaggtccttgccaagagacaaggaaaaacacccactgagaacttcattcccagtcacattctgctcaaggtcataaacttgtgacatgaaaaacaaaaggaagagccctctttatttatttatttatttatttatttatttatttttattagagtctcttttgagacagagtctccctctgtcgcccaggctggagtacaatggcgcaatctcagttcactgcaacctccgcctcctgggttcaagcaattctcctgcctcagcctcccaagtagctgggattacaggcgcccgccaccacacccggctgattttttgtatctttagtagagatgggatttcaccacattgtccaggctggtctcgaattcctgacctc

SEQ ID NO: 11453 - DNA, 405 bp, Homo sapiens
  chr7.fa.O7frz.5476397
  Located on chromosome 7
  Distance between a terminus base of telomere on chromosomal short arm and 5'-terminus of this base sequence : 4802808
  Distance between 3'-terminus of neighbour sequence of sequence listing upward to telomere on chrosomal short arm and 5'-terminus of this base sequence : 115407
taagatagccacctcaatacatagatcccatcctatgcactcgtcttgctgtaagaggagtggatgtacctctatcaggtgtgggggaatggggtctacacgcactccccttgaagctagcaggacccttgcagctgccttgagcaaaagtggtaccagaaaggtccgatccagaccccaagagagggttcttggaccccgtccaagaaagaattcagggagagcccacagagtaaagtgaagtttattaagaaagtcaagaaataaaagaatgactactccataggcagagcatcaccaagggctgctggttggctatttttatggttatttcttttatttatttatttatttatttatttatttatttatttatttttgagacagagtctagcactgtcactc

SEQ ID NO: 11454 - DNA, 144 bp, Homo sapiens
  DISD22_0004850
  Located on chromosome 7
  Distance between a terminus base of telomere on chromosomal short arm and 5'-terminus of this base sequence : 4915120
  Distance between 3'-terminus of neighbour sequence of sequence listing upward to telomere on chrosomal short arm and 5'-terminus of this base sequence : 111907
ggctttagagccaatctccataaataaaaataattacaaatgcatagttctctttttcctttggtttggaatacaaaacagaaacacacacacacacacacacacacacacacacacacagtgaaagaattaaggtgagacagt

SEQ ID NO: 11455 - DNA, 101 bp, Homo sapiens
  DISD22_0004853
  Located on chromosome 7
  Distance between a terminus base of telomere on chromosomal short arm and 5'-terminus of this base sequence : 4994843
  Distance between 3'-terminus of neighbour sequence of sequence listing upward to telomere on chrosomal short arm and 5'-terminus of this base sequence : 79579
agcaccttcttcccacagagataacaacaacaacaacaacaacaacaacaaagcacagcatttccaggcagtgactgcaaaacatgaacatgacacttgcc

SEQ ID NO: 11456 - DNA, 112 bp, Homo sapiens
  DISD22_0004854
  Located on chromosome 7
  Distance between a terminus base of telomere on chromosomal short arm and 5'-terminus of this base sequence : 5141025
  Distance between 3'-terminus of neighbour sequence of sequence listing upward to telomere on chrosomal short arm and 5'-terminus of this base sequence : 146081
ccacatctccacatctttgtactgtgtgtgtgtgtgtgtgtgtgtgtgtatgtctgtcgtgcatagcagaggggggaagaagtgtgttcggaggcacacctgctgccataac

SEQ ID NO: 11457 - DNA, 150 bp, Homo sapiens
  D7S2557
  Located on chromosome 7
  Distance between a terminus base of telomere on chromosomal short arm and 5'-terminus of this base sequence : 5239997
  Distance between 3'-terminus of neighbour sequence of sequence listing upward to telomere on chrosomal short arm and 5'-terminus of this base sequence : 98860
gcctcaattacaattcaacacttcagtactctataaaaatacagcaattacaccaatatttaactttaaacatggaaaccacacacacacgcacacacacacacacacacacacacaaaaactaaagaaaaaactccatctggtttaagc

SEQ ID NO: 11458 - DNA, 333 bp, Homo sapiens
  AC006458.2_67997
  Located on chromosome 7
  Distance between a terminus base of telomere on chromosomal short arm and 5'-terminus of this base sequence : 5388239
  Distance between 3'-terminus of neighbour sequence of sequence listing upward to telomere on chrosomal short arm and 5'-terminus of this base sequence : 148092
tgagccaataatgagttcagactatagaattgtattccattgaatgaattttggatgttctatctgaaatatttatctgtttgtatatatgtgtgtgtgtgtgtgtgtgtgtgtgtgtgtgtgtgtttctctttagtggtttttaaattccggccaatttaaccttgactctcatgcatgtttgactgttttataatattgatatttagttggtcaacttttcaagcaacattacacagggaaattatgtttgcaataagaaaatttcttttgtattttggctgaaggtatttaaaaagcattcatttcatgtctgtaatcaatgccattgtt

SEQ ID NO: 11459 - DNA, 272 bp, Homo sapiens
  AC006458.2_53825
  Located on chromosome 7
  Distance between a terminus base of telomere on chromosomal short arm and 5'-terminus of this base sequence : 5402464
  Distance between 3'-terminus of neighbour sequence of sequence listing upward to telomere on chrosomal short arm and 5'-terminus of this base sequence : 13892
tagccaaacataaggagttcaagaaaagtctccttcacacgcacacacacacacacacacacacacacacacagagagagagagagagagagagagataatctatatgtatctatctccctagatatatatgtatataaatgtaatttatgtatataatatatattatatatacattatacattatatgcttataacagtatatacatatatacaatatgtaatgtcaaatatttatcatttatttgtcttggaaacataccaaatctattc

SEQ ID NO: 11460 - DNA, 346 bp, Homo sapiens
  AC004739.1_83923
  Located on chromosome 7
  Distance between a terminus base of telomere on chromosomal short arm and 5'-terminus of this base sequence : 5515793
  Distance between 3'-terminus of neighbour sequence of sequence listing upward to telomere on chrosomal short arm and 5'-terminus of this base sequence : 113057
gaagttgcttatcagcttaagaagatttgggctaagatgatagggtttcctgggtgaaagatcatgtcatccgcaaacagggtcaatcgtgtgtgtgtgtgtgtgtgtgtgtgtgtgtgtgtgtgtgtgtgtgtgctgaattgcatccctccaaaattcatatgttgaagtcttaacccctagcaccacttcagaatgggatggtaattggagatggggtctttagaaatgtgattaaatgagtaggccctaatcccatataactggtgtccttataagaagaagagattatgactcagtaaatacagagggaagagcacggggagaacaaggtggctatttacaa

SEQ ID NO: 11461 - DNA, 195 bp, Homo sapiens
  AC004739.1_55949
  Located on chromosome 7
  Distance between a terminus base of telomere on chromosomal short arm and 5'-terminus of this base sequence : 5543849
  Distance between 3'-terminus of neighbour sequence of sequence listing upward to telomere on chrosomal short arm and 5'-terminus of this base sequence : 27710
atttgcctgtatacgtgcttacacacacacacacacacacacacacacacacaaacacacacacacacacagctatagctatttacaaagcactccataaatattaatctgttatgtgaaagcacaggtagatatttcattacattttgaatgagtaaaaagaaagagacaaaatttgacctatcaggatcatga

SEQ ID NO: 11462 - DNA, 441 bp, Homo sapiens
  AC004739.1_51739
  Located on chromosome 7
  Distance between a terminus base of telomere on chromosomal short arm and 5'-terminus of this base sequence : 5547958
  Distance between 3'-terminus of neighbour sequence of sequence listing upward to telomere on chrosomal short arm and 5'-terminus of this base sequence : 3914
tggtcataaagccaataattaaaggaagaatattgaaagagaaatttcccgaagcttaggcttcttctttgtttttctgactttattaacatctcctggacggggtgtgtgtgtgtgtgtgtgtgtgtgtgtgtgtgtgtgtgtgtgtgtgtgttgggagaggtattggtgtggggtttgggcttaacaggaaaactagtaactgtgtaacacattcactgtctgacatctactccctttatttgtctaaaataaaaccattgcgttgtatgcagatttccctcaagggatgagcccttcctcatgagaccattcaggcctctcagaagttttcttcattctatcctggaaaactttgcagctcttagaaaaactaacctgttagatgtgtgagtttcctctatacagtaatatggacactaggattgactggatgttgac

SEQ ID NO: 11463 - DNA, 342 bp, Homo sapiens
  AC004739.1_30338
  Located on chromosome 7
  Distance between a terminus base of telomere on chromosomal short arm and 5'-terminus of this base sequence : 5569394
  Distance between 3'-terminus of neighbour sequence of sequence listing upward to telomere on chrosomal short arm and 5'-terminus of this base sequence : 20995
catgaagacatgtattacatggacaataaaaatgaaaaaaatgtagcaaaattataaatttaacaaaagatgtgtgtgtgtgtgtgtgtgtgtgtgtgtgtgtgtgtgtgtgtgtgtgtagtgaatggacataatcacatcaatagctggttttataaccctgaagcagaaagtcattacaaggagatatttaatcatttacaccatgggagaaacaaagacggggcagggaccaccctgatataaatgaaagcctagtcccctccaagtgtcaccactgcaatgatttaagtattctctgcccttttgtaacactgctcaaggttcacattcctagaaagg

SEQ ID NO: 11464 - DNA, 318 bp, Homo sapiens
  AC004739.1_22335
  Located on chromosome 7
  Distance between a terminus base of telomere on chromosomal short arm and 5'-terminus of this base sequence : 5577382
  Distance between 3'-terminus of neighbour sequence of sequence listing upward to telomere on chrosomal short arm and 5'-terminus of this base sequence : 7646
ggaatcaacctaagtgtttatcaatggatgactgtataaagaaatgtgatgtatatacacaatgtagtactagactgtataaagaaaatgtgatatgtatgtgtgtgtgtgtgtgtgtgtgtgtgtgtgtgtgtatacacaatgcagtacttttcagccataaaaaagaatggaattatgtcttttgcaggaacaagccattatcttaagtcagtctcagaaagataaatattgcatgttctcatttgtaagttagagctagataatatgtacagatggatgtcaagtgtggaataatagacaatggagactcagatg

SEQ ID NO: 11465 - DNA, 380 bp, Homo sapiens
  AC004739.1_3555
  Located on chromosome 7
  Distance between a terminus base of telomere on chromosomal short arm and 5'-terminus of this base sequence : 5596081
  Distance between 3'-terminus of neighbour sequence of sequence listing upward to telomere on chrosomal short arm and 5'-terminus of this base sequence : 18381
aaaggtttatgtcttccagtctttttcttttaatatgttttggaagaaatcttttcaatgcataataaattacttatcataggtgtgttttttgttttgttttgttttgttttgttttttgccttctcctaatatataaggttctttctttctttctttctttctttctttctttctttctttctttctttctttctttctttctttctttctttttttgatggagtctcgctctgtcacctaggctggagtgcaatgacgcaatctcggatcactgcaacctctgcctcccaggttcaagcaattctcctgcctcagcctcccaagtagctagggactacattagtcactagtcccaattagttgagactacaggcatg

SEQ ID NO: 11466 - DNA, 242 bp, Homo sapiens
  AC006150.2_112841
  Located on chromosome 7
  Distance between a terminus base of telomere on chromosomal short arm and 5'-terminus of this base sequence : 5649213
  Distance between 3'-terminus of neighbour sequence of sequence listing upward to telomere on chrosomal short arm and 5'-terminus of this base sequence : 52752
cttgaacctgtggaattcatagaagcttgctccttcagtgccagcaacacacacacacacacacacaaacacacacagcagggggttgggtggaagagagagagagagagagagagagacagagagagagagatcttccttgctgcttcaattctcttacctctagaccttatttttaaaaattcatctactagatggagttcacccagaataagcttctttcgatgaacttaaagtcaact

SEQ ID NO: 11467 - DNA, 252 bp, Homo sapiens
  AC006150.2_96334
  Located on chromosome 7
  Distance between a terminus base of telomere on chromosomal short arm and 5'-terminus of this base sequence : 5665738
  Distance between 3'-terminus of neighbour sequence of sequence listing upward to telomere on chrosomal short arm and 5'-terminus of this base sequence : 16283
gcttgagacagtatggtctgactcatagatatcaagagggagggaaaagggagaggtgtgtgtgtgtgtgtgtgtgtgtgtgtgtgtgtgtgtgtgtgtgttaaaagagagtaggaagcagggagtcatagatacattatggaattagaatcagaggttgtaaaagaaagaggtgtcaggacctcaagttaggaccgcacaactcttttagtgtgtgcattgatacaagtgataggctatgatcattcactt

SEQ ID NO: 11468 - DNA, 386 bp, Homo sapiens
  AC006150.2_80651
  Located on chromosome 7
  Distance between a terminus base of telomere on chromosomal short arm and 5'-terminus of this base sequence : 5681234
  Distance between 3'-terminus of neighbour sequence of sequence listing upward to telomere on chrosomal short arm and 5'-terminus of this base sequence : 15244
gcacttgaattattccgaaaccatttccccactccctggtccatggaaaaattatcttccatgacactggtccctggtgccaaaaagtctggggaccagtgatctagaagacagccctgctctgaagggcagctcctcaattcaagccaattgcatgccagacatttcacaccactcaggaacacatatagaacaacagtattgataaattaatgctctatatatctctgcttacctagtacatgtgatatatatatatatatatatatatatatatatatatatatacatacacatacatatatatatacacacatatatgagataaatatgtatatatggatttaggtacatattagtttgttagtttggcttcagtttatgtg

SEQ ID NO: 11469 - DNA, 199 bp, Homo sapiens
  AC006150.2_59705
  Located on chromosome 7
  Distance between a terminus base of telomere on chromosomal short arm and 5'-terminus of this base sequence : 5702401
  Distance between 3'-terminus of neighbour sequence of sequence listing upward to telomere on chrosomal short arm and 5'-terminus of this base sequence : 20781
gttcagtacaaataggctctcaatgaaaaaaattactaaacacacacacacacacacacacacacacccaaaaagtgaagtcaatgtgaagaaataactcacaaatgaaatgagttattgagtggtataaataataataataagtaatttctttatgtttcaaaagaaagtactaaaattctggataatgattccacag

SEQ ID NO: 11470 - DNA, 341 bp, Homo sapiens
  AC006150.2_57560
  Located on chromosome 7
  Distance between a terminus base of telomere on chromosomal short arm and 5'-terminus of this base sequence : 5704443
  Distance between 3'-terminus of neighbour sequence of sequence listing upward to telomere on chrosomal short arm and 5'-terminus of this base sequence : 1843
cttggacagcaatcgtaatattacatattagtcagggacttctggaaaaactgagccagtagcatatatttgtgtgtttctctccaggaaaacaaaaccagaaacatatatacgtatgtgtgtgtatgtgtggggtatatgtgtgtgcgtgtgtgtgtgtgtgtgtgtgtatatgtatatatgtgtgtatatgtgtgtatatatatatacacacacacatatgtatatatatacatgtatatatagatacacacatgcacatatacatatatcggggggagagagagaaactaatttattatgagcaataggctaataagattatggaggttgtaaagtcc

SEQ ID NO: 11471 - DNA, 118 bp, Homo sapiens
  Z67672
  Located on chromosome 7
  Distance between a terminus base of telomere on chromosomal short arm and 5'-terminus of this base sequence : 5720327
  Distance between 3'-terminus of neighbour sequence of sequence listing upward to telomere on chrosomal short arm and 5'-terminus of this base sequence : 15543
ggaaactagccactacatactagaatataatatcttaaggctgtgtgcgtgtgtgtgtgtgtgtgtgtgtgtacatgttcctggaaatttttctaatctttgattcctatgaagtttg

SEQ ID NO: 11472 - DNA, 329 bp, Homo sapiens
  AC006150.2_24863
  Located on chromosome 7
  Distance between a terminus base of telomere on chromosomal short arm and 5'-terminus of this base sequence : 5737216
  Distance between 3'-terminus of neighbour sequence of sequence listing upward to telomere on chrosomal short arm and 5'-terminus of this base sequence : 16771
catatcaaactggctttgtaactaaactcctttacaaaatctttctttctttctttctttctttctttctttctttctttctttctttctttctctctctctttctctttctttcctttcttcctttctttctttctttcctttctctttccttcccttccctccctccctctttctttctttctttctctctctctctttctttctttctttctttctttctttctttctttctttctttctttctttcttatctttaaaaatgtttacacagtgtaggggtagctttgtttttaccagatgaatgtctgaaatacggctaagataca

SEQ ID NO: 11473 - DNA, 240 bp, Homo sapiens
  chr7.fa.O7frz.14960636
  Located on chromosome 7
  Distance between a terminus base of telomere on chromosomal short arm and 5'-terminus of this base sequence : 5899314
  Distance between 3'-terminus of neighbour sequence of sequence listing upward to telomere on chrosomal short arm and 5'-terminus of this base sequence : 161769
gtgaagtaatgctccttattgtactaatgatgatattaatctcacacacacacacacacacacacacgacaaactagctgaatgccagtttgaacactgccaaaccatgtatttgaagaacgattctcttttattgtacttcttatatttaaaatatctgctaaaagtaaagagaaagctagttagtccatttatgcctagtgttccattattggaacactaagcatgtaggagttattt

SEQ ID NO: 11474 - DNA, 260 bp, Homo sapiens
  chr7.fa.O7frz.14851153
  Located on chromosome 7
  Distance between a terminus base of telomere on chromosomal short arm and 5'-terminus of this base sequence : 5992300
  Distance between 3'-terminus of neighbour sequence of sequence listing upward to telomere on chrosomal short arm and 5'-terminus of this base sequence : 92746
gactatggttgactgcagtaactgaaaccgtggaaagcacaaccacagataaaggggactactgtaatattaagcattctacatttctggacttatccagcatgtaaacttctcacatataaaaaagtcatcataaaataccatggctatcatggtatcatacacacacacacacacacacacacacacacacacacatctatgtacacatcatagcaattaaactgaaatgtgatgttaatcatatgccatatccaata

SEQ ID NO: 11475 - DNA, 337 bp, Homo sapiens
  AC005248.1_7106
  Located on chromosome 7
  Distance between a terminus base of telomere on chromosomal short arm and 5'-terminus of this base sequence : 6163335
  Distance between 3'-terminus of neighbour sequence of sequence listing upward to telomere on chrosomal short arm and 5'-terminus of this base sequence : 170775
caattcctctgcagttctgtaataaatgtaaaaaaaaaaaattcattgccagatttgcggacaataaaaaaactataataaaaatatatttgtcatattaacagttctcaaatcattaacttgtgttaccagacaaaaacaacttctcctccttctcttcctcctcttttttctttctatataggtagatgcatatatagatagttatacatacccacatacacgcgcgcgcacacacacacacacacacacacacacacacacatatgtatatacatataaagaaataaataactgtggcattgactggaaagtctatagatctgcaatggacatt

SEQ ID NO: 11476 - DNA, 272 bp, Homo sapiens
  AC005248.1_37414
  Located on chromosome 7
  Distance between a terminus base of telomere on chromosomal short arm and 5'-terminus of this base sequence : 6193766
  Distance between 3'-terminus of neighbour sequence of sequence listing upward to telomere on chrosomal short arm and 5'-terminus of this base sequence : 30094
caaacacataaaccttaccgttagtgtgaagaattacaggttgatttgttatttttgagaaaaagtgttgcaacctcctttgcttgaggtaggggtgagagagagagagtgtgtgtgtgtgtgtgtgtgtgtgtgtgtgtgtgtgtgtgttctataagaacaaatggtgtataatagcagacaggtaacattaaaaaattaaataaaagagagaagtgcattatctaatccagggtttcattaaaacactaaattatctgcatctgtgaacc

SEQ ID NO: 11477 - DNA, 184 bp, Homo sapiens
  AC005039.1_13830
  Located on chromosome 7
  Distance between a terminus base of telomere on chromosomal short arm and 5'-terminus of this base sequence : 6238493
  Distance between 3'-terminus of neighbour sequence of sequence listing upward to telomere on chrosomal short arm and 5'-terminus of this base sequence : 44455
gcgtgacagagcaagactccgtcttataacaaaacaaaaccatatatatatatatatatatagagagagagagagagagagagagagagaaactttactagatgagaatttactatattttgaatgaacacgaaagatttaattgaggttaacttaatagaccttgttaatttgccagtattgc

SEQ ID NO: 11478 - DNA, 388 bp, Homo sapiens
  AC005039.1_31250
  Located on chromosome 7
  Distance between a terminus base of telomere on chromosomal short arm and 5'-terminus of this base sequence : 6255680
  Distance between 3'-terminus of neighbour sequence of sequence listing upward to telomere on chrosomal short arm and 5'-terminus of this base sequence : 17003
gatttatccaacctcgcatacaccctgctccagtaattcaaagagaactcagtctacactggaagatcaagattggtaaccactggagactggtctctgtgaaggaaaattatgtcagcctgtaggcaggtcagggactgaaagaatcaaatcaaaatggctaaggtttctgcattcttcaggcatcatctgcctaataaatataaattaaataaagttgatttgctccatattgacctttcaatataaatgtgttgaaatgtataaattaggtcacttttgtgtatatatatatgtgtgtgtgtgtgtgtgtgtgtgtgtgtgtatatgtgtgtgtgtatatatctatatgtgtgtgtgtgtatatatcttgatgcaatttgtcttg

SEQ ID NO: 11479 - DNA, 396 bp, Homo sapiens
  AC005039.1_42092
  Located on chromosome 7
  Distance between a terminus base of telomere on chromosomal short arm and 5'-terminus of this base sequence : 6266529
  Distance between 3'-terminus of neighbour sequence of sequence listing upward to telomere on chrosomal short arm and 5'-terminus of this base sequence : 10461
acgtgaactggacagtcattaaaaagcatattttgggggaggccaaggcaggtggatggcttgaggccacaagttccagaccagcctgggcaacatagtaagaccttgtctctacaaaagattttaaaaattggctgagcatggtggtgatgcaggcctatagtcccagctactctaggggcacaggtgagaagattgcttaagcccagaagttcaaggctgtagtgagctatgattttactccagtctgagcaacacagtgagaccttaccaagagaaagaaagaaaaagaaagaaagaaagaaagaaagaaagaaagaaagaaagaaagaaagaaagaaagaaagaaagggaaagaagaaagaatttttaaccttgcttaatacaattcgtcag

SEQ ID NO: 11480 - DNA, 180 bp, Homo sapiens
  AC005039.1_44331
  Located on chromosome 7
  Distance between a terminus base of telomere on chromosomal short arm and 5'-terminus of this base sequence : 6269024
  Distance between 3'-terminus of neighbour sequence of sequence listing upward to telomere on chrosomal short arm and 5'-terminus of this base sequence : 2099
attatcaccattcacagcaaattatttttgaacacacacacacacacacacacagaaaaaaaactgatgctaggtagttgaagctttactcttctttggtgatgacagaactaatgagttttgagacagaaaagaatacattttttgaaagtgttttaatatgtccagagcaatggtaga

SEQ ID NO: 11481 - DNA, 446 bp, Homo sapiens
  chr7.fa.O7frz.14458676
  Located on chromosome 7
  Distance between a terminus base of telomere on chromosomal short arm and 5'-terminus of this base sequence : 6396585
  Distance between 3'-terminus of neighbour sequence of sequence listing upward to telomere on chrosomal short arm and 5'-terminus of this base sequence : 127381
taaactcactaaacctcaattcaccattgtctctaactaggaaaagtaaacttttgtatggtacacgcgcacacacacacacacacacacgcaaaattcataaagggaaaagcagagatcctgctgcaaatgacattgccaccaccttcactcccattttgttctctatcccacaaaaattggataaagacaatatctccagactttacaccacgtatcttagagaaaataaaacaatgctggcctcaatactgtgggaagagagcctaattactaacccaattatcgaaacaaatagagtgtttaggcagagacaacagggtataaatgagacagatacaaggaactggcatgacaattaagcaagcatactaaggcaaaactatttaagaaagaaagtatggaaacgaaagaaaaagagcacatccaataaggaaacatagctt

SEQ ID NO: 11482 - DNA, 361 bp, Homo sapiens
  AC004857.1_8737
  Located on chromosome 7
  Distance between a terminus base of telomere on chromosomal short arm and 5'-terminus of this base sequence : 6516200
  Distance between 3'-terminus of neighbour sequence of sequence listing upward to telomere on chrosomal short arm and 5'-terminus of this base sequence : 119169
aagttcagcaaacaatctacagtattcttatgataaaaatagttggataatagaaaagaaaaataaggcatttccgtaatggtttttcttttccctttcttgaaaccttctttgcatctttctgtcttttccttttttcttccttagttttatacatgcaagtttctgtaacaagttactctgtaaagcaggatgcatgtatgtatttgtgtgtgtgtatatatatatatgtatgtatgtatgtatgtatgtatgtatgtaactttgtaaacgtcatttatttaaatgtgttcctttaatggatctgagctctgagacagagcaataaaattggtgtgtttatattgcaagtccaagttta

SEQ ID NO: 11483 - DNA, 397 bp, Homo sapiens
  AC004857.1_19946
  Located on chromosome 7
  Distance between a terminus base of telomere on chromosomal short arm and 5'-terminus of this base sequence : 6527508
  Distance between 3'-terminus of neighbour sequence of sequence listing upward to telomere on chrosomal short arm and 5'-terminus of this base sequence : 10947
aactatccatttcaagcatgactagttgcataccttctcgcccaagttagtattcctgagagttatacgatagctacctcttgatggttctgagtttcttttgggtatgctttttgtagttgctgctttgtgtgtgtgtgtgtgtgtgtgtgtgtgtgtgtgtgtgtgtgtgtgtgtgtgtgtgtgtgtgttttgagatggggtctcgctctgtcgcccaggctggagtgcagtggcgtgacctcagctcactgcaagctccgcctcccgggttcacgccattctcctgcctcggcctcccggctagctgggaccacaggcgcccgccaccacgccaggctaatttttttttttgtatttttagtagagacggggtttcactgtgttagccagtatg

SEQ ID NO: 11484 - DNA, 164 bp, Homo sapiens
  AC004857.1_39330
  Located on chromosome 7
  Distance between a terminus base of telomere on chromosomal short arm and 5'-terminus of this base sequence : 6546984
  Distance between 3'-terminus of neighbour sequence of sequence listing upward to telomere on chrosomal short arm and 5'-terminus of this base sequence : 19079
ttcaagcaggaaattggacccagtattgctcgatattgtgtgtgtgtgtgtgtgtgtgtgtgtgtgtgtgtgtgtgtgttcctagagaagccagcagtttggatttctaaaccagaagattttgaagctgatttttaaatgatcacagttaattggttatttgc

SEQ ID NO: 11485 - DNA, 198 bp, Homo sapiens
  AC004857.1_69803
  Located on chromosome 7
  Distance between a terminus base of telomere on chromosomal short arm and 5'-terminus of this base sequence : 6577430
  Distance between 3'-terminus of neighbour sequence of sequence listing upward to telomere on chrosomal short arm and 5'-terminus of this base sequence : 30282
ctcttacatgaatggacgctatagagcctggagtttcattcataaaatggagactgaaaggaaacacacacacacacacacacacacacactcactcactctctctggaatgtccatttatacagagctgaagggtgtagtgttccatcagctgctgcttatgccagttgactggaagtaatgattaatgctcattgg

SEQ ID NO: 11486 - DNA, 331 bp, Homo sapiens
  AC004857.1_72939
  Located on chromosome 7
  Distance between a terminus base of telomere on chromosomal short arm and 5'-terminus of this base sequence : 6580426
  Distance between 3'-terminus of neighbour sequence of sequence listing upward to telomere on chrosomal short arm and 5'-terminus of this base sequence : 2798
aaaccagcctgacttaagatagtgaaaccctgtctctactaaaagtacaaaattagcagggcatggtggtgcatgcctgtaatcccagctactagggaggctgaggcgggagaatcacttgaacccgggaggcagaggttgcagtgagctgagatcgcaccgttacactccagcctgggcaacaagagcgaaactccgtctcaaaataaataaataaataaataaataaataaataaataaataaatactcaaagttacagttgtgtctatgttttctatcacttcaactttattttaaaatttcagcttagtaagactatcacaggcttg

SEQ ID NO: 11487 - DNA, 273 bp, Homo sapiens
  AC005019.1_1540
  Located on chromosome 7
  Distance between a terminus base of telomere on chromosomal short arm and 5'-terminus of this base sequence : 6618357
  Distance between 3'-terminus of neighbour sequence of sequence listing upward to telomere on chrosomal short arm and 5'-terminus of this base sequence : 37600
tactatctttctagaggcatccactttattttacacacacacacacacacacacacacacacacacacacactccttcactccagtgttacagaacaagttgtggcttcctgaatgcatccaagtttccttaatgtttctatgcttttgttcatggtcttccttctgtctgcaattcttcatactttatcctctaaatcctactcatcttttaagacattttcactacatcttagatttcctctcagaccttatctccaggatagatcaactg

SEQ ID NO: 11488 - DNA, 191 bp, Homo sapiens
  AC005019.1_32006
  Located on chromosome 7
  Distance between a terminus base of telomere on chromosomal short arm and 5'-terminus of this base sequence : 6648776
  Distance between 3'-terminus of neighbour sequence of sequence listing upward to telomere on chrosomal short arm and 5'-terminus of this base sequence : 30146
cctaatctgattcctcagttgtacgtccattttccttttacagtggatatttcctacagaactactcctgggctttagctgtgtgtgtgtgtgtgtgtgtgtgtgtgtgtgtctgttttaaatttgaatccagtttatgcaacctcattccaacaccaaaaataattcagtcacttaaatgccatatggaa

SEQ ID NO: 11489 - DNA, 243 bp, Homo sapiens
  AC005019.1_60397
  Located on chromosome 7
  Distance between a terminus base of telomere on chromosomal short arm and 5'-terminus of this base sequence : 6677231
  Distance between 3'-terminus of neighbour sequence of sequence listing upward to telomere on chrosomal short arm and 5'-terminus of this base sequence : 28264
gagaaattggtccttagaaagaaagaaagaaagaaagaaagaaaaagaaattggccctttgtgagaatgtcctcatggagaattgctttcaaaggacttaagaattataatgtatcattaactactcttcacaccccaaatctaccttgtttatttctcctttccactcctattattcttagatactgtttgtatcatgcggcaattttgtctgccttttaatgttggtattactccatcttt

SEQ ID NO: 11490 - DNA, 241 bp, Homo sapiens
  AC005019.1_133243
  Located on chromosome 7
  Distance between a terminus base of telomere on chromosomal short arm and 5'-terminus of this base sequence : 6749935
  Distance between 3'-terminus of neighbour sequence of sequence listing upward to telomere on chrosomal short arm and 5'-terminus of this base sequence : 72461
taaacctaagactatgaggctgagaaaggataaaataattgggaacctagaaaaaaaccctgaaattgtcatcgtggcattaacagtaacattgtcagagtccttaccacatgctgggaagccaaaagacaaaacaaaacaacaaaaatacacacagacacacacacacacacacacacacacacacacacacacacacacacacacacaaatcaagatgtcacaggaaactaggacaatg

SEQ ID NO: 11491 - DNA, 200 bp, Homo sapiens
  AC005019.1_173822
  Located on chromosome 7
  Distance between a terminus base of telomere on chromosomal short arm and 5'-terminus of this base sequence : 6790544
  Distance between 3'-terminus of neighbour sequence of sequence listing upward to telomere on chrosomal short arm and 5'-terminus of this base sequence : 40368
ctgaagataagcataggtttgaactccaacttcatcatcttttgactttgaccttcagcaagtcaattcaaagctttagatccctgaagtataaaagatcgtttagatgagtaagaacaaaatatgtgtgtgtgtgtatatatatatatatttatgtctttaacatggttcattaagtgcatatcataagcatttaatga

SEQ ID NO: 11492 - DNA, 213 bp, Homo sapiens
  D7S664
  Located on chromosome 7
  Distance between a terminus base of telomere on chromosomal short arm and 5'-terminus of this base sequence : 6847231
  Distance between 3'-terminus of neighbour sequence of sequence listing upward to telomere on chrosomal short arm and 5'-terminus of this base sequence : 56487
gatcagtgctggtataatagtaggtactcattcgtacttattaatgattagaatagatttgaatacatttggattctcctttttgcatccataggagtatgtgcatgcctctgtctgtctgtgtgtgtgtgtgtgtgtgtgtgtgtgtgtgtgtgtatgtttaagtgaggttatttgcctcacttgaacagataatcctggaaagatagaatt

SEQ ID NO: 11493 - DNA, 328 bp, Homo sapiens
  chr7.fa.O7frz.13661245
  Located on chromosome 7
  Distance between a terminus base of telomere on chromosomal short arm and 5'-terminus of this base sequence : 7114221
  Distance between 3'-terminus of neighbour sequence of sequence listing upward to telomere on chrosomal short arm and 5'-terminus of this base sequence : 266777
tcctgtgacattgtacaagttcttctaaataattttcatgtcccagataaaacgtactatgaatgacattacttcagtgttgtatttctggtatagctgaatttatggactggcatttatccttgatacacacaaacacacacacacatatacatatatacatacacacacacatatatacatatgtgtgtgtgtgtgtgtatatatatatgtgtatatatatatgtgtatatatatatatatacacatatatatatatatatatatatcgtgcttaaatatacatgaaatgccgtaaatcagagtctacctagtggctatacaaatg

SEQ ID NO: 11494 - DNA, 176 bp, Homo sapiens
  AC006996.2_61843
  Located on chromosome 7
  Distance between a terminus base of telomere on chromosomal short arm and 5'-terminus of this base sequence : 7209708
  Distance between 3'-terminus of neighbour sequence of sequence listing upward to telomere on chrosomal short arm and 5'-terminus of this base sequence : 95159
tccatctatgacagtaagttgtgagatatatatgtgtatatatatacacacacacacacacacacacacacaaacacacaaacatacattttctttatccatccattcattgatgaacatttaggttgattccatgtcctggctattttaaatagtgctacaataaacgtggaagt

SEQ ID NO: 11495 - DNA, 322 bp, Homo sapiens
  AC006996.2_68498
  Located on chromosome 7
  Distance between a terminus base of telomere on chromosomal short arm and 5'-terminus of this base sequence : 7216241
  Distance between 3'-terminus of neighbour sequence of sequence listing upward to telomere on chrosomal short arm and 5'-terminus of this base sequence : 6357
aggtaaagtaggcttcagaataagatgtgttcaaatactccatctgccactggccagctctgttatcccaggccagtgacttaaacctgcagagccatggtttctgttccataaaatgtgagtactattacctgaagtgtagggtcattattaagatgaagcaagacacagacagacagacagacagacagacagacagatgattgatagacagatgatagataaatcgatagctattataaacacttgggacatgtagctggcaatctatcatctatctatctatctcaagagtttattatagtgcctggtacataacaga

SEQ ID NO: 11496 - DNA, 461 bp, Homo sapiens
  AC006996.2_82313
  Located on chromosome 7
  Distance between a terminus base of telomere on chromosomal short arm and 5'-terminus of this base sequence : 7230050
  Distance between 3'-terminus of neighbour sequence of sequence listing upward to telomere on chrosomal short arm and 5'-terminus of this base sequence : 13487
ttccacttaaatatgttccaatacccctcagcgaaccatagctaccaccttacttcctgtttcccttcatggcatgtgttgtctatagtcactgtgtcctttctcaccatcacaatttactctacttcccaatgcaatgaacctccattctggccaaccacaaaaatggtcttttgttgttgttgttgttgttgttgttgttgtttcagctgtcacccaggctagagcgcagtgatatgatcaatagctcactgcatccttgaactcctagcacagggattctcctgcctcagctgcccaagtagttgggactaccacaatgtctggctatttttaattttaatttttttttttttaagagagatgggtctgcctatgttgcccaagctggtctcaaattcctggcattgagtaatcctcccaccttggcctcccagaatgctaagattataggtatgagc

SEQ ID NO: 11497 - DNA, 433 bp, Homo sapiens
  chr7.fa.O7frz.13433664
  Located on chromosome 7
  Distance between a terminus base of telomere on chromosomal short arm and 5'-terminus of this base sequence : 7341793
  Distance between 3'-terminus of neighbour sequence of sequence listing upward to telomere on chrosomal short arm and 5'-terminus of this base sequence : 111282
cctgctacctagaaacctaaagtaggtaagaaagtgggttttcttaataaaaaccactttttttttcctaaccctaactttaactctagccctaaatcaatctccctctctctctctctctctctctctctctctctctctctctctctctctctcttaaactagggaggtaaaaatatctggaatggttactcccatgtcctctaagtctgcctctaggtttcagagatagccctagaggatacacgcattagctctttgagtgaatgaggccagcatatgcttcatgatagataataattttgttggtgacgtctttttaaattttcagctcctgctacatttcttcttccacaaaactcacacataataccgaatgtttaaagaattactccttaatcataactttatatccatagaagtctgagttctg

SEQ ID NO: 11498 - DNA, 448 bp, Homo sapiens
  chr7.fa.O7frz.13350053
  Located on chromosome 7
  Distance between a terminus base of telomere on chromosomal short arm and 5'-terminus of this base sequence : 7425394
  Distance between 3'-terminus of neighbour sequence of sequence listing upward to telomere on chrosomal short arm and 5'-terminus of this base sequence : 83168
ggacctatgttagatctactggtctccctgctgtcttccactgtattacacttctccttcaataacacacatacaagaaagcccaattcctttttaccccctcttattagacgttctcgaattggtaaatttgtgtgtgtgagtgtgagtgtgtgtgtgtgtgtgtggtttaaccaacgtatttccaatgctattacataattgttctcaattagatgtgcctgagggaaatttgaattgaaactgagaagaatttttttgataggcagccaagtaagccactctctgctttgaacaaaagtgtttagatgactgagatgttattcccatattttgagtcaaaatatgctgactttccagaagacagtaataagagtacaattcccagtcaagctatgaacaaatttatgcagttatctgaaaataacaggcttagtaaactcaaatc

SEQ ID NO: 11499 - DNA, 353 bp, Homo sapiens
  AC007243.3_96908
  Located on chromosome 7
  Distance between a terminus base of telomere on chromosomal short arm and 5'-terminus of this base sequence : 7523020
  Distance between 3'-terminus of neighbour sequence of sequence listing upward to telomere on chrosomal short arm and 5'-terminus of this base sequence : 97178
aaggatagtggtagaatacgaaacaaaagtagaactaccatttgatccagcaatcccactactggctatctattcagaggaaaagaagtcattatatgaaaaagatacttgcacatgcatgtttatagcagcacaatttgcaattgcaaaaatatggaaccagcccaaatgaccatcaatcaaccactggaaaaagacattgtgatatagatagatagatagatagatagatagatagatagatagatagatggaatactactcagccataaaaaaggaatgaattaatggcattcacagcaacctgaatggaactgcagacttctattctaggtgaagtaactcagtaatgc

SEQ ID NO: 11500 - DNA, 215 bp, Homo sapiens
  AC005228.1_78137
  Located on chromosome 7
  Distance between a terminus base of telomere on chromosomal short arm and 5'-terminus of this base sequence : 7700264
  Distance between 3'-terminus of neighbour sequence of sequence listing upward to telomere on chrosomal short arm and 5'-terminus of this base sequence : 176891
acctgagtgacagagtgagactacatctcaaaaaaaaaaaaaaaaaaaaaaaaaaaaaaaaatatatatatatatatatatatatataaaatggccttccttgagttaaattttatgtaatatctcaatgtctaaactagaatttctaaataaactataagagaaactatttagaccagtcagtcaagaaacttggtaatatgtcacttgcaata

SEQ ID NO: 11501 - DNA, 286 bp, Homo sapiens
  AC005228.1_54214
  Located on chromosome 7
  Distance between a terminus base of telomere on chromosomal short arm and 5'-terminus of this base sequence : 7724124
  Distance between 3'-terminus of neighbour sequence of sequence listing upward to telomere on chrosomal short arm and 5'-terminus of this base sequence : 23645
ccaaaccataaacataggatgttttccatttgtttatgtcatctctgatttcttcagcagtgttttgtatttctccttgaggagagatctttcacctccttggttagatgtattcttaggtatctgtgtgtgtgtgtgtgtgtgtgtgtgtctgcgtgtgtatttgagtgtctatcgtaaatgagaatacattcttgatttggctctcagcttgaacgttattggtatatagaaatgcgactgatttttctagatttattttgtatcctgaaacttgactgaagtt

SEQ ID NO: 11502 - DNA, 238 bp, Homo sapiens
  AC005281.2_92175
  Located on chromosome 7
  Distance between a terminus base of telomere on chromosomal short arm and 5'-terminus of this base sequence : 7869788
  Distance between 3'-terminus of neighbour sequence of sequence listing upward to telomere on chrosomal short arm and 5'-terminus of this base sequence : 145378
aggagagtaacaaacgaaggagaggctgccaggcactgtgtgtgtacatgcaagcaaacacacacacacacacacacacacacacacacacgcgcgcacacttgcctaagttctcagttgggaagggcagactctttgctttgaaatctgaagataagcaagtggacaggaacagtgcagtgcttctagagagaggccaccccatactatcctagtgagcagaagccttagatcctag

SEQ ID NO: 11503 - DNA, 301 bp, Homo sapiens
  AC005281.2_63513
  Located on chromosome 7
  Distance between a terminus base of telomere on chromosomal short arm and 5'-terminus of this base sequence : 7898346
  Distance between 3'-terminus of neighbour sequence of sequence listing upward to telomere on chrosomal short arm and 5'-terminus of this base sequence : 28320
tctactgtttgatccagcaaacccactaataggtatctatccagaagaaacgaagtcattatataaaaaagatacttgcacacacgtgtatagcagcacaatctacaattgcaagaatatgggaccagcccaaatgcccatccatgagtggataaagaaaatgtgatacacacacacacacacacacacacacactcaccatgaaatacaaagcagtgttttgctaaaattcctcttcctatcttattccatgatattttgcaagtgattattttctctgcaagtctgagaatacagactt

SEQ ID NO: 11504 - DNA, 241 bp, Homo sapiens
  AC005281.2_33327
  Located on chromosome 7
  Distance between a terminus base of telomere on chromosomal short arm and 5'-terminus of this base sequence : 7928552
  Distance between 3'-terminus of neighbour sequence of sequence listing upward to telomere on chrosomal short arm and 5'-terminus of this base sequence : 29905
gcaattacgttaccagtttcttatgtatttttccaggcactcaaattttgtcaacaagaatataggtaatgtagttattttaaatttttaacagaaaatgtaacatataaccttttcgaatccccccccgtgtgtgtgtgtgtgtgtgtgtgtgtgtgtgtgtgtgtgtgtgtgtctgtgtatcaacacacagtactcatagagctaccggtttttactgaccatatggtattccacttta

SEQ ID NO: 11505 - DNA, 434 bp, Homo sapiens
  AC005281.2_30755
  Located on chromosome 7
  Distance between a terminus base of telomere on chromosomal short arm and 5'-terminus of this base sequence : 7931066
  Distance between 3'-terminus of neighbour sequence of sequence listing upward to telomere on chrosomal short arm and 5'-terminus of this base sequence : 2273
atcctgattaacacgatgaagccccgtctctactaaaaatacaaaaaatgagctagttgtggtggcaggcgcctgtagtcccagctactcgggaggctgaggcaggagaatggtatgaacccaggagacagagcttgcagtgagccgagatcacgccactgcactccagcctgggcgacagagcgagactccgtctcaaaaaaacaaaacaaaacaaaacaaaacaaaacaaacaaaaaaaccactttgatagttaatagttttggcattttgatatttaaaaaagtgctgcattgaaataccattttatatactaaaatacttgatttatttttttcttttttttcgtcctattaattttgtgcatgaggcaagtgcctcactctcctgaccctagtcctctcctggctaagtgagctccagatctaaacttc

SEQ ID NO: 11506 - DNA, 469 bp, Homo sapiens
  chr7.fa.O7frz.12731789
  Located on chromosome 7
  Distance between a terminus base of telomere on chromosomal short arm and 5'-terminus of this base sequence : 8030441
  Distance between 3'-terminus of neighbour sequence of sequence listing upward to telomere on chrosomal short arm and 5'-terminus of this base sequence : 98941
agaagtctgcttactctgaatctaccacattcaaacaaacaaacaaacaaacaaacaacctccaaacccaaaacattactgtttacaaatttttttttatgctgagggatcaagtatgatgtaacaaaaatattaaaaagtggatgaataaaaacaaaatgttaagagtagttgtctctggctactgtgactattggtcattttttttagctttttagaattttatatcagacttcccaaaacacttatttcaaagcatgtattgacattattatcaaaataaaataagaaaataaagacaggcaaaaataaatcatgttattcttgatatattaacctttaataagttgctattttaaaatgtttccctcgtgttctctaaatatatagttattaactaaaaagaggaaaaaatttagaagcccaaggatagattaagtttattatttctacctaaaggataggaaga

SEQ ID NO: 11507 - DNA, 187 bp, Homo sapiens
  HUMUT5023
  Located on chromosome 7
  Distance between a terminus base of telomere on chromosomal short arm and 5'-terminus of this base sequence : 8349220
  Distance between 3'-terminus of neighbour sequence of sequence listing upward to telomere on chrosomal short arm and 5'-terminus of this base sequence : 318310
ttatgtgagccaattctcctcataagtctcctctcatctatgtatctatctattttatctatctatctgtctatctatctatctatctatctatctatctatctatctatctatccatctatctatcatctatctacctacctacctgccaatcatttaattggctgtgtctctctggagaaccctg

SEQ ID NO: 11508 - DNA, 281 bp, Homo sapiens
  AC007270.2_108395
  Located on chromosome 7
  Distance between a terminus base of telomere on chromosomal short arm and 5'-terminus of this base sequence : 8463505
  Distance between 3'-terminus of neighbour sequence of sequence listing upward to telomere on chrosomal short arm and 5'-terminus of this base sequence : 114098
ccagttctgcaaaagacattattttattattttctatagtggagtagtaatccatggtgtacacgtgtgtgtgtgtgtgtgtgtgtgtgtgtgtgtgtacataccacttttttaatccaatcatctgttgatgagcacttaggttgatttcatatttttgctattgtgaatagtgctgtgataaacatatgagtacaggtaggtatcattttggtatgatttctttcccttttgtgtatatagccagtggtgagatttctggatcaaatggtagttctagt

SEQ ID NO: 11509 - DNA, 240 bp, Homo sapiens
  AC007270.2_109216
  Located on chromosome 7
  Distance between a terminus base of telomere on chromosomal short arm and 5'-terminus of this base sequence : 8464296
  Distance between 3'-terminus of neighbour sequence of sequence listing upward to telomere on chrosomal short arm and 5'-terminus of this base sequence : 510
gtaatgcgtgaatgtaagcatgtttcaagaaaactacaaaatatattttatagcaattttaaaattttatccttagtaatctgtgtggcagagtacacacacacacacacacacacacacacacacacacacactatcatttggtaataatgccatctctttatctgatatcctaatactatattactataatatcacattttatagatgtccccatgatcttaagaacactgctaagtg

SEQ ID NO: 11510 - DNA, 375 bp, Homo sapiens
  AC007270.2_122857
  Located on chromosome 7
  Distance between a terminus base of telomere on chromosomal short arm and 5'-terminus of this base sequence : 8477736
  Distance between 3'-terminus of neighbour sequence of sequence listing upward to telomere on chrosomal short arm and 5'-terminus of this base sequence : 13200
tctatgcctccttactgtaatcagggatggtgctgtatgtaataaaggtccctttaaattactatagagaggaaagaaagaagttaggaagatgtaacttttattctttacttttctgcaattctgataaataaaccataagtactgcttcataaatgaatttgagacagtgtttttgctactatgtttttcaaaacattgtagacaaagggaattttgtcctatttaaaaagacccaagtcacagaattcttaatttagaaatttcaaggtattaattaacatatgtatatatatgtgtgtgtgtgtgtgtgtgtgtgtataacaactttttgtatataggttctgccaggtaaactgcaggaattgagtatgt

SEQ ID NO: 11511 - DNA, 270 bp, Homo sapiens
  AC007270.2_136647
  Located on chromosome 7
  Distance between a terminus base of telomere on chromosomal short arm and 5'-terminus of this base sequence : 8491756
  Distance between 3'-terminus of neighbour sequence of sequence listing upward to telomere on chrosomal short arm and 5'-terminus of this base sequence : 13645
taacagtattgccacttcatgtactgtttttctaagttctcctatactacagtctaactggaggggtgtgtgtgtgtgtgtgtgtgtgtgtgtgtgtgtgtgtgtgtctgtgtttagtataacttgaatttctctcattttagcctccaatatgaatttcttgtctgttccttaaaagatctctaagttaataatatatattttagctttgggtacgtaagattgtactttattactaagctacatgtcagctattgaaataaagcctaa

SEQ ID NO: 11512 - DNA, 295 bp, Homo sapiens
  AC007270.2_153368
  Located on chromosome 7
  Distance between a terminus base of telomere on chromosomal short arm and 5'-terminus of this base sequence : 8508415
  Distance between 3'-terminus of neighbour sequence of sequence listing upward to telomere on chrosomal short arm and 5'-terminus of this base sequence : 16389
atgcactgaaattcactcagtcttattttgtgttcaacatatggcggagatctagaaattttctatttcccttgaaaataaggtacatttattttggcagttctgcagttcctatgcatataattatacacacacacacacacacacacacacacacacacacacacatcaacaaggccaaggttgctaaaagtatagttcaatcttctgtatatttgttatgttttatcttcttgttttattggtgttggagaggtgtgttaaaaaacttctgaaatagttgtgaatttgttca

SEQ ID NO: 11513 - DNA, 438 bp, Homo sapiens
  AC007270.2_165529
  Located on chromosome 7
  Distance between a terminus base of telomere on chromosomal short arm and 5'-terminus of this base sequence : 8520564
  Distance between 3'-terminus of neighbour sequence of sequence listing upward to telomere on chrosomal short arm and 5'-terminus of this base sequence : 11854
acaactggccttgattatgtattttcaaatagtctgcttttgtgctaattctcccttctatgactaattctgctgttgtgctcttcattacatctttttcatttcatttattcttttttcatctccaggttttctgtgcgtgtgtgtgtgtgtgtgtgtgtgttttaaaatacttcaatctctgttacatttctatgataagtttctcaattgattcttagtgttttcttgaggtttgttgagcttccttaagatggctattttgagttctttttctgatagactataaatctctatcaatttagggtcagtttctagcaccttattttgtttgtttggtgaggtaatatttctctgaatgttcttgatgtgtttgtacctgtgacaatgtctgtacatagagggattaggtatgtagttcagtcttaacgatttggc

SEQ ID NO: 11514 - DNA, 108 bp, Homo sapiens
  G08627
  Located on chromosome 7
  Distance between a terminus base of telomere on chromosomal short arm and 5'-terminus of this base sequence : 8736883
  Distance between 3'-terminus of neighbour sequence of sequence listing upward to telomere on chrosomal short arm and 5'-terminus of this base sequence : 215881
tcaagccaaggcattttctatcgtctatttatctatctatctatctatctatctatctatctatctatctatctagatgagatcttgctatgttgcccaggttgaact

SEQ ID NO: 11515 - DNA, 293 bp, Homo sapiens
  chr7.fa.O7frz.5929838
  Located on chromosome 7
  Distance between a terminus base of telomere on chromosomal short arm and 5'-terminus of this base sequence : 8899943
  Distance between 3'-terminus of neighbour sequence of sequence listing upward to telomere on chrosomal short arm and 5'-terminus of this base sequence : 162952
tcttccattaaagctgtaatgtttttcttttgtgtggtgtgtgtgtgtgtgtgtgtgtgtgtgtgtgtgtgtgtgtgtgcgcatttgtctgggacagggtcttgctctattgcccagactgcagtacaatggtgcgatcatagctcactgcagcttcaacctcctaggctcaagcaatcctcccatgtcagcttcccaagtagctaggacaacaggtgcacactactttgaacagttacttaaaaaaaaaatttttttttgtagagatggagtctcactatgttcctatgctg

SEQ ID NO: 11516 - DNA, 282 bp, Homo sapiens
  AC004983.2_42709
  Located on chromosome 7
  Distance between a terminus base of telomere on chromosomal short arm and 5'-terminus of this base sequence : 9027376
  Distance between 3'-terminus of neighbour sequence of sequence listing upward to telomere on chrosomal short arm and 5'-terminus of this base sequence : 127140
ctactctggaaactaaggtaggaggatcactgaagcccaggaggttgaggctgtggtgagctatgatcgctacactgcactccagcttggacgacagagtgagactctggctctaaataaataaataaataaataaataagaggttggctggaaaattcatggaatcagagaagaaaactgctatttattagataactaaaattatagagatctgggatctgagcacacgattacacatctgtaagacaaaagaaacctactaaacatgaaagcaagacatc

SEQ ID NO: 11517 - DNA, 186 bp, Homo sapiens
  D7S481
  Located on chromosome 7
  Distance between a terminus base of telomere on chromosomal short arm and 5'-terminus of this base sequence : 9237448
  Distance between 3'-terminus of neighbour sequence of sequence listing upward to telomere on chrosomal short arm and 5'-terminus of this base sequence : 209790
tgattctcattctcacccccatattaattttattcttgtttttttatattagccaaaaaaacaggaaccatatttaatcattatgttagcatacacacacacacacacacacacacacacacacacatatatatgttgctgatttaatagtctggtaaaaaaatttttttggagacagtgggggat

SEQ ID NO: 11518 - DNA, 433 bp, Homo sapiens
  chr7.fa.O7frz.12055891
  Located on chromosome 7
  Distance between a terminus base of telomere on chromosomal short arm and 5'-terminus of this base sequence : 9477255
  Distance between 3'-terminus of neighbour sequence of sequence listing upward to telomere on chrosomal short arm and 5'-terminus of this base sequence : 239621
gactattctggccaacatagtgaaaacctgtctctactaaaaatacaaaaattagctgggcacggtgacacttgcctgtagacccaactacttgggaggctgaggcaggagaatcgcttgaacccgggaggtggaggttgcagtgagctgagattgtgccactgcattccagcctggtgacagaccgagactccgtctcaaaaataaatatatatatatatatatacacacacacacacacacacacacacgtataaacatatgtatatacatagaaagcgtatatacatatataaattgtgacagttttaaaaaatcaaaattgggggtagattaaaagtatacttttttgtttggtttggtttggtttgcaatcaaagttgttctcagcttgaaaaacttttttgtaagcctggtagttaccagaaaccaa

SEQ ID NO: 11519 - DNA, 384 bp, Homo sapiens
  chr7.fa.O7frz.6727056
  Located on chromosome 7
  Distance between a terminus base of telomere on chromosomal short arm and 5'-terminus of this base sequence : 9783269
  Distance between 3'-terminus of neighbour sequence of sequence listing upward to telomere on chrosomal short arm and 5'-terminus of this base sequence : 305581
acaatgagacattgaaatcaattgctattgtgcaataaagtacttaaaatgcaaaagattaagcatttatttatttatttatttatttatttatttattttagagacagggtcttgttccgtcacccaggctggagtgcactggtgcaatcatagctcactgcagctttgaactcctgggctcaagcaatcctcctgcctcagcctcccatagtgctaagattacaggtgtgagccaccacccctagtctacattttaaaatatacaaaataatataaaatcaaggcaaagtgatgctgccattcatgggaaaccgactaggtacctggcactgtgctgaattcttacatcttttactcaacgagaactaagaaataccttgta

SEQ ID NO: 11520 - DNA, 154 bp, Homo sapiens
  DID22N_0029224
  Located on chromosome 7
  Distance between a terminus base of telomere on chromosomal short arm and 5'-terminus of this base sequence : 9815023
  Distance between 3'-terminus of neighbour sequence of sequence listing upward to telomere on chrosomal short arm and 5'-terminus of this base sequence : 31370
gatgggctgaggtaacatgtgattatatataaagagagagataggtatatgtatatgtacagacacacacacacacacacacccagaatcatacacacatgcatacatatcctccctggttactcatttttattgtctctaaatgccattgtgg

SEQ ID NO: 11521 - DNA, 256 bp, Homo sapiens
  chr7.fa.O7frz.6974805
  Located on chromosome 7
  Distance between a terminus base of telomere on chromosomal short arm and 5'-terminus of this base sequence : 9957521
  Distance between 3'-terminus of neighbour sequence of sequence listing upward to telomere on chrosomal short arm and 5'-terminus of this base sequence : 142344
tagcaaacgaatagacggaacaggaagagagaaaagaagtaagggttttatgttgaaacccccagcatctgtggcccttagagtgctgatacgtgtgtgtgtgtgtgtgtgtgtgtgtgtgtgtgtgtgtgtgtgtgtgtgtgtgtgtgtgtgtgtgtatggcagctattttcactcagaggatggggcttttggatttagacagacttgggttttagatccagcaagtcacataaccttcctaagtttcagagtt

SEQ ID NO: 11522 - DNA, 117 bp, Homo sapiens
  DISD22_0004866
  Located on chromosome 7
  Distance between a terminus base of telomere on chromosomal short arm and 5'-terminus of this base sequence : 10223354
  Distance between 3'-terminus of neighbour sequence of sequence listing upward to telomere on chrosomal short arm and 5'-terminus of this base sequence : 265577
atgccttcattcctcaccctactttcaaacccctggtaacctcttctactttctagctctgtgtatatatatatatatatatattttttttttttctgacttcattcttcccattac

SEQ ID NO: 11523 - DNA, 137 bp, Homo sapiens
  DISD22_0004870
  Located on chromosome 7
  Distance between a terminus base of telomere on chromosomal short arm and 5'-terminus of this base sequence : 10408873
  Distance between 3'-terminus of neighbour sequence of sequence listing upward to telomere on chrosomal short arm and 5'-terminus of this base sequence : 185402
actcaattggttggccagaagcccaattgtcgttctctctctctctctctctctctctctctctctctctctctctctctctctccctctccctctctcctccctccctccctcccactccaagatatccagtaact

SEQ ID NO: 11524 - DNA, 346 bp, Homo sapiens
  AF265342.1_8604
  Located on chromosome 7
  Distance between a terminus base of telomere on chromosomal short arm and 5'-terminus of this base sequence : 10584203
  Distance between 3'-terminus of neighbour sequence of sequence listing upward to telomere on chrosomal short arm and 5'-terminus of this base sequence : 175193
atagtcaggactggttaatgacaggcttcaatagtgtgtgtgtgtgtgtgtgtgtgtgtgtgtgtgcaggcatgaagccagctgtaactctgggaacctttaaatgccagacttaagaggtatttactctaagagtgctttcccttgccatctgcccaattttttcctgggcaatgtcttaagattatttaaaccctctaatttttggcttggggcaaatggctgcctgcaaatcctttcagtccaatttctcaaacccatttcccactctatctactacagcctttctgggtgtctgccaggacagtcagcttcatggtgctcccttggctatggctgtctctac

SEQ ID NO: 11525 - DNA, 229 bp, Homo sapiens
  AC005532.1_100067
  Located on chromosome 7
  Distance between a terminus base of telomere on chromosomal short arm and 5'-terminus of this base sequence : 10650425
  Distance between 3'-terminus of neighbour sequence of sequence listing upward to telomere on chrosomal short arm and 5'-terminus of this base sequence : 65876
gcagaatatctgaaactggataatctataaagaaaagaaatttattccttacagttaggaaggctgaaaagtcctggttcagggggccacatctggtgagggcatttgctggtagggactctgcagagtcctgaggatagcacagggcaccacatggtgagggggccgagcatgctagcccagaactctttctttctttctttctttcttgtaaagctaccagttcctt

SEQ ID NO: 11526 - DNA, 173 bp, Homo sapiens
  D7S2553
  Located on chromosome 7
  Distance between a terminus base of telomere on chromosomal short arm and 5'-terminus of this base sequence : 10847668
  Distance between 3'-terminus of neighbour sequence of sequence listing upward to telomere on chrosomal short arm and 5'-terminus of this base sequence : 197014
catgtttttatgctttaactacatttcaaaataatacatcttttttttgttgtgtgtgtgtgtgtgtgtgtgtgtgtgtgtgtgtgtgttttttttgagacagagtctcactctgtcaaccaggttggagtgcagtggtgtgatctcagttcactgcagtccccacctctcaa

SEQ ID NO: 11527 - DNA, 233 bp, Homo sapiens
  AC004982.1_10401
  Located on chromosome 7
  Distance between a terminus base of telomere on chromosomal short arm and 5'-terminus of this base sequence : 10961410
  Distance between 3'-terminus of neighbour sequence of sequence listing upward to telomere on chrosomal short arm and 5'-terminus of this base sequence : 113569
tacattctcagctgaaactcagtgaagtgatgactgtatacagagacttgggagaaaggtcaagaaagcctccttttggaaagagaggaaggaaggaaaggagggagggagggagggaagaaggaagaaaggaaggaagaaaggaaggaagaaaggaaggaaggaaggaaggaaggaaggaaggaaggaaagaaggatcaatatttatcaagtacttgttaaatcaagctcca

SEQ ID NO: 11528 - DNA, 234 bp, Homo sapiens
  HUMUT7600
  Located on chromosome 7
  Distance between a terminus base of telomere on chromosomal short arm and 5'-terminus of this base sequence : 11157675
  Distance between 3'-terminus of neighbour sequence of sequence listing upward to telomere on chrosomal short arm and 5'-terminus of this base sequence : 196032
ctgaaattgtactgtgcttcttgtttccagtatacaattcaccaaacatttactaagtaaatatgaatagttactcttaaaatatctttatctatctatctatctatctatctatctatctatctatctacattatttcggtagacttaaggccaatgtataatataggaaaatctcatctgaaactttcccttcattctgcaatagcttagtaatgtatagactttccaaggg

SEQ ID NO: 11529 - DNA, 136 bp, Homo sapiens
  G10238
  Located on chromosome 7
  Distance between a terminus base of telomere on chromosomal short arm and 5'-terminus of this base sequence : 11157694
  Distance between 3'-terminus of neighbour sequence of sequence listing upward to telomere on chrosomal short arm and 5'-terminus of this base sequence : -215
cttgtttccagtatacaattcaccaaacatttactaagtaaatatgaatagttactcttaaaatatctttatctatctatctatctatctatctatctatctatctatctacattatttcggtagacttaaggcca

SEQ ID NO: 11530 - DNA, 405 bp, Homo sapiens
  AC007161.1_55559
  Located on chromosome 7
  Distance between a terminus base of telomere on chromosomal short arm and 5'-terminus of this base sequence : 11211161
  Distance between 3'-terminus of neighbour sequence of sequence listing upward to telomere on chrosomal short arm and 5'-terminus of this base sequence : 53331
ctgaaattatctggtgcagaatgtggcagaatgccagccaaatgccctgtccctcagatgtttcacacctttatcttaattcgctaaaaaggccaccttatttaaagaatttcaaacacaacttgagaatgccttattattggctttgacacagtttacacatacaatcctgtttcttattgctatcttctggtattaaggccctatagatttaagagattttaaaaaaatgtttatatttcttttaagtggagtgcatgtttgtgtgtgtgtgtgtgtgtgtgtgtgtgtgtgtctgtgtgtatgtgtgtgaactgttattggaagttattgccatgtttattttaggcacttcatatatctaattagaaatgatgtttattgttaagtaggcaaagttgcctt

SEQ ID NO: 11531 - DNA, 233 bp, Homo sapiens
  AC007161.1_86879
  Located on chromosome 7
  Distance between a terminus base of telomere on chromosomal short arm and 5'-terminus of this base sequence : 11242622
  Distance between 3'-terminus of neighbour sequence of sequence listing upward to telomere on chrosomal short arm and 5'-terminus of this base sequence : 31056
caaataggtggagtatgctcttctacacagtgagccaaccagccgtcatcttggcttctccaaaactggttttgtgtgtgtgtgtgtgtgtgtgtgtgtgtgtgtgtgtgtgtgtgtgtgtgagagagagagagagagagagacagagagagagcgtaaatatggcaaagtttaacaactgatgaatataggtaaaggtgaacagtctagagtgttcatggtactgttctttc

SEQ ID NO: 11532 - DNA, 149 bp, Homo sapiens
  D7S2514
  Located on chromosome 7
  Distance between a terminus base of telomere on chromosomal short arm and 5'-terminus of this base sequence : 11242657
  Distance between 3'-terminus of neighbour sequence of sequence listing upward to telomere on chrosomal short arm and 5'-terminus of this base sequence : -198
caaccagccgtcatcttggcttctccaaaactggttttgtgtgtgtgtgtgtgtgtgtgtgtgtgtgtgtgtgtgtgtgtgtgtgtgagagagagagagagagagagacagagagagagcgtaaatatggcaaagtttaacaactgatg

SEQ ID NO: 11533 - DNA, 340 bp, Homo sapiens
  AC006465.2_56110
  Located on chromosome 7
  Distance between a terminus base of telomere on chromosomal short arm and 5'-terminus of this base sequence : 11360460
  Distance between 3'-terminus of neighbour sequence of sequence listing upward to telomere on chrosomal short arm and 5'-terminus of this base sequence : 117654
tttcaagcaattagaaacaatctactgtgggccaggcacggtggctcatgcctataatcccagcactttgggaggccaaggtgagcagatcacctgaggtcaggagttcgagaccagcttggccaacatggtgaaaccctgtctcttccaaacacacacacacacacacacacacacacacacacaaatcagccgggcatggtggtgtgcacctgtagtcccaactacctgggggctgaggcaggaaaatctgttgaacctgggaagaagaggttgcagtgagccaagattgtgccactgcactccagcctgggagacagaacaagactccatctcagaa

SEQ ID NO: 11534 - DNA, 376 bp, Homo sapiens
  AC006042.2_10998
  Located on chromosome 7
  Distance between a terminus base of telomere on chromosomal short arm and 5'-terminus of this base sequence : 11416764
  Distance between 3'-terminus of neighbour sequence of sequence listing upward to telomere on chrosomal short arm and 5'-terminus of this base sequence : 55964
ctcatgcctgtaatcctaacactttggaaggccaaggcagacagatcacttgagctaaggagtttgagatcagcctgggcgacatagtaaaaccccatctctacccaaaatacaaaaaattagccaagtatggtggtgtgcatctgtggtcccagctactagggaggctgagatgggaggatcacctgagcctgggaggcggaaatggcaatgagcaaagatcatgccaacgcatttcagcctaggtgacagagtgagactctgtctcaaaaaaatagaaaataaaatatattgagacaagtctgtgtgtgtgtgtgtgtgtgtgtgtgtgtgtgtgtgtgtgcgcgcgcgcgcatgtccaaatggacaatgatat

SEQ ID NO: 11535 - DNA, 290 bp, Homo sapiens
  AC006042.2_146638
  Located on chromosome 7
  Distance between a terminus base of telomere on chromosomal short arm and 5'-terminus of this base sequence : 11552553
  Distance between 3'-terminus of neighbour sequence of sequence listing upward to telomere on chrosomal short arm and 5'-terminus of this base sequence : 135413
aggtgcctacagttaaaggaacgtttcagttcctttcattcattcctgggtttttcttttattttctaagaaggttgaagaaggatgagtgatagagaagaaagcaacaccattgatttttttttttaagaaatgatatatatatgtatatgtttgtgtgtgtgtgtgtgtgtgtgtgtgtgtgtattctgtgcattattttgtcatgatctcaattctcttctttccaccaaagtttgtcgtaatattttctcctgaaggtgcattctggctcctttaaattagtcagt

SEQ ID NO: 11536 - DNA, 176 bp, Homo sapiens
  AF146363.1_2213
  Located on chromosome 7
  Distance between a terminus base of telomere on chromosomal short arm and 5'-terminus of this base sequence : 11702260
  Distance between 3'-terminus of neighbour sequence of sequence listing upward to telomere on chrosomal short arm and 5'-terminus of this base sequence : 149417
cattgtatatgcaatgttgaagacagacacacacacacacacacacacacacacacacaccattttctttaaccattcatgtgtcaatggatatttaggttgctttcacatcttggctattgggaataatgctgcaataaacacagtatacagtgtcaaattcattgacaggttct

SEQ ID NO: 11537 - DNA, 372 bp, Homo sapiens
  AC007128.2_22067
  Located on chromosome 7
  Distance between a terminus base of telomere on chromosomal short arm and 5'-terminus of this base sequence : 11758562
  Distance between 3'-terminus of neighbour sequence of sequence listing upward to telomere on chrosomal short arm and 5'-terminus of this base sequence : 56126
gagccaacatcataccactacactttagcctgggtgacagagacagactctgtctcaaaaataaataaataaataaataaataaataaaataaaataaaataaaataataaaaaagtaaatttaaaaaaacccaacaaacccaaaaatgtaaggttttcttaaaaaaaaagaaaaaagaaatgcatatacttaacactttcacatcacggcaattatctaggatcttccttattgaggctttataatttatgaccttttgtttaaactccgctcctcatgtggctcctgtttatcaattttatatttccaaattgcactctgctgaaaataatgaaattagatcaatatagttatgttaatggaggtaccat

SEQ ID NO: 11538 - DNA, 455 bp, Homo sapiens
  AC004861.1_41043
  Located on chromosome 7
  Distance between a terminus base of telomere on chromosomal short arm and 5'-terminus of this base sequence : 11885402
  Distance between 3'-terminus of neighbour sequence of sequence listing upward to telomere on chrosomal short arm and 5'-terminus of this base sequence : 126468
tgaatctagaactgaattaggaagtttgggttccagtgtcctggaaaaactttgggaaggttaacctttttaaaactattttatcatctgttaaatgtatgctacctacacctgacagctgtcgtgtagattaaacggggtaatgtatgctctatcagataactgtaaaacgtaaaagccatttccatccatccatccatccatccatccatccatccatccatccacccacccatccatccaaccatcatttatttattcattctatcatgtattaatccttaattaaaagcctttacctgtagtaatactttatttctcattttatttttcattgatactgaaagtgctagttaatgaataggagaaacagaaagccaaaaatgctaagcttggtctaggatgttttttaaagtggaacaaatataaaagtagaattatggagtgcaatagac

SEQ ID NO: 11539 - DNA, 212 bp, Homo sapiens
  AC004613.1_32196
  Located on chromosome 7
  Distance between a terminus base of telomere on chromosomal short arm and 5'-terminus of this base sequence : 12138510
  Distance between 3'-terminus of neighbour sequence of sequence listing upward to telomere on chrosomal short arm and 5'-terminus of this base sequence : 252653
cagtattggagttgtgcctaagtaaaaattattttttctattgtgaaaatatcaattacacatttattttttgtaaggtacatttttaatcaatgtccctagtacttacaaacatatagacacacacacacacacacacacacacacacacacacacacacctatgcaattcaatccttgctgcaattctgcaaggcagatattaatagttc

SEQ ID NO: 11540 - DNA, 90 bp, Homo sapiens
  D7S641
  Located on chromosome 7
  Distance between a terminus base of telomere on chromosomal short arm and 5'-terminus of this base sequence : 12138601
  Distance between 3'-terminus of neighbour sequence of sequence listing upward to telomere on chrosomal short arm and 5'-terminus of this base sequence : -121
aatgtccctagtacttacaaacatatagacacacacacacacacacacacacacacacacacacacacacctatgcaattcaatccttgc

SEQ ID NO: 11541 - DNA, 417 bp, Homo sapiens
  chr7.fa.O7frz.8814846
  Located on chromosome 7
  Distance between a terminus base of telomere on chromosomal short arm and 5'-terminus of this base sequence : 12217874
  Distance between 3'-terminus of neighbour sequence of sequence listing upward to telomere on chrosomal short arm and 5'-terminus of this base sequence : 79183
cttcaatgctcaatttacctatagcagattggatcaactttatatatatatagagagagagagagagcgagagagagagaaagagagagcattgtttgtttatggacattaactttattttaaaaaataattgctgtacacaatctcagcaaaataaccagatgaatagttgctgtacacaatctcagcaaaataaccagatgaagaaatatgggaggtgaccaatttttaaagccacgagttgggaatcggaatttgaattgtttcaaaggttaacaaactatgtcaaattaagaacacaaattcattatcatcttccccttatggtacttagaaataagtctgttttcatacagaaaataatgaaagtactgcaagagaaacaaaaccagagttctaaagtgagaactcaatgac

SEQ ID NO: 11542 - DNA, 412 bp, Homo sapiens
  AC004740.1_28389
  Located on chromosome 7
  Distance between a terminus base of telomere on chromosomal short arm and 5'-terminus of this base sequence : 12255600
  Distance between 3'-terminus of neighbour sequence of sequence listing upward to telomere on chrosomal short arm and 5'-terminus of this base sequence : 37309
aaatcatctgtttgaagccacacgagaattgatgacatgaatacccaatacgtgggtaaagtaaaataaatactaaaatattaaaataacagtgatatattgtggaatttatgcatgcatagacatggatatatgtgtgtgtgtgtgtgtgtgagagagagagagagagagaaagagaaagagagaggagagagagagagagagagagaagcagtaatatttaaaccctaagttataattacatgaaatgtaaatggactaaatactcaaattgaaagaaaaatattgccagagtaaacaaaaaattaaaatcatttctatattacttacaaacggggcagcttaattataaagctgtaaaaagattgaaagcaaaatgctgtaaaagatactaaccaaaatggctgataaa

SEQ ID NO: 11543 - DNA, 197 bp, Homo sapiens
  AC004740.1_82224
  Located on chromosome 7
  Distance between a terminus base of telomere on chromosomal short arm and 5'-terminus of this base sequence : 12309515
  Distance between 3'-terminus of neighbour sequence of sequence listing upward to telomere on chrosomal short arm and 5'-terminus of this base sequence : 53503
ccactaagctatgttgatccaggtataacactaggaaatcaggcttaaaattaaaaataccacacaccactggagagatacgctttactgtgttactctaagcaaatacacacacacacacacacacacacacacacacaccccaaaacagcaacagagagattggcatccagagttgctacaatgtaccgtctaaa

SEQ ID NO: 11544 - DNA, 390 bp, Homo sapiens
  AC007164.3_50548
  Located on chromosome 7
  Distance between a terminus base of telomere on chromosomal short arm and 5'-terminus of this base sequence : 12459176
  Distance between 3'-terminus of neighbour sequence of sequence listing upward to telomere on chrosomal short arm and 5'-terminus of this base sequence : 149464
cttctatccttggcactacctcctgagtgttgctaggatcaaaatattactggataattgttttcatatagaatcatacctctatattctgttccatatattatctttttagtaatcccatcttttcacagaaaggtgtaatatgtttgatgtgaatctaaaatttctactgaatataagtgcgcgcgcgcgcgcacacacacacacacacacacacacacatttctctactcttttgaagagatcagtcaatgggcagagtttatagtaggattctataaaaatcatgggaaatttgaagaggatgcccagttacttacagctctggctttttcttttccaatgggatccaaccaaacatttattctgtcgttatggctaagatttcaa

SEQ ID NO: 11545 - DNA, 432 bp, Homo sapiens
  AC007164.3_61666
  Located on chromosome 7
  Distance between a terminus base of telomere on chromosomal short arm and 5'-terminus of this base sequence : 12470316
  Distance between 3'-terminus of neighbour sequence of sequence listing upward to telomere on chrosomal short arm and 5'-terminus of this base sequence : 10750
aacaagtctggcatttgtatttatgcagaaaaatgcatccttggttgcagaaatagtcatcatgagaatagaaactttcatgtttttctaaatatgatgtttactccacccttcacccaaaatttcagaataaattggaacagaaaatttgatcattgccctttggaatggtcacacacacacacacacacacacacacacaaagttgttaatgttatttgggggtcagggaaaataaaatgcagacagcagatgggtgggctgtgtgtgtaggtgtatatatgtatgtgtgtgtatatagactatatttctgcagataccattttcccattttgttgctaatttggggaacctaaagggcactaaaagctcattttctttgctcatttattctctaaagtaacctagtttatgtattcctcaacttgaaca

SEQ ID NO: 11546 - DNA, 254 bp, Homo sapiens
  AC007164.3_87521
  Located on chromosome 7
  Distance between a terminus base of telomere on chromosomal short arm and 5'-terminus of this base sequence : 12496301
  Distance between 3'-terminus of neighbour sequence of sequence listing upward to telomere on chrosomal short arm and 5'-terminus of this base sequence : 25553
taggtaaaggaaattaagcatcagaaggcagagcaggtgctagtgtgtgtgtgtgtgtgtgtgtcaaaaattacattaaaacttccaatacatgaggaaatagtcatccaaatccaaatggcattactttgttagtattagtttcctctgtcactgccttttttgtaaaactcgaaacctatttcctattggatataatcagttactaataagaattaggaattgttattgttattcaaggtgagaaaccatta

SEQ ID NO: 11547 - DNA, 394 bp, Homo sapiens
  AC004852.2_104635
  Located on chromosome 7
  Distance between a terminus base of telomere on chromosomal short arm and 5'-terminus of this base sequence : 12602857
  Distance between 3'-terminus of neighbour sequence of sequence listing upward to telomere on chrosomal short arm and 5'-terminus of this base sequence : 106302
cctccagctagtaagtgatacaactggttagggaaagtgattggcttggattaagaggctgtaaattcttcttgaaaggaatctgccatgatcataaggaatggaacggtggggagtctatggcctcagtgaaggcaggcagataaaaacgtaaagcaatgagaaaaccaaggattcctggcatcactggcacatgtcttataggactggtgaggaggacaattgtaaaatctaggtagtttggaggagtgagagcccaggggtgtgtgtgtgtgtgtgtgtgtgtgtgtgtgtgtgtgtggtgtgtgtgtgtgtgttgtgtgcatgcaaacacgtaaacattcagaattcccaggtatcatttggctagggtcgtgtcctattacaaatgaca

SEQ ID NO: 11548 - DNA, 257 bp, Homo sapiens
  chr7.fa.O7frz.9376742
  Located on chromosome 7
  Distance between a terminus base of telomere on chromosomal short arm and 5'-terminus of this base sequence : 12764664
  Distance between 3'-terminus of neighbour sequence of sequence listing upward to telomere on chrosomal short arm and 5'-terminus of this base sequence : 161413
gatttgctacaaatgaaatttaaggaaaagcctcaccattgtgagtataacatttgttcctgaaaatcactcatacagagatgaaaaacccagtttattggggagtgatcatatataattaaatgttcacacacacacacacacacacacacatataattggtatttatgatctcaagtctcatctgtagttggcttttttaatccatcatattttaaattaaatacaaataagttcttaacaaatagttgaaccaa

SEQ ID NO: 11549 - DNA, 448 bp, Homo sapiens
  chr7.fa.O7frz.9487615
  Located on chromosome 7
  Distance between a terminus base of telomere on chromosomal short arm and 5'-terminus of this base sequence : 12794915
  Distance between 3'-terminus of neighbour sequence of sequence listing upward to telomere on chrosomal short arm and 5'-terminus of this base sequence : 29994
ttagtatccgtctaatgtgcatagaaatatatcaaacatttaatagccatctatgtttctgttatggaaaacttataatctattttatactgaaaagttttctcagatgagtgtgtattgcacttatagactaagagtttatccaattcacattttaaaattgctaatgtgtaagtgccatcttttataaaatttctgccaaaatataattaaaaagaattttcaaaatggcattttaaaagctaaccataatttgccctggaatccagaatcctttgggcaacacctgctgaatgtttaggaaaatacctaatggattcatgggtctctctctctctctctctctctctctcaacatcccttcctctttttcttttttctttgtatagtgaggctcagagaattgtggttgtctcctgggaacacaagaccatggatattcaatgac

SEQ ID NO: 11550 - DNA, 468 bp, Homo sapiens
  chr7.fa.O7frz.9715432
  Located on chromosome 7
  Distance between a terminus base of telomere on chromosomal short arm and 5'-terminus of this base sequence : 13066515
  Distance between 3'-terminus of neighbour sequence of sequence listing upward to telomere on chrosomal short arm and 5'-terminus of this base sequence : 271152
cttagacagagaattgagcactacatgcagtctcatagggtggggagaatacagcagctaagaagtttggaaaactgctgtctttcatattttaaagttcgttatttatgttttatgactttttgaatcaattccatatgtttgtgcttttagattgtttataatttccccatttcatatatagataaatataagtaccccattatatatatacatactatatatacatacatataattttccacacgatgtacacacacacacacacacacacacatctcccctcaatggatatcacagcagttctatggttgcacatgttcacatttattttactaagatacagaatatatggaatcatatatgcaaatactacataaaattctagcatgttttatttattaaattaccctacagtaagactactatgtacgtttccacaatcactgcttaaaggtagccatttat

SEQ ID NO: 11551 - DNA, 171 bp, Homo sapiens
  D7S2547
  Located on chromosome 7
  Distance between a terminus base of telomere on chromosomal short arm and 5'-terminus of this base sequence : 13265293
  Distance between 3'-terminus of neighbour sequence of sequence listing upward to telomere on chrosomal short arm and 5'-terminus of this base sequence : 198310
cctcacataagttgccatcgtgtatgtgtgtgtgtttgagtgtgtgtgtgtgtgtgtgtgtgtgtggtgagcacacatgagatctactctttttaggaaatttcagatatataatacttttataattaactaaaaatcctaaaacgtgtacagagtcccaaaaaaatccgg

SEQ ID NO: 11552 - DNA, 427 bp, Homo sapiens
  chr7.fa.O7frz.10132543
  Located on chromosome 7
  Distance between a terminus base of telomere on chromosomal short arm and 5'-terminus of this base sequence : 13404577
  Distance between 3'-terminus of neighbour sequence of sequence listing upward to telomere on chrosomal short arm and 5'-terminus of this base sequence : 139113
gcaaggttgatcattacagtaggatagaatgaaaaaaaatctaaatgtcccacaaaataagatcagttaaataatttatggtacatctgtatcatggaattctagtcattataaaatcatatcaagtagatatttttacatgcaaatatgatcaagaaaaattataaagcaagaatatgaagtattaaatactaaatatagttgggtgtatgtttctgtggctgtatttgtgtgtatacatatatgtatgtgtatatatatatccacaaatatatatattttatatatatatatgtgtgtgtgtgtgtgtgtgtacctgggtatgtctgtgtgggtatgggtgtgcatacacacacacagatttttttttttcactgacaagtataatcattaatatgttggcaataattacgtttgagtggtaagg

SEQ ID NO: 11553 - DNA, 323 bp, Homo sapiens
  AC004936.2_36019
  Located on chromosome 7
  Distance between a terminus base of telomere on chromosomal short arm and 5'-terminus of this base sequence : 13487043
  Distance between 3'-terminus of neighbour sequence of sequence listing upward to telomere on chrosomal short arm and 5'-terminus of this base sequence : 82039
agcctcaaattgtagtgaacacacacacacacacacacacacacacacacgcacacacacacacagatgagtcaaacattaactcattcctgatacgggactgagataatgtgaaaagccctaataatttttttttgcaattttttccaaatgaatttatttgttaatatttacatatttcagccattattttattatgacacaaatatatttaagataaacactgtaaagtataggttatcctttttagaaagtagtaggaccaaaacaaatgattattgaacctatcacaattttcaagaaaggtaaccagcctctagcat

SEQ ID NO: 11554 - DNA, 193 bp, Homo sapiens
  D7S2464
  Located on chromosome 7
  Distance between a terminus base of telomere on chromosomal short arm and 5'-terminus of this base sequence : 13500248
  Distance between 3'-terminus of neighbour sequence of sequence listing upward to telomere on chrosomal short arm and 5'-terminus of this base sequence : 12882
ctgtaatcagattagagagccaatttcaaaaaccccagaatcaattcagaaaattattattaccattctgtttttctagacctactctcagggttaaaatatgtgttagtcattgctctctagagaaacaaaatcaatgggatatgcgcgcacacacacacacacacacacacgcacattctcactacagttg

SEQ ID NO: 11555 - DNA, 391 bp, Homo sapiens
  AC004879.1_59583
  Located on chromosome 7
  Distance between a terminus base of telomere on chromosomal short arm and 5'-terminus of this base sequence : 13669515
  Distance between 3'-terminus of neighbour sequence of sequence listing upward to telomere on chrosomal short arm and 5'-terminus of this base sequence : 169074
agatagaccgagactccgtctaagaaagaaagagagaaagacagcaaagaaagaaagagaaagagagaaagagagagagaaagggagaaagggaagggaaaggaagggaagggaagggaagggaagggaagggaagggaagggaagggaagggaagggaagggaagggaagggaagggaagggaacggagaaagaaggtgttctgcgagagggaataatagcatagtaaaatttcaaggagttttgggggaataatggatattcctgaatagactaaacgtgaggggatcgaatatgagtggaattacaggtaaaaccttaccttgcagcttaattgtggtggacctgacatggcatgttgaagaaagtaggctttatctcataggaattc

SEQ ID NO: 11556 - DNA, 215 bp, Homo sapiens
  AC004879.1_131003
  Located on chromosome 7
  Distance between a terminus base of telomere on chromosomal short arm and 5'-terminus of this base sequence : 13740888
  Distance between 3'-terminus of neighbour sequence of sequence listing upward to telomere on chrosomal short arm and 5'-terminus of this base sequence : 70982
tatctgtcttggcaggataaagggagtgttagatattgtacctttagtgtacagccttacaatttcaaagttgttgaatgaattttaagtgaatgagaaagttgttgtgaaccctggctctgaatcagtatctcccataagtatttaaacacacacacacacacacacacacacacacacacaaaattcaaaagtctgagtgtattccaaagctg

SEQ ID NO: 11557 - DNA, 396 bp, Homo sapiens
  AC004949.1_149910
  Located on chromosome 7
  Distance between a terminus base of telomere on chromosomal short arm and 5'-terminus of this base sequence : 13985488
  Distance between 3'-terminus of neighbour sequence of sequence listing upward to telomere on chrosomal short arm and 5'-terminus of this base sequence : 244385
aactaaggcagatcctcaagtctttgcaagccatggagaattgggggagcatcaagaggtgtataaagatacagaaagaagaaaagccttcaggcatttaaacacacacacacacacacacacacacacacacacacgtactccaagtgaatcattttagaaaagaaatgggaaagtggtttgaagaaataaggagcaaaccaaaaaagttatcttcggaattatattgtgagttctttatgaacagagacaaaatcttaaaactcagcatagtgctatatgctagatgaatattgataaatcaattatcaggaaataattacaacctacataaagtatatgtttaatctttaaagagtgttactgctataagactgctattgcttagaatttctg

SEQ ID NO: 11558 - DNA, 391 bp, Homo sapiens
  AC004949.1_79500
  Located on chromosome 7
  Distance between a terminus base of telomere on chromosomal short arm and 5'-terminus of this base sequence : 14055897
  Distance between 3'-terminus of neighbour sequence of sequence listing upward to telomere on chrosomal short arm and 5'-terminus of this base sequence : 70013
cacattacagtaccatttggtagactataaaatgcacattaaaaaaaattggaggtacagacaccaaattattaacagtagatatcttggggagatatatatatatcttggggatatatatatatatatatatatatagagagagagagagagagagagagagagagagggaaagagttatcttttatattttccttggagttttctatgatttatgtgttagtcacatattccttttataagcatcaaagagggtcaatttattcattttcagctattatattgacaattaaaaattcttcatggatatatggctgtctctccaaactttcagaactacactaaaatgggtgaattttactctatatcaaatatttgaatgcaattatga

SEQ ID NO: 11559 - DNA, 323 bp, Homo sapiens
  AC004535.1_93255
  Located on chromosome 7
  Distance between a terminus base of telomere on chromosomal short arm and 5'-terminus of this base sequence : 14187974
  Distance between 3'-terminus of neighbour sequence of sequence listing upward to telomere on chrosomal short arm and 5'-terminus of this base sequence : 131686
ccacaagaactgcttcaacccaggaggcagaggttgcaggagccaagatcacaccactgcactccagcctgggtgacagaatgagactctgtctgtctgtctgtctgtctgtctctctctctctctctctttctctctctttctctttccctctctctctctctctctctctcacatacacacacacacaaaatatgtgtgtgtgtgtgcatgtgtgtgtgtgtatgtaccatgtgggactaagaaatttcttaattatttgcaaatctcctgcacttaaattatttcttttttctccagtgactgaaataaagagtcaattc

SEQ ID NO: 11560 - DNA, 356 bp, Homo sapiens
  AC004535.1_62270
  Located on chromosome 7
  Distance between a terminus base of telomere on chromosomal short arm and 5'-terminus of this base sequence : 14218853
  Distance between 3'-terminus of neighbour sequence of sequence listing upward to telomere on chrosomal short arm and 5'-terminus of this base sequence : 30556
aactggatatgaacatgatcattaatttttcccaattacttgagttattttttaaggaaacacattcggtttgattctctagtcacttttgaaatgatataacaattttttcttagaattcaaggaagaaaagttatataccctattttgtttgggagaagaatacagtgtgtgtgtgtgtgtgtgtgtgtgtgtgtgtgtgtgtgtgtgtgtgtgtgtgaattaaagcatacaaacaatgtcaccttcaaaagtaggaacttgaagaagatctatgcttattttgagaatgtacccagtaccaaaacagcttgaaaattcttgtttggaattcctatctgagccaatagcatgtt

SEQ ID NO: 11561 - DNA, 248 bp, Homo sapiens
  AC004535.1_52963
  Located on chromosome 7
  Distance between a terminus base of telomere on chromosomal short arm and 5'-terminus of this base sequence : 14228284
  Distance between 3'-terminus of neighbour sequence of sequence listing upward to telomere on chrosomal short arm and 5'-terminus of this base sequence : 9075
ttcaatacattgaactgaattgactgaatgtaaatcagttggttgagttgaaaacaaacaaatacacacacacacacacacacacacacacacacaaagctttagttaacaatattccaatttagattgttccaaatattgccccaaaatactaagaagagagagtaatgacttgcaccctgtaggcactcaataaatgttaaatgagtgagtgaatgaatgaattctcatgtaagttagcaggatgc

SEQ ID NO: 11562 - DNA, 365 bp, Homo sapiens
  AC004535.1_30898
  Located on chromosome 7
  Distance between a terminus base of telomere on chromosomal short arm and 5'-terminus of this base sequence : 14250297
  Distance between 3'-terminus of neighbour sequence of sequence listing upward to telomere on chrosomal short arm and 5'-terminus of this base sequence : 21765
ctaattcaaagtttctgctttgtctgagaattttttaattacaagaaacaaaataattaagggttatttttaacaacagtgcgatttatattttaatgccagatgcattatttatataatatatatatatatatatatatatatatatttttttttttttttttttttttttttttgacagaattttgctcttgttgcccaggctggagtgcagtggcatgatctcggctcacggcaacctctgcctcccgggttcaagcaattcccctgcctcagcctcccgaataactgggattagaggcatgcgccaccatgcccagctaattttgtatttttagtagagacgaggtttcaccatgttggtc

SEQ ID NO: 11563 - DNA, 398 bp, Homo sapiens
  AC005376.1_76219
  Located on chromosome 7
  Distance between a terminus base of telomere on chromosomal short arm and 5'-terminus of this base sequence : 14287027
  Distance between 3'-terminus of neighbour sequence of sequence listing upward to telomere on chrosomal short arm and 5'-terminus of this base sequence : 36365
tgcttcacttatgtttgatacaatttcaaagaagtgaattttactctattaaagacatcagatgaaaaagttttctttgccacgttactgatttcaaatcaatgttattttagatcactgtatatatgtacatatatgtgcacatgaacacacacacacacacacacacacacacacacacacacacagtttctccttaaaagcataacattggggccaggcatggtggcttatgcctgtagccccagcattttggaaggctgaggcgggcaggtcacttgaggtcaggagtttgagaccagcctggccaacatggtaaaaccctgtctctactcaaaatacaaaaattagccaggcatggtggcttatgcctgtaatctaagctacataggtggctg

SEQ ID NO: 11564 - DNA, 377 bp, Homo sapiens
  AC005376.1_63865
  Located on chromosome 7
  Distance between a terminus base of telomere on chromosomal short arm and 5'-terminus of this base sequence : 14299429
  Distance between 3'-terminus of neighbour sequence of sequence listing upward to telomere on chrosomal short arm and 5'-terminus of this base sequence : 12004
acagcttccattaaatgaagtcccaggggttaactaaaccccatgtaaagagtatttccatgtccctaaaaggcatagatgatagatagatagatagatagatagatagatagatagatagatagatagatagatagatatagatagatgatagatagatagatagatagatagatagatagatagatagatagatagatagatagatgatagagaatagatgacatatacatacttatgtaggtagatagaggatatatacatacatacgtatatagacagatatagacacagatatagataacagttctcatttgaacgctggccactgaactaatggctcattcagtcttgtcaccatatcatttacctgagta

SEQ ID NO: 11565 - DNA, 386 bp, Homo sapiens
  chr7.fa.O7frz.11343453
  Located on chromosome 7
  Distance between a terminus base of telomere on chromosomal short arm and 5'-terminus of this base sequence : 14649031
  Distance between 3'-terminus of neighbour sequence of sequence listing upward to telomere on chrosomal short arm and 5'-terminus of this base sequence : 349225
tatgacaggatgaacatgaatcacatatgtaattatgttacataaaatggtaatgcctggctaggcatggcggctcatgcctataattccagcactttgggaggctgaggcaggcagatcacttgaggtcgggagttcgagaccagcctggccaacatggtgaaacccatctccactaaaattaacaaaaaattagccgggagtagtggtgcatgcctatagtcccagctacttgggaggctgaggcatgagaattatttgaacccaggagccagaggttgcagtgagccgagatcgcgccactgcactccagcctgggtgacagagtaagacgctgtctcaaaacaaaacaaaacaaaacaaaacagatagtaatgcctgtcttg

SEQ ID NO: 11566 - DNA, 357 bp, Homo sapiens
  chr7.fa.O7frz.11437582
  Located on chromosome 7
  Distance between a terminus base of telomere on chromosomal short arm and 5'-terminus of this base sequence : 14711272
  Distance between 3'-terminus of neighbour sequence of sequence listing upward to telomere on chrosomal short arm and 5'-terminus of this base sequence : 61855
gttgcacaacttacgaagtaagtggtaactatagaagttgaatttagttctctgtctcaaataatcaaagggaaagaaagatgctgaaagacagcatgagttttaggcacactgtggaatcttacagagccaattgtccagttagtaattcttcgtgcattaattaggtgaaaggtgaacccccaacccacggaaagatccagccaagtaaggaactgcaaaatattgaatgactaattctccaaacaaggtaaagtttactgatctctgtgtgtgtgtgtgtgtgtgtgtgtgtgtgtgtgtgtgtatgtgtgtgtgtgtgtacacagtgtgtgcttaggactgagttaaaatgcc

SEQ ID NO: 11567 - DNA, 219 bp, Homo sapiens
  AC004160.1_32665
  Located on chromosome 7
  Distance between a terminus base of telomere on chromosomal short arm and 5'-terminus of this base sequence : 14792653
  Distance between 3'-terminus of neighbour sequence of sequence listing upward to telomere on chrosomal short arm and 5'-terminus of this base sequence : 81024
ggaaagtacacattgaaccaataccaagcattgtgtgtatgtgtgtgcctgcgtgcgtgtgtgtgtgtgtgtgtgtgtgtgtgtgtgtgcatactttggtttgcaagaaaaagaaataggctcagctacctcagggatgatgatttatttcaaggaacataagaagtatagaaatacaaggaacactttgcagctgcattaggcttcaaagcctagagt

SEQ ID NO: 11568 - DNA, 305 bp, Homo sapiens
  AC004160.1_128834
  Located on chromosome 7
  Distance between a terminus base of telomere on chromosomal short arm and 5'-terminus of this base sequence : 14888782
  Distance between 3'-terminus of neighbour sequence of sequence listing upward to telomere on chrosomal short arm and 5'-terminus of this base sequence : 95910
acttaatccattgcaaccaagctgactcaagcattaaataaaattctttgaaagtatttttctaatctgtgatagtccaactctatcccttattttacacacacacacacacacacacacacacacacactgagagacagagacagagagcaagagagagagaaagggaagagagaaactatagctttttatgtaatgaattctagaaaagatagatttaaatagccctttgcagccattcttttgtgccaattttagtgaactaaaaacctaagtaaaatgaataaagtggacctgtctcaaag

SEQ ID NO: 11569 - DNA, 260 bp, Homo sapiens
  AC004141.1_35870
  Located on chromosome 7
  Distance between a terminus base of telomere on chromosomal short arm and 5'-terminus of this base sequence : 14939435
  Distance between 3'-terminus of neighbour sequence of sequence listing upward to telomere on chrosomal short arm and 5'-terminus of this base sequence : 50348
atttaaccagaagtcaagcctctggaagatacacacacacacacacacacacacacacacacacacacacacaccatttttttaagtgtaaagaactaattttaccttctccagtacattaactatcaccagttgccagtacttgtgatttggtttccaaatgacatttcaataattagcaattttatgacaatttttgtgtattgataatagattatataatgttactcaagattgtgtagaaagcaccaggtacagtg

SEQ ID NO: 11570 - DNA, 217 bp, Homo sapiens
  AC004141.1_78150
  Located on chromosome 7
  Distance between a terminus base of telomere on chromosomal short arm and 5'-terminus of this base sequence : 14981644
  Distance between 3'-terminus of neighbour sequence of sequence listing upward to telomere on chrosomal short arm and 5'-terminus of this base sequence : 41949
gttctaggtgcagtggatacatgtagtaaacgaggtaagacaagaattcttttcctgaaaaagtacaacagatcatccctgtagctggaaataaaatagaaacacacacacacacacacacacgcacacacaggcacgcacacatagatttcttttccctgaaattgtatcacccaaaaagtatttgctatgcatgtgctatgtgctttaacttggt

SEQ ID NO: 11571 - DNA, 454 bp, Homo sapiens
  AC004614.1_36936
  Located on chromosome 7
  Distance between a terminus base of telomere on chromosomal short arm and 5'-terminus of this base sequence : 15035928
  Distance between 3'-terminus of neighbour sequence of sequence listing upward to telomere on chrosomal short arm and 5'-terminus of this base sequence : 54067
agtcatgactgtcagaatcagttaggccgtgctatggagagggagaacagcatggggtcatcatgggtgcgattcagtagaacctttggagggacacggaatcccagaagccagaatctggactcttttccttatgtaattcaggatataatagtttggagttgggggcaatgtcatgaagggctcaagccttctcagagagctccatatggcagcaattagaaagctagagggccagtagcagcaattctatgagtttggactattacttgatatttctgggtctcagttaccatatctttcaggggagcaggaaagatagacagatagatagatagatagatagatagatagatagatagatagatagacagatgatagtgtgtgtgtgtgtgtgtgtgtgtgtgtgtgtgtgtgtgtgtgttttatggtactttatggctagttgtagcaa

SEQ ID NO: 11572 - DNA, 241 bp, Homo sapiens
  AC004614.1_36992
  Located on chromosome 7
  Distance between a terminus base of telomere on chromosomal short arm and 5'-terminus of this base sequence : 15036169
  Distance between 3'-terminus of neighbour sequence of sequence listing upward to telomere on chrosomal short arm and 5'-terminus of this base sequence : -213
cagcaattctatgagtttggactattacttgatatttctgggtctcagttaccatatctttcaggggagcaggaaagatagacagatagatagatagatagatagatagatagatagatagatagatagacagatgatagtgtgtgtgtgtgtgtgtgtgtgtgtgtgtgtgtgtgtgtgtgttttatggtactttatggctagttgtagcaatgcattctggattaacctacaaccttca

SEQ ID NO: 11573 - DNA, 195 bp, Homo sapiens
  D7S513
  Located on chromosome 7
  Distance between a terminus base of telomere on chromosomal short arm and 5'-terminus of this base sequence : 15036222
  Distance between 3'-terminus of neighbour sequence of sequence listing upward to telomere on chrosomal short arm and 5'-terminus of this base sequence : -188
atatctttcaggggagcaggaaagatagacagatagatagatagatagatagatagatagatagatagatagatagacagatgatagtgtgtgtgtgtgtgtgtgtgtgtgtgtgtgtgtgtgtgtgtgttttatggtactttatggctagttgtagcaatgcattctggattaacctacaaccttcaaaacact

SEQ ID NO: 11574 - DNA, 318 bp, Homo sapiens
  AC004614.1_102592
  Located on chromosome 7
  Distance between a terminus base of telomere on chromosomal short arm and 5'-terminus of this base sequence : 15101770
  Distance between 3'-terminus of neighbour sequence of sequence listing upward to telomere on chrosomal short arm and 5'-terminus of this base sequence : 65353
tgaggtgttcctagtcagctagcagcaacactctgatggagggtgctggcaaaagcactacattggggtggtgacaatggggtccacacttgggcatgcatgccatcaactacagggcagcagtgtggcagggtccacgtgtgtgtgtgtgtgtgtgtgtgtgtgagcgcgcgcccacaccagcaacaacagagcagcaacagggtggtgggccctggcacaatggttggggaaggctgcaggcaggagcatgctggggagggtccatctgcagaagctctctaatggtggtacctaccaatgaaggagctacagtag

SEQ ID NO: 11575 - DNA, 219 bp, Homo sapiens
  D7S2478
  Located on chromosome 7
  Distance between a terminus base of telomere on chromosomal short arm and 5'-terminus of this base sequence : 15181912
  Distance between 3'-terminus of neighbour sequence of sequence listing upward to telomere on chrosomal short arm and 5'-terminus of this base sequence : 79824
taccgtgctccgccatttctgtatactttttagagacaccttttcattttatacacacacacacacacacacacacacacactgaaagtgtgcatgcgctgctggggttttgatggggattgcatatggaatctgcagatcattttggctgcagcgagcatcccagtaagtaggtctgcctgtttccttgggagggatccccagaagtgggtctgggcg

SEQ ID NO: 11576 - DNA, 215 bp, Homo sapiens
  DISD22_0004876
  Located on chromosome 7
  Distance between a terminus base of telomere on chromosomal short arm and 5'-terminus of this base sequence : 15260075
  Distance between 3'-terminus of neighbour sequence of sequence listing upward to telomere on chrosomal short arm and 5'-terminus of this base sequence : 77944
aagagttcagcagcaacaagaaaataaaacacacagacacacacacacacacacacacacacacacacacacacacgcacaaacacacacatatatatttttcccccccaaaatggggattaaactgtatattctttttccctagaacataccattttttgtttcttttaatgctctctgctttgactttcattttggatatggacgctgtgact

SEQ ID NO: 11577 - DNA, 175 bp, Homo sapiens
  DISD22_0004880
  Located on chromosome 7
  Distance between a terminus base of telomere on chromosomal short arm and 5'-terminus of this base sequence : 15362823
  Distance between 3'-terminus of neighbour sequence of sequence listing upward to telomere on chrosomal short arm and 5'-terminus of this base sequence : 102533
tcctcacctctacatcgtttctttctatagttagttataatgtaaatagattcctcttaacacttcattttaggtgaagctgtttttggtgctgccagtgtgcgtgcatgtgtgtgtgtgtgtgtgtctgtgagtgtgtgtgtgtgtgcctgcctgagcttcaggtgaacatact

SEQ ID NO: 11578 - DNA, 241 bp, Homo sapiens
  AC005094.1_44243
  Located on chromosome 7
  Distance between a terminus base of telomere on chromosomal short arm and 5'-terminus of this base sequence : 15759734
  Distance between 3'-terminus of neighbour sequence of sequence listing upward to telomere on chrosomal short arm and 5'-terminus of this base sequence : 396736
gcagatatcaagtactaggcgtgtatgtgtgtgggtgtgcgtgtgtgtgtgtatatatatatatatatatatatatatatatatacacacacataatttaatcctgatagccactctctaagccatattatcacatcttacagatgaaaacattgagattttggatttaaatgatttgcaagtgaatctcacagctgagaagtcaaatccaggcagactgactcataatgctcaaatcata

SEQ ID NO: 11579 - DNA, 258 bp, Homo sapiens
  AC005094.1_124496
  Located on chromosome 7
  Distance between a terminus base of telomere on chromosomal short arm and 5'-terminus of this base sequence : 15839848
  Distance between 3'-terminus of neighbour sequence of sequence listing upward to telomere on chrosomal short arm and 5'-terminus of this base sequence : 79873
tagctatgagctccataagcattgcttggcctaaaaaagaaaaaacacaacaaaaagtaaagtaactataagcaatgcaaaaaaaattcttttcttattgttatattttaaaaatattttctctgtaatatatatggagggacactattagtgtatcattcacagatatttctttaaaaacttcacagtagtgtgtgtgtgtgtgtgtgtgtgtgtgtgtgtgtgtgtattctgtgatcagatctgttaaattatgga

SEQ ID NO: 11580 - DNA, 288 bp, Homo sapiens
  AC004595.1_12337
  Located on chromosome 7
  Distance between a terminus base of telomere on chromosomal short arm and 5'-terminus of this base sequence : 15885600
  Distance between 3'-terminus of neighbour sequence of sequence listing upward to telomere on chrosomal short arm and 5'-terminus of this base sequence : 45494
actggctatcaatccaggtatttttattgaataaaatatgttcatatcacagaacagtatgttgtattaaaatagtaatttcaatttatatattttttaacctggtgagatggccataatatattaaggtaaaaaatccaagtttgcatatatatgttgtgtgtgtgtgtgtgtgtgtgtgtgtgtgcaattttatgttaaaaatctcataaacacacatatatgatatgtgtaaactagagaaaagtgagaaaggatatactatcagttaacattgatgaattcagt

SEQ ID NO: 11581 - DNA, 213 bp, Homo sapiens
  D7S2562
  Located on chromosome 7
  Distance between a terminus base of telomere on chromosomal short arm and 5'-terminus of this base sequence : 15909965
  Distance between 3'-terminus of neighbour sequence of sequence listing upward to telomere on chrosomal short arm and 5'-terminus of this base sequence : 24077
gcaagagtttgatacatcagagtgcattcacaatatacgaaaatagaatagttaatttagtccgtatttccaaaacatatgatcgagttcattttgtgtatcttatgtgtatgtgtgtgtgtgtgtgtgtgtgtgtgtgtgtgtgtgtgtgtgcacgcatatgtaggtagatatatatgtgtgtgtgtgtgtgtggtgtgtgcatacttagtg

SEQ ID NO: 11582 - DNA, 472 bp, Homo sapiens
  chr7.fa.O7frz.22002572
  Located on chromosome 7
  Distance between a terminus base of telomere on chromosomal short arm and 5'-terminus of this base sequence : 15988871
  Distance between 3'-terminus of neighbour sequence of sequence listing upward to telomere on chrosomal short arm and 5'-terminus of this base sequence : 78693
agacaagtactaggtgaggacttcctctcctgagattcttgtggtggttgtttccttccttgatcacttactttatttatttatttatttatttatttatttatttatttatttataagacaggctcttcttctgtcacccaagcaggaatacagtggtgccatcacggctcactgcagccttgacctcctgggctcagttgattttcccacctcagcctccccagtagctgggactacaggtgcatgtcaccatgcctctctaatttttaaaattttttttgtagaaaggggtttttccatgttgctcaggctggtcttgaactcctggggtcaagcaatccacctgcctcagcctcctaaagtgctgagattacaggcctgagccactgtgcctggccttgattgcttgcttttgacagttttagtacaccgcagtttttttctctgtagatattgcaacattgttcttt

SEQ ID NO: 11583 - DNA, 294 bp, Homo sapiens
  chr7.fa.O7frz.22129822
  Located on chromosome 7
  Distance between a terminus base of telomere on chromosomal short arm and 5'-terminus of this base sequence : 16102630
  Distance between 3'-terminus of neighbour sequence of sequence listing upward to telomere on chrosomal short arm and 5'-terminus of this base sequence : 113287
gtaaacgaattacatcttaccagtgcattttgctctcaggttgaaggatggcgacctagtcttctccactgctgtttaggagtgtcattcggaaaagcaatgaataatgtaaacctaagtctaattcatatttagccacagctaatggggtgtgtgtgtgtgtgtgtgtgtgtgtgtgtgtgtgtgtgtgtatttggcatagtactcttctacttggcataatgtatattagtcataagcaagatagatgatggtgtaaaaaagaaggaagtaagctacctgttaaacagtgag

SEQ ID NO: 11584 - DNA, 213 bp, Homo sapiens
  D7S493
  Located on chromosome 7
  Distance between a terminus base of telomere on chromosomal short arm and 5'-terminus of this base sequence : 16229564
  Distance between 3'-terminus of neighbour sequence of sequence listing upward to telomere on chrosomal short arm and 5'-terminus of this base sequence : 126640
ggaagttcccagccatagttaactgcacggctattgactggtttcatgcgtggccgcaggaggctctggtctccgtcagcaggaggttcattgaggaaaccaagggaattgaggtatgccgtgtcagcctgcgtcacacacacacacacacacacacacacacacacacacacacacacacactctgaaaatcctcagtaggtaagtgctttc

SEQ ID NO: 11585 - DNA, 208 bp, Homo sapiens
  AC005078.1_72412
  Located on chromosome 7
  Distance between a terminus base of telomere on chromosomal short arm and 5'-terminus of this base sequence : 16229577
  Distance between 3'-terminus of neighbour sequence of sequence listing upward to telomere on chrosomal short arm and 5'-terminus of this base sequence : -200
catagttaactgcacggctattgactggtttcatgcgtggccgcaggaggctctggtctccgtcagcaggaggttcattgaggaaaccaagggaattgaggtatgccgtgtcagcctgcgtcacacacacacacacacacacacacacacacacacacacacacacacactctgaaaatcctcagtaggtaagtgctttccacagtac

SEQ ID NO: 11586 - DNA, 200 bp, Homo sapiens
  Z16718.1_139
  Located on chromosome 7
  Distance between a terminus base of telomere on chromosomal short arm and 5'-terminus of this base sequence : 16229577
  Distance between 3'-terminus of neighbour sequence of sequence listing upward to telomere on chrosomal short arm and 5'-terminus of this base sequence : -208
catagttaactgcacggctattgactggtttcatgcgtggccgcaggaggctctggtctccgtcagcaggaggttcattgaggaaaccaagggaattgaggtatgccgtgtcagcctgcgtcacacacacacacacacacacacacacacacacacacacacacacacactctgaaaatcctcagtaggtaagtgctttc

SEQ ID NO: 11587 - DNA, 325 bp, Homo sapiens
  AC006481.3_14925
  Located on chromosome 7
  Distance between a terminus base of telomere on chromosomal short arm and 5'-terminus of this base sequence : 16469864
  Distance between 3'-terminus of neighbour sequence of sequence listing upward to telomere on chrosomal short arm and 5'-terminus of this base sequence : 240087
ttggtcaagtctggaactagagaactgtgaaaaccaataaaggttatatttaaggaaaataacttcttcatttgataagagaacataggatattgggtgccaaataaatattcctggatgaattctgcaaaacaagctctgctggacaagtcaatatgctgaggaaaggaagagagcaaattgatagagtcaggatagaacaccagaactggaagagaaagagggagagagagcgggagagagagagagagagagagagagaatgaattgaaatttgtgctactcagagaatctagctaaaaaatgcaaattctgattcagtagg

SEQ ID NO: 11588 - DNA, 313 bp, Homo sapiens
  AC006481.3_123060
  Located on chromosome 7
  Distance between a terminus base of telomere on chromosomal short arm and 5'-terminus of this base sequence : 16578195
  Distance between 3'-terminus of neighbour sequence of sequence listing upward to telomere on chrosomal short arm and 5'-terminus of this base sequence : 108006
tcagaccagcctagtttatcagtgagctgagctgccaggaatatatatatatatatatatatatatatatatatatatatatatatatcagagggtaaagtagacaacttattttcattcaaaagtagtcatagcacagaagtaactctcaccctcactcaacttattctgtcatccttaacttgagaaaataacttatttttctctcaaagaaaatactctctgtcacatgttataactaggcaggcttctgaagtgctttagaaaaatactattctgagcatattcaatgtacagagtccttaaacagctt

SEQ ID NO: 11589 - DNA, 115 bp, Homo sapiens
  chr7.fa.O7frz.21408732
  Located on chromosome 7
  Distance between a terminus base of telomere on chromosomal short arm and 5'-terminus of this base sequence : 16654242
  Distance between 3'-terminus of neighbour sequence of sequence listing upward to telomere on chrosomal short arm and 5'-terminus of this base sequence : 75734
agttctcaatttgttaagtcgatggatggatggatggatggatggatggatggatggatggatacatggatggacacgtggatggatggataagtaggtggatgagtgataatga

SEQ ID NO: 11590 - DNA, 359 bp, Homo sapiens
  AC005251.1_82342
  Located on chromosome 7
  Distance between a terminus base of telomere on chromosomal short arm and 5'-terminus of this base sequence : 16742074
  Distance between 3'-terminus of neighbour sequence of sequence listing upward to telomere on chrosomal short arm and 5'-terminus of this base sequence : 87717
agtttaagagctccttactgcattcattttaagagctccttactaagagctgctagtagaaatattatatgtatgtatttatatatatatatatatatatacacacacacatatacatatggaaggagagagaaaaaagaacaaagcaaataagtgattatgggttatgtcaatgttattacgaaacattttctgttacaagaaaaatacaatcatacattttttaaaaaatcagtttaaaaactgcaattttatatttggattgaaaataataaacatttttaatgtatttctctctttcttaaaaaatatcatatctgcctattaaaaagattagaagcaatgacgtacaaccagta

SEQ ID NO: 11591 - DNA, 377 bp, Homo sapiens
  AC005251.1_65613
  Located on chromosome 7
  Distance between a terminus base of telomere on chromosomal short arm and 5'-terminus of this base sequence : 16758639
  Distance between 3'-terminus of neighbour sequence of sequence listing upward to telomere on chrosomal short arm and 5'-terminus of this base sequence : 16206
ctcctaatttacttttgccaattatgaattatacttgatgatcacaaacttgaacatctgaggcacttttcaaacatgttttctcaaatcctgtttctttcatggaggaagatatcttttccaaaatagtgaatttcaatataaaaataaagtttggttaacattttatgtctttacagaatcttttttcacctccatccacccatttgtcattcttaattctgtgttcatgtgtgtgtgtgtgtgtgtgtgtgtgtgtgtgtgttccagagagctttaacatgattactttctatccatttggagaaaatattgacatacccctaggtttggttcattctttcatttttactcttcactttaacctaagaatccaa

SEQ ID NO: 11592 - DNA, 296 bp, Homo sapiens
  AC005251.1_19517
  Located on chromosome 7
  Distance between a terminus base of telomere on chromosomal short arm and 5'-terminus of this base sequence : 16804870
  Distance between 3'-terminus of neighbour sequence of sequence listing upward to telomere on chrosomal short arm and 5'-terminus of this base sequence : 45854
tggagtgatctaaatttctggagctcaaaattacaattagtacctttccatcaggactattgaaataattaaagacatattttttttgtctttaaaacacacacacacacacacacacacacacacacactcaacataatacccagcaaagataaagcccaggtgaactttgatctccacaaattccaactcaaagatgcagagtttggccagaatcagcccagtcaccaaccaattgaaaaaccatttgattgctctacattcaagtttctgtgaaagattcaagccattaatac

SEQ ID NO: 11593 - DNA, 180 bp, Homo sapiens
  D7S1802
  Located on chromosome 7
  Distance between a terminus base of telomere on chromosomal short arm and 5'-terminus of this base sequence : 16944253
  Distance between 3'-terminus of neighbour sequence of sequence listing upward to telomere on chrosomal short arm and 5'-terminus of this base sequence : 139087
aaaatcctttcaacaaatagaagctcatctggaagcttgtatatctatatctgtatgtatgtatgtatgtatgtatgtatgtatgtatgtatctctatctatctatctatctatctatctatctatctatctatctttccatctctatctcatccagataaatggatcactgcattgctt

SEQ ID NO: 11594 - DNA, 142 bp, Homo sapiens
  G10071
  Located on chromosome 7
  Distance between a terminus base of telomere on chromosomal short arm and 5'-terminus of this base sequence : 16944273
  Distance between 3'-terminus of neighbour sequence of sequence listing upward to telomere on chrosomal short arm and 5'-terminus of this base sequence : -160
aagctcatctggaagcttgtatatctatatctgtatgtatgtatgtatgtatgtatgtatgtatgtatgtatctctatctatctatctatctatctatctatctatctatctatctttccatctctatctcatccagataaa

SEQ ID NO: 11595 - DNA, 305 bp, Homo sapiens
  AC002486.1_55136
  Located on chromosome 7
  Distance between a terminus base of telomere on chromosomal short arm and 5'-terminus of this base sequence : 16968536
  Distance between 3'-terminus of neighbour sequence of sequence listing upward to telomere on chrosomal short arm and 5'-terminus of this base sequence : 24121
gtttgctctagcatggatatttagatttcttagtgctttatagtttatttgcttttttaaaaagacgggatctgggtatgttgcccaggctgtcctcaaactcctaggcttaaggaatcctcctgcctcagcctcctgagtagctggcactgatggtacataacgctgggactacaggtgcacactagtgttttatagtttgtgtgtgtgtgtgtgtgtgtgtgttttgcaataataaaataatctttgtttaatagattcttcctgaaaaaaatgccaatgtattggatatgaggaatgtagga

SEQ ID NO: 11596 - DNA, 161 bp, Homo sapiens
  AC002486.1_48022
  Located on chromosome 7
  Distance between a terminus base of telomere on chromosomal short arm and 5'-terminus of this base sequence : 16975736
  Distance between 3'-terminus of neighbour sequence of sequence listing upward to telomere on chrosomal short arm and 5'-terminus of this base sequence : 6895
gaaagatacctgcacttgtatgtttattgtagccctattcacaatagcaaagatatggactcaacctaagtgttcatcagtgaatgaatggataaagaaaatgtttacacacacacacacacacacacacacacacacaacatggaatactagtcagccat

SEQ ID NO: 11597 - DNA, 242 bp, Homo sapiens
  AC002486.1_40638
  Located on chromosome 7
  Distance between a terminus base of telomere on chromosomal short arm and 5'-terminus of this base sequence : 16983184
  Distance between 3'-terminus of neighbour sequence of sequence listing upward to telomere on chrosomal short arm and 5'-terminus of this base sequence : 7287
cactcagaaatatcctttggtaacatttatgtatgatacacacacacacacacacacacacacacacacacacaccccaaaaacacttttaaaacactgagtcattatgtggatgttatgctatttttccctatcctttattgtaaaattttgagattgtttatattttttctatcgaaaatcatactttaatgaattattttagttccctctttcccacaaatagtggatgcaatctaata

SEQ ID NO: 11598 - DNA, 349 bp, Homo sapiens
  AC003091.1_33703
  Located on chromosome 7
  Distance between a terminus base of telomere on chromosomal short arm and 5'-terminus of this base sequence : 17143887
  Distance between 3'-terminus of neighbour sequence of sequence listing upward to telomere on chrosomal short arm and 5'-terminus of this base sequence : 160461
tactccatgacttagaggttgtagaaatatggttaaaataagcaaattttaaaatatgaacttaaatgctctataggattgataaacattggagtcaacatttggcctgttgaaaagaaagcaagacatagtagtcccatttgtaaagtaggaattcagggattgtggtttggggtgtgtgtgtatgtgtgtgtgtgtgtgtgtgtgtgtgtgtgtgtgtgtgttttgagtcagggtctcgctctgtcacctaggctggagtgcagtggcatgatcatggctcactgtagcctcaacctcctggcctcaagcattcctcccacatcagcctccttggtagatggaacca

SEQ ID NO: 11599 - DNA, 370 bp, Homo sapiens
  AC003091.1_8466
  Located on chromosome 7
  Distance between a terminus base of telomere on chromosomal short arm and 5'-terminus of this base sequence : 17169143
  Distance between 3'-terminus of neighbour sequence of sequence listing upward to telomere on chrosomal short arm and 5'-terminus of this base sequence : 24907
gcggattcatttagattaagtcctagatgggtcttgccaaatttgcagttctcagccagcaggggtcgctcctctgttgcctcccaatcataagcagagtgctgaggtgggaaggggatcctctcacttggaaaagaaaagaaaagaaaagaaaagaaaagaaaagaaaagaaaagaaaagaaaagaaaagaaaagaaaagaaaaaaaaaacagcttaaagtgcataaggaaggagaccgggggaaagaccttcttgctctatggaaatgggttcctttaatcagtgtatccctcacctgataaggacccctcagtcatgggaggaaaggcttcgcaggcgctggtgtgctaacatatctgcagtttaac

SEQ ID NO: 11600 - DNA, 270 bp, Homo sapiens
  AC004130.1_107819
  Located on chromosome 7
  Distance between a terminus base of telomere on chromosomal short arm and 5'-terminus of this base sequence : 17185762
  Distance between 3'-terminus of neighbour sequence of sequence listing upward to telomere on chrosomal short arm and 5'-terminus of this base sequence : 16249
gcataaacagccttctatattgacagatatgttaagatatagtggtggggttatgtggatgtatacatttgtcaaaactcctcaagctgtaaacttaagattggtgtgttatatggtatgtgaattcaatataatgaaaaaaatttcaaaagtggtcctgggcagctatgtcatcactgatatgatatctcatacaatgtgtttgtatgtgtgtgtgtgtgtgtgtgtgtgtgtgtgtgtgtgtgtgttaaggatggaagataagtgatg

SEQ ID NO: 11601 - DNA, 330 bp, Homo sapiens
  AC006034.2_7784
  Located on chromosome 7
  Distance between a terminus base of telomere on chromosomal short arm and 5'-terminus of this base sequence : 17301344
  Distance between 3'-terminus of neighbour sequence of sequence listing upward to telomere on chrosomal short arm and 5'-terminus of this base sequence : 115312
gtagacaagtatagaagttggcagatctcattgattttattccctgtgaatctacaaatgggacagatatttatttatttatttatttatttatttttaaaggcagtctatttagaatgctgttttctaaggcaactttttttcacattttactatattaaagaaatactcaaaatcgctttaatcataatcctttgcacgaagtcagtgggactgggatttaaacaactattgaaaaataatacacagaaggagtgagaaaagaatgtcatccagcaacaatacatttttttttttaagttggagcaaaatgccgaacttctaatagag

SEQ ID NO: 11602 - DNA, 347 bp, Homo sapiens
  AC004452.1_11498
  Located on chromosome 7
  Distance between a terminus base of telomere on chromosomal short arm and 5'-terminus of this base sequence : 17463032
  Distance between 3'-terminus of neighbour sequence of sequence listing upward to telomere on chrosomal short arm and 5'-terminus of this base sequence : 161358
ttctgatttggccagattatacaaaactaaaaaaaaattagatatttttatttctaataatcttgttttatgagccagaaaataaatcaatatttaaaaaagattattacaaatattcttaaaactccaagaagttacaaataaattaatgtattggatcatatatatatatatatatatatacacacacacacacacacacacacacacacacacacacacacacatatgtaaagagagtgagagagagaaatttttctgggaaattttgttatttatttacttcaaaatctcttcaactgaatccaggagtttgcactgcccgtctgtaaagctactgccacttt

SEQ ID NO: 11603 - DNA, 344 bp, Homo sapiens
  AC004452.1_45621
  Located on chromosome 7
  Distance between a terminus base of telomere on chromosomal short arm and 5'-terminus of this base sequence : 17497242
  Distance between 3'-terminus of neighbour sequence of sequence listing upward to telomere on chrosomal short arm and 5'-terminus of this base sequence : 33863
tggcattaaggaaatgttaattagaaaattcaaaagagaagagaattgttttcttaccaaaatgttattttctcgtggaggccaactgtgtacatacacacacacacacacacacacacacacacacacacacacacagacacacacacacacacagagagtttactattgattagcttgtaatctaataaaaaagtgagaaagggctataaacagatacaatgtagtatcttaaatacctaagtacaataggaacatggaactacatttgctttattcactgttgtgtacaaagtatatagcatagtacttgggccagagtaggtggtcaataaatgtttgac

SEQ ID NO: 11604 - DNA, 327 bp, Homo sapiens
  AC005550.1_39217
  Located on chromosome 7
  Distance between a terminus base of telomere on chromosomal short arm and 5'-terminus of this base sequence : 17572749
  Distance between 3'-terminus of neighbour sequence of sequence listing upward to telomere on chrosomal short arm and 5'-terminus of this base sequence : 75163
tatctgctggactttctagcaggtgtgaagaccccaccactccttctgttgcatctcatttccacttattaaatactttatcttggaggatgaagcaaaagtgacttttgtgtttcctggcagtctcctgtttcaaaggacttaatagtgatttgtttatttcagaggaaatgaacaccagtcagtgatgacagatttattattaagtggacatcacacacacacacacacacacacacacacacacacacacacacaaagcctctacttttcttacagttcagggttccttctaaccacactctaaatggtcaagacaatgttaca

SEQ ID NO: 11605 - DNA, 391 bp, Homo sapiens
  AC005550.1_40955
  Located on chromosome 7
  Distance between a terminus base of telomere on chromosomal short arm and 5'-terminus of this base sequence : 17574454
  Distance between 3'-terminus of neighbour sequence of sequence listing upward to telomere on chrosomal short arm and 5'-terminus of this base sequence : 1378
cataaggtcaggagttcatgaccagcctgggcaacacggtgaaaccctgtctctactaaaatacaaaaaattagccgggcgttgtggtatgtgcctatagtcccagctatttgtgaggctgaggcaggagaattgcttgaacctgggaggcggaggttgcagtgagccgagatcgtgccactgcactccagcgtgggcaacagagcaagactctgtctcaaaaaaaaaaaaaaaaaaaaaaaaaaaaatatatatatatatatatatatatatattcaaatggtaaaaattgaggatatgaacaagaatatcctaggaatagattttgcacaggattccaggaacccaaaagccacactgaattaaatatccttattacttgacaaggtcc

SEQ ID NO: 11606 - DNA, 336 bp, Homo sapiens
  AC005550.1_48732
  Located on chromosome 7
  Distance between a terminus base of telomere on chromosomal short arm and 5'-terminus of this base sequence : 17582324
  Distance between 3'-terminus of neighbour sequence of sequence listing upward to telomere on chrosomal short arm and 5'-terminus of this base sequence : 7479
atggaatagaacggatttgaaccatgctctggtaggatgaagcaatggaactcagtcttaaatataagtctaatagaaaagaagaaatcatcagctgagactataaatgtgaaagcatttggcagtaaattaaaattaattagataaaagattctgtgtgtgtgtgtgtgtgtgtgtgtgtgcatgtttagaaatggtgttgtctttagaaaacaaaaggaaaaaagttatggaataattaactgtatttttgatatttaattctgtgttttgagagtcttgtaagaactaaggatctgaaatagacaagaatggtcaatgttagactgctccaga

SEQ ID NO: 11607 - DNA, 153 bp, Homo sapiens
  AC005550.1_130554
  Located on chromosome 7
  Distance between a terminus base of telomere on chromosomal short arm and 5'-terminus of this base sequence : 17664269
  Distance between 3'-terminus of neighbour sequence of sequence listing upward to telomere on chrosomal short arm and 5'-terminus of this base sequence : 81609
atgcctgtcaagacattaagagcatgtcccaacacacacacacacacacacacacacccttggcaaaggctgagagattcatttgtttcatgcatttaatgaaatccctgtccaaccatgagctgactagtgcactaacttagcagagacttc

SEQ ID NO: 11608 - DNA, 355 bp, Homo sapiens
  AC005536.2_33840
  Located on chromosome 7
  Distance between a terminus base of telomere on chromosomal short arm and 5'-terminus of this base sequence : 17786916
  Distance between 3'-terminus of neighbour sequence of sequence listing upward to telomere on chrosomal short arm and 5'-terminus of this base sequence : 122494
gctgaactgtttaaaggaagtaatatagtggtgaatttttttttcgtgtgatttagtttgaaatactgtgcctaaaatgctgagcttgaagtcccataaagcttggtatgctttgcaaaaagcactcccagtttaatttaggccaggcctccttttgctttgaagaaacaaaaaagaaacattagctgttcttggccttatccttgggaatcaactcaagacttcccagtggtcatggtgatatccattgcaaacagataattcctgaatgaatgaatgaatgaatgaaaagaaaacagtgagttacattttatcttgatagaatgtaaatgtaaatccttgagtggcttatagt

SEQ ID NO: 11609 - DNA, 292 bp, Homo sapiens
  AC005536.2_80502
  Located on chromosome 7
  Distance between a terminus base of telomere on chromosomal short arm and 5'-terminus of this base sequence : 17833781
  Distance between 3'-terminus of neighbour sequence of sequence listing upward to telomere on chrosomal short arm and 5'-terminus of this base sequence : 46510
atctccatgtgactcagaacagagagacagataataagagagagagagagagagagagagacagagagagagagagagagagagctatttatttgggaaaagtaagggaagagaacaagagcctctgcatggtaacccagcgaattcttccaggtcttgtctaagatccccaaggtggtacctctgcaagtctgcaagaaccagaaccacagcattactgggcttggggtacccccagtgcagatacagctagatcacaacacccaagtcctttcaattatctggaaagcct

SEQ ID NO: 11610 - DNA, 402 bp, Homo sapiens
  AC005536.2_94593
  Located on chromosome 7
  Distance between a terminus base of telomere on chromosomal short arm and 5'-terminus of this base sequence : 17847792
  Distance between 3'-terminus of neighbour sequence of sequence listing upward to telomere on chrosomal short arm and 5'-terminus of this base sequence : 13719
aagcattcagaaattgacatctacaaggtccataaaagaatgtctaaatgacaagttttatatggttgtgtacaaaaatgcatgtagcctatagaactcaacagtatattagccttcttaaagaaatattcgtgaatcctatacacacacacacacacacacacacacacacacacagagagagaaaggcaagaaagacaaaagtgtttttaaaaaatgcacattaggctgggcgcggtggctcaagcctgtagttccagcactttgggaggctgaggtgggcagataatgaggtcaagagatcaacaccatcctggccaacatggtgaaaccccatctctattaaaaataaaaaaattgggggaggagccaagatggccgaatagaaagagctccggtcta

SEQ ID NO: 11611 - DNA, 385 bp, Homo sapiens
  AC005536.2_108211
  Located on chromosome 7
  Distance between a terminus base of telomere on chromosomal short arm and 5'-terminus of this base sequence : 17861300
  Distance between 3'-terminus of neighbour sequence of sequence listing upward to telomere on chrosomal short arm and 5'-terminus of this base sequence : 13106
atatgcctgcagtatgtaaacagggacatatagaaggagggtatagattagagacagggagaactatatctgattttctagccattcctctggggagctaacaagatggcagacaaaaaaatggcttgactgtgttgtgcagctcagtacccgggatccttgcatcctacactggtcagggttctccagagaaacaaaatcaataggatctgtctctctctctctctctctctctctctctctctctctctctgtgtgtgtgtgtgtgtgtgtgtgtgtgtgtgtgtgtgtgtgattatagaggctgagaagtcccatgatctgcaagctggagaaccagggaagctgcttgttcaaatcactctgagtctgatagcctaagaaa

SEQ ID NO: 11612 - DNA, 268 bp, Homo sapiens
  AC006035.2_53196
  Located on chromosome 7
  Distance between a terminus base of telomere on chromosomal short arm and 5'-terminus of this base sequence : 17978177
  Distance between 3'-terminus of neighbour sequence of sequence listing upward to telomere on chrosomal short arm and 5'-terminus of this base sequence : 116492
acttattaaacggcaatgtacaatcaaaataactttgttgtttccctgttgacacatcaattgcaaaggtgtgtgtgtgtgtctgtgtgtgtgtgtgtgtgtgtgtgtgtgtgttattgcaatggaaaagagaacaaaaatgttttcatttaaatagaagaagcaatattcagtaactggaggagttagtgaaaaactcttgtggccactgataataacaataggtaactaaaaaaagaaatcagttagaaatggttttcaaacagct

SEQ ID NO: 11613 - DNA, 207 bp, Homo sapiens
  AC004741.1_108467
  Located on chromosome 7
  Distance between a terminus base of telomere on chromosomal short arm and 5'-terminus of this base sequence : 18144825
  Distance between 3'-terminus of neighbour sequence of sequence listing upward to telomere on chrosomal short arm and 5'-terminus of this base sequence : 166380
gtctaacttgcctttcaaagtaagctttaagagctttcgtgcgcgcgcacacacacacacacacacacaaacttttgaatatgaataaaatctttttaattatactttgccaaaaaatctgggatcttcatctgcctattcaaccttaaaaaacaaaccacaaagttccctctctaatcttccgtatcttactatcattcgccaagt

SEQ ID NO: 11614 - DNA, 311 bp, Homo sapiens
  AC004741.1_104838
  Located on chromosome 7
  Distance between a terminus base of telomere on chromosomal short arm and 5'-terminus of this base sequence : 18148401
  Distance between 3'-terminus of neighbour sequence of sequence listing upward to telomere on chrosomal short arm and 5'-terminus of this base sequence : 3369
tccataggctacagtagcaataaggttgagacaggaatggaacagggatttggactggcctgctcttaaagtcaatcattggttattacacatacacacacacacacacacacacacacacattcacacacacactattcatttaaaaatgtaaactatcagggacctgaaacagataataaaaagtaaacccaatatggatgcagtgagaactaaaatagccagctcttttgtttgatatgaacttgtgccttgaaaacacattttcctagtctagtaataatagagttaacagaggaataagcaggtaa

SEQ ID NO: 11615 - DNA, 444 bp, Homo sapiens
  AC073629.5_26835
  Located on chromosome 7
  Distance between a terminus base of telomere on chromosomal short arm and 5'-terminus of this base sequence : 18162564
  Distance between 3'-terminus of neighbour sequence of sequence listing upward to telomere on chrosomal short arm and 5'-terminus of this base sequence : 13852
cgagttactggttacagcataccaacatggcacatgtgtacctatgtaacaaacctgcacattgtgcacaggtaccctagatcttaaagtataagaaagaaagacagaaagaaagaaagacagacacacagaaagaaagaaagaaagaaggaaagaaagaaagaaagaaagaaagaaagaaagaaagaaagaaagaaagaaagagaaagaagaaagaaagaaagaaagaggcaggcacaagataaggatgccccctctcaccactcctattcaacatagtattggaagttctggccagggcaatcaggcaagagaaagaaataaagggtattcaattaggaaaagaggaagtcaaattgtccctgtttgcagatgacatgattgtatatttagaaaaccccatcatgtcagccccaaatctccttaagctgataagcaacttca

SEQ ID NO: 11616 - DNA, 287 bp, Homo sapiens
  AC004741.1_90593
  Located on chromosome 7
  Distance between a terminus base of telomere on chromosomal short arm and 5'-terminus of this base sequence : 18162564
  Distance between 3'-terminus of neighbour sequence of sequence listing upward to telomere on chrosomal short arm and 5'-terminus of this base sequence : -444
cgagttactggttacagcataccaacatggcacatgtgtacctatgtaacaaacctgcacattgtgcacaggtaccctagatcttaaagtataagaaagaaagacagaaagaaagaaagacagacacacagaaagaaagaaagaaagaaggaaagaaagaaagaaagaaagaaagaaagaaagaaagaaagaaagaaagaaagagaaagaagaaagaaagaaagaaagaggcaggcacaagataaggatgccccctctcaccactcctattcaacatagtattggaa

SEQ ID NO: 11617 - DNA, 167 bp, Homo sapiens
  AC005014.1_133692
  Located on chromosome 7
  Distance between a terminus base of telomere on chromosomal short arm and 5'-terminus of this base sequence : 18409138
  Distance between 3'-terminus of neighbour sequence of sequence listing upward to telomere on chrosomal short arm and 5'-terminus of this base sequence : 246287
actagacaaacgtcaaaggctgctaaaacctttaagggaaagaaaggttaataggaaaagttataatgagatcatcaggctgaaatctcttgaacgcactgatcttttgtgtgtgtgtgtgtgtgtgtgtgtgtgtgtgtgtgtgtgtgtatgacagtctcgctttg

SEQ ID NO: 11618 - DNA, 371 bp, Homo sapiens
  AC005014.1_6125
  Located on chromosome 7
  Distance between a terminus base of telomere on chromosomal short arm and 5'-terminus of this base sequence : 18536785
  Distance between 3'-terminus of neighbour sequence of sequence listing upward to telomere on chrosomal short arm and 5'-terminus of this base sequence : 127480
agactacagaactggcctctagtttaaacaaaacaaaacaaaacaaaacaaaacaaaacaaaacaaaacacaaagctttcaacagaatgtaataatctgcttaagagcaaaagagatatgcaaaacttttgaatctcacatctccaactgtccttattttcctgtgtttgtgttttcactgtcatctgtgttaatcacttctgcccatttacgtgtctcctattactccctttcgtctcatttaaaaaaaattttcctggctcttttctctttctcacttgttcttttctgtttaccagctgtcaccttagcagaaattggtttttagagcaaaccaatgagagagtttctttccagaaaggtaagtatcg

SEQ ID NO: 11619 - DNA, 468 bp, Homo sapiens
  chr7.fa.O7frz.16890061
  Located on chromosome 7
  Distance between a terminus base of telomere on chromosomal short arm and 5'-terminus of this base sequence : 18640157
  Distance between 3'-terminus of neighbour sequence of sequence listing upward to telomere on chrosomal short arm and 5'-terminus of this base sequence : 103001
gctgaagctaagataccaagacgccaattaatacactacgaatcccacagggaagtccagattgagcatgaagcacaacagctctgctagtattctttctttctttctttctttccctttctttctttctttctttctttctttctttctttctttctttctttctttctttctttctttctttctttccttccttccttccttccttccttccttccttccttccttccttccttcctcccttctttccttcctttctttccttctttatttctattttctctttctttcttgaactcctgggctcaagtgatacttctgccttggcctctcaaagtgctgggatcacagacttaaggcccaatgctcagcccctgctgattttctgaagtcaagtttatgttaataatgtcttttatagtacttgagataataatgataaaatgtcaaataagtcaaaatgtctta

SEQ ID NO: 11620 - DNA, 472 bp, Homo sapiens
  AC073333.3_110782
  Located on chromosome 7
  Distance between a terminus base of telomere on chromosomal short arm and 5'-terminus of this base sequence : 18753510
  Distance between 3'-terminus of neighbour sequence of sequence listing upward to telomere on chrosomal short arm and 5'-terminus of this base sequence : 112885
aagtttggaggttgactagaagagcttgggacgagattagggaaaattggccagaaaggcagttgggaaatggaggatggagagttacagtaacaaaaagaggaattgtttcaagaggggtattaacactgtggaatcctgatgagagtttgagtagggagtgaaagatatgtatataatcaaagaataatttaatcatgttttatatttaagacagatatgttctaatatctatgctttgaagataatatttcatgaatgatgaatcataattaagcagaatgtcatttatatgtccatatatttcagagaaaaataaataaataaataaataaataaataaataaataaagtaagcagaacattttaccaaagtaatgattctaattcaactaactctcaggcactataaggctctatccaataaaaagaattgaaaatattcccatatttacttgcagttctcaaagaa

SEQ ID NO: 11621 - DNA, 190 bp, Homo sapiens
  AC004993.1_105331
  Located on chromosome 7
  Distance between a terminus base of telomere on chromosomal short arm and 5'-terminus of this base sequence : 18829832
  Distance between 3'-terminus of neighbour sequence of sequence listing upward to telomere on chrosomal short arm and 5'-terminus of this base sequence : 75850
ccaggaagtacaggacttctaacccaatgtaaatgtttttttttaaattattattattattattatttaaacacacacacacacacacacacacacacacacacacacactttcttttgtgatcggtcacatttcttctcatcacaccttcacctacttagccccaaacctgttcatgtggaactttcct

SEQ ID NO: 11622 - DNA, 400 bp, Homo sapiens
  AC004993.1_62281
  Located on chromosome 7
  Distance between a terminus base of telomere on chromosomal short arm and 5'-terminus of this base sequence : 18872846
  Distance between 3'-terminus of neighbour sequence of sequence listing upward to telomere on chrosomal short arm and 5'-terminus of this base sequence : 42824
catactttgtgtaagccattcactggcctttctcatttgagcttctcctatactcttatagcataccttgtacactggcaccaaaaccctacacatacatacacacacacacacacacacacacacacacacacacacacacacactctgtctttttaaaaaatattctttttgtaaactttttcttcaagctgttccttctgtctggaaaacttctgcccaacaaataatttctactgattaattgatcaaaggccatctttctgtgaatccttcctggattccctcagttgaatgtgtatatgctatgttcctactgagaggtgaagcgagctggacttcctgggtcgactggggacttggagaacttttatgtctacctagaggattgtaaatgcac

SEQ ID NO: 11623 - DNA, 374 bp, Homo sapiens
  chr7.fa.O7frz.17283503
  Located on chromosome 7
  Distance between a terminus base of telomere on chromosomal short arm and 5'-terminus of this base sequence : 19049362
  Distance between 3'-terminus of neighbour sequence of sequence listing upward to telomere on chrosomal short arm and 5'-terminus of this base sequence : 176116
tttaacagtggtcaattaccacagtcaattccatttaaaagaaatttctgatgcaaacatatttcataaaattaaccatatggcattttagaaaccttagtatcaatttttttactgcctgatgggttacaatattgacattatattcttaggttcttgcaaattataattaaaggtatattctatctggaaaatgaatgtgttagtgatttctttctttctttctttctttctttctttctttcttttagaaccatgtttgccatatgtttatcatctaggcatatgttgaactattgtgtatgtttaataaatacttaataagaatatgaatgtatttattagatttgtttagaactgtactcagaataggc

SEQ ID NO: 11624 - DNA, 280 bp, Homo sapiens
  AC003075.1_118997
  Located on chromosome 7
  Distance between a terminus base of telomere on chromosomal short arm and 5'-terminus of this base sequence : 19143180
  Distance between 3'-terminus of neighbour sequence of sequence listing upward to telomere on chrosomal short arm and 5'-terminus of this base sequence : 93444
ttaatagttcaatggcttcttgaggaccatgacttatttattattgtatctgcagcacccatcatggtgcctgacctacagaatatgttcaatatgtgtttattgaatgaattataataattgtggtatttttgcttatatgcacccccccaccacacacacacacacacacacacacacacacgttaaatctaaagcttcttgtgagcagaaggcttatcttgtaaattgttgtatccctagctcctcgaagggtgtctggtatgatacaaacattcaa

SEQ ID NO: 11625 - DNA, 279 bp, Homo sapiens
  Z67612
  Located on chromosome 7
  Distance between a terminus base of telomere on chromosomal short arm and 5'-terminus of this base sequence : 19148767
  Distance between 3'-terminus of neighbour sequence of sequence listing upward to telomere on chrosomal short arm and 5'-terminus of this base sequence : 5307
aatttaaggtatcagtcagagtcactttttattttcctatttctctttatttctatcttcttaggaggtagggagaccaaaataagacttgcaaaaaattattaaccacagctaaaacacacacacacacacacacacacacacacacacacacgcacacgcacacacacacacacatgagcacgtagttaaaaaaaggcacacaaggttggtctatgtgtttatttttcagaaacattgttttcttaggaccattccagtgaccttggttaatacggc

SEQ ID NO: 11626 - DNA, 420 bp, Homo sapiens
  AC003075.1_66875
  Located on chromosome 7
  Distance between a terminus base of telomere on chromosomal short arm and 5'-terminus of this base sequence : 19195280
  Distance between 3'-terminus of neighbour sequence of sequence listing upward to telomere on chrosomal short arm and 5'-terminus of this base sequence : 46234
ttacctaggaaagtaatgagcacttagtgtaattctcctgttttctgagttcacctattgaggaaaactgaagagtgttttcatagtcaagtttcaactgaatttaagtcctgagggatgaaaactaaagtatatacacacatgtatattttaggaaactttcttaggagatacacacacacacacacacacacacacacacacacctcctaagaaagtctcaagggaaaaaatgtcagtgggatgagcccttttaggagaagcagaataaaagactgactacaaatcaaaaagccaaagaagaagccacagacagaaatggagacaagatccagaagccaggctgaaacaggagggcaacaaatcaagtcaggaaataactgatatgaagcacatcggtgccttaatagtggctgaata

SEQ ID NO: 11627 - DNA, 441 bp, Homo sapiens
  AC003075.1_33209
  Located on chromosome 7
  Distance between a terminus base of telomere on chromosomal short arm and 5'-terminus of this base sequence : 19228984
  Distance between 3'-terminus of neighbour sequence of sequence listing upward to telomere on chrosomal short arm and 5'-terminus of this base sequence : 33284
attctgtcagttaccaatatccacatgcttttaagtgagataatatttgaaagtgcttggcaaaatgtttaagtggtagctgttattatttctattcagctgcgcttcctcccagactataaatacatacataccacacacatacacacacacacacacacacacacagtgaggaaaaaaaagaagagatagcattataacatgacacctccaatagtaagcatcctatcatgccatcagactttccttcacatatataatccacaagcagttaaaagctataccggaaaagccactttacaagatgtaatacctaggagtaaatataaagatacctgtgcacatcttttttgtagacaactttaaaacattctagcaggacaaaatatagacttgaacaaatggaaagaaatgtatgttcttggatagaatgattcaaga

SEQ ID NO: 11628 - DNA, 394 bp, Homo sapiens
  chr7.fa.O7frz.17508246
  Located on chromosome 7
  Distance between a terminus base of telomere on chromosomal short arm and 5'-terminus of this base sequence : 19372086
  Distance between 3'-terminus of neighbour sequence of sequence listing upward to telomere on chrosomal short arm and 5'-terminus of this base sequence : 142661
gcaacgtaactaaacgtgatttggatattaagtctcattttggataatcaaaatacataagcatgtgtgtgtgtgtgtgtgtgtgtgtgtgtgtgtgtgtgtataaaataaaacttacaaaatatgtatgtgtgtatgtatatattaagcttgtgaagtcctaaaagcctggcagagtgggagagacatgtagctccagtaccagtaaaacaaaccacatggctaattaaatgtgttctattgatctctccactaaccgctgaaaaatacatacagattttcagttaatcagctaatagtttggcattctgcgtgctatatctttctcacctattgttgtgattaactctatgattttaagcttttatttgtagatttgcactttacagacttc

SEQ ID NO: 11629 - DNA, 152 bp, Homo sapiens
  D7S507
  Located on chromosome 7
  Distance between a terminus base of telomere on chromosomal short arm and 5'-terminus of this base sequence : 19465188
  Distance between 3'-terminus of neighbour sequence of sequence listing upward to telomere on chrosomal short arm and 5'-terminus of this base sequence : 92708
tgcccaattctcagtgtttttaaatacacaaaatacggctttctactaaaaactggtaaatgaagttggaaaaatacaaacacacacacacacacacacacacacacacacacacacacacggtagcccttttattgcagccatgtacgtag

SEQ ID NO: 11630 - DNA, 374 bp, Homo sapiens
  AC006482.3_30886
  Located on chromosome 7
  Distance between a terminus base of telomere on chromosomal short arm and 5'-terminus of this base sequence : 19533034
  Distance between 3'-terminus of neighbour sequence of sequence listing upward to telomere on chrosomal short arm and 5'-terminus of this base sequence : 67694
atccttggaaagattcgtaaacacggacgactagaaaaacaatactgctaatatataaagtatggatgagttgactaaaaataactgaggaatttcttaaccctttaaggatatatctagaagactacttcagaagcatcattaaattatccctccacttaaaaatggatgactggaaataggagaggatgcagtgtgtgtgtgtgtgtgtgtgtgtgtgtgtgtgtgtgtgtgtgtgtgtgtatgtgtatgttttgaatcaatgaataaggtaaaggattggattaatgctttgggggcaggggagagcaatgaacaaagtgaaaggatttggtgtgactctcttccatgtcctagttctatgtcattaggca

SEQ ID NO: 11631 - DNA, 413 bp, Homo sapiens
  AC006482.3_67772
  Located on chromosome 7
  Distance between a terminus base of telomere on chromosomal short arm and 5'-terminus of this base sequence : 19569850
  Distance between 3'-terminus of neighbour sequence of sequence listing upward to telomere on chrosomal short arm and 5'-terminus of this base sequence : 36442
acttggccttgtaatgcacctccatctcctgcctgccctttccctcctacccaggtgcacaagcctgtgtgtgcacacacacccacatacacctacacacacacactgaagtattcttttccaaagctgcccttgaactctcttacaattttctagctgtatgacaagagagaacaaaatacattgaatgtcttatacttaatttttaaaagctgatccaaatgctgtctgggcccagccacagtcattgaacacacgcacagacacacacacacacacacacacacacacacacacacacacatcacagagcatttttagtttgacaagagaaggggacgtcaaaggcttgtccccagagacagctatttataaaagacatcaaattaatgtaacatgagtcaatggagtcc

SEQ ID NO: 11632 - DNA, 177 bp, Homo sapiens
  AC006482.3_110053
  Located on chromosome 7
  Distance between a terminus base of telomere on chromosomal short arm and 5'-terminus of this base sequence : 19612340
  Distance between 3'-terminus of neighbour sequence of sequence listing upward to telomere on chrosomal short arm and 5'-terminus of this base sequence : 42077
atgtgtccattgctagatgaacggataaagaaaatatggcatgtataaacacatacacacacacacacacacacacgtacaatggaatattattattagacttaaataagaaggaaattctgtcatttgagacaacacggatgaacctggaggatgttatgctaaatgaaataagcc

SEQ ID NO: 11633 - DNA, 173 bp, Homo sapiens
  Z66673
  Located on chromosome 7
  Distance between a terminus base of telomere on chromosomal short arm and 5'-terminus of this base sequence : 19693576
  Distance between 3'-terminus of neighbour sequence of sequence listing upward to telomere on chrosomal short arm and 5'-terminus of this base sequence : 81059
ctgcaaatacaaaaagtgttacaagtataaacatctgtaaaaagcttttacaaggagaggtcttttctttcatttacacacacacactttacaaggagaggtcttatatttacacacacacacacacacacacacacacagaactagcagcctaacttttgtaacttcatcct

SEQ ID NO: 11634 - DNA, 206 bp, Homo sapiens
  Z67142
  Located on chromosome 7
  Distance between a terminus base of telomere on chromosomal short arm and 5'-terminus of this base sequence : 19777332
  Distance between 3'-terminus of neighbour sequence of sequence listing upward to telomere on chrosomal short arm and 5'-terminus of this base sequence : 83583
cttcaaattatgtctctggccacatgttcaaattttaaaatgcactttgttaggagaaaatttactcacacacacacagacacacacacacacacacacacactttttccaatgcttcttttcaaaaggagaaaaaaacacctggggaaaatttttgattaaattttgtgtttcttattagttggtgcaatgagtcgatttgtatt

SEQ ID NO: 11635 - DNA, 290 bp, Homo sapiens
  AC005249.1_150140
  Located on chromosome 7
  Distance between a terminus base of telomere on chromosomal short arm and 5'-terminus of this base sequence : 20045915
  Distance between 3'-terminus of neighbour sequence of sequence listing upward to telomere on chrosomal short arm and 5'-terminus of this base sequence : 268377
gatctagattgcaaatggtgtaagaagggtttagaactcctggttttaggagatggagggagtgtggaatagagatgagagggagagaaagaaatggagccaaatagcaagatggtgggaagctgtagtgagagagagagagaggtgtgtgtgtgtgtgtgtgtgtgtgtgtgtgtgtgtgcacatgctcatttagttatttgggttttggctcaagtggatacagtgctggagagagcccaagaagcagagtggggcaggctgcaacctttctaggaactcctttggac

SEQ ID NO: 11636 - DNA, 208 bp, Homo sapiens
  AC005249.1_130852
  Located on chromosome 7
  Distance between a terminus base of telomere on chromosomal short arm and 5'-terminus of this base sequence : 20065308
  Distance between 3'-terminus of neighbour sequence of sequence listing upward to telomere on chrosomal short arm and 5'-terminus of this base sequence : 19103
tacagcagaatttcaggttctaaggcatgagagagagagagagagagagagagagagagagagagagagagagagactgaggatctgatgaatctcttggtgttcaacgtgttggcacagtaagcatttcccaccaataaatgatctgtatagtgattgtgataaactgagtttttgaaggatactctatggaggaaccatggttaat

SEQ ID NO: 11637 - DNA, 355 bp, Homo sapiens
  AC005249.1_119777
  Located on chromosome 7
  Distance between a terminus base of telomere on chromosomal short arm and 5'-terminus of this base sequence : 20076182
  Distance between 3'-terminus of neighbour sequence of sequence listing upward to telomere on chrosomal short arm and 5'-terminus of this base sequence : 10666
gtggaaccatgtaacctgtacttttacactaaatatcccccaaggctttactttctgtggttttctgcatatttcttaatttttgtcatattttgagaatgtcaacgtatagcagttttctccatttataattcactgcctctaacttgttgtagggttagaaagctaagaattgtgttaaataaaattgttaaaagatcacaagttctgaggaggtgcaaatgtcttgtttttttttttttttttttgtgtgtgtgtgtgtgtgtgtgtgtgtgtgcgcgcatgtgtctctgtgtgtgtgttttaaatagagttttgttcttgttgcccaggctggagtgcaatggcatgatct

SEQ ID NO: 11638 - DNA, 258 bp, Homo sapiens
  AC005249.1_43680
  Located on chromosome 7
  Distance between a terminus base of telomere on chromosomal short arm and 5'-terminus of this base sequence : 20152369
  Distance between 3'-terminus of neighbour sequence of sequence listing upward to telomere on chrosomal short arm and 5'-terminus of this base sequence : 75832
ttgcaatagctaaatcttcactttttcttttgtattcaggattgactggaaagtaaatgtcactcagtctgaggattcctccttcctgatatatatctatatctgtatctgtatatggacataacatatatatacatctctctattatctaatctgcatctatctatctatctatctatctatctattgatgcattccaagcttattcagttctagaaaatggaggagggatggaactcagtcctcagttcatactga

SEQ ID NO: 11639 - DNA, 208 bp, Homo sapiens
  AC005249.1_31559
  Located on chromosome 7
  Distance between a terminus base of telomere on chromosomal short arm and 5'-terminus of this base sequence : 20164560
  Distance between 3'-terminus of neighbour sequence of sequence listing upward to telomere on chrosomal short arm and 5'-terminus of this base sequence : 11933
gagtgaaccgtgattataccactgcacaccagcctgggtgacagagtgagaccctgtctcaaattgtgtatgtgtgtgtgtgtgcatgtatgtgtgtgtgtgtgtgtgtgtgtgtgtataaatatataaatgtaacaaaacaaaaataagagaagaaaacattgggtcaggtgtggtggttcacacctgtaattccagcactttagga

SEQ ID NO: 11640 - DNA, 150 bp, Homo sapiens
  D7S488
  Located on chromosome 7
  Distance between a terminus base of telomere on chromosomal short arm and 5'-terminus of this base sequence : 20256778
  Distance between 3'-terminus of neighbour sequence of sequence listing upward to telomere on chrosomal short arm and 5'-terminus of this base sequence : 92010
acctctccctgacctcattagagatgtctttccagatgacctcccatacttgagaacatctacacacacacacacacacacacacacacacacacacacacacacacacacacacagatattgcccttcctccttgctggcttatttttt

SEQ ID NO: 11641 - DNA, 236 bp, Homo sapiens
  AC002433.1_39009
  Located on chromosome 7
  Distance between a terminus base of telomere on chromosomal short arm and 5'-terminus of this base sequence : 20398196
  Distance between 3'-terminus of neighbour sequence of sequence listing upward to telomere on chrosomal short arm and 5'-terminus of this base sequence : 141268
aaataaggtcttgagttggaacaaaaattagtacactgtactttcccctccatcctattccttggaggtctaagggaatcaagctcactgactgcaggcaaatgcatatagttttattgctttaacaatagtttgaggaatgtgaggttgggagaagaggtaacatcaatgagtgagtgagtgagtgagtgagtgagtgagtggaggagcagcagttattggtgagtaatttgcag

SEQ ID NO: 11642 - DNA, 389 bp, Homo sapiens
  AC002433.1_96034
  Located on chromosome 7
  Distance between a terminus base of telomere on chromosomal short arm and 5'-terminus of this base sequence : 20455168
  Distance between 3'-terminus of neighbour sequence of sequence listing upward to telomere on chrosomal short arm and 5'-terminus of this base sequence : 56736
tttcatagcatttgacctacactagaacttctttcaaaattgaagtcaatgcttctcaaaccctgcttctgctttatcagctaagtttatgtaatattctgaatcctttgtcatcatttccacagtgttcacagcatcttcaccaggagtagattccatttcaagaaaccccttccttccttccttccttccttccttccttccttccttccttccttcctaccctccctccctccctccctccctctctccctctctccctctctccctttctccctccctctctccctccctccatttgcattcacaattttgtggtttggttcaagaggccttgctctccacctgtcttggctgtcaacatgccttcctaactcagcttaatcatt

SEQ ID NO: 11643 - DNA, 194 bp, Homo sapiens
  Z66816
  Located on chromosome 7
  Distance between a terminus base of telomere on chromosomal short arm and 5'-terminus of this base sequence : 20498915
  Distance between 3'-terminus of neighbour sequence of sequence listing upward to telomere on chrosomal short arm and 5'-terminus of this base sequence : 43358
gtgaccagcgattttacttcttaatctttgtcaaatattctagaggcatgagaggacaaaactcaccatcaacatctgtttctgtgtgtgtatgtgtgtgtgtgtgtgtgtgtgtgtgtgtgtgtatttcaggggcagtggcaagtacagaagtaaagcagaagcttcaagagttcctactgagtaaatcagca

SEQ ID NO: 11644 - DNA, 171 bp, Homo sapiens
  AC002433.1_139651
  Located on chromosome 7
  Distance between a terminus base of telomere on chromosomal short arm and 5'-terminus of this base sequence : 20498940
  Distance between 3'-terminus of neighbour sequence of sequence listing upward to telomere on chrosomal short arm and 5'-terminus of this base sequence : -169
ctttgtcaaatattctagaggcatgagaggacaaaactcaccatcaacatctgtttctgtgtgtgtatgtgtgtgtgtgtgtgtgtgtgtgtgtgtgtgtatttcaggggcagtggcaagtacagaagtaaagcagaagcttcaagagttcctactgagtaaatcagcaac

SEQ ID NO: 11645 - DNA, 184 bp, Homo sapiens
  AC002124.1_27183
  Located on chromosome 7
  Distance between a terminus base of telomere on chromosomal short arm and 5'-terminus of this base sequence : 20526133
  Distance between 3'-terminus of neighbour sequence of sequence listing upward to telomere on chrosomal short arm and 5'-terminus of this base sequence : 27022
atgtagctcttatgaactgtctgagtaggagggacattaaaacattatatatccacaataaaattacttttcatgccatttctatttgaatggtatataaaagatatatctagtacagaattttgtatatatatatatatatatatatatatatatatatgtaggaattcgtttgttacagaaa

SEQ ID NO: 11646 - DNA, 328 bp, Homo sapiens
  AC002124.1_56867
  Located on chromosome 7
  Distance between a terminus base of telomere on chromosomal short arm and 5'-terminus of this base sequence : 20555844
  Distance between 3'-terminus of neighbour sequence of sequence listing upward to telomere on chrosomal short arm and 5'-terminus of this base sequence : 29527
cctggtagcatcactaattcactaattttcttacagtttataccatgtatctgttttctttggcttcttatcttttcttaaaattgtgtgtgtgtgtatgtgtgtgtgtgtgtgtgtgtgtatacacacatatacatgtattttttttttcaggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattctt

SEQ ID NO: 11647 - DNA, 393 bp, Homo sapiens
  AC002124.1_92920
  Located on chromosome 7
  Distance between a terminus base of telomere on chromosomal short arm and 5'-terminus of this base sequence : 20591802
  Distance between 3'-terminus of neighbour sequence of sequence listing upward to telomere on chrosomal short arm and 5'-terminus of this base sequence : 35630
aatatttaactcatgaggaccagaaaacaatatttgatccattttactgacaacaaaaactttcttttcatcaaaactatcctgttaggccaggtgcagtggctcacacctacaatcccagcactttgggaggacaaggtgggcagattgcttgagcccaggagttcaagaccaacctgaggtgcaacaactcacaaacaaacaaacaaacaaacaaacaaacaataaaactatactgaaaaggctttaatacaccaactgataacttttagatggtttaaaggcatcttctgatgaactgtgtcctaatgagtgtgaatggatacctttgagcaaggtacccagatttaaaatgacatatctcttaattttaaacgtaagatcaaggtccta

SEQ ID NO: 11648 - DNA, 330 bp, Homo sapiens
  AC002088.1_35942
  Located on chromosome 7
  Distance between a terminus base of telomere on chromosomal short arm and 5'-terminus of this base sequence : 20635754
  Distance between 3'-terminus of neighbour sequence of sequence listing upward to telomere on chrosomal short arm and 5'-terminus of this base sequence : 43559
caaagcaaacttcacttgattctatgtatgttactttcatttctattcattatggaatctctgggtgggcttttcgaccaacctcttcctttgtctacagctgtgtttgatatttcagaacctgactacagaggaaaacaagccagataattccaaggccaaaggaaggttaagtgtggaacacacacacacacacacacacacacacacacacacacacacacaaagggtgctattccctctgcaaaggaacagtgctgtacatatatgcgtggataattatttctttttgtgtactctactccattctagttccgtgttctcaaactg

SEQ ID NO: 11649 - DNA, 205 bp, Homo sapiens
  D7S638
  Located on chromosome 7
  Distance between a terminus base of telomere on chromosomal short arm and 5'-terminus of this base sequence : 20635866
  Distance between 3'-terminus of neighbour sequence of sequence listing upward to telomere on chrosomal short arm and 5'-terminus of this base sequence : -218
tttcagaacctgactacagaggaaaacaagccagataattccaaggccaaaggaaggttaagtgtggaacacacacacacacacacacacacacacacacacacacacacacaaagggtgctattccctctgcaaaggaacagtgctgtacatatatgcgtggataattatttctttttgtgtactctactccattctagttccg

SEQ ID NO: 11650 - DNA, 295 bp, Homo sapiens
  AC002410.1_21147
  Located on chromosome 7
  Distance between a terminus base of telomere on chromosomal short arm and 5'-terminus of this base sequence : 20706425
  Distance between 3'-terminus of neighbour sequence of sequence listing upward to telomere on chrosomal short arm and 5'-terminus of this base sequence : 70354
actcagatttgtgttcctactcaggaaagacctgaaaaggccctaagctcttatgtcaaactgattttgaggctctgttcaaacaggaagtgaaggtccgggtagagttgtcagctgcctggctaaatatttaaaatgtgccctaagacacacacacacacacacacacacacacacacacacacacacacacacacacacagagcccctcggcaaaggctgggggagtgctggttttaagcattaaaagaaatatatttatccaatcattgactgaccactaagctaacaatgc

SEQ ID NO: 11651 - DNA, 337 bp, Homo sapiens
  AC002410.1_79442
  Located on chromosome 7
  Distance between a terminus base of telomere on chromosomal short arm and 5'-terminus of this base sequence : 20764596
  Distance between 3'-terminus of neighbour sequence of sequence listing upward to telomere on chrosomal short arm and 5'-terminus of this base sequence : 57876
tgtcatgtttcaacttcatttaaatttttatctttttctctatgtgtcatagttttggtaattttatgactaaaacatgcttttccttttgtctggaagtatttattttctttcactgaataattgcttctctttttttatttttttttaactgtgttgcagcacataaaaagtttatgaaatcaattcagagggtcaagattggcattttaatagaatgtaatagaagataaaagagtgtcacatattgtttcacaaaatatgttttagttgtgtgtgtgtgtgtgtgtgtgtgtgtgtatgtatgtatgtactagttcctggagtgaaatgtact

SEQ ID NO: 11652 - DNA, 479 bp, Homo sapiens
  chr7.fa.O7frz.19078202
  Located on chromosome 7
  Distance between a terminus base of telomere on chromosomal short arm and 5'-terminus of this base sequence : 20840141
  Distance between 3'-terminus of neighbour sequence of sequence listing upward to telomere on chrosomal short arm and 5'-terminus of this base sequence : 75208
atttaactggagaccagaataaagaaagaatgacaaatggccaacactttggaagagaataaataggagaaaagaaaatactcctaaataaaacatcatatctatcttagcttttgccaccaataaagggaatttccgaaagaaagtttcagagaaagagagagaaagaacgtaagagagaaagagaaaaagaagaaagaaagatagaaagaaagaaggaaggaaggaaggaaggaaaaaaagaaagaaagaaagaaagaaagaaagaaaggatgtcctgactttcttctccatgagaatttgtaataaagttttaaggtccatatttataatatacatgtgcaaacaaaaacagcaaactccacaaccagtcttgccatataagaatttaaaataggtcctagaaggtagtgtcccagatatccagcaaaagcaaacaatatcacacttgagccagacttgaatgacagataccatat

SEQ ID NO: 11653 - DNA, 240 bp, Homo sapiens
  AC004744.1_11912
  Located on chromosome 7
  Distance between a terminus base of telomere on chromosomal short arm and 5'-terminus of this base sequence : 20935095
  Distance between 3'-terminus of neighbour sequence of sequence listing upward to telomere on chrosomal short arm and 5'-terminus of this base sequence : 94475
gaacagtcttgattcctgtgaggtccccagttttggagaaagaagtgttcctttgattctaaggtttgtaatcacatgatatgtgaataatagggtaaatagggtattaaaatagggtatatatatatatatatatatatatatatacacacacacatacatatagtttatacaaactattatatatatatgctgaaagtttagttattatcctgaggctagaatttctgcactggacac

SEQ ID NO: 11654 - DNA, 256 bp, Homo sapiens
  AC003986.1_2960
  Located on chromosome 7
  Distance between a terminus base of telomere on chromosomal short arm and 5'-terminus of this base sequence : 20975926
  Distance between 3'-terminus of neighbour sequence of sequence listing upward to telomere on chrosomal short arm and 5'-terminus of this base sequence : 40591
aaaatggcatgttaatctactcatgtgtcttattaaattgatttgaataataataaccacaatttttcatcacttaacatgttttattaatatgtgacaactcaattaatatattcacaaaatctaagaaatttatatatatatatatatatatatatccttgtatacttgtccctattttaacccttagaaatactgaagctctaaaaagttatgtgaattattgatgatcataaagctaggaaatcacagctag

SEQ ID NO: 11655 - DNA, 343 bp, Homo sapiens
  Y10871.1_4750
  Located on chromosome 7
  Distance between a terminus base of telomere on chromosomal short arm and 5'-terminus of this base sequence : 21016212
  Distance between 3'-terminus of neighbour sequence of sequence listing upward to telomere on chrosomal short arm and 5'-terminus of this base sequence : 40030
taataggtaaaggaaagcggagtctctgaagcggttattaatagtaggggtgtgtgtgtgtgtgtgtgtgtgtgtgtgtgtgtgtgtgtgttagtagtatttcattaaaaccatatcctggaacaaagagttgttctttcatgtttctttgctttgttgttactctgacaggagttctaaaaacaggatttttccaatcaaaggatccctggagttatctgccccctcctagcctcctttccctccaccaaactgctcttggtatcattatcccgctatggattctttcttatactcttgatttagccagaggacatttaatagctgattggattaaatgttg

SEQ ID NO: 11656 - DNA, 407 bp, Homo sapiens
  AC003986.1_67285
  Located on chromosome 7
  Distance between a terminus base of telomere on chromosomal short arm and 5'-terminus of this base sequence : 21040114
  Distance between 3'-terminus of neighbour sequence of sequence listing upward to telomere on chrosomal short arm and 5'-terminus of this base sequence : 23559
tattgatatcaaatttgactgcagtgggccagacgtggcctaaaacacagaatgggtttatctaatagtcatattttttcctctctctcatattcatgctccaggcattaatatgataatgttatgttgtcagctaaagtaccctatttatcatatttattattaataatgaagtactctaataaaatgtatcacctaaaggaaataacaagtgttatatggtcttgcagtaataatctttttattatagcacaggcagggggacgctgcatatatatatatatatatatatatatatacacacacacacacacacacatatgtttgctatatatacatatatatatagcaaacacatatagacacacataaacgtagatgtatttctgaagcacttaagaaatagc

SEQ ID NO: 11657 - DNA, 380 bp, Homo sapiens
  AC003986.1_68908
  Located on chromosome 7
  Distance between a terminus base of telomere on chromosomal short arm and 5'-terminus of this base sequence : 21041902
  Distance between 3'-terminus of neighbour sequence of sequence listing upward to telomere on chrosomal short arm and 5'-terminus of this base sequence : 1381
tcttggaggtcacatttatcaggttctaatatattcttttagaaagtaaatattaaattttacacaatttatatgcaccttcacacacacacacacacacacagaacacacacacacacacacacacactggggctaagtaggaagaaaaactgtttactaattgtttaaaagtctggaatttcattagaaatgttaagtgtattcctgactagtcaataaatgccttagtgttagtatagattattgttacctgtttgttttggggaaggtgtttgtgggtatgtaaattatagataaactgagctgtgttttagatgaaatcccttaaagtttaatcaaattttccatttaagtgtcagtagaatgaaagagcatgtt

SEQ ID NO: 11658 - DNA, 197 bp, Homo sapiens
  AC003986.1_68884
  Located on chromosome 7
  Distance between a terminus base of telomere on chromosomal short arm and 5'-terminus of this base sequence : 21041902
  Distance between 3'-terminus of neighbour sequence of sequence listing upward to telomere on chrosomal short arm and 5'-terminus of this base sequence : -380
tcttggaggtcacatttatcaggttctaatatattcttttagaaagtaaatattaaattttacacaatttatatgcaccttcacacacacacacacacacacagaacacacacacacacacacacacactggggctaagtaggaagaaaaactgtttactaattgtttaaaagtctggaatttcattagaaatgtta

SEQ ID NO: 11659 - DNA, 213 bp, Homo sapiens
  AC003986.1_96982
  Located on chromosome 7
  Distance between a terminus base of telomere on chromosomal short arm and 5'-terminus of this base sequence : 21069956
  Distance between 3'-terminus of neighbour sequence of sequence listing upward to telomere on chrosomal short arm and 5'-terminus of this base sequence : 27857
gctaaggcataaatcagtactcagattaatgttttatgtttgtgtgtcaggtgatctcctatatggcttcccagggttcttaggtatggggcatattttcttaaaggattctatattcaaatgtaacacacacacacacacacacacacacacacacagacacacagtgctctgaaatatgtatatttgtctgtatagttactgaagttgcca

SEQ ID NO: 11660 - DNA, 217 bp, Homo sapiens
  D7S2495
  Located on chromosome 7
  Distance between a terminus base of telomere on chromosomal short arm and 5'-terminus of this base sequence : 21070016
  Distance between 3'-terminus of neighbour sequence of sequence listing upward to telomere on chrosomal short arm and 5'-terminus of this base sequence : -153
atatggcttcccagggttcttaggtatggggcatattttcttaaaggattctatattcaaatgtaacacacacacacacacacacacacacacacacagacacacagtgctctgaaatatgtatatttgtctgtatagttactgaagttgccatttataaattttatttctttggtgataataattttagtgaatctgagcattcatttcattgatg

SEQ ID NO: 11661 - DNA, 414 bp, Homo sapiens
  AC006381.2_131981
  Located on chromosome 7
  Distance between a terminus base of telomere on chromosomal short arm and 5'-terminus of this base sequence : 21175626
  Distance between 3'-terminus of neighbour sequence of sequence listing upward to telomere on chrosomal short arm and 5'-terminus of this base sequence : 105393
tcaggaatcattgctttcttagaccgctctattttcttttcacttttatcaacaagacttgctcttggcattctttggtatttgcaacagagacaatgctttattcattgacaagatttattaaaaatctcaagggaaaaagataaaactttgaaatcagtgcactgaagacatatatatatatatatatatatatatatatatatatatatatatatacacacacacacacacacacactgtgggtgagcattgaagctcactctaccacctcagcctctaagcccacaaaatttaaatattttgctcagaaaaaatatattgtagtttcagagacttttaggaatggttaaagttttcttttgagtttaaattggaaatatcaattgttgctcaaatgcaatggacctacta

SEQ ID NO: 11662 - DNA, 421 bp, Homo sapiens
  AC006381.2_97859
  Located on chromosome 7
  Distance between a terminus base of telomere on chromosomal short arm and 5'-terminus of this base sequence : 21209860
  Distance between 3'-terminus of neighbour sequence of sequence listing upward to telomere on chrosomal short arm and 5'-terminus of this base sequence : 33820
cagtggactaatacattgacattatataaccttaagaaacaatgacattgtataaccttaagaaaaaagtctgaactttatttatttatttatttatttatttatttttatttttttgagatggagtcttgctctgtcacccaggctgcagtgcagtggctagatgtcagctcactgcagcctccacctcccgggttcaagcaattctgctgccgcagcctcccgagtagctgtactacaggcttgcaccaccatacgtggctaatttttgtacttttagtagagacagggtttcaccatgttggccaggatggtcttgatctcctgacctcgtgatccacctgcctcagcctcccaaagtcctgggattacaggcatgagctaccgcgccaggccagtctgaaccttagtaagacattca

SEQ ID NO: 11663 - DNA, 415 bp, Homo sapiens
  AC006381.2_90689
  Located on chromosome 7
  Distance between a terminus base of telomere on chromosomal short arm and 5'-terminus of this base sequence : 21216970
  Distance between 3'-terminus of neighbour sequence of sequence listing upward to telomere on chrosomal short arm and 5'-terminus of this base sequence : 6689
ttagctatagtgcttatggcctacaattttggttagttctgccactgagagattaattttctgccattggatattcctcaataccagttgtctgtcatatttcccaatttgctgaaggctaacaatgagggtgtgtgtgtgtgtgtgtgtgtgtgtgtgtgtgtgtgcaggacaggtaagggagaaaggatttcattgagagtgagttcttcaccagactgaaggatgctgaatactgctgagtatgatctccttgccctggtaataattcctttagggttctagggaagaagtatatggcaccagaaacaagcctttgggtttagatcattgttcagtttgataacttgggagttgggacttctgactgtgattaactggttggtgcacactgaagtctatctttagcatgctt

SEQ ID NO: 11664 - DNA, 105 bp, Homo sapiens
  D7S2559
  Located on chromosome 7
  Distance between a terminus base of telomere on chromosomal short arm and 5'-terminus of this base sequence : 21243459
  Distance between 3'-terminus of neighbour sequence of sequence listing upward to telomere on chrosomal short arm and 5'-terminus of this base sequence : 26074
cctttgaatatccgtcttacaaggtttaccttgcaacaaatgcacatgcgcgcgcacacacacacacacacacacacacacactaagtgttcgtgagacccatgt

SEQ ID NO: 11665 - DNA, 333 bp, Homo sapiens
  AC006381.2_64284
  Located on chromosome 7
  Distance between a terminus base of telomere on chromosomal short arm and 5'-terminus of this base sequence : 21243474
  Distance between 3'-terminus of neighbour sequence of sequence listing upward to telomere on chrosomal short arm and 5'-terminus of this base sequence : -90
cttacaaggtttaccttgcaacaaatgcacatgcgcgcgcacacacacacacacacacacacacacactaagtgttcgtgagacccatgtacttggctccaattggcaatagagtcaaagcagatgctacacagatctttgctatatttgttatagccatgtcatcataaatttattcctattacttctctaatatatgttagtagatacaaaagcctaaagtcttacgttttaagtggttattggtatcacttttataaagtctataaacttatacacgagggccacagctcatatctgattgcttatgtgctagcaatttcagtatagcat

SEQ ID NO: 11666 - DNA, 464 bp, Homo sapiens
  AC006381.2_4652
  Located on chromosome 7
  Distance between a terminus base of telomere on chromosomal short arm and 5'-terminus of this base sequence : 21302835
  Distance between 3'-terminus of neighbour sequence of sequence listing upward to telomere on chrosomal short arm and 5'-terminus of this base sequence : 59028
atagtgaaatagcaggtttgtaagtccttttaagacgttagaacacatttctattaattaatgcagagctttcaatactttgtgtttagggcatactatctaaatgtatttggtttatttgttgaatttgtaatatattcacatttttccaattttaaagatgtaagagtagatacagccaaaagtttatctcctagatctctcatcctaaacacatagttaccctcctgtatcaaccagggttcaacaaagaagcagttggaggtagtagtatacatttttctttctatctatctatctatctatctatctatctatctatctatctatctatctatcggcttacctgattgtggggtctggctaagcaagtccagaatctgcagggcagccagtcaggaagagtgagattatgggcagtctcaaacccacaggtggaggcttaagctattagcctgtacagc

SEQ ID NO: 11667 - DNA, 148 bp, Homo sapiens
  D7S503
  Located on chromosome 7
  Distance between a terminus base of telomere on chromosomal short arm and 5'-terminus of this base sequence : 21331820
  Distance between 3'-terminus of neighbour sequence of sequence listing upward to telomere on chrosomal short arm and 5'-terminus of this base sequence : 28521
gtccctgaaaacctttaatcaggatacagacatgtgtgtttgtctgtgtgtgtgtgtgtgtgtgtgtgtgtgtgtgttgtagtcaaccctcacctgccacagtttgttcatggccatacatttatgccctgctcccattactccaagt

SEQ ID NO: 11668 - DNA, 148 bp, Homo sapiens
  D7S815
  Located on chromosome 7
  Distance between a terminus base of telomere on chromosomal short arm and 5'-terminus of this base sequence : 21487348
  Distance between 3'-terminus of neighbour sequence of sequence listing upward to telomere on chrosomal short arm and 5'-terminus of this base sequence : 155380
gtattactcaggattctccagagaaacagaaataataagatagatagatagagatagatagataattagatagatagatagatagatacactagatagaaagagtaagatataatatgagggagtggcttgcctaattatggagtctg

SEQ ID NO: 11669 - DNA, 366 bp, Homo sapiens
  AC004940.1_38111
  Located on chromosome 7
  Distance between a terminus base of telomere on chromosomal short arm and 5'-terminus of this base sequence : 21585329
  Distance between 3'-terminus of neighbour sequence of sequence listing upward to telomere on chrosomal short arm and 5'-terminus of this base sequence : 97833
acaaattgaactttatcataggcatgtatgtataggaaaatacatagtatatgtatatatatatatatatatatatatatagggtttggcagtatccacaatttcaggcattcactgggagctttggaatatatccctcatggggactactgtatttttataatatttactaactcaattgctgactaattcataataaaaaccattgttcatctgctccccgtcccatatacatacctgttttatgtgttttttgggtttggtgtttaaaagactaaactaaatcttactaaggtagagttccttaggttctttgagaaatgtattaaatattttatgaaagtaacgtcatagtgacttccagat

SEQ ID NO: 11670 - DNA, 417 bp, Homo sapiens
  AC004940.1_33734
  Located on chromosome 7
  Distance between a terminus base of telomere on chromosomal short arm and 5'-terminus of this base sequence : 21589675
  Distance between 3'-terminus of neighbour sequence of sequence listing upward to telomere on chrosomal short arm and 5'-terminus of this base sequence : 3980
gagattgcagtgagctgagatggtgccactgcactccagcctgggcaacagtgcgagactctgtctgtaaataaataaataaataaataaataaataaataaataaataaatggcttctgatatggtttggatgaatccccactcagatctcatcctgaattcccacttgttgtgggagggacctggtgagaggaaattgaatcataggggcaggtctttctcatgctgttctcatgatagtgaataagtctcatgaaatttgatggttatatagaaatgggagtttccctgcacaagctgtctctctctttgcctgctgccttctatgtaagatgttacttgctcctccttgccttccaccatgattgtgaggcctccccatctatatggaactgtaagttcaataaacagctttc

SEQ ID NO: 11671 - DNA, 322 bp, Homo sapiens
  AC004543.1_20566
  Located on chromosome 7
  Distance between a terminus base of telomere on chromosomal short arm and 5'-terminus of this base sequence : 21643708
  Distance between 3'-terminus of neighbour sequence of sequence listing upward to telomere on chrosomal short arm and 5'-terminus of this base sequence : 53616
aaaggttatttcgtggttcaacacacaaaatgcacataaaaagcatttcatagttttcttgatattgtgctgatgattgtgtttttcttacatcatatcctggctcaactcataaggatgcctcctttgttatgtgcttcgtttcatttgagatcccacttttctagtggttcctactatatatatatatatatatatatatatatatatatatatatatatataaattatctctgtaaaatggagaaagcttatcaagttggaaagcttgcctgaaagcactgtttttcaaatttggctgcatattagctttcataattcc

SEQ ID NO: 11672 - DNA, 224 bp, Homo sapiens
  AC004543.1_56552
  Located on chromosome 7
  Distance between a terminus base of telomere on chromosomal short arm and 5'-terminus of this base sequence : 21679839
  Distance between 3'-terminus of neighbour sequence of sequence listing upward to telomere on chrosomal short arm and 5'-terminus of this base sequence : 35809
agccatttaatttggtcttaagcccaagtaagaaacaaaacaaaacaaaacaaaacaaaacagaaaacgaataaaggacaatataaagaagcatagcttgtcagcatgaacctacatgcaagccagagatctatgattttgtttcccagggagggagtgactaatgcgcgcaccctgaccatcaccgtaaagaggtaaagagagagtgaaatggctcaacgtac

SEQ ID NO: 11673 - DNA, 308 bp, Homo sapiens
  AC004543.1_116196
  Located on chromosome 7
  Distance between a terminus base of telomere on chromosomal short arm and 5'-terminus of this base sequence : 21739411
  Distance between 3'-terminus of neighbour sequence of sequence listing upward to telomere on chrosomal short arm and 5'-terminus of this base sequence : 59348
gagcttagatggtttagcaaatacgtagatatcattaccttgagtcagtgcttccacaccaggatgattaccatccctcctcccacccataatcaaacacacagacacacacacacacacacacacacacacacacacacacgaggcatttggcaatgccaggagaaatttttggttgtcacaaatgaggagtgtgccactggcacactctaaacaccccataatgcacaggacagcctgagaatgttaatcatgccaaggttgagaaattgtgccctaaataagttcttgcctatttcaggatactt

SEQ ID NO: 11674 - DNA, 186 bp, Homo sapiens
  AC004543.1_117684
  Located on chromosome 7
  Distance between a terminus base of telomere on chromosomal short arm and 5'-terminus of this base sequence : 21740952
  Distance between 3'-terminus of neighbour sequence of sequence listing upward to telomere on chrosomal short arm and 5'-terminus of this base sequence : 1233
ttctgaggatatgaatgtggacatctttggagggtccttattgtatctaacgtgtgtgtgtgtgtgtgtgtgtgtacactaaataaaatcagtagccttcactgtttgtcttatatatatagaatgtataagccttacaaatttggttatttgagaaacaggttgagattctgagatttaaaggag

SEQ ID NO: 11675 - DNA, 407 bp, Homo sapiens
  AC003990.1_12313
  Located on chromosome 7
  Distance between a terminus base of telomere on chromosomal short arm and 5'-terminus of this base sequence : 21757268
  Distance between 3'-terminus of neighbour sequence of sequence listing upward to telomere on chrosomal short arm and 5'-terminus of this base sequence : 16130
tccataaccagcaaatgtattcttcaaaaataaagatgaaataaagacattttcaaataaatgaaatctagaaaatttgtcaccaggaaaactgatctataagaaatgctaaaggaagtcctcctgggtgaagtgaattaaaactaaatgatacacatgaagggatgaacagagcatgaaacataatgtattggtaaatgtaaaacaaaatatctttttcccattaattttttaaaaatacaattattgaaagcaatatgtatatatatatatatatatatatatagagagagagagagagagagagagagagagcatgttgtgaagtatataacaaatgtaaatttcaattatatgtcaaaaatagcatttcctgtggtagagtatcaaatctaagtttactgcgg

SEQ ID NO: 11676 - DNA, 223 bp, Homo sapiens
  D7S654
  Located on chromosome 7
  Distance between a terminus base of telomere on chromosomal short arm and 5'-terminus of this base sequence : 21850582
  Distance between 3'-terminus of neighbour sequence of sequence listing upward to telomere on chrosomal short arm and 5'-terminus of this base sequence : 92907
ccactcactctgtggcattttcatgtcaaggttatgaggaattgtctagtggtgtgtgtgtgtgtgtgtgtgtgtgtgtgtgtgtgtgtgcatggggaaaaataatattttctaactctagggtcaacctgggtctgcctaaggatcatctctccatctccacctgccatggtgcgtaagatttactaactaactcatgttggacctggaaaatcaccagcaa

SEQ ID NO: 11677 - DNA, 273 bp, Homo sapiens
  AC005062.1_93091
  Located on chromosome 7
  Distance between a terminus base of telomere on chromosomal short arm and 5'-terminus of this base sequence : 21850607
  Distance between 3'-terminus of neighbour sequence of sequence listing upward to telomere on chrosomal short arm and 5'-terminus of this base sequence : -198
tcaaggttatgaggaattgtctagtggtgtgtgtgtgtgtgtgtgtgtgtgtgtgtgtgtgtgtgcatggggaaaaataatattttctaactctagggtcaacctgggtctgcctaaggatcatctctccatctccacctgccatggtgcgtaagatttactaactaactcatgttggacctggaaaatcaccagcaatttcattcatataaatcatctcagtgtttcatggggatggaaaggcagagtagtagatggtccaataattgatcc

SEQ ID NO: 11678 - DNA, 361 bp, Homo sapiens
  AC005062.1_90762
  Located on chromosome 7
  Distance between a terminus base of telomere on chromosomal short arm and 5'-terminus of this base sequence : 21852753
  Distance between 3'-terminus of neighbour sequence of sequence listing upward to telomere on chrosomal short arm and 5'-terminus of this base sequence : 1873
tgcagtcagcctttaaactaatattctaaaactttttttaaaaagtattgtttaaagttttatttcttaaaatctattatatacagttcatatatataaagtctataataaaatttatattatataaatttatatagtatatatactatatatagtatataaatatatataagtatatatatatactgtatatatagtatataaatttatatatatatatatatatatatatatatatatatatatatttaaaacactggagagtccccaaagacattcctgcctatttccccctctaaattctagactgtcaagtagctggtgagacagctaagcggtcagataagttgatgaaccattt

SEQ ID NO: 11679 - DNA, 372 bp, Homo sapiens
  AC005062.1_50343
  Located on chromosome 7
  Distance between a terminus base of telomere on chromosomal short arm and 5'-terminus of this base sequence : 21893301
  Distance between 3'-terminus of neighbour sequence of sequence listing upward to telomere on chrosomal short arm and 5'-terminus of this base sequence : 40187
tgtagaaccataagccaattaaacctctttcctttataaattacccagtttcaggtatttatttgtaacagtacaagaacgaactaatgcagacacacacacacacacacacacacacaaagatatatgtgtaagcatacataatgaaatacattgttgctattactttatgaacaaaatgttatctattagaccaactaagaataagaaaaataaaagcttttgtttaccttcatttattccttctctaatgctcttccttttttacgtagatatgtgtttctgacctatatcatttttcttcttttcaaataaataacttcttttaacaattcttgcaagacaagtctactggcaacaaatttattcaat

SEQ ID NO: 11680 - DNA, 249 bp, Homo sapiens
  AC007001.2_83214
  Located on chromosome 7
  Distance between a terminus base of telomere on chromosomal short arm and 5'-terminus of this base sequence : 21968641
  Distance between 3'-terminus of neighbour sequence of sequence listing upward to telomere on chrosomal short arm and 5'-terminus of this base sequence : 74968
ccaagaatagagtgctagcaaggtaagggctctctttctggcatgcagagaatcactatctcaatgtgttcacatggctcctccgtgtgtgtgtgtgtgtgtgtgtgtgtgtgtgtgtgtgtgtgttaaagaaagggaggtttgaaaaagtattcactagccagtgtggttaactatttgtagtaggactctttagaatagatgaaaatgttaagattttactaagatatttaccatgacgattggtaa

SEQ ID NO: 11681 - DNA, 178 bp, Homo sapiens
  D7S2551
  Located on chromosome 7
  Distance between a terminus base of telomere on chromosomal short arm and 5'-terminus of this base sequence : 22085751
  Distance between 3'-terminus of neighbour sequence of sequence listing upward to telomere on chrosomal short arm and 5'-terminus of this base sequence : 116861
aatttcacactattattgctgcccagaatgttaatcttatttcacacacacacacacacacacacacacacacacacactccagagaataattgattcaatttatgcctacattttatacaattctgtggtcatcattattcttatgttctatgcttttgtcctgaattaacaaggtt

SEQ ID NO: 11682 - DNA, 281 bp, Homo sapiens
  AC005083.1_109427
  Located on chromosome 7
  Distance between a terminus base of telomere on chromosomal short arm and 5'-terminus of this base sequence : 22088563
  Distance between 3'-terminus of neighbour sequence of sequence listing upward to telomere on chrosomal short arm and 5'-terminus of this base sequence : 2634
ataaatttgaatggcgatactaaaaactgttctaaggatgtatgtgctctgtgtgtgtgtgtgtgtgtgtgtgtgtataattaacatttacttataaagtaaaaattctcaatgtacacataaacatgaaagaaataggactgccagctaaaactatgttctaaaactgacctggacaatttgattccatatcaggttctaacaaaacttttagtgataaaaatcttacattatataaataatatgtattacaaagaaaaatggagtctttgtaacaagca

SEQ ID NO: 11683 - DNA, 329 bp, Homo sapiens
  AC005083.1_75417
  Located on chromosome 7
  Distance between a terminus base of telomere on chromosomal short arm and 5'-terminus of this base sequence : 22122397
  Distance between 3'-terminus of neighbour sequence of sequence listing upward to telomere on chrosomal short arm and 5'-terminus of this base sequence : 33553
gctgtacgtgagatactttcatgaccttttcctgcccatctcaactctgcacatttttccaggcctgcttaaagttccaccacctcccacaatgtcctcttgaaattcagggcactgtgactgccccttcctctggcagcctgggtacgcgtctcttctgtgttttaggaagtcactccactctgcttctgaatgactcatatacatctcaagtttatttatttatttatttatttatttatttatttatttggtctccagtaattatagttgaaagaaaggtttttgaaggtgtctttttaatcccctgatactgagcatcacacttt

SEQ ID NO: 11684 - DNA, 268 bp, Homo sapiens
  AC005083.1_53908
  Located on chromosome 7
  Distance between a terminus base of telomere on chromosomal short arm and 5'-terminus of this base sequence : 22144019
  Distance between 3'-terminus of neighbour sequence of sequence listing upward to telomere on chrosomal short arm and 5'-terminus of this base sequence : 21293
cagaccgtacaacttagctgagctcctcattctctgctcagcaaataaccatattttcagccctgagcagcatatatgtgtgatgtgtgttatgtgtgtgtgtgtgtgtgtgtgtgtgtgtgtgtgtgtgtgtgtgtgtattatttaattttcctattggattatctgtttatttgtctactatatttccccagtagtttcttaggagcaggaaccctagctttttcaccatggcatccccactgtctagaattctacctgccataaa

SEQ ID NO: 11685 - DNA, 380 bp, Homo sapiens
  chr7.fa.O7frz.22471904
  Located on chromosome 7
  Distance between a terminus base of telomere on chromosomal short arm and 5'-terminus of this base sequence : 22402621
  Distance between 3'-terminus of neighbour sequence of sequence listing upward to telomere on chrosomal short arm and 5'-terminus of this base sequence : 258334
aggataggagttcaagaccagcctggtcaacatggtaaaaccctgtctctactaaaaatacaaaaattagctgagtgtggtggaaggcacctgtaatcccagttactcaggaggctgagggaaagagaatcacttgaacctgggaggcggaggttgcagtgagccgagattgaaccagggtgacagagcgagactctatctcaaaaataaataaataaataaataaataaataaataaataaataataaaataaaatttgattcccagtgttggaggtgtggcctaatgggaggtgtttgcctcagaggggtagatgcctcatgaatggtggtgtccttgtggtaatgagcaagttctcactctatttgtttctgctaga

SEQ ID NO: 11686 - DNA, 135 bp, Homo sapiens
  D7S2458
  Located on chromosome 7
  Distance between a terminus base of telomere on chromosomal short arm and 5'-terminus of this base sequence : 22495403
  Distance between 3'-terminus of neighbour sequence of sequence listing upward to telomere on chrosomal short arm and 5'-terminus of this base sequence : 92402
ctaacatgactttgagtgttggttccaaatggaatgaaatcttaacatgggaaaacattgtgtgtgtgtgtgtgtgtgtgtgtgtgtgtgtgtgtgttttgttttgtgactgccttccctggaggtatgtggatt

SEQ ID NO: 11687 - DNA, 197 bp, Homo sapiens
  D7S2510
  Located on chromosome 7
  Distance between a terminus base of telomere on chromosomal short arm and 5'-terminus of this base sequence : 22581833
  Distance between 3'-terminus of neighbour sequence of sequence listing upward to telomere on chrosomal short arm and 5'-terminus of this base sequence : 86295
gactcagtttatcacagcaaacaggtagtttaatctgtttggaaactacacacacacacacacacacacacacacgcacgcacgcacacacacaccccaacaaacagaggaccaattaaatgagaagacacaaaatggagatatttgcaactgattccaatctttcttttaagctgcctaccttagtctgtgggaca

SEQ ID NO: 11688 - DNA, 290 bp, Homo sapiens
  chr7.fa.O7frz.22864561
  Located on chromosome 7
  Distance between a terminus base of telomere on chromosomal short arm and 5'-terminus of this base sequence : 22737793
  Distance between 3'-terminus of neighbour sequence of sequence listing upward to telomere on chrosomal short arm and 5'-terminus of this base sequence : 155763
tccagcaaatgtaccttttacaaaatttaaacacattctgttttaatgtgtgtaaatacttttcagtgcaacccaggaaagacaaagttctcacttatccaatcaaaataaataaggaaacagatgcagcagaggaaaagcaagtataacacttgcatgttttccattattactaaagggggctgtgctgctcgtgaatgagagagagagagagacagagagagagaagctgtgggtctagtttgtcagtgattagagaaagaaaataaagaaactcttactggaatcag

SEQ ID NO: 11689 - DNA, 350 bp, Homo sapiens
  AC002480.1_25667
  Located on chromosome 7
  Distance between a terminus base of telomere on chromosomal short arm and 5'-terminus of this base sequence : 22994336
  Distance between 3'-terminus of neighbour sequence of sequence listing upward to telomere on chrosomal short arm and 5'-terminus of this base sequence : 256253
ctttcaggttaatactggaatgagttaagactttaagactgttgggaaggaatggttggttttgaaacttgaaagggacatgaaattttggaggggccaggggtgaaataatatggtttgtctctgtgtccccacaaaaatctcatttcaaattgtaatcctcaggtgtcaagggaggaacctggtgggaagtgattggatcatggaggtggtttcccccatgctgttctcatgatagtgagtgagttctcataagagctgatggttttaaagtgtggcatttcctggttcgttctctctctctctctctctctctgtctcacctgctatgtaagatacgccttgtcttc

SEQ ID NO: 11690 - DNA, 342 bp, Homo sapiens
  AC002480.1_75686
  Located on chromosome 7
  Distance between a terminus base of telomere on chromosomal short arm and 5'-terminus of this base sequence : 23044534
  Distance between 3'-terminus of neighbour sequence of sequence listing upward to telomere on chrosomal short arm and 5'-terminus of this base sequence : 49848
ggtaaccactgagcatctgtaccctttagtatcttcattttgattataataaatgagttacgaatctatatctggggccctagttatatatttgccatatgttcacaccacatgcacacacacacacacacacacacacacacacacacactcacatatatggtgactaagactaagagtcagcctaaaagaagaatgatttggagcgggagctcttggagggaatggtaggaaaataacagggatccactcagtctcattttctactaaatttcaataatgagaagtgtgctcagcaaatgtttgttgactatatgaataaatgaaatggtgcatttaacc

SEQ ID NO: 11691 - DNA, 340 bp, Homo sapiens
  AC002480.1_91581
  Located on chromosome 7
  Distance between a terminus base of telomere on chromosomal short arm and 5'-terminus of this base sequence : 23060355
  Distance between 3'-terminus of neighbour sequence of sequence listing upward to telomere on chrosomal short arm and 5'-terminus of this base sequence : 15479
cactcagctgcagaaccttcctctaccctcaggccccatactgttgacatttctggaaagggagcccctttcagactgcattcctcccactagaggactctgtccttccccaattttctctctctctctctctctctctgtctctctctctctgtctctctctgtctctctctctgtctctctctctgtctctctctctctctctctctctctctctcccctctctcccctctctcccctctctacccagtgcagctcctctcctgggcccctctcctcccaatcacctgcatgattaccaattaccagccctccagtttacttccattaaggattccat

SEQ ID NO: 11692 - DNA, 218 bp, Homo sapiens
  D7S1810
  Located on chromosome 7
  Distance between a terminus base of telomere on chromosomal short arm and 5'-terminus of this base sequence : 23141650
  Distance between 3'-terminus of neighbour sequence of sequence listing upward to telomere on chrosomal short arm and 5'-terminus of this base sequence : 80955
ccacctgttaagtggaggtggagggggtaggggaggcttccctgaggaagtgagacctgaaggaagaagaggaatagtcaagaaagccagtccacagccctgcagtgggaaagaaggaagtaatgaatgcatggatggatggatggatggatggatggatggatggatggatggatgaaaaaatgaatgattgaataaacgaaaggacagaccaatga

SEQ ID NO: 11693 - DNA, 161 bp, Homo sapiens
  AC002480.1_184880
  Located on chromosome 7
  Distance between a terminus base of telomere on chromosomal short arm and 5'-terminus of this base sequence : 23153803
  Distance between 3'-terminus of neighbour sequence of sequence listing upward to telomere on chrosomal short arm and 5'-terminus of this base sequence : 11935
gaaataccatgagcttgtgaatgatcgtgtgtgtgtgactgtgtgtgtgtgtgtgtgtgtgtgtgtgtgtgtgtgtacacatattcagcttcccctaacttaatttctgtctcagtggtgctgggagaagaaatcagttatttgacaattacgataggtca

SEQ ID NO: 11694 - DNA, 259 bp, Homo sapiens
  D7S629
  Located on chromosome 7
  Distance between a terminus base of telomere on chromosomal short arm and 5'-terminus of this base sequence : 23247096
  Distance between 3'-terminus of neighbour sequence of sequence listing upward to telomere on chrosomal short arm and 5'-terminus of this base sequence : 93132
atttctgattcaaaatgccgaatacacagttttcgagtttaaagaagtaaatcctcagttctccaaagaattcatccatctggacaattttagtcccaagtgaatcatttctacatgacagcagaacacaaaattgataggattcagatattataattagacagactaagcattaagacacacacacacacacacacacacacacacacacacatgcacgcacatatactttcccacagaaatccttgggtataacatt

SEQ ID NO: 11695 - DNA, 391 bp, Homo sapiens
  chr7.fa.O7frz.23806442
  Located on chromosome 7
  Distance between a terminus base of telomere on chromosomal short arm and 5'-terminus of this base sequence : 23278645
  Distance between 3'-terminus of neighbour sequence of sequence listing upward to telomere on chrosomal short arm and 5'-terminus of this base sequence : 31290
ctcaaggaagcttattttgaactatttatggcctttaataattgagtaaggtaaactcctgtgaacaaaatttggagcatctctctctctctctctctctctctctctctctctctgcctggcttctccagaatttagaaactagttgtgagtattcttaacttatggcaatatagttatttgcatcagtgcaataagaatcccttttcttttgcaacatgacacaattgtagaaactggttgtcttaccaaggctttgactggaagggtgtgcttccctttaaggagtgaagctcaactggtagagccaataaaagccccttgggaaaactggcctcacaccttgtctacacagtccctgtacagggttcctgacttgtgataagtaaag

SEQ ID NO: 11696 - DNA, 180 bp, Homo sapiens
  HUMUT5947
  Located on chromosome 7
  Distance between a terminus base of telomere on chromosomal short arm and 5'-terminus of this base sequence : 23300834
  Distance between 3'-terminus of neighbour sequence of sequence listing upward to telomere on chrosomal short arm and 5'-terminus of this base sequence : 21798
tccaattttccctctaaacttcatatcccggaaaaagaaaaagaaagaaagggaaagagaaaagaaggaagggaggaaggaagggagggagggagggaggaagggaggaaggaaggaaggaaggaaggaaggaaggaattaaaagaaaagaaaacctccagtactgaatcatggcctagc

SEQ ID NO: 11697 - DNA, 324 bp, Homo sapiens
  AC006039.2_22191
  Located on chromosome 7
  Distance between a terminus base of telomere on chromosomal short arm and 5'-terminus of this base sequence : 23463472
  Distance between 3'-terminus of neighbour sequence of sequence listing upward to telomere on chrosomal short arm and 5'-terminus of this base sequence : 162458
taaagaatggatagctgtcgacatttgcttttgcatattttacttcatcattaacataagaatgccctagaagaaatagcattcaactgttaaacttgactatttccatcaatctgccaaaaaaaagccgtgataacagactattttaatcacaaagataacacaagcaggaaacacacacacacacacacacacacacacacacacacacaagatttaatcaaagttttttgttttgttttgttttctttcagagacaaaagtctcattctgtcaccagactggacagcagtggtgccaccatagctcactgcaactttgaat

SEQ ID NO: 11698 - DNA, 278 bp, Homo sapiens
  D7S682
  Located on chromosome 7
  Distance between a terminus base of telomere on chromosomal short arm and 5'-terminus of this base sequence : 23519187
  Distance between 3'-terminus of neighbour sequence of sequence listing upward to telomere on chrosomal short arm and 5'-terminus of this base sequence : 55391
gtatcgccggtgaaacagttcaggcataaattggacagagtctgaaaggtctctgattccattttgttttgtatttgaatgagaagtagcaaatatatatatgcactccagcctgggcgacagatatatctatatctatatctatatatgtccctggctgggaaagaggagaatggaatctagattgtgtgtgtgtgtgagtgtgtgtgtgtgtgtgtgtgtgtgtgtgtgtgtatccgtatgagatatatctcaaaatccgtatgagatacaagaaa

SEQ ID NO: 11699 - DNA, 380 bp, Homo sapiens
  AC006039.2_92177
  Located on chromosome 7
  Distance between a terminus base of telomere on chromosomal short arm and 5'-terminus of this base sequence : 23533371
  Distance between 3'-terminus of neighbour sequence of sequence listing upward to telomere on chrosomal short arm and 5'-terminus of this base sequence : 13906
ctactgagcaggtctaaccttagccatcagaaaaaataataataattataggacaagattatagccataactgttcctattattcaggttaaaatatatggtttttgtctgatgcaattcaatgagcttggtttgtgtctaaggaaaagactctgccctatgtgaagaaaaaagaaagaaagaaaaagaaagaaagaaagagagaaagaaagagagaaagaaaaaagaaagaaagagaaagaaagaaagaaaaaagaaagagaaagaaagaaagaaagaaagaaagaaaagaaaagaaaagaaaagaaagaaagaaaaaatcaaaggaagtgaatctttgccccctcattagagtcctaccttgtacttatcttgctcag

SEQ ID NO: 11700 - DNA, 405 bp, Homo sapiens
  AC006039.2_108273
  Located on chromosome 7
  Distance between a terminus base of telomere on chromosomal short arm and 5'-terminus of this base sequence : 23549556
  Distance between 3'-terminus of neighbour sequence of sequence listing upward to telomere on chrosomal short arm and 5'-terminus of this base sequence : 15805
agtgttacagtgccgtaaagttagaggttaccctgaaggatttgatcaggtggtatgttttataagctttagataaattaacaccgaagatgttatagttttattgccctgtagaatgttagccaattttatatctaaattagcaaatattttcttttgcttactgtatacgtgtgtgtgtgtgtgtgtgtgtgtgtgtgtgtgcatttggaaaagccaattcttttgtctagttgtctaatttccagttccctcactagtggcttaaaaaaaactttgacacactataatgaataactttgttcagagattttgcttttcaagttttgtattttttttcccacacattatctgagataactaccttcagtccataaagactaacaagttcacaggtacttgatc

SEQ ID NO: 11701 - DNA, 450 bp, Homo sapiens
  chr7.fa.O7frz.23646837
  Located on chromosome 7
  Distance between a terminus base of telomere on chromosomal short arm and 5'-terminus of this base sequence : 23757877
  Distance between 3'-terminus of neighbour sequence of sequence listing upward to telomere on chrosomal short arm and 5'-terminus of this base sequence : 207916
ataagaatactcagagcagtaggaggaataacccaaatgtccatcaacagcagaatgggtaaatcggttgtgatatgcaatggaatgtgttttgttttgttttgttttgttttgagacagagtctcgctctgtcacccagactagagtgcagtggtgccatctcagctcactgcaaactccacctgccgggttcaagtgattctcctgcctcagcctcccaagtagctgaaattacaggcatgcaccaccacgcctggctaatttttgtatttttagtagagatggggttttaccatgttggccaggctggtctcgaactcctgacctcaaataatctgcctgcctcagctcccaaagtgctgggattacaggcacccaggtgatatgcaatggactatgaagccatattctagtaaaaacgaatgagatgatagctataagcaccaaga

SEQ ID NO: 11702 - DNA, 409 bp, Homo sapiens
  AC023105.6_97726
  Located on chromosome 7
  Distance between a terminus base of telomere on chromosomal short arm and 5'-terminus of this base sequence : 24064906
  Distance between 3'-terminus of neighbour sequence of sequence listing upward to telomere on chrosomal short arm and 5'-terminus of this base sequence : 306579
ggattaaaggtgtgaactatcatgcctggccattcactatttatttatttatttatttatttatttatttatttatttattgagacggagtctctgtcacccaggctggagtgcagtggcgcgatctcggctcactgcaagctccgcctcccgggttcacgccattctcctgcctcagcctcccgagtagctgggattacaggcgcacgctgccatgcctggctaattttttgtatttttagtagagacggggtttcaccgtgttagccaggatggtctcaatcttctgacctcgtgatctgcccgccttggcctcccaaagtgctgggattacaggcgtgagccgccgcgcccggcccaatgtatttattgagtgccactacaagtgtttggaaacagtgaatagtga

SEQ ID NO: 11703 - DNA, 248 bp, Homo sapiens
  D7S2463
  Located on chromosome 7
  Distance between a terminus base of telomere on chromosomal short arm and 5'-terminus of this base sequence : 24080469
  Distance between 3'-terminus of neighbour sequence of sequence listing upward to telomere on chrosomal short arm and 5'-terminus of this base sequence : 15154
tggattgcatgttgtaaaggttggtactgagtttgcatgttagattctaagtgcagtgtgaaactgttgaaaggtttttaagcaggagaatgtgatatgcttgtgtgtgtgtgtgtgtgtgtgtgtgtgtgtgtgtgtgtgtgtggtaaaaaaatacataatctaaaatttatcattttaacatttaagtgtacagttcagtgacattaagtacgttcacatcatcatgcaaccatcactaccatcca

SEQ ID NO: 11704 - DNA, 118 bp, Homo sapiens
  D7S673
  Located on chromosome 7
  Distance between a terminus base of telomere on chromosomal short arm and 5'-terminus of this base sequence : 24339024
  Distance between 3'-terminus of neighbour sequence of sequence listing upward to telomere on chrosomal short arm and 5'-terminus of this base sequence : 258307
tcccagtcctgtggctacaggaagcaggcttttcttggagcttttgtgtgtgtgtgtgtgtgtgtgtgtgtgcctgtgtctgttggcatttctgggtggcagacttctcaaggacccc

SEQ ID NO: 11705 - DNA, 364 bp, Homo sapiens
  AC003087.1_71326
  Located on chromosome 7
  Distance between a terminus base of telomere on chromosomal short arm and 5'-terminus of this base sequence : 24360623
  Distance between 3'-terminus of neighbour sequence of sequence listing upward to telomere on chrosomal short arm and 5'-terminus of this base sequence : 21481
aaccagtgattgctcgaagacattttctaattccctctttaatttcttccttgacccagtggtcattcagcagcacgttgtttaatttccatgttgtgtgtgtgtgtgtgtgtgtgtgtgtgtgtgtgtgttgtttttgagctgggggtctcactctgttgcccaggctggagtgcagtggtgtgatctcatctcactgcaacttctgcctcatgggtacaagcaattctcctgcctcagcctcttgagtagctgagattataggtgtctgccaccacactcatctaatgtttgtatttttagtagagacgaggtttcaccatgtcagccaggctggtctcaaactcctgaccttaagtgatcc

SEQ ID NO: 11706 - DNA, 229 bp, Homo sapiens
  AC003087.1_8330
  Located on chromosome 7
  Distance between a terminus base of telomere on chromosomal short arm and 5'-terminus of this base sequence : 24423674
  Distance between 3'-terminus of neighbour sequence of sequence listing upward to telomere on chrosomal short arm and 5'-terminus of this base sequence : 62687
tcatacctcagagctatgcatctgttttgaccagcaggactactccctgatgcagtgtgtgtgtgtgtgtgtgtgtatgtgtgtgtgtaacattttctttttctctcaacttttttcctggaatgttgctgatactttctgatctgattttcagtctgactactggctccctttcccttttgcacaggtgcaagtctgaggttttcttcacctgacaattctttatcag

SEQ ID NO: 11707 - DNA, 429 bp, Homo sapiens
  AC009308.3_24905
  Located on chromosome 7
  Distance between a terminus base of telomere on chromosomal short arm and 5'-terminus of this base sequence : 24575828
  Distance between 3'-terminus of neighbour sequence of sequence listing upward to telomere on chrosomal short arm and 5'-terminus of this base sequence : 151925
ttactatgttagccagactggtcttgaactcttgacctcgtgatctgcctgccttggcctcccaaagttttgggattacaggtgtgagccaccgcgcccggctaagaattttcttaaaaagagcaaaattcccaaaccaagaaagaaacaataaaaataaataacaatgaacaacaacaacaacaataacaacaataaaaatagagaagattaacaaaatcaaaaattgttacattggaagaattaataagtaaatggatatggtacgttttatcaaagaaaatagaaagcagataaatttgaaatttagaatatataaggagaaataactacagaaagaacagaatagaaaatagtaacagaattaggggcaacgaaatcaacagagaagtgtagattgtttaataaatcatgttaggaaacttgatt

SEQ ID NO: 11708 - DNA, 200 bp, Homo sapiens
  AC009308.3_47901
  Located on chromosome 7
  Distance between a terminus base of telomere on chromosomal short arm and 5'-terminus of this base sequence : 24598923
  Distance between 3'-terminus of neighbour sequence of sequence listing upward to telomere on chrosomal short arm and 5'-terminus of this base sequence : 22666
tgaagtctcagctactcaggaggctgatggcaccactgcactgaatcctgggtgacagagtgagaccctgtctctctctctctctctctctctcacacacacacacacacacacacacacacacacacacacacacacacacgaaggaaggaaaagcatgatttgggtcccacttgggttggagaaggtcatagaatcat

SEQ ID NO: 11709 - DNA, 345 bp, Homo sapiens
  AC004485.1_171614
  Located on chromosome 7
  Distance between a terminus base of telomere on chromosomal short arm and 5'-terminus of this base sequence : 24672926
  Distance between 3'-terminus of neighbour sequence of sequence listing upward to telomere on chrosomal short arm and 5'-terminus of this base sequence : 73803
aaatgccgaatctctaaggtaggggtgtgtgtgtgtgtgtgtgtgtgtgtgtactgaatgtgagagacactggatacatgtggtctcatccgctgtggaggaggggaggcagcctggtcagcttcagttggagatattggtaatgcagacacgagatgtagagtcttttcctagaaaatcaataacctgcttgaagaggcctctccacagagatttgtctagagagagcacactggctttgtatgtgtgtgtgtgtttaaagtaagctgcaaaattctttgctatttttcccatttctgtgggaagaattgctatttttcccacttctgtggaagattcacagaa

SEQ ID NO: 11710 - DNA, 438 bp, Homo sapiens
  AC004485.1_127430
  Located on chromosome 7
  Distance between a terminus base of telomere on chromosomal short arm and 5'-terminus of this base sequence : 24716789
  Distance between 3'-terminus of neighbour sequence of sequence listing upward to telomere on chrosomal short arm and 5'-terminus of this base sequence : 43518
tttactgaaagttgagcagataacacagacagttttcatatggcctctgtctcccatgctcacaatttttcctattactaacattttgcatttgttacaattgatgaactaatactgatactttatattgactgaagtctgtagattacattaggattcactctttgccttgtaatgctctatgggtttttgacaaatgtgtaatgtcatatatccaccattacagtatcatacacaataatttcactgtcctaaaaattccctggctccactactcatcttttcttcctccaaatccctagctagcaactgctttttattttattttattttattttattttattttattttattttattttattttatttttttggcaaaatctattgttttgcttttaacagaatgttatatagttggaatcatagagcatgtag

SEQ ID NO: 11711 - DNA, 267 bp, Homo sapiens
  AC004485.1_69709
  Located on chromosome 7
  Distance between a terminus base of telomere on chromosomal short arm and 5'-terminus of this base sequence : 24774696
  Distance between 3'-terminus of neighbour sequence of sequence listing upward to telomere on chrosomal short arm and 5'-terminus of this base sequence : 57469
cttaggatattcagaaaggcagaaaatcttttgtttgacagggcttatggagctcctaactgtgtacaagcgctgatttaggtgttaaaggtagaacagtaaaaacacaggaaaggcttctgctctcatgaagccgatattctagtggaggtaaatagatgatagatagatagatagatagatagatgatagatagatagatagatagatagatagatagatagatgatagtgtaggtaaatagatggaggtaaatagatggtagat

SEQ ID NO: 11712 - DNA, 181 bp, Homo sapiens
  AC003044.1_15947
  Located on chromosome 7
  Distance between a terminus base of telomere on chromosomal short arm and 5'-terminus of this base sequence : 24861139
  Distance between 3'-terminus of neighbour sequence of sequence listing upward to telomere on chrosomal short arm and 5'-terminus of this base sequence : 86176
ccaagtttatgagtgcttcaaggacactgcaaaatccagacattttatgcaaatgtgtgtgtgtgtgtttatgtgtgtgtgtgtgtgtgtgtgtgatgtgcatgagggtatgcatttttctgggaagagttttcatccaagtctatgacccaatagaatgctaagaacaacttgctatttc

SEQ ID NO: 11713 - DNA, 470 bp, Homo sapiens
  AC003044.1_47571
  Located on chromosome 7
  Distance between a terminus base of telomere on chromosomal short arm and 5'-terminus of this base sequence : 24892614
  Distance between 3'-terminus of neighbour sequence of sequence listing upward to telomere on chrosomal short arm and 5'-terminus of this base sequence : 31294
caaatgttctcgaaagcaccaagcttaaaaatataatcttgactctgtgttcatattcaataaattctttcctatgagggtttgacaatcttatcatcagcaaatgtatccactccactcctgatctgcctcaaactggattgctttttacttactaacctagggtaaatgggaatatgttagactttgggtttgcagagtaactatagcttgtttgtttgttggttggttggttggttggttggttggttggtttgttcttggaggcaaggtcttgctctgtcaccgaggctggagtatcatggtacaatcatgcctcactgcagcctcgaacacctggactcaagtgattctcctgcctcagcctcaagtagctgggactacccacccccacacctggctaatacagctagttgtttattctagctttacttactgcatgagaagtagagtcaaagattgagcaagta

SEQ ID NO: 11714 - DNA, 231 bp, Homo sapiens
  D7S2444
  Located on chromosome 7
  Distance between a terminus base of telomere on chromosomal short arm and 5'-terminus of this base sequence : 24907882
  Distance between 3'-terminus of neighbour sequence of sequence listing upward to telomere on chrosomal short arm and 5'-terminus of this base sequence : 14798
ctcctggacttggagttgaatgtttacaaatcacaagtgagttcatcgagaaggtttaactttgtttaggagaaactcctggttctaccacacaaagcaaaataactcaggctgtgtgtgtgtgtgtgtgtgtgtgtgtgtgtgtgtgtcctcttaattgatctcttccccaggaaagatccaagatgtagaaaccatcttgtagtgacccagcattttctgagcacccaa

SEQ ID NO: 11715 - DNA, 235 bp, Homo sapiens
  AC002530.1_19857
  Located on chromosome 7
  Distance between a terminus base of telomere on chromosomal short arm and 5'-terminus of this base sequence : 24946098
  Distance between 3'-terminus of neighbour sequence of sequence listing upward to telomere on chrosomal short arm and 5'-terminus of this base sequence : 37985
tacaggaatacaaggcatgtacctgaaggcactcaatagatatttgtggaacgatgaatgaatgaatgaatgaatgaatgaatgaatgaatgaatgaatgaatggaataataagattctgagaatagcatttaaatttataaaagtaacaaagaggaaataaaaatactgaaagaattttattaagaaggagctatgggaggtgtgaacaatggaagtcatctaaatcgtcacct

SEQ ID NO: 11716 - DNA, 374 bp, Homo sapiens
  AC002530.1_61767
  Located on chromosome 7
  Distance between a terminus base of telomere on chromosomal short arm and 5'-terminus of this base sequence : 24987851
  Distance between 3'-terminus of neighbour sequence of sequence listing upward to telomere on chrosomal short arm and 5'-terminus of this base sequence : 41518
gaatttcaatgaagagacctagtaattggattctgtctgtcctgagttttcaatcatactccaaaatctgacttttctaaaatacataataccttccaattttgaaagagagctcaataaataatttcttaaaaatattatctttgcctcaataattccattcccagcgctttataatctgccttctttcctctcttccataagggaaggaggaaggaaggaaggaaggaaggaaggaaggaaggaaggaaggaaggaaggaaggaaagaaggaaagaaggaaagaaggaaacgtgttacacatatagatgggcttcaaacaataaagagattggttaagtcaagtgtactataccaacctgatgaacagttat

SEQ ID NO: 11717 - DNA, 154 bp, Homo sapiens
  D7S1838
  Located on chromosome 7
  Distance between a terminus base of telomere on chromosomal short arm and 5'-terminus of this base sequence : 24988012
  Distance between 3'-terminus of neighbour sequence of sequence listing upward to telomere on chrosomal short arm and 5'-terminus of this base sequence : -213
tcccagcgctttataatctgccttctttcctctcttccataagggaaggaggaaggaaggaaggaaggaaggaaggaaggaaggaaggaaggaaggaaggaaggaaagaaggaaagaaggaaagaaggaaacgtgttacacatatagatgggct

SEQ ID NO: 11718 - DNA, 397 bp, Homo sapiens
  AC002530.1_64562
  Located on chromosome 7
  Distance between a terminus base of telomere on chromosomal short arm and 5'-terminus of this base sequence : 24990740
  Distance between 3'-terminus of neighbour sequence of sequence listing upward to telomere on chrosomal short arm and 5'-terminus of this base sequence : 2574
ggtagcctaaattcatacaaagtggctcaggtctctaaagtcagagagaaagagggagagagatctgggtaggtaggtagattaattgattaaatcaatcaatagacttacgtaggtggatggatggatggatggatggatggatggatggatggatggatgacaaagtgacagacacactgtatcacatcttctaatatagtatcagaagtcacccaatctcacttccaccatattctactcattagaagaaaggtaccaaggacagcttacagtcaaacagagggaaagtagactctacttttatggaaatgtgtcaaagaatttgcaaaagtgtaaaaccaccacaattatacagttccttccccttcttgtttgctaatctaaatcttgtcat

SEQ ID NO: 11719 - DNA, 293 bp, Homo sapiens
  AC002530.1_108532
  Located on chromosome 7
  Distance between a terminus base of telomere on chromosomal short arm and 5'-terminus of this base sequence : 25034776
  Distance between 3'-terminus of neighbour sequence of sequence listing upward to telomere on chrosomal short arm and 5'-terminus of this base sequence : 43639
aacatagttcttaatcgctcgagacatttttcaagttgtcatgtgcgtgcgtgtgtgtgtgtgtgtgtgtgtgtgtgtgtttagcgatcctgtatgtaggtttcttttcttgtatttaataatacaatggcattctttgttttaccttgaaattacaaacaaacaatacacatcacaactgcaaaattcatttaacaacacagtggagcaaatgaatcacaggactgttgggagatggatttttaacttgctatggaagcacaaaacaagacgtgtctaagtcagcaggcttt

SEQ ID NO: 11720 - DNA, 473 bp, Homo sapiens
  AC005084.1_157904
  Located on chromosome 7
  Distance between a terminus base of telomere on chromosomal short arm and 5'-terminus of this base sequence : 25065442
  Distance between 3'-terminus of neighbour sequence of sequence listing upward to telomere on chrosomal short arm and 5'-terminus of this base sequence : 30373
gatggttaagacttctaattgaattgaaccttttatcattatgtaatgcccttctttgtcctttttgattgatgttggtttaaactctgttttgtctgatataagaatagcaacccctgctctttgttgttttccatttgcttgtctatgatttgtattgtattcaagatgtattaagaaaaagcagtttgcaaaatacaaaacatttctgtgggaaattaaagtgtgataccattagaggagaaagatagatggatggttatacagattgatagatgattagctagctacctagaagattagatagatagatagatagatagatagatagatagatagatagacagacagatagatagatagatatagatagatggatgataggagagagagagtcagatagatagatatgaatatgcatagcaaatatctggaaaaatttggtgttctactgtgacatttcacttatcatt

SEQ ID NO: 11721 - DNA, 449 bp, Homo sapiens
  AC005084.1_112275
  Located on chromosome 7
  Distance between a terminus base of telomere on chromosomal short arm and 5'-terminus of this base sequence : 25111165
  Distance between 3'-terminus of neighbour sequence of sequence listing upward to telomere on chrosomal short arm and 5'-terminus of this base sequence : 45250
gccagacatttgaaatcagtataattgggccaaaatcaaggtgtcaacagggacatttttcctccaaagaatctaagggagaacttacttgttgccttttccagtttctggtggcttctggcattccttggcttgcggctacacactgcagtcttcaaggctggcatttgaaatctttcagctctgtgtctttcatttccccacgtgtgtgtgtgtgtgtgtgtgtgtgtgtgtgtgtgtgtgtgtgtgtcagagagaaagggaaatctccctctgtgaaggacacttgtgaaggcatttagtgctctctggaataacctccccatcacaagatctttaatcacacctgtgaaactttccaaatgcggtgacattcataggtgtcaggaattaagacatagatatcttgtggagggggagactattattcagcctaccataatggtaat

SEQ ID NO: 11722 - DNA, 245 bp, Homo sapiens
  AC005084.1_54132
  Located on chromosome 7
  Distance between a terminus base of telomere on chromosomal short arm and 5'-terminus of this base sequence : 25169514
  Distance between 3'-terminus of neighbour sequence of sequence listing upward to telomere on chrosomal short arm and 5'-terminus of this base sequence : 57900
cctacctttgctgaatacacacacacacacacacacacacacactacttagaatatagtatccaacgcagaaaaaaaagcccttcaatagatgttaaggttctttccttcctttttttttcctttgaagctttctttttatactatgttaaaagaattggagtattacaaggttaaagatgctaaatcaggtagtggctttttattccagcaaatatttctatctaaacaattggcaattctagc

SEQ ID NO: 11723 - DNA, 446 bp, Homo sapiens
  AC005084.1_21320
  Located on chromosome 7
  Distance between a terminus base of telomere on chromosomal short arm and 5'-terminus of this base sequence : 25202231
  Distance between 3'-terminus of neighbour sequence of sequence listing upward to telomere on chrosomal short arm and 5'-terminus of this base sequence : 32472
attctagctaccttttctgcagcaattggaagcttatcttataatttatatagaaatgccagtaacttggccttgaggactactgccatctgttttgttttgttttgttttgttttgttttgttttgttttgttttgttgagatggagtcttgctctgttgcccaggctggagtgcaatggcatgatctcggctcactgcagcctccacctcctggattcaagccattctcctgcctcagcctccccagtagctgggattacaggcacccaccatcctgcctggctaattttttttgtatttttagtagagacttgctttcaccatgttggccaggctggtttcgaactcctgacctcaggtgatctgcctgccttagcctcccaaagtgctgggattacaggtgctatattaacagtattaattcttccagtctatgagcataga

SEQ ID NO: 11724 - DNA, 389 bp, Homo sapiens
  AC005084.1_2120
  Located on chromosome 7
  Distance between a terminus base of telomere on chromosomal short arm and 5'-terminus of this base sequence : 25221358
  Distance between 3'-terminus of neighbour sequence of sequence listing upward to telomere on chrosomal short arm and 5'-terminus of this base sequence : 18681
ctgaaacagtactccattatccagaaatcacaggctagagagccaataattttgtagtaatgaaccttaactaaacatgaaaaaggcaatcctgaagttttatgtacatagatagcagttcattttttaaatgttcgagttgccatatattatgtatgtgtgtgtgtgtgtgtatatatatatatatatatatatatatatatatatatatacagctatgtgtataatatgtaaaattctcccaaaatgtatgaatataaaactgaatgtattcattcatgtaattataactagcattctaaaatttttaattactcccatttctttgacattctgaaactttttttagattgttttaaaacgctctggttccaccttgaagctgataa

SEQ ID NO: 11725 - DNA, 319 bp, Homo sapiens
  AC003093.1_51427
  Located on chromosome 7
  Distance between a terminus base of telomere on chromosomal short arm and 5'-terminus of this base sequence : 25274973
  Distance between 3'-terminus of neighbour sequence of sequence listing upward to telomere on chrosomal short arm and 5'-terminus of this base sequence : 53226
ctggcactcagatggaaagccggcagccatgctgtgtgtgtgggcaagaaaacagggcagcacgtgtgtgtgtgtgtgtgtgtgtgtgtgtggaccgcgggcacacagtggaccagtgcagcacgtgtgtgtgtgtgtgtgtgtgtgtgtgtgtgtgtgtgtgtgtgtgtgtgtggaccacgggcacacagtggaccagtgaccagggctccactagaagcttttctctttcattggttttcaatcccaatacgtatagaaaggtgcacagaaaggactaatgaataaagttagcgcctgtttaaccactatccaggtg

SEQ ID NO: 11726 - DNA, 143 bp, Homo sapiens
  D7S2493
  Located on chromosome 7
  Distance between a terminus base of telomere on chromosomal short arm and 5'-terminus of this base sequence : 25384542
  Distance between 3'-terminus of neighbour sequence of sequence listing upward to telomere on chrosomal short arm and 5'-terminus of this base sequence : 109250
ctgaggttgtggcatttagtgatggacctgaaacatcttaacaaagtcacaacaatttgtacacacacacacgcacacacacacacacacacacacacacacacacacaaacacacacaatggtgctgcctctgccaacagaa

SEQ ID NO: 11727 - DNA, 314 bp, Homo sapiens
  AC004016.1_39145
  Located on chromosome 7
  Distance between a terminus base of telomere on chromosomal short arm and 5'-terminus of this base sequence : 25384554
  Distance between 3'-terminus of neighbour sequence of sequence listing upward to telomere on chrosomal short arm and 5'-terminus of this base sequence : -131
catttagtgatggacctgaaacatcttaacaaagtcacaacaatttgtacacacacacacgcacacacacacacacacacacacacacacacacacaaacacacacaatggtgctgcctctgccaacagaagatgggggtcaaatggaactaaaattttctaacgacgcctatgaaacacacttagctccttgctttaaacaatttaattgagcaaaataatgggcaggacaacagagtaatcaacagctggggctccaccatcagccctggattcttccccactccatcacctattaactccatgaccttgga

SEQ ID NO: 11728 - DNA, 231 bp, Homo sapiens
  AC004016.1_57091
  Located on chromosome 7
  Distance between a terminus base of telomere on chromosomal short arm and 5'-terminus of this base sequence : 25402519
  Distance between 3'-terminus of neighbour sequence of sequence listing upward to telomere on chrosomal short arm and 5'-terminus of this base sequence : 17651
cgttcagcactagacttcagtctgaattttaaccgaaagagagtgtgtgtgtgtgtgtgtgtgtgtgtgtgtgtgtgtgtggtgttgggggaaggaagttggtttaagaattggctgaacagtatgagacaatgcaaatcagtaaatatgacaacttgattgaaataattattttgttgaaaatcagcatccacaaattctaggtatttaaatgtactggaaatctggaag

SEQ ID NO: 11729 - DNA, 317 bp, Homo sapiens
  AC004016.1_102044
  Located on chromosome 7
  Distance between a terminus base of telomere on chromosomal short arm and 5'-terminus of this base sequence : 25447405
  Distance between 3'-terminus of neighbour sequence of sequence listing upward to telomere on chrosomal short arm and 5'-terminus of this base sequence : 44655
gattatcaggcaccatacagactgcgcaatacaagtaacagattttaaaaacccaaatattgatatcctggagcataggatatttgtaacatatatatatatttgtaacatatatatatatatatatatatatatttgtaacatatatatatatacacacacatatatatatatatacacacacacacacacacacttaaacagggagtttcatcaatttttttgtaactcctaatttaagctctcacttttgtggcagttcttagagaacagacacagtcagcttctatgttatgtatcagcagacatgacctttc

SEQ ID NO: 11730 - DNA, 292 bp, Homo sapiens
  AC004008.1_40557
  Located on chromosome 7
  Distance between a terminus base of telomere on chromosomal short arm and 5'-terminus of this base sequence : 25512105
  Distance between 3'-terminus of neighbour sequence of sequence listing upward to telomere on chrosomal short arm and 5'-terminus of this base sequence : 64383
cctttcctcgttcaagctattttctttctttttcttttgctctccaccttcagcctctccgcctgtttctttagcattggtttttctgtaggagacaagccttcaatccgaaaggaagtgatttgcatagggctttgttgtttagcatcccgttccgagctttttcattaatgtcttcctaatcaaataataatagagtgtacattctctctctctctctctctctctgtgtgtgtgtgtgtgtgtgtgtgtgtgtgtgtgtgtgtgtgtgtacttgaggcagttaattgga

SEQ ID NO: 11731 - DNA, 462 bp, Homo sapiens
  AC004694.1_46806
  Located on chromosome 7
  Distance between a terminus base of telomere on chromosomal short arm and 5'-terminus of this base sequence : 25614913
  Distance between 3'-terminus of neighbour sequence of sequence listing upward to telomere on chrosomal short arm and 5'-terminus of this base sequence : 102516
atttgaatcggtagactgagtaaagaagattaccctcaccgatatgggtgaacgtcatccaatccattaagggcatgaatagaacaaaaatgctgaggaaaggctgattcactgctgtttgaactgagatatccatcttctctggccctcagatattgctgctgcttcttgggcctttggacttgatctgagcttatcccattggctcccttagttctcaggcctttgtactcagatgaattacatcaccagctttcctgcttctgcagcttgcagacaacagatcatgagacttctcagccttcataaccatgtaagccaattcttgtactaaatctctgattagatagatagatagatagatagatagatagatagatagatagattcaattgattctgtttctttggagaacactgactaatacaggcattattgaaaggtcaaatacttatcattagg

SEQ ID NO: 11732 - DNA, 314 bp, Homo sapiens
  D7S1821
  Located on chromosome 7
  Distance between a terminus base of telomere on chromosomal short arm and 5'-terminus of this base sequence : 25615191
  Distance between 3'-terminus of neighbour sequence of sequence listing upward to telomere on chrosomal short arm and 5'-terminus of this base sequence : -184
aacagatcatgagacttctcagccttcataaccatgtaagccaattcttgtactaaatctctgattagatagatagatagatagatagatagatagatagatagatagattcaattgattctgtttctttggagaacactgactaatacaggcattattgaaaggtcaaatacttatcattaggatcccagaagaagttaaaaaactggggggagaaaaagatattaaaaagaaaatggctgaaaacttctcaaatctgatgaaaaacatacacttacagattcaaatatcttggtcatccccaaacagaatga

SEQ ID NO: 11733 - DNA, 176 bp, Homo sapiens
  D7S1791
  Located on chromosome 7
  Distance between a terminus base of telomere on chromosomal short arm and 5'-terminus of this base sequence : 25633135
  Distance between 3'-terminus of neighbour sequence of sequence listing upward to telomere on chrosomal short arm and 5'-terminus of this base sequence : 17630
ggtggcaggctaacttgttagcttccaagtagagtaaaacctcagaatctttattattattattattattattattattattattattattatatttttgagacagggtgtcactctgtcacccaggcaggctggagtgcaatggtgcaatcatagctcactgcattcttgaactc

SEQ ID NO: 11734 - DNA, 369 bp, Homo sapiens
  AC004129.1_2885
  Located on chromosome 7
  Distance between a terminus base of telomere on chromosomal short arm and 5'-terminus of this base sequence : 25657749
  Distance between 3'-terminus of neighbour sequence of sequence listing upward to telomere on chrosomal short arm and 5'-terminus of this base sequence : 24438
taacggatagcttacagatgaggaaattgaagctgagagagacagagtgctaataaggattgagaacttataataaatttagtcccagtgccttttctaccacatcacattatctgtttgtttgtttgtttgtttgtttgtttgtttgtttgtttctgtcttgtttcattttttatttttattttttgtagatacaggatctcactatgttgcccaggctggtcttgaactcccgacctcaagccatccttcctcctgggcatcccaaagtgctggaattacaagtgtgagccaccatgccgtgacacattatttgtttctaataagtgtgtaactcatacctactagttgaatcaattctttgacttg

SEQ ID NO: 11735 - DNA, 349 bp, Homo sapiens
  AC004129.1_28631
  Located on chromosome 7
  Distance between a terminus base of telomere on chromosomal short arm and 5'-terminus of this base sequence : 25683349
  Distance between 3'-terminus of neighbour sequence of sequence listing upward to telomere on chrosomal short arm and 5'-terminus of this base sequence : 25231
gcaatacagcctcaagataaagctccttgcttccctcgtggtcctattacaggcagcccgtcatccctagggccatcctgagcaaccagtccaccctggacatcattttcatcatgtcacatccctacccagaaatcttcaaaggtatgttgccttcaaagtccaaatacctcgtgcattattcaggatctctctctctctctctctctctctctctctctctctctctctctctctctcgcaaacacacacacacacaaacacacacacacacacacacacacacacacacacacacacacacacacacaccatagtctcaacctactcaagttctctacttcagcca

SEQ ID NO: 11736 - DNA, 279 bp, Homo sapiens
  AC004129.1_47472
  Located on chromosome 7
  Distance between a terminus base of telomere on chromosomal short arm and 5'-terminus of this base sequence : 25702292
  Distance between 3'-terminus of neighbour sequence of sequence listing upward to telomere on chrosomal short arm and 5'-terminus of this base sequence : 18594
aataacaggccaagaatcattcaataggcctggttctctcttctgtgccaggaagaaaacctagaatataaaggttcatcttctaccaacctttgaaattatgctctccaccctttcaagcctgagtctcacctcctcttctctccacccacacacatacacacacacacacacacacacacagtcattaactctggaagattggaagaataatagcagcagcgctagtgccaccagtaattaacattcactgggagcttactgagttgagcatttgct

SEQ ID NO: 11737 - DNA, 99 bp, Homo sapiens
  D7S2457
  Located on chromosome 7
  Distance between a terminus base of telomere on chromosomal short arm and 5'-terminus of this base sequence : 25702401
  Distance between 3'-terminus of neighbour sequence of sequence listing upward to telomere on chrosomal short arm and 5'-terminus of this base sequence : -170
accctttcaagcctgagtctcacctcctcttctctccacccacacacatacacacacacacacacacacacacagtcattaactctggaagattggaag

SEQ ID NO: 11738 - DNA, 169 bp, Homo sapiens
  DISD22_0004894
  Located on chromosome 7
  Distance between a terminus base of telomere on chromosomal short arm and 5'-terminus of this base sequence : 25911096
  Distance between 3'-terminus of neighbour sequence of sequence listing upward to telomere on chrosomal short arm and 5'-terminus of this base sequence : 208596
tctagtgttgctcaggattccgtgtgtgtgtgtgtgtgtgtgtgtgtgtgtgtgtgtgtctgtctgtctgtctgtatgtgtgtgtgtttgtgtggtgactctggagaggctgcaaaacttatgaatctaaactttgtaactggtttgtaggattatcccaacatcttcg

SEQ ID NO: 11739 - DNA, 318 bp, Homo sapiens
  AC003985.1_69555
  Located on chromosome 7
  Distance between a terminus base of telomere on chromosomal short arm and 5'-terminus of this base sequence : 26194189
  Distance between 3'-terminus of neighbour sequence of sequence listing upward to telomere on chrosomal short arm and 5'-terminus of this base sequence : 282924
gaatgtagcttagtttgaactgagagtagaacctggggaaaaagtaagggaaccagagtttttgagaatcaagtaagcattgagctttttacttgggtcaagaataagatgtctgtttatgtttcaactttacacaaacttatatacagcaactcctggagtgccctgaataacggtcccagtggagatgaccatcacaaaagccatccatgaacctgggggagttggggaggtggggggagggggcagagagagagagagagagagagagagagagagaattttttcacttttaaaattccagtagctttgcaaatt

SEQ ID NO: 11740 - DNA, 222 bp, Homo sapiens
  D7S529
  Located on chromosome 7
  Distance between a terminus base of telomere on chromosomal short arm and 5'-terminus of this base sequence : 26218484
  Distance between 3'-terminus of neighbour sequence of sequence listing upward to telomere on chrosomal short arm and 5'-terminus of this base sequence : 23977
ggtaccatcaccacaatcaagataatggacatattcaacacttgccaaagtttcctcattttttttgttttcgtcttaattgtgtgtgtgtgtgtgtgtgtgtgtgtgtgtgtgtatttggcaataacacttaacgtgagatcttaaactaacaaatcttaagtgcacaattccatatttttaactataagcactacattttacaggcgatgtctagaattt

SEQ ID NO: 11741 - DNA, 380 bp, Homo sapiens
  AC003985.1_7439
  Located on chromosome 7
  Distance between a terminus base of telomere on chromosomal short arm and 5'-terminus of this base sequence : 26256288
  Distance between 3'-terminus of neighbour sequence of sequence listing upward to telomere on chrosomal short arm and 5'-terminus of this base sequence : 37582
agtctccaaatggaggtctaaggcatcaaggtagggactttaattttttaaatattcccagcatctaaaaagtacttggcacatagtagatgttccataaatgtttgctgaattaattaattaaatactggcatatagaagaaaaaggcttgaaagtcactagcatggaagttttttattgaattcctaggagagaggaaagggaaagagagagcaaacagctctctggaatccagccacagaaaaacttcaattgtgtgtgtgtgtgtgtgtgtgtgtgtgtgtgtgtgtgtgtgtagtggaaggtgagctagcaaaggaagtcatggtctgctcagattgctagaagaagtagggtattgtcatgttacagatgtgga

SEQ ID NO: 11742 - DNA, 178 bp, Homo sapiens
  D7S2525
  Located on chromosome 7
  Distance between a terminus base of telomere on chromosomal short arm and 5'-terminus of this base sequence : 26324430
  Distance between 3'-terminus of neighbour sequence of sequence listing upward to telomere on chrosomal short arm and 5'-terminus of this base sequence : 67762
ttttccatcctgcctactaatttgatctttggttttattgattttgctacttaactcataggttgaattttcatagcaccaccacccccaaccacacacacacacacacacacacacacagaaagagagagagagattgagcatcattatccaaaatgcttgggaccagaggtgtgtt

SEQ ID NO: 11743 - DNA, 399 bp, Homo sapiens
  AC005100.2_114443
  Located on chromosome 7
  Distance between a terminus base of telomere on chromosomal short arm and 5'-terminus of this base sequence : 26377950
  Distance between 3'-terminus of neighbour sequence of sequence listing upward to telomere on chrosomal short arm and 5'-terminus of this base sequence : 53342
aggaagcatttagtctaaacctagccagaggggaatcatctcttctccagtcacaacctgagttcccacagccctgctaccatgggctaaagtgctctggggttctaaggaaactcaaaaggcagtctgggccacaaggactgcaatttcttcacaagtcatggtgctgtgctggactcggagcccggggacttgagggggcatgcaacctagtgagacaccagctggagtggctaagggagtgcttgccctactcctccttctaccccaggcagtgaagctcacagctctaggagagattccttacctccgcttgaggagaggagaggagaggagaggagaggagaggagaggagaggagaggaagagtaaagaggactttgtcttgcaacttaggta

SEQ ID NO: 11744 - DNA, 218 bp, Homo sapiens
  D7S2534
  Located on chromosome 7
  Distance between a terminus base of telomere on chromosomal short arm and 5'-terminus of this base sequence : 26421816
  Distance between 3'-terminus of neighbour sequence of sequence listing upward to telomere on chrosomal short arm and 5'-terminus of this base sequence : 43467
agctgtcctgttttacacagttttatgacttctaatctacttctatcagttattctgttttatggctgcaaatgataagataaattgggttctctttctctctctctctctctctctctgtgtgtgtgtgtgtgtgtgtgtgtatgtgtgtcagtgtcacagtttagaggactcatgacttgtctgtaaaccaaaactgatcattccacaaacccatg

SEQ ID NO: 11745 - DNA, 424 bp, Homo sapiens
  AC005165.1_1148
  Located on chromosome 7
  Distance between a terminus base of telomere on chromosomal short arm and 5'-terminus of this base sequence : 26536183
  Distance between 3'-terminus of neighbour sequence of sequence listing upward to telomere on chrosomal short arm and 5'-terminus of this base sequence : 114149
gatgacgaaatgtattagtactgaggaataactttctcccgtcttcttggaaaacatctggggtattaccctttcctccactcattcccccacctcttaccccaaagctgactctcagccgacagtttatcagcaataaatggaaacacctgtgtggcagataaggccaactgagtgtgatcagctgaggaaaccttagggacgcatgtcactcaatatttctttttccatgccaggcagggcagaggcacaatctagcctgtgacagatggcaaggttcactttctcattcattcattcattcattcattcattcagttagtcattcattcaaaacaacctcaggaggtcagcaggcccagctccctgcctgaaataggtcaatgcctgagccaccaggtgaattagaaggctattgatcctg

SEQ ID NO: 11746 - DNA, 232 bp, Homo sapiens
  AC005165.1_24418
  Located on chromosome 7
  Distance between a terminus base of telomere on chromosomal short arm and 5'-terminus of this base sequence : 26559710
  Distance between 3'-terminus of neighbour sequence of sequence listing upward to telomere on chrosomal short arm and 5'-terminus of this base sequence : 23103
accttcctgattcttccagtaggaattgatctctctctctctctctctctctctcccgaactgctacaggcccttgttgtctctgctcctttcgcgtgattcctctcacattgctttgtgttatgtttgctttccaaacaggctgtgctcccaaggagtgagttgtattttggattttctgtactacaaattttctggtatctcacagtacttagcattacacctcacatgt

SEQ ID NO: 11747 - DNA, 353 bp, Homo sapiens
  AC005165.1_55903
  Located on chromosome 7
  Distance between a terminus base of telomere on chromosomal short arm and 5'-terminus of this base sequence : 26591061
  Distance between 3'-terminus of neighbour sequence of sequence listing upward to telomere on chrosomal short arm and 5'-terminus of this base sequence : 31119
gagcaatcagtcattgttaaattccatccctgggaattgaaccaggcttggcttcttttcattcaaagtcttcttgcaggcggcctcctttggaaaagggaggccctgagcttctgatcccatggagggatttattatctgctgcagaggagtgagtgaatgagtgtgtgtgtgtgtgtgtgtgtgtgtgtgtgtgtgtgtgtgtggctatcaccgatggagcagttcctaaaggccagtccatgaattggccctgtcagaatctcccaggatgagtgacaaaaacaggcattcctagtccccagcccagacccacagaattatcctcaaggacaagatccagaattgtttga

SEQ ID NO: 11748 - DNA, 268 bp, Homo sapiens
  AC005165.1_100789
  Located on chromosome 7
  Distance between a terminus base of telomere on chromosomal short arm and 5'-terminus of this base sequence : 26636005
  Distance between 3'-terminus of neighbour sequence of sequence listing upward to telomere on chrosomal short arm and 5'-terminus of this base sequence : 44591
tgtgcttgtaactaagctaacagtgttattcccagtgtattactgggaatatacaaaagtcctatgtgtgtatcattaagcagatattatatatatggagcctgagtgtgtgtgtgtgtgtgtgtgtgtgtgtgtgcgcgcgtgcatttgggtagatttaatacattgaatcctctcaaaaaaagaccttggaagaatgcttctccaaccaacaaatgtttattgcctatctcctatgagattactagatgcttagagcaatcttgac

SEQ ID NO: 11749 - DNA, 201 bp, Homo sapiens
  AC005165.1_133242
  Located on chromosome 7
  Distance between a terminus base of telomere on chromosomal short arm and 5'-terminus of this base sequence : 26668434
  Distance between 3'-terminus of neighbour sequence of sequence listing upward to telomere on chrosomal short arm and 5'-terminus of this base sequence : 32161
agtgacttgcagacttgctataacatagatggatccccgggatagagcaaccatactattggctttgaaaataaagactcaaatataactatattatttagaaatatagaggtaaaaatgtaaacatacatatatatatatatatatatatatatatatgccaggcatggtggttcatatctgtaatctcggcctgtagtc

SEQ ID NO: 11750 - DNA, 382 bp, Homo sapiens
  AC004520.1_84155
  Located on chromosome 7
  Distance between a terminus base of telomere on chromosomal short arm and 5'-terminus of this base sequence : 26980311
  Distance between 3'-terminus of neighbour sequence of sequence listing upward to telomere on chrosomal short arm and 5'-terminus of this base sequence : 311676
ttgagtggtttcaactccttatctaatgattttaagtttttgtttaaatatttttttccagaatgaaataaaaaatacctcttctctctctaacacacacacacacacacacacacacacacaaagggtcttcaaaaagttcatagaggccaggcacggtggtgcacgtccgtaatcccagcagtttgggaggtcaaggcaggaggatcgcttgagcccagaagtttgagactagtctgggcaacatagggagggcctgtctctacaaaaacataaaacttagcctggcatggtggtatgttcctgtagtctcagctacttgggaagctgaggccgggggatcccttgaaccaaggagcttgaggctacagtgaactatgat

SEQ ID NO: 11751 - DNA, 134 bp, Homo sapiens
  D7S2538
  Located on chromosome 7
  Distance between a terminus base of telomere on chromosomal short arm and 5'-terminus of this base sequence : 26994798
  Distance between 3'-terminus of neighbour sequence of sequence listing upward to telomere on chrosomal short arm and 5'-terminus of this base sequence : 14105
gcaaaccaagtgtccatcaatggatgaatggataaacgaaatgtgttgtgatgtttgtgtgtgtgtgtgtgtgtgtgtgtgtgtataatggaatattattcagccttaagttaaatggatggacctgaggacat

SEQ ID NO: 11752 - DNA, 180 bp, Homo sapiens
  AC004520.1_69707
  Located on chromosome 7
  Distance between a terminus base of telomere on chromosomal short arm and 5'-terminus of this base sequence : 26994819
  Distance between 3'-terminus of neighbour sequence of sequence listing upward to telomere on chrosomal short arm and 5'-terminus of this base sequence : -113
ggatgaatggataaacgaaatgtgttgtgatgtttgtgtgtgtgtgtgtgtgtgtgtgtgtgtataatggaatattattcagccttaagttaaatggatggacctgaggacattatgctaagtaagataagtcagtcacaaaaggacaagtattttctatgaggtacctagaataggcaa

SEQ ID NO: 11753 - DNA, 171 bp, Homo sapiens
  AC004520.1_53153
  Located on chromosome 7
  Distance between a terminus base of telomere on chromosomal short arm and 5'-terminus of this base sequence : 27011303
  Distance between 3'-terminus of neighbour sequence of sequence listing upward to telomere on chrosomal short arm and 5'-terminus of this base sequence : 16304
gaggttactgtgaacaatggagattgctccattgcactccagcctgggcgacagagccagaacctgtctcgaaagaaaaaatatatgtatgtatagatacacacacacacacacacacacacacacacacacatacatatattccatagaaatagttcttatgtaggctgg

SEQ ID NO: 11754 - DNA, 406 bp, Homo sapiens
  chr7.fa.O7frz.26779244
  Located on chromosome 7
  Distance between a terminus base of telomere on chromosomal short arm and 5'-terminus of this base sequence : 27084537
  Distance between 3'-terminus of neighbour sequence of sequence listing upward to telomere on chrosomal short arm and 5'-terminus of this base sequence : 73063
catagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtg

SEQ ID NO: 11755 - DNA, 341 bp, Homo sapiens
  AC004540.1_99040
  Located on chromosome 7
  Distance between a terminus base of telomere on chromosomal short arm and 5'-terminus of this base sequence : 27342007
  Distance between 3'-terminus of neighbour sequence of sequence listing upward to telomere on chrosomal short arm and 5'-terminus of this base sequence : 257064
cagtgcaccatgatagcaccactgcactccagcctcggcaacacagggagaccagaagagagagagagagagagagagagagagagagagagggagagagagagagagagagagagagagagagagagagagagaaaaagaaagaaagaaagagaaggaaagaaaggaaggaaggaaggaaaaaggaagaaagaaagaggaaggaaggaaagaaagaaagaaagggaaaagaagggaaaatatcagagtgcatggtgaagggaagtattgttttgctaaggagttttgttttgttttgttcatggaacagctagttattgaatagctattctgtagcagac

SEQ ID NO: 11756 - DNA, 151 bp, Homo sapiens
  chr7.fa.O7frz.27144317
  Located on chromosome 7
  Distance between a terminus base of telomere on chromosomal short arm and 5'-terminus of this base sequence : 27448823
  Distance between 3'-terminus of neighbour sequence of sequence listing upward to telomere on chrosomal short arm and 5'-terminus of this base sequence : 106475
gtctgtcaaattatagctgcattggctgagagccattttatctctcagcgactccacatctcctggctccaacctattccatatatattgtatgtatgtatgtatgtatgtatgtatgtatgtatgtgatccattatgtttgattgtaaag

SEQ ID NO: 11757 - DNA, 188 bp, Homo sapiens
  D7S2440
  Located on chromosome 7
  Distance between a terminus base of telomere on chromosomal short arm and 5'-terminus of this base sequence : 27592103
  Distance between 3'-terminus of neighbour sequence of sequence listing upward to telomere on chrosomal short arm and 5'-terminus of this base sequence : 143129
caacctcagcactattgacgtttgggccagacaattctttgttgtgggggttgccctgtgcattgtaggtcgtttaacagcatccttggcccttacccaccacatatctgtaacacacacacacacacacacacacacacacacacacacacacatcccagttatgataaccaaaagtgtctccaggc

SEQ ID NO: 11758 - DNA, 353 bp, Homo sapiens
  AC003999.1_39622
  Located on chromosome 7
  Distance between a terminus base of telomere on chromosomal short arm and 5'-terminus of this base sequence : 27592165
  Distance between 3'-terminus of neighbour sequence of sequence listing upward to telomere on chrosomal short arm and 5'-terminus of this base sequence : -126
ttgtaggtcgtttaacagcatccttggcccttacccaccacatatctgtaacacacacacacacacacacacacacacacacacacacacacatcccagttatgataaccaaaagtgtctccaggcattgccaaacatactctggggtcaatatcttccctggctgggaaccactgatgtagctccaatttgcaaaaatgagtcattttatctcaccaccagtggaaatatatgttttgtgtgcacacagatattttcggtttagtatgtgttaagccatcccttgtaatgaaaggaatttgcaatgccaatggcaacatagagaaaagctacaagacaggcagaactgtatt

SEQ ID NO: 11759 - DNA, 449 bp, Homo sapiens
  chr7.fa.O7frz.27393688
  Located on chromosome 7
  Distance between a terminus base of telomere on chromosomal short arm and 5'-terminus of this base sequence : 27698088
  Distance between 3'-terminus of neighbour sequence of sequence listing upward to telomere on chrosomal short arm and 5'-terminus of this base sequence : 105570
acatatcctacctttagtggctgtttttgcctgctctttgcttttgaattgcttatttctttaagactacctcagttttcctttggagaatggtacctccccaaatctccatggggatcaggtgaagctggccttacccctctccacaaactcttttttgggcacacgatccagacctagccaattcgtgcaatacacacacacacacacacacacacgccacagtgattgatttagaataagcacataacccaagccaaggattcctgctgcaattcttgagagatctctatttcaatggggttgctaacctggtagaaatatctaagaagctgctggtgggtggtcatctttgccacagccatcctatgggtacagtgtctctaagaagaagctacacataggaaagcagtatgtgagtgggaatactcattacagtttgaacacct

SEQ ID NO: 11760 - DNA, 381 bp, Homo sapiens
  AC004079.1_32875
  Located on chromosome 7
  Distance between a terminus base of telomere on chromosomal short arm and 5'-terminus of this base sequence : 27922528
  Distance between 3'-terminus of neighbour sequence of sequence listing upward to telomere on chrosomal short arm and 5'-terminus of this base sequence : 223991
gacctcagatgctaaatctgttagctttcttcctatatgtgctagattctatgtagggaacttaatcaaatataaagtatatgggtcactacagaaagaggaagagaatgatctctgtgtgtgtgtgtgtgtgtgtgtgtgtgtgtatctatctatctatctatatatattttttttttttttttggacacagagtttcgttttgttgcccaggctggagtacagtggtgccatcttggttcactgcagcctccacctcctgggttcaagcgattctcctgcctcagcctcccaagtagctgagactacaggcatgcgccaccacacccagctaattttgtagttttagtagagacagggtttcaccatgttggtaaggct

SEQ ID NO: 11761 - DNA, 337 bp, Homo sapiens
  AC004079.1_93881
  Located on chromosome 7
  Distance between a terminus base of telomere on chromosomal short arm and 5'-terminus of this base sequence : 27983526
  Distance between 3'-terminus of neighbour sequence of sequence listing upward to telomere on chrosomal short arm and 5'-terminus of this base sequence : 60617
tttcagaagctgagcttgttaggaagttaatccaccttgttggggatatgactcacctcctccaaatgaaccccttgtggccaagccaaggggggagggaaaactttgtgtggaacacattgcgtgtgtgtgtgtgtgtgtgtgtgtgtgtttagggtgagggaccaacagtaacaccccacccagcaagtcacaactaaaatcctggagagttctttactcctttcctctccctgtttctcaggcacttcccagcaagccacccccacttctttacttctttcccccagttacagaaggttcccagaacctcctgtcttggactttctaaggtgct

SEQ ID NO: 11762 - DNA, 363 bp, Homo sapiens
  AC004080.1_81945
  Located on chromosome 7
  Distance between a terminus base of telomere on chromosomal short arm and 5'-terminus of this base sequence : 28080520
  Distance between 3'-terminus of neighbour sequence of sequence listing upward to telomere on chrosomal short arm and 5'-terminus of this base sequence : 96657
ggatctaatgtgaggttatgtcaggtcatgggaccctaggctggtgcaaagtaatttgatgtcaccaagagcaagcagactcgtttgtcaccctgaggaatagaagtccctgtgatttctgctgggagcagagcagggttgcttggctgggggtgtggaatccagacaggggtccagtgtgggcctaaccaggtgagctgggaggggactttctggatcgtgtgtgtgtgtgtgtgtgtgtgtgtgtgtgtgtgtgtgtgtgtatgtttgtctgtctcaggttgagaggattaagggatcagctctgctccaagctcacacagcagcccattggaactcagcatgtgacctggactgatccag

SEQ ID NO: 11763 - DNA, 296 bp, Homo sapiens
  AC004080.1_125953
  Located on chromosome 7
  Distance between a terminus base of telomere on chromosomal short arm and 5'-terminus of this base sequence : 28124601
  Distance between 3'-terminus of neighbour sequence of sequence listing upward to telomere on chrosomal short arm and 5'-terminus of this base sequence : 43718
gtgaggtgaactcagaacagagaagcgggaacgatcgtttgatgtgccgagccggaaaaagagaggagagggagaggctcccagcgagcgcggagacagaggagcccacgcggcacagcacgagccctactcttgcccgcgtagaggtgtgtgtgtgtgtgtgtgtgtgtgtgtgtgtgtgtgtgtgtgtgtgttttcctctgtatttctgtgtttgaaacaaaagcccaactaacggattcctggtgctctgaggactcactcccgggagcgactttgatgtattgctgtccaat

SEQ ID NO: 11764 - DNA, 144 bp, Homo sapiens
  D7S2564
  Located on chromosome 7
  Distance between a terminus base of telomere on chromosomal short arm and 5'-terminus of this base sequence : 28167877
  Distance between 3'-terminus of neighbour sequence of sequence listing upward to telomere on chrosomal short arm and 5'-terminus of this base sequence : 42980
agctaaggaatgaggttaatgaatgcagtgtgtgtgtgtgtgtgtgtgtgtgtgtgtgtgtgtgtgtgtgtgtgtgtgtgtttaaagagaggaaggcaataagactagacagaaaggtaaaccaggaacagatcatgggagatc

SEQ ID NO: 11765 - DNA, 262 bp, Homo sapiens
  D7S2441
  Located on chromosome 7
  Distance between a terminus base of telomere on chromosomal short arm and 5'-terminus of this base sequence : 28202529
  Distance between 3'-terminus of neighbour sequence of sequence listing upward to telomere on chrosomal short arm and 5'-terminus of this base sequence : 34508
acactcccatgctgaacatccaaatgaaacatttctaatatcatcatagtgttgttcataaacacagaagtatatctggtataagcaaatccttggatacatttttagaagtgaatgattttgaaaattccaatctaaaatctgcctgttccaacacacacacacacacacacacacacactcactcacactgtgatgactttccatctcttcacacttgtacttttaaaaatatcaaaacccttgaatttggaaatcttcc

SEQ ID NO: 11766 - DNA, 367 bp, Homo sapiens
  AC004996.1_74734
  Located on chromosome 7
  Distance between a terminus base of telomere on chromosomal short arm and 5'-terminus of this base sequence : 28202607
  Distance between 3'-terminus of neighbour sequence of sequence listing upward to telomere on chrosomal short arm and 5'-terminus of this base sequence : -184
gtataagcaaatccttggatacatttttagaagtgaatgattttgaaaattccaatctaaaatctgcctgttccaacacacacacacacacacacacacacactcactcacactgtgatgactttccatctcttcacacttgtacttttaaaaatatcaaaacccttgaatttggaaatcttccttcccttcagtttcagatgtcccttctccttccctctttgaatacaattaccaactacaatcagcttcagaactcctttcccttcataacagatttataatgattaaaaaattatttttcacttgtggaattttatctgtaagcaactttaaacatgctgtatttaggcatgcttagcactag

SEQ ID NO: 11767 - DNA, 161 bp, Homo sapiens
  AC004996.1_77876
  Located on chromosome 7
  Distance between a terminus base of telomere on chromosomal short arm and 5'-terminus of this base sequence : 28205778
  Distance between 3'-terminus of neighbour sequence of sequence listing upward to telomere on chrosomal short arm and 5'-terminus of this base sequence : 2804
taagaggttatgagtggcaaagttcagagaggatagttggaaaggagtgtgtgtgtgtgtgtgtgtgtgtgtgtgtgtgtgtgtgtgtgttggaatccagagggcatgattagatctaggcctgggtgtctctgatactaagattggcagactagtgaaac

SEQ ID NO: 11768 - DNA, 356 bp, Homo sapiens
  AC004009.1_16344
  Located on chromosome 7
  Distance between a terminus base of telomere on chromosomal short arm and 5'-terminus of this base sequence : 28244893
  Distance between 3'-terminus of neighbour sequence of sequence listing upward to telomere on chrosomal short arm and 5'-terminus of this base sequence : 38954
gtccaagattgataatggtgacaagcctgcctctgtccccatcagaactccagagagcaggagtagccgatctcagccattggtgccacccacacgggaaatgagagcacttcctcttttacacacacacacacacacacacacacacacacacacacacacacatcattagcagttatggttgggcactgtctcacaagatctcacctcctatagggcttgtccctttgttcatgaggaaagatgggaccagaatgctgtgggatgcaaaatcaattcattagatcacagggtgcctggaaagtggtgttagatttttgactttagagagagggtctagcagacactcaaccact

SEQ ID NO: 11769 - DNA, 85 bp, Homo sapiens
  D7S2556
  Located on chromosome 7
  Distance between a terminus base of telomere on chromosomal short arm and 5'-terminus of this base sequence : 28467722
  Distance between 3'-terminus of neighbour sequence of sequence listing upward to telomere on chrosomal short arm and 5'-terminus of this base sequence : 222473
gtgtaatttccataagggcaggtgtgtgtgtgtgtgtgtgtgtgtgtgtgtgtgtgtgtgtgtgtgaaccgctatattcccaggc

SEQ ID NO: 11770 - DNA, 105 bp, Homo sapiens
  G08591
  Located on chromosome 7
  Distance between a terminus base of telomere on chromosomal short arm and 5'-terminus of this base sequence : 28577528
  Distance between 3'-terminus of neighbour sequence of sequence listing upward to telomere on chrosomal short arm and 5'-terminus of this base sequence : 109721
agtacttgtcagagtgcctggccatcatcatcatcatcatcatcatcatcatcctcctcctcctcatcatcttcgatgccttatctcccagtccagaaaattttc

SEQ ID NO: 11771 - DNA, 411 bp, Homo sapiens
  AC004885.2_28046
  Located on chromosome 7
  Distance between a terminus base of telomere on chromosomal short arm and 5'-terminus of this base sequence : 28870042
  Distance between 3'-terminus of neighbour sequence of sequence listing upward to telomere on chrosomal short arm and 5'-terminus of this base sequence : 292409
tagctttaaatatgaaccaagaacagtcaagaaattgtctctagacattggaggaaaagtcttaaacgtgaatgagagaaaccagaacaaacaaatggggagggcaggacagaaaaaaggaagggaggaagagaggaatggggggaagaaggaaggaaggaaggaaggaaggaaggaaggaaggaaggaaggaaggcaggcaggcaggcaggcaggcagacatgagcaaagtaacaaacacatcaaggcctgggaagttaagtgacatgtttacttacacaaacctggtactggcagggctaggaccagaagccctgcgtcctgagtcttattgggccagcatttggactattaaaaatgctgcttatcctctaaagacatttcattgttactatccagttctaacactgg

SEQ ID NO: 11772 - DNA, 254 bp, Homo sapiens
  D7S1808
  Located on chromosome 7
  Distance between a terminus base of telomere on chromosomal short arm and 5'-terminus of this base sequence : 28870124
  Distance between 3'-terminus of neighbour sequence of sequence listing upward to telomere on chrosomal short arm and 5'-terminus of this base sequence : -329
cagaacaaacaaatggggagggcaggacagaaaaaaggaagggaggaagagaggaatggggggaagaaggaaggaaggaaggaaggaaggaaggaaggaaggaaggaaggaaggcaggcaggcaggcaggcaggcagacatgagcaaagtaacaaacacatcaaggcctgggaagttaagtgacatgtttacttacacaaacctggtactggcagggctaggaccagaagccctgcgtcctgagtcttattggg

SEQ ID NO: 11773 - DNA, 331 bp, Homo sapiens
  AC004885.2_86410
  Located on chromosome 7
  Distance between a terminus base of telomere on chromosomal short arm and 5'-terminus of this base sequence : 28928445
  Distance between 3'-terminus of neighbour sequence of sequence listing upward to telomere on chrosomal short arm and 5'-terminus of this base sequence : 58067
aggcagttcataccacatgtacatgacaggagagaacagcctcatgtcagatgggactcctgggagcgcaagtctttaccatataaaaattaactacaagactcaaagggcaacatcacgtggcagcttcattccttgaactatttcaacaactacacacacacacacacacacacacacacacacacacacacaataagaaagaaattcttgaggctggactgaatgtattatctgagtgtgagcatgaaatttcacagaagaaatcattataaaccttttcctccttaagaatcacatccaccatgtcacaagtgctaaactagtggat

SEQ ID NO: 11774 - DNA, 438 bp, Homo sapiens
  AC004885.2_148736
  Located on chromosome 7
  Distance between a terminus base of telomere on chromosomal short arm and 5'-terminus of this base sequence : 28990764
  Distance between 3'-terminus of neighbour sequence of sequence listing upward to telomere on chrosomal short arm and 5'-terminus of this base sequence : 61988
aagctacagtattctatggcaaatgactttgtatttcattactaattctaattttccatattaacattcttcaagtttgtattcaatccataatgtacacattactctgtcatttgaggttgtaagattagttgttggagatctatttctaagagagttttacacacacacacacacacacacacacacacaacacacacacacacagagtcatgagcagcatatcctccaaaaacagcagagggatctgttcctgcagaggatgctcattcattagacacaaattataaaactttcacacagcagatatcttaccagataaatagctatgacaacaaaatacccctacataataaataaaggcaatgctggggaagagagcagggagaatcccttggaatgaaagctccctagacatgaacaaagtatggctcctaa

SEQ ID NO: 11775 - DNA, 254 bp, Homo sapiens
  D7S516
  Located on chromosome 7
  Distance between a terminus base of telomere on chromosomal short arm and 5'-terminus of this base sequence : 29030239
  Distance between 3'-terminus of neighbour sequence of sequence listing upward to telomere on chrosomal short arm and 5'-terminus of this base sequence : 39037
gacctctcaaaacttggttgagggcaggcactctgggcctagggagaaaggagaccacattgaaaacacgcgcgcacacacacacacacacaaacacacacacacacacacagagagagagagagagagggagagagagagagagagagatacttcctaatgctgcctgggcctcacccaaaacccatggtccataggggactgacaggagataaaaaggcaaggaggggtagccaacgtaatggaggcagtag

SEQ ID NO: 11776 - DNA, 386 bp, Homo sapiens
  AC005017.1_9670
  Located on chromosome 7
  Distance between a terminus base of telomere on chromosomal short arm and 5'-terminus of this base sequence : 29042225
  Distance between 3'-terminus of neighbour sequence of sequence listing upward to telomere on chrosomal short arm and 5'-terminus of this base sequence : 11732
agtgcttaactcacagtgtttacagttgggccccatatgtaccactagtcaaaaaaaaaatctttaaaataaagtacatgagctgagtactgggccgtgtgcatgcaatcccagctaccagaaggctgaggcaggaggatcgctggagcccaaaagttcaagatcagcctgggcaacataccaagaccctgtctgaaaaataataataaaataaagtacctgaacataattacatgattttaattttggaaatctgaagtaaaagagaagttgatatgtgtgtgtgtgtgtgtgtgtgtgtgtgtgtgtgtgtgtgtgtgtgtgtgtgtgtgtatgtgtgtatgtgtgtgtatgtgtagagggttaggtattgtgtttgtcaggag

SEQ ID NO: 11777 - DNA, 310 bp, Homo sapiens
  AC005017.1_14154
  Located on chromosome 7
  Distance between a terminus base of telomere on chromosomal short arm and 5'-terminus of this base sequence : 29046868
  Distance between 3'-terminus of neighbour sequence of sequence listing upward to telomere on chrosomal short arm and 5'-terminus of this base sequence : 4257
atctgactgtttacaggtgagaagaggctaatggaaaaaccagtgaaaacagagttttggagactgccgtaaagtttcagatttcgggttccctgatcctgcctatggggtgtgtgggtgtgtgtgtgtgtgtgtgtgtgtgtgtatgcacatgtatttaaaactcctagcattacacctgggggcttctcgggaaccctgggagtaacagggagatcttgccgccaagccacagggcacaggcagagagcagggcaggcagcaacaagcctttcattcattcatttattaattcagtcattccttctcc

SEQ ID NO: 11778 - DNA, 263 bp, Homo sapiens
  AC005017.1_66200
  Located on chromosome 7
  Distance between a terminus base of telomere on chromosomal short arm and 5'-terminus of this base sequence : 29098887
  Distance between 3'-terminus of neighbour sequence of sequence listing upward to telomere on chrosomal short arm and 5'-terminus of this base sequence : 51709
caaattgctttaagtcgaagagctaaacatttagggttgctcacatgtgatgttattaatcactttattatgtaatacttgctctgaaatacaggcaacacaagcaaattccatcaatattcttttgaactttttatttattcagtgtgtgtgtgtgtgtgtgtgtgtgtgtgtggtttttttttttttttttggacggagtctcactctgtcatccaggctggagtgcagtggcgtgatctcggttcactgcaagcttcacc

SEQ ID NO: 11779 - DNA, 284 bp, Homo sapiens
  AC005017.1_84863
  Located on chromosome 7
  Distance between a terminus base of telomere on chromosomal short arm and 5'-terminus of this base sequence : 29117574
  Distance between 3'-terminus of neighbour sequence of sequence listing upward to telomere on chrosomal short arm and 5'-terminus of this base sequence : 18424
ttatttaacgcatttcagacacatggctcagcaattttttcaactgcaaatctcttttccttccatctttgaactcagatggctgagctgtgcggaggaattgaactgtccggtaaatccatttatttatttatttatttatttatttattttttctgtagctgtcacttatctgcaggtgacgctgtttaccacagaaaaagataagcacattagggaaacacatgcatggtctttgtcttaaaaggccatagtttgttaactgattgctttaagttaacgtg

SEQ ID NO: 11780 - DNA, 203 bp, Homo sapiens
  AC005017.1_121336
  Located on chromosome 7
  Distance between a terminus base of telomere on chromosomal short arm and 5'-terminus of this base sequence : 29154147
  Distance between 3'-terminus of neighbour sequence of sequence listing upward to telomere on chrosomal short arm and 5'-terminus of this base sequence : 36289
cacctagaacagcatctggtacacacacacacacacacacacacacacacacacacacacacacgcacagatacacacacacacagagtaggcactcaacaaatactggataaaagaaaaactgatagattaaattgacaaaattaaaaccttttatccataccaaacaacataaacaggatacaaaggcaaatgataaactg

SEQ ID NO: 11781 - DNA, 275 bp, Homo sapiens
  AC005017.1_127468
  Located on chromosome 7
  Distance between a terminus base of telomere on chromosomal short arm and 5'-terminus of this base sequence : 29160114
  Distance between 3'-terminus of neighbour sequence of sequence listing upward to telomere on chrosomal short arm and 5'-terminus of this base sequence : 5764
taattactagctgaaaggccataggcaagttacttattttctctgggctttagtttcttcacctgtggaatggggaaaatagtatcaccaaaccatattaaatgagctaagatatatgtaacatgctctggcatagtattgcccaataaatgtttgccgtgtgtgtgtgtgcatgcatgtgtgcatgtgtgtgtgtgtgtgtgtgtgtgtgtgtgtgtgtgtgtgtgtattgtcctacattgtccgattgcctgtaggcatagcattcacatctt

SEQ ID NO: 11782 - DNA, 217 bp, Homo sapiens
  G10090
  Located on chromosome 7
  Distance between a terminus base of telomere on chromosomal short arm and 5'-terminus of this base sequence : 29198208
  Distance between 3'-terminus of neighbour sequence of sequence listing upward to telomere on chrosomal short arm and 5'-terminus of this base sequence : 37819
ggaggatggcatttagtaaccaagatatgggctctagatgtactcattgttactgtgatgtcattgattttagaccttctcaggagacagaactggtacacacacacattatctatctatctatctatctatctatctatctatctatctatctatctatctatctacctatctatcttgaaaaacatgagttcacactgatacccacagttccagc

SEQ ID NO: 11783 - DNA, 307 bp, Homo sapiens
  AC006367.3_50765
  Located on chromosome 7
  Distance between a terminus base of telomere on chromosomal short arm and 5'-terminus of this base sequence : 29220444
  Distance between 3'-terminus of neighbour sequence of sequence listing upward to telomere on chrosomal short arm and 5'-terminus of this base sequence : 22019
tggcacattactagccttaaacaagtcatgccaattctccaaacagcagcttcctcatttataaaatgatgatcaacatgcgcctgctttctctctctctctgtctctctctctctgtctctctctctcacacacacacacacacacacacacacacacacacagacaccttgcatggtagtggtgagaattagagatatgtctaaaatgctcagcatactatctggcccacagtagggactcaatgcttggaagctattattattagctattactaaataaagtctgtggaaagagtctttctgta

SEQ ID NO: 11784 - DNA, 268 bp, Homo sapiens
  AC003074.1_10872
  Located on chromosome 7
  Distance between a terminus base of telomere on chromosomal short arm and 5'-terminus of this base sequence : 29336599
  Distance between 3'-terminus of neighbour sequence of sequence listing upward to telomere on chrosomal short arm and 5'-terminus of this base sequence : 115848
atttggtagaatttagcagtgaagccatctgggcctgatctctcctttgtggaaagttgcgtgtgtgtgtgtgtgtgtgtgtgtgtgtgtgtgtgtgtgtgttactaatgcaatctctttgcttgttgcatgtttattcagattttctattttttcttgagtcatttttggtagtttgtatctttctaggaatttgtccttttcatcaggattatctgacttgttcacaatacagttgttcctgctgcatctacttttgtttcaagtt

SEQ ID NO: 11785 - DNA, 329 bp, Homo sapiens
  AC003074.1_125956
  Located on chromosome 7
  Distance between a terminus base of telomere on chromosomal short arm and 5'-terminus of this base sequence : 29452427
  Distance between 3'-terminus of neighbour sequence of sequence listing upward to telomere on chrosomal short arm and 5'-terminus of this base sequence : 115560
ggcaacctatagatgcctactccaaatcatagactttctaaaacattgaaagaattaatttaaaataattcaactaagcttcatgctgttagaggtgactgatgaattttacagaccaggtacacccaaataaaaatctgatgaaataaaagtctggaattggagaaagttgaagacttttaactaaaaggaaaatgaggggtgtctgtgtgtgtggggggggcatgtggtgtcaactgctagatttgtcccaatccccccccaccacacacacacacacacacacacacacacacacaatagatagctgctacttatttaacgcagct

SEQ ID NO: 11786 - DNA, 173 bp, Homo sapiens
  AC005105.2_4026
  Located on chromosome 7
  Distance between a terminus base of telomere on chromosomal short arm and 5'-terminus of this base sequence : 29479928
  Distance between 3'-terminus of neighbour sequence of sequence listing upward to telomere on chrosomal short arm and 5'-terminus of this base sequence : 27172
aggaaagtggtttaatgtcgttttatctgttgaaccacaaaatgataaagaacattgactcttacccaaaataagaccagtgcccacagggctgtgtgtgtgtgtgtgtgtgtgtgtgtgtgtgtgtgtgtgtgtgtgtgtgtgtgtgtgttttaccatgtgcatacttggaa

SEQ ID NO: 11787 - DNA, 185 bp, Homo sapiens
  Z67429
  Located on chromosome 7
  Distance between a terminus base of telomere on chromosomal short arm and 5'-terminus of this base sequence : 29494450
  Distance between 3'-terminus of neighbour sequence of sequence listing upward to telomere on chrosomal short arm and 5'-terminus of this base sequence : 14349
tcctgtgagcgaaacttggtgaggagggtggcacatttctctttccgcaatgtgaattcttacacatatacacacattctctctctctctctctcacacacacacacacacacacacacacacacacactccccacacccttcaatcatatatccccttagagatgttcattacatcagccatgc

SEQ ID NO: 11788 - DNA, 267 bp, Homo sapiens
  AC005105.2_55244
  Located on chromosome 7
  Distance between a terminus base of telomere on chromosomal short arm and 5'-terminus of this base sequence : 29531185
  Distance between 3'-terminus of neighbour sequence of sequence listing upward to telomere on chrosomal short arm and 5'-terminus of this base sequence : 36550
actcggtctctaatctttaaatcattgcactaaatattatatgtgtgtgtgtgtatatatatatatatatatatatatatgtatatataagtcataatttataataagttttcatgttgagggatttccaaaatgaaatgagaatgaatactttatttggtcctcttcctcagaacactggccaactgactcattcctttcacaaatgtggaagagaatcaatgttttaaacaacctacttaataaacatactaggtggatcggatt

SEQ ID NO: 11789 - DNA, 130 bp, Homo sapiens
  D7S2515
  Located on chromosome 7
  Distance between a terminus base of telomere on chromosomal short arm and 5'-terminus of this base sequence : 29544417
  Distance between 3'-terminus of neighbour sequence of sequence listing upward to telomere on chrosomal short arm and 5'-terminus of this base sequence : 12965
cacacattcaggacaccagacaaggagatcagttgtattatggaaaaaaaaaaaaaacacacacacacacacacacacacacaaacactggactaggttttaaaagacctgggatctagttaataaatct

SEQ ID NO: 11790 - DNA, 220 bp, Homo sapiens
  AC005105.2_86200
  Located on chromosome 7
  Distance between a terminus base of telomere on chromosomal short arm and 5'-terminus of this base sequence : 29562110
  Distance between 3'-terminus of neighbour sequence of sequence listing upward to telomere on chrosomal short arm and 5'-terminus of this base sequence : 17563
acaccatttcatgaatctgaaggatgtgcaggatctcttagaaaagtttatgggctgtgaattctcccattttacttgtatttggtgtgtgtgtgtgtgtgtgtgtgtgtgtgtgtgtgtgttgtttttgtcaatgtaaaaactgagagtcaggcttacccaagtacatataagttctggcaattggagtccagttcactctaggtctagctcaccatca

SEQ ID NO: 11791 - DNA, 322 bp, Homo sapiens
  AC005105.2_133830
  Located on chromosome 7
  Distance between a terminus base of telomere on chromosomal short arm and 5'-terminus of this base sequence : 29609641
  Distance between 3'-terminus of neighbour sequence of sequence listing upward to telomere on chrosomal short arm and 5'-terminus of this base sequence : 47311
ctagcttcagatctagctgcacctcctggtttcttcccccctctgttcctcatttccccattgacaaaatggggataatttttaaagattaaatgaggtaacagagaaatcatttagcacatagtaatttctctctctctctctctctctgtgtgtgtgtgtgtatatatgtatatatatacgtatatatatatatatatatatatatatatatatatatatatatatatatttttaactcctgtttcaaaggatacttctgtttcttttactggtttaattcatatggtttaaaacatacttgttcaaggtgcatagtctc

SEQ ID NO: 11792 - DNA, 309 bp, Homo sapiens
  AC005013.1_9707
  Located on chromosome 7
  Distance between a terminus base of telomere on chromosomal short arm and 5'-terminus of this base sequence : 29662523
  Distance between 3'-terminus of neighbour sequence of sequence listing upward to telomere on chrosomal short arm and 5'-terminus of this base sequence : 52560
ctactcatagcaaatgttatccaaccataataaattgaatatttggctattgacagttgccctccttggcaaagcatgcaatatgtggtgtctcaccaaggaagctcagtgatgatctacttcccgtagtgaatgggctttggaacgaaatcaaaggatacattttagcagaagaaagaaagaaagagagagagagagagagagagagagagagagatagagagagagagaaagaaagaaagaaagagaaggaaaaagaaagaaaaataaagaaagaaagggaaaaactagcaggcactgaatcagtac

SEQ ID NO: 11793 - DNA, 281 bp, Homo sapiens
  AC005013.1_40405
  Located on chromosome 7
  Distance between a terminus base of telomere on chromosomal short arm and 5'-terminus of this base sequence : 29693384
  Distance between 3'-terminus of neighbour sequence of sequence listing upward to telomere on chrosomal short arm and 5'-terminus of this base sequence : 30552
tttgaatgcttgacctcttaatgtgtgtgtgtgtgtgtgtgtgtgtgtgtgtgttcatgggttttaaaagaacagtattttacaaaaggtgtagcttttataagagtgcagaaaagggaaggatgtgtttttttctctcactatagtataagaatctattttggagaaaaaaagaaaatatgagggtctcgaagcatgatttttatataactagtttcagttttatctaataacttactttttaaatcaatatttatcaacaatctttccttgtatgcagt

SEQ ID NO: 11794 - DNA, 233 bp, Homo sapiens
  AC005013.1_65551
  Located on chromosome 7
  Distance between a terminus base of telomere on chromosomal short arm and 5'-terminus of this base sequence : 29718384
  Distance between 3'-terminus of neighbour sequence of sequence listing upward to telomere on chrosomal short arm and 5'-terminus of this base sequence : 24719
aacagaattcagtggaatcaacattcattgttctgggcatggcctttagctggtctggcttcttccacttcctgcctcttaggagccagccaagccccatgtaaaggtcctgaaggatgagatgccatgtgggaagggaggaaggggatgtggagggagggagacacagagagagagagagagagagagagagatgccaaggagcacagaggtaccagacgtgtaagtggaga

SEQ ID NO: 11795 - DNA, 199 bp, Homo sapiens
  AC005013.1_149708
  Located on chromosome 7
  Distance between a terminus base of telomere on chromosomal short arm and 5'-terminus of this base sequence : 29802577
  Distance between 3'-terminus of neighbour sequence of sequence listing upward to telomere on chrosomal short arm and 5'-terminus of this base sequence : 83960
gaactcctgacctcaggttatctgcccacctcggcctcccaaactgctgggattacaggcatgagccaccgtgtctggccaacattgctgatttcttcagggagaaagtctctggtggtaatatgtcttaatctctctctctctctctctctctcctatcaacatcttttggacaaactaaatacacctgaggctgaaa

SEQ ID NO: 11796 - DNA, 161 bp, Homo sapiens
  AC005013.1_167493
  Located on chromosome 7
  Distance between a terminus base of telomere on chromosomal short arm and 5'-terminus of this base sequence : 29820438
  Distance between 3'-terminus of neighbour sequence of sequence listing upward to telomere on chrosomal short arm and 5'-terminus of this base sequence : 17662
agaacagccttagtcaaattatgtgtaaagcaaaaacaacaaacaacaaaaagccgtgtgtgtgtgtgtgtgtgtgttttcagaagttaaaaaagaaatagaaaaaaaacaacaacaaccatgtcaccaaataatgagtgtgaaggcagtaaatgtacata

SEQ ID NO: 11797 - DNA, 387 bp, Homo sapiens
  AC005162.1_93337
  Located on chromosome 7
  Distance between a terminus base of telomere on chromosomal short arm and 5'-terminus of this base sequence : 29941862
  Distance between 3'-terminus of neighbour sequence of sequence listing upward to telomere on chrosomal short arm and 5'-terminus of this base sequence : 121263
tcttgcagaatatctaagacgatccaggatttttacagaatgcctgaaaattaccataggataaatactgtggtggaaatgggggaagcaattccagtcctcagcctgccacaatctatttgtgtatccttcggcaattcattgctatcccctggggctcggcatcctctccactcaccagtaaatgtgtgtgtgtgtgtgtgtgtgtgtgtgtgtgtgtgtgtgtgtgtgtgtgtgtgtgtgcatgtaaatgcatagggacagtagatgacctatctccagagtactctccagctctgagttactactctttgattaattaaatcattttaaaggatcagagcgtcaaacaggctttatcattttaggcttgagattctgacattt

SEQ ID NO: 11798 - DNA, 446 bp, Homo sapiens
  AC005232.1_877
  Located on chromosome 7
  Distance between a terminus base of telomere on chromosomal short arm and 5'-terminus of this base sequence : 29995703
  Distance between 3'-terminus of neighbour sequence of sequence listing upward to telomere on chrosomal short arm and 5'-terminus of this base sequence : 53454
tgaatttaggaactgaaattaggttcccaagaagccccagggtaatgacctctatggcactgtgaaaacatttttttaaattacttgaacttgtttacactgatgcttttatagcacagctactttcaagggatgcctgaaatcaacaatcttactctctaactggttcagaaaaaaaaaaaaaaaaaaaaaaaaaaaaaaaatatatatatatatatatatatatatatgcaatattaaaaaaaaataatggaagaagctcttccagtaagaggtttttgttttttttttttcccctggggacagaaacaagaaaccaatcatgccatctaatttctcaatcttcctgctgccaatccctagctccctttaatggaagccattaatatttaaataaccagggtagttacagcacttcccttgtaagcagatgttgactcaaagat

SEQ ID NO: 11799 - DNA, 362 bp, Homo sapiens
  AC004593.1_11503
  Located on chromosome 7
  Distance between a terminus base of telomere on chromosomal short arm and 5'-terminus of this base sequence : 30067796
  Distance between 3'-terminus of neighbour sequence of sequence listing upward to telomere on chrosomal short arm and 5'-terminus of this base sequence : 71647
gtatctttctgatcctgattgaagtgggttaggggaagagaggtcgagcccatcctctgactcttggcacatttacgagagagagagagagagagagagagagagagagagtgtgtgtgtgtgtgtgtgtgagagagagagagagagagactccttagagattttctgataatagtggctgtaatttcactagcaaggcatgcattttttttccttttaagaatggttgagcaaagggaaggcttctttcagcttttctatggttgatcatcgggtctaattgaagagaaaaaaattgctaatgaatctgaaggagtaggaatcaatagaggcagacccactggtttctgagtatgacaggt

SEQ ID NO: 11800 - DNA, 282 bp, Homo sapiens
  AC004593.1_19975
  Located on chromosome 7
  Distance between a terminus base of telomere on chromosomal short arm and 5'-terminus of this base sequence : 30076167
  Distance between 3'-terminus of neighbour sequence of sequence listing upward to telomere on chrosomal short arm and 5'-terminus of this base sequence : 8009
tgtcacattcttgtttagacagattttgtgttttgttttgtttgggcttcagtttaattctagacttcatgtatttttgttagatttatgtatacgcctccttccaaagaaagcctgcaatgctatgaagttggaaagagaagctgaggaaacaaagcacacgtttttctctctctctgtgtgtgtgtgtgtgtgtgtgtgtgtgtgtgtgtgtgtgtgtgtgtgtagaaaactcttgcctcatagcctttgtaccgtgatgtcctgccatggataagtatg

SEQ ID NO: 11801 - DNA, 239 bp, Homo sapiens
  AC004593.1_27358
  Located on chromosome 7
  Distance between a terminus base of telomere on chromosomal short arm and 5'-terminus of this base sequence : 30083666
  Distance between 3'-terminus of neighbour sequence of sequence listing upward to telomere on chrosomal short arm and 5'-terminus of this base sequence : 7217
ttaacagatccattctggctattatgttgagattagactaaacacaaatgctgcatgttggcacacacacacacacacacacacacacacacacacacacacacagaaacagaagttccacaaagagagttcatcctgttatatatgatgtgctctgagactgtcttttctattgtatttctcttcatttatctaaaaactatcagggcccacaagttgatttcagaatccactctaga

SEQ ID NO: 11802 - DNA, 276 bp, Homo sapiens
  AC004593.1_84191
  Located on chromosome 7
  Distance between a terminus base of telomere on chromosomal short arm and 5'-terminus of this base sequence : 30140381
  Distance between 3'-terminus of neighbour sequence of sequence listing upward to telomere on chrosomal short arm and 5'-terminus of this base sequence : 56476
tttgtttagtgaaactcctgaaactaagggtgtgggaacaaattatccatatttagtatatgtggtgggttaaaaaatgtcatccatttttgataacataggaggaagtgtaaattgttagtttatcagccatttctaatggtttttaaaaaatgtccttcatccacggcttcaccagaacacacacacacacacacacacacacacacacacacacaatgtccttcaatttcataccatttgaaaaataatcttgttgagtattaggattggcta

SEQ ID NO: 11803 - DNA, 361 bp, Homo sapiens
  HUMUT898
  Located on chromosome 7
  Distance between a terminus base of telomere on chromosomal short arm and 5'-terminus of this base sequence : 30152635
  Distance between 3'-terminus of neighbour sequence of sequence listing upward to telomere on chrosomal short arm and 5'-terminus of this base sequence : 11978
gggtgacagagcgaggctccgtctcataaataaataaataaataaataaataaataaaaatagggaagaggagcagtgttttagagggacaggaaagttaatggcttgagtttgggggcttgttggttttgggcatctgaggaacttacagttggagttacccattaggctgtgggtaatgtgagacaggaaacctaagagagaggattacaggtaaacaaacctactaagtacaagacactctacaaggcactgggtgtagaagtggttcctaggctttgttacttacagctgaacagagaaggcagatgttcagccataaacttggaacgtgagaacagcctggaaagcctgccaatgg

SEQ ID NO: 11804 - DNA, 323 bp, Homo sapiens
  AC004417.1_124264
  Located on chromosome 7
  Distance between a terminus base of telomere on chromosomal short arm and 5'-terminus of this base sequence : 30330589
  Distance between 3'-terminus of neighbour sequence of sequence listing upward to telomere on chrosomal short arm and 5'-terminus of this base sequence : 177593
caactagatcattggtttcctaagggaatgagacagtagctgtttgtataaggagcatagctgtgcacacacacacacacacacacacacacacacacacacacaccccatgcattacaaatagatgtagaattctaatgttagctgccctacctctgttctccaatattatataattatctgtttatgtgtctcacccctgcccccaactttttacttctcaagggcaaatgtattcccggtgcctggagttaatgtgtgtggaacatttgaagatggaaagtggtcctagctaagtcctcactttagaagtgaggaaagtg

SEQ ID NO: 11805 - DNA, 404 bp, Homo sapiens
  AC007255.3_41554
  Located on chromosome 7
  Distance between a terminus base of telomere on chromosomal short arm and 5'-terminus of this base sequence : 30334003
  Distance between 3'-terminus of neighbour sequence of sequence listing upward to telomere on chrosomal short arm and 5'-terminus of this base sequence : 3091
agagcctaatacagaacctgacacataggaattgtccacttaatgttgcttgattgtctgactggtttgttggttaactggttggttcattggatggatggatggatggatggatggatggatggatggatggatggatggatggaaggaagagagaggatgcaaagtgcctacagcagtgtctcatacatacatataataaattgtaactgtatatttctgtcataaaaaataccttttttgtcatatacactgaaacatttgtgtctataaattcccattcatttaacctattttaatattgtacttggaacagtgtttttctcataatagaaaaaatatagtcattgtttcacacgcattttgtttgtgcaggaagccaaaatacaaatgcattctgcgta

SEQ ID NO: 11806 - DNA, 188 bp, Homo sapiens
  D7S1806
  Located on chromosome 7
  Distance between a terminus base of telomere on chromosomal short arm and 5'-terminus of this base sequence : 30338452
  Distance between 3'-terminus of neighbour sequence of sequence listing upward to telomere on chrosomal short arm and 5'-terminus of this base sequence : 4045
tgggagacagagtgaaattgtcaaaataaagagagaaagagagagaggaagagaggaaggaaggaaggaaggaaagaaagattggttaccaaagctaaaattatcatagctatactctacatattgagacgtaattttctgggtgtagataaatttatttggagcgaatctatgttatatgaacatga

SEQ ID NO: 11807 - DNA, 223 bp, Homo sapiens
  D7S2496
  Located on chromosome 7
  Distance between a terminus base of telomere on chromosomal short arm and 5'-terminus of this base sequence : 30399233
  Distance between 3'-terminus of neighbour sequence of sequence listing upward to telomere on chrosomal short arm and 5'-terminus of this base sequence : 60593
caggaaattgaccagttcacaagactatagaccttactcagttttcacaaggccttaaacctatacccacgtgtgtgtgtgtgtgtgtgtgtgtgtgtgtgtgtgtgtgtgtagttttatgcaatttcatcaaatgtatagatttattcatctactaccacaatcaagatataatctgtccaggcattctggctcacacctccaatctcagtgctttaggagg

SEQ ID NO: 11808 - DNA, 326 bp, Homo sapiens
  AC004912.1_153124
  Located on chromosome 7
  Distance between a terminus base of telomere on chromosomal short arm and 5'-terminus of this base sequence : 30680762
  Distance between 3'-terminus of neighbour sequence of sequence listing upward to telomere on chrosomal short arm and 5'-terminus of this base sequence : 281306
cttcaaattctagacaggcaaccttcaacaggcaatttgtggccacctgaatcggggcagagcggtcagggtgacagacacttgtaggctggcttcctgccattgccccctttttgttcctttaggagtctctgttttcacgtaattgtgagtgtgacattgtgtcacagattgcagttacccagcagcagaaggaatggaggaagtgtgtgtgtgtgtgtgtgtgtgtgtgtgtgtgtctaagaacatacagttataagaacaggggaaagccagctggtctagcctggcaacgctctttttaggagacttattgttcagaaacc

SEQ ID NO: 11809 - DNA, 226 bp, Homo sapiens
  AC004912.1_73314
  Located on chromosome 7
  Distance between a terminus base of telomere on chromosomal short arm and 5'-terminus of this base sequence : 30760699
  Distance between 3'-terminus of neighbour sequence of sequence listing upward to telomere on chrosomal short arm and 5'-terminus of this base sequence : 79611
actgtctagccttctaattcagattagagaaagggaagaaaagcagcatttaaactgtgtgagtgtgtgtgcgtgtgcgtgtgtgtgcgtgtgtgtgtgtgtgtgtgtgtgtctatggagaaatcaatgcataagcctgaaagagtagaatgatatggataaggagaaagatacatagaagactcaccaggtagagggacattttgagtacaagtatggaggtagg

SEQ ID NO: 11810 - DNA, 300 bp, Homo sapiens
  AC004912.1_67060
  Located on chromosome 7
  Distance between a terminus base of telomere on chromosomal short arm and 5'-terminus of this base sequence : 30766863
  Distance between 3'-terminus of neighbour sequence of sequence listing upward to telomere on chrosomal short arm and 5'-terminus of this base sequence : 5938
tctgattacatttctccttaccagttttcttcttgttcactgttgacctggctccccaagatgagttcttcgtggtctgggagacagtgttgtttctatcagatgagtgtgttctcataccctgtggtctcctatgtgccctctgtccccacctgcttgtttgctgtctctctttctgacacacacacacacacacacacacgacacacacacgagcacacacgcttagctcttccactagccatcatcactgtctccactctgcaggtgtttgctattttcttccattgagtgaatggc

SEQ ID NO: 11811 - DNA, 179 bp, Homo sapiens
  D7S2492
  Located on chromosome 7
  Distance between a terminus base of telomere on chromosomal short arm and 5'-terminus of this base sequence : 30946447
  Distance between 3'-terminus of neighbour sequence of sequence listing upward to telomere on chrosomal short arm and 5'-terminus of this base sequence : 179284
gggtatgccagtggctagggctagaaatctcttcttacccagttatttatctagtcatgattgtcagaaacaaagttgtgtgtgtgtgtgtgtgtgtgtgtgtatgtgtggtgtttttgtttgctttgtttttgaggataagaacaaaatgttatttatttcatttacgtttataggcc

SEQ ID NO: 11812 - DNA, 95 bp, Homo sapiens
  Z67430
  Located on chromosome 7
  Distance between a terminus base of telomere on chromosomal short arm and 5'-terminus of this base sequence : 31086081
  Distance between 3'-terminus of neighbour sequence of sequence listing upward to telomere on chrosomal short arm and 5'-terminus of this base sequence : 139455
aaggtaggcaaaagtttcttaggatacacacacacacacacacacacacaccaacccataaaagaaaaaaaatgaattaaactttgcactttgaa

SEQ ID NO: 11813 - DNA, 448 bp, Homo sapiens
  AC006978.2_19025
  Located on chromosome 7
  Distance between a terminus base of telomere on chromosomal short arm and 5'-terminus of this base sequence : 31167090
  Distance between 3'-terminus of neighbour sequence of sequence listing upward to telomere on chrosomal short arm and 5'-terminus of this base sequence : 80914
agaatcttaagcctttcagttgtaaaggatagaagcataactcaaaatagcattaagtggaaaaactgtatattgtttcaaattattgaaaaggatcctagggtaacttagagaattgaaggaacaaaggcaggacccaatgcccctggagctgaaatttagagagagagggagggggacagagagagagagggagggaaggagagagagagagagagagagagagagagagagagagtgtgtgtgtgtgtgtgtgtgtgtgtgtgtgtgtgtgtgtgtgtgtgtgtgattgcaggtgtcagccactgcccccaggcagtatgggccttctttaagctggggccttgagactctctgtacttccaactacatgcgatctttcaggcctgaagggagtacctttctctacctccagcagaaaggactcagattagctcagtttgagttc

SEQ ID NO: 11814 - DNA, 331 bp, Homo sapiens
  AC005154.1_63461
  Located on chromosome 7
  Distance between a terminus base of telomere on chromosomal short arm and 5'-terminus of this base sequence : 31392968
  Distance between 3'-terminus of neighbour sequence of sequence listing upward to telomere on chrosomal short arm and 5'-terminus of this base sequence : 225430
aattaactttaggagatggcagtcctggcctggtcccttttatgtgctggagcaccaccctaaaaactgttggctggctacatcacagagaattcccagggctctcttgctagcagccagagtggagagaggcaggaaggaagggagagagaaagagagagagagaaggagagagagagagagagagagagagagagagagagagagagagagagagagagagagagagagagacagtccaaacaggaaggaataatgcaaacttgagtcatttgaaagacagtggattttcctgttactgcagtatgtttgctgcagattacataagact

SEQ ID NO: 11815 - DNA, 211 bp, Homo sapiens
  G09471
  Located on chromosome 7
  Distance between a terminus base of telomere on chromosomal short arm and 5'-terminus of this base sequence : 31544019
  Distance between 3'-terminus of neighbour sequence of sequence listing upward to telomere on chrosomal short arm and 5'-terminus of this base sequence : 150720
tgtggtgagctgagattgtgccactgcactccagcctgggtgacagagtgagaccctgtgatgatgatgatgatgatgatgatgatgatgatgatgataatgatgatgatgatagaagaagaaggaggatgaagaggaggaggaggaggagaagaagaagaggtagtactagtagtagtagtggtggtgagggagagaaggtgatgacatt

SEQ ID NO: 11816 - DNA, 416 bp, Homo sapiens
  AC004976.1_105478
  Located on chromosome 7
  Distance between a terminus base of telomere on chromosomal short arm and 5'-terminus of this base sequence : 31591738
  Distance between 3'-terminus of neighbour sequence of sequence listing upward to telomere on chrosomal short arm and 5'-terminus of this base sequence : 47508
agttacagattaacagcatctcagggcaaagcaattgttcaaggtacaggtcaaaatggagcttcttatgtcttccctttcttcatagacacggtaacagtctgatctctctttctcttccctacaccatccatccatcatccatccatccatccatccatccgttcatccatcatccatccatccatcattcatgcatccattcatccatccatccatccatccatccatccatccatccatcattcatccatccatccattcatccatccatccatccatccatccatccatccatccatttactcttcctttcctccatttctccctccctccctccctctctgtatctattcatgcatcaactcacccaactatttagcattcattgaggtttcctatgtactcagaccatg

SEQ ID NO: 11817 - DNA, 167 bp, Homo sapiens
  AC006022.1_24722
  Located on chromosome 7
  Distance between a terminus base of telomere on chromosomal short arm and 5'-terminus of this base sequence : 31638410
  Distance between 3'-terminus of neighbour sequence of sequence listing upward to telomere on chrosomal short arm and 5'-terminus of this base sequence : 46256
ggagcttgtcgactcagagatgcacagagccacagctgtatggtgatggatatgatttctcacacacacacacacacacacacacacacacacacacacctacctttcttctctgtgtgacagatgtgttatgaggcaaggccgtctaaattgtccttccagtgtaa

SEQ ID NO: 11818 - DNA, 163 bp, Homo sapiens
  D7S2491
  Located on chromosome 7
  Distance between a terminus base of telomere on chromosomal short arm and 5'-terminus of this base sequence : 31654552
  Distance between 3'-terminus of neighbour sequence of sequence listing upward to telomere on chrosomal short arm and 5'-terminus of this base sequence : 15975
catggctgtttcagtcagtattctccagaggaacagaatcaatatagtctctgtgtgtgtatgtttgtgtgtgtgtgtgtgtgtgtgtgtgtgtgcatgtatctatatgcatatgtacctgtatgtatacataaagaagtttggccaggtgcagtggctcacg

SEQ ID NO: 11819 - DNA, 219 bp, Homo sapiens
  D7S632
  Located on chromosome 7
  Distance between a terminus base of telomere on chromosomal short arm and 5'-terminus of this base sequence : 31657379
  Distance between 3'-terminus of neighbour sequence of sequence listing upward to telomere on chrosomal short arm and 5'-terminus of this base sequence : 2664
attcaatggtgtgcccaacacagtctcagagacaaagagcagtctgaaatttccagatgctttggtaggtcagaagcacatgccatccaccctcttacactccgctcaactcccctcaccttcttttgttctttcttgctctcttacttcctctctctctctctgacacacacacacacacacacacacacacacacccattggcacacctgacttcag

SEQ ID NO: 11820 - DNA, 229 bp, Homo sapiens
  AC004691.1_56714
  Located on chromosome 7
  Distance between a terminus base of telomere on chromosomal short arm and 5'-terminus of this base sequence : 31700498
  Distance between 3'-terminus of neighbour sequence of sequence listing upward to telomere on chrosomal short arm and 5'-terminus of this base sequence : 42900
ggctttacaagaaagctaggagagaggaaacaaacaaacaaaaaacatagagatgagatgaacaaattctgggcaatgatgacaagaactcgatttgtgtgtgtgtgtgtgtgtgtgtgtgtgtgtttcccagaagtattgcagtgaaattggcgagatagcctacatgcagtgcttggcaaacgccaacctacagagctgaccatcctgtattggctggtgtatgagt

SEQ ID NO: 11821 - DNA, 132 bp, Homo sapiens
  D7S526
  Located on chromosome 7
  Distance between a terminus base of telomere on chromosomal short arm and 5'-terminus of this base sequence : 31781390
  Distance between 3'-terminus of neighbour sequence of sequence listing upward to telomere on chrosomal short arm and 5'-terminus of this base sequence : 80663
aacaagggcttctgctgagtgcacacacacacacacacacacacacacacacacacacacacacactctgcaatacctcgatcatcagccaccgtgtcctcacctaacctgcgggccctcacaccaagatgg

SEQ ID NO: 11822 - DNA, 456 bp, Homo sapiens
  AC005155.1_55210
  Located on chromosome 7
  Distance between a terminus base of telomere on chromosomal short arm and 5'-terminus of this base sequence : 31840727
  Distance between 3'-terminus of neighbour sequence of sequence listing upward to telomere on chrosomal short arm and 5'-terminus of this base sequence : 59205
aggcagacctaggtttgtataccaacttcctcttttccggggtgactttgggcaagtcggtcaaccctaacctctgcttcctgagctgtgaaatggaaagaacaagagcattaactgcacaagagaggattagaccttctgttcctccctctctccctccctccctccctccctccctccctccctcccttccttccttccttccttccttccatctgaacatctaccaaacacacctgaaactactgtgagcaggtctttgcctaggattagggcacagatatgaatcaggccttgtccctgttctcaggtcatgtggaccacagagcccagaaagacacccaaatggcttggctcatcctgttcactgtttccagcaggtattgggccacatgcacccagaatgtgacttcatcacccagctgagagaggatgagagtgcctgtctacaagcag

SEQ ID NO: 11823 - DNA, 226 bp, Homo sapiens
  AC005155.1_71817
  Located on chromosome 7
  Distance between a terminus base of telomere on chromosomal short arm and 5'-terminus of this base sequence : 31857443
  Distance between 3'-terminus of neighbour sequence of sequence listing upward to telomere on chrosomal short arm and 5'-terminus of this base sequence : 16260
taattgcatgagtcaataccatacaataaagctctttctacactgtgtgtgtgtgtgtgtgtgtgtgtgtgtgtgtgtatgtgtgaggggtgtgtatataaaatgttggttttattctctggagaatcctgactgatacagaaggcattatttagggctctctgttgcagacaacaggacccactctggctgagttaagcaaaaacatgacaagtttaaggacatc

SEQ ID NO: 11824 - DNA, 230 bp, Homo sapiens
  chr7.fa.O7frz.31857921
  Located on chromosome 7
  Distance between a terminus base of telomere on chromosomal short arm and 5'-terminus of this base sequence : 31980947
  Distance between 3'-terminus of neighbour sequence of sequence listing upward to telomere on chrosomal short arm and 5'-terminus of this base sequence : 123278
tttccagttcaaagtcaagacaggtaaaagggcattcatcattgtgcctcatatcaggttttgatgaatatatgtgtgtgtgtgtgtgtgtgtgtgtgtgtgtgtgtagagggatggacaggatgctgtttattttccctttcttggaaatggaccttctgtcccttccatttggacaccacagtggaagctggtggcctggaaggaaggattaggtcatggacatttga

SEQ ID NO: 11825 - DNA, 474 bp, Homo sapiens
  AC005090.1_113098
  Located on chromosome 7
  Distance between a terminus base of telomere on chromosomal short arm and 5'-terminus of this base sequence : 32285033
  Distance between 3'-terminus of neighbour sequence of sequence listing upward to telomere on chrosomal short arm and 5'-terminus of this base sequence : 303856
ttagaccaaagtcttgcataaaattagcactcagtaagtatttatgtgagggatcaggggaaaggaggagggatgagcagaaggaaaggacaatcagagagatacagttgagggagatgaagaaggagggaaaggaaggaaggaaggaaggaaggaaggagggaaggcaggccacctcatgattcccctcggccagctgtcattgtaaatgaatgagcagaaaatggtatgatgttattgaaggacatgcaaaggtctgtttattgggttctaaattctcccttattggattcttacgtgtatctcctggagacttttcccttttaaatactctaaggcaccagcaaaagttagttgatttggtttatccctttagtcttattgttgtctagaaaagagtaaatttctgagaaacacgacccaggagaggaagcttgtgatggggaaggggcttaggtgtcttagatggaagtg

SEQ ID NO: 11826 - DNA, 270 bp, Homo sapiens
  AC005090.1_76488
  Located on chromosome 7
  Distance between a terminus base of telomere on chromosomal short arm and 5'-terminus of this base sequence : 32321702
  Distance between 3'-terminus of neighbour sequence of sequence listing upward to telomere on chrosomal short arm and 5'-terminus of this base sequence : 36195
caaagctcgtgcttaatgatacattgcctctcaaagagtctttcatccagctggcaaatatggggaataaaatgattgtgtgtgtgtgtgtgtgtgtgtgtttaaaaacctactgcagagtgtgagggatgaattatggttgtatgtgagtgaaatctgtacaaggaaaatgaatggtagattatagaaaatagccttatggggatagtggatatacaaatctataaaataattcctctcaattaactgtgaaactgatttaggctttcc

SEQ ID NO: 11827 - DNA, 340 bp, Homo sapiens
  AC005090.1_69783
  Located on chromosome 7
  Distance between a terminus base of telomere on chromosomal short arm and 5'-terminus of this base sequence : 32328311
  Distance between 3'-terminus of neighbour sequence of sequence listing upward to telomere on chrosomal short arm and 5'-terminus of this base sequence : 6339
tactcagcacttctcatcctttacctcatagggaactgtgtcccactacatgggcccctctttcacctccgtatctctgcacaggctagtccctcttcctctgactggttggctgctcattatccttccaggtttatctcagtagtcactccttcaggaagctttccatgtcacacacacacacacacacacacacaaacacacacacacacttcggagatggcccacacctgttcccctattgcattctaggaacacttccaccacagcatcacacaacacaagagtgagacaggaggtctcatttctcccaacagtagaaatctccttgaacaaagtg

SEQ ID NO: 11828 - DNA, 412 bp, Homo sapiens
  AC005090.1_5453
  Located on chromosome 7
  Distance between a terminus base of telomere on chromosomal short arm and 5'-terminus of this base sequence : 32392568
  Distance between 3'-terminus of neighbour sequence of sequence listing upward to telomere on chrosomal short arm and 5'-terminus of this base sequence : 63917
gtcaggtttctgcactgttaagttacgcttttcctctttccatacttattttttgaaagaaagtcactatgcacatcgcacacccaagaagtgagaagttatactctacctccttgaaggtgggagtatctacatagattatttggaattattctacccagctttggccaataagagctctttcagttgattcctgtgtctctttgacataccacatcattgtgtgtgtgtgtgtgtgtgtgtgtgtgtgtgtgtgtgtgtgtgtgtgtgagagagagagagagagtttggcacttttcttactttctggcactataaagtgatataagctcatcttttgtatttcctgccctagacctagaatcagaatggttttagaaaccaagatctggataccagctatgttcattac

SEQ ID NO: 11829 - DNA, 313 bp, Homo sapiens
  AC005090.1_4330
  Located on chromosome 7
  Distance between a terminus base of telomere on chromosomal short arm and 5'-terminus of this base sequence : 32393747
  Distance between 3'-terminus of neighbour sequence of sequence listing upward to telomere on chrosomal short arm and 5'-terminus of this base sequence : 767
ataacctagaatgcattccatcttgctaaatgtctcatgtgagcctgctactcaagattatgatatgtagattatctctgagacctcagttctggaatgtgtccgaggaaagttgtttcagtttgtccagctttttctcctttccctccttccttccttccttccttccttccttccttccttccttccttccttccttccttccttccttcctcctttattccctccctccctcccttccttccttccttctttctttcttttgacacagggcctcgttctctcacccaagctatagtacagtggcggtgat

SEQ ID NO: 11830 - DNA, 416 bp, Homo sapiens
  AC006044.2_11279
  Located on chromosome 7
  Distance between a terminus base of telomere on chromosomal short arm and 5'-terminus of this base sequence : 32409081
  Distance between 3'-terminus of neighbour sequence of sequence listing upward to telomere on chrosomal short arm and 5'-terminus of this base sequence : 15021
cagttctgccttcagtcttaagcaggcctcattcacctgcaccttacaagtcatttctcttagctcttctcctcctcacttagccataagtagctgctgcctcttattcagagtaagtcttggaaagcttagaggagtttcttttagttattctgctccattatgagactttcagcagattttgcatgcctgagcttaagtgaaaatttcacttagctatcctgctcccctctagccatagcctgctgttgcttcctatttattgtatgcctagaaggtgtgtgtgttgtgtgtgtgtgtgtgtgtgtgtgtgtgtgtgtgtgtgtttccccttccaaagacactgcctgttgaagaggaactggtctctttactgtcctactttgctcccaatcttcctggtgaatactcacata

SEQ ID NO: 11831 - DNA, 330 bp, Homo sapiens
  AC007093.3_5584
  Located on chromosome 7
  Distance between a terminus base of telomere on chromosomal short arm and 5'-terminus of this base sequence : 32604837
  Distance between 3'-terminus of neighbour sequence of sequence listing upward to telomere on chrosomal short arm and 5'-terminus of this base sequence : 195340
agactagccagattctacaatcacataggccaattcctttaaatctttctctctctctctctctcctctctttctgtgtgtgtgtgtgtgtgtgtgtgtgtgtgtgtgtgtgtgactggtctgcttctctgaagaaccctaatacaccaagacacttagagctctttattgccacaatgtgtgtttggtctgctttacatttaaccgttaatgttaggaaaatcaataatggtaaactgtaacccaagggggacctcggggatttcttgacagttgtccttggatctaattcttcaaaagatagcactgactgacgaattaggtgaatga

SEQ ID NO: 11832 - DNA, 343 bp, Homo sapiens
  D7S1834
  Located on chromosome 7
  Distance between a terminus base of telomere on chromosomal short arm and 5'-terminus of this base sequence : 32659088
  Distance between 3'-terminus of neighbour sequence of sequence listing upward to telomere on chrosomal short arm and 5'-terminus of this base sequence : 53921
ccatggggaatgttacaaagtaatttccatcatcaaagtctctgctcataggttaagaaagaagaaaatatattatattatctatctatctatctatctatctatctatctatctatctatctatctatctatctatctatcatctatctatctatctatctacctacctacctatctaaggaaaagtgacccatgagagaagtgatattaaaataaacagtatccatacttccaaaatatggataacaaaaattggtcttcaacttttggattaccgtctcacatcccatgataatgttgctttttactttacacttttgtatctaaaggcatggttccaag

SEQ ID NO: 11833 - DNA, 465 bp, Homo sapiens
  chr7.fa.O7frz.32656244
  Located on chromosome 7
  Distance between a terminus base of telomere on chromosomal short arm and 5'-terminus of this base sequence : 32779030
  Distance between 3'-terminus of neighbour sequence of sequence listing upward to telomere on chrosomal short arm and 5'-terminus of this base sequence : 119599
actagttgtatgaccttgaacaagctttttaaatacccaatatttccatttcttctttggtaaaataggaataagagtatcttcctcatagatttgatgattacacataaaataatgtatgtagagaggttaacaccacgcttttaagccttcagtagctgctatgtgtgcacgaatgcacgtgtgtatatactttgtgccaggtactctgctgggtacataaataactatgatgcaaggcagaatgaaagagagaaactgaagagcaagaataggacttgagaatgagccaaccatttcttgatatgtggggtgtgtgtgtgtgtgtgtgtgtgtgtgtttcttacctcagggccagaactaatttcagatgatgggaaattctgaccctataggtaaatgcaaaataaatttccttgttcaaggatgccgagagcaagaaaagtgccatccaagacatattac

SEQ ID NO: 11834 - DNA, 395 bp, Homo sapiens
  AC007033.3_56628
  Located on chromosome 7
  Distance between a terminus base of telomere on chromosomal short arm and 5'-terminus of this base sequence : 32858930
  Distance between 3'-terminus of neighbour sequence of sequence listing upward to telomere on chrosomal short arm and 5'-terminus of this base sequence : 79435
gaagccaaggaatatcaagattgccaggagccaccagatgctgggaagaggcaaggaaggttcttccccagggtcgatggaaggagcatggtcccactaacccccttgattttggacttctggcctccagaactgtgagggaaaaaatttgttttaagccacctggtttgtgataatttgctgcaacaacattaggaaactaaccaggagaggggaaggtttttagctgaaaatagtctataacacttatagagttttcattgaacacgaacacacacacacacacacacacacacatacacacacaaaactaggaagaaacgcttctgttttaagacaaactccaaacatatggtcaatgctgattaaattaaatgagcatgagtcagaactac

SEQ ID NO: 11835 - DNA, 283 bp, Homo sapiens
  AC007033.3_65765
  Located on chromosome 7
  Distance between a terminus base of telomere on chromosomal short arm and 5'-terminus of this base sequence : 32868305
  Distance between 3'-terminus of neighbour sequence of sequence listing upward to telomere on chrosomal short arm and 5'-terminus of this base sequence : 8980
cttcagaaccatctgtctctttacgcttccggacacacacacacacacacacacacacacacacacacacacttccatgcattcactgggtgtaaaaaccaagttgagagagagagaagctggcaacataggtctcccttgcaacagagcttggaggggcacacgaggaagaaacatcgtgattactctatggactttgcatccctggatggagcaaagttttcccaccccgcccatacccctccagcccagccccaagctagaacagtaacttacaggcctg

SEQ ID NO: 11836 - DNA, 428 bp, Homo sapiens
  AC007033.3_70692
  Located on chromosome 7
  Distance between a terminus base of telomere on chromosomal short arm and 5'-terminus of this base sequence : 32873056
  Distance between 3'-terminus of neighbour sequence of sequence listing upward to telomere on chrosomal short arm and 5'-terminus of this base sequence : 4468
ccatttagttcaagctccaatacagcccccacaccatttcatatggaatatatttacttttttgaatatatttttgcttttacagaatattttcacaggacataattttttaaactcatccctgaaaaggactactatttgctatcaaaaataaaaaggtcgagattgatctctccacgtttgtatacatgtgcctgtgtgtgtatacgtgtgtgtgtgtgtgtgtgtgtgtatgtatggggagggtggagacagcaaaaacaccaagtgaaaaaacaaggcatagaattgtacataatacaatcacactctgtaaaagaatggataggcatatatgccagcatgtgaataagcattcttaaagaatacagaagaaaatgtttatggtgatttttctttggagaataggactgagaaatctacagtgg

SEQ ID NO: 11837 - DNA, 272 bp, Homo sapiens
  AC004931.1_27568
  Located on chromosome 7
  Distance between a terminus base of telomere on chromosomal short arm and 5'-terminus of this base sequence : 32906104
  Distance between 3'-terminus of neighbour sequence of sequence listing upward to telomere on chrosomal short arm and 5'-terminus of this base sequence : 32620
tatgtccagattagacctggacatttaaattcatccccaaaaggatatagcttatgctctgatactctactcccaccaaccattatcagtaattttcaaattatggactgctctctatcagtagataataaaatcagcttactgggttatagccaacaattttatgttaataaaatagaataggaaaattagacttaatcagtggtagtaagatgagagactgtgtgtgtgtgtgtgtgtgtgtgtgtgtgtttgcacgcataatgtaaagt

SEQ ID NO: 11838 - DNA, 252 bp, Homo sapiens
  D7S2252
  Located on chromosome 7
  Distance between a terminus base of telomere on chromosomal short arm and 5'-terminus of this base sequence : 32906296
  Distance between 3'-terminus of neighbour sequence of sequence listing upward to telomere on chrosomal short arm and 5'-terminus of this base sequence : -80
acttaatcagtggtagtaagatgagagactgtgtgtgtgtgtgtgtgtgtgtgtgtgtgtttgcacgcataatgtaaagtgtatttttttactgtgtgtcacagtcaaaccagcatacagcacctggatatcaaccccttactggaaagagcagagagacaacatgagcaaagaactggaaaaacaggtttccttcatgaacttctaaaagcaaaatgaggaagaaattaagccctcttgtggcccaacaga

SEQ ID NO: 11839 - DNA, 336 bp, Homo sapiens
  AC004931.1_40576
  Located on chromosome 7
  Distance between a terminus base of telomere on chromosomal short arm and 5'-terminus of this base sequence : 32919157
  Distance between 3'-terminus of neighbour sequence of sequence listing upward to telomere on chrosomal short arm and 5'-terminus of this base sequence : 12609
tccaactcctaaacattctgaccaaagtatttccataatccagacacatgaaaattgaacgtgtgtctgtagaactccctcaggtttgtggataggtctttaatttgtgcctctatttcttaatcccctatcatactgaaataggggtgtgtgtgtgtgtgtgtgtgcgagacagagtgtgtgtgtgtgtgtgtgtgtgtgtgtgttggaagcacctctatcatagattcagcttgcaacatcagctctgatagcaattcctttcttcaagggcagctcataagtatttggttatttctaagtatttctcaaaggtataaacttctgcaagccaga

SEQ ID NO: 11840 - DNA, 163 bp, Homo sapiens
  Z66719
  Located on chromosome 7
  Distance between a terminus base of telomere on chromosomal short arm and 5'-terminus of this base sequence : 32919228
  Distance between 3'-terminus of neighbour sequence of sequence listing upward to telomere on chrosomal short arm and 5'-terminus of this base sequence : -265
gaactccctcaggtttgtggataggtctttaatttgtgcctctatttcttaatcccctatcatactgaaataggggtgtgtgtgtgtgtgtgtgtgcgagacagagtgtgtgtgtgtgtgtgtgtgtgtgtgtgttggaagcacctctatcatagattcagct

SEQ ID NO: 11841 - DNA, 360 bp, Homo sapiens
  AC004931.1_49834
  Located on chromosome 7
  Distance between a terminus base of telomere on chromosomal short arm and 5'-terminus of this base sequence : 32928383
  Distance between 3'-terminus of neighbour sequence of sequence listing upward to telomere on chrosomal short arm and 5'-terminus of this base sequence : 8992
agaccaagctgatgtagaaagtagagaatgacaaagagctgttgtgttctgggacctggcaaatttggcagggtgggagatggagaggccagcttcatgctgggagagaaggcaagggcatcttcacaaggccaggctgaggacaccacttcaaagaaggtctagagtggcactttgcaaagtctgttccctggaatgggtccaccgttctctctctctctctctctctctctctctctctctctctctcactgaaacacacacacacacacacacacacacacacacacacagcttcatctgtttgtcgtttctgtttttctaaggggaggcattacagcatactgctcaagatcactt

SEQ ID NO: 11842 - DNA, 159 bp, Homo sapiens
  G08595
  Located on chromosome 7
  Distance between a terminus base of telomere on chromosomal short arm and 5'-terminus of this base sequence : 32969054
  Distance between 3'-terminus of neighbour sequence of sequence listing upward to telomere on chrosomal short arm and 5'-terminus of this base sequence : 40311
gggttctgcagagaatcagaaccagtaggggatagaaagatagatagatagatagatagatagatagatagatagatagacagacagatcaacagtcagccataaagagatttattataacaaattggttcaaagattatggaaaataagaggtcccaa

SEQ ID NO: 11843 - DNA, 223 bp, Homo sapiens
  AC004931.1_106318
  Located on chromosome 7
  Distance between a terminus base of telomere on chromosomal short arm and 5'-terminus of this base sequence : 32984991
  Distance between 3'-terminus of neighbour sequence of sequence listing upward to telomere on chrosomal short arm and 5'-terminus of this base sequence : 15778
aaatgttggtattacaggcaagagacactatgctcagccttaaaaagctttcttgattacatataaaacatatatatacatatatgtgtgtgtgtgtgtgtgtgtgtgtgtgtgtgtgtgtgtgtgtatatatatatatatatatatatatatctcaaactcctgcctgcttcttggttattgtgatgcttcaactttgatcagaggcagtaaagacatactc

SEQ ID NO: 11844 - DNA, 230 bp, Homo sapiens
  G08620
  Located on chromosome 7
  Distance between a terminus base of telomere on chromosomal short arm and 5'-terminus of this base sequence : 32998448
  Distance between 3'-terminus of neighbour sequence of sequence listing upward to telomere on chrosomal short arm and 5'-terminus of this base sequence : 13234
tcacagaaacccaatccactattctagatagatagatagatagatagatagatagatagatagatagattcatttaaatatcaatgcaactctatgaaatatgcactgtgattatctcctttatataaatgggaaactgagaccaagaaaaataaggtaacttactcaaggaagagtggcagagccaggttctgaactcaggccgtctggctccagactccaggcattta

SEQ ID NO: 11845 - DNA, 301 bp, Homo sapiens
  AC005589.1_79828
  Located on chromosome 7
  Distance between a terminus base of telomere on chromosomal short arm and 5'-terminus of this base sequence : 33104000
  Distance between 3'-terminus of neighbour sequence of sequence listing upward to telomere on chrosomal short arm and 5'-terminus of this base sequence : 105322
aaatgttagcaagctgaatgtaacaatgtattctttattatatggcttacacaaattacgcttgtcacagaagtgtaagaataatattagagaatccattaatcttatgttatcatttagcatgctaagggattattgaagaaaacaaagatatcatcttgtaaatgtaggaagagtctttgaaaatattcaagaaccaatcgtgattaaaacaaataaatatgtgtatacacacacacacacacacacacacacacacacacacacatatatgatgaagtctggttccagataagatgaa

SEQ ID NO: 11846 - DNA, 356 bp, Homo sapiens
  AC005589.1_115456
  Located on chromosome 7
  Distance between a terminus base of telomere on chromosomal short arm and 5'-terminus of this base sequence : 33139694
  Distance between 3'-terminus of neighbour sequence of sequence listing upward to telomere on chrosomal short arm and 5'-terminus of this base sequence : 35393
acgtccacgtaaggaacagatgaagaaagtggagtcaggtagaagggggtgacccatcaagcactggggccaaggagggcttctggaagaaggcagaagtgaggtctttccctcaaactacagaaaatgcagcctctttctctctctctcacacacacacacactctctctctctctctctctctctctctctctctctctaacagcccagcaaatgacagtaccccaaccatctgaaagtaagtctcttctctagcacccctggcagtgacagggaaggcatggaacatcacaatgagatgaaaccccctcagaaatgacttctttttctcccagtcactgcctcatttctctgt

SEQ ID NO: 11847 - DNA, 270 bp, Homo sapiens
  D7S690
  Located on chromosome 7
  Distance between a terminus base of telomere on chromosomal short arm and 5'-terminus of this base sequence : 33192674
  Distance between 3'-terminus of neighbour sequence of sequence listing upward to telomere on chrosomal short arm and 5'-terminus of this base sequence : 52624
tgctgggcttcatacctgaatgatggggtgatctgtgcggcaaaccaccatggcacacgtttacctatataacaaacctgcacatcctgcacatgtacccctgaacttaaaagtggggggaaaaaggtagagttaaagggattatgcaaggaattgttctaggaatattgtcacactttcaactgcatgtgcccccaccaggtgcttaggcacacacatacacacacacacacacacacacacacttccacataagcaaaataaaagttt

SEQ ID NO: 11848 - DNA, 395 bp, Homo sapiens
  AC018641.3_159457
  Located on chromosome 7
  Distance between a terminus base of telomere on chromosomal short arm and 5'-terminus of this base sequence : 33255760
  Distance between 3'-terminus of neighbour sequence of sequence listing upward to telomere on chrosomal short arm and 5'-terminus of this base sequence : 62816
ttctagatctggcattctgtagagaagcaaaaagacttcagatctcacacagcaggaaccaagggaaagtccctttggggattctgctgtcaatggaaaagaccaggaaagactgttctatgttagagacagttgccttttgaatgtgaaatgcctgatataataattatcagaatgctggatggatggatggatggatggatgcatggatggatggaaggatggatgggtggttggatggatggatggactgattcacccattcattcagtcaggacagaaatgaccaacctgacttttactcagtttctgacactggaaagggtccaagctttggagtcagccactcctgggttgacccctttggagtccgctccaactcttacaatcagtga

SEQ ID NO: 11849 - DNA, 420 bp, Homo sapiens
  AC018641.3_122011
  Located on chromosome 7
  Distance between a terminus base of telomere on chromosomal short arm and 5'-terminus of this base sequence : 33293276
  Distance between 3'-terminus of neighbour sequence of sequence listing upward to telomere on chrosomal short arm and 5'-terminus of this base sequence : 37121
agtctatccatgagcaagtcacttggactctcaaaaggatgctgtgaacaccacagaggggtagttttcaaagtcagggttttcacccctagaaggcggattaaaactaacacacacacacacacacacacacagcactaggttgaataatttgagtaaattacagaaaatataacactaaggatgacataaatatgtaggactgtgtcctacctcagaagtaggtgatctagggcctgaaccctctaaggccacatgaactgctttgtggattttgctggcctccccgcggccttcagcctctctctcatcccactccctttctcttccctgccttcctcactccagttattgtttaatttccatggaagaatcatcatggcattgtggaaggagaactggattacaaatcagattcac

SEQ ID NO: 11850 - DNA, 278 bp, Homo sapiens
  AC018641.3_18592
  Located on chromosome 7
  Distance between a terminus base of telomere on chromosomal short arm and 5'-terminus of this base sequence : 33396726
  Distance between 3'-terminus of neighbour sequence of sequence listing upward to telomere on chrosomal short arm and 5'-terminus of this base sequence : 103030
agtgaaccgagatcatgctactgcactcctccctgggcggctgagcgagactccatcttgtgggagggagaaatacacacacacacacacacacacacacacagagagaaaagaaaatgggtattatatctaactgagggatgtttcccctatctagtgctataaaactgaaggcatgtaaatctgctctttgagaaatgttaattggacacactaaatgggaactagtaagattgcctgagcccacaaaatatgggttagaagctgcagtgctagtt

SEQ ID NO: 11851 - DNA, 231 bp, Homo sapiens
  AC018633.2_20107
  Located on chromosome 7
  Distance between a terminus base of telomere on chromosomal short arm and 5'-terminus of this base sequence : 33428774
  Distance between 3'-terminus of neighbour sequence of sequence listing upward to telomere on chrosomal short arm and 5'-terminus of this base sequence : 31770
actccatctcaaagtaaatgaatgaatgaatgaatgaatgagtattccttcaaacagaaaaaaagataaagttttttttttaaaaatgaacccagcatattagtgtggtatttcaaaaaattttatttaatttctaaaattgtgataaaatacacataacatacaatttatcatcgtaaccattttaaggtgtacaattcagtgctattaagtacattcatgttatgcagc

SEQ ID NO: 11852 - DNA, 340 bp, Homo sapiens
  AC018633.2_92942
  Located on chromosome 7
  Distance between a terminus base of telomere on chromosomal short arm and 5'-terminus of this base sequence : 33501421
  Distance between 3'-terminus of neighbour sequence of sequence listing upward to telomere on chrosomal short arm and 5'-terminus of this base sequence : 72416
gtaactcaagtatctgtggacagactgaatagataagcaaaatcgtgtgtgtgtgtgtgtgtgtgtgtgtgtgtacacacaatggaatccaagtatccatggacaggctgaatggataagcaaaatctagtgtgtgtgtgtatgtgtgtgtacacacaatggaatccaagtatccatggacagattgaatggataagcaaaatcgtgtgtgtgtgtgtgtgtgtgtgtgtgtgtacacacaatggactattatttagctttaaaaggaaggaaattctgacatgcttcaacatagaagaaacttggggacagtaggctaattgaaataggccagtaacaa

SEQ ID NO: 11853 - DNA, 433 bp, Homo sapiens
  AC018633.2_136650
  Located on chromosome 7
  Distance between a terminus base of telomere on chromosomal short arm and 5'-terminus of this base sequence : 33545166
  Distance between 3'-terminus of neighbour sequence of sequence listing upward to telomere on chrosomal short arm and 5'-terminus of this base sequence : 43405
aacaagctatagccactgacactggaagaaccagagacagccatctggaaagacccaaatgctctaaggtaaaagctgccctcatgccaccttaagcagtagtctacagacttttttacaccaaaactacagtaagaagactttacacaactcagcacacatacatatgtgtgtgtgtgtgtgtgtgtgtgtatatacatacacacagcaaatggaagtttctctaagtagtatctatccttactagtctggtagatgatattatttactttgtagtattttttttctcatctaaaatgaaatgggctcaacccactgaatcaattttaaaactctcaaataagtgataacctgcaatttgacaaacactgtgctgaagtagtcactgcttgactttggggactggggaaagtcaagtgttccatgagatcat

SEQ ID NO: 11854 - DNA, 367 bp, Homo sapiens
  AC018633.2_145779
  Located on chromosome 7
  Distance between a terminus base of telomere on chromosomal short arm and 5'-terminus of this base sequence : 33554311
  Distance between 3'-terminus of neighbour sequence of sequence listing upward to telomere on chrosomal short arm and 5'-terminus of this base sequence : 8712
ctcatcttgaattgtaatcctcaggtgtcaagggaagaacctggtgggaggtgattggatcatgggggcggtttcccccatgctattctcatgatagtgagtgagttctcacgagagctgatggttttaaagtgttgtactttctggtgctctctctctctctctctctctcttgcctgccccatgtaagaagtgccttgcttccccttcaccttccaccatgattgtaagtttcctgaggcctccccagccatgcagaactatgagtcaattaaacctcctttctttataaatactcagtctctggtggtattcttcatagcagtgtgaaaacagactaatacagagaattggtaccgaggtagtg

SEQ ID NO: 11855 - DNA, 357 bp, Homo sapiens
  AC018633.2_152537
  Located on chromosome 7
  Distance between a terminus base of telomere on chromosomal short arm and 5'-terminus of this base sequence : 33560947
  Distance between 3'-terminus of neighbour sequence of sequence listing upward to telomere on chrosomal short arm and 5'-terminus of this base sequence : 6269
accggagctgttcctattcggccatcttggctcctccgactggcagcattttgcacctggtctagagacctgtggaactttgaaataatatggtttgtctctgtgtccccaccaaaatctcctctcgaattgtaatcctcaggtgtcaagggaggaacctggtgggaattgagtgcatcatggaggtggtttcccccatgcggttctcatgatagtgagtgagttctcatgagagctgatggttttaaagtgtggcacttcctggttcgttctctctctctctctctctctctgtctcacctgctgctatataagatgtgccttgcttcccctttgtcttccacaatgattgtgaat

SEQ ID NO: 11856 - DNA, 390 bp, Homo sapiens
  chr7.fa.O7frz.33566496
  Located on chromosome 7
  Distance between a terminus base of telomere on chromosomal short arm and 5'-terminus of this base sequence : 33685948
  Distance between 3'-terminus of neighbour sequence of sequence listing upward to telomere on chrosomal short arm and 5'-terminus of this base sequence : 124644
atgatatcatactgacatggaaagatgcttaagatatataagggagtaaacaaaatgatatagtcttattaatgcataattaacaaacataaaagtaaaaaaaagtgtaaaagagcaaaattttaagagtggttttttgggtggagagataatcgagaggtatagggcttttttattaaacttatttctattttttttctgctactaaagaaaatgtaaaagtcttttgttcccctcaaacatcaatcattattttgtttatgtgtgagaaactgtgtgtgtgtgtgtgtgtgtgtttgtgtgtgtgtatgtttcaatgataatatttttatcccccacaaaatatacaggaaaagcttattccatttaaggagctttacgtaccttaga

SEQ ID NO: 11857 - DNA, 330 bp, Homo sapiens
  AC074338.1_13768
  Located on chromosome 7
  Distance between a terminus base of telomere on chromosomal short arm and 5'-terminus of this base sequence : 33919759
  Distance between 3'-terminus of neighbour sequence of sequence listing upward to telomere on chrosomal short arm and 5'-terminus of this base sequence : 233421
tgacatttatgttgcaataggtaggtcaggtccaagaaaacaggatgtaagataataccataaatggcgtcttcatttatagtattgatacatttgatttgtgtgtgtgtgtgtgtgtgtggtttttttttgatgtatttgatttttagtagagatgaggtccccttattttgcccaggctggtctctaactcttaggctcaggtgatcctcctgcctccacctcccaacgtgctgggattacaggtatgagccaccttgcccggcctggtaaatagtttaaaataaacaaattccttataaaaagctggatcataattcaggtactcat

SEQ ID NO: 11858 - DNA, 434 bp, Homo sapiens
  AC007312.1_129027
  Located on chromosome 7
  Distance between a terminus base of telomere on chromosomal short arm and 5'-terminus of this base sequence : 34055604
  Distance between 3'-terminus of neighbour sequence of sequence listing upward to telomere on chrosomal short arm and 5'-terminus of this base sequence : 135515
catgttcaatcttaaggtactcctctttatgacagaatatagtaaaaaacatttatagcagaaagttccccagagttgctatagcttaagaccagcctcacaaatcctttttctcattaattaaaatattgcaagaggtagtgatttttaccacacctataagcagtttgcacacagagagagagagagagagagagagtgagagaagaaaggcaagggaagggagaaaagcattgcctgcagtggggtgggaagacgaggagcttaggggaagctagagaaagacccaccattgcagtgacactaaacaaagttcaggtggttgcttgtaatttgctaagggatcttttccagcagtcccatcagctttcaagtttccccttttggggagaaaagaagctccccatgtccggtgatcctgtacatgcctaatc

SEQ ID NO: 11859 - DNA, 325 bp, Homo sapiens
  AC074338.1_149689
  Located on chromosome 7
  Distance between a terminus base of telomere on chromosomal short arm and 5'-terminus of this base sequence : 34055604
  Distance between 3'-terminus of neighbour sequence of sequence listing upward to telomere on chrosomal short arm and 5'-terminus of this base sequence : -434
catgttcaatcttaaggtactcctctttatgacagaatatagtaaaaaacatttatagcagaaagttccccagagttgctatagcttaagaccagcctcacaaatcctttttctcattaattaaaatattgcaagaggtagtgatttttaccacacctataagcagtttgcacacagagagagagagagagagagagagtgagagaagaaaggcaagggaagggagaaaagcattgcctgcagtggggtgggaagacgaggagcttaggggaagctagagaaagacccaccattgcagtgacactaaacaaagttcaggtggttg

SEQ ID NO: 11860 - DNA, 362 bp, Homo sapiens
  AC007312.1_63896
  Located on chromosome 7
  Distance between a terminus base of telomere on chromosomal short arm and 5'-terminus of this base sequence : 34120706
  Distance between 3'-terminus of neighbour sequence of sequence listing upward to telomere on chrosomal short arm and 5'-terminus of this base sequence : 64777
gtagcatgctgagtaatggtagttttctttcatgtttgctacaccacttactctgctgtatatattccacaggaagagaaagacagagaaatggaggacatggcattcaggactgccctccatgaggcccttgttgccataataatgaaggatggaacatgctctgggtcatgcatggtagaaagaacttctgggcatggggacacacacacacacacacacacacacgcgtacactcctacacttcatgaatagattgtaattttcatgaatagattataatttaatagagaagactgttaaatttagcagtatgattaacatttagttgattaccagtttatgcatcatgttaaagcttt

SEQ ID NO: 11861 - DNA, 452 bp, Homo sapiens
  AC007312.1_18794
  Located on chromosome 7
  Distance between a terminus base of telomere on chromosomal short arm and 5'-terminus of this base sequence : 34165748
  Distance between 3'-terminus of neighbour sequence of sequence listing upward to telomere on chrosomal short arm and 5'-terminus of this base sequence : 44680
cagcattgtgaatcttagtctaacatatactttgaagccagtacaaataatttattttacattatatgatgctgtttaactttgatctagtcaattaaaacaataagactacttataaatatttttccatttataaatgtttacttctgttagcagcagcaaccctcccccccatatgccaaacacacacacactcacgcacacaatacttccatctatctatcatctatctatctatctatctatctatctatctatctatctatctatctatctatctatctatctctttgtccatccatccatccatccatccatccatccatccatccatccacccatccatccgagtatgtatgtacatatctttcttccctggagtgtgagtggcttgccagagagggcaggcagaggcatcttggctggaggctccagttaatttaagacagtgg

SEQ ID NO: 11862 - DNA, 226 bp, Homo sapiens
  AC006195.1_134867
  Located on chromosome 7
  Distance between a terminus base of telomere on chromosomal short arm and 5'-terminus of this base sequence : 34240157
  Distance between 3'-terminus of neighbour sequence of sequence listing upward to telomere on chrosomal short arm and 5'-terminus of this base sequence : 73957
actgaagctactgagcttactgagttatacacaccttcatgggaataaagtaagatattaagaaaggaagtatttaacgaatctgtattgagagaaaaaagtacacacacacacacacacacacacacacacacacacacacccatacccccttgaaatagtctggctcaggacattccaattaaaaaaaaaactctagtttttctggtgagctttcactttctac

SEQ ID NO: 11863 - DNA, 411 bp, Homo sapiens
  chr7.fa.O7frz.34301271
  Located on chromosome 7
  Distance between a terminus base of telomere on chromosomal short arm and 5'-terminus of this base sequence : 34364202
  Distance between 3'-terminus of neighbour sequence of sequence listing upward to telomere on chrosomal short arm and 5'-terminus of this base sequence : 123819
gttcatgattactgaagtggttacaaactcaaatgactagagggccaggcaggtaacacagatgtagatgggaaacaataaggagtaatgtgcaggacttgaatgttgttctgaaccaaaggcattcaaacattcaaatgcaggtttacttaaaagagggacaaacaaaggaatctgtgggcccttcaccccaggagatcagttgttggggaggagtcatttataggtatttctcatactcacttaacctgatagccgtttgtatagcacttatcatctagtataggagtgagtgtgtgtgtgtgtgtgtgtgtgtgtgtgtgtgtgtgtgtgtgtatgtgttgaagggtacagtatggcacagtggaaaatgcttgggctttgtaggttttaaagatacctggtttgaat

SEQ ID NO: 11864 - DNA, 233 bp, Homo sapiens
  Z67551
  Located on chromosome 7
  Distance between a terminus base of telomere on chromosomal short arm and 5'-terminus of this base sequence : 34454096
  Distance between 3'-terminus of neighbour sequence of sequence listing upward to telomere on chrosomal short arm and 5'-terminus of this base sequence : 89483
agctaaacagaaccacttaaggcttttaagtacaaggatgatatgatcactgttcccttttcatagttataccttgtttctacaatgcacacacacacacacacacacacacacatacacacactgcatctgatgctcacaaggtcaaagttacatagttaacatttctggacacttttgcccttcaggttctatttctactcacttgacctcctgcccattcattttattca

SEQ ID NO: 11865 - DNA, 389 bp, Homo sapiens
  G10084
  Located on chromosome 7
  Distance between a terminus base of telomere on chromosomal short arm and 5'-terminus of this base sequence : 34467765
  Distance between 3'-terminus of neighbour sequence of sequence listing upward to telomere on chrosomal short arm and 5'-terminus of this base sequence : 13436
gataggtgcagcaaaccactatggcacacatatacctttgtaacaaacctgcatattctgcacttgtatcctggaacttaaagtaaaataaaaaaaaaaaaacccaacaatttcacagaaatgttggctttccaagatggcccctgagcacagaacagaaacacacacacacacacacacacacacacacatttatatatgtgtgtgtgtgactattgatacatataattgtagatatataattgatatataattatctatctatctatctatctatctatctatctatctatctatctatctatatataattagtcaaaaaaattcccaccatcatacctttaccaattgggtgctcttgaggaaaagttaagtccaagtgagggcag

SEQ ID NO: 11866 - DNA, 210 bp, Homo sapiens
  AC008080.1_21014
  Located on chromosome 7
  Distance between a terminus base of telomere on chromosomal short arm and 5'-terminus of this base sequence : 34605057
  Distance between 3'-terminus of neighbour sequence of sequence listing upward to telomere on chrosomal short arm and 5'-terminus of this base sequence : 136903
gtgctaagaataatttctgagcagtaatcaattgcatctctatagaggacagacagtattataaatattgccataagaagaaagttttggccacttctctatgtttccttctatttcgctactggtagtgttaggggtgtgtgtgtgtgtgtgtgtgtgtgtgtgtgtgactatgtgcaggtgcaactgagttagcctaaggtgaataaa

SEQ ID NO: 11867 - DNA, 313 bp, Homo sapiens
  AC008080.1_38892
  Located on chromosome 7
  Distance between a terminus base of telomere on chromosomal short arm and 5'-terminus of this base sequence : 34622889
  Distance between 3'-terminus of neighbour sequence of sequence listing upward to telomere on chrosomal short arm and 5'-terminus of this base sequence : 17622
aagctcagccttacctacttctctccctgagaactactaggggagacctgggcacgtatcttcgaaatgcacgggccccccttgctctttgatatctgatgttctgggagaacacgtataggttctgacaatgtttaaaacctcctagtaggggcacaacagtctctgataacacacacatgcacacacacacacacacacacacacacatggattctaaacatgcaaaaaattcctgtaaggcctggtagatatgatgtcagaaagaaaaacaattgcaatatcttttgtgtactatgtcacagaactgcag

SEQ ID NO: 11868 - DNA, 463 bp, Homo sapiens
  AC008080.1_40377
  Located on chromosome 7
  Distance between a terminus base of telomere on chromosomal short arm and 5'-terminus of this base sequence : 34624211
  Distance between 3'-terminus of neighbour sequence of sequence listing upward to telomere on chrosomal short arm and 5'-terminus of this base sequence : 1009
attaagttcaggaattcaggactaaaaatactaggataaagatattaaaactctaagatttcaagtgtcatttagagttgggtgcttcaggaaaataacaggtttcctgctgactcctgtagattttctggtggcttctgtgaaggctgaatcctggaaccaccccactgccctacagccatggtggcaatagacgctttcctgcttgcaagtcttccttccttccttccttccctccctcccttcctccttccctctttctttcttttctttctttcttttcttttccttccttccttccttccttccttccttccttccttccttccttcctttctttctttctctttctttctttctttctttctttctttctttctttctttctttctttctttctttctttcttttcttctttcttctttctttttttttttttctagttaaagtcttgctctgttgc

SEQ ID NO: 11869 - DNA, 192 bp, Homo sapiens
  AC008080.1_47784
  Located on chromosome 7
  Distance between a terminus base of telomere on chromosomal short arm and 5'-terminus of this base sequence : 34631907
  Distance between 3'-terminus of neighbour sequence of sequence listing upward to telomere on chrosomal short arm and 5'-terminus of this base sequence : 7233
gccaactgttactgagttcaagaagagtctctttctcttgttctctctctctctgtacacacacacacacacacacaccctggggggtattaaacaaagtgttcctttaaagctgtattgtggttaatctcttatggcttgatgaaagagcctctctgtatggacaacccctaagttcataatggccgtaaa

SEQ ID NO: 11870 - DNA, 235 bp, Homo sapiens
  AC008080.1_49856
  Located on chromosome 7
  Distance between a terminus base of telomere on chromosomal short arm and 5'-terminus of this base sequence : 34633879
  Distance between 3'-terminus of neighbour sequence of sequence listing upward to telomere on chrosomal short arm and 5'-terminus of this base sequence : 1780
aacagtcttgcaagttagatgttcttactcatgtgaagaaaatggggtttcaagaagctaaataacttgcctaagcccatcaaccttgaaaatggagaagccaggatttcagcccaaggtaatctgaccctagcagctgttatctttccatttaatgagagagagagagagagagagagaacttgaaggcttgaggttcagaggaggtgaggatgccttatgacttgtgatttac

SEQ ID NO: 11871 - DNA, 354 bp, Homo sapiens
  AC008080.1_146164
  Located on chromosome 7
  Distance between a terminus base of telomere on chromosomal short arm and 5'-terminus of this base sequence : 34730284
  Distance between 3'-terminus of neighbour sequence of sequence listing upward to telomere on chrosomal short arm and 5'-terminus of this base sequence : 96170
agccagtttgcagtacactaattggttgcagcagccacaggagatgaatgcacacaaatacacacacacacacacacacacacacacacacacacacacatgcatacatatgttatatatatgagagcacaaggcagacaaaaaggttcctgctctcattggacaatgaaacatcgtagttcacaggcatcaaacacgtaattgaaataaagagcagtgagggttatgacagaggaagaatagggatcttgtgggaacatatgagaaaaccttactcttaggtcaggcaaggcttccgcaaagagagggcatttaaattgaaactagaaggtcaataagagaatctgccactta

SEQ ID NO: 11872 - DNA, 337 bp, Homo sapiens
  chr7.fa.O7frz.34744984
  Located on chromosome 7
  Distance between a terminus base of telomere on chromosomal short arm and 5'-terminus of this base sequence : 34808963
  Distance between 3'-terminus of neighbour sequence of sequence listing upward to telomere on chrosomal short arm and 5'-terminus of this base sequence : 78325
gaacaaggaagtgacatgtaagagagagaagtgccccgtgctgtcccgagactgtgccctggccatcaagcagaggggagcctgttgtgaacagtgcaaaggtgattgatgtcttggccgtcttctcttctggctgctgcttcaggcatttttatttctctttctctcaccttccttttcactcagcttttggctggggtgcacatgggtggggaggagaagtagggtgtgtgtgtgtgtgtgtgtgtgtatgtgtgtgtttgtgtgtatgtgtgtatctggggctggaaggaagggggctctcctggaggagggatgaaagtatgtgagcatcttc

SEQ ID NO: 11873 - DNA, 260 bp, Homo sapiens
  D7S683
  Located on chromosome 7
  Distance between a terminus base of telomere on chromosomal short arm and 5'-terminus of this base sequence : 34929340
  Distance between 3'-terminus of neighbour sequence of sequence listing upward to telomere on chrosomal short arm and 5'-terminus of this base sequence : 120040
ttttagtcttatcaaacgggaaaattagatttctgtcattgtatcatgtatgaaaattcatgcttggttttcccccagggtggaactaagtaaacaatgcatgacaacaagacataaatatgacttggttaaacacacaataattatttttatatccaggagggggaacacacacacacacacacacacacacatgcttgcacacaatctgaaatcttcactaatctttatcttaaatcagttggatgtagacagacacc

SEQ ID NO: 11874 - DNA, 204 bp, Homo sapiens
  AC007350.1_32980
  Located on chromosome 7
  Distance between a terminus base of telomere on chromosomal short arm and 5'-terminus of this base sequence : 34929421
  Distance between 3'-terminus of neighbour sequence of sequence listing upward to telomere on chrosomal short arm and 5'-terminus of this base sequence : -179
ggaactaagtaaacaatgcatgacaacaagacataaatatgacttggttaaacacacaataattatttttatatccaggagggggaacacacacacacacacacacacacacatgcttgcacacaatctgaaatcttcactaatctttatcttaaatcagttggatgtagacagacacctgagtcatttagtctaatgatggcg

SEQ ID NO: 11875 - DNA, 392 bp, Homo sapiens
  AC007350.1_94163
  Located on chromosome 7
  Distance between a terminus base of telomere on chromosomal short arm and 5'-terminus of this base sequence : 34990418
  Distance between 3'-terminus of neighbour sequence of sequence listing upward to telomere on chrosomal short arm and 5'-terminus of this base sequence : 60793
gcagactttgagtaaagcagattcctctctgcaacatggataggcctcatccaattggttgaaggccttcatagaaaaaggctaacctctctcaaacaagagggaattctgccagcagatcaccatcatgaaatgcagcgtcacctcttgcctgggtctctagcctgccaggctactctacagattttggatttaccagcccccacaatgttgtcaatgaattccttaaaatctctctctctctctctctcactgtctctctctctctctctcacacacacacacacacacacacgcactcgatacgatgacacatatacatgcacgctattggttctgcttcactggagaacactcggaagaattgaataatgcagtaagttcaggagaac

SEQ ID NO: 11876 - DNA, 359 bp, Homo sapiens
  AC007350.1_104726
  Located on chromosome 7
  Distance between a terminus base of telomere on chromosomal short arm and 5'-terminus of this base sequence : 35001170
  Distance between 3'-terminus of neighbour sequence of sequence listing upward to telomere on chrosomal short arm and 5'-terminus of this base sequence : 10360
gccagtgaccacagcttaggcgacagagcgagacgctgtctcaaaaaaaaagagacagaaagaaaaggaaggaaggaaggaaggagagagagagagagagagagagagagagagaaagagagagagagagaaagagagaaagaaagaaagaaagaaagaaagaaagaaagaaagaaagaaagaaagaaaacctgccatattataatttaggcttagttttatttcagttcctttgccatgagtccccaagggcatggactgaactggggagtaaaacctcattctctagtggctttcatcttgtcccttgtctggagtctttcctcacctggaaacactatttgcaaattgcattcagt

SEQ ID NO: 11877 - DNA, 271 bp, Homo sapiens
  D7S656
  Located on chromosome 7
  Distance between a terminus base of telomere on chromosomal short arm and 5'-terminus of this base sequence : 35029490
  Distance between 3'-terminus of neighbour sequence of sequence listing upward to telomere on chrosomal short arm and 5'-terminus of this base sequence : 27961
tgggagcctcaggaagccccatttgaggttttctgtttgggagagtgtcaagagtgccagagaaagtgactactgagatgagtcttggtagaggactaagtagcctttacctttgcaaagatgtgtgtgtgtgtctatgtgtgtgtgtgtgcatgtgtgtgtgtgtgtgtgtgtgtgtgtgtgaattttcaggagtggagtagtctgggcatttaaagaacaggtaactaagtagataaggagagagacaaacaggcagtgtgggtgtgca

SEQ ID NO: 11878 - DNA, 318 bp, Homo sapiens
  AC009262.4_118948
  Located on chromosome 7
  Distance between a terminus base of telomere on chromosomal short arm and 5'-terminus of this base sequence : 35039174
  Distance between 3'-terminus of neighbour sequence of sequence listing upward to telomere on chrosomal short arm and 5'-terminus of this base sequence : 9413
tgtcatttccaagagatgaaacttggcaggctaagtgcctgatttttaaaactactttgctaatatatatatatatatattatatatatatatatatataatatatataaaatatatatatatataatacacacacacacacacacacacacacacacacacacacacacacactatgggggagtttgtcactcacttcttttaaaacaagctcccacaggtctaagaatgtttaaaacagaaatgtatttaaatgcagacacagatcacagaaggacaaatcctcgtggacagtcaggtgaaagactatttaatcaa

SEQ ID NO: 11879 - DNA, 242 bp, Homo sapiens
  AC005686.1_24136
  Located on chromosome 7
  Distance between a terminus base of telomere on chromosomal short arm and 5'-terminus of this base sequence : 35082548
  Distance between 3'-terminus of neighbour sequence of sequence listing upward to telomere on chrosomal short arm and 5'-terminus of this base sequence : 43056
ttaccattgttatgcatgtctatatctagatagaaagatagacagacatatagatggtaggtagatagattagatagatagatagatagatagatagatagacagataagatagatagatgatagatagatagatagatagatagatagatagatagactctatctatatacatacacactagagaattttaagttacacatgtggctcacattatgttttcactggacagcaccagtctaa

SEQ ID NO: 11880 - DNA, 242 bp, Homo sapiens; identical to SEQ ID NO: 11879
  AC009262.4_75655
  Located on chromosome 7
  Distance between a terminus base of telomere on chromosomal short arm and 5'-terminus of this base sequence : 35082548
  Distance between 3'-terminus of neighbour sequence of sequence listing upward to telomere on chrosomal short arm and 5'-terminus of this base sequence : -242

SEQ ID NO: 11881 - DNA, 470 bp, Homo sapiens
  AC005686.1_27830
  Located on chromosome 7
  Distance between a terminus base of telomere on chromosomal short arm and 5'-terminus of this base sequence : 35085986
  Distance between 3'-terminus of neighbour sequence of sequence listing upward to telomere on chrosomal short arm and 5'-terminus of this base sequence : 3196
ctatgccaagactatgattcaaagaaactactagaaggccgggtgtagtggctcacgcctgtaatcccagcactttgggaggctgaggggggtggatcacttgaggccaggagttcaaaaccagcctggccaacatggtgaaaccccgtctctactaaaaatataaaaattagccaggcattgtgacacatgcctgtactcccagctactcgggaggttgaggcaggagaatcgtttgaacctgggaggcggaggttgcagtgagccgagatcgctccactgcactccagcctggacgacagagtgagaccccatctcaaataaatgaaagaaagaaagaaagaaagaaagaaagaaagaaagaaagaaagaaagaaaagaaagaaaataaattactaaagaaggcagtgtggaagccagactctgagactgtgaggcaggcaaagaaggtagttacatgatggcaccat

SEQ ID NO: 11882 - DNA, 434 bp, Homo sapiens
  chr7.fa.O7frz.35121621
  Located on chromosome 7
  Distance between a terminus base of telomere on chromosomal short arm and 5'-terminus of this base sequence : 35185462
  Distance between 3'-terminus of neighbour sequence of sequence listing upward to telomere on chrosomal short arm and 5'-terminus of this base sequence : 99006
gagatagccaaattaagcattaaaataataaaatgtcattttgtttttgttttataatgctccatttattctattattgggcttcttgtccacacaagaccacctcattgaatatttgcaaaacaagggaagttgagaaagaagaaagttagcagccatttttcctattataaaaataatacatttggtgcagaagtcttcaagaaaaagttaaaatttcccgtaatctcaccaactagagagaaacacataggcatatatgtaattcagttacatatttatgtctgtgtctacatgtctatatacatacatatatctattctaacatgataccttaaatgcctgtatatgtgtttgtatgtatgtgtatatatatatatatgtatatgatatatatcttttacatgcatgtaaggtatgtacgtaaggtatgc

SEQ ID NO: 11883 - DNA, 294 bp, Homo sapiens
  AC005502.1_18021
  Located on chromosome 7
  Distance between a terminus base of telomere on chromosomal short arm and 5'-terminus of this base sequence : 35299419
  Distance between 3'-terminus of neighbour sequence of sequence listing upward to telomere on chrosomal short arm and 5'-terminus of this base sequence : 113523
ttagcaaagccatagacttagaagtctaactgggtccttctaattctagatgatgtatttatttacaggtattcaagggacataaagtaagatagttactcaagatacatatatatatatatatatatgtgtgtgtgtatatatatatatatatatatgtatatatatatatatatatatatatatatacacacacacacattagcctgggatttaagtgaggaggaggcgtgatcctgttgagggttgtctgctcacctaggattcagggtgatagatggaagcataaagttg

SEQ ID NO: 11884 - DNA, 394 bp, Homo sapiens
  AC005490.1_7881
  Located on chromosome 7
  Distance between a terminus base of telomere on chromosomal short arm and 5'-terminus of this base sequence : 35321282
  Distance between 3'-terminus of neighbour sequence of sequence listing upward to telomere on chrosomal short arm and 5'-terminus of this base sequence : 21569
aatctgtagattgctttaggcagcatggccattttaagggtattgattcttccaatctatgagcatggaatgatttttttattattttgtgtcatctatgatttcttttagcagtgttctgtagttcttcttgcagagatctttcactttcttgtaaaattacaacactttctactttctacacacacacacacacacacacacacaccacacacacacagatcacatacaaatacccctcctgacagaagagcaaggaaaacaaacacacagtgaaagatttttattgtataaataaacatacattatattatctcagatattaaataacaagatttgcagactaagcaaaacccaatgctttatattactcctgaaacgtatctaaaatgaa

SEQ ID NO: 11885 - DNA, 380 bp, Homo sapiens
  AC005852.1_10017
  Located on chromosome 7
  Distance between a terminus base of telomere on chromosomal short arm and 5'-terminus of this base sequence : 35362582
  Distance between 3'-terminus of neighbour sequence of sequence listing upward to telomere on chrosomal short arm and 5'-terminus of this base sequence : 40906
ctttgtacattctaggcctcagtttcttgttctgtaaatggaaccaacacatgattgttttgaagcctaaattaaataacatgaaaatgcgtagcacagagtcctctgcacagagtagaaactcagttattgttagctccataaagcaaatgcagtttgtgccactcataaagacaattttctgctttctttgtgtgtgtgtgtgtgtgtgtgtgtgtgtttgtgtgtgtgtggctatggcacatgtgtccttgatggaatcagttgatgaattatctcttatgtaaccaaaagactgagaggcaatgtggtcagcctgctccgaaggccggcatctgatgcttcatcagcctgtagtctggtcactataaccttgtttc

SEQ ID NO: 11886 - DNA, 419 bp, Homo sapiens
  AC005688.1_20676
  Located on chromosome 7
  Distance between a terminus base of telomere on chromosomal short arm and 5'-terminus of this base sequence : 35404611
  Distance between 3'-terminus of neighbour sequence of sequence listing upward to telomere on chrosomal short arm and 5'-terminus of this base sequence : 41649
aggatggtctttatgaacaaagagaaatgatgtgcatacagataacacttgttacctaccaacaaggtttgtttttttccctcattaaagcttttgttgcttactgaaacatttttgagtgttgaggttttggatttaaacttatttttaatatttaccggttatactccttcagatttgcatttatttatttatttatttatttatttatttatttatttatgagacagagtctcgctctgtcgcccaggctggagtgcagtggcgcgatctcggctcactgcaggctccgcctcccgggttcatgccattctccggcctcagcctctcgagtagctgggactacaggcgcccaccaccatgcccagctaattttttgtattttttttagtagagactaaaggtttcaccttgttagc

SEQ ID NO: 11887 - DNA, 207 bp, Homo sapiens
  AC005680.1_33610
  Located on chromosome 7
  Distance between a terminus base of telomere on chromosomal short arm and 5'-terminus of this base sequence : 35577218
  Distance between 3'-terminus of neighbour sequence of sequence listing upward to telomere on chrosomal short arm and 5'-terminus of this base sequence : 172188
gttcctaaaggctcctgattagcatatctttaatgtatgtttgtgtatgtatgttgatctctctctctctctctctctctctcatacacacacataagtcttttcatttattagctttgctttaaactttgctaatgtgatattaatattatgtttatctatcttctttttattgcacttgtttgccaagcaccgaactaagcattt

SEQ ID NO: 11888 - DNA, 103 bp, Homo sapiens
  D7S497
  Located on chromosome 7
  Distance between a terminus base of telomere on chromosomal short arm and 5'-terminus of this base sequence : 35596733
  Distance between 3'-terminus of neighbour sequence of sequence listing upward to telomere on chrosomal short arm and 5'-terminus of this base sequence : 19308
ggacctctgaaacccttctaagtacccacacacacacagactcacacacacacacacacacacacacagacacacacacacactcacacacacacagagctct

SEQ ID NO: 11889 - DNA, 440 bp, Homo sapiens
  AC004788.1_27512
  Located on chromosome 7
  Distance between a terminus base of telomere on chromosomal short arm and 5'-terminus of this base sequence : 35755935
  Distance between 3'-terminus of neighbour sequence of sequence listing upward to telomere on chrosomal short arm and 5'-terminus of this base sequence : 159099
atgaaatttattcactatcacgagaatagcgtgggaaagactgtctcccatgattaaatgacctccccctaggtccctcccacaacatgtgggaattctgggagatacaattcaagttgagatttggttggggacacagccaagccatatcagatggatggatagatagatagagagatagatagatagatgatagatagatagatagatagatagatagatagatagatagatagatattacctatggacatcctattatatatatgtgtgtgcgtatatatatatatatatatatatatatacacacatatgcacacacatatacacaattttcctatagctatctatctatatccttgatagttctagatttagatatagataacagagaatgcctatgtgtaggctctatacaagacaatttacctccatgaattc

SEQ ID NO: 11890 - DNA, 154 bp, Homo sapiens
  AC004788.1_32827
  Located on chromosome 7
  Distance between a terminus base of telomere on chromosomal short arm and 5'-terminus of this base sequence : 35761384
  Distance between 3'-terminus of neighbour sequence of sequence listing upward to telomere on chrosomal short arm and 5'-terminus of this base sequence : 5009
aaatgtaagatgccagttagacagccacggagaaatattgaacagagagttatacagatatatatatatatatatatatatatataaaacatatgcaagtttctgatatttagataatatttagaaccatgggactggacatcacctaaggatt

SEQ ID NO: 11891 - DNA, 383 bp, Homo sapiens
  AC004788.1_33349
  Located on chromosome 7
  Distance between a terminus base of telomere on chromosomal short arm and 5'-terminus of this base sequence : 35761833
  Distance between 3'-terminus of neighbour sequence of sequence listing upward to telomere on chrosomal short arm and 5'-terminus of this base sequence : 295
caatccttatctgctcataagtagtatgcttatgtaagtttcagcagtgttagtaggattggaatacttgtcatcttggtcttgagaacacaagactcttctcacatattaaaaagtaatcttatttatgtatttatttatttatttatttatttatttattgagacagaatctcactcttttgccagactggagtgcagtggcacaatctcggctcactgcaacctccacctcctgggttcaagcaattctcctgcctcagactcctaagtagctgggactacaggcgtttgccaccacacccagctaatttttgtatttttagtagagacagggtttcaccatgttggccaggatggtctctatctcttgacctcatgatc

SEQ ID NO: 11892 - DNA, 436 bp, Homo sapiens
  AC005401.1_1828
  Located on chromosome 7
  Distance between a terminus base of telomere on chromosomal short arm and 5'-terminus of this base sequence : 35879101
  Distance between 3'-terminus of neighbour sequence of sequence listing upward to telomere on chrosomal short arm and 5'-terminus of this base sequence : 116885
ctatagccactgacattggaagaaccagagacagccatctggaaagacccaaatgctctaaggtaaaagctgccctcatgccaccttaagcagtagtctacagacttttttacaccaaaactacagtaagaaggctttacacaactcagcacacacacgtgtggtgtgtgtgtgtgtgtgtgtgtatatatatatttatagcaaatagaagtttctctaaatagtatctatccttattagtgtggtatatgatattatttactttgcagcatttttttttcttcatctaaaatgaaatgggctcaacccactgaatcaattttaaaactctctaataagtgatgccctgcaatttgacaaacactgtgctgaagtagtcactgcttgactttggggactggggaaagtcaagtgttctatgagatcatacttcagc

SEQ ID NO: 11893 - DNA, 251 bp, Homo sapiens
  chr7.fa.O7frz.35925799
  Located on chromosome 7
  Distance between a terminus base of telomere on chromosomal short arm and 5'-terminus of this base sequence : 35989906
  Distance between 3'-terminus of neighbour sequence of sequence listing upward to telomere on chrosomal short arm and 5'-terminus of this base sequence : 110369
tatgaaacttggctagctgtagggatgtttgtatgtgtgtgtgtgcgtgcgtgtgtgtgtgtatgaaacttgactggctgcagggacgtgtgtgtgggtgtatgtgtgtgtgtgtgtgtgtgtgtgtatgcacatgcccctgctagtgcacatgcataattcaggttgtggtgtgtctggaaactaggaatgtatttataagtcttggatcttaattttttaaaatataggagttgcggatctagctatca

SEQ ID NO: 11894 - DNA, 319 bp, Homo sapiens
  AC006379.2_148686
  Located on chromosome 7
  Distance between a terminus base of telomere on chromosomal short arm and 5'-terminus of this base sequence : 36072589
  Distance between 3'-terminus of neighbour sequence of sequence listing upward to telomere on chrosomal short arm and 5'-terminus of this base sequence : 82432
cctgtagttgaagtgcattaaatctaaagttgaaaaactattaatttcattaaaactatgttattagggaaataaattgttgcaaaatgccaaatgtgttaccctgactgtaaatgcatatatatatatatatatatgctgttcaaaaacaatatacaggtcatatataactaaaatatttgttactattataaacattaaaggaaggcttaagaagatagcaaaagttgaaaataaagtggaagaatgctttagattacttataagaattgccaacatttcagttatggagccattccattatcaagcaatttaagat

SEQ ID NO: 11895 - DNA, 257 bp, Homo sapiens
  AC005826.1_143426
  Located on chromosome 7
  Distance between a terminus base of telomere on chromosomal short arm and 5'-terminus of this base sequence : 36116848
  Distance between 3'-terminus of neighbour sequence of sequence listing upward to telomere on chrosomal short arm and 5'-terminus of this base sequence : 43940
attactattgcaatgtcaaaacaactgaaaaatgtctaattatttcttcatgtaccaattatctaaatgagataatacttaacaaattttctattaaaagctgagcaaggcattgtttaaaggggtgtgtgtgtgtgtgtgtgtgtgtgtgtgttttcatctatctagtcaactactggtctgcttcgatcaaacgcaaaatcttcttgttgaaggtgctttcaaaagaaaaactagcttacactaatcgcatgagt

SEQ ID NO: 11896 - DNA, 99 bp, Homo sapiens
  D7S484
  Located on chromosome 7
  Distance between a terminus base of telomere on chromosomal short arm and 5'-terminus of this base sequence : 36116947
  Distance between 3'-terminus of neighbour sequence of sequence listing upward to telomere on chrosomal short arm and 5'-terminus of this base sequence : -158
gctgagcaaggcattgtttaaaggggtgtgtgtgtgtgtgtgtgtgtgtgtgtgttttcatctatctagtcaactactggtctgcttcgatcaaacgca

SEQ ID NO: 11897 - DNA, 446 bp, Homo sapiens
  AC007652.1_1670
  Located on chromosome 7
  Distance between a terminus base of telomere on chromosomal short arm and 5'-terminus of this base sequence : 36210288
  Distance between 3'-terminus of neighbour sequence of sequence listing upward to telomere on chrosomal short arm and 5'-terminus of this base sequence : 93242
ttaactacctgtgccttcaaacaccatcctttactttaaccttgaagtctttctcatcattttgtcctacactaaggaaataaagtatcctagatgggatagaatactccttgctcattgctgctgtgatttttcttactagtcagctgaggtagccacaatgagtggtaagctttctgctgaatagctaattcccatgaactagttgtctttctgatctgtcctctattttcaaggagtgtgtgtgtgtgtgtgtgtgtgtgtgtaataaacttcactgacttcatccctgtggttggttcgtgcacataactgagtgggaatgctgactacatccagaccatgtagctgtaatctgcgttcctttagcacaatccagaaaatacccatcttctgtgggtgtttctctgtgggcataaagtgaccactgtctttatcagaatgtc

SEQ ID NO: 11898 - DNA, 145 bp, Homo sapiens
  D7S2250
  Located on chromosome 7
  Distance between a terminus base of telomere on chromosomal short arm and 5'-terminus of this base sequence : 36210489
  Distance between 3'-terminus of neighbour sequence of sequence listing upward to telomere on chrosomal short arm and 5'-terminus of this base sequence : -245
ctagttgtctttctgatctgtcctctattttcaaggagtgtgtgtgtgtgtgtgtgtgtgtgtgtaataaacttcactgacttcatccctgtggttggttcgtgcacataactgagtgggaatgctgactacatccagaccatgt

SEQ ID NO: 11899 - DNA, 363 bp, Homo sapiens
  AC007652.1_27815
  Located on chromosome 7
  Distance between a terminus base of telomere on chromosomal short arm and 5'-terminus of this base sequence : 36236596
  Distance between 3'-terminus of neighbour sequence of sequence listing upward to telomere on chrosomal short arm and 5'-terminus of this base sequence : 25962
aaactggttcatgtagcaaactgtaatactaattgctcatagtatgaggagaagagaattggcttatcctatatgacacacacacacacacacacacacacacacacacacacacacagagtttcacaatggtaggtatcttagatcttgcctagacctgagatgacaaacacctgccatgaagaaagacccgtctctctccgttcccatgcccatggcagacattactaatcaatcacagcactttcccagctaaatatggatataatctcaaaatcctcagttttgaatccaacattggttgtttcttcacctgcccactgctgaactcctatgtttctgagcataatttgtctgagtatg

SEQ ID NO: 11900 - DNA, 365 bp, Homo sapiens
  AC007652.1_182609
  Located on chromosome 7
  Distance between a terminus base of telomere on chromosomal short arm and 5'-terminus of this base sequence : 36391310
  Distance between 3'-terminus of neighbour sequence of sequence listing upward to telomere on chrosomal short arm and 5'-terminus of this base sequence : 154351
gaagtggagattgtatctatgcagaagatgacataaagaatatattagtaacatataaaagaatctagccctgtgcctggcacagataaggcacccaataaatgggattttcttttttccaaactttaggtggattgggcaatttccacaaaattgtgttgggcaagccacacacacacacacacacaccccttatgatccctggccactcggcagagttgccaaaggtgggcagcctctgccacacccttctttcaccccagaaaaggaaagaagccccagcttcttgtcccaaacctcagaaatcttgtagacatcacctccaggagttttattccacagaataccgtttgatttggtatgag

SEQ ID NO: 11901 - DNA, 421 bp, Homo sapiens
  AC007652.1_188853
  Located on chromosome 7
  Distance between a terminus base of telomere on chromosomal short arm and 5'-terminus of this base sequence : 36397549
  Distance between 3'-terminus of neighbour sequence of sequence listing upward to telomere on chrosomal short arm and 5'-terminus of this base sequence : 5874
cgatcgcattgtctattcttaataagactttgaattccaaccctgccttttccaagtattttttcacttctgggatgaagcatgggtggaaccattccataaacaagatggtcatcacccacactttctgatcatgttgccagaacacgggcaaattatttttggttgtgtgtgtgtgtgtgtgtgtgtgtgtgtgtgttgagatggagtctcactccattgcccaggctggagtgcagtggcccaatcccagctcactgcaacctccgcctcccaggttcaagcgattctcctgcctcagcctcctgagtagctgggactacaggcacgtgccaccaaacccagctaatttttgtatttttagtagagacagggtttcaccatgttggccaggctggtctcaaacttctgacctcaggta

SEQ ID NO: 11902 - DNA, 474 bp, Homo sapiens
  chr7.fa.O7frz.36418991
  Located on chromosome 7
  Distance between a terminus base of telomere on chromosomal short arm and 5'-terminus of this base sequence : 36482940
  Distance between 3'-terminus of neighbour sequence of sequence listing upward to telomere on chrosomal short arm and 5'-terminus of this base sequence : 84970
ccactggctgacagataagggtttttctaaggcagtgatatagtttgtatatttctccctgcccaaatctcatgttgaattataatcccaggtattggaggtggggcctggtgggaggtgactggattgtaggggtagatttctcatgaatggcttgggccatccccttggtgctgagtgagctctcgccctgagttcacatgagatctggttctttaatggtgtgtggcacctacccccaccaatccctctctctcaatctctctctctctctctctcctgcttttgccatgtgaggtacctgcccccctttcacattccaccatgactgtaagcttcctgaggccacctgagaagccaagcagatgccagcatcatgcttcctgcacagcctgcagaactgtgaaccaattaaacctcttttctttataaattaccagtcacaggtattactttatagcaatgcaagaactg

SEQ ID NO: 11903 - DNA, 227 bp, Homo sapiens
  AC007551.1_49685
  Located on chromosome 7
  Distance between a terminus base of telomere on chromosomal short arm and 5'-terminus of this base sequence : 36620633
  Distance between 3'-terminus of neighbour sequence of sequence listing upward to telomere on chrosomal short arm and 5'-terminus of this base sequence : 137219
tctgcgttacagtcagacaactccagctgcctaaccctgctctccccctcatttcccagatgtcactccccaataaaacactggtattcctaactctctctctctctctctctctctctctctctctctctctctctctgtcagcatcttcttcctggagaaccaaactggtacagtgagggcaaacatgggcttatagatcagtgttaggaaacagtagacaggag

SEQ ID NO: 11904 - DNA, 377 bp, Homo sapiens
  AC007551.1_49937
  Located on chromosome 7
  Distance between a terminus base of telomere on chromosomal short arm and 5'-terminus of this base sequence : 36620901
  Distance between 3'-terminus of neighbour sequence of sequence listing upward to telomere on chrosomal short arm and 5'-terminus of this base sequence : 41
tcttaaagtcttcacttaccaaaggtgtaggagatcagtcaaggttcaattagagaagtagaatactaggagatagataggtaggtaggtaggtaggtaggtaggtaggtaggtaggtaggtagatagatagacagatagatagacagacaggtagatagattgatatagtagggcatttattatagggatttgatcttattcatttgggggagcttgttacttactctgtgtgaggccatcgcatctgtgtttggtgctgaagcctgaaatcctcagagaaggcatttgggaaagagagatgtctgtgaagttggggaaacaggcaaactggaacccacgaggacggactggaatctgcattcatatcctactgct

SEQ ID NO: 11905 - DNA, 226 bp, Homo sapiens
  AC007551.1_51985
  Located on chromosome 7
  Distance between a terminus base of telomere on chromosomal short arm and 5'-terminus of this base sequence : 36622922
  Distance between 3'-terminus of neighbour sequence of sequence listing upward to telomere on chrosomal short arm and 5'-terminus of this base sequence : 1644
cgatttattgaatatttggcacaagtaatgggtagttgtagtctaggggaagtagaccttgcagaccttggtggggattgcagggacttagcagtacagtcagatctctctctctctctctctctctctctctctctctctctctctctcattctctcctccgcttttctctgtgcaggggatgcattcctacattctttcctactacagatgagcttgctcatct

SEQ ID NO: 11906 - DNA, 275 bp, Homo sapiens
  AC007551.1_75083
  Located on chromosome 7
  Distance between a terminus base of telomere on chromosomal short arm and 5'-terminus of this base sequence : 36646052
  Distance between 3'-terminus of neighbour sequence of sequence listing upward to telomere on chrosomal short arm and 5'-terminus of this base sequence : 22904
catctaatatcagtggccatctgttgaggtggagtgatgaaacaaagtggatggaacacagggtgagaagatacacacacacacacacacacacacacacacacacacacacacacacacactaaccatgtaaatgcaatacctatttaactaattttgttgcctcctgcctatatgattgtataaataagcagtgagatggaccctgggtaaaatgagatcatagttgagaagcaacccttttcctcaaatgctgcatcttccactcttgtatc

SEQ ID NO: 11907 - DNA, 409 bp, Homo sapiens
  AC083864.2_114875
  Located on chromosome 7
  Distance between a terminus base of telomere on chromosomal short arm and 5'-terminus of this base sequence : 36858322
  Distance between 3'-terminus of neighbour sequence of sequence listing upward to telomere on chrosomal short arm and 5'-terminus of this base sequence : 211995
tttaaatacgtgccagtcttagtgggtaggagaaggaatccgttcaaaataaaccagaggacaacacatttgacatgactggccccttgggaagaacatggataacactgccctaggtcttgggatctcagcaagtcagtgccagacaaaactgctcaagtgattttcatatgtggttttgatgttcttgacataaaatgggcagaggcctgaggagtcacaaactatacacacacacacacacacacacacacacacacacacacacagcagcagcagcagcagcaagtaagaagtagaatgagccaggactaaagccgagtaaaatgcaaatataaaatatacacacagtgacaccagacagccaggtacacatccagggatacatctcaaacatactggtgaggag

SEQ ID NO: 11908 - DNA, 179 bp, Homo sapiens
  Z67001
  Located on chromosome 7
  Distance between a terminus base of telomere on chromosomal short arm and 5'-terminus of this base sequence : 36889218
  Distance between 3'-terminus of neighbour sequence of sequence listing upward to telomere on chrosomal short arm and 5'-terminus of this base sequence : 30487
tggggacagagcatttcctgtagaactccaaaaaactttccatttctgaacagaaagtgtgtgagttcttaattaaaacaaaaaacgtgtgtgtgtgtgtgtgtgtgtgtgtgtgtatgttaaaaaaaacacacttactacaggcagagagggtgacctttcactctggttgtcctcaa

SEQ ID NO: 11909 - DNA, 156 bp, Homo sapiens
  D7S2251
  Located on chromosome 7
  Distance between a terminus base of telomere on chromosomal short arm and 5'-terminus of this base sequence : 37119743
  Distance between 3'-terminus of neighbour sequence of sequence listing upward to telomere on chrosomal short arm and 5'-terminus of this base sequence : 230346
cggaaagtgggcattttagttaattatgggctaggctctgtggttcattaaacacacacacacacacacacacacacacacacacacacacacattttctccttattctttgaaaatcatcacaagatatcaggtatattcaggggctctcactac

SEQ ID NO: 11910 - DNA, 282 bp, Homo sapiens
  AC006960.1_5279
  Located on chromosome 7
  Distance between a terminus base of telomere on chromosomal short arm and 5'-terminus of this base sequence : 37179627
  Distance between 3'-terminus of neighbour sequence of sequence listing upward to telomere on chrosomal short arm and 5'-terminus of this base sequence : 59728
gtcttgaactcctgacctcaggtgatcagcctgccttggcctcccaaagtgctgggtttacaggcatgagacaccacgtccggccaaagccggaattcttagcccatacttttactctattctctttctctttctctctctctctctctctctctctctctctctgtgtgtgtgtgtgtgtgtgtgtgtgtgtgtgtatgtgtaacagagcatttttgtttccattcttaaatatattcttaattttctgcaatgaatatgaaagcatcaatttggtaatca

SEQ ID NO: 11911 - DNA, 278 bp, Homo sapiens
  AC006960.1_5311
  Located on chromosome 7
  Distance between a terminus base of telomere on chromosomal short arm and 5'-terminus of this base sequence : 37179631
  Distance between 3'-terminus of neighbour sequence of sequence listing upward to telomere on chrosomal short arm and 5'-terminus of this base sequence : -278
tgaactcctgacctcaggtgatcagcctgccttggcctcccaaagtgctgggtttacaggcatgagacaccacgtccggccaaagccggaattcttagcccatacttttactctattctctttctctttctctctctctctctctctctctctctctctctgtgtgtgtgtgtgtgtgtgtgtgtgtgtgtgtatgtgtaacagagcatttttgtttccattcttaaatatattcttaattttctgcaatgaatatgaaagcatcaatttggtaatca

SEQ ID NO: 11912 - DNA, 273 bp, Homo sapiens
  AC006960.1_82713
  Located on chromosome 7
  Distance between a terminus base of telomere on chromosomal short arm and 5'-terminus of this base sequence : 37256986
  Distance between 3'-terminus of neighbour sequence of sequence listing upward to telomere on chrosomal short arm and 5'-terminus of this base sequence : 77077
ctaagacaactggttatccatacaaaaaacaagatcaatccagatagtttaaagacaaaagcatgaaaagccatactttaaaatatttagaagaaagtacagcagaacatctttattatctcagggtatggaaggatttcttaaggcataaaaaacacaaatcctaaaggaaaatatatatggtatatgtgtatgtgtatgtgtgtatgtgtgtgtgtgtgtgtgtgtgtgtatcattagttatattaaacatttctgtacatctgaaacatc

SEQ ID NO: 11913 - DNA, 386 bp, Homo sapiens
  AC006960.1_118549
  Located on chromosome 7
  Distance between a terminus base of telomere on chromosomal short arm and 5'-terminus of this base sequence : 37292907
  Distance between 3'-terminus of neighbour sequence of sequence listing upward to telomere on chrosomal short arm and 5'-terminus of this base sequence : 35648
aattgtagtttgcatgaaaggtagaagcaaccgaaaggcatttgaagaaatgcagttgtgcagattgaatgaatgaatggatgaatgaatgaatctctatatatacacatgtacacatacattctctctctctctctctctctctcccttccttcccttatcaataaatagctaaaacaacttctgtgaattttgctgtgtgcgtatatgtggtgatgatggggcattttggggtggacagatgataccacacatgaaaactagccgaaagttgatgtattaaattataaggacttggtaaatgagcaaccaaggttttccccaaccacctaccatgttttataaagatagtgttactgatttcgtcttcgctgttacgtacagtt

SEQ ID NO: 11914 - DNA, 247 bp, Homo sapiens
  AC006960.1_127827
  Located on chromosome 7
  Distance between a terminus base of telomere on chromosomal short arm and 5'-terminus of this base sequence : 37302221
  Distance between 3'-terminus of neighbour sequence of sequence listing upward to telomere on chrosomal short arm and 5'-terminus of this base sequence : 8928
atcttgactcagaagtcaatgttactttagatatctgtctatctatctatctatcatatatatatgtgtgtatatatgtgtgtgtttgtgtgtgtgtgtgtgtgtgtgtgtgtgtgtgtgtgtatatatatatatatatataatatatatatatatattaccattttattcttgatttcagggacaaatcattgatggaaccaatccaggccttgtataaccaaaagactagcagttggcgtttatc

SEQ ID NO: 11915 - DNA, 350 bp, Homo sapiens
  AC007349.1_64424
  Located on chromosome 7
  Distance between a terminus base of telomere on chromosomal short arm and 5'-terminus of this base sequence : 37665071
  Distance between 3'-terminus of neighbour sequence of sequence listing upward to telomere on chrosomal short arm and 5'-terminus of this base sequence : 362603
tttagatcaggtgaatctgtttactagcagatgcccctggacaaggcagcttctcagagcctggaagacgatgggaccagatctatggttttcagtctatgtttctcaggggattcctcaggggctgtcattgtggggccaggtccaaagagagtccttgggctcctgcttgccaatgtcaccccagcacctctgcgtttgccttttatggagatcagaatttcacacaggctttggtttgggcattgggggagttgtgggaaaacaaaaaacaaacaaacaaacaaacaaacaaacagctttgaaaaccaccagagagatcatcatttccagcttaaagttgaatgata

SEQ ID NO: 11916 - DNA, 388 bp, Homo sapiens
  AC007349.1_91343
  Located on chromosome 7
  Distance between a terminus base of telomere on chromosomal short arm and 5'-terminus of this base sequence : 37692216
  Distance between 3'-terminus of neighbour sequence of sequence listing upward to telomere on chrosomal short arm and 5'-terminus of this base sequence : 26795
gaaagatactcaaacagacgatagatagatatagatagatgattagatagatagatagatagatagatagatagatagatagatggacgatagatgagagagaagaaggaaagaaggaaggagggaggaagaaaaggaaaaaagaaagggagaaaaggagaaagatgaaaagataaagagatttattataaggaattgactcacacagttacaaaggctgagaagtcccaagatctgtattcagcaagagacccaggagagctgatggtagagttccagactgagtccaaaggcctgagaatcaggagagctgatggtagagttccagactgagtccaaaggcctgagaatcaggagagctgatggtgtaagttccagtccaagttca

SEQ ID NO: 11917 - DNA, 444 bp, Homo sapiens
  AC007349.1_92153
  Located on chromosome 7
  Distance between a terminus base of telomere on chromosomal short arm and 5'-terminus of this base sequence : 37692930
  Distance between 3'-terminus of neighbour sequence of sequence listing upward to telomere on chrosomal short arm and 5'-terminus of this base sequence : 326
tatcctatgtggctcaactgagaatagcatttatatttgtacagttataatattaatattaaatattgaatttatcaaaaacttgacataagtataactggagtttgaggggaagagaaatgtttgtgtgtgtgtgtgtgagagagagagagagagagagagagagaggagatgtgataatggtggggcaaagagtaaaaaagagctaaatccttatcttccatagtgggaagtcattttatgctgcctaatgctgaaaatcacaagtagtgctaaaaatcatatgttatttattgatacgcaggtgaaaaacaagagcaatagtttaaaaagctgcaaaggtagccttttaggaatggaaacttgaggttgtaggtggggagcaggttattgttttggttcagcttgattttggtaataattctggtaaaacaatttgactgt

SEQ ID NO: 11918 - DNA, 443 bp, Homo sapiens
  AC007349.1_131922
  Located on chromosome 7
  Distance between a terminus base of telomere on chromosomal short arm and 5'-terminus of this base sequence : 37732605
  Distance between 3'-terminus of neighbour sequence of sequence listing upward to telomere on chrosomal short arm and 5'-terminus of this base sequence : 39231
catgctcttcaaggttcacggcatgattccttctctccattcacggcggtctgtgaactatctcatttaattcgcatgcagcccatgtagcaagtgttttcatctcctttatgaggtggggcttagagaggctcaatgagtgtccaaggtgacagcaccgcctgcctcctcgcccgccaccaaaactgtgttattctcctttcttcagcatctcccttccagagaggccacaaaaacaaacaaacaaacaaacaaacaaaaacccagtaaactcccaatcaacaggattaaggactgcccttccttctatcatcctaagaaagacagagaggcccacagaggtatgaattccctaaaatgtggacgctatgccagctttaaggaggctgctaggtgaacccattatctttatatctgtcctttgacctttaagctactgtaca

SEQ ID NO: 11919 - DNA, 180 bp, Homo sapiens
  AC007349.1_167135
  Located on chromosome 7
  Distance between a terminus base of telomere on chromosomal short arm and 5'-terminus of this base sequence : 37767925
  Distance between 3'-terminus of neighbour sequence of sequence listing upward to telomere on chrosomal short arm and 5'-terminus of this base sequence : 34877
tcttgaggcagacctgaagcatgctctctttccctcaaattgagagctgtgagactatgtcccttcacatataggaaaggggaagataatgagaccaatgtcagtagtaggacaaagaaaacagacgtgtgtgtgtgtgtgtgtgtgtgtgaaagagtgttaatggttaagccttgttca

SEQ ID NO: 11920 - DNA, 432 bp, Homo sapiens
  chr7.fa.O7frz.37759825
  Located on chromosome 7
  Distance between a terminus base of telomere on chromosomal short arm and 5'-terminus of this base sequence : 37840811
  Distance between 3'-terminus of neighbour sequence of sequence listing upward to telomere on chrosomal short arm and 5'-terminus of this base sequence : 72706
tccactcttgatagcattgtattcatttttcaggctctccttatatatgtaaacacacacacaaacacacacacaaatacattcatacacttaacacacacacacacacacacacacacacacacacacacacgcacaccaaggatcatatgctgaatgctgtcctaataccttctttgttccatgaattatttcttggtaatcttcctctgtccaatacacacacatgcacggcattctatacaataaaatcatattacacaatttatccagatgcagctgagcagcagacatgataacctggttgggaaaaccatgccagtgtggagtgtgctttttctaaatgtggtagccacaaaacagtggactgcaacttagtccactggaggcttcccactctgtggttaactagctaatgttgcttacaatctt

SEQ ID NO: 11921 - DNA, 468 bp, Homo sapiens
  chr7.fa.O7frz.37875975
  Located on chromosome 7
  Distance between a terminus base of telomere on chromosomal short arm and 5'-terminus of this base sequence : 37956697
  Distance between 3'-terminus of neighbour sequence of sequence listing upward to telomere on chrosomal short arm and 5'-terminus of this base sequence : 115454
atgtaagtttcatccaaggaaggtccctgacagcaacaccgttgacctgctttgggaagaattaggcggcagtgcgtctctctcagatctctaagggcaagcagaggtgctcagccaggctctggacaccacttccagatggagcctcactctgtggcagcagagtcccttcctcctccacagccctcccgggcaagcctcctgccaggcagggctccagcaccttttgctctttcagacacaagaggccggagttagaactgattttaaatacttctattttgaatttttcttcaagttatattttttaaaacaatttttttggctaaaagaaacatttttgtaacaatacatgactgtgtgtgtgtgtgtgtgtgtgtgtgtgtgtgtgtgtgaagagaaggagagaaaaagagggtgaatgataaaacatatgtggcaaaatgttggcataactatagatgaacc

SEQ ID NO: 11922 - DNA, 474 bp, Homo sapiens
  AC007444.1_132218
  Located on chromosome 7
  Distance between a terminus base of telomere on chromosomal short arm and 5'-terminus of this base sequence : 38117459
  Distance between 3'-terminus of neighbour sequence of sequence listing upward to telomere on chrosomal short arm and 5'-terminus of this base sequence : 160294
acaacgctttgttaagatgtaggtaactgatggagagacagatagatagatagataaacagacagatagatagatagatatctatctatatatatatctgtatatatctgtctatatctatctatatatatctctatctatctatctatctatctatctatatctcctgtctggcagtgatttaattgacttcctttccactggtggaaaactagttgtgtcttcatttgcaattcatctcaacattcctttgcttcatataaatttgtgctcttttgactttttctttaaagttataacatctgcctagtttcatcatatcatatgagtaaaataaattattttaacacatatttgtatatctgaagtcaaaatgtaatatagagggaaacctctaaattaaacattttattggagaatcatagaattgcaatttgaagcatacacatagactggtagactttggtatgtctg

SEQ ID NO: 11923 - DNA, 324 bp, Homo sapiens
  AC007444.1_156233
  Located on chromosome 7
  Distance between a terminus base of telomere on chromosomal short arm and 5'-terminus of this base sequence : 38141441
  Distance between 3'-terminus of neighbour sequence of sequence listing upward to telomere on chrosomal short arm and 5'-terminus of this base sequence : 23508
actgtagcgtcttgtttagcagctttaattcagaagactctaaagttcttatgtagaatcagctgtcaatggatcagtgaagtggtcaatatttctaaattatttttatgaattgtcataataacccattaaagctacaaaatacttaaactctctctctctctcacacacacacacacacacacagacacacacacacacacacacactgactttttcttttttttctttttttttttgagatggagtctcactctctcacccaggctggagtgcagtggcactacctctgctcactgcaagctccacctattaggtttcacg

SEQ ID NO: 11924 - DNA, 254 bp, Homo sapiens
  G08639
  Located on chromosome 7
  Distance between a terminus base of telomere on chromosomal short arm and 5'-terminus of this base sequence : 38390986
  Distance between 3'-terminus of neighbour sequence of sequence listing upward to telomere on chrosomal short arm and 5'-terminus of this base sequence : 249221
aaatgtcagagcagggcatagaaccatgtctcaaagcctaatgtgttgtgttttctgccaagcagcaatgactttttgtcttatgtgtttcagctcttctttttgtttctgcacatccaaatctccttctctctctttctctccccctccctaacctctctgtctgtctatctatctatctatctatctatctatctatctatctatctatctatctattcatgtaggaatgacccaccaggcaagttagtgtt

SEQ ID NO: 11925 - DNA, 238 bp, Homo sapiens
  G08636
  Located on chromosome 7
  Distance between a terminus base of telomere on chromosomal short arm and 5'-terminus of this base sequence : 38390987
  Distance between 3'-terminus of neighbour sequence of sequence listing upward to telomere on chrosomal short arm and 5'-terminus of this base sequence : -253
aatgtcagagcagggcatagaaccatgtctcaaagcctaatgtgttgtgttttctgccaagcagcaatgactttttgtcttatgtgtttcagctcttctttttgtttctgcacatccaaatctccttctctctctttctctccccctccctaacctctctgtctgtctatctatctatctatctatctatctatctatctatctatctatctatctattcatgtaggaatgacccacc

SEQ ID NO: 11926 - DNA, 394 bp, Homo sapiens
  chr7.fa.O7frz.38399619
  Located on chromosome 7
  Distance between a terminus base of telomere on chromosomal short arm and 5'-terminus of this base sequence : 38481583
  Distance between 3'-terminus of neighbour sequence of sequence listing upward to telomere on chrosomal short arm and 5'-terminus of this base sequence : 90358
gaaagcatttaccatttgtattagtccattttcacactgctatgaagaacttccctgagactgggtgatttataaaggaagaggtttataaaagaggtttgattgacttacagttccacatggctggggaggcctcaggaaacttacaatcatgttggaaggaaaagcaggcacatcctacatggcagcaggtgagagacagacacagagagagagggagggagagagagagagagagagagagagagagagagggaaggaggaagaaccccttataaaaccatcagatctcatgaaaactcacttaatatcaccagaacagcatgagggaaactgctcccatgatccaattacctcccactaggtcgctccctcaacaccttacaattcaaga

SEQ ID NO: 11927 - DNA, 318 bp, Homo sapiens
  chr7.fa.O7frz.38498484
  Located on chromosome 7
  Distance between a terminus base of telomere on chromosomal short arm and 5'-terminus of this base sequence : 38593466
  Distance between 3'-terminus of neighbour sequence of sequence listing upward to telomere on chrosomal short arm and 5'-terminus of this base sequence : 111489
caaggctaagtactttggtattatacattactagcaaaaaacatggtttgaaaattgaggtgcaatattatcactatctaacaatctaacacagatgcatagaaagatattagcagaaaatacactaatattttaaaaagtggaaaaattctgttctaatttttctttttcctttccttccttccttccttccttccttccttccttccttccttccttccttccttccttccttctttctttctttctttttttttttttgacagagtctcagtctgttgcccaggttggagtacagtggtatcttgtaccacttgg

SEQ ID NO: 11928 - DNA, 277 bp, Homo sapiens
  AC018634.3_116971
  Located on chromosome 7
  Distance between a terminus base of telomere on chromosomal short arm and 5'-terminus of this base sequence : 38746892
  Distance between 3'-terminus of neighbour sequence of sequence listing upward to telomere on chrosomal short arm and 5'-terminus of this base sequence : 153108
cactccagtctggtgacagagcgagactccatctcaaaaaaacactatatatatatatatagatagatagatagatagatagatagataataaattatctataatatatgaaacataaacatatatacaaccttacacattacaaataattttttcttttacacaaagaatacctcaacaaatttttaatcaaaattttaccacatatatttttctgattataatccaataaaattggaaataaacaataaaaaggtaattggaaatgttcatttga

SEQ ID NO: 11929 - DNA, 330 bp, Homo sapiens
  AC018634.3_110631
  Located on chromosome 7
  Distance between a terminus base of telomere on chromosomal short arm and 5'-terminus of this base sequence : 38753150
  Distance between 3'-terminus of neighbour sequence of sequence listing upward to telomere on chrosomal short arm and 5'-terminus of this base sequence : 5981
tgagctgagatggtgctactgcaccccagcctgggcgacagagtgagaccctgtcaaaaaaaagaaaaaaagaaaagaaataaaggaaggaaggaaggagggagagagggaggaagggaaagaaagaaagaaagaaagaaagaaagaaagaaagaaagaaagaaagaaagagagagagagagagagaaagaaagaaagaaagaaagaaagaaagagaaagaaagaaagagaaagaaagaaagaaaggtcaacaaggtgttcggggctttgaagtatgatttttttatgcatcaggttattccatgaaacttctatgcaattgctagacac

SEQ ID NO: 11930 - DNA, 356 bp, Homo sapiens
  AC018634.3_109245
  Located on chromosome 7
  Distance between a terminus base of telomere on chromosomal short arm and 5'-terminus of this base sequence : 38754553
  Distance between 3'-terminus of neighbour sequence of sequence listing upward to telomere on chrosomal short arm and 5'-terminus of this base sequence : 1073
gaaataccttcaggtattcaatcaccttgtttatccccaaatgggacaaatcaaatcatggttattgaacataaaaattatttgcaatgacttccataattgtgttggttgattatttaggttactgtctacacacacacacacacacacacacccacacaatcactcacattcacatgcatacacccaagaaaaagatttaatgagatacctgtgtgtgtgtgttgtatatgtgtatgtgtgtgcatgcatgattcctatacgatgaaaaattggaaatagcatcataatgagatgttaagagatactattcaccttaaattaaaacctaagaaggtatttctgcaaactttcaa

SEQ ID NO: 11931 - DNA, 456 bp, Homo sapiens
  AC018634.3_87743
  Located on chromosome 7
  Distance between a terminus base of telomere on chromosomal short arm and 5'-terminus of this base sequence : 38776062
  Distance between 3'-terminus of neighbour sequence of sequence listing upward to telomere on chrosomal short arm and 5'-terminus of this base sequence : 21153
cagttcctgtagttaaccagttatattattaagtttgatttgttaaaaaaatagagaaggttgcataggcttttccagcagttaagaaatctgtctatctatctatctatctatctatctatctatctatctatctatctatctatcatctatctatctatctgtctgtctgtctgtctatctatccatccatctatctttctatccatctatctatcaatcatctatcaagccatctatttatctctatactttgaggggctcaaatcactatttcccagctgccaggagtgtaggaagtgctgagaatgttgtcagctgatggttcacagacgaagggaggagctttgcccaaggtggccaccagttccaactttacatttttaatcaatatggggaaggagaaataatcttagtgagggtttccatacaccatacacttagtgagcatttcca

SEQ ID NO: 11932 - DNA, 283 bp, Homo sapiens
  AC018634.3_4585
  Located on chromosome 7
  Distance between a terminus base of telomere on chromosomal short arm and 5'-terminus of this base sequence : 38859285
  Distance between 3'-terminus of neighbour sequence of sequence listing upward to telomere on chrosomal short arm and 5'-terminus of this base sequence : 82767
actcaacttgaatttcactttcagagtgtattagggttctccagagaaataatacacacacacacacacacacacacacacatacacacacagagacacaagcacgcacatgcacagatttattttatcttatatatgtgaagatttataatatacatgaagatgtatacgtgtatatatatgaatatttattttattatggaaattggcttacacaattacagaggctgcaaagtttcaccgtctacaacctggagaaccaagaaagccagtggagtaattc

SEQ ID NO: 11933 - DNA, 110 bp, Homo sapiens
  D7S528
  Located on chromosome 7
  Distance between a terminus base of telomere on chromosomal short arm and 5'-terminus of this base sequence : 38859287
  Distance between 3'-terminus of neighbour sequence of sequence listing upward to telomere on chrosomal short arm and 5'-terminus of this base sequence : -281
tcaacttgaatttcactttcagagtgtattagggttctccagagaaataatacacacacacacacacacacacacacacatacacacacagagacacaagcacgcacatg

SEQ ID NO: 11934 - DNA, 429 bp, Homo sapiens
  chr7.fa.O7frz.38841524
  Located on chromosome 7
  Distance between a terminus base of telomere on chromosomal short arm and 5'-terminus of this base sequence : 38893537
  Distance between 3'-terminus of neighbour sequence of sequence listing upward to telomere on chrosomal short arm and 5'-terminus of this base sequence : 34140
gacctagagtcttggatagctaaggccactgactggacaacttttcttattaggtggtttatagttaacttttcttcctagagagatgccattctttttttttggtttgtgtgtgtgtgtgtgtgtgtgtgtgtgcatgtgtgtgtgtgtttccacttgtttttttggtttgttgttttgttttgttttgtttttgttttataattttgagataggtcttgctctgttgcccaggctggagtgcagtggcatgatcttagctcactgcaacctccccccacctaggttcaagcaattctcctgcctcagcccccttggactgggactgcaggcgcgcaccaccacacccacctaatttttttgtatttttagtggagatgggtttttaatctactttgggttgtctctagagaaagttgtcatttcttt

SEQ ID NO: 11935 - DNA, 340 bp, Homo sapiens
  AC006033.2_43041
  Located on chromosome 7
  Distance between a terminus base of telomere on chromosomal short arm and 5'-terminus of this base sequence : 39092688
  Distance between 3'-terminus of neighbour sequence of sequence listing upward to telomere on chrosomal short arm and 5'-terminus of this base sequence : 198722
tcttagaacatccttagcatgttctttggaacctcttccacagccctgtcatcctgtgttgtctgcactgccttcagcgctgacctggtctgtttctactgcgggttgtaaacttgagttagagactacatcattgtattccctacattaggcctagttaatattttcacacacacacacacacacacacacacacacacacacacacacagagtggtaaaagggattccagacagaaagagccatgaatgattgaagattacagccatgtgaaatatcagtgtactggaggaactccaagtaacttgagattctggactattggtgttggatctgaaag

SEQ ID NO: 11936 - DNA, 202 bp, Homo sapiens
  D7S2497
  Located on chromosome 7
  Distance between a terminus base of telomere on chromosomal short arm and 5'-terminus of this base sequence : 39092770
  Distance between 3'-terminus of neighbour sequence of sequence listing upward to telomere on chrosomal short arm and 5'-terminus of this base sequence : -258
acctggtctgtttctactgcgggttgtaaacttgagttagagactacatcattgtattccctacattaggcctagttaatattttcacacacacacacacacacacacacacacacacacacacacacagagtggtaaaagggattccagacagaaagagccatgaatgattgaagattacagccatgtgaaatatcagtgt

SEQ ID NO: 11937 - DNA, 183 bp, Homo sapiens
  AC006033.2_59115
  Located on chromosome 7
  Distance between a terminus base of telomere on chromosomal short arm and 5'-terminus of this base sequence : 39108908
  Distance between 3'-terminus of neighbour sequence of sequence listing upward to telomere on chrosomal short arm and 5'-terminus of this base sequence : 15936
aaagtcgtgatgttggataaatgtgtgtgtgtgtgtgtgtgtgtgtttaaatatatgggctctgggttcagagggacctagctttaaattacgactattactttaaaaatagtgaccttgagtaggtaatttaatctttctcatctgtgaactgtgagccttaattgtactgacctcaactgg

SEQ ID NO: 11938 - DNA, 212 bp, Homo sapiens
  AC006033.2_119965
  Located on chromosome 7
  Distance between a terminus base of telomere on chromosomal short arm and 5'-terminus of this base sequence : 39169642
  Distance between 3'-terminus of neighbour sequence of sequence listing upward to telomere on chrosomal short arm and 5'-terminus of this base sequence : 60551
ggacaagtgcatgaactaatactccacttatttcaggagttagatatgtttgatgagaacaacagagcagacactataggtagtgtgggttaaaggagctaatatatgcaaagaattgagaacactgtagagaacttacacacacacacacacacacacacacacacacacgatacaattctctcttcctttacaggtaagaccaaaggtta

SEQ ID NO: 11939 - DNA, 388 bp, Homo sapiens
  AC006033.2_155283
  Located on chromosome 7
  Distance between a terminus base of telomere on chromosomal short arm and 5'-terminus of this base sequence : 39204854
  Distance between 3'-terminus of neighbour sequence of sequence listing upward to telomere on chrosomal short arm and 5'-terminus of this base sequence : 35000
acaaataaactagctgtatcaaagttggcatgaacatatagagaatgattctgtattctgattgtgtgcacaaaaaagaaagaaagagagagaaaaggaagaaaggaaaaaaagaaggaagtaagagagggagggaggaagaaaggaaggaagtaaggaagggaaggagagagggaggaagaaagaaaggaaggaaggaaggaagggaaggagagagggaggaagaaaggaaggaaggaaggaaggaaggaaggcaagctagggagggagctagggagggagggaggggaggccagaaaaagggatgtgtagaaaaatagcaagtaaccaagaaagtagagagagagacaaaaaggaaagcagagggagacaatgttcaactgcatac

SEQ ID NO: 11940 - DNA, 281 bp, Homo sapiens
  AF099118.1_210
  Located on chromosome 7
  Distance between a terminus base of telomere on chromosomal short arm and 5'-terminus of this base sequence : 39293128
  Distance between 3'-terminus of neighbour sequence of sequence listing upward to telomere on chrosomal short arm and 5'-terminus of this base sequence : 87886
cttaccaagttgcagatcatactctggtctgtctgcattgtgaataatgaagtatcctggggctgaaaatcaaggataaaaatagaagatgttttttaaagatatttaaatcagctaccatcaattgtgtctgcctacgtatctatctatctatctatctatctatctatctatctatctatctatccatctatctatcgacactctatctatctaatttttttttgagaaagggtctcctctgttccccaggctggagtatagtggtatgatcatgctca

SEQ ID NO: 11941 - DNA, 457 bp, Homo sapiens
  chr7.fa.O7frz.39388319
  Located on chromosome 7
  Distance between a terminus base of telomere on chromosomal short arm and 5'-terminus of this base sequence : 39395810
  Distance between 3'-terminus of neighbour sequence of sequence listing upward to telomere on chrosomal short arm and 5'-terminus of this base sequence : 102401
gtaattatggaatcatttgcagttgtgtgtgtgtgtatatatatagttgtgttacttgtgtgtatatatatatatagttgtgtatatatatacacaatcttatatatcatctattatatataatatatagttgtgtatatatgtagttgtgtgtgtgtgtgtatatatatatatatatatagagagagagagagagagagagagagagagagagagggagcctttgcatcctgtactcagtcttccttcacagcgacattttacaaaattattgtacaatgtcacaacatagatgcaacctacccatcttattcagcttctcccagttttacctgtactcatttgtgcgtgtgtgtgtgtgtgtgtgtgtgtgtgtgtgtgtgtttagttttatgcgattttaccacatgtgtaggttcatgtatccatcaccacagtcaggatacagaactttcca

SEQ ID NO: 11942 - DNA, 478 bp, Homo sapiens
  chr7.fa.O7frz.39507741
  Located on chromosome 7
  Distance between a terminus base of telomere on chromosomal short arm and 5'-terminus of this base sequence : 39516413
  Distance between 3'-terminus of neighbour sequence of sequence listing upward to telomere on chrosomal short arm and 5'-terminus of this base sequence : 120146
tttagatttatcctcaacttcctagccttgccatcacctcttaaccaaaaagcttggaggggaaataatggtaccaaatgtcagcctcagctacctctcttctctctgccttctcaagtactcactgccttggtagctctctgatgccttcggatgggtgtgtgtgtgtgcttgtgtgtgtgtgtgtgtgtgtgtgtgtgtgtatgcatgcatgttaatctgctctgctagtctacacattctcagcaggagaattggtctactacaaaatagtccatcattgccagaagcatgattccaaactcttgttttattgaattcatgtttttagtaacttgttttacagcaaaaagaagctctgaggaatttccttctgttccctgagttatatttttatctatatggtgttctgtttgtcttttgcatgaacaatttcttacattaacttattttttctcggtatgtttacaggttactg

SEQ ID NO: 11943 - DNA, 180 bp, Homo sapiens
  D7S2507
  Located on chromosome 7
  Distance between a terminus base of telomere on chromosomal short arm and 5'-terminus of this base sequence : 39731346
  Distance between 3'-terminus of neighbour sequence of sequence listing upward to telomere on chrosomal short arm and 5'-terminus of this base sequence : 214455
tctactattgacggacatttgagttagaggctattaggaattaagctattattaacaatctgtttgtgtgtgtgtgtgtgtgtgtgtgtgtgtgtgtgtgtgtgtgtgtggacatacgcatcgcaagcatttttgttgaatatgtacttaggagtgcaaactgccaggtcgttaggcaga

SEQ ID NO: 11944 - DNA, 413 bp, Homo sapiens
  chr7.fa.O7frz.39814273
  Located on chromosome 7
  Distance between a terminus base of telomere on chromosomal short arm and 5'-terminus of this base sequence : 39822851
  Distance between 3'-terminus of neighbour sequence of sequence listing upward to telomere on chrosomal short arm and 5'-terminus of this base sequence : 91325
ctatcggtttaaagtacatttcacgaagcaacagtagttagtaaagttacaggaccaagtgttaggtagctaagttctagttgatatctgcgggctggcttctgtctacagtattgacttgctctcatatttaaaaaggcatctgtgcatcacattctctcttttggaggaatggggctgggtggcctcaaagatttcctttaaatttaattttagaggattctcctgcttctttttttgtttgtttgttttgttttgttttgttttgttttgttttgtttgagatggagatttgctcttgtcgcccaagctggagtgcaatggcgtgatctcggctcactgcaacatccgcctcccaggttcaagtgattctcctgcctcagcctcccgagtagctaggattacaggagcac

SEQ ID NO: 11945 - DNA, 422 bp, Homo sapiens
  chr7.fa.O7frz.39933473
  Located on chromosome 7
  Distance between a terminus base of telomere on chromosomal short arm and 5'-terminus of this base sequence : 39927041
  Distance between 3'-terminus of neighbour sequence of sequence listing upward to telomere on chrosomal short arm and 5'-terminus of this base sequence : 103777
atcttccatgagctattgaatctttgctttgtattcttgttttatagaggttattctttctttcattaagtttaaaaatgtataacaatatattcgaacataatgctttaaattgccttatggcaaacattttctggtgaatgttcttttcttgatgcattttcttttgttgtctccttctccatcttttttataatttttgtatggataaagtgttgacttctttataaaaattattactctaaaaactcaggacttcccagaattcaggattagaactcaacagaagctctctccttgtttctctctctttctctttttctctctctctctctgtgtgtgtgtgtgtatgtgtgtgtgtgtgtgtgtgtgtgtgtaggtggtggggatggggttgccaatgctatgttctatgccagtag

SEQ ID NO: 11946 - DNA, 252 bp, Homo sapiens
  D7S510
  Located on chromosome 7
  Distance between a terminus base of telomere on chromosomal short arm and 5'-terminus of this base sequence : 40020894
  Distance between 3'-terminus of neighbour sequence of sequence listing upward to telomere on chrosomal short arm and 5'-terminus of this base sequence : 93431
acccagccgcaagatttccttttttaaggctgagtaatatgtctgtgtgtgtgtgtgtgtgtgtgtgtgtgtgtgtgtagcatctaggttgttttcacctattggctattgtgactaatgctgcaatgaacataggagtgtagatatctttacaaggtggtgatttcatctcctttgggtaaacacccagaagaaggattgccaggtcatatgatagttttacttttattttctttgggaacctccacactg

SEQ ID NO: 11947 - DNA, 465 bp, Homo sapiens
  AC005483.1_142525
  Located on chromosome 7
  Distance between a terminus base of telomere on chromosomal short arm and 5'-terminus of this base sequence : 40212323
  Distance between 3'-terminus of neighbour sequence of sequence listing upward to telomere on chrosomal short arm and 5'-terminus of this base sequence : 191177
actgtagccatgcactcacataatgctaatattgcctaatcatataatcttaaagacttccaacttaaacctcagtttccccatcaatattattattactattattattattattattatttgagaaagaatctcactgtcacccaggctggcatacagtggcacaaacacagctcactgcagcctcgacctcccaggctcaagccatcctcctgcctcagcctcccgagcgtctgggactacaggcatgtaccatcacgcctggctaatttttgtattttttgtagagatggggttttgccatgttgcccaggctggtctcgaactcctgggctcaagtgatccacctgcctcagccttccaaagtgctgggattataggtgtcagccactgtgcccagcccatcaatattattattaagaatgaagaatttttttattatacttgatataggataaagatgcc

SEQ ID NO: 11948 - DNA, 404 bp, Homo sapiens
  AC005483.1_74036
  Located on chromosome 7
  Distance between a terminus base of telomere on chromosomal short arm and 5'-terminus of this base sequence : 40280633
  Distance between 3'-terminus of neighbour sequence of sequence listing upward to telomere on chrosomal short arm and 5'-terminus of this base sequence : 67845
agcaaattctcaagacatcaagggttaagtgactccctgggataacatcttctggaagtggcagaactgagatttgcgttccaagtccattcccatccttccatatcaccctgattttctcgggttcagagtcctggttcatttcctggctgttccgcagacatgtcacaaactccagaaccttcatttctccatctgcaaatggcaattgtaattcttgctctgtcaacctcacagatttctctcgaaggcatacacacacacacacacacacacacacacacacacacacacacacactagaaaactgtaaagagatgtaaaccttaccgaataattacagggtattttgattggtatttttactatgattatttttgctaatcaaagaaaccagacaggta

SEQ ID NO: 11949 - DNA, 307 bp, Homo sapiens
  AC005483.1_19549
  Located on chromosome 7
  Distance between a terminus base of telomere on chromosomal short arm and 5'-terminus of this base sequence : 40335341
  Distance between 3'-terminus of neighbour sequence of sequence listing upward to telomere on chrosomal short arm and 5'-terminus of this base sequence : 54304
caaagcagaagtctagaagtcatcccaacccctttatacacacacacacacacacacacacacacacacacacacacaccctaagtcactaaagttctggcaattctgcctcatgaattccttttgaatctgtctcccactctccatcacccacttccactacttagttcagacccacctgcctctcacctggatcaccatgatatgctcctcctagcctctacatccatcatatgtttaccccagagtagtcaaaaggccagtataaataaatttctcttttgtttaaaacctttcctacgttacc

SEQ ID NO: 11950 - DNA, 386 bp, Homo sapiens
  AC005483.1_13898
  Located on chromosome 7
  Distance between a terminus base of telomere on chromosomal short arm and 5'-terminus of this base sequence : 40340838
  Distance between 3'-terminus of neighbour sequence of sequence listing upward to telomere on chrosomal short arm and 5'-terminus of this base sequence : 5190
gcacttcctaaacctataacctactcaacatttttatagcacttgtaatcatcttatacgctacgtagtttaactatttaatatatttgttgtttattatctgcctcttcctaattagaatataaccccctcaaagtcagcaatccttgtttgatttatttttcataagccccaaaacagtgcctggcccaataaacatttgttgcctgaatgaatgaatgaatgaatgaatgcagttttggaacatactggtgtagggttgccagatttagcaaataaaaacactggacacccagctgaatttgaatttcagatgaatatttcatgcaatatttcaggcatatttataataaaaatgtttcattgttcatctgaaattcaaatat

SEQ ID NO: 11951 - DNA, 354 bp, Homo sapiens
  HUMUT1544
  Located on chromosome 7
  Distance between a terminus base of telomere on chromosomal short arm and 5'-terminus of this base sequence : 40368439
  Distance between 3'-terminus of neighbour sequence of sequence listing upward to telomere on chrosomal short arm and 5'-terminus of this base sequence : 27215
attccagcctcggcaacagagtgagactctgtctcaaaaatgaaagagagagagagagagagagagagagagagagggaaagaaagaaaggaagagaaaagaaaagaaaagagaaaagaaaggaaggaaggaaagaaggaaaggaaggaaggagagagaaagaaagaaagaaagaaagaaagaaagaaagaaagaaagaaagaaagaaagaaagaaaggaaggaaggaaggaaggaaggaaggaaggaaggaaggaaaagaaaaagttaatttctggcagcccctcaataccaagaaggatgaaattcacttttgagtttgtgattaaaagttctcccaaaatatgatatctcc

SEQ ID NO: 11952 - DNA, 267 bp, Homo sapiens
  D7S668
  Located on chromosome 7
  Distance between a terminus base of telomere on chromosomal short arm and 5'-terminus of this base sequence : 40493133
  Distance between 3'-terminus of neighbour sequence of sequence listing upward to telomere on chrosomal short arm and 5'-terminus of this base sequence : 124340
aattttgttgacagcagtccacagtaacctcataactacacacacacacacacacacacacacacacacacacattctttctctctcttaaaggccttcttcgtaggcctttatcagtcaagtgcccaaactttctcaattcatggcacccttattatcgcagtaatttttttcacagcatccctaggtcaaaagaaacacctaacagtttaatttttttgttttttgttttttgagacggagtctcgctctttcacccgtgctgga

SEQ ID NO: 11953 - DNA, 351 bp, Homo sapiens
  AC004837.1_59503
  Located on chromosome 7
  Distance between a terminus base of telomere on chromosomal short arm and 5'-terminus of this base sequence : 40548471
  Distance between 3'-terminus of neighbour sequence of sequence listing upward to telomere on chrosomal short arm and 5'-terminus of this base sequence : 55071
ggaatgtgcagctcatagttattaggaaatgtttgcactttggaaaaacatccttggaaatctctgtcttttctgcttctgagtcacagattgtgttttaaattattctagaaggaaaagtgttttaacccagttgtagtgactgctaagtgttttcttttgaacacacacacacacacacacacacacacacacaactcttagagtattaattgatatggtaatgccctgagctcatgtgatatgtactgttttaaaaataaaacagtagatatattagctgtgacatgattataactgccagcaagtaatgatcataataaagaagtcacttcctgatgtatttaggaa

SEQ ID NO: 11954 - DNA, 203 bp, Homo sapiens
  Z66592
  Located on chromosome 7
  Distance between a terminus base of telomere on chromosomal short arm and 5'-terminus of this base sequence : 40548496
  Distance between 3'-terminus of neighbour sequence of sequence listing upward to telomere on chrosomal short arm and 5'-terminus of this base sequence : -326
gaaatgtttgcactttggaaaaacatccttggaaatctctgtcttttctgcttctgagtcacagattgtgttttaaattattctagaaggaaaagtgttttaacccagttgtagtgactgctaagtgttttcttttgaacacacacacacacacacacacacacacacacaactcttagagtattaattgatatggtaatgcc

SEQ ID NO: 11955 - DNA, 244 bp, Homo sapiens
  D7S485
  Located on chromosome 7
  Distance between a terminus base of telomere on chromosomal short arm and 5'-terminus of this base sequence : 40562689
  Distance between 3'-terminus of neighbour sequence of sequence listing upward to telomere on chrosomal short arm and 5'-terminus of this base sequence : 13990
ctacaggattctattcaggatacgaattttttctaaggttaggactagggcaagtgtgtgtgtgtgtgtgtgtgtgtgtatgtgtgtgtatgtgtgttttgcttaaataacaaagttatttctcacagttctggaggctggcgagtccaagatcaaggtcttagacaaaatgattctggagagggctttcttcctgatttgctggatttccttataccttcctgctgcatcctcacatgacaga

SEQ ID NO: 11956 - DNA, 420 bp, Homo sapiens
  chr7.fa.O7frz.40715136
  Located on chromosome 7
  Distance between a terminus base of telomere on chromosomal short arm and 5'-terminus of this base sequence : 40673663
  Distance between 3'-terminus of neighbour sequence of sequence listing upward to telomere on chrosomal short arm and 5'-terminus of this base sequence : 110730
ttgaaatcaggctagtgctgttgccttggtgcccttcattgtttattttgtgatcttttgccttattgtagcctcctccccaattccatctcccttctctcctcattctgctacacacacacacacacacacacacacgcacgcacgcacgcacacacacacacacacacacacagagatccggtaaactcattcacataatgcttcctgatttgtgttactgcttgcaagggtgttttcatttcaaaggaaaatttctgtttatcccatatttgggcaatatgtaaccaaaatctctgttgatagaattcaaaccttctttggacagggaaggaaaaacaaagaaaaagactgacacaggaagtaaatgctttggagaccaagcacctaagtgatgtactttcacaaatacaaggtacg

SEQ ID NO: 11957 - DNA, 317 bp, Homo sapiens
  chr7.fa.O7frz.40907781
  Located on chromosome 7
  Distance between a terminus base of telomere on chromosomal short arm and 5'-terminus of this base sequence : 40793013
  Distance between 3'-terminus of neighbour sequence of sequence listing upward to telomere on chrosomal short arm and 5'-terminus of this base sequence : 118930
cctagcattgctataacaaagtaccacaagctggataacttaaaatagtagaaatatattctctcacagttttggaggatagaagtccagaatcaaaatgttggcagagctgtgctcccttagaaagatgttttcttgcttcttcttagcttttgcaagcaatccgtggcatttgttggcttgtagttgttattactcaaatttctgtctctgtcttctcttggctttctcatgtgtgtgtgtgtgtgtgtgtgtgtgtgtgtgtgtgtgtttccaaatctccccttcttgtcaggacattagcctttgaagttagg

SEQ ID NO: 11958 - DNA, 153 bp, Homo sapiens
  AC006023.2_21084
  Located on chromosome 7
  Distance between a terminus base of telomere on chromosomal short arm and 5'-terminus of this base sequence : 40919878
  Distance between 3'-terminus of neighbour sequence of sequence listing upward to telomere on chrosomal short arm and 5'-terminus of this base sequence : 126548
tagtttcttgccatccaataacaacttattgaagttactaaattttgttttccaatttaatggcagaaggactgtgtgtgtgtgtgtgtgtgtgtgtgtgtgtgtgtgtgtgttttcctgggttattgagtttattgcttggaattgatctaa

SEQ ID NO: 11959 - DNA, 338 bp, Homo sapiens
  AC006023.2_105055
  Located on chromosome 7
  Distance between a terminus base of telomere on chromosomal short arm and 5'-terminus of this base sequence : 41003767
  Distance between 3'-terminus of neighbour sequence of sequence listing upward to telomere on chrosomal short arm and 5'-terminus of this base sequence : 83736
gattaagtttaggaatcaggctgggcgtggtggcttatgcctgtaatcctaccactttgggaggctgaagtgggtggatcacctgaggtcaggagtgagccgagattgcccattgtactccagcctgggcgacaacagcaaaactctggctcaaaaataaataaataaataaataaataaataaataaataaataaataaataaatccaggattcataatattaattaatttatttaattttgtgacaaagtcttgttctgtcacccaggctggagttcgatggcaagatctcagctcactgcaacctccacctcctgggttcaaggattgttctgca

SEQ ID NO: 11960 - DNA, 342 bp, Homo sapiens
  AC004988.2_36049
  Located on chromosome 7
  Distance between a terminus base of telomere on chromosomal short arm and 5'-terminus of this base sequence : 41336868
  Distance between 3'-terminus of neighbour sequence of sequence listing upward to telomere on chrosomal short arm and 5'-terminus of this base sequence : 332763
cactcacggaataattgcttattctccttttctctaactacacattttatgtttacaatattcctggctaggaaaagaaactaagtgaacagtctctctctctctctctctctctctctctctctgtctttctctctctgtcacacatacacagaatcatatgtacacaacttaaatctctaaatttataaatttacattttcctttttaaatgatttttctttcctctattgtgaattgtttttcttttctcatttgctaactttggaaagagaaaaaatccagacattggaatgtctgagtttatttaagtctcagtactctgttcaatttaatgaacgg

SEQ ID NO: 11961 - DNA, 261 bp, Homo sapiens
  AC004988.2_131295
  Located on chromosome 7
  Distance between a terminus base of telomere on chromosomal short arm and 5'-terminus of this base sequence : 41432083
  Distance between 3'-terminus of neighbour sequence of sequence listing upward to telomere on chrosomal short arm and 5'-terminus of this base sequence : 94873
taggactctgctcaaatgtcacctcaacagagaggtttctcttgatcactctctttccttgcttaattttcttcgtagtgatcaacacctggcatatcacacacacacacacacacacacacgcacacacacacacacacacacacacacacacgaatataagcttcataaactcaggtgttcctggccataatatacactcagtgaatatgtgtgtttgttgaatgactctgcttcccatggagcgtctacagtgtagtc

SEQ ID NO: 11962 - DNA, 109 bp, Homo sapiens
  Z66662
  Located on chromosome 7
  Distance between a terminus base of telomere on chromosomal short arm and 5'-terminus of this base sequence : 41483648
  Distance between 3'-terminus of neighbour sequence of sequence listing upward to telomere on chrosomal short arm and 5'-terminus of this base sequence : 51304
gatgtccagtaaaattctgattcaactggttagatttatatgtgtgtgtgtgtgtgtgtgtgtgtgtgtgtgtgtgtgcatgttttcttactcgttgacttgctcttcc

SEQ ID NO: 11963 - DNA, 371 bp, Homo sapiens
  AC005030.1_4133
  Located on chromosome 7
  Distance between a terminus base of telomere on chromosomal short arm and 5'-terminus of this base sequence : 41490863
  Distance between 3'-terminus of neighbour sequence of sequence listing upward to telomere on chrosomal short arm and 5'-terminus of this base sequence : 7106
tggttagactcctatcacgagtagaactgctctttggataaaaggaaagtcgggagtgaggaaatcaagtaggtagggcccctgacttccctcctctgtctctgtaaaacgtttctgtgcaaacacacacacacacacacacacacacacacacacacacacgcacaccacaaacacgccaagctgagcagaccttcttttatctgttttcacaatggacttccaagtaatgtttcatttgaagagtttctctgtaaaaaacaaacacactttgaaaatgactgcctgctacaaccccacttatcatagtgcattcttatctttcccccccagttgaaaatgctgatgtaactcagatgttagctgaggtc

SEQ ID NO: 11964 - DNA, 173 bp, Homo sapiens
  D7S2541
  Located on chromosome 7
  Distance between a terminus base of telomere on chromosomal short arm and 5'-terminus of this base sequence : 41543011
  Distance between 3'-terminus of neighbour sequence of sequence listing upward to telomere on chrosomal short arm and 5'-terminus of this base sequence : 51777
ggcctattcccttgtgttttgaagtttactattttgtttcttcacacaaaaattgttataaaaaccaaacatacaaatgcaaactttcagaatgacgtgtgtgtgtgtgtgtgtgtgtgtgtgtgtgtgtgtgtgtggtgtataaagggtcatactctaacatgccatgccat

SEQ ID NO: 11965 - DNA, 161 bp, Homo sapiens
  AC005030.1_56255
  Located on chromosome 7
  Distance between a terminus base of telomere on chromosomal short arm and 5'-terminus of this base sequence : 41543085
  Distance between 3'-terminus of neighbour sequence of sequence listing upward to telomere on chrosomal short arm and 5'-terminus of this base sequence : -99
aaatgcaaactttcagaatgacgtgtgtgtgtgtgtgtgtgtgtgtgtgtgtgtgtgtgtgtggtgtataaagggtcatactctaacatgccatgccatgaagtgcccacataagtcattcacctcccatgtgagttttctaaatgttccgaaacgtatgt

SEQ ID NO: 11966 - DNA, 265 bp, Homo sapiens
  AC005160.1_120609
  Located on chromosome 7
  Distance between a terminus base of telomere on chromosomal short arm and 5'-terminus of this base sequence : 41763445
  Distance between 3'-terminus of neighbour sequence of sequence listing upward to telomere on chrosomal short arm and 5'-terminus of this base sequence : 220199
agtgctggaactgtgaaactactgaataaaatataggggaaaagcttcttgacattgggcaaagacttttttggatatgaccccaaaagcacaggaaacaaaaatagaattaaactactgatatttcattaagaaatcatgttgcacactttaaatatatacaatttttgtcaattatacctcaataaagctggacacacacacacacacacacacacacacacacacacatttggtatatttggggtttaccttccagcacgtg

SEQ ID NO: 11967 - DNA, 203 bp, Homo sapiens
  AC005029.1_3345
  Located on chromosome 7
  Distance between a terminus base of telomere on chromosomal short arm and 5'-terminus of this base sequence : 41773256
  Distance between 3'-terminus of neighbour sequence of sequence listing upward to telomere on chrosomal short arm and 5'-terminus of this base sequence : 9546
ggtaggaagatggaagtaggttatacttgttaggagaaatatttgttctgatagtgtgtgtgtgtgtgtgtgtgtgtgtgtgtgtgtgtgtgtgtgtgagagagagagagagagagagagaagattgagtggggacttgggtttctgcctcagaatcatgaacttcactgacttctaaactctttcttagctcagaaatgcag

SEQ ID NO: 11968 - DNA, 301 bp, Homo sapiens
  D7S521
  Located on chromosome 7
  Distance between a terminus base of telomere on chromosomal short arm and 5'-terminus of this base sequence : 41828653
  Distance between 3'-terminus of neighbour sequence of sequence listing upward to telomere on chrosomal short arm and 5'-terminus of this base sequence : 55194
tcctgtttgcctcaagtggacagttggtatctcaagatccttcagattgcataatattcagttcaatagactgtgctcaccaagaaccctcaacccctactatacgaattccttcaaaggtaaatcacacacacacacacacacacacacacacacacacacacacacacatcagaaaaatggagagttttgctcaagacagcatacttgcattactagtgagaagttctaggttaaaaaatccattcatgtcatgaaaagagtgtgcaatacaatgggaaaagggtgggtgagttggctc

SEQ ID NO: 11969 - DNA, 309 bp, Homo sapiens
  AC005029.1_177087
  Located on chromosome 7
  Distance between a terminus base of telomere on chromosomal short arm and 5'-terminus of this base sequence : 41947048
  Distance between 3'-terminus of neighbour sequence of sequence listing upward to telomere on chrosomal short arm and 5'-terminus of this base sequence : 118094
tactcaggaaattcactccttcccccacccattcccacctagttcaaaaaataaaataaaataaaataaaataaaataaaataaaataaaataaaataaaataaaataaaccaatagagaaattcacgattctaaaggcctctaaactttgtattttatcccaaggattctgccttccatggaaaatgccttaacacaaagaggtggcattacaattaattccttgatatgtgaaatttggcttagaagttagagaagatactgcctttgggtttcaaatgaaaggtgttgctaaagaaataacttgtc

SEQ ID NO: 11970 - DNA, 384 bp, Homo sapiens
  AC005022.1_27494
  Located on chromosome 7
  Distance between a terminus base of telomere on chromosomal short arm and 5'-terminus of this base sequence : 41981963
  Distance between 3'-terminus of neighbour sequence of sequence listing upward to telomere on chrosomal short arm and 5'-terminus of this base sequence : 34606
atacgaagagctaagaggacagaagaatcattttgggctagaacattcagaaaaatgctcccagagggaaaataatatgtattgggttttgaaggatagataaaagctgataataaagacattctaagaaagcaaatgatgaaagagaagagaaatctgatttgcagggaataactaggaagaaaatactagtgctcaggaagttgattttgtttcatctctacttcctcagtgaggagcaacacctagacactcttactattttctccagcaaccttatgagaccaatatttatttatttatttatttatttattttatcagaagagaggacattatgttcatgattgcttcttttcaggtaacggttttagacttatgtcaa

SEQ ID NO: 11971 - DNA, 401 bp, Homo sapiens
  AC004843.1_25676
  Located on chromosome 7
  Distance between a terminus base of telomere on chromosomal short arm and 5'-terminus of this base sequence : 42094433
  Distance between 3'-terminus of neighbour sequence of sequence listing upward to telomere on chrosomal short arm and 5'-terminus of this base sequence : 112086
cctttgcgtcttcatagcttagctcccacatgtgagtgagaacatatgatgttttgttttctgttcttgagttacttactttagaataatagtcttcaattccatccaagttgctgtgaatgccattatttcattcctttttatgtctgagtagtattccatggtgtgtgtgtgtgtgtgtgtgtgtgtgtgtgtgtgtatgatggccatttgggctggttccatattttggcaactgcaaattgtgcgctataaacgtgcttgtgcaagtatctttttcatacagtgacttcttttcctctgggtagataccttgtagtgggattgctggatcaaacagtaatctactttcagttctttaaggaatctccacactgttttccatagtggttgcactagtt

SEQ ID NO: 11972 - DNA, 391 bp, Homo sapiens
  AC004843.1_57746
  Located on chromosome 7
  Distance between a terminus base of telomere on chromosomal short arm and 5'-terminus of this base sequence : 42126431
  Distance between 3'-terminus of neighbour sequence of sequence listing upward to telomere on chrosomal short arm and 5'-terminus of this base sequence : 31597
ggctggagtacagtaatcacagctcaatgcagcctcgacctcctgagctcaagggatcctcccacctcagccttccaagtagctgggactacagctgcatgccaccacccttggttaattttttaaatgttgtttagagatgggggtctcactatattgcccaggctagccttgaactcttgggttcaagcaatcttccaccttggctgcatgagccaccatatacatatatatatgtgtgtgtgtgtgtgtgtgtgtgtgtatgtgtgtgtgtgtgtattctctgagcttcctgaatgtgtggtttggtgtgtgaaattaaatgatttaaatatttcttcagatatttttgttcctttctctctttcttcaccttctggtagtaccatta

SEQ ID NO: 11973 - DNA, 409 bp, Homo sapiens
  AC004843.1_73645
  Located on chromosome 7
  Distance between a terminus base of telomere on chromosomal short arm and 5'-terminus of this base sequence : 42142354
  Distance between 3'-terminus of neighbour sequence of sequence listing upward to telomere on chrosomal short arm and 5'-terminus of this base sequence : 15532
gtcctgcagatctgattctattacagccatatgatgtggttcaaataccttaatttgagttaaaaagtcatcctcgacttggccatggccaactttcctaccttggctttgtttgttttctctctttcaatcaggcccagctgttttggatgtgtgtgtgtgtatgtgtgtgtgtgtgcacatgtgtgtgtgtgcatgtgcgtgcatgcaggtgtgtgtgtgtgtgtgtgtgtgtgtgtgtgtgtgtgtgctttctctccctgggtatattggaactctttctgttctccttcacacatctgggcctctacttcttgctcatctgcacttctggaaagttgcccctttctcttcatctaattaactactgtttaccctgtggattctaaatgccacatcctatttaaac

SEQ ID NO: 11974 - DNA, 324 bp, Homo sapiens
  AC004843.1_79300
  Located on chromosome 7
  Distance between a terminus base of telomere on chromosomal short arm and 5'-terminus of this base sequence : 42148133
  Distance between 3'-terminus of neighbour sequence of sequence listing upward to telomere on chrosomal short arm and 5'-terminus of this base sequence : 5370
tcttgttgcttatcaataggaaactagttaaagatattgtgaaaaatcccacacaatagattactacatggctcttaaacaagattatgtgtgtgtgtgtgtgtgtgtgtgtgtgtgtgtgtgtgtgtgtgtatctgtctgtacactgtcttaaaaaatctttttggcatattgttgaaaaaaacagcttgtaaaacagcatgtatattttgatcccatttatgtgcagattatatacatatatggtcatacatatatatccatatattatacggccagctttggaagggtgtccatcaaatccttgacagtagctgacttagt

SEQ ID NO: 11975 - DNA, 223 bp, Homo sapiens
  AC004843.1_98944
  Located on chromosome 7
  Distance between a terminus base of telomere on chromosomal short arm and 5'-terminus of this base sequence : 42167841
  Distance between 3'-terminus of neighbour sequence of sequence listing upward to telomere on chrosomal short arm and 5'-terminus of this base sequence : 19384
tttatggctgagtactattccatcacacacacacacacacacacacacacacacacacatatatatatcacagtttctttatccactcattgattgatgggcatttgggttggttccacgtttttgcaattgtgaattgtgttgctataaacatgcatgtgcaagtatctttttcgaataatgacttctattcctctgcgtagttactcagtagcaggattgc

SEQ ID NO: 11976 - DNA, 214 bp, Homo sapiens
  D7S2454
  Located on chromosome 7
  Distance between a terminus base of telomere on chromosomal short arm and 5'-terminus of this base sequence : 42251529
  Distance between 3'-terminus of neighbour sequence of sequence listing upward to telomere on chrosomal short arm and 5'-terminus of this base sequence : 83465
gcaatttctgacgttacatggagatccaacagaaagaagccagcaactatagtgtagaaaggattctgagttttaaacacacacacacacacacacacacacacacacacacacacacacaaagacacacatgcacaaacacacacacaaacacacacacacatatatacctgcagaggttccctaatagcagagagccaaggacctttttata

SEQ ID NO: 11977 - DNA, 274 bp, Homo sapiens
  AC004934.1_72272
  Located on chromosome 7
  Distance between a terminus base of telomere on chromosomal short arm and 5'-terminus of this base sequence : 42291091
  Distance between 3'-terminus of neighbour sequence of sequence listing upward to telomere on chrosomal short arm and 5'-terminus of this base sequence : 39348
ttcataagatggacttcaagactgccattaagaataaatctaaaaagaaaaaacctgggggaaaaaaatcaggttagcatctatggtattggcccattaaaataaaatctctctctctctgtctctctttctctctctctctctctctctcacacacacacacacatacacacacaggcgcacacacacacacttaaagaaacagagatgggcagagacagggagaaagaaatgactaaaataatacatattaaagcattagtcattcctgttt

SEQ ID NO: 11978 - DNA, 379 bp, Homo sapiens
  AC005027.2_101386
  Located on chromosome 7
  Distance between a terminus base of telomere on chromosomal short arm and 5'-terminus of this base sequence : 42555128
  Distance between 3'-terminus of neighbour sequence of sequence listing upward to telomere on chrosomal short arm and 5'-terminus of this base sequence : 263763
ccttaacgaaatgtaacttggtattcttttttccttgatctttcattctttccatacttgttctcaattttttaatgttgtttgttttgttttgttgcaaaagtggtacagaaaaaggaagtgtgaccacctgcacacgattgttcttttaccagtatgtgtatatatgtaatgtgtggaaatgcctgtgtgtgtgtgtgtgtgtgtgtgtgtgtgtgtgtatgctgatatacacagagataagtgtcacacagacataccttatgacctgggtaattgggtaggaaagtgcctgtgatgggccctttcaaactcatggctttctagatgctatttgggttgttctagtccacactactgcagactagattggttgatt

SEQ ID NO: 11979 - DNA, 261 bp, Homo sapiens
  Z67447
  Located on chromosome 7
  Distance between a terminus base of telomere on chromosomal short arm and 5'-terminus of this base sequence : 42569873
  Distance between 3'-terminus of neighbour sequence of sequence listing upward to telomere on chrosomal short arm and 5'-terminus of this base sequence : 14366
gaatgcctgcttcataaatcaagaactttggaaatagtaattctctttaaatgaacttcataagtatccttcccaggtctttagaatctcattctaactaaccaaacacacacacacacacacacacacacaacaacaacaacaacaaaaaccctcatgcatcattcttttttaccagaacttcaactcctataatttctaaattgttacaaatataacagcagattaatgaaaagaagtgaacactccttgaaatagggg

SEQ ID NO: 11980 - DNA, 331 bp, Homo sapiens
  AC005027.2_85866
  Located on chromosome 7
  Distance between a terminus base of telomere on chromosomal short arm and 5'-terminus of this base sequence : 42570725
  Distance between 3'-terminus of neighbour sequence of sequence listing upward to telomere on chrosomal short arm and 5'-terminus of this base sequence : 591
tagtggagtcaatgaccttcagggcatctaaactcacccctgacccacacatgaaccctagtgtcctgaaaacatcccctccgcctccacacaaagtagtgtgtgtgtgtgtgtgtgtgtgtgtgtgtgtgtgtgtgtgtgtgtaggtgacgtggggtgggggtggggggcacaaaacaaacccagatcagatcccagttcctctgctcactcaccgtgtaaactcaggcctcagtgttcccatctataaaatgggatccatgatatgaacctgtgggggtcaagtgcagctgtcagataataataagtgatactatttctgagaagcctg

SEQ ID NO: 11981 - DNA, 203 bp, Homo sapiens
  D7S2548
  Located on chromosome 7
  Distance between a terminus base of telomere on chromosomal short arm and 5'-terminus of this base sequence : 42570806
  Distance between 3'-terminus of neighbour sequence of sequence listing upward to telomere on chrosomal short arm and 5'-terminus of this base sequence : -250
cgcctccacacaaagtagtgtgtgtgtgtgtgtgtgtgtgtgtgtgtgtgtgtgtgtgtgtgtaggtgacgtggggtgggggtggggggcacaaaacaaacccagatcagatcccagttcctctgctcactcaccgtgtaaactcaggcctcagtgttcccatctataaaatgggatccatgatatgaacctgtgggggtcaa

SEQ ID NO: 11982 - DNA, 307 bp, Homo sapiens
  AC005028.1_170114
  Located on chromosome 7
  Distance between a terminus base of telomere on chromosomal short arm and 5'-terminus of this base sequence : 42675411
  Distance between 3'-terminus of neighbour sequence of sequence listing upward to telomere on chrosomal short arm and 5'-terminus of this base sequence : 104402
tggataaatcctgagaaagattaaagagtggtaagagatgtctgcccttcaacacttaagaaattatatcttgctgtggctgtttttttatcttgtgtatgtatatgagtaagcttagcaaagtccttcctgctaaaattgtggattgcgttttatcagaagtcatttgagatttcatgtatgaggccaatctttgaaattttcatgctgaaaatgtttccaatgaggaactgcaactcctctgcattccctcatttcattttattttattttattttattttattttaattcagcttgtattccaa

SEQ ID NO: 11983 - DNA, 146 bp, Homo sapiens
  D7S671
  Located on chromosome 7
  Distance between a terminus base of telomere on chromosomal short arm and 5'-terminus of this base sequence : 42789754
  Distance between 3'-terminus of neighbour sequence of sequence listing upward to telomere on chrosomal short arm and 5'-terminus of this base sequence : 114036
caagagtgggaaatagaatgtcaagttatgtaaaaatttgtgtgtgtgtgtgtgtgtgtgtgtgtgtgtgagacagagtcttactctgttgcccaggctggagtgcagtggagcaatcttggctcactgcaacctgtgcctcccag

SEQ ID NO: 11984 - DNA, 210 bp, Homo sapiens
  AC005026.1_115789
  Located on chromosome 7
  Distance between a terminus base of telomere on chromosomal short arm and 5'-terminus of this base sequence : 42853169
  Distance between 3'-terminus of neighbour sequence of sequence listing upward to telomere on chrosomal short arm and 5'-terminus of this base sequence : 63269
caggtagaatggaatctgacttccccagagctacacctctccttcagactgactggggtagggcccgacaagtgtttttccatggaagcacaagactgcatcttaatcacaacttctgctacaacatacacagacacagacacagacacacacacacacacacacacacacacacacacacagatgggttgagtcaaagtggaacctatt

SEQ ID NO: 11985 - DNA, 179 bp, Homo sapiens
  AC005026.1_112776
  Located on chromosome 7
  Distance between a terminus base of telomere on chromosomal short arm and 5'-terminus of this base sequence : 42856249
  Distance between 3'-terminus of neighbour sequence of sequence listing upward to telomere on chrosomal short arm and 5'-terminus of this base sequence : 2870
aactttgaaaggtaggacgaataggtataataatatttataatagtacatttgcacttttaactgtagggtgattaatgcttgcttacacacacacacacacacacacacacacaatgactatccctaagaagaacagagaagatttaatttttagtctccttgattacaaaggtaggc

SEQ ID NO: 11986 - DNA, 261 bp, Homo sapiens
  AC005026.1_97430
  Located on chromosome 7
  Distance between a terminus base of telomere on chromosomal short arm and 5'-terminus of this base sequence : 42871471
  Distance between 3'-terminus of neighbour sequence of sequence listing upward to telomere on chrosomal short arm and 5'-terminus of this base sequence : 15043
tgctttagtaagcctcattatgttccccttattgaatgctttggtgagcgtggtctctttaagggctctctaccgtatgtgactataatgtttgccatattttagaacgtcaaaatttaagaacggatggatggatagatggatggatgtggtgcaaagtgcttaactgctaaaaaacattttttatcctgaattcacatacacacacacacacacacacacacacacacacacacacagattcagagtcatgtctggatg

SEQ ID NO: 11987 - DNA, 334 bp, Homo sapiens
  AC005026.1_40192
  Located on chromosome 7
  Distance between a terminus base of telomere on chromosomal short arm and 5'-terminus of this base sequence : 42928683
  Distance between 3'-terminus of neighbour sequence of sequence listing upward to telomere on chrosomal short arm and 5'-terminus of this base sequence : 56951
ctttatgctaactggatttggatggtgattgattagaagaaagtgggaccacgtagccttgcaaaaggttcagtactgagccacaagcttcaacactaaaggagcttttaccagtgagttcacagctatttttatattaacaacatttctcccatccaggtttgtgcattttatctttattctttcaaatcctgaaattgcttggataagagagaaggtttatatattatacacacacacagacacacacacacacacacacacatttctaagagcagcctgaacttttaggagaaattgaagaggctttgtgtcaagtacagctaaatccagc

SEQ ID NO: 11988 - DNA, 306 bp, Homo sapiens
  chr7.fa.O7frz.43211526
  Located on chromosome 7
  Distance between a terminus base of telomere on chromosomal short arm and 5'-terminus of this base sequence : 43133864
  Distance between 3'-terminus of neighbour sequence of sequence listing upward to telomere on chrosomal short arm and 5'-terminus of this base sequence : 204847
acatttaacgttctaggaagactcatgtctttaattctgataaattctatgccatttccctctatcaagttctgcctcactgccatttcctttatcatgtacttctgaaattcctctcaggtgagtgatggagtctctcaaggctaactttagctgcagccatgtatctgcccttctatcccatcctatcccatcccatcccatcccatcccatcccatcccatcccatcccatcccatcccatcccatcccatcacatcccattctatcctattctgcttccttcagtacagatttacctgagaa

SEQ ID NO: 11989 - DNA, 396 bp, Homo sapiens
  chr7.fa.O7frz.43326660
  Located on chromosome 7
  Distance between a terminus base of telomere on chromosomal short arm and 5'-terminus of this base sequence : 43249098
  Distance between 3'-terminus of neighbour sequence of sequence listing upward to telomere on chrosomal short arm and 5'-terminus of this base sequence : 114928
gtggaactgtaagtacattaacctctttcttttgtaaattgcccagtcctgggtatgtctttatcagcagcatgaaaatggactaatacacacacacacacacacacacacacacacacacacacacacacgtacatatacatatatatattcaaactctggttggttgtacaatgacatcttaattaaattttcatattacactggaaatgatattcttccctttgaaaaataaccattctctctttagagaaaaaaagatttattttccttagtcttttattttcccagattttgaataagatatagatatgagaaatagttaacattcacataactttaagattaataaaatcaatatcacaagtgaaacgataggtagcaactgacattcaa

SEQ ID NO: 11990 - DNA, 300 bp, Homo sapiens
  chr7.fa.O7frz.43440303
  Located on chromosome 7
  Distance between a terminus base of telomere on chromosomal short arm and 5'-terminus of this base sequence : 43362626
  Distance between 3'-terminus of neighbour sequence of sequence listing upward to telomere on chrosomal short arm and 5'-terminus of this base sequence : 113132
aagcaagtaacatgtttcacagccattacctggggcagaaggctaatttccaatctggagggtaaggatatctggatttttatttgtgaactcacaatatattccccagttcacgtggggagcccaattctggctcctcagctggcatttgtcattgggcatccccatgtccaattcttgggcctgtcacatacccctattttgtgtgtgtgtgtgtgtgtgtgtgtgtgtgtgtgtgtgtgtgtgtgtgttttattaatatttcttttttgagcacttacttacattctgcaccactca

SEQ ID NO: 11991 - DNA, 471 bp, Homo sapiens
  chr7.fa.O7frz.43536499
  Located on chromosome 7
  Distance between a terminus base of telomere on chromosomal short arm and 5'-terminus of this base sequence : 43476667
  Distance between 3'-terminus of neighbour sequence of sequence listing upward to telomere on chrosomal short arm and 5'-terminus of this base sequence : 113741
ctgagtgaacaaacctgtaaagccacccacaagaatattctaataactgcatgttgataaaggagctccttattcaaggatgtgtttttcttttaaagaaataaaaagcattttaaaagatgctcaaataaaaagctgaaaagagcatggttgagcaattctatttccaggcatttaccctagaaaaataaattatttatcatgtgccccaatgcatgtattcaagaatgtatgggagtgtgtgtgtgtgtgtgtgtacatatataacatatatactataatataaaagatacactatgtatatgtaatatataaacattatatacattatagctatctatctcaaaacatttcaatttcatgcaaataactgaaaaaaaatccaatggccggataaattgtggcatatttatgcaatggaataccataaaggagtacaaatgaataaactacagctccatacatcaacac

SEQ ID NO: 11992 - DNA, 171 bp, Homo sapiens
  DISD22_0004913
  Located on chromosome 7
  Distance between a terminus base of telomere on chromosomal short arm and 5'-terminus of this base sequence : 43850593
  Distance between 3'-terminus of neighbour sequence of sequence listing upward to telomere on chrosomal short arm and 5'-terminus of this base sequence : 373455
tcatagtcttcttaggtctccctctttcttctgtctttcacacacacacacacacacacacacacacacacacacacacacgcatacacacatgtaccttgaaaaatagcttttctttttcttaaaacttcccaaagctttcataaaattagccctcaagcactcttacgt

SEQ ID NO: 11993 - DNA, 192 bp, Homo sapiens
  DISD22_0004917
  Located on chromosome 7
  Distance between a terminus base of telomere on chromosomal short arm and 5'-terminus of this base sequence : 44011100
  Distance between 3'-terminus of neighbour sequence of sequence listing upward to telomere on chrosomal short arm and 5'-terminus of this base sequence : 160336
ttctgtggcatgactgttcaaagatagcttttaacttatggtgtatttcaaatatactgcatgtactacacacacacacacacacacacacacacacacacacacacacacacaccaaaccttgtgcccagctaaaaaattaaaatttgaaaattcactgaagtccccatatctctccctgatctcatcctc

SEQ ID NO: 11994 - DNA, 383 bp, Homo sapiens
  chr7.fa.O7frz.43808200
  Located on chromosome 7
  Distance between a terminus base of telomere on chromosomal short arm and 5'-terminus of this base sequence : 44142053
  Distance between 3'-terminus of neighbour sequence of sequence listing upward to telomere on chrosomal short arm and 5'-terminus of this base sequence : 130761
ctcatgatagtaagttctcctgagatatggttgtttaaaagtgtgtatcacctcccccttcactctctctctctctctctctctctctctcctgctttctcccctaatcaacatggttgtaagtttcctgaagcctcccagccatgcttcctatacagcctgcagtgagtaaattaaacctcttttgttcataaattacccggtctcaggtaattctttagagcaatgcaagaacagactagtacatattcctttaattaatatagagctattcaagttttgtgttcctattttggtaatttgtatttctcatttctattttagcaatttgtatttttcaaggaatgtagccattttatcttaatagattgtcaaatccactg

SEQ ID NO: 11995 - DNA, 463 bp, Homo sapiens
  chr7.fa.O7frz.43926890
  Located on chromosome 7
  Distance between a terminus base of telomere on chromosomal short arm and 5'-terminus of this base sequence : 44260436
  Distance between 3'-terminus of neighbour sequence of sequence listing upward to telomere on chrosomal short arm and 5'-terminus of this base sequence : 118000
gtataccactttattcctgcaagaatgggcataataaaaaaattaaaaaacagtagatattggcatggatgtggtgatcagggaacacttctacactgctagtaggaatgtaaactagtacagatactatggaaaacagtgtggagattctttaaagaactaaaagtagaactaccatttgatccagcaatcccactactaggtatctacccagaggaaaataagtcattattcaaaaaagatacttgcacatgcacgtgcatgtttatagcagcacaattcccaattgcaaaatcatggaaccaacccaaatgcccatcaatcaacaagtggataaagaaactgtggtatatatatatatatacacacatatatatatatatacacatatatatatatatatacacaatgcaatactatgcagccataaaaaaggaataaattaacatttgtagcaacttgg

SEQ ID NO: 11996 - DNA, 296 bp, Homo sapiens
  AC005537.2_36104
  Located on chromosome 7
  Distance between a terminus base of telomere on chromosomal short arm and 5'-terminus of this base sequence : 44469959
  Distance between 3'-terminus of neighbour sequence of sequence listing upward to telomere on chrosomal short arm and 5'-terminus of this base sequence : 209060
taaatgagttcagcaaggtcacaggatacgtaaaaaatacacacacacacacacacacacactaattattttttttctattctaccagtgaatgagtttttatgtttttttattttccatattttgtggtgccttgacatcttagggactttgcaggcttggaagaaactgcccctcccagggctagctaattcctagagatggcaaacaacttgtctgagagcccaccattcatatgtaaaccaaccaatccagagtccatgcccacaaccacctcctttgtccaactcacatag

SEQ ID NO: 11997 - DNA, 179 bp, Homo sapiens
  D7S2428
  Located on chromosome 7
  Distance between a terminus base of telomere on chromosomal short arm and 5'-terminus of this base sequence : 44572216
  Distance between 3'-terminus of neighbour sequence of sequence listing upward to telomere on chrosomal short arm and 5'-terminus of this base sequence : 101961
tatgaggccctgggtggctctggtagaacatcattaagaggggctcaggtcatcctgagacaggatttttgcatgcctgggccactgatagaagactcaagaaggatcaagtagaagtgagtgtgtgtgtgtgtgtgtgtgtgtgtggtattgttacagggcgtccttgctcccagagc

SEQ ID NO: 11998 - DNA, 272 bp, Homo sapiens
  AC004455.1_66413
  Located on chromosome 7
  Distance between a terminus base of telomere on chromosomal short arm and 5'-terminus of this base sequence : 44572313
  Distance between 3'-terminus of neighbour sequence of sequence listing upward to telomere on chrosomal short arm and 5'-terminus of this base sequence : -82
caagaaggatcaagtagaagtgagtgtgtgtgtgtgtgtgtgtgtgtgtggtattgttacagggcgtccttgctcccagagctcccaagatggtgttgggccacttccaagatggctgcaagcctcgtgttcgctaacctggggttcttggcctcatggattccaaggaatggaatctggggccatgcagtgagtgttatagctctattagaagccttgggtcacggaagagaaccatggaacccagtgactagtgttcagctcaattagga

SEQ ID NO: 11999 - DNA, 245 bp, Homo sapiens
  AC004692.1_14783
  Located on chromosome 7
  Distance between a terminus base of telomere on chromosomal short arm and 5'-terminus of this base sequence : 44598851
  Distance between 3'-terminus of neighbour sequence of sequence listing upward to telomere on chrosomal short arm and 5'-terminus of this base sequence : 26266
tcctttcacaatagtaaatgaaaccaaaaaaaaactaactatacccaatgattaatttcagaaagaagagactataaaggtaaagtgaaaactagggaggagaaggagggagggagggaggaagcagggatgggagggagggaagaaagaaaaaaagaaggaaggaaggaaggaagtaggtaggtaggtaggtaggtaggtaggtaggtaggtaggtaggtaggtaaagtgtgactgtttgccta

SEQ ID NO: 12000 - DNA, 249 bp, Homo sapiens
  AC004692.1_19259
  Located on chromosome 7
  Distance between a terminus base of telomere on chromosomal short arm and 5'-terminus of this base sequence : 44603336
  Distance between 3'-terminus of neighbour sequence of sequence listing upward to telomere on chrosomal short arm and 5'-terminus of this base sequence : 4240
gagtcaagctttgcagttaaacaattagtaaactgtaaagaaataatttacagtaaactgtaaagtgaaatacaccggtatccccagtactaagtgctaaatagataatgtctaaacagcccatttgagtggtcttttttcctcttctttttactctcctaatgtatgtgtgtgtgtgtgtgtgtgtgtgtgtgtgtgtgtgtgtgtgtgtttaattaattggatcaatatttggcttaggacagtgag

SEQ ID NO: 12001 - DNA, 174 bp, Homo sapiens
  D7S678
  Located on chromosome 7
  Distance between a terminus base of telomere on chromosomal short arm and 5'-terminus of this base sequence : 44603453
  Distance between 3'-terminus of neighbour sequence of sequence listing upward to telomere on chrosomal short arm and 5'-terminus of this base sequence : -132
agcccatttgagtggtcttttttcctcttctttttactctcctaatgtatgtgtgtgtgtgtgtgtgtgtgtgtgtgtgtgtgtgtgtgtgtgtttaattaattggatcaatatttggcttaggacagtgagcacaccctataccaggctctgtgctaagtgctgaggatggca

SEQ ID NO: 12002 - DNA, 332 bp, Homo sapiens
  AC004692.1_118950
  Located on chromosome 7
  Distance between a terminus base of telomere on chromosomal short arm and 5'-terminus of this base sequence : 44703066
  Distance between 3'-terminus of neighbour sequence of sequence listing upward to telomere on chrosomal short arm and 5'-terminus of this base sequence : 99439
ggatagcattaggtgaaatatctaatgtaaatgatgagttgatgggtgcagcaaactaacattgcacatgtataactatgtaacaaacctgcacattgtgcacatgtaccctagaacttacagtattataaataaataaataaataaataaataaataaataaataaatagttacagtgtcattttacatattggttcgttttggtcacttttgctatgctatcgtatttaaagacattaacatgggatttattcttctaaataacaaattagtcaagtaatatacagttactcatgtaaaaaatatatatcagctatcacaattacttcaa

SEQ ID NO: 12003 - DNA, 397 bp, Homo sapiens
  AC006365.3_86082
  Located on chromosome 7
  Distance between a terminus base of telomere on chromosomal short arm and 5'-terminus of this base sequence : 44722758
  Distance between 3'-terminus of neighbour sequence of sequence listing upward to telomere on chrosomal short arm and 5'-terminus of this base sequence : 19360
gtttgtctttcagctgaaactaagatctgcttcaaatactaccatggagtgagtggggccctgcgagcaaccacccccagtgtcacggtcaaaaactcggcagctcctgtaagtctcatttctccgtctttggttagacctaactctggtctttcttcactttcctattttgttcttgtgcgtgcgtgtgtgtgtgtgtgtgtgtgtgtgtgtgtgtacgtgtacatacacacatatggagatatactgatagattgattatgaataaatggaaagacacctcaaaatggtcaagaggaatgagatccatagtcgaccttattaaagctcatgctacacttgtgtgttagggaggagccaagcttctttattttccttagatggccaaatgtttcta

SEQ ID NO: 12004 - DNA, 412 bp, Homo sapiens
  AC006365.3_21828
  Located on chromosome 7
  Distance between a terminus base of telomere on chromosomal short arm and 5'-terminus of this base sequence : 44787053
  Distance between 3'-terminus of neighbour sequence of sequence listing upward to telomere on chrosomal short arm and 5'-terminus of this base sequence : 63898
taatacaatcaaggacatttgaacagaagtggatattttatatatttaccaagacactcacacacacacacacacacacacgtgtacatatatgcagatgtacacatgtggatagctaggtagatagatagatagatgatagatagatagatagatagatagatagatagatagatgctttattgagcagtctcaattcggtagggtatcttaataatgtcttgggcatattccataaccttctggtcacttgtatttataagtaatccaatcaagtctaattttatattcagcttacctctcttgtttcttgccccagcctcctgcgctatccactacagattggaattgtggtttgagggtcttggaaattgtcttggttcattttctgttgctataatggaatacgaca

SEQ ID NO: 12005 - DNA, 345 bp, Homo sapiens
  AC006365.3_21923
  Located on chromosome 7
  Distance between a terminus base of telomere on chromosomal short arm and 5'-terminus of this base sequence : 44787060
  Distance between 3'-terminus of neighbour sequence of sequence listing upward to telomere on chrosomal short arm and 5'-terminus of this base sequence : -405
atcaaggacatttgaacagaagtggatattttatatatttaccaagacactcacacacacacacacacacacacgtgtacatatatgcagatgtacacatgtggatagctaggtagatagatagatagatgatagatagatagatagatagatagatagatagatagatgctttattgagcagtctcaattcggtagggtatcttaataatgtcttgggcatattccataaccttctggtcacttgtatttataagtaatccaatcaagtctaattttatattcagcttacctctcttgtttcttgccccagcctcctgcgctatccactacagattggaattgt

SEQ ID NO: 12006 - DNA, 333 bp, Homo sapiens
  chr7.fa.O7frz.44558475
  Located on chromosome 7
  Distance between a terminus base of telomere on chromosomal short arm and 5'-terminus of this base sequence : 44892141
  Distance between 3'-terminus of neighbour sequence of sequence listing upward to telomere on chrosomal short arm and 5'-terminus of this base sequence : 104736
ctcatgctttactgtaatcgacactttactgcagtagatacaaactcctatttgaaactctaccatcttagattctgacatgccattgtcacctagtttttattatatctttattataagtaaataaacatagttttatcacatcagtaaggtatactcattatgaaaaaatttaatatacataagaaaatatctccatacagaaataaatgccattattcttctgacctaagtttttccatatcttttatggatggatggatggatggatggatggatggaaagacagatataattttatataaaatatagcaatgtaatcaaagtttactg

SEQ ID NO: 12007 - DNA, 343 bp, Homo sapiens
  AC005189.1_4592
  Located on chromosome 7
  Distance between a terminus base of telomere on chromosomal short arm and 5'-terminus of this base sequence : 44987574
  Distance between 3'-terminus of neighbour sequence of sequence listing upward to telomere on chrosomal short arm and 5'-terminus of this base sequence : 95100
ttggtcagtgaaaagatgctactatattgcttttgtcccaaagtgagtaaaatcccctagagcagagagagagagagagagagagagtgtcttcatgccaaccacagcctgtttctgctgagtttcttatcagccctcaagctatgctaggaaaagttataaaatgccaaaatatttataaacatttactttgtccataaaaaatttacattggatactctgtaagtaggaggtactttgtcccaaaaagatgtataagaatgtactaatagttttatttgattaggattgaacagttcagttgtatctatgccccacagtgaccagtaaagtccaattaaaa

SEQ ID NO: 12008 - DNA, 356 bp, Homo sapiens
  AC005189.1_23638
  Located on chromosome 7
  Distance between a terminus base of telomere on chromosomal short arm and 5'-terminus of this base sequence : 45006461
  Distance between 3'-terminus of neighbour sequence of sequence listing upward to telomere on chrosomal short arm and 5'-terminus of this base sequence : 18544
gtgcagtgacatgatcataactcattgcagcctccaactcctgggttcaagcgatcctcctgcttcagcctcctgggtagctgggattataggtgtgcactatcacgcctggctaaattatagatagatagattagatagatagatagatagatagatagatagatagatagatagatagataggcaggcaggcaggcaggcaggcaggcaggcagagagacagagagagagagagagagagagagagagagagagacagggtcttgctgtgttgcccaggctggtttcaaaccccagggctcaagcaatcctcttacctcagcctcccaaagtgctgagagctatcaaagccaac

SEQ ID NO: 12009 - DNA, 402 bp, Homo sapiens
  AC005189.1_79430
  Located on chromosome 7
  Distance between a terminus base of telomere on chromosomal short arm and 5'-terminus of this base sequence : 45062337
  Distance between 3'-terminus of neighbour sequence of sequence listing upward to telomere on chrosomal short arm and 5'-terminus of this base sequence : 55520
agatttcaaatacgttaccatcacagaaaaaaactgacaaagatgccctaatcagcttttataaaaatgtaggcagatatatatatatatatatacatacacgtatatatatgtacacatatatacgtgtatatatacgtgtgtgtgtgtgtgtgtgtgtgtgtgttagagtaaggtacctaaatagctactttaatattcaatgctcacactaacctttctgcattttcttacaatagtcctattttaaagaaaaaacaaactggcaaatgttgtttatagtttacaagtgtagtgagttaagaaaatgaagccatagcaacactggccacagcacccaaaacaaacacctccctactaggtgctctgtaaagaagtaggtacatctcaggctgttactgg

SEQ ID NO: 12010 - DNA, 212 bp, Homo sapiens
  AC005189.1_88273
  Located on chromosome 7
  Distance between a terminus base of telomere on chromosomal short arm and 5'-terminus of this base sequence : 45071233
  Distance between 3'-terminus of neighbour sequence of sequence listing upward to telomere on chrosomal short arm and 5'-terminus of this base sequence : 8494
tgcctttcacaggtagatctacaatccactgagaattcatttggggtgtaatatgagatacaggtcttgattcactttgttttattgtgtgtgtgtgtgtgtgtgtgtgtgtgtgtgtgtgtgtatacgcatgaacatgcatatatataaaatgcttcagcactatttactgaaatatattgtcaccgttctgcacgttatctttataacaa

SEQ ID NO: 12011 - DNA, 275 bp, Homo sapiens
  AC005189.1_117214
  Located on chromosome 7
  Distance between a terminus base of telomere on chromosomal short arm and 5'-terminus of this base sequence : 45100199
  Distance between 3'-terminus of neighbour sequence of sequence listing upward to telomere on chrosomal short arm and 5'-terminus of this base sequence : 28754
agttgacattggtacaatccacagaatttattcagatttcaccagttttatatgcacatctgtgtgtgtgtgtgtgtgtgtgtgtgtgtgtgtgtgtgtgtgtgtagttctatgcaattttatcacatttctattcatctaaccatcaccccagttaagattccaaacaatttcatcacaaggatccctgctacttccctttcatagccacagtcaattcctgtctttcctgccagaccctctctgtaagccttagcaaccactaatctgttcat

SEQ ID NO: 12012 - DNA, 164 bp, Homo sapiens
  AC005189.1_168715
  Located on chromosome 7
  Distance between a terminus base of telomere on chromosomal short arm and 5'-terminus of this base sequence : 45151706
  Distance between 3'-terminus of neighbour sequence of sequence listing upward to telomere on chrosomal short arm and 5'-terminus of this base sequence : 51232
tcctacttccaagcaccacatttctcctggtagtcttgtggtagtggtatgtacgtgtgtgtgtgtgtgtgtgtgtgtgtgtcttcctctagctgactgagctcattgaaaggcgatgattttaatttgttctccatgatttctcctacagcgcctagtacata

SEQ ID NO: 12013 - DNA, 475 bp, Homo sapiens
  AC004951.3_51248
  Located on chromosome 7
  Distance between a terminus base of telomere on chromosomal short arm and 5'-terminus of this base sequence : 45357772
  Distance between 3'-terminus of neighbour sequence of sequence listing upward to telomere on chrosomal short arm and 5'-terminus of this base sequence : 205902
cttccggaatttctgtttcatttcttggatcaatctctctgttcaggtgtcactactagactattttaatccccgtatgtatgtatgtatgtatgcatgtatgtatgtatgtatttattttgagacggagttttgctcttgttgcccaggctagagtgcaatggtgcggtctcagctcactgcaacctccacctcctgggttcaaacgattcattctcctgcctcagcctcccaactagctgggattacaggtgcccaccaccacgcctggctaatttttgtgtttttagtagagatggggtttcaccattttggccaggctggttgagaactcctgacctcaagtcatctgcccgcctctgcctcccaaagtgctgggattacaggcgtgagccactgcgcccagccaatcgctgtatttttatagtctgctttgttctgtaaatgatccctctcgagtgtaactcactagtgg

SEQ ID NO: 12014 - DNA, 236 bp, Homo sapiens
  G09840
  Located on chromosome 7
  Distance between a terminus base of telomere on chromosomal short arm and 5'-terminus of this base sequence : 45597676
  Distance between 3'-terminus of neighbour sequence of sequence listing upward to telomere on chrosomal short arm and 5'-terminus of this base sequence : 239429
ggaaggaaggtggcacagcaatcccccatccctcccccaccgcctggctccaggaccctggctggccaggccatgaaattgggtcctcctgcctggggatcccgtgctgcccatgcaggcctgggtggggacagacaggcacgtttcaacctaggactgcagcgcttctcaaatgggatcctcccccaaccccagcagcagcagcagcagcagaatcgccctgtacagtcagaaat

SEQ ID NO: 12015 - DNA, 403 bp, Homo sapiens
  AC004453.1_70771
  Located on chromosome 7
  Distance between a terminus base of telomere on chromosomal short arm and 5'-terminus of this base sequence : 45814915
  Distance between 3'-terminus of neighbour sequence of sequence listing upward to telomere on chrosomal short arm and 5'-terminus of this base sequence : 217003
gcagctttaagactcatatctgacataaatatgcttaaacatgcagagaatatctccaaaagaacaatagggtagcagcagctacctttatggctggaaactggagacttctcttcattgacacttttgtacatacattaccatttgaaaaaagtcaaaattgtgaaaatatataaataaaatacccacacacacacacactcacacacacacacacacacacacacacacacacaaaagaccaacatggccccagcacttggcagagatcagggagtaaacatgaagactcctcaaaagttgggaaaaagaaacggctctctcaagaaaggagaatgagtataatgccgggggatatccttggggacgctgccgccagcaacagtgcagtcacttggcctat

SEQ ID NO: 12016 - DNA, 263 bp, Homo sapiens
  AC004453.1_42395
  Located on chromosome 7
  Distance between a terminus base of telomere on chromosomal short arm and 5'-terminus of this base sequence : 45843335
  Distance between 3'-terminus of neighbour sequence of sequence listing upward to telomere on chrosomal short arm and 5'-terminus of this base sequence : 28017
aaaccgtacatgtgtctggtatggtgtgccatgtgcacttggtgtgatgtgtgtgcatgcatacaagcatgtgtatgagcctggagaaaggtgtgcaaggacacatctcagtatactgacactggctgcaggattagacggggagtgctgtgtgtgtgtgtgtgtgtgtgtgtgtgtgtgtgtgtgtgtgtggtgatgtgtatgcatacatacaagcatgtgtatgagcctggagaaaggtgtgcaaggacatctcacagtat

SEQ ID NO: 12017 - DNA, 350 bp, Homo sapiens
  AC004453.1_38385
  Located on chromosome 7
  Distance between a terminus base of telomere on chromosomal short arm and 5'-terminus of this base sequence : 45847294
  Distance between 3'-terminus of neighbour sequence of sequence listing upward to telomere on chrosomal short arm and 5'-terminus of this base sequence : 3696
ctgagcctgtaacctaactcaattttagataaaaacccaaataattttttgcatgcttttattatatcatgaattttccaggaatacaacatgtctgattctggcctttactaaaatgtaattgcctttttgaaaatactcatcaccaaagcaacactgcctgtgtattctgggttaccaatcaagacacaaccaggctgtgtgtgtgtgtgtgtgtgtgtgtgtgtgtgtgtgtgtgtgtgtatacacaaagatacaaaagatttatagtatcttttgcattgtatgagtgcccatggccctcatgagatagctgctggcactgaatatatgacactaagcgaaggcta

SEQ ID NO: 12018 - DNA, 126 bp, Homo sapiens
  D7S667
  Located on chromosome 7
  Distance between a terminus base of telomere on chromosomal short arm and 5'-terminus of this base sequence : 45847462
  Distance between 3'-terminus of neighbour sequence of sequence listing upward to telomere on chrosomal short arm and 5'-terminus of this base sequence : -182
tctgggttaccaatcaagacacaaccaggctgtgtgtgtgtgtgtgtgtgtgtgtgtgtgtgtgtgtgtgtgtgtatacacaaagatacaaaagatttatagtatcttttgcattgtatgagtgcc

SEQ ID NO: 12019 - DNA, 228 bp, Homo sapiens
  D7S2488
  Located on chromosome 7
  Distance between a terminus base of telomere on chromosomal short arm and 5'-terminus of this base sequence : 45894647
  Distance between 3'-terminus of neighbour sequence of sequence listing upward to telomere on chrosomal short arm and 5'-terminus of this base sequence : 47059
ctccagtgcaatgttgggtaaaagtgggcaactttgtctcattcccaatctcaggggaaagggtttcaatgtttgactattaagtataaaatttgttcaaccgtatgttattttatatgtgtgtgtgtgtctgtgtgtgtgtgtgtgtgtgtgtgtgtgtgtgtataataacattatacagttgaacaaatactacagataggactggcatggtggctcatacctgta

SEQ ID NO: 12020 - DNA, 310 bp, Homo sapiens
  AC004859.2_13194
  Located on chromosome 7
  Distance between a terminus base of telomere on chromosomal short arm and 5'-terminus of this base sequence : 46010779
  Distance between 3'-terminus of neighbour sequence of sequence listing upward to telomere on chrosomal short arm and 5'-terminus of this base sequence : 115904
ttgatgtgatatcatggatgttactgaagactgtggttgcagattgtggcagatttcacacacacacacccctacacacacacacacacacacacacacccctacacacacacacacacacacacacccctacacctgcagattatatctagaataaaactgagccctgaggtttcagaatcaaggactattatgtgcccaggcctattcttttgccttccttttctcaaacataaccttttcttggaaccaaccaagttgttttcagtgatgttaggatttggagtcagtagctcctaaatgacagtgc

SEQ ID NO: 12021 - DNA, 262 bp, Homo sapiens
  D7S2436
  Located on chromosome 7
  Distance between a terminus base of telomere on chromosomal short arm and 5'-terminus of this base sequence : 46064924
  Distance between 3'-terminus of neighbour sequence of sequence listing upward to telomere on chrosomal short arm and 5'-terminus of this base sequence : 53835
tggcattggggacactgagcaaatgagtaaacatatcaaaggcagtgaggatggagtgtcttgcagttgtaggagatatttataggtgtggaaggaggtggcctagaaagtgttggattaaaatttggaggtatcaatacaaactcatagttttattgcatacacacacacacacacacacacacacacacacacagaaatagccatgtatatgtgcgcctgcatatgcacacatgtattttttagatgtatgcggaatggg

SEQ ID NO: 12022 - DNA, 362 bp, Homo sapiens
  AC004859.2_67427
  Located on chromosome 7
  Distance between a terminus base of telomere on chromosomal short arm and 5'-terminus of this base sequence : 46064977
  Distance between 3'-terminus of neighbour sequence of sequence listing upward to telomere on chrosomal short arm and 5'-terminus of this base sequence : -209
gagtgtcttgcagttgtaggagatatttataggtgtggaaggaggtggcctagaaagtgttggattaaaatttggaggtatcaatacaaactcatagttttattgcatacacacacacacacacacacacacacacacacacagaaatagccatgtatatgtgcgcctgcatatgcacacatgtattttttagatgtatgcggaatgggcctagaaatgatgatatcctggcagtgatgagcacacaaatactggtcttaaatcccatcctctactggaggaagctggcttcttagagaaacagctgatattgtccagggctggacagggacagtacaacatggaagctacaatgttctgtt

SEQ ID NO: 12023 - DNA, 449 bp, Homo sapiens
  AC004859.2_97523
  Located on chromosome 7
  Distance between a terminus base of telomere on chromosomal short arm and 5'-terminus of this base sequence : 46094902
  Distance between 3'-terminus of neighbour sequence of sequence listing upward to telomere on chrosomal short arm and 5'-terminus of this base sequence : 29563
gtatgtgcaggtctttgtaagttctcactgcaggtctgtggccctcagcaccctgcaaggagaacagggctttgtaagggctctggaaagatcaggaacagtcagaacatgctggaccaggtgttcacacatgacgtcttgcagatggttccctggttttgttctgtttcagtttttaattgtcccattttctaaaattggaaaacaattgttggaagaagctccatgcagtctaggcagcatcttgtgtgtttagatgagacttagtgggtcaggaccgtgtgtgtgtgtgtgtgtgtgtgtgtgtgtgtgtgtgtgtgtgtgtcgaacagcagagtgacatcaggtgacagccttgggttagcatcacagatgcagcaggcatggtgtggtgtgggtgagctgaagggaaatgcaaaccgtttttaggacaaagaggccttgttctg

SEQ ID NO: 12024 - DNA, 182 bp, Homo sapiens
  AC004854.2_24047
  Located on chromosome 7
  Distance between a terminus base of telomere on chromosomal short arm and 5'-terminus of this base sequence : 46230521
  Distance between 3'-terminus of neighbour sequence of sequence listing upward to telomere on chrosomal short arm and 5'-terminus of this base sequence : 135170
gaactgacttcgtattaacctgagttaaggttgttggttttaaaaaattacacacacacacacacacacacacacacacacacacacagagagagacagagagagagagagaggaggaagtaggagttcgttcattttacttggataaacttgcaaactggatactaagacactttcatgtc

SEQ ID NO: 12025 - DNA, 124 bp, Homo sapiens
  D7S478
  Located on chromosome 7
  Distance between a terminus base of telomere on chromosomal short arm and 5'-terminus of this base sequence : 46277149
  Distance between 3'-terminus of neighbour sequence of sequence listing upward to telomere on chrosomal short arm and 5'-terminus of this base sequence : 46446
tgtgtcattacgcttttcatctttatgtttcttcatctctgtctctacacacacacacacacacacacacacacacacacacacacacgctatttgacatttttctttctcctgaaccatttga

SEQ ID NO: 12026 - DNA, 236 bp, Homo sapiens
  D7S2427
  Located on chromosome 7
  Distance between a terminus base of telomere on chromosomal short arm and 5'-terminus of this base sequence : 46309696
  Distance between 3'-terminus of neighbour sequence of sequence listing upward to telomere on chrosomal short arm and 5'-terminus of this base sequence : 32423
aggattgtttgagcccagaagatggaggctgcagtgagccgtgattgcaccccttgcactccagcctgggtgacagagtgagaccctgtttcaaacacacacacacacacacacacacacacacacacacacacacacacacacacacactaagataccagtacagacccatagacccatcaaatgaaaaagactgacaataccaggagtaacatccccgctgctgatgggaatct

SEQ ID NO: 12027 - DNA, 317 bp, Homo sapiens
  AC013416.3_173941
  Located on chromosome 7
  Distance between a terminus base of telomere on chromosomal short arm and 5'-terminus of this base sequence : 46582949
  Distance between 3'-terminus of neighbour sequence of sequence listing upward to telomere on chrosomal short arm and 5'-terminus of this base sequence : 273017
tcactggtaaattctgtcaaacatttaagaaagaaataacaccattatttaactaatacagcagaagaggaaagaatgtttttgtatcttattattattattattattattattattattattattattattttggatgctttgtcatcccaaagtgctgggattacaggcatgaaccactgtggcctgccgaggaattttttttaaattcactttatgggtccagcataactttgataccaaaacctgacaaggaaattataagaaaagaaaattatagaccaatatttttcatgaacatagatgtgaaagtcttt

SEQ ID NO: 12028 - DNA, 363 bp, Homo sapiens
  AC004844.1_71413
  Located on chromosome 7
  Distance between a terminus base of telomere on chromosomal short arm and 5'-terminus of this base sequence : 46615045
  Distance between 3'-terminus of neighbour sequence of sequence listing upward to telomere on chrosomal short arm and 5'-terminus of this base sequence : 31779
gctttgtagatgcaaactctaaattcattgtatcaactattgatcccctatggcatgaagatgaaaatgaaaatcttaagaccttcccttaagccattctggtgaattaaatagatacttgcttgaaaaaaacacaaaatataattgttgtaatgattgttattgttttgtttcatttagagtttatgttaaccccagtcttttccctgcaacaaaaggggacacacacacacacgcagagagagagagagagagagagagagagacagagagagagagacagagagagaaagagagaagaacaagagcaagggagctgtccaaaatttgcagacccctgaaatctgtccttggcttcagttg

SEQ ID NO: 12029 - DNA, 379 bp, Homo sapiens
  AC004844.1_66158
  Located on chromosome 7
  Distance between a terminus base of telomere on chromosomal short arm and 5'-terminus of this base sequence : 46620398
  Distance between 3'-terminus of neighbour sequence of sequence listing upward to telomere on chrosomal short arm and 5'-terminus of this base sequence : 4990
agacttagcatttaattgtttcaccccagtttcttttaaagatatattgcaagtaaattcaatttaaacattttaaaattaaagttagtatgtttaggatgattccatcttaatacaatctatctatctatctatctatctatctatctatctatctatctatctatcatctatctatccatcatctatcatctatccatctatctatctatctatctatctatctatctatctatctatcatctatcttctatctctatcatttaacttctatctaatctatcatctatctatattatctatctatctgtctatctatctatctatcatctatctacctatctaccatctatttatctgtgaaggttatcagaatcaa

SEQ ID NO: 12030 - DNA, 282 bp, Homo sapiens
  HUMUT5049
  Located on chromosome 7
  Distance between a terminus base of telomere on chromosomal short arm and 5'-terminus of this base sequence : 46620493
  Distance between 3'-terminus of neighbour sequence of sequence listing upward to telomere on chrosomal short arm and 5'-terminus of this base sequence : -284
aggatgattccatcttaatacaatctatctatctatctatctatctatctatctatctatctatctatctatcatctatctatccatcatctatcatctatccatctatctatctatctatctatctatctatctatctatctatcatctatcttctatctctatcatttaacttctatctaatctatcatctatctatattatctatctatctgtctatctatctatctatcatctatctacctatctaccatctatttatctgtgaaggttatcagaatc

SEQ ID NO: 12031 - DNA, 486 bp, Homo sapiens
  HUMUT6144B
  Located on chromosome 7
  Distance between a terminus base of telomere on chromosomal short arm and 5'-terminus of this base sequence : 46628754
  Distance between 3'-terminus of neighbour sequence of sequence listing upward to telomere on chrosomal short arm and 5'-terminus of this base sequence : 7979
accattcacctggaggttcctgactgccctaagccttggaattaatgaagtgacacagacgagagcatgcttgataaatgctgtttgggtctgactctaatttcctgttggctggataaattttaggttccagttcctcttcatctttggtgatactcaattttttcttttctcccttccttccttccttccttccttccttccttccttcctttcttccttccttctttctctctctctctttctttctttctttctttttttctttctttctttctttttctttcttttctttctttctttctttctttctttctttctttctttctttctttctttctttctttctctttttctttctttctttccttccttcttctttctttctctttctttttgttttccttttttttgatgcagtttcactctctagcccaggctggagtgtagtggcatgatctcggctcactgcaatctctgcctccc

SEQ ID NO: 12032 - DNA, 448 bp, Homo sapiens
  AC004844.1_32466
  Located on chromosome 7
  Distance between a terminus base of telomere on chromosomal short arm and 5'-terminus of this base sequence : 46653973
  Distance between 3'-terminus of neighbour sequence of sequence listing upward to telomere on chrosomal short arm and 5'-terminus of this base sequence : 24733
ttcagattggagcttacattactggcttctctgggtcttcacactgccctgaccctgcagagctcagaacttctccgccaccataatcatgtgagccaattctctatctatctatcatctctatctatctctatcatgtatctattaatctatctatcatgtatctattagtctatcactattatctatcatctatatctatctaacaccttctatctatatctatcctatctattctatatctatctatctatctatctatctatctatctatctatctatctacctacctatctatctatttctgtctgtctgtctatccatccatccatctatccatcctgttggttctatttctctggagacccctgacacagaggtcattcttctcatgttacagtgtctgctcctagggagtcactgtgtacagtattgcagcttattgttt

SEQ ID NO: 12033 - DNA, 409 bp, Homo sapiens
  AC004844.1_18750
  Located on chromosome 7
  Distance between a terminus base of telomere on chromosomal short arm and 5'-terminus of this base sequence : 46667719
  Distance between 3'-terminus of neighbour sequence of sequence listing upward to telomere on chrosomal short arm and 5'-terminus of this base sequence : 13298
tgccagtcttcctactgtaaagttattttctgtttcccctttccagactgtatgtaccctttggaaggaaatcactatacacaatgagcacttaagggtcagagacttacgttccaccttcttgagggaacagtatctataataaactatttgggattttttggtacaggagatttgtcttttctaccttgcattggtcagaattctccagagaaacagaaacaataggagagagagagagagagagagagagaggagagagagagagagagagagagagagatattatgagagattggcccacatgagtatggaggccaagaagtcccatgatctactctctgcaagctggagacccaggggggataatggtgtaattcattccaagtctgaaaacctaagaaccagg

SEQ ID NO: 12034 - DNA, 270 bp, Homo sapiens
  chr7.fa.O7frz.46654395
  Located on chromosome 7
  Distance between a terminus base of telomere on chromosomal short arm and 5'-terminus of this base sequence : 46922367
  Distance between 3'-terminus of neighbour sequence of sequence listing upward to telomere on chrosomal short arm and 5'-terminus of this base sequence : 254239
gttgtgaaatcattgcttagagggaaatctctacctgtaaatgcctatacttaaaaaaattaataaacaaactgtatcattcagggttctccagagaaatagaaccaataggatgtgtgtatatatatgtatatgcatatgtatatgtgtgtgtgtgtgtgtgtgtgtgtgtgtgtgtacatatacacataagcacacaaacatacatacagagagggagaaagaaagaaagaaagagagaaatgtatttaatccaattaactctcatga

SEQ ID NO: 12035 - DNA, 183 bp, Homo sapiens
  chr7.fa.O7frz.48950749
  Located on chromosome 7
  Distance between a terminus base of telomere on chromosomal short arm and 5'-terminus of this base sequence : 47206569
  Distance between 3'-terminus of neighbour sequence of sequence listing upward to telomere on chrosomal short arm and 5'-terminus of this base sequence : 283932
gagcaagaccgtgatatttattttatatatatgtgtatatatattttatattatatattttatacgtgtgtgtgtgtgtgtgtgtgtgtgtgtgtgtgtgtgtgtatcctatatgttgggatattttgtagccatgagaattaaaaaaaaatagtaacacagtaaatcgcctggtttaatact

SEQ ID NO: 12036 - DNA, 204 bp, Homo sapiens
  D7S665
  Located on chromosome 7
  Distance between a terminus base of telomere on chromosomal short arm and 5'-terminus of this base sequence : 47267638
  Distance between 3'-terminus of neighbour sequence of sequence listing upward to telomere on chrosomal short arm and 5'-terminus of this base sequence : 60886
gaagagtgagtgaggtgtatatgagtttgtgtgtgtgtgtgtgtgtgtgtgtgtgtcttgatctagatagttgatctgtgaaatataaaaagtgattgactaggattagaattttatctttttttggagtggagggaggttggtttaaatttcagatattctattcagtaggcttgtaaaaaaaatcgttaatgttagtgcagg

SEQ ID NO: 12037 - DNA, 218 bp, Homo sapiens
  D7S2561
  Located on chromosome 7
  Distance between a terminus base of telomere on chromosomal short arm and 5'-terminus of this base sequence : 47290349
  Distance between 3'-terminus of neighbour sequence of sequence listing upward to telomere on chrosomal short arm and 5'-terminus of this base sequence : 22507
tgcattacggccagttctttgtcgtaccttggaatttgtgtgtgtgtgtgtgtgtgtgtgtgtgtgtgtgtgtgtgttttgtcctctgtgtttgtttgtttgtttccttttgatgcatataatgtaatattcttggtgaaggccatacctcccctttctgcaggtgtgagtgggagggctgcaggttgcggagtgagacctgaggctacactgctggc

SEQ ID NO: 12038 - DNA, 108 bp, Homo sapiens
  D7S670
  Located on chromosome 7
  Distance between a terminus base of telomere on chromosomal short arm and 5'-terminus of this base sequence : 47514873
  Distance between 3'-terminus of neighbour sequence of sequence listing upward to telomere on chrosomal short arm and 5'-terminus of this base sequence : 224306
aaccgaagcaggattttatttctagcccaatagagtgtgtgtgtgtgtgtgtgtgtgtgtgtgtgtgtgtgtgtgtgtaagtttgtgaaatgctaaataaaaatggac

SEQ ID NO: 12039 - DNA, 150 bp, Homo sapiens
  D7S679
  Located on chromosome 7
  Distance between a terminus base of telomere on chromosomal short arm and 5'-terminus of this base sequence : 47547937
  Distance between 3'-terminus of neighbour sequence of sequence listing upward to telomere on chrosomal short arm and 5'-terminus of this base sequence : 32956
tacaggcgtgaggcaccatgcctggctgaaatttctccttttgcgtccttttggagagagagagagaaagagagagagagagagagagagagagagtgtgtgtgtgtgtgtgtgtgtgtgtgtgtgcctaatatggaagcctgctggtga

SEQ ID NO: 12040 - DNA, 292 bp, Homo sapiens
  chr7.fa.O7frz.48292842
  Located on chromosome 7
  Distance between a terminus base of telomere on chromosomal short arm and 5'-terminus of this base sequence : 47896429
  Distance between 3'-terminus of neighbour sequence of sequence listing upward to telomere on chrosomal short arm and 5'-terminus of this base sequence : 348342
actcactgaggtaacgtaggtcctggtgtgaataagaggtttctccacaggccaagtgtgaacacattgcttttctgtcctttctcttggacagagaatcctccgctaagactggtgtgtgtgtgtgtgtgtgtgtgtgtgtgtgtgtgtgtgtgtgtgacagaatcccactcttgtcactcaggctggagggcagtggcgcgatctcagctcactgcaatctacgcctcccaggttcaagcgattctcctgcctcagcctcctgagtagctggtattacaggttcgtgcca

SEQ ID NO: 12041 - DNA, 140 bp, Homo sapiens
  D7S2558
  Located on chromosome 7
  Distance between a terminus base of telomere on chromosomal short arm and 5'-terminus of this base sequence : 48046038
  Distance between 3'-terminus of neighbour sequence of sequence listing upward to telomere on chrosomal short arm and 5'-terminus of this base sequence : 149317
tgaacaggaccccattccattgcaaggcgcgcgcgtgcacgcacacatacacacacacacacacacacacacactcatagtcacttactctgggagaccttagacatgccaattcacccaatgtgcataactctgggatg

SEQ ID NO: 12042 - DNA, 317 bp, Homo sapiens
  HUMUT1451B
  Located on chromosome 7
  Distance between a terminus base of telomere on chromosomal short arm and 5'-terminus of this base sequence : 48139475
  Distance between 3'-terminus of neighbour sequence of sequence listing upward to telomere on chrosomal short arm and 5'-terminus of this base sequence : 93297
aaaattggcctgtagctagcttgctttctttctctttctttctttctttctttctttctttctttctttctttctttctttctttctttctttttttctttttctttctttctttctttctctttctttctttctctctttctttctcttttcctttctttctccctctgtttctccctctttgttcctccctccttccctccttcccttccttccttccttccttccttccttacttccttcctcccttcctcccttcctcccttcctctcctccttctttctttcccaccttccttctttttgtgtctttgtctg

SEQ ID NO: 12043 - DNA, 429 bp, Homo sapiens
  chr7.fa.O7frz.47883112
  Located on chromosome 7
  Distance between a terminus base of telomere on chromosomal short arm and 5'-terminus of this base sequence : 48224083
  Distance between 3'-terminus of neighbour sequence of sequence listing upward to telomere on chrosomal short arm and 5'-terminus of this base sequence : 84291
aacagaagatgaagtcagcactgagaaaaggccacagaaccacaggcagacctgggtccctaatcactaaacaaaatccccttgagctttctttattgatataatgtaaaatcatttcagccaatttctgtttggatttttactatgcacaccattgcaactaaagaaggcaatctaaatgatctagagaaggccctttatacacacacgcacacacacacacacacacactgcactggatttacagagagtgatgttcaaattaaaagtctactgcaacagcatgaagtcatgttgaaattctagaacccactttgatgaatgtaataatgttatgccagaagatattagcaaaattctaggttgaccgatgagaaaacagtcacacaaaaccctccataagaaaactgagtctagctcatgcattac

SEQ ID NO: 12044 - DNA, 196 bp, Homo sapiens
  D7S1800
  Located on chromosome 7
  Distance between a terminus base of telomere on chromosomal short arm and 5'-terminus of this base sequence : 48442265
  Distance between 3'-terminus of neighbour sequence of sequence listing upward to telomere on chrosomal short arm and 5'-terminus of this base sequence : 217753
caggcctctctcagaaacagaaccatctgtctcctaatatctcctgttggtctgtttcctggaggtccctgactaacttgactaacgcagcaagtttggaagatagatagatagatagatagatagatagatagatagatagatagttaaaattagttcacaaggctgtggaggctgacagggccaagatctacaa

SEQ ID NO: 12045 - DNA, 256 bp, Homo sapiens
  D7S519
  Located on chromosome 7
  Distance between a terminus base of telomere on chromosomal short arm and 5'-terminus of this base sequence : 48567714
  Distance between 3'-terminus of neighbour sequence of sequence listing upward to telomere on chrosomal short arm and 5'-terminus of this base sequence : 125253
acagaccaggactcagccagaagtgagcctgttgatctccagtgcttgctgtctctctctcaacctctctctctctctctctctctccctcagtctctctatctctctctctctctcgtgtgtgtgtgtgtgtgtgtgtgtgtgcagttccttcttggcttagacaatctacatcacaaactcacaaactctactatcattattcacctaaaactctgatctctgcctcgttaattcagcagaaatgcttggctgt

SEQ ID NO: 12046 - DNA, 475 bp, Homo sapiens
  chr7.fa.O7frz.47085595
  Located on chromosome 7
  Distance between a terminus base of telomere on chromosomal short arm and 5'-terminus of this base sequence : 48712088
  Distance between 3'-terminus of neighbour sequence of sequence listing upward to telomere on chrosomal short arm and 5'-terminus of this base sequence : 144118
atttaaacaaaaggctcaaataaccctgcagaaggttgtagaaagaaagcagacacacacacacacacacacacacacacacacacacacacacacacaggacaggacagaaagactgatctaaacatgcaatgaaaatagcaataagatttttttaaaatctaaaaagcctctagcaagactgacaaacaaaagagagagaacatacaaattgccagtgacaaaaatagaataggagatatcaccacagaccttgcagatagtaaaagaataataagtgaatactacaacaactctacgcacatatattcaataacttaaaaaaatagatcagtactttgaaaccacaaaatactaaaactcacccaagattaaatagaaagcccatactaactcattatttatacatgaaattaatagtttaaaacctttcaaaaaaagaaatctccaagtttcatgagtgaattctaaagag

SEQ ID NO: 12047 - DNA, 461 bp, Homo sapiens
  chr7.fa.O7frz.46922692
  Located on chromosome 7
  Distance between a terminus base of telomere on chromosomal short arm and 5'-terminus of this base sequence : 48805410
  Distance between 3'-terminus of neighbour sequence of sequence listing upward to telomere on chrosomal short arm and 5'-terminus of this base sequence : 92847
gaatatggcagttgcaaattctaatatcatcacaacacactcataggtaggccccatatatctgatgaacttccaggaccacatctctacaaatgctgaagattatttggagatgggaaaatgtggctgcaggtgctttttctccaggtctgagtaaaatgaaatagtgggtatttctaagatacattaggaggatgccagtttctctttgtttcatattttcaaaaacagagatttaaagaggatgggctagagctcttacgttcagcttcttattccataagggaagaatcaggcgtatttcttgtgttgaagcaacacacacacacacacatacacacacacacacacacacgcacatgttgtttggcaaaagtcagaccagaagaaagcttctctcctaccagcctcattccttggccttgaaccagcattctaagtcttccaatacatccttgtct

SEQ ID NO: 12048 - DNA, 168 bp, Homo sapiens
  D7S2506
  Located on chromosome 7
  Distance between a terminus base of telomere on chromosomal short arm and 5'-terminus of this base sequence : 49066431
  Distance between 3'-terminus of neighbour sequence of sequence listing upward to telomere on chrosomal short arm and 5'-terminus of this base sequence : 260560
cagcagggcttgaaatgaacagggaatgcacacacacacacgcacacacacacactctctctctctctctctctctctctctctctctctcacacacacacacacgtcaggggaaagggggatttagcaggtttattaggctcttcctctatgccagctccactgtgt

SEQ ID NO: 12049 - DNA, 346 bp, Homo sapiens
  chr7.fa.O7frz.49330853
  Located on chromosome 7
  Distance between a terminus base of telomere on chromosomal short arm and 5'-terminus of this base sequence : 49222971
  Distance between 3'-terminus of neighbour sequence of sequence listing upward to telomere on chrosomal short arm and 5'-terminus of this base sequence : 156372
tcatttatggaacatctgctaggtgccaagctgttccaaggatatgtttgaatgtgcctgtacaaatacacacacacacacacacacacacacacacacacattcaaatcctagcaaaacccccaaggtatgtatcatagttctaccttattaagacttgaagaaagttaagaaacttgcccaatggcacatggtcaaagaggagctgggagtgagttttaggtctgctgattctaaagcctgtgcattttcattttcacacactcaaatcatagttctttaatcctgggtgttaaattccatcattagaaagtcatttgtgtttatcttgaagatgactcgttct

SEQ ID NO: 12050 - DNA, 118 bp, Homo sapiens
  Z67339
  Located on chromosome 7
  Distance between a terminus base of telomere on chromosomal short arm and 5'-terminus of this base sequence : 49444470
  Distance between 3'-terminus of neighbour sequence of sequence listing upward to telomere on chrosomal short arm and 5'-terminus of this base sequence : 221153
tcacccaggactggaaattgagcatactcagttctgtggactgaattgcaccccaccccccaacacacacacacacacacacacacacacacattcatttgttgaagccctaccatca

SEQ ID NO: 12051 - DNA, 476 bp, Homo sapiens
  chr7.fa.O7frz.49875211
  Located on chromosome 7
  Distance between a terminus base of telomere on chromosomal short arm and 5'-terminus of this base sequence : 49585530
  Distance between 3'-terminus of neighbour sequence of sequence listing upward to telomere on chrosomal short arm and 5'-terminus of this base sequence : 140942
gtgctaaactttcatagtgagtctttgatggatgaggccagcacctgcagacggttgtggagggtggagctggattctctctcctcaaccccctcggaaggcaccttgtgcagtgcacacactgcataaccttcagagggctgcagcccatcctgactttgtctccacagttaccttctcaccactctgcctactcctttacactcttcggctgttgtcttcctttcttgctttctcttattctgtttttaaaatctgtccccaccttccccaaacacacacacacacacacacacacacacacacacacacacacacacattcccaattcatttcctccttcttgtatatttggattggtcttttccatgttagtaaccctttaagactggccttggatgatttatttactttgattacaaaccttttggattattggggtggattattccctaaacaaaagcaatttctgttta

SEQ ID NO: 12052 - DNA, 394 bp, Homo sapiens
  chr7.fa.O7frz.50010110
  Located on chromosome 7
  Distance between a terminus base of telomere on chromosomal short arm and 5'-terminus of this base sequence : 49696339
  Distance between 3'-terminus of neighbour sequence of sequence listing upward to telomere on chrosomal short arm and 5'-terminus of this base sequence : 110333
ttatctattcaaccatccacacacccatctattcatctattcattcatctgtttgtccatccatccgtccatccatccatccatccatccatccatccatccatatatccatctatccatttatccatttaaatccatccacacatccatccatccatccatccattcattcatgcatctattcatccatccatccatccatccattcatctatctgtccatccatccatccatctattcattcattcaaccatcgattcatctatctatccattcatccatcaatccattcatccatttatctattcatccattgacacatccatccatccatccatccatccatccatccatccatccatctatacattaatccatttattcatctatcctc

SEQ ID NO: 12053 - DNA, 413 bp, Homo sapiens
  chr7.fa.O7frz.50119281
  Located on chromosome 7
  Distance between a terminus base of telomere on chromosomal short arm and 5'-terminus of this base sequence : 49767341
  Distance between 3'-terminus of neighbour sequence of sequence listing upward to telomere on chrosomal short arm and 5'-terminus of this base sequence : 70608
aagaccaataactcaccatctcctgtgagcttcccatagcatgttgattatacttcatctgtaacatttatctcattgtgtcctaattggatatatacacatgatttatctagataactctgatttcctgcagaaggacctgtgcttcgttgctctttgatgcccctacctttatacccaatatgcaaccagcacctatgatgctatagaccatttgtgcaatcttgcaagaatttataaaatacacatgaatgaaataccctcatcctcacttcctccaccctatcattattacctactgctcttggcttcaagaattttaaaacacacacacacacacacacacacacacacactatggggagcaaaattgtccataaaatgtgtttgtatattgaaattcaaagtgcatc

SEQ ID NO: 12054 - DNA, 113 bp, Homo sapiens
  DISD22_0004931
  Located on chromosome 7
  Distance between a terminus base of telomere on chromosomal short arm and 5'-terminus of this base sequence : 49929667
  Distance between 3'-terminus of neighbour sequence of sequence listing upward to telomere on chrosomal short arm and 5'-terminus of this base sequence : 161913
aattatatccgtgtatggtctagcttttgttgtttttgtttactgcttgtgtgtgtgtgtgtgtgtgtgtgtgtgtgtgtgtgtgtgtgtgttttgcatggcctcatctttct

SEQ ID NO: 12055 - DNA, 285 bp, Homo sapiens
  chr7.fa.O7frz.50373153
  Located on chromosome 7
  Distance between a terminus base of telomere on chromosomal short arm and 5'-terminus of this base sequence : 50154007
  Distance between 3'-terminus of neighbour sequence of sequence listing upward to telomere on chrosomal short arm and 5'-terminus of this base sequence : 224227
aacaatccatgatagaggaaagaaatcgcacttttctagttttcttttatttgcatttaatagtgtggcaaagctttagagaccttttccaagattgctttagcaaatttgtgcctttgatcaaacacacaccataccacacacacagacacacacgcacgtgcacacacacacacacacacacacacacgtctattttgaaatccagttgctttaatggtcatcataatgatgctgtctatactcagcttctcaatacttcttttatgaccaagaactagacaa

SEQ ID NO: 12056 - DNA, 307 bp, Homo sapiens
  AC006024.1_8530
  Located on chromosome 7
  Distance between a terminus base of telomere on chromosomal short arm and 5'-terminus of this base sequence : 50401637
  Distance between 3'-terminus of neighbour sequence of sequence listing upward to telomere on chrosomal short arm and 5'-terminus of this base sequence : 247345
tatctggtattctttcataccaatgccagtcatagtaaattttttccttggtagatgattgcttttatataaacattattgtgatttctcctgagatacagagaagttacatctatctatctatctatctatctatctatctatctatctatctatctatatatatatatatttcgtttgtgtcttttattttaagaattgttaagcagagccagagaagcatttatctatctataattattatctgctactgggataattctattctgtttaccctgccttcctgtaacatctttgtacctttgtt

SEQ ID NO: 12057 - DNA, 186 bp, Homo sapiens
  D7S1818
  Located on chromosome 7
  Distance between a terminus base of telomere on chromosomal short arm and 5'-terminus of this base sequence : 50770390
  Distance between 3'-terminus of neighbour sequence of sequence listing upward to telomere on chrosomal short arm and 5'-terminus of this base sequence : 368446
ccctaactcccatgttgatgttgttcaagggtgaactttacatatacaaatagaggatctatctatctttttatatctatctgtccatctcatataatataccagatagatagatagatagatagatagatagatagatagatagatagatagaatctctctttagaggttagcacaatcctgggt

SEQ ID NO: 12058 - DNA, 342 bp, Homo sapiens
  AC004831.1_27888
  Located on chromosome 7
  Distance between a terminus base of telomere on chromosomal short arm and 5'-terminus of this base sequence : 50850471
  Distance between 3'-terminus of neighbour sequence of sequence listing upward to telomere on chrosomal short arm and 5'-terminus of this base sequence : 79895
ttccataacatccggtcaccaaaagccacaattagcctttttgcctacgtggcttcaattccacagcatttgtagccactttcccattgtatcatcatgttctgggagacaacttataccagtgtttaccctttgggagacaaactcatttgcaaatacagcctaagtgtttgagttgttgattccatacctatatgcttctcttctattaaatgtgttccatgtgtctctttctctctctatctcatacacacacacacacacacacacacacagacacacacagacacacagacacacacaatgggcctgctgtgactaaacagtttacctagaggctca

SEQ ID NO: 12059 - DNA, 344 bp, Homo sapiens
  AC004831.1_42697
  Located on chromosome 7
  Distance between a terminus base of telomere on chromosomal short arm and 5'-terminus of this base sequence : 50865434
  Distance between 3'-terminus of neighbour sequence of sequence listing upward to telomere on chrosomal short arm and 5'-terminus of this base sequence : 14621
gtcctcaaattcaggaacttaatataagttactgaaacctagcaatttaccattgcttttcaaaacttaatgagtgacttcaaatagttctggggtgtgtgtgtgtgtgtgtgtgtgtgtgtgtgtgtgtgtgtgtggtgtgtgttggaacagctttattaagatttaattcagatattacaaaacttacccactaaaggtatacaatttttgtttttaatatatacacagagtatctgattatcagtgcattctatttttagatcatattcatcaccccttcccccaaaaccagaatcctttagcagtctctcttcgtcctatctccagcctagcaagtacta

SEQ ID NO: 12060 - DNA, 393 bp, Homo sapiens
  AC004831.1_93528
  Located on chromosome 7
  Distance between a terminus base of telomere on chromosomal short arm and 5'-terminus of this base sequence : 50916115
  Distance between 3'-terminus of neighbour sequence of sequence listing upward to telomere on chrosomal short arm and 5'-terminus of this base sequence : 50337
tcaaacttgtttatgctcaaaggtccccaaaacaccccctgcaatttgaaatggtctctggtgaaattgggccagtgacagagaagcacacatgtgagcatgacattaagaaaatgtgctgtagtcccagctactcagaaggctgaggcaggagaatggcttgaaccccggaggcagagcttgcagtgagccaagatggcatcactgcactccagcctcggggacagagcgaggctctgtctcaaaataaataaataaataaataaataaacaaacaaacaaataaatgaatgaatgaatgaaaatgtgaagaagacaggcgttggcttgggagagactcagttttagatggagcagaccaaaaagaattgaacagactgtaaggctagatcc

SEQ ID NO: 12061 - DNA, 147 bp, Homo sapiens
  D7S674
  Located on chromosome 7
  Distance between a terminus base of telomere on chromosomal short arm and 5'-terminus of this base sequence : 50920806
  Distance between 3'-terminus of neighbour sequence of sequence listing upward to telomere on chrosomal short arm and 5'-terminus of this base sequence : 4298
caaactgaaactaggaggacacacacacacagacacacagacacacagacacacacacacacacacacacacacacacacacgacaaaagactctaacttttaggatgcctctagtctcctaaaaatagttcagcctccttgatgtt

SEQ ID NO: 12062 - DNA, 236 bp, Homo sapiens
  DISO7_10002278
  Located on chromosome 7
  Distance between a terminus base of telomere on chromosomal short arm and 5'-terminus of this base sequence : 51185694
  Distance between 3'-terminus of neighbour sequence of sequence listing upward to telomere on chrosomal short arm and 5'-terminus of this base sequence : 264741
tatgttcagggccttgtgcatatgtgtgtgtgggtgtgtgtgtgtgtgtgtgtgtgtgtgtgtatcccctttacatacattatctcatctaatcattctctttgtaagaaaagtattattatttatgtttacagaaaaagaaactgaggctcagaaaatgtcaggtgatttgcaaacaacatagaatcaagaatatatgtgcctaacttccaaaccctactctatttcaccaagcc

SEQ ID NO: 12063 - DNA, 101 bp, Homo sapiens
  DISO7_10002279
  Located on chromosome 7
  Distance between a terminus base of telomere on chromosomal short arm and 5'-terminus of this base sequence : 51240126
  Distance between 3'-terminus of neighbour sequence of sequence listing upward to telomere on chrosomal short arm and 5'-terminus of this base sequence : 54196
atcatgccctgctatcaagaaaaaattacaaggcacactgaaaggcaaacaaaacaaaacaaaacaaaacaaaaacagtttgaagagacagaacagacatc

SEQ ID NO: 12064 - DNA, 119 bp, Homo sapiens
  DISO7_10002284
  Located on chromosome 7
  Distance between a terminus base of telomere on chromosomal short arm and 5'-terminus of this base sequence : 51463178
  Distance between 3'-terminus of neighbour sequence of sequence listing upward to telomere on chrosomal short arm and 5'-terminus of this base sequence : 222951
cttcttctgcctttctgtgtagttatatatgtgttgtgtgtgtgtgtgtgtgtgtgtgtgtgtgtgtgtgtgtgtgtgcaatgtctataaaaaagagctctaattaactgatttgaagg

SEQ ID NO: 12065 - DNA, 232 bp, Homo sapiens
  chr7.fa.O7frz.51602527
  Located on chromosome 7
  Distance between a terminus base of telomere on chromosomal short arm and 5'-terminus of this base sequence : 51600961
  Distance between 3'-terminus of neighbour sequence of sequence listing upward to telomere on chrosomal short arm and 5'-terminus of this base sequence : 137664
tggaaattgtgaaatggaggatagatacacaagagaaaaaatttgaaaagtcaaaagttatttcctacctaagtgtccatagacagatgaatggataaagaaaatatggtgtgtgtgtgtgtgtgtgtgtgtgtgtgtgtgtataaatatatattagaatattattcagccataaaaagaaaaagaacttccatttaccacaacatggatgaacctgaaggacattgtaagt

SEQ ID NO: 12066 - DNA, 252 bp, Homo sapiens
  AF073377.1_127
  Located on chromosome 7
  Distance between a terminus base of telomere on chromosomal short arm and 5'-terminus of this base sequence : 52013825
  Distance between 3'-terminus of neighbour sequence of sequence listing upward to telomere on chrosomal short arm and 5'-terminus of this base sequence : 412632
gtacaaatgcctttggattactctggctgtcacggaggagaaaaagcctggggaagggaaaatagttgattgctaaaatattttaaaatctggaactaatcacacacacacactctcttacacacacacacacacacacacacacacacacacaggcttggagccacaatgcttcagtgcagtgctttggcatttaagtggcctctaggggcaacagcacaccaggcaagcaccaagacggtaattctgaat

SEQ ID NO: 12067 - DNA, 465 bp, Homo sapiens
  AC005153.1_7325
  Located on chromosome 7
  Distance between a terminus base of telomere on chromosomal short arm and 5'-terminus of this base sequence : 52146346
  Distance between 3'-terminus of neighbour sequence of sequence listing upward to telomere on chrosomal short arm and 5'-terminus of this base sequence : 132269
tgttcctaagttcagaatcataaccttaaatgacttggaaaaccattttaggtaaatgtcctatcagctggaacagtcaaataaaatttaaagagagacatttcaaatgatcttcgtaacttcccacctcaagggttaagagtggcaggtactatcaacaaatttcttaaagaaaatgtagtctaataaaatgttctttagccaaagtatggggggggggtgtagtacttaaaaatgaaaaactacagaatcactctttcactaaaaataataataataataacaacagtgacagactttgggaatggaattcatttccaggaactgagcccaaatcaactctcggagatgatgtcatctttcagctcctccacgcactgccaaaagattaaggaatctagggcacccaacagaaaatccaaagctgtatgtgatcagcagatgaagtctcatctgaggactgtt

SEQ ID NO: 12068 - DNA, 274 bp, Homo sapiens
  AC004830.1_1289
  Located on chromosome 7
  Distance between a terminus base of telomere on chromosomal short arm and 5'-terminus of this base sequence : 52296127
  Distance between 3'-terminus of neighbour sequence of sequence listing upward to telomere on chrosomal short arm and 5'-terminus of this base sequence : 149316
tacctaatgctaaatgacgagttaatgggtgcagcacaccagcatggcacatgtatacatatgtaactaacctgcacattgtgtacatgtaccctaaaacttaaagtattataataataataataataataataaagaaatcagaggggacacaaacaaatggaaaaacattccatgctcatggataggaagaatcagtatcttgaaaatggccatgacgcccaaggcaattcatagattcaatgctattctcattaaactaccattgacactc

SEQ ID NO: 12069 - DNA, 203 bp, Homo sapiens
  AC004414.1_23363
  Located on chromosome 7
  Distance between a terminus base of telomere on chromosomal short arm and 5'-terminus of this base sequence : 52401717
  Distance between 3'-terminus of neighbour sequence of sequence listing upward to telomere on chrosomal short arm and 5'-terminus of this base sequence : 105316
ttcttatttctgcaataacatgaacatattccttataataaacctctttatgttgatatccgtatatatacacacacacacacacacacacacacacacacacacacacatatacacatacatgtcctattggctctgtttttctggggaaccctaactaatattaatacttttctccttagtaatggaagatctaggtgacc

SEQ ID NO: 12070 - DNA, 199 bp, Homo sapiens
  AC004414.1_38234
  Located on chromosome 7
  Distance between a terminus base of telomere on chromosomal short arm and 5'-terminus of this base sequence : 52416580
  Distance between 3'-terminus of neighbour sequence of sequence listing upward to telomere on chrosomal short arm and 5'-terminus of this base sequence : 14660
ttatggtttatgagccttgaagcatcactaacacctaatcaatataattcctaatacatgagcaagaatgcgtgcacgtgtgtgtgtgtgtgtgtgtgtgtgtgtgtgtgtgttggggtgggagatgctaaatggaatccttgctttcagggaaagtatagtctaataggagataaaatgctcatctatgaaagattgg

SEQ ID NO: 12071 - DNA, 354 bp, Homo sapiens
  AC004414.1_64572
  Located on chromosome 7
  Distance between a terminus base of telomere on chromosomal short arm and 5'-terminus of this base sequence : 52442767
  Distance between 3'-terminus of neighbour sequence of sequence listing upward to telomere on chrosomal short arm and 5'-terminus of this base sequence : 25988
atccattactgaatcatgtcagaattgaaacacgtctcagaagccatctggcccaagcagccctttaatctaggaattccattgcaggggccaggtgggcagtaatgtgcagaccagcacaagaccaaaatggagaagccggggaaatccagaaagtgcatgctctgcccaagggacttcagattccgtaactgtccaacattaggctggaatgcaagcatgtacgagtgaatgaatgaatgaatgaatgaatgaatgaatgaatgaataagactggcggcttccgtgccagctgagggccatgagtttgtgatgtgtgctctgtggggccccaaatggatgatcttccatcct

SEQ ID NO: 12072 - DNA, 202 bp, Homo sapiens
  AC004414.1_101869
  Located on chromosome 7
  Distance between a terminus base of telomere on chromosomal short arm and 5'-terminus of this base sequence : 52480156
  Distance between 3'-terminus of neighbour sequence of sequence listing upward to telomere on chrosomal short arm and 5'-terminus of this base sequence : 37035
gccttgagacttggatagaatctcatcaccagctttccggggtctccagcttacagatggcaaatggtcaaacttcttggtttctataattacacaaggccatccctataaaaaaaaatctctccccaccatagatacacacacacacacacacacacacacacacactcataaatatatcctattgttctgtatctctgga

SEQ ID NO: 12073 - DNA, 195 bp, Homo sapiens
  D7S2422
  Located on chromosome 7
  Distance between a terminus base of telomere on chromosomal short arm and 5'-terminus of this base sequence : 52488695
  Distance between 3'-terminus of neighbour sequence of sequence listing upward to telomere on chrosomal short arm and 5'-terminus of this base sequence : 8337
gctccacattccttgggtatgaaggatgaaacagttaaaacacacacacacacacacacacacacacacacaaaattccgagaagccagaggaagcaagtgctctgtatgtggattaatttctgggtctggataatctgtaattggttatgatgactcaagacatcttgaatacttgtttgaaaggccctcactt

SEQ ID NO: 12074 - DNA, 230 bp, Homo sapiens
  AC005535.2_21032
  Located on chromosome 7
  Distance between a terminus base of telomere on chromosomal short arm and 5'-terminus of this base sequence : 52605585
  Distance between 3'-terminus of neighbour sequence of sequence listing upward to telomere on chrosomal short arm and 5'-terminus of this base sequence : 116695
aggtcaacatctgcaaatgtacaatgggcattctacatatgtatatacatatatgtatatgtttaagtatatatatatatatatatatacacacacacacacacacacacacatatatctatatctgcctatatatacatataaacatctctttctgtatagaaatatctctatgaaacttaaatagatgttggaataaatgcaaaatctggactaatcatttgcatact

SEQ ID NO: 12075 - DNA, 195 bp, Homo sapiens
  D7S1775
  Located on chromosome 7
  Distance between a terminus base of telomere on chromosomal short arm and 5'-terminus of this base sequence : 52746778
  Distance between 3'-terminus of neighbour sequence of sequence listing upward to telomere on chrosomal short arm and 5'-terminus of this base sequence : 140963
ttactttactgccaagggactgtgggtgtatgggtgggtatgtggtatgtgcgtgtgtatgtgtgtgtgtgtgtgtgtgtgtgtgtgtgtgttgctcccatcacagcaagtagttggagtaggaggagtggtttgagtggatattggtcaaggtcactgataaaaagagcaaagtgatacaaaggttcagcatgg

SEQ ID NO: 12076 - DNA, 306 bp, Homo sapiens
  chr7.fa.O7frz.53088826
  Located on chromosome 7
  Distance between a terminus base of telomere on chromosomal short arm and 5'-terminus of this base sequence : 52931739
  Distance between 3'-terminus of neighbour sequence of sequence listing upward to telomere on chrosomal short arm and 5'-terminus of this base sequence : 184766
gtagttattgtaactggaattgctttcttgatgtctttttcaaacagcttgctattggcatatagaaacactactgatttttgtatgtttattttgtatcctgcaactttacagtttattagtactaacagtttgtgtgtgtgtgtgtgtgtgtgtgtgtgtgtagaccttagggttttctatgtatataatcatgtcatctgcagagagagacaatttgactttctctttttcaatctggaggccttttatttctttctcttaccagatccatctggctagaacttccagtactatgttgagtgg

SEQ ID NO: 12077 - DNA, 382 bp, Homo sapiens
  D7S1833
  Located on chromosome 7
  Distance between a terminus base of telomere on chromosomal short arm and 5'-terminus of this base sequence : 53105326
  Distance between 3'-terminus of neighbour sequence of sequence listing upward to telomere on chrosomal short arm and 5'-terminus of this base sequence : 173281
tagatgatgggttgatgggtgcagcaaaccaccatggcacatgtatgcctatgtaacaaacctgaacgttctgcacatgtatcccagaatttgaagcataataaaaataaaaagtgacatctaaatgaaacaaaacaaagatatgtataatttttttctagatacatactgccaataaatcacaataatttatgaaacaattttaaacagtacttactttccatctcattatatataacttattatctatctatctatctatctatctatctatctatctatctatctatctatctatcatctatctatctatctagtaagcaatctccatggggtctatatgtggaataaaagagggaggacagcccatcatgtactttac

SEQ ID NO: 12078 - DNA, 187 bp, Homo sapiens
  D7S1831
  Located on chromosome 7
  Distance between a terminus base of telomere on chromosomal short arm and 5'-terminus of this base sequence : 53105486
  Distance between 3'-terminus of neighbour sequence of sequence listing upward to telomere on chrosomal short arm and 5'-terminus of this base sequence : -222
gatacatactgccaataaatcacaataatttatgaaacaattttaaacagtacttactttccatctcattatatataacttattatctatctatctatctatctatctatctatctatctatctatctatctatctatcatctatctatctatctagtaagcaatctccatggggtctatatgtgga

SEQ ID NO: 12079 - DNA, 217 bp, Homo sapiens
  D7S1830
  Located on chromosome 7
  Distance between a terminus base of telomere on chromosomal short arm and 5'-terminus of this base sequence : 53105486
  Distance between 3'-terminus of neighbour sequence of sequence listing upward to telomere on chrosomal short arm and 5'-terminus of this base sequence : -187
gatacatactgccaataaatcacaataatttatgaaacaattttaaacagtacttactttccatctcattatatataacttattatctatctatctatctatctatctatctatctatctatctatctatctatctatcatctatctatctatctagtaagcaatctccatggggtctatatgtggaataaaagagggaggacagcccatcatgtac

SEQ ID NO: 12080 - DNA, 277 bp, Homo sapiens
  AC006478.2_43208
  Located on chromosome 7
  Distance between a terminus base of telomere on chromosomal short arm and 5'-terminus of this base sequence : 53172862
  Distance between 3'-terminus of neighbour sequence of sequence listing upward to telomere on chrosomal short arm and 5'-terminus of this base sequence : 67159
cattcataattgaaggcagttattttgtcttggggtacatacacatatacatacctgactctgtctctttctatatatatatatatatatatatatatatatatatatatatatatatatatatatatatgtatatacagttattcatcacttagtgaagtgatgaatatatatacagttattcatcacttagtgaagaggatacttctgaaaatgtgtccttaggtgatttcatcattgtgtgaacatcatagagtgcatttacacgaacttaggt

SEQ ID NO: 12081 - DNA, 310 bp, Homo sapiens
  AC006478.2_70207
  Located on chromosome 7
  Distance between a terminus base of telomere on chromosomal short arm and 5'-terminus of this base sequence : 53199696
  Distance between 3'-terminus of neighbour sequence of sequence listing upward to telomere on chrosomal short arm and 5'-terminus of this base sequence : 26557
ttacaatgttaccttgcaggtcttatcctagattattttggaaatgaaccatgctagaaggcttgaagatatggaagaacaaaaggataaacaccaaagggagattccagagaagggtgaaggtgatgaggtagaaaactcatgtgtggggataagtctagacaagatgagagctgcgacctttgctgagatgacaagaagtgtttgcgggtgggtataataataataataataaagtgtgtgtgtgtgtgtgtgtgtgtgttggggagaagtgagaataattaatgtctgatgcagaactttgtaaatt

SEQ ID NO: 12082 - DNA, 247 bp, Homo sapiens
  AC006478.2_90969
  Located on chromosome 7
  Distance between a terminus base of telomere on chromosomal short arm and 5'-terminus of this base sequence : 53220548
  Distance between 3'-terminus of neighbour sequence of sequence listing upward to telomere on chrosomal short arm and 5'-terminus of this base sequence : 20542
tttgtactccaggaatgctaagtcttgattttgccatgagtacttggtgatgtgagtgagattttactattagcaagaagactaggcaaggaggaattacttggctgtgccaagatgcaatttcattcaaaggaccacatgtgtatacacacacacacacacacacacacacacacacattctatgcttttatcggtaactacatctatgacattatatattggttagaaagcaagtattcgaacac

SEQ ID NO: 12083 - DNA, 243 bp, Homo sapiens
  D7S2467
  Located on chromosome 7
  Distance between a terminus base of telomere on chromosomal short arm and 5'-terminus of this base sequence : 53220563
  Distance between 3'-terminus of neighbour sequence of sequence listing upward to telomere on chrosomal short arm and 5'-terminus of this base sequence : -232
tgctaagtcttgattttgccatgagtacttggtgatgtgagtgagattttactattagcaagaagactaggcaaggaggaattacttggctgtgccaagatgcaatttcattcaaaggaccacatgtgtatacacacacacacacacacacacacacacacacattctatgcttttatcggtaactacatctatgacattatatattggttagaaagcaagtattcgaacacagatgaccttt

SEQ ID NO: 12084 - DNA, 368 bp, Homo sapiens
  AC006478.2_115883
  Located on chromosome 7
  Distance between a terminus base of telomere on chromosomal short arm and 5'-terminus of this base sequence : 53245425
  Distance between 3'-terminus of neighbour sequence of sequence listing upward to telomere on chrosomal short arm and 5'-terminus of this base sequence : 24619
taaagaaaacatgctgaatcacacatgagcagggtagggtacagagaggactggatatggagtcataaaagtgctgaaggaaggttgccagggaatttgctattctttgggcatgttttatctctgagaaagatgggaagaaagaaagaaaaagaaagaaagaaaaaaagaaagaaagaaagtaagaaagaaagaaagaaagaaagaaggaaggaaagaaagaaagaaagagggagggaggaaggaaggaaggaaaagaaggaaggaaggaaaaagaatagatcattgttattcaaatacccaaggccattgaagaatgaatgtctgacttaagatgtactactgtttaccaatgcatacttagattt

SEQ ID NO: 12085 - DNA, 197 bp, Homo sapiens
  chr7.fa.O7frz.53526850
  Located on chromosome 7
  Distance between a terminus base of telomere on chromosomal short arm and 5'-terminus of this base sequence : 53366049
  Distance between 3'-terminus of neighbour sequence of sequence listing upward to telomere on chrosomal short arm and 5'-terminus of this base sequence : 120256
ttcagtcaatttggtgataaatttaaaaactaataggggtaaggaactgccaagaaaaacttttaggggtgtgtgtgtgtgtgtgtgtgtgtgtgtgtgtgcacgcgcgaaggtcgggaatttggttttgaatattcagtttgaggaacctgtgacagtatctgagattttttaactacttggatttgcagtacaaa

SEQ ID NO: 12086 - DNA, 426 bp, Homo sapiens
  chr7.fa.O7frz.53874616
  Located on chromosome 7
  Distance between a terminus base of telomere on chromosomal short arm and 5'-terminus of this base sequence : 53677509
  Distance between 3'-terminus of neighbour sequence of sequence listing upward to telomere on chrosomal short arm and 5'-terminus of this base sequence : 311263
ctttgcaatttctcagcattttctcactcagattttccatccttttctctttttctctctttctttttctttctccctccttccttccttccttccttccttccttccttccttccttccttccttccttccttatttctctctctctctctttcttgcctagtgatatctaaaatcatctctggtagccagagattatatgtgattatatatgtcagcccagggtgagaccagggctgaaaaactccctgagggacttggcctgttataaagggatttaaatataaggaccaattaaactttagggattcccagctgtgttgaaaggaggaaatggattggaaaaaaggtagagacagaggaaaagtgatacagataagactgaggaggatggatagtaggctaaagaccactaatttcaacttg

SEQ ID NO: 12087 - DNA, 323 bp, Homo sapiens
  AC006459.2_153626
  Located on chromosome 7
  Distance between a terminus base of telomere on chromosomal short arm and 5'-terminus of this base sequence : 53846615
  Distance between 3'-terminus of neighbour sequence of sequence listing upward to telomere on chrosomal short arm and 5'-terminus of this base sequence : 168680
catccttagaaatgcaatagctagctttccatttctgaaatatgaataacacacttcttccaaaaggagaaaagctatctgtttgattagtcatacttgctacattaaattttcaatagttactcttaaaaaaaaatctctgcaatgaaaatgaaaatcttgtgagatataggagaaatattcccaaatgtattattttcctagcctggttaaaatagttgataaatggttattttaaaaaatttcacgtgtgtgtgtgtgtgtatatatatatatatatatatatatatacacacaccatgaatttcatggcagttgatatg

SEQ ID NO: 12088 - DNA, 277 bp, Homo sapiens
  AC006459.2_176037
  Located on chromosome 7
  Distance between a terminus base of telomere on chromosomal short arm and 5'-terminus of this base sequence : 53869138
  Distance between 3'-terminus of neighbour sequence of sequence listing upward to telomere on chrosomal short arm and 5'-terminus of this base sequence : 22200
tacgtgaacctaatttccatctatcaataatggtaaatccaaagaaaataataccttgggcaaacttcccccagacagatttccaaatattacatttacgtgaagattttttgcactcaagaaaatcactattttttatgaatgtgtgctctgtgtgtgtgtgtgtgtgtgtgtgtgtaaatgaaaggggaggatttttacccaatctcagtaaaatgattccaaaaatgaggaatgggtttggtgagggtacaaaggattcactaacatcaatggt

SEQ ID NO: 12089 - DNA, 302 bp, Homo sapiens
  AC006459.2_177300
  Located on chromosome 7
  Distance between a terminus base of telomere on chromosomal short arm and 5'-terminus of this base sequence : 53870418
  Distance between 3'-terminus of neighbour sequence of sequence listing upward to telomere on chrosomal short arm and 5'-terminus of this base sequence : 1003
caacgttctgttacttcaaatattatgaggatttccttcatttgcttgtttaatcttttctcctcttcctccttttcttcctcctcttcttccttctccttcttccttactgatagatgatgatgataaattatatagatagatagatagatagatagatagatagatagatagatctgtaaatataatcacttctttcaatgctagagacattacctgcctcaacaaaatcatctaaactttcatctactttcttcatgttacctaagtatcgggccctattacaaactaaagttgccagt

SEQ ID NO: 12090 - DNA, 148 bp, Homo sapiens
  D7S2451
  Located on chromosome 7
  Distance between a terminus base of telomere on chromosomal short arm and 5'-terminus of this base sequence : 54026167
  Distance between 3'-terminus of neighbour sequence of sequence listing upward to telomere on chrosomal short arm and 5'-terminus of this base sequence : 155447
tctataagaccacatggtgaggaatggaggcctcctgccaacaaccgtgtgtgtgtgtgtgtgtgtgtgtgtgtgtgtgtgtgtgtgtgtaccaccgtggatgaggatcccctagcccaagcaagcattcggataactgcaatttcag

SEQ ID NO: 12091 - DNA, 154 bp, Homo sapiens
  Z66731
  Located on chromosome 7
  Distance between a terminus base of telomere on chromosomal short arm and 5'-terminus of this base sequence : 54119190
  Distance between 3'-terminus of neighbour sequence of sequence listing upward to telomere on chrosomal short arm and 5'-terminus of this base sequence : 92875
ggagtcactagttgtgggtttcattttttcatatccatctaagatgagcatactgttgtgtgtagattttcttcaatcaatcacacacgtgtgcgcgtgcacacacacacacacacacacacacacacttactacagatcccagaagcattttg

SEQ ID NO: 12092 - DNA, 210 bp, Homo sapiens
  Z66846
  Located on chromosome 7
  Distance between a terminus base of telomere on chromosomal short arm and 5'-terminus of this base sequence : 54145687
  Distance between 3'-terminus of neighbour sequence of sequence listing upward to telomere on chrosomal short arm and 5'-terminus of this base sequence : 26343
ttttacttaactcttatagagccactttttcagttttagacgtattttattgtcttcctaataccaaagttaaagttctaagtcttatatacatgtatgtacctgcaacatgaatgcacacacacacacacacacacacacacacacacacttcattccctctacctccagggagttatagcctatgttgttgttggtaagtcattggct

SEQ ID NO: 12093 - DNA, 139 bp, Homo sapiens
  D7S506
  Located on chromosome 7
  Distance between a terminus base of telomere on chromosomal short arm and 5'-terminus of this base sequence : 54175772
  Distance between 3'-terminus of neighbour sequence of sequence listing upward to telomere on chrosomal short arm and 5'-terminus of this base sequence : 29875
tccttcaaatgcacagatatcaatacaagactacactgataacaggcaaacatgacaccacacacatacacacacacacacacacacacacacacacacacacacacacacaaactaataaagttccagtaactgacgc

SEQ ID NO: 12094 - DNA, 318 bp, Homo sapiens
  chr7.fa.O7frz.54702548
  Located on chromosome 7
  Distance between a terminus base of telomere on chromosomal short arm and 5'-terminus of this base sequence : 54525397
  Distance between 3'-terminus of neighbour sequence of sequence listing upward to telomere on chrosomal short arm and 5'-terminus of this base sequence : 349486
ctttaacaaattcactggacattaggcatttctctgttgtatctatgaaaacaataaaaataaaagtaataatttaaaaacaagaagacagaaactgataggagaaaatgagacataatatatatatatatatatatacaacaaattaaaaaacaaattaagtacaaatgatcaaagattaacttaaacataagtagacaatgtttttgttaaaatagaaagataggcaaaattaaaaaaatccctctctatcgtagttacaagagaggcaactaatatataaatttacagaaactttgaagttcaaacaatacagat

SEQ ID NO: 12095 - DNA, 201 bp, Homo sapiens
  AC007735.2_107254
  Located on chromosome 7
  Distance between a terminus base of telomere on chromosomal short arm and 5'-terminus of this base sequence : 54712172
  Distance between 3'-terminus of neighbour sequence of sequence listing upward to telomere on chrosomal short arm and 5'-terminus of this base sequence : 186457
aggatagaaatcctgataggtgagaaacaatgaggtaagtctgatttttaaaagagcttccagggcaaaatataagtatagtgtatcagttatcacttagggttctacagagagacagagccaataggatgaagagtgtgtgtgtgtgtgtgtgtgtgtgtttgtatatgtgtgtgtgttttaaggcagtagctcaaacag

SEQ ID NO: 12096 - DNA, 408 bp, Homo sapiens
  AC007735.2_96398
  Located on chromosome 7
  Distance between a terminus base of telomere on chromosomal short arm and 5'-terminus of this base sequence : 54722998
  Distance between 3'-terminus of neighbour sequence of sequence listing upward to telomere on chrosomal short arm and 5'-terminus of this base sequence : 10625
atttgcaaactatttatctgacaagggactaatatccagtgtgcaaggaacccaaaacactcaacagaaatatatatatatatacacgtatatatacgtgtatatacgtgtatatatacgtatatacatgtgatacacgtatatatatgtgtgtgtgtgtatatatatatatatatatatatatatatatacacacacacacacatatatatgtatggcattaaaaagtaagcaaaggacctgctggtcactgtggtaattgccactttctggattccagcagttaagagctgcacctagcctctaatgctttggggcgtgtttatatatatttgagcccaaaactgtaactcccttttttactatcagctgtggcatgcagaggacagttatgaccgaatttgttag

SEQ ID NO: 12097 - DNA, 360 bp, Homo sapiens
  AC007735.2_88547
  Located on chromosome 7
  Distance between a terminus base of telomere on chromosomal short arm and 5'-terminus of this base sequence : 54730897
  Distance between 3'-terminus of neighbour sequence of sequence listing upward to telomere on chrosomal short arm and 5'-terminus of this base sequence : 7491
tatctttggaaagacagaaggtagattgcatagattctatagatctataccagtcactctgatgtaatcatgcccaatatctagctttggttattaaaatatattcacacacacacacacacacacacacacacacacacacaagcactttccatcactagggacaaacatctattctctaacacagagtacatttaacttatatttttataatcttgtaatcagtactagacagacacacatttggtagacatcgaatttcaccaaaggattgaatactatttctcttaagttaatgaaaaaaatggaagcatgtatgctacatacactgttagactggttcattcttagtaaattcca

SEQ ID NO: 12098 - DNA, 369 bp, Homo sapiens
  AC007735.2_70070
  Located on chromosome 7
  Distance between a terminus base of telomere on chromosomal short arm and 5'-terminus of this base sequence : 54749230
  Distance between 3'-terminus of neighbour sequence of sequence listing upward to telomere on chrosomal short arm and 5'-terminus of this base sequence : 17973
catggatttgactattctggacattttatataaatggaatcatacaacatatggccttatttgtctgttttcttttttaacttaacaatgttttcaaggttcatccatggtgtagaaagcactgggactttatttcttatggctccatattattccttaatgtttctgaggtataccacattttgtttatctgtttataaattgataagacattttggttaggctttctgctgtttggctattattaataatgctacaacacacacacacacacacacacacacacatatatatatgtttttgcacaaacatatttttaattcttttcagtgtataactagggggtggaattttaaatcctatggatag

SEQ ID NO: 12099 - DNA, 352 bp, Homo sapiens
  AC007735.2_60615
  Located on chromosome 7
  Distance between a terminus base of telomere on chromosomal short arm and 5'-terminus of this base sequence : 54758856
  Distance between 3'-terminus of neighbour sequence of sequence listing upward to telomere on chrosomal short arm and 5'-terminus of this base sequence : 9257
tacgttctgtaaaaggtgatctatatttcagtgacttggatgcttggatgcttggaggtgggtggagacaactgtgctccccagcttttatttatttatttatttatttatttattcatttatttttatttttgagacagaatttctctctgtcgcccaggctagagtgcagtggcatgatctttgatcactgcaacctccacctcctgagttcaagtgattctcatgcctcaagcctcccgagtagctgggactacaggcccacaccaccacacctggctaatttttaaaattttttggtagagacggggtttcgccatgttggtcaggctaatctcaaactcctgacctc

SEQ ID NO: 12100 - DNA, 350 bp, Homo sapiens
  AC007735.2_10857
  Located on chromosome 7
  Distance between a terminus base of telomere on chromosomal short arm and 5'-terminus of this base sequence : 54808651
  Distance between 3'-terminus of neighbour sequence of sequence listing upward to telomere on chrosomal short arm and 5'-terminus of this base sequence : 49443
gtactccttttgaaaggactcataatgagtttaagtcaacctgtaacacaaacacacacacacacacacacacacacactcatgtacacatacaatgacttttagactccagtcccagtgcaaattcttcctgtagaggaaaagcaaatgtttgaggccatctccactgtgaaatggtagagtgaaagtcattaaataattggggcatctacttatccttgttttgaaactatttgcaaaacattcaaattttgggctgtgtatggttttataaccaaatctccctaaagaaaagaattcaaacatagcactggcttcacatattcaggttcctaaggcaatttctgatt

SEQ ID NO: 12101 - DNA, 223 bp, Homo sapiens
  AC007735.2_6632
  Located on chromosome 7
  Distance between a terminus base of telomere on chromosomal short arm and 5'-terminus of this base sequence : 54812862
  Distance between 3'-terminus of neighbour sequence of sequence listing upward to telomere on chrosomal short arm and 5'-terminus of this base sequence : 3861
aaagcctctataactagtgaggagtatttctagggccttgccttctgtctagatagatagatagatagatagatagatagatagatagatagacagatagatagaatataaatatatatgtataatatataatatatacataatatataaatataaatatatatatattatctctctctctttctaagaaagataggggagtaataacgcagaattagttgat

SEQ ID NO: 12102 - DNA, 251 bp, Homo sapiens
  HUMUT1224
  Located on chromosome 7
  Distance between a terminus base of telomere on chromosomal short arm and 5'-terminus of this base sequence : 54812888
  Distance between 3'-terminus of neighbour sequence of sequence listing upward to telomere on chrosomal short arm and 5'-terminus of this base sequence : -197
tttctagggccttgccttctgtctagatagatagatagatagatagatagatagatagatagatagacagatagatagaatataaatatatatgtataatatataatatatacataatatataaatataaatatatatatattatctctctctctttctaagaaagataggggagtaataacgcagaattagttgatgattcagagataggtaatttgggccgggagtggtggctcacaccagtaagccca

SEQ ID NO: 12103 - DNA, 101 bp, Homo sapiens
  D7S2475
  Located on chromosome 7
  Distance between a terminus base of telomere on chromosomal short arm and 5'-terminus of this base sequence : 54901772
  Distance between 3'-terminus of neighbour sequence of sequence listing upward to telomere on chrosomal short arm and 5'-terminus of this base sequence : 88633
tgcatgtgtgtatgtatgtgtttgtgtgtgtgtgtgtgtgtgtgtgtgtgtgacagagagagaaagaagggaaggatggctccaataagtagccaaaacag

SEQ ID NO: 12104 - DNA, 458 bp, Homo sapiens
  chr7.fa.O7frz.55354300
  Located on chromosome 7
  Distance between a terminus base of telomere on chromosomal short arm and 5'-terminus of this base sequence : 55258904
  Distance between 3'-terminus of neighbour sequence of sequence listing upward to telomere on chrosomal short arm and 5'-terminus of this base sequence : 357031
caaactgcatttaagatgctatgtgcttttgttctcagaggaaacacatttactagagagagagtggcacaggataggacagcacactcatctcctcctatctcagccattgttgtaggataggacgtttttccatctaaccatgacctgcatgactatggtggtggaggatacatgactaacagtgactcctgattctccattgtgtggccggtcctccaggatctggagttgcgtttctggaaaaagacagagagagagagagagagagagagagctgttcctgcagccattatttggaaaaccaggattcaaaaagtcagttgctctagttcctgcctggggctagaattaagtccctcttttttaagtctttctccacataggtccctgactacatatgacaaaagtaggaacttagtcatcccaggtccattctacaccagtagctacttcga

SEQ ID NO: 12105 - DNA, 457 bp, Homo sapiens
  chr7.fa.O7frz.55531513
  Located on chromosome 7
  Distance between a terminus base of telomere on chromosomal short arm and 5'-terminus of this base sequence : 55302699
  Distance between 3'-terminus of neighbour sequence of sequence listing upward to telomere on chrosomal short arm and 5'-terminus of this base sequence : 43337
cctgataacatatgacatggagcatctttttatgtgtgtatttgtcatctgtgtaacttctttggtgaggagtctgttgaggactttcacccaatttttaatagagttgtttttcttgttattgagttttaagtgctctttgcatattttggataatagtcctttatcagatatgtaatgatatgtaatttacaaatattttctccaggctgtggcttctctttttattttcttaaaaatgttttttacagagcatatatatatatatatatatacacacacacacacacatatatatttaaaataaagttcagtttattaattatttgtttcatagattgtacctttggtgttatatctaaaaagtgccaaatcctaggtaatctactcctatgttatattttaggagttttataactttgtgttctacatttaggtctatgattcaatttgagtt

SEQ ID NO: 12106 - DNA, 386 bp, Homo sapiens
  chr7.fa.O7frz.55653954
  Located on chromosome 7
  Distance between a terminus base of telomere on chromosomal short arm and 5'-terminus of this base sequence : 55390266
  Distance between 3'-terminus of neighbour sequence of sequence listing upward to telomere on chrosomal short arm and 5'-terminus of this base sequence : 87110
tagaattgtaacgtttctaggaagttattcaccaagaagatacataaaatccacagagaaggctttacaactacaataataaaaataagtcaaaatgaatagatgaagaattattccattgatcattttgaaatataaattctcagaaaattaatctaaaaatacaatcccaattaagtgttggctggctaccttgaaaaactcaattagatgtggtgtgtgtgtgtgtgtgtgtgtgtgtgtgagagagagagagagagagaaatgggggaattttttttacttctgaaataagtattgaattgaatgaattttaaccatttatacattatacattttcaggaaacttggaaatctagacagttgagttaaacatagaaacaagc

SEQ ID NO: 12107 - DNA, 327 bp, Homo sapiens
  chr7.fa.O7frz.56260643
  Located on chromosome 7
  Distance between a terminus base of telomere on chromosomal short arm and 5'-terminus of this base sequence : 55777676
  Distance between 3'-terminus of neighbour sequence of sequence listing upward to telomere on chrosomal short arm and 5'-terminus of this base sequence : 387024
acagtctccagactattccaaccagatcagaagttttaccttggggtccatgaataggctttgtcttcggaatacctgaaactgtgctcatcttttggttctctctctctctctctctctctctctctctctctctctttctccctctctctctctttcctttttaaggaagacaactcagatgtttctatcagagtctcagtggcgtctaagacctgaggaagtgaaagcactccttagctagagaaagacaaaaacacacctctgagtaactccgcctggtgtatttgacacggtctccttttcttaggacctgtgagaaggtac

SEQ ID NO: 12108 - DNA, 336 bp, Homo sapiens
  AC069313.4_78007
  Located on chromosome 7
  Distance between a terminus base of telomere on chromosomal short arm and 5'-terminus of this base sequence : 55878871
  Distance between 3'-terminus of neighbour sequence of sequence listing upward to telomere on chrosomal short arm and 5'-terminus of this base sequence : 100868
ttcaacttaaagcactatcttcagcatttctattaaggaaggtctagtggtgacaaactcttcagcttttgtttatctgggaaactatgtcattcattcataaaggatggctttgctaggtataatattcttagttggaaggttttgtttgtttgtttgtttgtttgtttgtttgttccagaactttgaatgtatcattctactgacctgcaaagtgtctgctgagaaatatgctaatagtcttatggcagggagagaaaggggttttttcttggatgtgatgactcgttttctcttgctgctttcaaaattttctcattgtctttgacttttgaa

SEQ ID NO: 12109 - DNA, 185 bp, Homo sapiens
  DISD22_0004973
  Located on chromosome 7
  Distance between a terminus base of telomere on chromosomal short arm and 5'-terminus of this base sequence : 56140413
  Distance between 3'-terminus of neighbour sequence of sequence listing upward to telomere on chrosomal short arm and 5'-terminus of this base sequence : 261206
tcctagacaagctgatataaatgtcatatagaatatttacaaaaattctgaaaatagggaagaataaagagagtagctcactaaatatatacatatacatatatatatatatatatatatatatatatatatatatactatatatatcatcagtatatatgtgtggggattggaacagtatgctt

SEQ ID NO: 12110 - DNA, 275 bp, Homo sapiens
  DISD22_0004985
  Located on chromosome 7
  Distance between a terminus base of telomere on chromosomal short arm and 5'-terminus of this base sequence : 56418102
  Distance between 3'-terminus of neighbour sequence of sequence listing upward to telomere on chrosomal short arm and 5'-terminus of this base sequence : 277504
ccaatctacgatgttgttatagtgagtgttaaaaattctggaacagattttttgttgttgttgttgttgttgttgttttcttttattattatactttaagttttagggtacatgtgcacattgtgcaggttagttacatatgtatacatgtgccatgctggtgcgctgcaccaactcgtcatctagcattaggtatatctcccaatgctatccctcccccctccccccaccccacatctggaacatattttaaaacgtgtcagtcaccaactagg

SEQ ID NO: 12111 - DNA, 351 bp, Homo sapiens
  AC006971.2_106556
  Located on chromosome 7
  Distance between a terminus base of telomere on chromosomal short arm and 5'-terminus of this base sequence : 56630643
  Distance between 3'-terminus of neighbour sequence of sequence listing upward to telomere on chrosomal short arm and 5'-terminus of this base sequence : 212266
taaattagcttcaacttaatggaggtatagttacatacaataagccagatctatttagagtgtcctacatagacagatagatagatagatagatagatagatagatagatagatagatagatgatggataggtagagagagaatgtgtgtgtgagagagacagagaaagagagagaaagaaaaagagaagaaacaaagaaagaaaaagagaggaaacaaagacagaaagaaaaataaagaaggaaagaaagaaagaaagagaaaaaaagaaagaaagagaaagagagagaaagaaaaaaaatactgggcaataaataatgagtaacacttaagtattgatatggaatgagc

SEQ ID NO: 12112 - DNA, 150 bp, Homo sapiens
  G08615
  Located on chromosome 7
  Distance between a terminus base of telomere on chromosomal short arm and 5'-terminus of this base sequence : 56630654
  Distance between 3'-terminus of neighbour sequence of sequence listing upward to telomere on chrosomal short arm and 5'-terminus of this base sequence : -340
caacttaatggaggtatagttacatacaataagccagatctatttagagtgtcctacatagacagatagatagatagatagatagatagatagatagatagatagatagatgatggataggtagagagagaatgtgtgtgtgagagagac

SEQ ID NO: 12113 - DNA, 259 bp, Homo sapiens
  D7S2550
  Located on chromosome 7
  Distance between a terminus base of telomere on chromosomal short arm and 5'-terminus of this base sequence : 56691415
  Distance between 3'-terminus of neighbour sequence of sequence listing upward to telomere on chrosomal short arm and 5'-terminus of this base sequence : 60611
gctctcctcgtctcacacctcttgccctgcatgcatttctttgctctgattaaacgagcattttataagccacatttgctgtgtgaaaggcaaagtcttccctcccacggatgacggtctccagggatgtgtgtgtgtgtgtgtgtgtgtgtgtgtgtgtgtgtgagagagagagagagagagagagactgtaaacatatatctctgtgaaacttcattttccatatgtgaatttttggaaccgagacaaatggaactt

SEQ ID NO: 12114 - DNA, 237 bp, Homo sapiens
  AC073347.2_176162
  Located on chromosome 7
  Distance between a terminus base of telomere on chromosomal short arm and 5'-terminus of this base sequence : 56999511
  Distance between 3'-terminus of neighbour sequence of sequence listing upward to telomere on chrosomal short arm and 5'-terminus of this base sequence : 307837
cttagttactcatctaacagccatttcctcctttttacttgattttgttgtggccgtggacttaaggggaattgagcccagctctaggagctgaatcatgattaatgtctttgaccagcagcagcagcagcttcaactgatgttcaagtccaaccaggagatgggtaccatgcagagtttaatagggaaagtttaacttaaagaattgttatgaactgtgagactggagtaacaaga

SEQ ID NO: 12115 - DNA, 161 bp, Homo sapiens
  DISO7_10002290
  Located on chromosome 7
  Distance between a terminus base of telomere on chromosomal short arm and 5'-terminus of this base sequence : 57075085
  Distance between 3'-terminus of neighbour sequence of sequence listing upward to telomere on chrosomal short arm and 5'-terminus of this base sequence : 75337
gctttagcacgtgtgctctttcttttgctctctctctcactttctctacacacacacacagacacacacacacagacacacacacacagacacacacacacacacacagacatacacacacagacacacacacacacagacacacatacctgctgcatcat

SEQ ID NO: 12116 - DNA, 138 bp, Homo sapiens
  DISO7_00001511
  Located on chromosome 7
  Distance between a terminus base of telomere on chromosomal short arm and 5'-terminus of this base sequence : 57183626
  Distance between 3'-terminus of neighbour sequence of sequence listing upward to telomere on chrosomal short arm and 5'-terminus of this base sequence : 108380
gagctccgtcctcaagacctggttcccctgatatctctgtgctcccttcccctgcactctacacacacacacacacacacacacacacacacacacacacacacacacactcaccctcttcctaggcctagcaacgag

SEQ ID NO: 12117 - DNA, 289 bp, Homo sapiens
  DISD22_0004988
  Located on chromosome 7
  Distance between a terminus base of telomere on chromosomal short arm and 5'-terminus of this base sequence : 60272558
  Distance between 3'-terminus of neighbour sequence of sequence listing upward to telomere on chrosomal short arm and 5'-terminus of this base sequence : 3088794
tgaattaagaatatggctttatcctacacacacacacacacacacacacacacgcatattctatatatagatacacaaacacataggatgtgtgtgtgtgtgtgtgtgtgtgtgtgtgtgtatatatataatttaaaaatcctttatattttccaaggtacatagagttggtttttcaaatatatacacatacaaaaacatatttgaaaatgactaaagaaaatacctcagaattcattttcttttgagccccttcgacctccttttgcttactggtcagagtctcatc

SEQ ID NO: 12118 - DNA, 101 bp, Homo sapiens
  DISD22_0004992
  Located on chromosome 7
  Distance between a terminus base of telomere on chromosomal short arm and 5'-terminus of this base sequence : 60344115
  Distance between 3'-terminus of neighbour sequence of sequence listing upward to telomere on chrosomal short arm and 5'-terminus of this base sequence : 71268
ctcacttccaacagggaagatgagttttgttttgttttgttttgtttttttctgcttctgggatggtagagagcagtcttcagcctgagatccatccctag

SEQ ID NO: 12119 - DNA, 213 bp, Homo sapiens
  D7S659
  Located on chromosome 7
  Distance between a terminus base of telomere on chromosomal short arm and 5'-terminus of this base sequence : 60423111
  Distance between 3'-terminus of neighbour sequence of sequence listing upward to telomere on chrosomal short arm and 5'-terminus of this base sequence : 78895
cactgcacctggcctaaaaaattttttaaataagtaatggctgtctggacaggatttgtgaggatcatcatcttaaataacgttttaaaagtgtgtgtgtgtgtgtgtgtgtgtgtgtgtgtgtgtgtgtgtgtgtgtgtatggaggctggggtgggggatgggacagtggagggaaccagccaggcattatttccgatttcaagagatgcag

SEQ ID NO: 12120 - DNA, 353 bp, Homo sapiens
  chr7.fa.O7frz.57352690
  Located on chromosome 7
  Distance between a terminus base of telomere on chromosomal short arm and 5'-terminus of this base sequence : 60556786
  Distance between 3'-terminus of neighbour sequence of sequence listing upward to telomere on chrosomal short arm and 5'-terminus of this base sequence : 133462
tttaggttaattccatgactttactattatgagtaggaatgtaatacacatgagtgaaagtgacttttttatataattatttcttttctttcagatgcctagtagtataatcactgggccaaatggtagctctatttttagtgcttcgagaaatctctatgctgtttttcatagaggttgttatggtcccaccaacagtgaataagcattcattattctctgcattcacaccaacatctgttgtgtttatatcttattttgtgtgtgtgtgtgtgtgtgtgtgtgtgtgtgtgtgtgtgtgtttgagacagagtctcgccctgtcactcaggctggagttcagtggtatgatc

SEQ ID NO: 12121 - DNA, 293 bp, Homo sapiens
  chr7.fa.O7frz.57621084
  Located on chromosome 7
  Distance between a terminus base of telomere on chromosomal short arm and 5'-terminus of this base sequence : 61093019
  Distance between 3'-terminus of neighbour sequence of sequence listing upward to telomere on chrosomal short arm and 5'-terminus of this base sequence : 535880
cataagtgtccttcagctgtactgaaatggaaatggctagcttgtctcaagtagcaggggagcccaggcaggggcagccggggcacgggggtcagggaccgaggctgctgtgggctaacttcaaaagctgacaggggaatcaggagggtgctcaaagacgtcaacctgggatgtgggcaggcccagggactttattattattattattattattattattattattattattattagagacaggatctcactgtctcacccaggctggagtgtaatagtgcaatcataactca

SEQ ID NO: 12122 - DNA, 341 bp, Homo sapiens
  HUMUT5530
  Located on chromosome 7
  Distance between a terminus base of telomere on chromosomal short arm and 5'-terminus of this base sequence : 61373879
  Distance between 3'-terminus of neighbour sequence of sequence listing upward to telomere on chrosomal short arm and 5'-terminus of this base sequence : 280567
agctagacaaccacatgtgtaatgcaaaatatacacgttctagattgtgctatgtatcctggatgtttcaggacagtctcatcgtcaattacattttctttcttttctttctcttccttttcttttcttccttcctttgttccttcctttcctcctcctcctctttcttcttcttttcctcttctcctccccttccttccttccttcccttccttcctcccttcctccccctctttctttctccctctgtctctgtctctgtctctctcttcctctttctctctctttttctctctttcttcccttctttgcaacaagggtcttactgtctctcaggctgg

SEQ ID NO: 12123 - DNA, 283 bp, Homo sapiens
  DISD22_0005006
  Located on chromosome 7
  Distance between a terminus base of telomere on chromosomal short arm and 5'-terminus of this base sequence : 61584903
  Distance between 3'-terminus of neighbour sequence of sequence listing upward to telomere on chrosomal short arm and 5'-terminus of this base sequence : 210683
tgaattaagaatatggctttatcctacacacacacacacaagtgtatattctatatatagatacacaaacacataggatgtgtgtgtgtgtgtgtgtgtgtgtgtatatatatatatatatataatttaaaaatactttatattttccaaggtacatagagttggtttttcaaatatatacacatacaaaaacatatttgaaaatgactaaagaaaatacctcagaattcattttcttttgagccccttcgacctccttttgcttactggtcagaatctcatc

SEQ ID NO: 12124 - DNA, 402 bp, Homo sapiens
  chr7.fa.O7frz.57986604
  Located on chromosome 7
  Distance between a terminus base of telomere on chromosomal short arm and 5'-terminus of this base sequence : 61658857
  Distance between 3'-terminus of neighbour sequence of sequence listing upward to telomere on chrosomal short arm and 5'-terminus of this base sequence : 73671
gctatgatcagcactgaactcaagcctggatgacagagagattctgtctcaaacacacacacacacacacacacacacacacacacacacaaaacaggcatgttttgcaaagactcaaatagaaattgaacaacggaaacttaaataaatttaatatacaatgtatggtttaattattaaaccaagttaataacaacaggattagtgaactagaatactgagatgaataaataaaagaactacagaaaaacaaaatgatcacaatacaaatatgattgtacatgtacaaagaataaaatgagatgaaatcaaacacattggtttcactagcttacatacaaataacaaatcacactaataacaaatatttatacatttctgaaactgaatatcagataggaa

SEQ ID NO: 12125 - DNA, 454 bp, Homo sapiens
  chr7.fa.O7frz.58091141
  Located on chromosome 7
  Distance between a terminus base of telomere on chromosomal short arm and 5'-terminus of this base sequence : 61834974
  Distance between 3'-terminus of neighbour sequence of sequence listing upward to telomere on chrosomal short arm and 5'-terminus of this base sequence : 175715
ctgacaatttagtattacgctttagtatttttgccattacttttaatggcaaaaactgcaattacttttgcaccaacttaataatatctttttcttttcatgctgtcttcacttgtgtttggttgaattttttttgttttcgttgctgttatatgctttgattccttttccttccttccttccttccttccttccttccttccttccttccttcctttctttttttgtttgagacaaagttttgctcttgttgcccaggctggagtgcaatggcacgatctcagatcaccacaacctctgcttcccaggttcaagcgattctcctgcctcaaccttctgagtagctgggattacaggcatgcgccaaccactcctggctaattttgtatttttagtacagatgggtttctccctgttggccaggctggtctataactcctgatctcaggtgatc

SEQ ID NO: 12126 - DNA, 121 bp, Homo sapiens
  DISD22_0005010
  Located on chromosome 7
  Distance between a terminus base of telomere on chromosomal short arm and 5'-terminus of this base sequence : 62018062
  Distance between 3'-terminus of neighbour sequence of sequence listing upward to telomere on chrosomal short arm and 5'-terminus of this base sequence : 182634
ggtggcccagagtaacagaaaagataggaaaggaaagagagagagagagagagagagagagagagagagagagagattgagagagagattgcctatggcagggcaggaaaggtgaggagct

SEQ ID NO: 12127 - DNA, 362 bp, Homo sapiens
  chr7.fa.O7frz.58468258
  Located on chromosome 7
  Distance between a terminus base of telomere on chromosomal short arm and 5'-terminus of this base sequence : 62165462
  Distance between 3'-terminus of neighbour sequence of sequence listing upward to telomere on chrosomal short arm and 5'-terminus of this base sequence : 147279
tcagtgactttacctgtctgagcctcagggttgacatatgaaaaaagtatagcattagtccctaccgcagagggtggtcatgaggattcagtgaaatgccctacatcacaggctaaacatgggggttggtatacttaatgagtaagtgatcattaagggttgattcttatttttatttttggagcagggctggagcacctctgtatgcatatgtaggtgtgtgtgtttgtgtctctgtgtgtgtttgtgtgtgtgtgtgtgtgtgtgtgtggttaagcctcttagctgattctgctaggcccagctattcatgcacctatccattcatgcattcatttctttatgtgctaatccattcatac

SEQ ID NO: 12128 - DNA, 181 bp, Homo sapiens
  D7S494
  Located on chromosome 7
  Distance between a terminus base of telomere on chromosomal short arm and 5'-terminus of this base sequence : 62244505
  Distance between 3'-terminus of neighbour sequence of sequence listing upward to telomere on chrosomal short arm and 5'-terminus of this base sequence : 78681
cctgggtgacagagattctttctcaaacacacacacacacacacacacacacacacacacacacacactaaacaggcatgttttgcaaagactcaaacagaaattgaacaactgaaacttaaataaatttaatatacagtgtatggtttaattattaaaccaagttaataacaacaggatt

SEQ ID NO: 12129 - DNA, 418 bp, Homo sapiens
  chr12.fa.O7frz.40043589
  Located on chromosome 7
  Distance between a terminus base of telomere on chromosomal short arm and 5'-terminus of this base sequence : 62496211
  Distance between 3'-terminus of neighbour sequence of sequence listing upward to telomere on chrosomal short arm and 5'-terminus of this base sequence : 251525
aagagtacagtggttcctaaattaaaaataaatggaacataggctgggctcagtggctcatgcctgttatcccagcactttaggacaccgaggtggccagatcacgaggtcaggtgttcaagaccagcctgaccaacatggtgaaaccctgtctcaactaaaaatacaaaaattagctgggagtggtgctgcatgcctgtaatcccagctactcaggaggctgaggaagcagaatcacttgaatctgggaggtggaggttgcagtgagccaagagagtcagactccagctcaaaaataaataaataaataaataaatagaaatgaaacacagaattactatatcagtcagcaagtccacttctgggtttaaacccacaaaaattgaaagcagggacttcaacagatatttgcaaattc

SEQ ID NO: 12130 - DNA, 353 bp, Homo sapiens
  chr4.fa.O7frz.199680790
  Located on chromosome 7
  Distance between a terminus base of telomere on chromosomal short arm and 5'-terminus of this base sequence : 62537236
  Distance between 3'-terminus of neighbour sequence of sequence listing upward to telomere on chrosomal short arm and 5'-terminus of this base sequence : 40607
tatagaaactgtagtgatgtcctctcttttattaatttctcacactggtaatttctggtctctctttctgtctcactgtttatctttctgtcactctcttcccctctttctccgtgtgtatgtatgtgtgtgtgtgtgtctgtataaaagaatttaaatatacggatagtccttgacttaatgatggtttgacttacaatttttcgactttacaatattgcaaaacaatcacaatttcaacataacgtaccatattcaatacattacatgacagattcaacactttctgataaagtaggctttctgttagataattttgcccaactgtaggctaatgttagtgcactgagcat

SEQ ID NO: 12131 - DNA, 212 bp, Homo sapiens
  HUMUT902
  Located on chromosome 7
  Distance between a terminus base of telomere on chromosomal short arm and 5'-terminus of this base sequence : 62614757
  Distance between 3'-terminus of neighbour sequence of sequence listing upward to telomere on chrosomal short arm and 5'-terminus of this base sequence : 77168
ttactgcactccaacctggatgacagactgagcttccatctcaataaataagtaaatacataaaataaagagaaaaaagaaagaaagaagaaagaaaaagaaagaaagaagaaaggaaaagaaagaaagaagaaagaaaaagaaagaaagagaaagaaaaaagagaaaggaagaaagaaagaaaaagagagaagtagtgtgctcaggttgct

SEQ ID NO: 12132 - DNA, 133 bp, Homo sapiens
  DISD22_0005012
  Located on chromosome 7
  Distance between a terminus base of telomere on chromosomal short arm and 5'-terminus of this base sequence : 63172888
  Distance between 3'-terminus of neighbour sequence of sequence listing upward to telomere on chrosomal short arm and 5'-terminus of this base sequence : 557919
tcttactttgccttgagccaaaataaaaattctgcccatggtcatttagtaaatatataagtgtgtgtgtgtgtgtgtgtgtgtgtgtgtgtttttcagggaccactgacatttagggatgtggccatagaat

SEQ ID NO: 12133 - DNA, 102 bp, Homo sapiens
  DISD22_0005016
  Located on chromosome 7
  Distance between a terminus base of telomere on chromosomal short arm and 5'-terminus of this base sequence : 63282607
  Distance between 3'-terminus of neighbour sequence of sequence listing upward to telomere on chrosomal short arm and 5'-terminus of this base sequence : 109586
aattcactcttgcctttaagaacttttgaaaactgtttaaaaaacaaacaaacaaacaaacaaacaaacaaacaaaaaacagggcaggaacctaaattctga

SEQ ID NO: 12134 - DNA, 335 bp, Homo sapiens
  DISO7_00036490
  Located on chromosome 7
  Distance between a terminus base of telomere on chromosomal short arm and 5'-terminus of this base sequence : 63366342
  Distance between 3'-terminus of neighbour sequence of sequence listing upward to telomere on chrosomal short arm and 5'-terminus of this base sequence : 83633
cacctttagtgcaacagcacacagcctccagcaggtatcccccactcccttcccagctgctttgctcctgccactgaggtgagtacccaaagacaggcagaaatcccatatccactagcactctgctccagctatggcaccttcatcccacaaactcgcaaactccaaatctcaaggagccagagaacacagttggggctcaaaacaagtcccccggagttagagtatgcagcctctgagttgtgagctgagcattgcccacccaccaccaccaccaaacaaaacaaaacaaaacaaaacaaaacaaaaaaaacctcccaggaacaaagcctgtt

SEQ ID NO: 12135 - DNA, 120 bp, Homo sapiens
  DISO7_11405100
  Located on chromosome 7
  Distance between a terminus base of telomere on chromosomal short arm and 5'-terminus of this base sequence : 63471922
  Distance between 3'-terminus of neighbour sequence of sequence listing upward to telomere on chrosomal short arm and 5'-terminus of this base sequence : 105245
ctgccttaccataagcaatgctttctctctctctccctctctctctctctctccctctctctctctctctctctctttctctctctccctttcctatcttttctgttactctgggccacc

SEQ ID NO: 12136 - DNA, 117 bp, Homo sapiens
  D7S2530
  Located on chromosome 7
  Distance between a terminus base of telomere on chromosomal short arm and 5'-terminus of this base sequence : 63509756
  Distance between 3'-terminus of neighbour sequence of sequence listing upward to telomere on chrosomal short arm and 5'-terminus of this base sequence : 37714
ctttgtaaaacatgcctgcttagtgtgtgtgtgtgtgtgtgtgtgtgtgtgtgcgcgcgcgcgcgcgcacgtctgtgtgtatttgagaagaatctgtcacccaggcttgagttcagt

SEQ ID NO: 12137 - DNA, 177 bp, Homo sapiens
  Z67515
  Located on chromosome 7
  Distance between a terminus base of telomere on chromosomal short arm and 5'-terminus of this base sequence : 63541124
  Distance between 3'-terminus of neighbour sequence of sequence listing upward to telomere on chrosomal short arm and 5'-terminus of this base sequence : 31251
acgtagtccccactggcaaattcaatggaattccagaatcatatatatcatatcacacatgtgtgtgtgtatatatatacatatgtgtatgtatatatatacatgtgtatatatatacatatatatgtgtgtgtgtgtgtgtgtgtgtatatatattggagacagggtttgttgccc

SEQ ID NO: 12138 - DNA, 183 bp, Homo sapiens
  D7S2429
  Located on chromosome 7
  Distance between a terminus base of telomere on chromosomal short arm and 5'-terminus of this base sequence : 63959999
  Distance between 3'-terminus of neighbour sequence of sequence listing upward to telomere on chrosomal short arm and 5'-terminus of this base sequence : 418698
cagtgctggagttgttcaagtaaacgttcagtgagaaagttacacacacaccacacacacacacacacacacacacacacacacacacacacacacacgggtgtacacgccccgacaactggcccagtaccccttccagcctaatctttttctctatccccctccaaaacacttgactcccag

SEQ ID NO: 12139 - DNA, 114 bp, Homo sapiens
  DISD22_0005028
  Located on chromosome 7
  Distance between a terminus base of telomere on chromosomal short arm and 5'-terminus of this base sequence : 64048936
  Distance between 3'-terminus of neighbour sequence of sequence listing upward to telomere on chrosomal short arm and 5'-terminus of this base sequence : 88754
tatgctttagatatgttgttgagcatttttaggtgttctatattaggaggtgcttgtgtgtgtgtgtgtgtgtgtgtgtgtgtgtgcgcgcgcgcgcgcatgcttggtctgata

SEQ ID NO: 12140 - DNA, 280 bp, Homo sapiens
  chr7.fa.O7frz.62495038
  Located on chromosome 7
  Distance between a terminus base of telomere on chromosomal short arm and 5'-terminus of this base sequence : 64406977
  Distance between 3'-terminus of neighbour sequence of sequence listing upward to telomere on chrosomal short arm and 5'-terminus of this base sequence : 357927
tctattcggcatatgactgtactgaatactgtaggcaactataacacaatggtgtttgtgtatctaaacatagaaaagaaacagcaaaaaatacattattataatctcatgggaccactgtcatagacacaattcatcactgatccaagtgtcattatgtggcgcatgactgaatatatgtttctatagtggttttggtggcaggggttatgtgtgtgtgtgtgtgtgtgtgtgtgtgtgtctgtgtgtgtgtgtgtgtctgattcagagtcatactcct

SEQ ID NO: 12141 - DNA, 102 bp, Homo sapiens
  DISO7_10002293
  Located on chromosome 7
  Distance between a terminus base of telomere on chromosomal short arm and 5'-terminus of this base sequence : 64464121
  Distance between 3'-terminus of neighbour sequence of sequence listing upward to telomere on chrosomal short arm and 5'-terminus of this base sequence : 56864
tctgcagataccaagcatgatgagaacacacacacacacacacacacacacacacacacacacacacacacacacgaaattccagatctagggacagtgaga

SEQ ID NO: 12142 - DNA, 196 bp, Homo sapiens
  DISO7_10002291
  Located on chromosome 7
  Distance between a terminus base of telomere on chromosomal short arm and 5'-terminus of this base sequence : 64472855
  Distance between 3'-terminus of neighbour sequence of sequence listing upward to telomere on chrosomal short arm and 5'-terminus of this base sequence : 8632
agaagtcacagtgtccatatccaaaatgaaagtcaaagcaaagagcattaaaagaaacaaaaaatggcatgttctagggaaaaagaatatacagtttaatccccattttggggggggagactatatatatgtatgtgtgtttgtgtgtgtatgtgtgtgtctgtgtgttttattttcttgttgctgctgaactctt

SEQ ID NO: 12143 - DNA, 110 bp, Homo sapiens
  DISO7_10002292
  Located on chromosome 7
  Distance between a terminus base of telomere on chromosomal short arm and 5'-terminus of this base sequence : 64478544
  Distance between 3'-terminus of neighbour sequence of sequence listing upward to telomere on chrosomal short arm and 5'-terminus of this base sequence : 5493
ctgactaggtttgtccaagaacaaaatggaggtaggaggttttacagagaaagagagagagagagagagagagagagagagagaagggaaatgttacgtattgctcttag

SEQ ID NO: 12144 - DNA, 254 bp, Homo sapiens
  DISO7_10002294
  Located on chromosome 7
  Distance between a terminus base of telomere on chromosomal short arm and 5'-terminus of this base sequence : 64534817
  Distance between 3'-terminus of neighbour sequence of sequence listing upward to telomere on chrosomal short arm and 5'-terminus of this base sequence : 56163
gattccagcgaggttagggaaatagaattcacagggtcatagcggactgtggtggcatgcacctgtagtcccagctactcgggagattgaggtgggaagatcagttgaacccaggagttcgaggctgcaatgagctatgatggaaccaatgcactccagcctgggcagcagagcaagagcccaacacaataataatagtaaataagaagaagaagaaggagaagaagaagtcacaggatctaatactgagcatg

SEQ ID NO: 12145 - DNA, 114 bp, Homo sapiens
  DISO7_10002296
  Located on chromosome 7
  Distance between a terminus base of telomere on chromosomal short arm and 5'-terminus of this base sequence : 64727963
  Distance between 3'-terminus of neighbour sequence of sequence listing upward to telomere on chrosomal short arm and 5'-terminus of this base sequence : 192892
aataatggaatgtctttcaatatccaaaatatatgtgtgtatacacacacacacacacacacacacacacacacacacacatatatgtaaaagattggatggtaagatttacca

SEQ ID NO: 12146 - DNA, 216 bp, Homo sapiens
  chr7.fa.O7frz.63003361
  Located on chromosome 7
  Distance between a terminus base of telomere on chromosomal short arm and 5'-terminus of this base sequence : 64802464
  Distance between 3'-terminus of neighbour sequence of sequence listing upward to telomere on chrosomal short arm and 5'-terminus of this base sequence : 74387
gtagtaagctactgatttgcagagattttcttaaatgtttgttatttccccacttcctccaaataaattttataatgttctcttttgggtgtgtgtgtgtgtgtgtgtgtgtgtgtgtgtgtgtgtgtgcgtgctggagcatgcctttactaatcagccagaaatttacaacttggttcttgccttactttctgctgatacagagtttgaaggtca

SEQ ID NO: 12147 - DNA, 470 bp, Homo sapiens
  chr7.fa.O7frz.63078171
  Located on chromosome 7
  Distance between a terminus base of telomere on chromosomal short arm and 5'-terminus of this base sequence : 64878955
  Distance between 3'-terminus of neighbour sequence of sequence listing upward to telomere on chrosomal short arm and 5'-terminus of this base sequence : 76275
gtctgtatctggctatgtgataagtaagaaaatacaaaaccacctaagtcataacaggaaaaagtgtttctcttaagctgttggtgaagaccacaaaggatggagaaatttatttatttatttatttatttatttatttatagacagtctcgctctgccaccctggctggagtgggaaagagtgcaaggaatttttttttagatggagtctggctctgtcacccaggctggagtgcagtggtgtgatctcgactcactgcaacctccgcctcccgggttcaagcaattctcctgcctcagcctcttgagtagctgggattacaggtgcatgccaccaccccagctaatttttgtatttttagtacagacagggtttcacaatgttggccaggctagtctcaaactcctggcctcaggtcatctgcccgcctcggcctcccaaagtgctgggattataggcatgagccaca

SEQ ID NO: 12148 - DNA, 101 bp, Homo sapiens
  DISO7_11405101
  Located on chromosome 7
  Distance between a terminus base of telomere on chromosomal short arm and 5'-terminus of this base sequence : 65092293
  Distance between 3'-terminus of neighbour sequence of sequence listing upward to telomere on chrosomal short arm and 5'-terminus of this base sequence : 212868
tggaggaagcaggttaggggtgtgtgtgtgtgtgtgtgtgtgtgtgtgtgtgagagagagagagagggaattctcccatgccaggacatctgcgtgtctca

SEQ ID NO: 12149 - DNA, 89 bp, Homo sapiens
  D7S520
  Located on chromosome 7
  Distance between a terminus base of telomere on chromosomal short arm and 5'-terminus of this base sequence : 65430426
  Distance between 3'-terminus of neighbour sequence of sequence listing upward to telomere on chrosomal short arm and 5'-terminus of this base sequence : 338032
tatccatacacaccatgccagcctgcacgtgtgtgtgtgtgtgtgtgtgtgtgtgtgtgtgtgagacaggacatagcctggacctgttg

SEQ ID NO: 12150 - DNA, 132 bp, Homo sapiens
  DISD22_0005045
  Located on chromosome 7
  Distance between a terminus base of telomere on chromosomal short arm and 5'-terminus of this base sequence : 65521736
  Distance between 3'-terminus of neighbour sequence of sequence listing upward to telomere on chrosomal short arm and 5'-terminus of this base sequence : 91221
tgcagctcactgatgctctattcttccttccttccttccttccttcctttctttctccagtttttattttctctttgtgtttgattttggatagtatctattgctttgtctttgagtgttgcaagatataat

SEQ ID NO: 12151 - DNA, 230 bp, Homo sapiens
  DISD22_0005048
  Located on chromosome 7
  Distance between a terminus base of telomere on chromosomal short arm and 5'-terminus of this base sequence : 65783218
  Distance between 3'-terminus of neighbour sequence of sequence listing upward to telomere on chrosomal short arm and 5'-terminus of this base sequence : 261350
tcatcaactcttctgaaagtatctgtttgggtccactatttcatttccagtttgaaaaggtgtacacacacacacacacacacacacacacacacacataggcacgcataaatacattttttcttctatatatctcttataactaaagtttatctttagcttaatatattggtatatttcatgtaatgtaaatcaaaccaaaaaaaattatgtgttcaattggctcagga

SEQ ID NO: 12152 - DNA, 204 bp, Homo sapiens
  DISD22_0005050
  Located on chromosome 7
  Distance between a terminus base of telomere on chromosomal short arm and 5'-terminus of this base sequence : 65953889
  Distance between 3'-terminus of neighbour sequence of sequence listing upward to telomere on chrosomal short arm and 5'-terminus of this base sequence : 170441
atataaattccgctgcgcagtgtccaggcattgccattcctctagagagaattctattttcacatccctaaatgtcagtggtccctgaaaaacacacacacacacacaaacacacatatgtttactaagtggccatgggcagaattttttatttgacttaaggtgaaatgaaagagtaaagagaacaagttctgacttacagga

SEQ ID NO: 12153 - DNA, 115 bp, Homo sapiens
  DISD22_0005056
  Located on chromosome 7
  Distance between a terminus base of telomere on chromosomal short arm and 5'-terminus of this base sequence : 66277156
  Distance between 3'-terminus of neighbour sequence of sequence listing upward to telomere on chrosomal short arm and 5'-terminus of this base sequence : 323063
gatccaggtgtctcaaagtatgatatgcacacacacacacacacacacacacgcatgcacgagcacccccagagtctgtgcccccaatggtggctgccaccagcctctgcagtag

SEQ ID NO: 12154 - DNA, 210 bp, Homo sapiens
  D7S1792
  Located on chromosome 7
  Distance between a terminus base of telomere on chromosomal short arm and 5'-terminus of this base sequence : 66347549
  Distance between 3'-terminus of neighbour sequence of sequence listing upward to telomere on chrosomal short arm and 5'-terminus of this base sequence : 70278
ttaaaattctgattgaggaaatacctactaagtaactaatacataataataataataataataataataataatacctgaaatttcttcttttttttttgagatggagtttcgctcttgtcacccaggctggagtgcaatggcgcaatctcggctgactgcaacctccgcctcccgagttcaagcagtcctcctgcctgagcctactggg

SEQ ID NO: 12155 - DNA, 235 bp, Homo sapiens
  DISO7_00036534
  Located on chromosome 7
  Distance between a terminus base of telomere on chromosomal short arm and 5'-terminus of this base sequence : 66977051
  Distance between 3'-terminus of neighbour sequence of sequence listing upward to telomere on chrosomal short arm and 5'-terminus of this base sequence : 629292
catgtctgtagtcccagctacttgggcacacgcctgtagtccaggccactcgagcacacacctgtagtaccagctactctggaggctgaggcaggaggatcacttgagcccaggagattaagactgtagtatactatgatcgtgcctgtggctagccactgtgctccagcctgggcaacaccatcgtaaaaataaataaataaataaataaattggggaggacagcctcactggt

SEQ ID NO: 12156 - DNA, 222 bp, Homo sapiens
  DISD22_0005067
  Located on chromosome 7
  Distance between a terminus base of telomere on chromosomal short arm and 5'-terminus of this base sequence : 67153297
  Distance between 3'-terminus of neighbour sequence of sequence listing upward to telomere on chrosomal short arm and 5'-terminus of this base sequence : 176011
ttccattcccactgttacctcttatttatttatttatttatttatttattttcgagacagggtttcactctgttgcgcaggctggagtgcagtggtgcgatctcggcttactgcagcctctgcctcccaggtccaagcgattcttgtgcctcagcctcctgagtacctgggattacaggcaagcgccaccatgcctggctacccactgtgttacctcaagtc

SEQ ID NO: 12157 - DNA, 298 bp, Homo sapiens
  DISO7_00036551
  Located on chromosome 7
  Distance between a terminus base of telomere on chromosomal short arm and 5'-terminus of this base sequence : 67354512
  Distance between 3'-terminus of neighbour sequence of sequence listing upward to telomere on chrosomal short arm and 5'-terminus of this base sequence : 200993
tctgcatgtatccttgccccccccaccacacacacacacacacacacacacacacacacacacacacacacacacacaagcaaatcacagaatgctgtgggaactagaagagggagtaactgtacccactgtcatgtgcatttttttcgcacccagatacataatgatagcccatactctggggtgtgggaaatgccacccacaaagttggtagcacaacacggccatgccatggattggacgagatgtgcggcccgtgttggatgattcacaaatggcgtgaattggaaagaatgag

SEQ ID NO: 12158 - DNA, 128 bp, Homo sapiens
  DISO7_10017839
  Located on chromosome 7
  Distance between a terminus base of telomere on chromosomal short arm and 5'-terminus of this base sequence : 67523200
  Distance between 3'-terminus of neighbour sequence of sequence listing upward to telomere on chrosomal short arm and 5'-terminus of this base sequence : 168390
ttgatgaagtgtagatccacataccatatattagtatgtgtgtgtgtttatacagtgcgtgtgtgtgtgtgtgtgtgtgtgtgtgtgtgtgtgtatatatatatatgctgacatcactatattagggc

SEQ ID NO: 12159 - DNA, 169 bp, Homo sapiens
  D7S663
  Located on chromosome 7
  Distance between a terminus base of telomere on chromosomal short arm and 5'-terminus of this base sequence : 67638207
  Distance between 3'-terminus of neighbour sequence of sequence listing upward to telomere on chrosomal short arm and 5'-terminus of this base sequence : 114879
atttcaaaagcagtttggcaatacataccgagaacttttatctttacctttgggttaaatgatttaaagaaaaaaaattacacacacacacacacacacacacacacacacacacacacacacacatatatatattttgagatggagtctcgctgtgttgccaggctgg

SEQ ID NO: 12160 - DNA, 187 bp, Homo sapiens
  DISO7_10017865
  Located on chromosome 7
  Distance between a terminus base of telomere on chromosomal short arm and 5'-terminus of this base sequence : 67936599
  Distance between 3'-terminus of neighbour sequence of sequence listing upward to telomere on chrosomal short arm and 5'-terminus of this base sequence : 298223
attcaagaggctgagtgatggacagtgtgtgtgtgtgtgtgtgtgtgtgtgtgcatgtgcgtgtgtgtgtatgtgtgcatgtgcattgtgtgtgtgtgtgagagagagagagacagacagacagagagagagagaggcagagacagagacagagacagagagagccatcctggctgctcttgatatt

SEQ ID NO: 12161 - DNA, 176 bp, Homo sapiens
  D7S482
  Located on chromosome 7
  Distance between a terminus base of telomere on chromosomal short arm and 5'-terminus of this base sequence : 68093519
  Distance between 3'-terminus of neighbour sequence of sequence listing upward to telomere on chrosomal short arm and 5'-terminus of this base sequence : 156733
tggctcacgtctggaatcccagcactttgtgacgctgaggcaggaggactgcttgaggccaggagttcgagaccagcccaggcaacatagtgagatctcatagccacacacacatacacacagacacacacacacacacacacacacacacaagatttacaaattagccagccaca

SEQ ID NO: 12162 - DNA, 392 bp, Homo sapiens
  AC006013.3_130254
  Located on chromosome 7
  Distance between a terminus base of telomere on chromosomal short arm and 5'-terminus of this base sequence : 68377650
  Distance between 3'-terminus of neighbour sequence of sequence listing upward to telomere on chrosomal short arm and 5'-terminus of this base sequence : 283955
agcctgataagttgaatgactaagcagaacgctgcttagcaaatgtaaaatcagaaccaaagtctctgggaggcagctttgaagaatcttacagctcacagatgaccctttcttgaagtcctctcttatgtgatagggaaatttcaatgtctctttacacacacacacacacacacactcatgtcaatgtctcattgctttgtttcaccggactttttttgataccttcccaatatagaaatgttttttcttcaaatattttattaccattgattaggcaacaactttatttgctatgcaactgtgtccagaattggtgggttcttggtctcactgacttcaagaatgaagccgtgaactctggcggtgagtgttacagctattaaggtggc

SEQ ID NO: 12163 - DNA, 327 bp, Homo sapiens
  AC006013.3_122667
  Located on chromosome 7
  Distance between a terminus base of telomere on chromosomal short arm and 5'-terminus of this base sequence : 68385305
  Distance between 3'-terminus of neighbour sequence of sequence listing upward to telomere on chrosomal short arm and 5'-terminus of this base sequence : 7263
caacttgtatttaagctcagcatacttaaaatatgctttaaatatgttgttcagcatttttaggtgttctgtattaggagatgtgtgtgtgtgtgtgtgtgtgtgtgtgtacttggtctgatatatagctttaagtaaaagtttgcccacagtttttttctaaatttactataaaataatgctaataagcacagcaaatatcagcagtggtttaattttgaaagtactaatgagttattttttctttattttcatttatattttcagaaatttaaagaggatcgtttgttatttttatgaaagaaacattatggcaaggaattacat

SEQ ID NO: 12164 - DNA, 179 bp, Homo sapiens
  AC006013.3_104421
  Located on chromosome 7
  Distance between a terminus base of telomere on chromosomal short arm and 5'-terminus of this base sequence : 68403584
  Distance between 3'-terminus of neighbour sequence of sequence listing upward to telomere on chrosomal short arm and 5'-terminus of this base sequence : 17952
ggacaatggagtatgactctgtctcagaacacacacacacacacacacacacacacacacacacacacacacacacaaataaaacaaaccctgccaccaaaaccactgtagaaacatatattcagtcatgtgccacataatgacatttggatcaatgatgaattgtttctatgagcctg

SEQ ID NO: 12165 - DNA, 276 bp, Homo sapiens
  AC006013.3_101903
  Located on chromosome 7
  Distance between a terminus base of telomere on chromosomal short arm and 5'-terminus of this base sequence : 68406022
  Distance between 3'-terminus of neighbour sequence of sequence listing upward to telomere on chrosomal short arm and 5'-terminus of this base sequence : 2259
gacttggaggcattcaataactgtcctaagataaaacagtaagaagaagcagagcagacagagcacccaggatgtttgttatttttatttttcataacatttcataaaataatgttataatgcttatctctctctctctctctctctctctctctcttttctgagacagactcttgctgtcacccaggctggaatgtagaggcacagtcatagctcactgtagccttgacctcccctgctcaaggtatcctcccacctcagacttatgagaagctg

SEQ ID NO: 12166 - DNA, 356 bp, Homo sapiens
  HUMUT6351
  Located on chromosome 7
  Distance between a terminus base of telomere on chromosomal short arm and 5'-terminus of this base sequence : 68428430
  Distance between 3'-terminus of neighbour sequence of sequence listing upward to telomere on chrosomal short arm and 5'-terminus of this base sequence : 22132
cacaatttgccaagcacatttaaccctattatctcattggattgttacaagaagcttttgaaataaatagcaaaacccattatctgctttaataagaaagaaagaaagaaagaaagaaagaaagaaagaaagaaagaaagaaagaaagagaaagaaagagaaagagagaaagagagagagaaagagagaaaagagagagaaagagagaaaagagagagaaagagagaaagcaaaagagggagggagggaggaaggaaggaagaaaggaaggaaggaaggaaggaaggaaggaaggaaggaaggaaggaaggaaggaagggaggaaggaaagaaggaaggaactgttggccctgtgg

SEQ ID NO: 12167 - DNA, 354 bp, Homo sapiens
  AC006013.3_79503
  Located on chromosome 7
  Distance between a terminus base of telomere on chromosomal short arm and 5'-terminus of this base sequence : 68428457
  Distance between 3'-terminus of neighbour sequence of sequence listing upward to telomere on chrosomal short arm and 5'-terminus of this base sequence : -329
attatctcattggattgttacaagaagcttttgaaataaatagcaaaacccattatctgctttaataagaaagaaagaaagaaagaaagaaagaaagaaagaaagaaagaaagaaagaaagagaaagaaagagaaagagagaaagagagagagaaagagagaaaagagagagaaagagagaaaagagagagaaagagagaaagcaaaagagggagggagggaggaaggaaggaagaaaggaaggaaggaaggaaggaaggaaggaaggaaggaaggaaggaaggaaggaagggaggaaggaaagaaggaaggaactgttggccctgtggctgatctgacatgtccaagttctta

SEQ ID NO: 12168 - DNA, 415 bp, Homo sapiens
  chr7.fa.O7frz.70107291
  Located on chromosome 7
  Distance between a terminus base of telomere on chromosomal short arm and 5'-terminus of this base sequence : 68588823
  Distance between 3'-terminus of neighbour sequence of sequence listing upward to telomere on chrosomal short arm and 5'-terminus of this base sequence : 160012
ccataactgcttcatccatatttcccagctgttaaccatcttattgcatttttacatatcttcctccctctcttgtccccactctccctcccttgctcttattctttctcttttcacacacacacacacacatgcacacacacacactagtcttttccttcaccacttgagctagctgtgggaacagtataccttcacttgtaaacacttccgtgtgcattctctaaaacaaagatctctcatgcaagcttctaagtcaggaagtcaacattttcactatgctcccatccaatccatttagagcccattcaaattttaccaactctctcaatgatgtgtctttttcccttggggtccaagatgccatctgggaaaatgtattgcatctattctagttgtcatgtctcctagtgtc

SEQ ID NO: 12169 - DNA, 345 bp, Homo sapiens
  chr7.fa.O7frz.70290171
  Located on chromosome 7
  Distance between a terminus base of telomere on chromosomal short arm and 5'-terminus of this base sequence : 68733665
  Distance between 3'-terminus of neighbour sequence of sequence listing upward to telomere on chrosomal short arm and 5'-terminus of this base sequence : 144427
cgataggtgattgagataggtaggtagagaggatagagatagtaggtcgatagatagatagatggatagatagatagatagatagatagatagatagatagataatatagatagataattgatagagacagatgggtagatactaggtatgtagatatagataaatatgtaaatagagataggtagatagatagatagatagacatagctagatgatagcttgctagctagctagataattgatagaggtaagtaggtaggtagagatagatagatgatagatagatagatagatagatagatagatagatagatatacatagatggataatagcttgttagcta

SEQ ID NO: 12170 - DNA, 409 bp, Homo sapiens
  AC004910.1_52516
  Located on chromosome 7
  Distance between a terminus base of telomere on chromosomal short arm and 5'-terminus of this base sequence : 68968147
  Distance between 3'-terminus of neighbour sequence of sequence listing upward to telomere on chrosomal short arm and 5'-terminus of this base sequence : 234137
cacttgaggtcaaaactttcagaccattctgggcaacatagcaagaccccatctctacaaaaaataaaaaattagccaggtatggtggcatgcatctgtagtcccagctactcaagaggctgagacagtaggatcacttgagcccaggaggtagaggctgccatgagctatgattgcacctctgccctccagcctgggtgacagagtaagaccctgtgtgtgtgtgtgtgtgtgtgtgtgtgtgtgtgtgtatatataaatatataaaaatcagtgatcacattctgggcaaagttccagtctctttctcttttgctctccagttatttcaagaactgtagttaggagcccatcactggccacaggccaggcacttaagtgactacttgagatggagatagtcaaagaa

SEQ ID NO: 12171 - DNA, 397 bp, Homo sapiens
  AC004910.1_53939
  Located on chromosome 7
  Distance between a terminus base of telomere on chromosomal short arm and 5'-terminus of this base sequence : 68969704
  Distance between 3'-terminus of neighbour sequence of sequence listing upward to telomere on chrosomal short arm and 5'-terminus of this base sequence : 1148
gctacagtgagctgtaattgagccactgcactccagcctggatgacagagcaagaccctgtctcaaaaagaaggaaggagggaaggaaggaaggaaggaaggaaggaaggaaggaaggaaggaaggaaggaaggaaggaaggaaggaaggacggcaggaagggagggagggaggaagggagggaaggagagagagaaacaagaaggaaggagaaagaaagaaaaagaaagaaggaaagaaagaaagaaagaaagaacagaaagaaagaaaggaagagaaaggaaggaaggaaaggaggcagggagggagggaggaaagaaggtaaagaaagaaagaaagaaaaaagaatcttgtgctgcaatctgcaaccaggctgtctaaattacaactcatgctc

SEQ ID NO: 12172 - DNA, 228 bp, Homo sapiens
  AC004910.1_60253
  Located on chromosome 7
  Distance between a terminus base of telomere on chromosomal short arm and 5'-terminus of this base sequence : 68975970
  Distance between 3'-terminus of neighbour sequence of sequence listing upward to telomere on chrosomal short arm and 5'-terminus of this base sequence : 5869
aggtaaatcaggtaaatgaacctcttataaatgcattcagttgcctgaagtagataatttaggaatattcagtcagtgaaggagtctcactagagactagagtctaataatcctcagtaaaaaaaatcgtgtgtgtgtgtgtgtgtgtgtgtgtgtgtgtgtgtgtgtggttttagacataagatctcactctgccagccaggctggagtacaattatcatagctcac

SEQ ID NO: 12173 - DNA, 443 bp, Homo sapiens
  AC004910.1_88864
  Located on chromosome 7
  Distance between a terminus base of telomere on chromosomal short arm and 5'-terminus of this base sequence : 69004525
  Distance between 3'-terminus of neighbour sequence of sequence listing upward to telomere on chrosomal short arm and 5'-terminus of this base sequence : 28327
ataaagtgacatgcaatgaaacaagatgtgcctgtgttcaaacataattccagcaatccctcttgagccccctgctgcagcccagctgatctggtcagagcacaccatcctaaaactcacctgatgcacaagacccttcctctctctttttagtagcacagttcctcctgcctggaggctcttgcttctcttctcttctcttctcttctcttctcttctcttctcttctctttgcttatcttcacttcacttctcttctcttctcttttcttctcttctttcaggaatatgttcatctccagcttccttcatagagccagtcctgaccactctgccctacaaaacccctcctttccctcaaaagagtgttgtccacctgctgatcttggttggcatgaacatgcttccctctcgatgctgggtgacatttcacaagtttatgg

SEQ ID NO: 12174 - DNA, 221 bp, Homo sapiens
  D7S2489
  Located on chromosome 7
  Distance between a terminus base of telomere on chromosomal short arm and 5'-terminus of this base sequence : 69020418
  Distance between 3'-terminus of neighbour sequence of sequence listing upward to telomere on chrosomal short arm and 5'-terminus of this base sequence : 15450
tcatagccagggatgggagggaaaaagccagagtgtgcatacaaatgctccacctggctccttcacaaaagagtctgcacctgctgtgttttcccaggtgcacaggaaaatggtaggtcacaaaaaaagggaagagaatgtgctagaagaatctggcatctctctctctcacacacacacacacacacacacacacttccatataagctctgcacaacttg

SEQ ID NO: 12175 - DNA, 480 bp, Homo sapiens
  chr7.fa.O7frz.70660954
  Located on chromosome 7
  Distance between a terminus base of telomere on chromosomal short arm and 5'-terminus of this base sequence : 69094712
  Distance between 3'-terminus of neighbour sequence of sequence listing upward to telomere on chrosomal short arm and 5'-terminus of this base sequence : 74073
aagccaaaggttctaaatatctagtacccattagcttgaggagattgcaaatgatctgtcctccagctattagggaaacattgcattgtgaaataaacaattatactcactacctcttggcagaaacaagagtttgtccaaactcaaccagttcgtcatcacgaacacacttgggttgtgtgtgttgtgctaagagatgagacatccaagggcaggttccaagaatccaagactgtcttttttttctttctttcctgttttatttatttatttatttatttatttattgagatggaatctcactctttcgccaggctggagtgcagtggcacgatctcagctcactgcaacgtctgcctccctggttcaagcaattctcctgtctctgtctcccaagtagctgtgattacaggtgtgtgccaccatgcccagctaatttttgtgtttttagtagagatggggttatgccatgttggctag

SEQ ID NO: 12176 - DNA, 207 bp, Homo sapiens
  HUMUT530
  Located on chromosome 7
  Distance between a terminus base of telomere on chromosomal short arm and 5'-terminus of this base sequence : 69133615
  Distance between 3'-terminus of neighbour sequence of sequence listing upward to telomere on chrosomal short arm and 5'-terminus of this base sequence : 38423
atcacaccactgcactctggcctgggtgacaagagagaaactctgtctcaaaaataaataaataaataaataaataaataaataaataaataaaccacttactgccattttaattcttcgtagagagaaacattcaccaaatcaaatgacagagtattgcaattcccgaacgggtggaatggttattcttctaacacatggttggtg

SEQ ID NO: 12177 - DNA, 125 bp, Homo sapiens
  D7S2483
  Located on chromosome 7
  Distance between a terminus base of telomere on chromosomal short arm and 5'-terminus of this base sequence : 69264334
  Distance between 3'-terminus of neighbour sequence of sequence listing upward to telomere on chrosomal short arm and 5'-terminus of this base sequence : 130512
gtggtatgcatccattctatgtccaccatacacacacacacacacacacacacacacacacacacacacacagatgatccttcaactcactatacatctacctccatgcctcgttgctgcccaaa

SEQ ID NO: 12178 - DNA, 121 bp, Homo sapiens
  HUMUT6755
  Located on chromosome 7
  Distance between a terminus base of telomere on chromosomal short arm and 5'-terminus of this base sequence : 69353805
  Distance between 3'-terminus of neighbour sequence of sequence listing upward to telomere on chrosomal short arm and 5'-terminus of this base sequence : 89346
agatgacatacggatgaatggatggggagatgatagatagattagatagatagatagatagatagatagatagatagatagatagatgatagatagataatagaaagatgatagaggagac

SEQ ID NO: 12179 - DNA, 269 bp, Homo sapiens
  D7S639
  Located on chromosome 7
  Distance between a terminus base of telomere on chromosomal short arm and 5'-terminus of this base sequence : 69448809
  Distance between 3'-terminus of neighbour sequence of sequence listing upward to telomere on chrosomal short arm and 5'-terminus of this base sequence : 94883
ggcctgtgtggcttattttaattcttataatttttttttaattgctagaatatgagtgtgtgtgtgtgtgtgtgtgtgtgtgtgtgtgtgtgtgttacctgtaatataacaaaccatttcgatctttaaattcagatatttttccagattcatatagattaatccttaaacatacttttttacattttcttccatttgtcctgtttctttcctcagaaatctctatcattcttaaggtttctgtatgtatgatccatatctgcctaatt

SEQ ID NO: 12180 - DNA, 468 bp, Homo sapiens
  chr7.fa.O7frz.71245684
  Located on chromosome 7
  Distance between a terminus base of telomere on chromosomal short arm and 5'-terminus of this base sequence : 69525478
  Distance between 3'-terminus of neighbour sequence of sequence listing upward to telomere on chrosomal short arm and 5'-terminus of this base sequence : 76400
ctccttatccaactatgctttccacagcaagaatgtgcaggagttctctcagccccattcttggaccccccaaacgagagcctcaacccagtcaaagggacagaactggaaacacccaccacaccaagtttttcctccccctcttctcccctctctgtttccccagttagtaagtctcctgtaaaaattaaaaatctagagtatggaaaggggtgggagggaggaatcgagattatatgtgtgtggtctgaaggaacactccaggggtatgcctcagggatctgtcctgtgtgtgatgcgggatgtggaagaggttgccaaaatgagcaatgtctgaacatcatctcagccacctacccatatccccccaaaaaatgtgaccatgagagaaagaaagagagagagagagagagagaagtattaccagcgtaaaactatgttaaagggttaaagctctgtttgcattta

SEQ ID NO: 12181 - DNA, 414 bp, Homo sapiens
  AC004966.2_121342
  Located on chromosome 7
  Distance between a terminus base of telomere on chromosomal short arm and 5'-terminus of this base sequence : 69710363
  Distance between 3'-terminus of neighbour sequence of sequence listing upward to telomere on chrosomal short arm and 5'-terminus of this base sequence : 184417
gtggctcatacctgtaaatttattttattttattttattttattttattttattttattttattttattttatttattttattttattttattttattttttgagacggagtctctctgtcatgtcgcccaggctggagtgcagaggcacaatctcagctcaatacaacctccacctcctaggttcaagcgattctcatgcctcagcctcccaagtagctgagactacaggcacacaacaccacgcccagctaatttttgtacttttagtagagacagggttttactaggctgctcttgaactcctggcctcaagtgatctgcctgcctcggcctcccaaagtgctgagattacaggcattgtcccagcgcccatccatacctctaatgttttaatttatgaggtggctcatac

SEQ ID NO: 12182 - DNA, 114 bp, Homo sapiens
  D7S2435
  Located on chromosome 7
  Distance between a terminus base of telomere on chromosomal short arm and 5'-terminus of this base sequence : 69864384
  Distance between 3'-terminus of neighbour sequence of sequence listing upward to telomere on chrosomal short arm and 5'-terminus of this base sequence : 153607
ctgtgtgctttctacagagtcatatgttcgtgtgtgtgtgtgtgtgtgtgtgtgtgtgtgtgtctgtgtagtatatacctttcccgggtgtcctcgggactggagactgatggg

SEQ ID NO: 12183 - DNA, 459 bp, Homo sapiens
  AC006012.2_74806
  Located on chromosome 7
  Distance between a terminus base of telomere on chromosomal short arm and 5'-terminus of this base sequence : 69878263
  Distance between 3'-terminus of neighbour sequence of sequence listing upward to telomere on chrosomal short arm and 5'-terminus of this base sequence : 13765
agatgaatatgaagatcagtcaagttacacacttctctcaagagtcactctccgtctctttctttctttctttctttctttctttctttctttctttctttctttctttttttaagagatgggatctcactctgtttcccaggctggagtgcagcagtaatcatagctcactgcatcctgaaactcctggcctcaagcgatcctcctgctgcagcctcctgaggacctgttggtgtgtgtcaccatgcctggctaattttttaatttttttttgtagagacagggtcttgctgtgttgcccaggcattctcaaactcctgggctcaagtgatcctcctgcctcagcctcccaggtagctgggactgcaggtgtgaaccactacccctgctaattttttttggaggggtagaaatggggtcttgcaatgttacccaggctgatctagaactcctggtctc

SEQ ID NO: 12184 - DNA, 337 bp, Homo sapiens
  AC006361.3_19528
  Located on chromosome 7
  Distance between a terminus base of telomere on chromosomal short arm and 5'-terminus of this base sequence : 70011619
  Distance between 3'-terminus of neighbour sequence of sequence listing upward to telomere on chrosomal short arm and 5'-terminus of this base sequence : 132897
caacggtagatttcaaattcagttctttctggcttcaaagcctgagatttgccaccaccgcatgagctgcttggagtactggattggctctcccacagtttttgtcattgtgtgtgtgtatgtgtgtgtgtgtatatgtatgtgtgtgacagacagagagaaggagaggggtgtgtgtgtgtgtgtgtgtgtgtgtgtgtgtatgagagagagagagaaagtgtgccagaaattatttgcgtacgttttaaaatctctgttaggccattttttaaatctgtaaaatgggcatgaagcatgcagagttcatagggtttctttgctgagtagaatatgg

SEQ ID NO: 12185 - DNA, 208 bp, Homo sapiens
  D7S645
  Located on chromosome 7
  Distance between a terminus base of telomere on chromosomal short arm and 5'-terminus of this base sequence : 70150640
  Distance between 3'-terminus of neighbour sequence of sequence listing upward to telomere on chrosomal short arm and 5'-terminus of this base sequence : 138684
tgggccactctgtgaagtagttctttacttctagccaccacccctgcctctagaacaatgcaaccaaccttaaccaaagtcacatatcaagagttctctgctgcctgttaatgcagatttgacttctttgtgtgtgtgtgtgtgtgtgtgtgtgtgtgtgtgtgtgtgtgtgtgtcagggtctcattctgtcaccgaggctagaatgc

SEQ ID NO: 12186 - DNA, 370 bp, Homo sapiens
  D7S1832
  Located on chromosome 7
  Distance between a terminus base of telomere on chromosomal short arm and 5'-terminus of this base sequence : 70190300
  Distance between 3'-terminus of neighbour sequence of sequence listing upward to telomere on chrosomal short arm and 5'-terminus of this base sequence : 39452
tgtcctgtgctattttgaggctttgttatttggtacataaacatttagggttatgtggtattgattgattgatccctttattattatgagatgaccacctctatccctggtaatagtctttgctctgaaatctatctgtctgtctgtctgtctatctatctatctatctatctatctatctatctatctatctatctgcctgcctacctacctacctatatctgtcagtcatgtatctcactttattatctcttttaattggagtattttccattcaaatgttaggtttgagactttcatgttgccatttgttttttgttagtcgcattttttttccttaccctctttccctgcagccttgagaatgaat

SEQ ID NO: 12187 - DNA, 128 bp, Homo sapiens
  D7S2500
  Located on chromosome 7
  Distance between a terminus base of telomere on chromosomal short arm and 5'-terminus of this base sequence : 70195074
  Distance between 3'-terminus of neighbour sequence of sequence listing upward to telomere on chrosomal short arm and 5'-terminus of this base sequence : 4404
ttttccagactgagccagaatgctcgtactgcattttggatttacacacacacacacacacacacacacacacacacactacttttttactttccagtttcccctgttacttggtgtgctgcttgaaa

SEQ ID NO: 12188 - DNA, 383 bp, Homo sapiens
  AC006317.3_142986
  Located on chromosome 7
  Distance between a terminus base of telomere on chromosomal short arm and 5'-terminus of this base sequence : 70268790
  Distance between 3'-terminus of neighbour sequence of sequence listing upward to telomere on chrosomal short arm and 5'-terminus of this base sequence : 73588
ggagtctacacatgaattaatgactttatttatttatttatttatttatttatttagagaccgagtttcgctctcgttgcccaggctggagtgcaatgacatggtctcggttcactgcaacttctgcctcccgggtttgagtaattctcctgcctcagcctcccaagtagctgggattacaggcacctaccaccatgcctggctaatttttgtatttttagtagagatgggatttcaccatgttggccaggctggtctcgaactcctgacctcgggtgattcactcgcctcagcttcccaaagtgccaggattagaggtgcgagccaccgcgtctgactttgaaatattttttttttaagattacacagctaaatggaattct

SEQ ID NO: 12189 - DNA, 244 bp, Homo sapiens
  AC006317.3_113366
  Located on chromosome 7
  Distance between a terminus base of telomere on chromosomal short arm and 5'-terminus of this base sequence : 70298410
  Distance between 3'-terminus of neighbour sequence of sequence listing upward to telomere on chrosomal short arm and 5'-terminus of this base sequence : 29237
tagaatgtaacaaatgtttgtcagactgagggaggaaggaaggaaggaaggaaggagtagagtgatatcacatgcaaggaattggatttactgacttattcctctggccaagtgtgtcaacattatgattgcaataagaacttttgcattaatactatttatacttatgggtattattgctgcatttggtaattctacggtaaatttggaggtgcttctagtatcactgtcttgttctaccaat

SEQ ID NO: 12190 - DNA, 468 bp, Homo sapiens
  AC006317.3_104220
  Located on chromosome 7
  Distance between a terminus base of telomere on chromosomal short arm and 5'-terminus of this base sequence : 70307360
  Distance between 3'-terminus of neighbour sequence of sequence listing upward to telomere on chrosomal short arm and 5'-terminus of this base sequence : 8706
acgttggacataattatgacacagatttcataaggctgcttctccttttacaattatattttatgaagaacagacaatgttttctttgcaaattttgaagctccttcattttctgaatgcattggatttggtactaaatgctctctcccgtttgcatttccttctctccctccctccttgcctccttccctcccttccttccttccttccttccttccttccttccttccttccttccttccttccttccttttttttttttttttatttttggtcagtgtttcactcttgttgcccaggctggagtgcaatggcgcaatcttggcttaccacaacctccacctcctgagttcaagcaattctcctgcctcagcctcccgagtagctgggattacagacatgcgccaccacgtgcgtctaattttgtattttcagtagagacagggtttctctatgttggtcaggctg

SEQ ID NO: 12191 - DNA, 278 bp, Homo sapiens
  AC006317.3_17897
  Located on chromosome 7
  Distance between a terminus base of telomere on chromosomal short arm and 5'-terminus of this base sequence : 70393675
  Distance between 3'-terminus of neighbour sequence of sequence listing upward to telomere on chrosomal short arm and 5'-terminus of this base sequence : 85847
gaactgtccatgaagacaagagcaagaatgaaatcagaggtagaagccagaaggctgagatgagagttggtgacaacctgacgtgggcataacagaaggttgaataattggtgttggaagtgacgtagcatttttcccacctgatgcttttatcaagttgttgctccatttttacttgatttcttccaacaactatatgcttatttctcaatcaaatatatatatatatattgtgtgtgtgtgtgtgtgtgtgtgtgtgtttggtcggctattagtaa

SEQ ID NO: 12192 - DNA, 396 bp, Homo sapiens
  chr7.fa.O7frz.72210371
  Located on chromosome 7
  Distance between a terminus base of telomere on chromosomal short arm and 5'-terminus of this base sequence : 70461027
  Distance between 3'-terminus of neighbour sequence of sequence listing upward to telomere on chrosomal short arm and 5'-terminus of this base sequence : 67074
atttagctattcaggcactttgtgtttgtgtgtatacatatacattctcttatatacatttgcgacatgtggtaaaaggccctactttttggagtcagaaattgtgctcatttctgtatctgccaccttgtagctgttggctcttgaacaacaactaagcctctactttgaacatcaattttctcagtaaaatgagggaactagactaaatagttgccaaaattcttagtccacacacacacacacacacacacacccattttgtacttctaaagacactggaaagaagtttacggatggaggaggagccaagatggccgaataggaacagctccggtctacagctcccagcgtgagcgacgcagaagacgggtgatttctgcatttccatctgag

SEQ ID NO: 12193 - DNA, 473 bp, Homo sapiens
  chr7.fa.O7frz.72316470
  Located on chromosome 7
  Distance between a terminus base of telomere on chromosomal short arm and 5'-terminus of this base sequence : 70567104
  Distance between 3'-terminus of neighbour sequence of sequence listing upward to telomere on chrosomal short arm and 5'-terminus of this base sequence : 105681
agatcaaggaaacctacataagactcccagagcaaaaggaccctgtaacacttgtgccttggcattgccatatgctctgttgcgcaggaatggggaggaacggccatccacatgccacccccacttccactcggaaataatagggggtgacaaatggctgctgcattctattctgttttaccaggctgtttctttcctgccctcaagaggtttctgactttctgacagcagggagctgaggttgatctagcaactgggaggattgcacctggatttgcagaaatacacatgcacatgtgtgcacgcacacacacacgcgcgcgcgcgcacatacacacacacacacacacacacacacacacacacagtgctgctgcaactcccagagtatcacataatcactcttctggctttagtggttttcctttggccacactctgctcttgtttggcttgctagcacagtaatcagag

SEQ ID NO: 12194 - DNA, 346 bp, Homo sapiens
  AC004773.1_75191
  Located on chromosome 7
  Distance between a terminus base of telomere on chromosomal short arm and 5'-terminus of this base sequence : 70681946
  Distance between 3'-terminus of neighbour sequence of sequence listing upward to telomere on chrosomal short arm and 5'-terminus of this base sequence : 114369
aagctccttggaggctaaggatcatttggacctccctgggattggggtgcacaggataatcacagggggcacttgtgatctttgggatctgtcacccaggcttggtggctaactttctgtgtgtgtgtgtgtgtgtgtgtgtgtgtgtgtgtgtctgtgtgtgtagacggggtcttaccatgttgccccagctgatcttgaactccagggcttaagggatcctcccacctcggcctctcaaagtgctgggattacaggcatgagccactatgcatggcctggtggctgactgtcatagaacaccaaagctagacaagcctaaataataacagtgacgatgctaagc

SEQ ID NO: 12195 - DNA, 225 bp, Homo sapiens
  AC004773.1_101459
  Located on chromosome 7
  Distance between a terminus base of telomere on chromosomal short arm and 5'-terminus of this base sequence : 70708203
  Distance between 3'-terminus of neighbour sequence of sequence listing upward to telomere on chrosomal short arm and 5'-terminus of this base sequence : 25911
tcatgttagtggcctctgatagagtgtaacctgggaggctctttggttgtcagagaatttgtcttatactgtattagggttgcagagtgttctgtcttcaatgaagatagaactttttggtcatgtacgtgtgtgtgtgtgtgtgtgtgtgtgtgtgtgagagagagagagagagagaaagagttaatcccccttgacaactcctggatggcaagatagttacag

SEQ ID NO: 12196 - DNA, 341 bp, Homo sapiens
  chr7.fa.O7frz.72547095
  Located on chromosome 7
  Distance between a terminus base of telomere on chromosomal short arm and 5'-terminus of this base sequence : 70749906
  Distance between 3'-terminus of neighbour sequence of sequence listing upward to telomere on chrosomal short arm and 5'-terminus of this base sequence : 41478
ctgaattcgactctacattgaaaaattaaggactggcaaccaaaggctgtcacttgttgaagaaaaaaaccttaattaaaaaataaataaataataaataaataaataaataaataaataaacctaatgaagctgagggtcaaggggcatcgggataaactgttttgcaagggttgatgacattaggaaaaataactctattaaatcagaagtctgcctctgccaggtaatccttaccaaaagtatgcaagaagcttgagagatcagccctagaaggaaaggtgccaccccagtcctccaagggcacagggcacaggggttagcatgtaagcttgctagtc

SEQ ID NO: 12197 - DNA, 379 bp, Homo sapiens
  AC004881.1_23520
  Located on chromosome 7
  Distance between a terminus base of telomere on chromosomal short arm and 5'-terminus of this base sequence : 70855190
  Distance between 3'-terminus of neighbour sequence of sequence listing upward to telomere on chrosomal short arm and 5'-terminus of this base sequence : 104943
aaatgtgaaagattaggtgctcctgaatgtgacaccagacgtggtgtgacagagcccatttgtgggtgtctgtttcaaagcttttggttcataggccatgctgcccgctttgctggaggaaagttccaagacccacaccaggctactccttgacaggaagcttttgttcctagcaacgggtttacccagtctttgtttgtttgtttgtttgtttgtttgttttgagacagggtctcactctgtcccccaggctggagtgcagtggtgctatctcagctcaccgcaacctccacctccaggttcaagcggttcttctgcctcagccacccaggtagctgggattacaggcactggccatcacgcctgactaactttatat

SEQ ID NO: 12198 - DNA, 235 bp, Homo sapiens
  AC004881.1_1667
  Located on chromosome 7
  Distance between a terminus base of telomere on chromosomal short arm and 5'-terminus of this base sequence : 70877135
  Distance between 3'-terminus of neighbour sequence of sequence listing upward to telomere on chrosomal short arm and 5'-terminus of this base sequence : 21566
tgattaaagctgtcatttggagctgctcattaaagacaagccccagaatagcaagaggaaaaaaggttggagaggcatatatatacatatatgtgtgtgtgtctgtgtgtgtgtgtgtgtgtgtgtgtgtattttttgccttaaaagtgcatcattcttttctagattgagccactgaaatcaaggctgtagagacatttccactgagaatatagaatgctgttttgcaagtaat

SEQ ID NO: 12199 - DNA, 262 bp, Homo sapiens
  DISO7_10002300
  Located on chromosome 7
  Distance between a terminus base of telomere on chromosomal short arm and 5'-terminus of this base sequence : 70948446
  Distance between 3'-terminus of neighbour sequence of sequence listing upward to telomere on chrosomal short arm and 5'-terminus of this base sequence : 71076
tagacatctggccagtggagggagaaactgagatttacccagcagtggggataggatggtgtggtgtggtatggtgtggcgtgatgtggtgtggtgtggcgtggcgtggcgtgttgtggcgtggtatggtgtggcgtggcatgttgtggtatggtgtgtgtggtgtggtatggtgtggcgtggtatggtgtggggtggtgtggcgtggcgtgtggtgtggtatggtgtgttgtggtatggtggggatggacagtgggagcat

SEQ ID NO: 12200 - DNA, 392 bp, Homo sapiens
  chr7.fa.O7frz.73181891
  Located on chromosome 7
  Distance between a terminus base of telomere on chromosomal short arm and 5'-terminus of this base sequence : 71213837
  Distance between 3'-terminus of neighbour sequence of sequence listing upward to telomere on chrosomal short arm and 5'-terminus of this base sequence : 265129
ccaataggtagtatttcatccttcaactccctcccaccttcccacattttgcagtctctaatgtccataattctactctgtatgtctgtgtgtacctattgtttaactcccacttgtaagagagaaaatgtggttcttgactttttgtttctgagtcattttacttaggacaatagtcttcagttccatccatgctgctgcaaaagatgatttcatcctttttcatggctgagtagtattccatggtgtgtatatatgtgtatacacacacacacacacacacacaccatggaatactactaccacaaaaatgtgagatatatatgagatacatgtatatatctcacattttctttatccaaacatctgctggtagacacttaggttgattc

SEQ ID NO: 12201 - DNA, 419 bp, Homo sapiens
  chr7.fa.O7frz.73085094
  Located on chromosome 7
  Distance between a terminus base of telomere on chromosomal short arm and 5'-terminus of this base sequence : 71254243
  Distance between 3'-terminus of neighbour sequence of sequence listing upward to telomere on chrosomal short arm and 5'-terminus of this base sequence : 40014
agcctatgaggaaccagaggaggggcctgcacgctaggggataaattgcttgttgaaactgtgctgggtgtgcctgcccatcagacacctgatcttccaaaactgtcattaaaagtctcactttcgctgttctccggttcttttctcacaaaaccatggctggtcaatccttccttccttcctttcttccttcctgcctgcctgccttttcttttccttctttctttctttctttcttttttctttctttctttctttctttctttctttctttctttcttttttctttctttctttccttttttctttctttcttctttccttctttctttctctttctctctctctccttccttccttcctccctcccttcctcccttcctcccttccttccttccttctgttcatttattcattgg

SEQ ID NO: 12202 - DNA, 250 bp, Homo sapiens
  AC004963.2_165904
  Located on chromosome 7
  Distance between a terminus base of telomere on chromosomal short arm and 5'-terminus of this base sequence : 71381260
  Distance between 3'-terminus of neighbour sequence of sequence listing upward to telomere on chrosomal short arm and 5'-terminus of this base sequence : 126598
taggtgagcatccataatgttttgagaatgcacacagggagtaatttacacaacctagggaattaggagagattttgcgtgcacgcgcacacgtgcacacacacacacacacacacacgcatgcacgtatgcacgcacacagagatgcccaagtccagtttggtaagaaatcgttggccttcaacattttctcaaacaatccatgatgaacatatcatccatggatttctttaaaccaacataaggctga

SEQ ID NO: 12203 - DNA, 410 bp, Homo sapiens
  AC004963.2_141236
  Located on chromosome 7
  Distance between a terminus base of telomere on chromosomal short arm and 5'-terminus of this base sequence : 71405810
  Distance between 3'-terminus of neighbour sequence of sequence listing upward to telomere on chrosomal short arm and 5'-terminus of this base sequence : 24300
gattacaggtatgcgccaccacgtctggctgtgtgtgtgtgtgtgtgtgtgtgtgtgtgtgtgtgtgtatgtgtgtatttttagtagagacagggtttcaccatattgaccagcctggtcttgaactcctgacctcaagtgatcctcctgcctcagtctcccaaagtgctgggatttcaggcatgagccaccacatttggctgtgtgtgtgtgtgtgtgtgtgtgtgtgtgtgtgtttagtagagatggggtttcaccatgttggccagccctgtcttgaactcctgacctcaagtgatcctcttgcctcagcctcccagagtgctgggattataggaatgagccactatgcggggccctcaggagatatttcttgaatggatgcatggacagctagcaatgcttcatag

SEQ ID NO: 12204 - DNA, 338 bp, Homo sapiens
  AC004963.2_114548
  Located on chromosome 7
  Distance between a terminus base of telomere on chromosomal short arm and 5'-terminus of this base sequence : 71432591
  Distance between 3'-terminus of neighbour sequence of sequence listing upward to telomere on chrosomal short arm and 5'-terminus of this base sequence : 26371
atttaaggtgtaccgtaacatgacgtttttatatactcatatatagtgaattaaatatttaatactatagtcaagcaaattaacacatccatcagctcacatagttacgtgtatgtgtgtgtgtgtgtgtgtgtgtgtgtgtggtaagagcacctaaaatctactctcttagcaagtttcaaatatacagtattaataacttttttaaaaagttgttttgattgctttaggtcctttgcatttctgtgtgaattttgggaccagttaatttctgcaggtggggataaactctacctgtccatcttttaaatgtattgttgaatttgattgctgacatt

SEQ ID NO: 12205 - DNA, 325 bp, Homo sapiens
  AC004963.2_14690
  Located on chromosome 7
  Distance between a terminus base of telomere on chromosomal short arm and 5'-terminus of this base sequence : 71532532
  Distance between 3'-terminus of neighbour sequence of sequence listing upward to telomere on chrosomal short arm and 5'-terminus of this base sequence : 99603
gaatgagatccatctcaataaataaataaataaataaataaataaataaataaataaatattaaaaaaaagagattgggctgcctgccagaggaggctggcctctccttcactggctgggtgctggctgaactgtggcactcataggtccatcttcataggcgagagcagggtttgatgagtgcattcttgggatcacctgaaatagggaagaaattgatgtgacttctctggacttggaggagcctcggtgaaggttggggttgtgcctgtctcctgtctcctgcttggggaattctgagggcaggagtttggtaggcaggaag

SEQ ID NO: 12206 - DNA, 368 bp, Homo sapiens
  AC004963.2_9405
  Located on chromosome 7
  Distance between a terminus base of telomere on chromosomal short arm and 5'-terminus of this base sequence : 71537675
  Distance between 3'-terminus of neighbour sequence of sequence listing upward to telomere on chrosomal short arm and 5'-terminus of this base sequence : 4818
tactttagagccaacagatgtttcttttaagaacataggaaaagagagtgagataaagagactttggctaagcattcttttgatcagccatgaaaagtttgacttttaactgttggtcaaatacaatcatggcatttccaaaaatttttctctaatgagataatgtgtgtgtgtgtgtgagagagagagagagagagagagaatgagagacacacagaaagagaatgtgaatcataggtttccactgacctgttttaattttagagactcatttcagggatgtgcacccacagaaaaatgcctggcatctaagcatagcatgtgccacactgaagaatattctggttcatttcaagctgtactatgct

SEQ ID NO: 12207 - DNA, 478 bp, Homo sapiens
  AC004874.1_8174
  Located on chromosome 7
  Distance between a terminus base of telomere on chromosomal short arm and 5'-terminus of this base sequence : 71614790
  Distance between 3'-terminus of neighbour sequence of sequence listing upward to telomere on chrosomal short arm and 5'-terminus of this base sequence : 76747
tttagagaaggtgaattgaagaggcagaagagatgaggataaaacagcagctcaaaactctggcagcggctgggcgcagtgagtcatgcctgtaatcccagcactttgggaggccaaggctggtggatcacttaaggccaggagtttaagatcagcatggccaacatggcaaaatctcatctctactaaaaatacaaaaattagctgggcatagtgttacacacctgtagttccagctactcaggaagatgaggcacaagaattgtttgaacctgggaggcagagggtgcagtgagccaagattgagccagtgcactcaagcctgggtgacaagagagaaactgcatctcaaacaaacaaacaaacaaacaaagaacataagtaaataaagcctctgtcagaaaacctctctggacagaaagaatagtgcctagaaaaccctaagtttggaatgggcttgatttaggaactgatagca

SEQ ID NO: 12208 - DNA, 273 bp, Homo sapiens
  AC073330.4_101550
  Located on chromosome 7
  Distance between a terminus base of telomere on chromosomal short arm and 5'-terminus of this base sequence : 71888938
  Distance between 3'-terminus of neighbour sequence of sequence listing upward to telomere on chrosomal short arm and 5'-terminus of this base sequence : 273670
cctctaggaaactccactgtacgcttgtaagagagtgaaagtgaataaggcaagtggcgtcatagcataattataaaaatcattttgacctggtagagccctgaaaagctctcaggatccccacaggccacactttgaaaaccacagctgaagaacctaaccaagtccatgtcacttctttggtctccagcctttgtttttatttatttatttatttattttgagacagagtctcactctgttgcccaggctggagtgcaatagcacgatctc

SEQ ID NO: 12209 - DNA, 223 bp, Homo sapiens
  D7S2516
  Located on chromosome 7
  Distance between a terminus base of telomere on chromosomal short arm and 5'-terminus of this base sequence : 71913531
  Distance between 3'-terminus of neighbour sequence of sequence listing upward to telomere on chrosomal short arm and 5'-terminus of this base sequence : 24320
aactgtatgcctgtcctgagtcagttccttggtgggggtcttcagattggttagccattctgctggaattcaggattaaacacacacacacacacacacacacacacacacatacacaccttaagcaattattgggttaaaaggtccagtgttagagattttatctataggaacaatgagggagcaggtagtcagtgtgctacgtgacccttgaatagttagc

SEQ ID NO: 12210 - DNA, 454 bp, Homo sapiens
  chr7.fa.O7frz.73811333
  Located on chromosome 7
  Distance between a terminus base of telomere on chromosomal short arm and 5'-terminus of this base sequence : 71989220
  Distance between 3'-terminus of neighbour sequence of sequence listing upward to telomere on chrosomal short arm and 5'-terminus of this base sequence : 75466
gttcggtaccactaggctatactgcctgccatgtgactttgctttgctgtccctgttctaacatgaaaaccttagatgagagaggaggaggggagtgaggatctgcaggaatatgtctagatacattgctgtggacccttaaatgctaaaggagcagagattcattggtgtgtgtgtgtgtgtgtgtgtgtgtgtgtgcgcgcgcgcgcgcgtgcgcgcacatgcactcaggccctgggaggagcttcattccaaaggaaaaaacaactgctttacaacagccaagtgctgtctcaacctccaacctcctgtcacacttctgcgtctgtctttcaccttaaagtgccaacaaatgtgcactttaaggattctcaaagagtgacgagttctccctgaaatagctcagagagtcctccgtaggctgagaaaatagtctgactcacgtgagattaaa

SEQ ID NO: 12211 - DNA, 277 bp, Homo sapiens
  HUMUT5655
  Located on chromosome 7
  Distance between a terminus base of telomere on chromosomal short arm and 5'-terminus of this base sequence : 72065340
  Distance between 3'-terminus of neighbour sequence of sequence listing upward to telomere on chrosomal short arm and 5'-terminus of this base sequence : 75666
gctgggactacaggtgcctgccaccatgcctggttatgtatgtatgtatgtatgtatgtatgtatgtatgtatgtatgtatgtatgtatctatctatctatctatctatctatctatctatctatctatcgagacagggttttgccatgttgcccaggttgcaggttaaaattcttagccactatttgacttgggaaaaatgacttcactttgtggagcctcagtttcctcatctacatgaaaatggtaacagaacttgtctctcagggccatgcag

SEQ ID NO: 12212 - DNA, 223 bp, Homo sapiens
  D7S1816
  Located on chromosome 7
  Distance between a terminus base of telomere on chromosomal short arm and 5'-terminus of this base sequence : 72065343
  Distance between 3'-terminus of neighbour sequence of sequence listing upward to telomere on chrosomal short arm and 5'-terminus of this base sequence : -274
gggactacaggtgcctgccaccatgcctggttatgtatgtatgtatgtatgtatgtatgtatgtatgtatgtatgtatgtatgtatctatctatctatctatctatctatctatctatctatctatcgagacagggttttgccatgttgcccaggttgcaggttaaaattcttagccactatttgacttgggaaaaatgacttcactttgtggagcctcagtt

SEQ ID NO: 12213 - DNA, 230 bp, Homo sapiens
  AC004905.1_2022
  Located on chromosome 7
  Distance between a terminus base of telomere on chromosomal short arm and 5'-terminus of this base sequence : 72067893
  Distance between 3'-terminus of neighbour sequence of sequence listing upward to telomere on chrosomal short arm and 5'-terminus of this base sequence : 2327
aagataaggcagactggctaactggaggggctgtgtatttgtgtatgtgtgtgcgtgtgtgtgtgtgtgtgtgtgtgcgtgcatgtgtctgttgtttgtgttgacctaaaaattaaacaagataacaaaatcaaaccaaaaacaaacctttcccatcaaaagtgccacaatctttggggtcttattttttttctttattctttattcttccattcatgtagaaggaatag

SEQ ID NO: 12214 - DNA, 369 bp, Homo sapiens
  AC004905.1_80923
  Located on chromosome 7
  Distance between a terminus base of telomere on chromosomal short arm and 5'-terminus of this base sequence : 72146624
  Distance between 3'-terminus of neighbour sequence of sequence listing upward to telomere on chrosomal short arm and 5'-terminus of this base sequence : 78501
tgcatccaatttagaatagtcttcccccaatactttattcccttgtcctacttaaaaaaaaaaacaactttttaagagatggggtcttgctatgttgcccaggctggagtacaatggcacaatcatagctcacttcagcctccaactcctgggctcaagtgatcctcctgcctcagcctctggagtagctgggactatgggcatgccaccatgcccatctaatttgtgtgtgtgtgtgtgtgtgtgtgtgtgtgtgtgtgtgtgtgtttgtaaagacagtgtctcattatgttgcccaggctggtctcaaactactggcttcaagcaatccctccacctccacctccaaagtttccaggattacaggca

SEQ ID NO: 12215 - DNA, 429 bp, Homo sapiens
  AC004905.1_100298
  Located on chromosome 7
  Distance between a terminus base of telomere on chromosomal short arm and 5'-terminus of this base sequence : 72166100
  Distance between 3'-terminus of neighbour sequence of sequence listing upward to telomere on chrosomal short arm and 5'-terminus of this base sequence : 19107
gagcaaaggacatgaacaggctgaggctggagaatggtgtgaacctgggaggcggagcttgcagtgagctgagatggagccactgcactccagcctgggtgacaatgcgagactccgtctcaaaaccaaccaaccaaccaaccaaccaaccaaccaaccaaccaatcaaaaaaaaaaaacatataaatggccaaaactcttatggaaaaaatgttcaacatcactaatcatcagagaaatgcaaattataactacaatgagatactatcttacaccagtcagagtaactattattagtaataaataacagtaaaaaataacaggtattggagaggatgtgaagaaaagcaaatagatggatagaccaatggaacagaatagagaacccaaaaataaagcaacatacctaaagtcaactgagctttgact

SEQ ID NO: 12216 - DNA, 294 bp, Homo sapiens
  AC004905.1_105312
  Located on chromosome 7
  Distance between a terminus base of telomere on chromosomal short arm and 5'-terminus of this base sequence : 72171154
  Distance between 3'-terminus of neighbour sequence of sequence listing upward to telomere on chrosomal short arm and 5'-terminus of this base sequence : 4625
tgttccacttcataaagtatggtccagggaggcactgtgcaaattgctaaatcaatttacttttaaacagaaatgaggtttaaacacacacacacacacacacacacacacaacttaaggaaggcttgatgtgttccatcgcaagcgtctccagaatgctgcactgctctccctgtgaagtcaatattacagattcctgggctgcaaaccagaaggacaaattgggggccatgtgcacagccgcattatttttctcgtttgcaaaggtcagtgattctccatgcatcaactatg

SEQ ID NO: 12217 - DNA, 132 bp, Homo sapiens
  D7S1776
  Located on chromosome 7
  Distance between a terminus base of telomere on chromosomal short arm and 5'-terminus of this base sequence : 72171171
  Distance between 3'-terminus of neighbour sequence of sequence listing upward to telomere on chrosomal short arm and 5'-terminus of this base sequence : -277
tatggtccagggaggcactgtgcaaattgctaaatcaatttacttttaaacagaaatgaggtttaaacacacacacacacacacacacacacacaacttaaggaaggcttgatgtgttccatcgcaagcgtc

SEQ ID NO: 12218 - DNA, 447 bp, Homo sapiens
  AC005011.2_97431
  Located on chromosome 7
  Distance between a terminus base of telomere on chromosomal short arm and 5'-terminus of this base sequence : 72268471
  Distance between 3'-terminus of neighbour sequence of sequence listing upward to telomere on chrosomal short arm and 5'-terminus of this base sequence : 97168
aggcagagttcttagacttgacactaaaatcacagtccatactgggaaaaatcgaaaagctagaccacatcaaaattaaaagcttttgttcttccaaaggttgtaagaagagaatgaaaagataaactacacacttgcagaagacatttgcaaacaacatatctgaccaaggagtagtatacaaaatatataaagaattctcaaaactcaagaacaaaacaaaacaaaacaaaacaaaacaaaaacaactaaccaatttgcaaacaacatatctggccaaggagtagtatacaaaatatataaagacttctcaaaactcaagagcaaaacaaaacaaaacacaaaaacaactaaccaattagaatatgggcaaaagacatcaacagacatttcacagaagaggacatacagatggtaaatgatcactgttaaagattagccatcaga

SEQ ID NO: 12219 - DNA, 303 bp, Homo sapiens
  AC005011.2_51106
  Located on chromosome 7
  Distance between a terminus base of telomere on chromosomal short arm and 5'-terminus of this base sequence : 72314850
  Distance between 3'-terminus of neighbour sequence of sequence listing upward to telomere on chrosomal short arm and 5'-terminus of this base sequence : 45932
attagccaagcatggtataatcccagctacttgggaggctgagacaggagaatcgcatgaacccaggaggtggaggttgcagcgagccacggttgtgccactactgcattccagcctgggtgacagagcaagactccaccacaataaataaataaataaataaataaataaataaataaataaataaatattttgttatttggaaaggaaaaaataaaacatttttaaaactttagaaaagttagacttaaaggtaataggggtaatgatataattagggtgatggtagaattagttaattgg

SEQ ID NO: 12220 - DNA, 392 bp, Homo sapiens
  AC005011.2_3346
  Located on chromosome 7
  Distance between a terminus base of telomere on chromosomal short arm and 5'-terminus of this base sequence : 72362645
  Distance between 3'-terminus of neighbour sequence of sequence listing upward to telomere on chrosomal short arm and 5'-terminus of this base sequence : 47492
cactgatcaatgattgcatactactgcactccagcttgggtaacacagtaagaccctgcctctataaaaaataaaataaaataaaataactctgagcagttcagcccatttggcgcgcacacacacacacacacacacacacacacacacacacagccagtcccaccactgagggcaaactggctccaggccaggtgagcaatcccagaccctcctgcctgccttccattctgtcccctgggaatgtctggatggatccgtgtccaggaaatccaggcgagatccctaatccagggagatgactgttccatgtgtagccggcaaggcacccccgctcccagtgagccacctaatgaaaacctcatgtgtcaacttgagttgcacagacaaac

SEQ ID NO: 12221 - DNA, 427 bp, Homo sapiens
  AC002527.1_41879
  Located on chromosome 7
  Distance between a terminus base of telomere on chromosomal short arm and 5'-terminus of this base sequence : 72499041
  Distance between 3'-terminus of neighbour sequence of sequence listing upward to telomere on chrosomal short arm and 5'-terminus of this base sequence : 136004
gaatcacttctggaagttcagaagtttgagaccaccctgagcaatatagcgagactctgtctctgccaaaaaaactaaaaattagccagtcatggtagcatgctcctgtagtcccagctactagggaggctgaggtgggaggatcacatgagcccaggagttggaggccacagtgagctatgatcacaccaccgcactccagcctggatgacacagtgagactctgtctcaaaaataaataaataaataaataaataagaaaaataaataattttccaaaaagttcaagcagatcaattagagtgtgtccacgccttatagaattcctttaaatactgcattagtattgtcctgggtgcattttaaaaagaatttgctacagggaaatctacattgaaggcaactcctaaagaaatagctccatagt

SEQ ID NO: 12222 - DNA, 244 bp, Homo sapiens
  AC002527.1_52222
  Located on chromosome 7
  Distance between a terminus base of telomere on chromosomal short arm and 5'-terminus of this base sequence : 72509594
  Distance between 3'-terminus of neighbour sequence of sequence listing upward to telomere on chrosomal short arm and 5'-terminus of this base sequence : 10126
aacaagaatgaaactccatctctaaataaataaataaataaataaataaataaataaataaataaagttgagtaaaacaagatcagagatagaattcacttcccagacatcacaccattggctagaggcaatgctgggattttcatccaggtatctgcgactccaaagcccatggtctttctttgctaggctgatgcctcagcaaaactcaaaagaccagttcttctttcaatagcgactgtgc

SEQ ID NO: 12223 - DNA, 431 bp, Homo sapiens
  AC002527.1_75397
  Located on chromosome 7
  Distance between a terminus base of telomere on chromosomal short arm and 5'-terminus of this base sequence : 72532656
  Distance between 3'-terminus of neighbour sequence of sequence listing upward to telomere on chrosomal short arm and 5'-terminus of this base sequence : 22818
tggtgacatgcacctgtagtcctagctactcgggaggccgaggcaggagaatcacttcagcccagaaggtggaggataaagtaagctgagatcacaccactgcactccagcctgggcaacagagcaagaccctgccacacacacacacacacacacacacacacacacagaactaattgtaacatacttctgggtatgacaaagaaacttatgcaagaataaccctcccaccatgtgccataagccaggcacaataaaactgaaccaaatatatgaggcaactgttttcaggcaaatgacaacaggcagcacaagattacaattgcaaggagaagggaaattcacatgacaagccccatgctcgccctggctctctgcctggggacaatttcccaaccacaattcacgtagtagctgcacgaactagaatc

SEQ ID NO: 12224 - DNA, 129 bp, Homo sapiens
  D7S2415
  Located on chromosome 7
  Distance between a terminus base of telomere on chromosomal short arm and 5'-terminus of this base sequence : 72532773
  Distance between 3'-terminus of neighbour sequence of sequence listing upward to telomere on chrosomal short arm and 5'-terminus of this base sequence : -314
aacagagcaagaccctgccacacacacacacacacacacacacacacacacagaactaattgtaacatacttctgggtatgacaaagaaacttatgcaagaataaccctcccaccatgtgccataagcc

SEQ ID NO: 12225 - DNA, 138 bp, Homo sapiens
  D7S672
  Located on chromosome 7
  Distance between a terminus base of telomere on chromosomal short arm and 5'-terminus of this base sequence : 72661609
  Distance between 3'-terminus of neighbour sequence of sequence listing upward to telomere on chrosomal short arm and 5'-terminus of this base sequence : 128707
acatgaaggtctaccagtagcctcttcaagtgaaggatctcactgctcctcttgggggatcttggagagcacccattctctctcacacacacacacacacacacacacacacacacacaccttgctccaaccaaagtg

SEQ ID NO: 12226 - DNA, 180 bp, Homo sapiens
  Z67406
  Located on chromosome 7
  Distance between a terminus base of telomere on chromosomal short arm and 5'-terminus of this base sequence : 72719683
  Distance between 3'-terminus of neighbour sequence of sequence listing upward to telomere on chrosomal short arm and 5'-terminus of this base sequence : 57936
cagcctggcaacagaggaaggccatgtttctagaaacaatatatatatatatgtgtgtgtgtgtgtgtgtgtgtgtgtgtgtgtgtgtgtgtacataggtgtgtatatataatacacacatatatatttatgcacatatattatatatatattttttctctcaatgaatcccctatctcc

SEQ ID NO: 12227 - DNA, 330 bp, Homo sapiens
  AC008576.6_278894
  Located on chromosome 7
  Distance between a terminus base of telomere on chromosomal short arm and 5'-terminus of this base sequence : 72759219
  Distance between 3'-terminus of neighbour sequence of sequence listing upward to telomere on chrosomal short arm and 5'-terminus of this base sequence : 39356
tggagctcaagagttcgaggctgcagtgagctatgattgtgccactgcactccagcctgggggacagagaaagaccctgtctcaaaaataataataataataataataagattgttcctctccatatggtcctccccaagggctgtgtgagtgcccttatggcatgatagctggcttccccaaaataacacctgtaagctgcaacgcctgcatgacctggtcttggaaatcaccccctattacttccactttcttctgtgagccacacagccagctcaatccaatgagggagggacccacacaagtgcatgaattctaggaggcaagaat

SEQ ID NO: 12228 - DNA, 423 bp, Homo sapiens
  AP000425.2_57824
  Located on chromosome 7
  Distance between a terminus base of telomere on chromosomal short arm and 5'-terminus of this base sequence : 72930027
  Distance between 3'-terminus of neighbour sequence of sequence listing upward to telomere on chrosomal short arm and 5'-terminus of this base sequence : 170478
caatggagtcaacagataacagtgaacaaaaataaaatgaagtgttccttcagccactggaccaggtcggggtctccccacatctcgtgatgtggttcacgtgttaggaggagaaatgaatgatgatatatcccttcaggtttttaatatagatagatagatagatagatagatagatagatagatagatagataaatttttttccttttttcacaagctccaaagctagaaaaatatcacatcagaaagattctaaaactggtagagaaaaagctaacaaactctaagagctgctcaaattttatttacatgatttttaacatttctaacaggcaaaacacatttttccccccagtgtgtggaagggaaggtgcaaatggctgaatataaatggtatttatttcaatccaatatctcagact

SEQ ID NO: 12229 - DNA, 101 bp, Homo sapiens
  DISD22_0005162
  Located on chromosome 7
  Distance between a terminus base of telomere on chromosomal short arm and 5'-terminus of this base sequence : 73689101
  Distance between 3'-terminus of neighbour sequence of sequence listing upward to telomere on chrosomal short arm and 5'-terminus of this base sequence : 758651
ataccttctgccaatccatagagacccctctctctgtacatacatacacacacacacacacacacacacacccttataccctctgacgaacctttctgatt

SEQ ID NO: 12230 - DNA, 241 bp, Homo sapiens
  Z67541
  Located on chromosome 7
  Distance between a terminus base of telomere on chromosomal short arm and 5'-terminus of this base sequence : 73775297
  Distance between 3'-terminus of neighbour sequence of sequence listing upward to telomere on chrosomal short arm and 5'-terminus of this base sequence : 86095
ctcagcagagggacttcacccacggcgaccgctaagccagtgtgtgtgtgtgtgtgtgtgtgtgtgtgtgtgtgtgtgtccaggaggcaaacactctagaaagagacagaaatgtcaaatgtcagcagataaataacaatatataatatatataatataaatattgtaataaaccaaaaagtgtttcatcttatatatgtgatattctttaattcccaaccattcaaactgaaagtgcagc

SEQ ID NO: 12231 - DNA, 176 bp, Homo sapiens
  AF156673.1_25091
  Located on chromosome 7
  Distance between a terminus base of telomere on chromosomal short arm and 5'-terminus of this base sequence : 74030949
  Distance between 3'-terminus of neighbour sequence of sequence listing upward to telomere on chrosomal short arm and 5'-terminus of this base sequence : 255411
caggagtcagttagataaggtcaccccaaacccagaacccactgcagggtcaagtgtgtgtgtgtgtgtgtgtgtgtgtgtgtgtgtgtgtgtttgtgtcttcacccccaaccccatcccccagagatagaatcgtgctatgttgcccaggctggtctcaaacttctggcctcaag

SEQ ID NO: 12232 - DNA, 143 bp, Homo sapiens
  DISO7_00036665
  Located on chromosome 7
  Distance between a terminus base of telomere on chromosomal short arm and 5'-terminus of this base sequence : 74080549
  Distance between 3'-terminus of neighbour sequence of sequence listing upward to telomere on chrosomal short arm and 5'-terminus of this base sequence : 49424
agtctgctaccttggacagacacctgttcatggccagcgccaggacccagagtcagcgtgtgtgtgtgtgtgtgtgtgtgtaaaggaagtggggcttgagccaccaccacattgactggctctgcaactgggcatgatactga

SEQ ID NO: 12233 - DNA, 400 bp, Homo sapiens
  DISO7_00036655
  Located on chromosome 7
  Distance between a terminus base of telomere on chromosomal short arm and 5'-terminus of this base sequence : 74155936
  Distance between 3'-terminus of neighbour sequence of sequence listing upward to telomere on chrosomal short arm and 5'-terminus of this base sequence : 75244
ggaacagacttgttcctggagcatggttgtgggggctggggaatgggaagggcggctgacccaggctgcatggctgtgtgtgtatgtgtatgtgtgtgtatctgtgtgtctgtgaatctgtgtgtgtgtctgtgaatctgtgtgtgtctgtgtctgtgtatctgtatgtctgtgtgtctgtgtatctgtgtatgtctgtgtgtgtatgtgtgtgtgtctgtgtatctgtgtgtctgtgtgtgttctgtttgtgtatctgtgtgtgtctgtgtgtctgtgcatgtctgtgtatctgtgtgtgtgtgtctgtgtatctgtgtgtgtgtctgtgtgtgtgtctgtgtgtgtgtgtagttgagattctcttgttgttgctttcttgggtctggcaggcttattc

SEQ ID NO: 12234 - DNA, 343 bp, Homo sapiens
  DISO7_00036644
  Located on chromosome 7
  Distance between a terminus base of telomere on chromosomal short arm and 5'-terminus of this base sequence : 74380499
  Distance between 3'-terminus of neighbour sequence of sequence listing upward to telomere on chrosomal short arm and 5'-terminus of this base sequence : 224163
ggattccagttgtcccaggtgctgggatcccaggtgctgcggttccaggtgagctgggctgtgtgtgtgtgtgtgtgtgtgtgtgtgtgtgtgtgtgtattagagagaaatattgagactattgccaaaatttttgcattctccctaacaccataaccatctgcccatacccttgaccacgtctcatcccctcatcttctcttccttgggctataccaatctccttattagcttctaatcagtatcatattttccaattgaccttctggctatcagtgttctctggggggcaggaaccgtgtctttttcaactccatgttcctagcccttagctgagtaggtg

SEQ ID NO: 12235 - DNA, 107 bp, Homo sapiens
  HUMUT623
  Located on chromosome 7
  Distance between a terminus base of telomere on chromosomal short arm and 5'-terminus of this base sequence : 74484352
  Distance between 3'-terminus of neighbour sequence of sequence listing upward to telomere on chrosomal short arm and 5'-terminus of this base sequence : 103510
cctccctccctaatccatgcccaaggggcgattttttatttatttatttatttatttatttatttatttatttttgagacagagtttggcttttgttacccaggctg

SEQ ID NO: 12236 - DNA, 121 bp, Homo sapiens
  DISD22_0005171
  Located on chromosome 7
  Distance between a terminus base of telomere on chromosomal short arm and 5'-terminus of this base sequence : 74789095
  Distance between 3'-terminus of neighbour sequence of sequence listing upward to telomere on chrosomal short arm and 5'-terminus of this base sequence : 304636
aggaaagcctcagtgctcttcctggcacacagtagatgctcaggaagtatctgttgaatgaatgaatgaatgaatgaatgaatgaatgaatgcatggacaaagcaattctttggcagtctg

SEQ ID NO: 12237 - DNA, 314 bp, Homo sapiens
  AC005231.2_71608
  Located on chromosome 7
  Distance between a terminus base of telomere on chromosomal short arm and 5'-terminus of this base sequence : 75170634
  Distance between 3'-terminus of neighbour sequence of sequence listing upward to telomere on chrosomal short arm and 5'-terminus of this base sequence : 381418
cttgcagacagttgatctgataacccagacggctcccaagtgactaacgggtgggtggcgtctaccgtagttccccctcttatctgcagtttcgctttctgcagtttcagttacccacggtcaaccgcggtccaaaaatagctgagttcagtacaagaagatatttttgagagagaggcagagacagaccacagtcacataacttttattacggtatattgttatagatgttagaacaattccatatatatatatatatatatatgtatatatatatatatatataaaatatagacaacctatagctttgcaac

SEQ ID NO: 12238 - DNA, 159 bp, Homo sapiens
  AC005231.2_54222
  Located on chromosome 7
  Distance between a terminus base of telomere on chromosomal short arm and 5'-terminus of this base sequence : 75188157
  Distance between 3'-terminus of neighbour sequence of sequence listing upward to telomere on chrosomal short arm and 5'-terminus of this base sequence : 17209
tttgtcctgagctcagttctataggaagcgtgtgtgtatatgtgtgaatgtgtgtgtatatgtgtgaatgtgtgtatgcatgtgtgaatgtgtgtatgtatgagtgtgtgtgtgtgtgtgtgtgtgtggtttacgtacttattgctaagcttcgaattt

SEQ ID NO: 12239 - DNA, 99 bp, Homo sapiens
  D7S2472
  Located on chromosome 7
  Distance between a terminus base of telomere on chromosomal short arm and 5'-terminus of this base sequence : 75352178
  Distance between 3'-terminus of neighbour sequence of sequence listing upward to telomere on chrosomal short arm and 5'-terminus of this base sequence : 163862
tctaaagtctgccaggctacacacacacacacacacacacacacacacacacacacacacacacagttttttttttttttggagatggagtctcgctgc

SEQ ID NO: 12240 - DNA, 394 bp, Homo sapiens
  AC005015.2_86277
  Located on chromosome 7
  Distance between a terminus base of telomere on chromosomal short arm and 5'-terminus of this base sequence : 75399943
  Distance between 3'-terminus of neighbour sequence of sequence listing upward to telomere on chrosomal short arm and 5'-terminus of this base sequence : 47666
gataaactttcaagtaaagaggactgaaataaaagaaagaaagaaggaaggaaagaaagaacaaacgaaagaaagaaagaaagaaagaaagaaagaaagaaagaaagaaagaaagaaagaaaaacagctttatttatttatttattatttatttatttgagacagggtctcgctctgtcatccaggctggagggcagtggcatgatcatggctcactgcagcctcggcctcctggactcaggtgatcctcccacgtcagcctccccagtagctgggattacagacatgtgccgccatgcctggggtttcaccatgttgcccaggctggtctcgaactcctaagctcaagcaatcctcccgcctcgacctcccaaagtgccagattacaggtgtg

SEQ ID NO: 12241 - DNA, 478 bp, Homo sapiens
  AC005015.2_93806
  Located on chromosome 7
  Distance between a terminus base of telomere on chromosomal short arm and 5'-terminus of this base sequence : 75407308
  Distance between 3'-terminus of neighbour sequence of sequence listing upward to telomere on chrosomal short arm and 5'-terminus of this base sequence : 6971
gtctaggcatttggaatatgtaagctcgccgtgtggtttacattctagattcttttatttttaatgtttttatttagagacaaggcttcactctgttgcccaggctgcagtgagttgacatgattatagctcactgcagcctccaattcctgggcttaagcgatcctccaacctcagcttccagagtagctgggactataggcatgtgccaccatgcctggctaattaaaaaacaaacaaacaaacaaacaaacaaacaaaaaaccacatttgtttatagagatgggatcttgctatgttgcccaggctggtctataactcctgtgctcaagtgatcctcccatctcagcttcccaaagtgctgggattacaagtgtgagccactgggcccagccatcatgctactttttttgcatagctcacactaaataaagatcatcaccatatccaggtttcttctatccataatgcttacaat

SEQ ID NO: 12242 - DNA, 345 bp, Homo sapiens
  AC005015.2_116962
  Located on chromosome 7
  Distance between a terminus base of telomere on chromosomal short arm and 5'-terminus of this base sequence : 75430544
  Distance between 3'-terminus of neighbour sequence of sequence listing upward to telomere on chrosomal short arm and 5'-terminus of this base sequence : 22758
ttaagatggattcgtatcttacactttttcagtcttaattctaatatggtaaatatagaataaacaaacaaaagctctttggggatcctcaataatttttaggagtttaaaggggtccctgagaccaaacattttggggaggcattaatcctttctttctttctttctttctttctttctttctttctttctttctttctttctttctttcttctttctttctttttctttctttctttctctctctctctcttttctttctttctttctttcttttttttttttaaagagacagggttttgctctattgccccggctggagtgcagtggtatgccatagctgac

SEQ ID NO: 12243 - DNA, 154 bp, Homo sapiens
  DISO7_10017887
  Located on chromosome 7
  Distance between a terminus base of telomere on chromosomal short arm and 5'-terminus of this base sequence : 75735974
  Distance between 3'-terminus of neighbour sequence of sequence listing upward to telomere on chrosomal short arm and 5'-terminus of this base sequence : 305085
aaccctcacctggcatagggaaaatccaagtgtgagagagagagagagagagagagagagagagagagagagagagagagagtgtgtgtgtgtgtgtgtgtgtgtatgtgtgtgtgtgtgtgattccctcttttaccttccaaggccttcaact

SEQ ID NO: 12244 - DNA, 375 bp, Homo sapiens
  chr7.fa.O7frz.75474642
  Located on chromosome 7
  Distance between a terminus base of telomere on chromosomal short arm and 5'-terminus of this base sequence : 75955863
  Distance between 3'-terminus of neighbour sequence of sequence listing upward to telomere on chrosomal short arm and 5'-terminus of this base sequence : 219735
gacctctactgctaatacaaacatgagctgggcatggtggcaggcgcctgtaatcccagctactcaggaggctgaggcaggagaactgcttgaacccaggaggtggagactgtattgagctaagattgcaccactgcactccagcctgggcaacagagccagactatttcaattaaaaataaataaataaataaataaataaataaataaataaataaataaatacatgaagcaacgatccaatcaatcaaaccaacaaattctggaaaggtagagaagagaagggctgacccagtggtgagttcccagggtggtttgatggtttgttctttggcctcctatataccctgtcttatctgttacagcggagtctac

SEQ ID NO: 12245 - DNA, 336 bp, Homo sapiens
  AC004491.1_3911
  Located on chromosome 7
  Distance between a terminus base of telomere on chromosomal short arm and 5'-terminus of this base sequence : 76082461
  Distance between 3'-terminus of neighbour sequence of sequence listing upward to telomere on chrosomal short arm and 5'-terminus of this base sequence : 126223
tcatcctgattacgttgcttacatggcagaggagggggaaaccagctctctcttgtttctctctctttttttattttttagagacatggcctcactgttgcccacgctggagtgcagtggcatgatcatcactcactgcagcctcgaattcctgggctcaagtgatcctccacctcagcctcctcagtagctggtactacaggcatacaccaccatgcgggctaatttgtgtgtgtgtgtgtgtgtgtgtgtgtgtgtgtgtgtgtgtgtgtgtgtgtttagtagagatggggtttcgccacattggccaggctggtcttgaactcctgacctcag

SEQ ID NO: 12246 - DNA, 241 bp, Homo sapiens
  AC004491.1_43006
  Located on chromosome 7
  Distance between a terminus base of telomere on chromosomal short arm and 5'-terminus of this base sequence : 76121716
  Distance between 3'-terminus of neighbour sequence of sequence listing upward to telomere on chrosomal short arm and 5'-terminus of this base sequence : 38919
tagtgagctatgactgcgttactgcactccagcctgggcaacagagcaagattgtcaaataaataattatctatctatctatctatctatctatctatctatctatctatctatatattttttaaaggaaattggctgggtgtggtggctcacgcctgtaatcctagcactttgggaagctaaggcgggcagatcacctgaggtcaggagtttgagaccagcctgaccaacatggtgaaag

SEQ ID NO: 12247 - DNA, 192 bp, Homo sapiens
  AC004491.1_47043
  Located on chromosome 7
  Distance between a terminus base of telomere on chromosomal short arm and 5'-terminus of this base sequence : 76125790
  Distance between 3'-terminus of neighbour sequence of sequence listing upward to telomere on chrosomal short arm and 5'-terminus of this base sequence : 3833
cataaggttcaacctagtgcatgcacacaaacacacacacacacacacacacacacagaaaagtctgtaagaacctacactaaattgttaacagtagttttagatggtggaaaaatatttgatctttattttctttataccttttcatattttctgaaaagtggcagaagtttaacatttctgtggattacc

SEQ ID NO: 12248 - DNA, 144 bp, Homo sapiens
  D7S2490
  Located on chromosome 7
  Distance between a terminus base of telomere on chromosomal short arm and 5'-terminus of this base sequence : 76239214
  Distance between 3'-terminus of neighbour sequence of sequence listing upward to telomere on chrosomal short arm and 5'-terminus of this base sequence : 113232
agcacccggcatagatgtattttttaaaagttatttgaaactcggagtaatgaatggcacctttaggcctaacaatttggtgattcgtgtgtgtgtgtgtgtgtgtgtgtgtgttgtaaatttggccaggtgcggtggcttaca

SEQ ID NO: 12249 - DNA, 176 bp, Homo sapiens
  AC004491.1_160523
  Located on chromosome 7
  Distance between a terminus base of telomere on chromosomal short arm and 5'-terminus of this base sequence : 76239245
  Distance between 3'-terminus of neighbour sequence of sequence listing upward to telomere on chrosomal short arm and 5'-terminus of this base sequence : -113
tatttgaaactcggagtaatgaatggcacctttaggcctaacaatttggtgattcgtgtgtgtgtgtgtgtgtgtgtgtgtgttgtaaatttggccaggtgcggtggcttacacctgtaatctcagcgctttgggaggctgaggcaggcggatcgtttgagctctgaactttgaaa

SEQ ID NO: 12250 - DNA, 141 bp, Homo sapiens
  D7S2518
  Located on chromosome 7
  Distance between a terminus base of telomere on chromosomal short arm and 5'-terminus of this base sequence : 76247490
  Distance between 3'-terminus of neighbour sequence of sequence listing upward to telomere on chrosomal short arm and 5'-terminus of this base sequence : 8069
tttgataaaaacaagcaaaagaaaaatcccatatagctgtatatatccttttgtatgtgaaagaatacacacacacacacacacacacacacacacacacacacaaggcatggaaggatataatcccagatgctagttttg

SEQ ID NO: 12251 - DNA, 364 bp, Homo sapiens
  HUMUT533B
  Located on chromosome 7
  Distance between a terminus base of telomere on chromosomal short arm and 5'-terminus of this base sequence : 76288889
  Distance between 3'-terminus of neighbour sequence of sequence listing upward to telomere on chrosomal short arm and 5'-terminus of this base sequence : 41258
taatctcccatcccacagattgcctttctacgtcttacggttctccctccctccctccctcccttccttccttccttccctccattcctccctacctctctttctttctttcccttcttttcttccttcttccccagctctctccctccttttctctttctttttctttctttctttctctctctctctttctgtctctctcccttccttccttccttccttcctttctttctttctttctttctttctttctttctttctttcttccttccttccttccttccatcctccctccctccctccctccatacctctttctctctctttcttttctttttcttttctttgcagtggtgcaatcata

SEQ ID NO: 12252 - DNA, 358 bp, Homo sapiens
  AC005102.1_41033
  Located on chromosome 7
  Distance between a terminus base of telomere on chromosomal short arm and 5'-terminus of this base sequence : 76324983
  Distance between 3'-terminus of neighbour sequence of sequence listing upward to telomere on chrosomal short arm and 5'-terminus of this base sequence : 35730
gctccaaatgcactagttgtatcattccttaaaaatcttccagggaaggtaccatcacttccctcccaactccctgccatccccacccccaacacacacacacacacacacacacacacacacacacccctaatcaggcctctcattttgttgattttacctatttaacacctcccagatccacctgttcctttttggcccgttccactgcctccccactcacctttctccaatctgttctgtgcacagctgcaaaacaaacgcccctcctaaaatgcacaccagcctggtcaccccctgcctaaaacttttcaccagtgctccatcaccaacacccaaacttcatccactcgctcat

SEQ ID NO: 12253 - DNA, 399 bp, Homo sapiens
  AC005067.2_25073
  Located on chromosome 7
  Distance between a terminus base of telomere on chromosomal short arm and 5'-terminus of this base sequence : 76430137
  Distance between 3'-terminus of neighbour sequence of sequence listing upward to telomere on chrosomal short arm and 5'-terminus of this base sequence : 104796
tatccatacgatgaaatgttactcaggcatgaagaggaatgaagggcttttatgcatgccacaacgtggatggaccttgaagacattattctaagtgaaagaaaccagttacaaagggccacttattgtgtgattttatttatttatttatttatttatttatttatttatttatttatttgagacacagtctccctctctcacgcaggctataatgcagtggtgcagtcttggctcactgcaacctccacctcccaggttcaagcgattctcctgccttagcctcccgagtagctgggattacaggcgcctgtcatcacacccgactaatttttttgtatttttagtagagacggggtttcaccacgttggacaggttggtctcgaactcctgtcctc

SEQ ID NO: 12254 - DNA, 262 bp, Homo sapiens
  AC005067.2_22285
  Located on chromosome 7
  Distance between a terminus base of telomere on chromosomal short arm and 5'-terminus of this base sequence : 76432929
  Distance between 3'-terminus of neighbour sequence of sequence listing upward to telomere on chrosomal short arm and 5'-terminus of this base sequence : 2393
agtgatcaatagcaggaaattaacattgatatcctgtgttgtctaatcatagagtttctttacattttgccgttaatatcttttacatcagaaaaaatatgtttttttcctggtccaagacctcagagtgtgtgtgtgtgtgtgtgtgtgtgtgtgtgtgtgtgtgtgtgtgtgtgtcttagatcactcagtctttgtttatctttcatggccttaacatttttgaaaatgtgaggccgtgtctttgtcaacgtctcacagt

SEQ ID NO: 12255 - DNA, 372 bp, Homo sapiens
  AC005067.2_20787
  Located on chromosome 7
  Distance between a terminus base of telomere on chromosomal short arm and 5'-terminus of this base sequence : 76434396
  Distance between 3'-terminus of neighbour sequence of sequence listing upward to telomere on chrosomal short arm and 5'-terminus of this base sequence : 1205
tctcgaatcctgacctcaggtgatctgcccccgtcggcctcccaaagtgctgggattataggcttgagccactgcgcctggctggagggaccggttttttaattgagagggttggtacttctcccttcctgcctttttccaagggctgctcggggcttgtgtgtgtgtgtgtgtgtgtgtgtgtgtgtgtgtgtgtgtgtgtgtgtgtttcaaagacagagatctgtatttattaactcaggtcagacacttgggatttttcaccaggcatcatcaccaatcagccagctcagattaattaatattaatttggttggtctgttcccaggcccttggtgtgcaggcactttctgtcattaagtccttgtgacc

SEQ ID NO: 12256 - DNA, 465 bp, Homo sapiens
  AC005077.3_122932
  Located on chromosome 7
  Distance between a terminus base of telomere on chromosomal short arm and 5'-terminus of this base sequence : 76657431
  Distance between 3'-terminus of neighbour sequence of sequence listing upward to telomere on chrosomal short arm and 5'-terminus of this base sequence : 222663
cagtggctcaagtctgtaataccagcactttgggagtccgaggcgggcggatcacaaactcaggagttcaagaccagcctggccaataatggtaaaactccgtctctactaaaaatgcaaaaatcaacggggcatgttggtgggtgcccgtattcccagctactcgggaggtttaaagaattgcttaaagccgggaggtggagattgcagtgagctgagatcacgccactgccctccagcctgggcgacagagcaagactccttctcaaaacaacaacaacaacaacaacaacaacaacaaaataaaataactcaaacttaattaaatataaccctaatggtgaatgaatatttgtcaacaataacaaagatatattactcagaacagagataagagtccaacaagaatccaagagtcttactttttaaacacaaaacaaatcctttcctttgcaagtaatatcc

SEQ ID NO: 12257 - DNA, 386 bp, Homo sapiens
  chr7.fa.O7frz.76185023
  Located on chromosome 7
  Distance between a terminus base of telomere on chromosomal short arm and 5'-terminus of this base sequence : 76666290
  Distance between 3'-terminus of neighbour sequence of sequence listing upward to telomere on chrosomal short arm and 5'-terminus of this base sequence : 8394
tggtgaatgccgtctatactaaaaataaaaaattagccgggcgtggtggcgggcacatgtaataccagctattcgggaggctgaggcagaggcagagaattgcttgaacccggggggcggcggctgcagtgagccgagatcgcgccactgcactccagcctgggcgacagaccgagactccaactaaaaaaaaaaaaatatatatatatatatatatatatatatatatatatttggagcccgggaggttgaggttaccgtgagctgagattacgccactgcacttcagcctgggtgacagagggagaccatgtctctaaaaaaaattacatgtgagtgagagcttttcttccagtgctcatgctcagactgaagaaagtaattgg

SEQ ID NO: 12258 - DNA, 238 bp, Homo sapiens
  D7S2470
  Located on chromosome 7
  Distance between a terminus base of telomere on chromosomal short arm and 5'-terminus of this base sequence : 76908195
  Distance between 3'-terminus of neighbour sequence of sequence listing upward to telomere on chrosomal short arm and 5'-terminus of this base sequence : 241519
gacaatttcccatctgaccagtgggaaatggttgcctctctctctctctctctctctgtctcacacacacacacacacacacacacacacacacacatgcatgcacacgcacacacacacaaacactccagcaaaagtgaaggattcatacctgggggaatgttctgggctctttctgtcccttcttctacagtcaatccaagatcgaatcactttgtctgcccctggaagtttagga

SEQ ID NO: 12259 - DNA, 435 bp, Homo sapiens
  AC006972.2_3401
  Located on chromosome 7
  Distance between a terminus base of telomere on chromosomal short arm and 5'-terminus of this base sequence : 77454333
  Distance between 3'-terminus of neighbour sequence of sequence listing upward to telomere on chrosomal short arm and 5'-terminus of this base sequence : 545900
acctgataagaatcccagttctaccacccatgtgtaggccctcaccaaatttttctgcaactctctagggtttaatttctaatatttttttctctatatcctccttcttgactctgcacctgctattttcaattacagcccatccacctcacttgttgtgtgagcgcacacacacacacacacacacacacacacacacaccacatcacagagtattctgtgatggtggtgtcccagatgatttggggaatcacaggaagggaaagtgagtccttcctgtataaataactgcatacatactttctgttttttctcttgtctcttcttacctattcagagccacctaccaaattctttttatgttttatgcacatgaattttatccactcctaggacataaaacttctttatttctactctaagcaatacgccaaa

SEQ ID NO: 12260 - DNA, 267 bp, Homo sapiens
  AC006384.2_31392
  Located on chromosome 7
  Distance between a terminus base of telomere on chromosomal short arm and 5'-terminus of this base sequence : 77553347
  Distance between 3'-terminus of neighbour sequence of sequence listing upward to telomere on chrosomal short arm and 5'-terminus of this base sequence : 98579
aaagactgtcctagaatttgatttttctctgggataaactttccatattatgcaatcatgtttgccaccagattttatgcagtaacttggagtttattttacttttgtatatcaaataatcaactgaaagattgcttgctaacattttccctcccactcagctagaaggattgatgtattgttttgttttgttttctgctttttctgtttgtttgtttgtttgtttgttttgcaaagagaggtgtgtaggcactttactagctccac

SEQ ID NO: 12261 - DNA, 267 bp, Homo sapiens; identical to SEQ ID NO: 12260
  AC006972.2_102456
  Located on chromosome 7
  Distance between a terminus base of telomere on chromosomal short arm and 5'-terminus of this base sequence : 77553347
  Distance between 3'-terminus of neighbour sequence of sequence listing upward to telomere on chrosomal short arm and 5'-terminus of this base sequence : -267

SEQ ID NO: 12262 - DNA, 101 bp, Homo sapiens
  DISD22_0005197
  Located on chromosome 7
  Distance between a terminus base of telomere on chromosomal short arm and 5'-terminus of this base sequence : 77703881
  Distance between 3'-terminus of neighbour sequence of sequence listing upward to telomere on chrosomal short arm and 5'-terminus of this base sequence : 150267
ctcattgtggttacagaaacttccaattgaagacactgagctgaaccattccgcccgcccgcccgcctgcccgcccgagggcactccaggtctgatctttg

SEQ ID NO: 12263 - DNA, 156 bp, Homo sapiens
  DISO7_10002305
  Located on chromosome 7
  Distance between a terminus base of telomere on chromosomal short arm and 5'-terminus of this base sequence : 78153839
  Distance between 3'-terminus of neighbour sequence of sequence listing upward to telomere on chrosomal short arm and 5'-terminus of this base sequence : 449857
ttggtgctactccatcctaacaaataaaaagctgaacagactgaaaaatcaattacatatgcttaggtacacacacacacacacacacacacactcacacacacatatatgcttctatatgagtaaaattaatgacagcaatgatataattggcag

SEQ ID NO: 12264 - DNA, 444 bp, Homo sapiens
  chr7.fa.O7frz.77940909
  Located on chromosome 7
  Distance between a terminus base of telomere on chromosomal short arm and 5'-terminus of this base sequence : 78250813
  Distance between 3'-terminus of neighbour sequence of sequence listing upward to telomere on chrosomal short arm and 5'-terminus of this base sequence : 96818
ttcctcttcctatttgaaagatatttttgatggatataggattcttggttgacaggtatgtgtgtgtgtgtgtgtgtgtgtgtgtctgttttttcttcactttaaatgtgtcagccactgccttctcccttccattattttagatgagaagttactcttatgtgattcccttgtacataataagctgtggttttttgttttgctttttgctgctttggagatttatctttatctttggctttcagcagtttgtgatgtatctgaatgtgaatatctttttgttgattctacttgggattctttgagctcctgaatatgttttcatcccatttgcaaagttttttatttctttaagtttgttttctgttctctttttctctagttctcccattacttgtaatttagtgggattaatgtcctccatttctgtgacaatctgtttgt

SEQ ID NO: 12265 - DNA, 316 bp, Homo sapiens
  chr7.fa.O7frz.78055322
  Located on chromosome 7
  Distance between a terminus base of telomere on chromosomal short arm and 5'-terminus of this base sequence : 78403254
  Distance between 3'-terminus of neighbour sequence of sequence listing upward to telomere on chrosomal short arm and 5'-terminus of this base sequence : 151997
tgttaaggttgaagctaattctagggatggtacttcctatttggaatatttgattctgaaaccaatcagaaacaatgcaaacaacatttatacaaaatgttctatttcacacacacacacacacacacacacagaggtcgatatagtcgttgtgcaactaaacctagtatataatttgagagccaagtaaatatattccccacgacagcttccaaagttccacatccaagagacaaagcacaacataaccagaatttgtcaagaaagaacagtgagtcatggtgccacatgagttgagaatttacaagtctgaaag

SEQ ID NO: 12266 - DNA, 254 bp, Homo sapiens
  AC004955.2_102489
  Located on chromosome 7
  Distance between a terminus base of telomere on chromosomal short arm and 5'-terminus of this base sequence : 78729072
  Distance between 3'-terminus of neighbour sequence of sequence listing upward to telomere on chrosomal short arm and 5'-terminus of this base sequence : 325502
actgagtttgaaatgtaggcaggtaccttatattagagttttgttatcagatagaactcaaaattagtggtgagtcagtggtaagggttaaaaataactgctcgacatagaagggattctgtttgtgtgtgtgtgtgtgtgtgtgtgtgtgtgtgtgtgtgtgtgtgtatgtatgtgtatgtgtatgtgtgtctgcctgcctgtgtggaggggacccttttagaactctccttacagtggcagatagcagtagt

SEQ ID NO: 12267 - DNA, 311 bp, Homo sapiens
  AC004955.2_69468
  Located on chromosome 7
  Distance between a terminus base of telomere on chromosomal short arm and 5'-terminus of this base sequence : 78762040
  Distance between 3'-terminus of neighbour sequence of sequence listing upward to telomere on chrosomal short arm and 5'-terminus of this base sequence : 32714
ggactcagcatatggttgtacttatggctatgatttgttatagtgaaggaggacaggcatggtggctcacagctcttatcccagcattttggggagctggggccggaggattgcttgagcctgggagtacgagaccagcctgggcaacgtggcaagaacccatctttaaaaaaaaaaaaaaaaatacacacacacacacacacacacacacacacacacacggcaagaatccatctttaaaaaaatatacagacacacagtgaaaggatacaaagtaaaatcaacaagaaaaatagcacttggtgcaattt

SEQ ID NO: 12268 - DNA, 202 bp, Homo sapiens
  D7S2455
  Located on chromosome 7
  Distance between a terminus base of telomere on chromosomal short arm and 5'-terminus of this base sequence : 78762153
  Distance between 3'-terminus of neighbour sequence of sequence listing upward to telomere on chrosomal short arm and 5'-terminus of this base sequence : -198
cttgagcctgggagtacgagaccagcctgggcaacgtggcaagaacccatctttaaaaaaaaaaaaaaaaatacacacacacacacacacacacacacacacacacacggcaagaatccatctttaaaaaaatatacagacacacagtgaaaggatacaaagtaaaatcaacaagaaaaatagcacttggtgcaatttctga

SEQ ID NO: 12269 - DNA, 203 bp, Homo sapiens
  D7S675
  Located on chromosome 7
  Distance between a terminus base of telomere on chromosomal short arm and 5'-terminus of this base sequence : 78935897
  Distance between 3'-terminus of neighbour sequence of sequence listing upward to telomere on chrosomal short arm and 5'-terminus of this base sequence : 173542
ttgctgtccaggtgcctgtgattcatggtgtttgggttgatctaagaaaatagcattaactctggttttatgaaatgaatattacatgcatgaattgtaaatatcagaaggtagatttgtgtgtctgtgtgtgtgtgtgtgtgtgtgtgtgtgtgtaatactaaaaagtataatttcttcctatacggtaatactttaattcc

SEQ ID NO: 12270 - DNA, 170 bp, Homo sapiens
  AC004990.1_19476
  Located on chromosome 7
  Distance between a terminus base of telomere on chromosomal short arm and 5'-terminus of this base sequence : 78935983
  Distance between 3'-terminus of neighbour sequence of sequence listing upward to telomere on chrosomal short arm and 5'-terminus of this base sequence : -117
tgcatgaattgtaaatatcagaaggtagatttgtgtgtctgtgtgtgtgtgtgtgtgtgtgtgtgtgtgtaatactaaaaagtataatttcttcctatacggtaatactttaattcctaatatcagcttctttctgctttccatttttgctgaggaatggtgatttcagt

SEQ ID NO: 12271 - DNA, 160 bp, Homo sapiens
  AC004990.1_89831
  Located on chromosome 7
  Distance between a terminus base of telomere on chromosomal short arm and 5'-terminus of this base sequence : 79006280
  Distance between 3'-terminus of neighbour sequence of sequence listing upward to telomere on chrosomal short arm and 5'-terminus of this base sequence : 70127
cctcactggaattcatattgacctacaaattcaacaccaccatgaagcaatcgcccaaaccgactcttccattttgtaggcttaagaaaatgaagttacacacacacacacacacacacacacacacacacacaaaaccttcagtaaagctttagctcga

SEQ ID NO: 12272 - DNA, 307 bp, Homo sapiens
  AC004990.1_98168
  Located on chromosome 7
  Distance between a terminus base of telomere on chromosomal short arm and 5'-terminus of this base sequence : 79014678
  Distance between 3'-terminus of neighbour sequence of sequence listing upward to telomere on chrosomal short arm and 5'-terminus of this base sequence : 8238
gacacgttgagaccatagctactatacacaacacagacacacacacacacacacacacacacacacacacacacacgcacgcacacacctgttggaatgaataattgaagcaagaagaacaaaatattgataaacattgatggtgagtgatgcacaattgggaatccactatactcctgtctctactttgagacaagactgaatctgactaatgtctttcatctcttatgttatagccgttcctccccttcacctccacctgattattcatgtcgtgaagaaactggtctacttgtcctgtagaatc

SEQ ID NO: 12273 - DNA, 312 bp, Homo sapiens
  AC004990.1_108083
  Located on chromosome 7
  Distance between a terminus base of telomere on chromosomal short arm and 5'-terminus of this base sequence : 79024543
  Distance between 3'-terminus of neighbour sequence of sequence listing upward to telomere on chrosomal short arm and 5'-terminus of this base sequence : 9558
ctgaggttggctgaaacagcccaaatgtgctgcttgacatgagtagcaggagcctggacagggagtcaaatgggatatgtgggctctgtgtgtgtgtgtgtgtgtgtgtgtgtgtgtgtgtgtgtgtgtgtgtgtgtgtgtgtatgttatttagaggagctgcaattggagcagagaggcagagggagtctggaatagtcctggcccagactggcagaggccttttacatgcttccagcaaacattcatggtgtggaggccgagcccatctaaggaatcctgaccagctggacaccatgtacctgaattcag

SEQ ID NO: 12274 - DNA, 93 bp, Homo sapiens
  D7S2421
  Located on chromosome 7
  Distance between a terminus base of telomere on chromosomal short arm and 5'-terminus of this base sequence : 79064704
  Distance between 3'-terminus of neighbour sequence of sequence listing upward to telomere on chrosomal short arm and 5'-terminus of this base sequence : 39849
tgtgaggctaatgtaccgtgtgtgtgtgtgtgtgtgtgtgtgtgcacgtgtgcacacgcagttggctcccactgagagatggaatgagtggca

SEQ ID NO: 12275 - DNA, 185 bp, Homo sapiens
  AC004808.1_13620
  Located on chromosome 7
  Distance between a terminus base of telomere on chromosomal short arm and 5'-terminus of this base sequence : 79084336
  Distance between 3'-terminus of neighbour sequence of sequence listing upward to telomere on chrosomal short arm and 5'-terminus of this base sequence : 19539
ttgtagatagcttcaaggaatgactgtgatggttttgtgtgtgtgtgtgtgtgtgtgtgtgtgtatctacataaatttatataagcataaaactttttgataagaaaatgtttagtagtaagccaattaaataatttacttaatgaataatgttgtcttttatgttaaattctagccagtcctgg

SEQ ID NO: 12276 - DNA, 277 bp, Homo sapiens
  AC004808.1_19466
  Located on chromosome 7
  Distance between a terminus base of telomere on chromosomal short arm and 5'-terminus of this base sequence : 79090077
  Distance between 3'-terminus of neighbour sequence of sequence listing upward to telomere on chrosomal short arm and 5'-terminus of this base sequence : 5556
ggctggaccttaatagctaaacaggttcttcttggtagatttcttggtcactataaacacacacacacacatacacacacacacacacacacatatatgtgtgtgtatatatatacacacatatatatacacacacacacatatatatatatatatatatatatatatatatatatatatatatacacacacacacacagacattctgtccccttccctaggtgctttatcattttctattacgcagtggaaggtgttcttgagtgatttgtggaac

SEQ ID NO: 12277 - DNA, 328 bp, Homo sapiens
  AC004808.1_32679
  Located on chromosome 7
  Distance between a terminus base of telomere on chromosomal short arm and 5'-terminus of this base sequence : 79103281
  Distance between 3'-terminus of neighbour sequence of sequence listing upward to telomere on chrosomal short arm and 5'-terminus of this base sequence : 12927
gctatcttcaactgagctatgttactaaaatgaaacttctaagatctccactcattcttagagtatttttaaaatatcgagttccagttgagagggagagggagagggagaaggagatggtgggggggcgggggagggagggagggggggagagagagagagagagagagagagagagagagagagagagagacagagagagagacagagatactaaaaccagataaaggtaattcaggagtctctgtgtgcactgcattatgtgggtcaaggaaatgccaaatttaggaaactgatcaaaggacttaagaggaattctaagcactca

SEQ ID NO: 12278 - DNA, 324 bp, Homo sapiens
  AC004808.1_34842
  Located on chromosome 7
  Distance between a terminus base of telomere on chromosomal short arm and 5'-terminus of this base sequence : 79105437
  Distance between 3'-terminus of neighbour sequence of sequence listing upward to telomere on chrosomal short arm and 5'-terminus of this base sequence : 1828
gtggtgcatgcctagctactcaggaggctgaggtgggaggatcacttgagcccaggagttcgaggctgcagtgagccatgattgcacctctgtattccagcctggggaacaagtgtgaggacttatctctaaaacaaaacaaaataataaaactcccacacacacacacacacacacacacacacacaaacaaaacaaaatcaaacccaaaaaagtcccagcatctcttgagaaacttcatccaagcagaagtgtgaaatgacccttatggatgcacagaagagagaagaatccttcatcaaggttctgcctaagcacataacc

SEQ ID NO: 12279 - DNA, 153 bp, Homo sapiens
  AC004808.1_40344
  Located on chromosome 7
  Distance between a terminus base of telomere on chromosomal short arm and 5'-terminus of this base sequence : 79111051
  Distance between 3'-terminus of neighbour sequence of sequence listing upward to telomere on chrosomal short arm and 5'-terminus of this base sequence : 5290
ttgtagcttttaacatcgtagtgactgatgtgtatgtgtgtgtatgtgtgtgtgtgtgtgtgtgtgtgtgataagagagtaagagtgaatgaataagagacagaatgatcgattgaatgatttgggggtaaattaaggaagtggttgctgata

SEQ ID NO: 12280 - DNA, 349 bp, Homo sapiens
  AC004808.1_87917
  Located on chromosome 7
  Distance between a terminus base of telomere on chromosomal short arm and 5'-terminus of this base sequence : 79158422
  Distance between 3'-terminus of neighbour sequence of sequence listing upward to telomere on chrosomal short arm and 5'-terminus of this base sequence : 47218
ggacagctcttcagatcctatttagttaggatgtcacatcatggtgtcattcttttgtgtgaagtaatttctttgggttttagaaatactgacttttgaaatgaaatttaaaaacgtacttcaaaacacaaatggtatttggatgattttctgttttgacttatttatgcctctgctctcctctattactgtagatcatttaaaatttattgggcataaaatcccaaatgtttcaaaacatagattcacacacacacacacacacacacacacacacacacacacacacacacacacaatttgtatgctcaacgacaatgataaactattacttgttaatttccaggca

SEQ ID NO: 12281 - DNA, 139 bp, Homo sapiens
  D7S669
  Located on chromosome 7
  Distance between a terminus base of telomere on chromosomal short arm and 5'-terminus of this base sequence : 79263239
  Distance between 3'-terminus of neighbour sequence of sequence listing upward to telomere on chrosomal short arm and 5'-terminus of this base sequence : 104468
atgcaacctaccctcaaatggttcagatacacacacacacacacacacacacacacacacacacacacacacactctctctctctctctcttataaaacaaatggggcaaaatgttaatagcaatgtgggtaaaccgta

SEQ ID NO: 12282 - DNA, 427 bp, Homo sapiens
  AC006043.1_114591
  Located on chromosome 7
  Distance between a terminus base of telomere on chromosomal short arm and 5'-terminus of this base sequence : 79530216
  Distance between 3'-terminus of neighbour sequence of sequence listing upward to telomere on chrosomal short arm and 5'-terminus of this base sequence : 266838
tgttcagctttgacagaagttaaaaatatatctctgggctgggcgtgatcctgggaagtcgaggctgcagtgagcagtgattgcgccactgcactccagcctgggcgacagagcaagactttgcctcaaaaaaaaaaaaaaaaaaaaaaaaaaaaaaaaaaatatatatatatatatatatatatatatatatatggacagagagaactatctatatctagctatctattttgcccccaggtggctgctgaagacagcagaaagacagaacctggtgctcagtggccaaggccatcttgtgggccacccggcagccatcttggccaagtgggttctgctgggaaggaaactggtggttgagcaccacgagggcatcaacatttctggcaatttctggagaaacaaattaaagtatctggccttcctc

SEQ ID NO: 12283 - DNA, 396 bp, Homo sapiens
  AC006043.1_123495
  Located on chromosome 7
  Distance between a terminus base of telomere on chromosomal short arm and 5'-terminus of this base sequence : 79539149
  Distance between 3'-terminus of neighbour sequence of sequence listing upward to telomere on chrosomal short arm and 5'-terminus of this base sequence : 8506
aactattaaacatgtcagcctgatctaattatagaacacatgactgactacattctatataatactctgacaatggctgtgttacatggaaaatgaagttgagaaatgtacacagaagtataatgtaggcaaacacacacacacacacacacacacacaaatttgaagtacaaagataagaaaaattttcgtttagggttacagccagtgtccaatttcataattagttataaaggatctaccagcagcagatcttcacttgcagaacacacatctcgatgatcaagaagggatgaagcatagctttctgacacaggggtgtcttgcctctctgttagatgattaggacagagaagaaaggttttagttaaatcctctcctgcattggaagttagc

SEQ ID NO: 12284 - DNA, 196 bp, Homo sapiens
  Z67560
  Located on chromosome 7
  Distance between a terminus base of telomere on chromosomal short arm and 5'-terminus of this base sequence : 79603177
  Distance between 3'-terminus of neighbour sequence of sequence listing upward to telomere on chrosomal short arm and 5'-terminus of this base sequence : 63632
tcatttcccagagacaggtattatagacttatagcttctctatgagctgaattgcctgttggaatcagtgaggtaggctgtgtgtgtgtgtgtgtgtgtgtgtgtgtgttttaagcaaaagaaaacacctacttggtttttgaatacctttattacattccctgctgattcagtgaacttttgattagcctccatg

SEQ ID NO: 12285 - DNA, 227 bp, Homo sapiens
  G08635
  Located on chromosome 7
  Distance between a terminus base of telomere on chromosomal short arm and 5'-terminus of this base sequence : 79669786
  Distance between 3'-terminus of neighbour sequence of sequence listing upward to telomere on chrosomal short arm and 5'-terminus of this base sequence : 66413
agtaaatggaattgcttgttaccttaactcaaaacctatactgtttaatacgtcttttaaaactacatatctaatgtttcactgtagagttcctttatgctattcagaaataactattctatctatctatctatctatctatctatctatctatctatctttctatcttatacacagaaccaaagaatcattctcctttgtttcacttattttctgttttgtcatga

SEQ ID NO: 12286 - DNA, 359 bp, Homo sapiens
  AC004547.1_52802
  Located on chromosome 7
  Distance between a terminus base of telomere on chromosomal short arm and 5'-terminus of this base sequence : 79913410
  Distance between 3'-terminus of neighbour sequence of sequence listing upward to telomere on chrosomal short arm and 5'-terminus of this base sequence : 243397
cagctttcaaacaggtttaaatactagaaagaacgtaatgagagtgaggtgacagtgtctggtagaagaaacagcatgagaactacccatttggctagaacaaaacagagaggcctgttttggaggaatagaagaaaaaagttgaaacacacacacacacacacacacacacacacacacacacacacacacacacacgggaggggggttagatcataaaaggccttgcataccagataaaggagcatctggcctatactttaatgacattgagggattctgatttataaattccagactgcagacttatttgaaaatacagtagaaacttagaaaggaagattgagtactcatttcac

SEQ ID NO: 12287 - DNA, 361 bp, Homo sapiens
  AC004547.1_68731
  Located on chromosome 7
  Distance between a terminus base of telomere on chromosomal short arm and 5'-terminus of this base sequence : 79929410
  Distance between 3'-terminus of neighbour sequence of sequence listing upward to telomere on chrosomal short arm and 5'-terminus of this base sequence : 15641
tgcatcttatgctctaagacctacttaaagacattgaaatctcccctcctccctccctccctccttctccctccttctctctctctctctctctctccataatcatcaatttcctcttctctcttaaatcattctctttaacacacaagcatgctaaaatttttcatttagcttaaaaaaattccacctcttggccctctttcctctctggctcctgccttatttctcaaatatttcttctttttatggtaaaaaacaaaaaaataaagcaaaataaaacttaaaagaattatctgaattctctatctccatttccgttttattatcttgaactctcaatgtcactaaagccaatggacat

SEQ ID NO: 12288 - DNA, 165 bp, Homo sapiens
  D7S2499
  Located on chromosome 7
  Distance between a terminus base of telomere on chromosomal short arm and 5'-terminus of this base sequence : 79984718
  Distance between 3'-terminus of neighbour sequence of sequence listing upward to telomere on chrosomal short arm and 5'-terminus of this base sequence : 54947
tgtgctgggacaacattttacagttatctacctacatatatgtatgtatgtgtgtgtgtgtgtgtgtgtgtgtgtgtacatatatatatatttgccgatagattggaatttattgcagaataatactggaatacttgatgctttcaatatagtgattgttctagc

SEQ ID NO: 12289 - DNA, 305 bp, Homo sapiens
  AC006324.3_946
  Located on chromosome 7
  Distance between a terminus base of telomere on chromosomal short arm and 5'-terminus of this base sequence : 80127755
  Distance between 3'-terminus of neighbour sequence of sequence listing upward to telomere on chrosomal short arm and 5'-terminus of this base sequence : 142872
gtacatactttcatactcaaccaaaattgcttccctccctcccttccttccttccctccctccttttctctctctctctcccttccttctttccttccttcctccctccctccctttctctctccctttctttctttttctttctttctctttctttctttctttctttctttctttctttctttctttctttctttctttctttctttctttcatttctttcgttcattctttctttcttccttcctcagtaataattttctgaggtctcacagatttttgttaaattgtctttgctcaactct

SEQ ID NO: 12290 - DNA, 322 bp, Homo sapiens
  AC006324.3_18161
  Located on chromosome 7
  Distance between a terminus base of telomere on chromosomal short arm and 5'-terminus of this base sequence : 80144931
  Distance between 3'-terminus of neighbour sequence of sequence listing upward to telomere on chrosomal short arm and 5'-terminus of this base sequence : 16871
gtataaccatagcaatcaggacagatatacagtatttggtcatttttcctaaaaaattatattcataaaaatatctttttaatgtttgccagagtaggggcatatgcttattttgggaggtatttacggctaaaattaactgaagtaaagaggagatagtttgtgattctgtgctcttgttgcttttacacacacacacacacacacacacacacacacagagttttctttttaaacaaatctgggctatatatttatcatttccctcaaagtagttacaggtacaaaaactgaaatactgaatggtcactgttgctcttta

SEQ ID NO: 12291 - DNA, 478 bp, Homo sapiens
  AC006324.3_22682
  Located on chromosome 7
  Distance between a terminus base of telomere on chromosomal short arm and 5'-terminus of this base sequence : 80149339
  Distance between 3'-terminus of neighbour sequence of sequence listing upward to telomere on chrosomal short arm and 5'-terminus of this base sequence : 4086
aaaggactcatggtagtcaatctcaagacttactacaaagctgtagtagtcaggacagtgtaatattggcaaaagagaacacatcacatataggtcaatgtaacagaatagaaaaacccacataaatgaggtcaactgattctgacaaggcaaaaaggcaattcaatgaaggaaccatctttccaacaaatggtacaggaacaatcagacagccacatgcagaatgaaagacagaaagagagaaagagagcgacagagagagagagagagagaaacataagcaaagaccttacaatttacaaagaaagaaagaaagaaagaaagaaagaaagaaagaaagaaagaaagaaagaaagaaagaaagaaagagcaaagaccttacaatttacacaaaaagttaatctaaaatgtaatgaaataaaaaactataaaatttattgaaaaacaggaggaaatctatgtgaactcttgtttggtg

SEQ ID NO: 12292 - DNA, 252 bp, Homo sapiens
  Z66998
  Located on chromosome 7
  Distance between a terminus base of telomere on chromosomal short arm and 5'-terminus of this base sequence : 80162974
  Distance between 3'-terminus of neighbour sequence of sequence listing upward to telomere on chrosomal short arm and 5'-terminus of this base sequence : 13157
cctatatgtaaccttgaactaaacgtaagttttccatctgtaaatatccacctgcacaggtgttatgtatgtcctattattttactgaaataagagattttatatgtacatacacacacacacacacacacacacacacacacacacagagatatggtttggctttttgtccccacccaaatctcaactggaattgtaatccccatgtgtcgagggagggatttggtggggggtgattagatcatgggggca

SEQ ID NO: 12293 - DNA, 367 bp, Homo sapiens
  AC006324.3_36540
  Located on chromosome 7
  Distance between a terminus base of telomere on chromosomal short arm and 5'-terminus of this base sequence : 80163399
  Distance between 3'-terminus of neighbour sequence of sequence listing upward to telomere on chrosomal short arm and 5'-terminus of this base sequence : 173
ccatatggaactgtgagtcaactaaacctttcttttataaattattcagtttcagtatttttatagcagggtgagaatggactaatagacacacacatacacacacacacacacacacacccctacatatacacatcatatttcatatagacataaatatatagttgtctacatctatatctacacatagagacatatataaacatatatactaaaatatatgcttaaatatacattataacatatatatctatcttatgttcagatatatatgtcttataatcaagataaaaactgcatttcaactctggctctgccagtaagttatataatcctgggatacgtacttaatttgcaaagcttcatt

SEQ ID NO: 12294 - DNA, 444 bp, Homo sapiens
  AC006324.3_57147
  Located on chromosome 7
  Distance between a terminus base of telomere on chromosomal short arm and 5'-terminus of this base sequence : 80184002
  Distance between 3'-terminus of neighbour sequence of sequence listing upward to telomere on chrosomal short arm and 5'-terminus of this base sequence : 20236
tcaactttgctctttatcttgtaccacgttcttttggtagaagatccttccttccttcctttcttccttccttccttccttccttccttccttccttccttcctttctttctttctttctttctttctctgttctttcttcctttcttctttctttctttttcttgttttttattgagtagctatatcattcagtacatgtagtgggtctttgtgctgagctactctgcccttacttagtcaatcaaaatgtttcttccaggaaatggctatagaagcagagtgcccaaagaatgcgaatgcaactggcttcatcttgaaagcgacactctgaagaaattacccataatttctccctcttggacatgcagaattatcctgttcttgtatttttctggccagcttctccaactttccctttcttgtttgcaactaattaaacttt

SEQ ID NO: 12295 - DNA, 258 bp, Homo sapiens
  AC006324.3_69738
  Located on chromosome 7
  Distance between a terminus base of telomere on chromosomal short arm and 5'-terminus of this base sequence : 80196568
  Distance between 3'-terminus of neighbour sequence of sequence listing upward to telomere on chrosomal short arm and 5'-terminus of this base sequence : 12122
aacctaggaaatactattctggacatagaacccagcaaaggcttcaagacaaagccaccaatagcaattgcaacaaaaacaaaaattgacaaatacaacttaattaaaccaaagagcttctgcatagcaaaacaaaacaaaacaaaacaaaacaaaaaactatcaacaaagtaaagacacaacctaaagaatgggagaaaatatttgcaaactatacaaccaacaaaagtctcatatccagagtctgtaagtagctca

SEQ ID NO: 12296 - DNA, 383 bp, Homo sapiens
  AC006355.3_19013
  Located on chromosome 7
  Distance between a terminus base of telomere on chromosomal short arm and 5'-terminus of this base sequence : 80302837
  Distance between 3'-terminus of neighbour sequence of sequence listing upward to telomere on chrosomal short arm and 5'-terminus of this base sequence : 106011
gtgaggattaaatgagttaatgaatataaaaatttcaaatgttgttaactattattattaaccaattttcactcatgaccttcatgtgccatgtgctagagactgtactaagtgctttcgatgatattttgaaaacaataaaaggtaaaggaaacagaagctcacagaagttaattaaccaagccaaaaggtagcttggttatctgttggattatggaacactagtcttgaagaaagtcaccaattcattcattcattcattcattcattcattcatttattcattcactcactcattcattcattcattcattccagataaatttatagaaggaacagggatgaggatcatggagcaggtactaggctagttacaatgcaag

SEQ ID NO: 12297 - DNA, 457 bp, Homo sapiens
  AC006355.3_24181
  Located on chromosome 7
  Distance between a terminus base of telomere on chromosomal short arm and 5'-terminus of this base sequence : 80308087
  Distance between 3'-terminus of neighbour sequence of sequence listing upward to telomere on chrosomal short arm and 5'-terminus of this base sequence : 4867
tccatcttgagtgacagagtaaaatcctctcgaaagaaagaaagaaagaaagaaagaaagaaagaaagaaagaaagaaagaaagaaagaaagaaagagaaagaaagaaagaaagaaagaaggaaagaaagaaagaaagaaggaaagaaagaaagaaagaaggaaagaaagaaagaaagaaagaaagaaagaaagaaagaaagaaagaaagaaagaaagaaagacacaaaaggcactgtatacagtcttacttttaacatttaaatttaccagagggagatgaaaatagtaacataattccaaatgtcttatatttgtctttcctatttccatccaacactatgtacaaggtaaaaggttttcagtcagatgtctacttacctagggccaagaaagctaagttctaatctagattctgtctttgatacactgggagcttatttccaatagcctcattt

SEQ ID NO: 12298 - DNA, 217 bp, Homo sapiens
  AC006355.3_74304
  Located on chromosome 7
  Distance between a terminus base of telomere on chromosomal short arm and 5'-terminus of this base sequence : 80358288
  Distance between 3'-terminus of neighbour sequence of sequence listing upward to telomere on chrosomal short arm and 5'-terminus of this base sequence : 49744
accaacataaatgcataggattacaccatttttaccatttgtttcccaaatactctagaggccagccctatttgcctgggaaaatatatatatatatatatatatatatatatatatatatatatatatatatatttatatttatttatttataaactacatacatttaaactatatatataaagtttaatgagcgaccatgcacttatcactcagt

SEQ ID NO: 12299 - DNA, 259 bp, Homo sapiens
  AC004945.1_12230
  Located on chromosome 7
  Distance between a terminus base of telomere on chromosomal short arm and 5'-terminus of this base sequence : 80531692
  Distance between 3'-terminus of neighbour sequence of sequence listing upward to telomere on chrosomal short arm and 5'-terminus of this base sequence : 173187
taaacttaaagaatccattccaagaaatcattgctaaacatttgaaaattaaagacaaagaaaaaccctaaatcagccagagaaaaataacacattatgggacggaaaagccaattcaaatgacagcagagaccaaaaggaaatgctcaagtgggaaacacacacacacacacacacacacacacacacacacacacacacagaaaacaaaaaaactaccaaccacaaattttatatccaattaaactatgtctcagga

SEQ ID NO: 12300 - DNA, 304 bp, Homo sapiens
  AC004945.1_39655
  Located on chromosome 7
  Distance between a terminus base of telomere on chromosomal short arm and 5'-terminus of this base sequence : 80559239
  Distance between 3'-terminus of neighbour sequence of sequence listing upward to telomere on chrosomal short arm and 5'-terminus of this base sequence : 27288
tacttcaacagagatggctcacaaatttttatgcttgtgtgtgtgtgtgtgtgtgtgtgtgtgtgtgtgttaacattaacttagaggacatttgcttctgaattcagctctcagctgtttggagcctctgggtatgattcaagtcttagaattggcaaggaattctctcctatctttacatcagtgggatttccatttgcttactttggaattgtttacttttctactttcctcttgcttttctgtgtagaccatagtcacttcctccacctctgattcttcctaaggctttcgattaccactt

SEQ ID NO: 12301 - DNA, 224 bp, Homo sapiens
  AC004945.1_44101
  Located on chromosome 7
  Distance between a terminus base of telomere on chromosomal short arm and 5'-terminus of this base sequence : 80563547
  Distance between 3'-terminus of neighbour sequence of sequence listing upward to telomere on chrosomal short arm and 5'-terminus of this base sequence : 4004
tgacttcattctggctttagactccattcttattacggacaacttaggattgttgtaaaaatctgttaaagaaacggttaaaagaaggaaaaaatgtattctaaaagcaattacctttaacatatatatatatatatagacatatatatatatatatatatatatatatagacatatatatatatatatatatatacacactttactgtaagttccaggctaca

SEQ ID NO: 12302 - DNA, 417 bp, Homo sapiens
  AC004945.1_165162
  Located on chromosome 7
  Distance between a terminus base of telomere on chromosomal short arm and 5'-terminus of this base sequence : 80684647
  Distance between 3'-terminus of neighbour sequence of sequence listing upward to telomere on chrosomal short arm and 5'-terminus of this base sequence : 120876
acttgaaactagtcatagctcgagtatctacaacatggaattcagcaaatgctgtaaatcaactttgtcttttcctctagaaagccagtttacaagcacacctaagtccaaataaaagattatatctatatctatgtgtgtgtgtgtgtgtgtgtgtgtgtgtgtgtatatatatatatatgatgagagttgatatagtataatagatagtgatacctacctaggagaaaattgaaacagggaagaggatgagatgtagggcggcagtttaaattttagatgaggtagtcagggaaggccttgctgagtaagataacagtctaatgatatgagggagcacgctgtatgaagcatttttgggcaggggccttcataagtaagaggactctgagataataacttgtctgctgttcttgg

SEQ ID NO: 12303 - DNA, 314 bp, Homo sapiens
  chr7.fa.O7frz.80502445
  Located on chromosome 7
  Distance between a terminus base of telomere on chromosomal short arm and 5'-terminus of this base sequence : 80684657
  Distance between 3'-terminus of neighbour sequence of sequence listing upward to telomere on chrosomal short arm and 5'-terminus of this base sequence : -407
agtcatagctcgagtatctacaacatggaattcagcaaatgctgtaaatcaactttgtcttttcctctagaaagccagtttacaagcacacctaagtccaaataaaagattatatctatatctatgtgtgtgtgtgtgtgtgtgtgtgtgtgtgtgtatatatatatatatgatgagagttgatatagtataatagatagtgatacctacctaggagaaaattgaaacagggaagaggatgagatgtagggcggcagtttaaattttagatgaggtagtcagggaaggccttgctgagtaagataacagtctaa

SEQ ID NO: 12304 - DNA, 390 bp, Homo sapiens
  chr7.fa.O7frz.80754807
  Located on chromosome 7
  Distance between a terminus base of telomere on chromosomal short arm and 5'-terminus of this base sequence : 80996232
  Distance between 3'-terminus of neighbour sequence of sequence listing upward to telomere on chrosomal short arm and 5'-terminus of this base sequence : 311261
atgtcataacgctcaacattagatcaccagaatttattcatcttataattgaaagcttgtaccccttgaccaacatattccaatttcccccaccttccagcccctggtaaccactattctcctccttgattctgtgagtttgacatttttagatttcacatagaagtgaagtcatagagtatttgtttttctgtatctggcttatttcacttagcataatgcctcccaagttaatccatgttgttgcaaacatcaagattttcttcttttttatggatgtgttgcatttcattttacacacacacacacacacacacacacacacactccataattttttattcattctcccgacaaggaacacttaggttgagttcctatcttggctat

SEQ ID NO: 12305 - DNA, 381 bp, Homo sapiens
  AC004548.1_85212
  Located on chromosome 7
  Distance between a terminus base of telomere on chromosomal short arm and 5'-terminus of this base sequence : 81074880
  Distance between 3'-terminus of neighbour sequence of sequence listing upward to telomere on chrosomal short arm and 5'-terminus of this base sequence : 78258
cttaacgaatgttgctaaagctacccaggccgtgctgtgtaaaaggaacagcaaaagcctggataacagcacatctctttatagcatggtttaatgaatattttaagcccctgttgagacctgctgctcagaaaaaaaaaaaaaaaaatatatatatatatatatatatatatatgtatatgtatagataacttttaaaatatcactgttcattgacaatacaatacacctaaaagctctgatgaacatgtataaggaaattaatgttatgttcatgcctgctaaaacatctattcagcagcccatggattaaagagtagtttgaattttgaggccttattatgtaagaaatacattttgtaaggctatagcttccataga

SEQ ID NO: 12306 - DNA, 382 bp, Homo sapiens
  AC004159.1_33016
  Located on chromosome 7
  Distance between a terminus base of telomere on chromosomal short arm and 5'-terminus of this base sequence : 81276902
  Distance between 3'-terminus of neighbour sequence of sequence listing upward to telomere on chrosomal short arm and 5'-terminus of this base sequence : 201641
cacctacaatttggagattcatgtctttctaaaaattgttttttacagttcttgatagttaatctattttgttttttcttttctctatatattttatataaaatagttgctgaacctcacgaatttttcctttcttttctatgtttactattttcacattttgtgtgtgtctgtgtgtgtgtgtgtgtgtgtgtgtgtgtgtgtgtgtgttaagttttggtccttggctttatctttcagtccttttataatgttatttatttctatcatagttttattctcttttctttcctttccatagcatcctactcttgtaatatctcattgagaatattagattattttcaaattttaaaaactatttcctgtattgtcagtttcc

SEQ ID NO: 12307 - DNA, 312 bp, Homo sapiens
  AC004159.1_53120
  Located on chromosome 7
  Distance between a terminus base of telomere on chromosomal short arm and 5'-terminus of this base sequence : 81297148
  Distance between 3'-terminus of neighbour sequence of sequence listing upward to telomere on chrosomal short arm and 5'-terminus of this base sequence : 19864
atttgttcattctgtggaattaagtaagagtgtgtgtgtgtgtgtgtgtgtgtgtctaaattaagtacatctggccggaagtggtgtggaacagagggaaagtgtgttaaagcagaagtggaggcagagcatacaccacccaaggtgtcaagggcagggaggcagcagctgactctgggttataaatgcattatctcctatgctccctccaataacttgccaagtaattaaaacagatatcattactgtttgacagataaggaaaccgaagacaatcatttacggaatgtcttacagcaaattagtcttgga

SEQ ID NO: 12308 - DNA, 136 bp, Homo sapiens
  D7S634
  Located on chromosome 7
  Distance between a terminus base of telomere on chromosomal short arm and 5'-terminus of this base sequence : 81391144
  Distance between 3'-terminus of neighbour sequence of sequence listing upward to telomere on chrosomal short arm and 5'-terminus of this base sequence : 93684
ttcagtacacgttgctggtaagtagtttccaagttacgtgttgtcactgggttgaagtatatttgtgtgtgtgtgtgtgtgtgtgtgtgtgtgtgtaaccataaactatattcatatctgtttcatttggaggatt

SEQ ID NO: 12309 - DNA, 143 bp, Homo sapiens
  D7S2443
  Located on chromosome 7
  Distance between a terminus base of telomere on chromosomal short arm and 5'-terminus of this base sequence : 81430512
  Distance between 3'-terminus of neighbour sequence of sequence listing upward to telomere on chrosomal short arm and 5'-terminus of this base sequence : 39232
aataggggtttcattttatccaacaacatggatgtttttgagtagtaaattagcacctctctctttctctacacacacacacacacacacacacacacacacacaatgcttagaatagtgattaacacataaaatgacataag

SEQ ID NO: 12310 - DNA, 285 bp, Homo sapiens
  AC003988.1_31131
  Located on chromosome 7
  Distance between a terminus base of telomere on chromosomal short arm and 5'-terminus of this base sequence : 81456550
  Distance between 3'-terminus of neighbour sequence of sequence listing upward to telomere on chrosomal short arm and 5'-terminus of this base sequence : 25895
acttaacatcagcctgtgaaagcagctaggggactgtaccatgcagctccacggggacagagtaatatacatatatatatatatatatatatatatatatatatatatatatatatatatacacacacacacatataaaataaggaaatgtacagctatttagtagttaagttaatgtgatagttatagaaccaaaataatagaattagttattgatatgtcaactacactgaaaaatttttgaacaaaattattacttgaattctgaagcttccttgtatctta

SEQ ID NO: 12311 - DNA, 197 bp, Homo sapiens
  AC003988.1_31447
  Located on chromosome 7
  Distance between a terminus base of telomere on chromosomal short arm and 5'-terminus of this base sequence : 81456814
  Distance between 3'-terminus of neighbour sequence of sequence listing upward to telomere on chrosomal short arm and 5'-terminus of this base sequence : -21
ctgaagcttccttgtatcttaaacattcttgtgtagaatacccacacaccaataactgcatttttataaagaactttaaagcttcttttattgttgctcctctctttttatgtaggaacaactgtgtgtgtgtgtgtgtgtgtgcgtgtgtgcattctttcattatttagatagtgaggttgagtaaattaccttga

SEQ ID NO: 12312 - DNA, 422 bp, Homo sapiens
  AC004862.1_134663
  Located on chromosome 7
  Distance between a terminus base of telomere on chromosomal short arm and 5'-terminus of this base sequence : 81618455
  Distance between 3'-terminus of neighbour sequence of sequence listing upward to telomere on chrosomal short arm and 5'-terminus of this base sequence : 161444
aacttgatgctttacagctagaagacaaaacccttgaagtagctaggcttgatgaatttataagtttaaggaacaatgatagaagaaacttgaaaattttatgatgagttccctaagttacacacacatgctaggcggaggttgcagtgagcctagatcgcaccactgcactccagcctgggcgacagagtgaggctctatcttaaaaaaaaaaaaaaaatgtatatatatatatatatatatatatatatatatataaaatatgtaatataaatgtgagaaattcaaaggaaaaaatacattcatattacaaaaaactacaaataagagttcccctattatctacttataattgtagacattagaaagtcattaacctgtttattagttaccaaagttatattgcaaggtttgaagtgtaa

SEQ ID NO: 12313 - DNA, 508 bp, Homo sapiens
  chr7.fa.O7frz.81504406
  Located on chromosome 7
  Distance between a terminus base of telomere on chromosomal short arm and 5'-terminus of this base sequence : 81665706
  Distance between 3'-terminus of neighbour sequence of sequence listing upward to telomere on chrosomal short arm and 5'-terminus of this base sequence : 46829
ccaaagaacaagatcctttaacatataatttaaaaatatgctcaaaaatggtcctcctcctcttcatcctcctctttcctcctcctcctctttcctcttcctcctcctctttcctcctcctcctcctctttcctcctcctcctctttcctcctcctcctctttcctcctcctcctctttgttcctcctccttctctttcctcctcctcctcctctttcctcctccacctctttcctcctccacctctttcctcctccacctctttcctcctcctcctctttcctcctcctcctctttcctcctcctcctctttcctcctcctcctctttcctcctcctcctctttcctcctcctcctctttcctcctcctctctgcacctcctcctcctttcctcctcctccttctcttcctgctgttgttgctgctgcttctgtttcttctgcttcttcttttacttctttttagccacaattatcctttaaaattctctagcagtaacaaagccat

SEQ ID NO: 12314 - DNA, 366 bp, Homo sapiens
  chr7.fa.O7frz.81594640
  Located on chromosome 7
  Distance between a terminus base of telomere on chromosomal short arm and 5'-terminus of this base sequence : 81757175
  Distance between 3'-terminus of neighbour sequence of sequence listing upward to telomere on chrosomal short arm and 5'-terminus of this base sequence : 90961
ccttgatcatgtgatcagatactgtggcacaggacaaagggaatagaagaagcccaaggaacaaggcaaagtaaaggggaaaagaagaactcacagaacagctaccacattgcactggaagcccaatagatacaaccatgctgttatagtttgctgatagaaagaggtttcaataacactctgaatctaatcatgtcagaagttattaggccacttgatccatgatcaaaagcaagaaataggtacatattttgcaacatagagcatgcaccctgaattgtgtgtgtgtgtgtgtgtgtgtgtgtgtgtgtgtgtgtgtgtgtgtgtggaggtgggggggttgtctggtgaactcattgatattgt

SEQ ID NO: 12315 - DNA, 373 bp, Homo sapiens
  chr7.fa.O7frz.81702362
  Located on chromosome 7
  Distance between a terminus base of telomere on chromosomal short arm and 5'-terminus of this base sequence : 81806588
  Distance between 3'-terminus of neighbour sequence of sequence listing upward to telomere on chrosomal short arm and 5'-terminus of this base sequence : 49047
gacataaaggtaattatgaaccactgcaactctatatgatgcgactttatgtgaaatgttataagtataatgtatatttaacatgactccattgctgtcttaaatataaataccaaattctattaaaagctgtctacaggtatgcatgttagtagaaataattgttttaagttatgtccaaagagcatgttggcatgcttttgagtaggaaataagtgagtatattttgtaaaagcacatttataaaagaagttgcactttagttaatactgagaaaagtaaaactgtgtgtgtgtgtgtgtgtgtgtgtaatgtgtttaatattgaaacataaatccttattaaattgtaggtaaacttgtttggtaataca

SEQ ID NO: 12316 - DNA, 284 bp, Homo sapiens
  chr7.fa.O7frz.81832191
  Located on chromosome 7
  Distance between a terminus base of telomere on chromosomal short arm and 5'-terminus of this base sequence : 81977483
  Distance between 3'-terminus of neighbour sequence of sequence listing upward to telomere on chrosomal short arm and 5'-terminus of this base sequence : 170522
ttgagaaggttaagtttatgctacaatatttctataatttggagcaaatattattactgtattacattcaagtaatcttgaaattataacatttttctttcatcttttacagctttacaaataaaatagatatactaaaaatatatacatatacactaaaactatatagttgcctccaactaaaagtatacacacacacacacacacacacatataatacacataaaaatatatatacttttttagctgaaggcaaaaggtgatacttcaagtaacttggcaga

SEQ ID NO: 12317 - DNA, 229 bp, Homo sapiens
  AC004880.1_39638
  Located on chromosome 7
  Distance between a terminus base of telomere on chromosomal short arm and 5'-terminus of this base sequence : 82040693
  Distance between 3'-terminus of neighbour sequence of sequence listing upward to telomere on chrosomal short arm and 5'-terminus of this base sequence : 62926
atttaattgcaaggatgtacgatgttgtttctgataaagaatgatcttctaccaaaaaaattcatgcctgttacttttgttgcctggagaaagaaacacacacacacacacacacacacacacacacacacacacacacactctctctcatgtaaagtttttcaatcattttaaccaagaagtcaataagaccaataagattattcttccaaatgaatctcaaatattg

SEQ ID NO: 12318 - DNA, 226 bp, Homo sapiens
  D7S1797
  Located on chromosome 7
  Distance between a terminus base of telomere on chromosomal short arm and 5'-terminus of this base sequence : 82098852
  Distance between 3'-terminus of neighbour sequence of sequence listing upward to telomere on chrosomal short arm and 5'-terminus of this base sequence : 57930
aaattgagatcgcagctgacatatcagttcttcagagagttgtttcttgttcatttttttattcatcatctatctatattacctattatctatctatctatctatctatctatctatctatcttctactgtcctttctctctactagaatgcaaatttcataaatgtgtttcctttaccactataatatccattagtccaatacctggcatggattagctcttgaa

SEQ ID NO: 12319 - DNA, 194 bp, Homo sapiens
  D7S660
  Located on chromosome 7
  Distance between a terminus base of telomere on chromosomal short arm and 5'-terminus of this base sequence : 82129135
  Distance between 3'-terminus of neighbour sequence of sequence listing upward to telomere on chrosomal short arm and 5'-terminus of this base sequence : 30057
agcttgatagtgggaatcatttcacagtggagatatatatatgtgtgtgtgtgtgtgtgtgtgtgtgtgtgtgtgtgaatccatcatgttgtataccttgaatatatgcaagttttatttgtcaattatatctcaataatcctgaaactcacagaaattgttcccagatgctgggcctccccagtgttggccta

SEQ ID NO: 12320 - DNA, 456 bp, Homo sapiens
  AC074089.7_111905
  Located on chromosome 7
  Distance between a terminus base of telomere on chromosomal short arm and 5'-terminus of this base sequence : 82149344
  Distance between 3'-terminus of neighbour sequence of sequence listing upward to telomere on chrosomal short arm and 5'-terminus of this base sequence : 20015
ctgattacctggaaaaccgtgtatgttttcagaagaatatcatgtaaataggccgggcgcagtggctcatgcctgtaatcccagcactttgggagcccgaggtgggcggatcacgaggccaggagatcgagaccaccctggctaacacggtgaaacctcgtctctactaaaaatacaaaaaattagccgggcgtggtggcgggcgcctgtagtcccagcaactcgggaggctgaggcaggagaatggcgtgaacccaggaggcagagcttgcagtgagccaagatagcaccactgcactccagcctgggtgacagagcgagatgccgtctcaataataataataataataataataatatcatgtaaatattacattttgaattttgtatttagtgaatccaaatcagttttgttcctgtccataacactttatgttatgaggatgcactgagata

SEQ ID NO: 12321 - DNA, 237 bp, Homo sapiens
  AC005008.2_9354
  Located on chromosome 7
  Distance between a terminus base of telomere on chromosomal short arm and 5'-terminus of this base sequence : 82311460
  Distance between 3'-terminus of neighbour sequence of sequence listing upward to telomere on chrosomal short arm and 5'-terminus of this base sequence : 161660
cactagcgtatcagtgaatgtaactcatccttgttagcttccttgatctttttcttagacaattgtctcttcgtgcctaaatgcatttgttcagcttttagtacaggcatgcaagacatatgcccttaagcacacacacacacacacacacacacacacacacacacacaggcacacatgcaaacacacactaagctactgtttctgctccccatctgttggttacaaacggaacta

SEQ ID NO: 12322 - DNA, 163 bp, Homo sapiens
  AC005008.2_51008
  Located on chromosome 7
  Distance between a terminus base of telomere on chromosomal short arm and 5'-terminus of this base sequence : 82353188
  Distance between 3'-terminus of neighbour sequence of sequence listing upward to telomere on chrosomal short arm and 5'-terminus of this base sequence : 41491
aattgcttaataccagtgatgaagagaaaaacttgcaagcaacagaggaaaataatacacacacacacacacacacacacacacacacacacacacactcacataccccacatgccaaggaccaaaaattaggattgcaccagatatcctgttggaatcattg

SEQ ID NO: 12323 - DNA, 271 bp, Homo sapiens
  AC004866.1_8934
  Located on chromosome 7
  Distance between a terminus base of telomere on chromosomal short arm and 5'-terminus of this base sequence : 82491325
  Distance between 3'-terminus of neighbour sequence of sequence listing upward to telomere on chrosomal short arm and 5'-terminus of this base sequence : 137974
acagaaccaataggatctacctctctatctatcatctggccagcttcctgtctatctatctgtctgtctatctatctatctatctatctatctatctatctatctatctatcatctgtcaatcatcaaagggaaagagagatatttattgcaaggaattgacttacataattatggggatctgcttctgtaaatttgagatccagagggtagtctgtcaaaggggcaggctggaactctcctggagaagctaatgcttcagtcttgagaca

SEQ ID NO: 12324 - DNA, 346 bp, Homo sapiens
  AC004866.1_90508
  Located on chromosome 7
  Distance between a terminus base of telomere on chromosomal short arm and 5'-terminus of this base sequence : 82572761
  Distance between 3'-terminus of neighbour sequence of sequence listing upward to telomere on chrosomal short arm and 5'-terminus of this base sequence : 81165
ctgctacctgttcaaaatcaatgtatttttcctcattgaccccaacagaataaaccaatacatcacaatatgatatctagtttagtagtgctgtttcatggtggaaagaagatggggggtgatttcaagcagactcttaagctataacagcccaaatcactctctctctccctgtctctgtctctctctttttctctctctctaacacacacacacacacacacacacacacacacacacacacacaccctgaccttgcccatgttcagtttttcagtttgcatgtgctcacctcatgtgtgggcaagattcattcagggtgaaactactagtgccagtgctttga

SEQ ID NO: 12325 - DNA, 311 bp, Homo sapiens
  AC004866.1_102338
  Located on chromosome 7
  Distance between a terminus base of telomere on chromosomal short arm and 5'-terminus of this base sequence : 82584551
  Distance between 3'-terminus of neighbour sequence of sequence listing upward to telomere on chrosomal short arm and 5'-terminus of this base sequence : 11444
ataagttggttagattggaccttcattgtgaaatgcagtaactttggtttaagcaatatccaaaaccagaaattggtcgaggggtctactaaattccgttttcttttgttctaaacaattaaacattctaaaatttagggaaaaggaccaatggtgcaaacattttagagctgacagttgtgtgccatatgccatgattctgttacaaatgaacagtattcagattcaaaatcagtgtaaacactgtgtgtgtgtgtgtgtgtgtgtgtgtattttacacagccatttaaatattaaccgcctttgagtat

SEQ ID NO: 12326 - DNA, 197 bp, Homo sapiens
  Z67063
  Located on chromosome 7
  Distance between a terminus base of telomere on chromosomal short arm and 5'-terminus of this base sequence : 82584770
  Distance between 3'-terminus of neighbour sequence of sequence listing upward to telomere on chrosomal short arm and 5'-terminus of this base sequence : -92
tcagattcaaaatcagtgtaaacactgtgtgtgtgtgtgtgtgtgtgtgtgtattttacacagccatttaaatattaaccgcctttgagtattaggggaaaaaacagaaactaaaagcgaatatatttgtttcctgaatcctcccaccaaaccactttttaaattaattatatttcctgccttagtgaggatcttcc

SEQ ID NO: 12327 - DNA, 351 bp, Homo sapiens
  AC008163.2_111694
  Located on chromosome 7
  Distance between a terminus base of telomere on chromosomal short arm and 5'-terminus of this base sequence : 82731828
  Distance between 3'-terminus of neighbour sequence of sequence listing upward to telomere on chrosomal short arm and 5'-terminus of this base sequence : 146861
aaggtcaggagttcaagactagcctggccaacatggtgaaatcctgtcactactaaaaataataataaaaaaaaaattagctgggtgtggtggtgggcgcctgtagtcccagctacttgggaggctgaagtaggagaatcacttgaacctgggagccagaggttgcagtgagctgagaacacgccaccacactccagcctgggtgacacagtgagactctgtctcataataataataataataataataataacaataatttgaaaagagatactttgaaactacataagcatcttgtttttcatcaaactgtccatttatctttgtatttatatctaatggactcatgga

SEQ ID NO: 12328 - DNA, 393 bp, Homo sapiens
  AC004960.1_38410
  Located on chromosome 7
  Distance between a terminus base of telomere on chromosomal short arm and 5'-terminus of this base sequence : 82850320
  Distance between 3'-terminus of neighbour sequence of sequence listing upward to telomere on chrosomal short arm and 5'-terminus of this base sequence : 118141
cttcaggatttcgattaaactttaatatacatgaatatgattaaaaataagtaaataataaaactaaggttttgaatgtaaaatagagtaggtcttgttcccaggactggctctgcctccagctatgtgaccctgggcaagtcattatacttttctgttcgtgtgtgtgtgtttgtgtgtgtgtttgtgtgtgtgtgtttgtgtgtgtgtgtttgtgtgtgtgtgtgtgtgtgtgtaaaatgaagaggtgatttttaacaggccttggcagttgtcaaagtctctgtaatatagacttgtaatgtaatgcaaaacgaccctatgaaaaagatggtaattttctttgaaggtgtttctctctttcataaaacaccttctggtatcagcaataaa

SEQ ID NO: 12329 - DNA, 381 bp, Homo sapiens
  AC004960.1_61490
  Located on chromosome 7
  Distance between a terminus base of telomere on chromosomal short arm and 5'-terminus of this base sequence : 82873402
  Distance between 3'-terminus of neighbour sequence of sequence listing upward to telomere on chrosomal short arm and 5'-terminus of this base sequence : 22689
ccatttcactgccaaatactattctcacttttcttcctttactttcaccactgtctatactacactatctataccacactactttcagactcatgtctacaaaaatatatgtgatacaatacttattttttattggttcaacttaaatttgaagaaagaaaacatgtcaatgataaaagttttacctacggaagggtaggggtgtgtgtgcgtgtgtgtgtgtgtgtgtgtgtgtgtgtgtgtgtgtgtgtatggcctcagaaccaaacatggactttttctgaaaacataaagaaaactttctcccactcttcttaaagctttaactcaatttcaaaagtttacgaacatcatgtatttctccatgaagaaatcgatgtt

SEQ ID NO: 12330 - DNA, 281 bp, Homo sapiens
  AC004960.1_96164
  Located on chromosome 7
  Distance between a terminus base of telomere on chromosomal short arm and 5'-terminus of this base sequence : 82908132
  Distance between 3'-terminus of neighbour sequence of sequence listing upward to telomere on chrosomal short arm and 5'-terminus of this base sequence : 34349
ttcttaaagtcaagcagttcaggtgaaaccaagtccatgtattcaaggaaacaggtgaacatataaacgatgtaacagtttatatgtaggagtgccctttggctctgtctattgctgtcagtacattatttacctgctccagcaagttctcctctaaaacaaaacaaaacaaaacaaaacaaaacaagctaactactgccctagatagatcacaaaaactcacagagtaatggtttctgttcatcggttcaatatttgttctaagtacagttctggactga

SEQ ID NO: 12331 - DNA, 254 bp, Homo sapiens
  AC004960.1_108181
  Located on chromosome 7
  Distance between a terminus base of telomere on chromosomal short arm and 5'-terminus of this base sequence : 82920188
  Distance between 3'-terminus of neighbour sequence of sequence listing upward to telomere on chrosomal short arm and 5'-terminus of this base sequence : 11775
caacatcctttgattcattaagaccctaagttcatagtatcatagtatgttcattcaattctatatagctaagatatttaataatcccaaatacatatgtgtgtctatgtgcgtgcgtgtgtgtgtgtgtgtgtgtgtgtgtgtgtgtgtgtgtgtgtgaatgaggaggattttaccatttctgggccaaaaaatcttggctctaatacataatattacctgtggttttctgcacaggttgccataaatttgga

SEQ ID NO: 12332 - DNA, 208 bp, Homo sapiens
  AC006145.2_19074
  Located on chromosome 7
  Distance between a terminus base of telomere on chromosomal short arm and 5'-terminus of this base sequence : 83068170
  Distance between 3'-terminus of neighbour sequence of sequence listing upward to telomere on chrosomal short arm and 5'-terminus of this base sequence : 147728
cattcaaatttaggaaatgcagagaaaccttgtgagatatctcacacacacacacacacacacacacacacacacacacacacaaaatcccaagacacatagtcatcagattctccatggtctcaataaaagaaaaaatgttaaagacagctagagagaatgacaagtcctctacaaaaggaaacccttcatgctaacagcagacttt

SEQ ID NO: 12333 - DNA, 436 bp, Homo sapiens
  AC006145.2_132708
  Located on chromosome 7
  Distance between a terminus base of telomere on chromosomal short arm and 5'-terminus of this base sequence : 83181607
  Distance between 3'-terminus of neighbour sequence of sequence listing upward to telomere on chrosomal short arm and 5'-terminus of this base sequence : 113229
gtgccatttctgtgctataaagtttacatcatatcatatactctgtgcataaagtaatacttaacctcatttttcattcagtttgttttagatattaaaaggactttgtaaaatgcattaaagtcatattattcaaagctgaagatgtgcctggtaaaatattccttagtttgagggactgacaacactaattttactctatgagaaacaagtgtaaataaatgttatcagagacaagaacacacacacacacacacacacacacacacgtgcataaaacttatcttttaaattgatgatcgctctactagctgggcatattacattgtagttattgttttcagcttcacagtaactccagaataaatacttggtttttatgaacaaaggtagagccctattctaaagctaaaaatttaagaagctgttgaaagca

SEQ ID NO: 12334 - DNA, 402 bp, Homo sapiens
  AC004892.2_16542
  Located on chromosome 7
  Distance between a terminus base of telomere on chromosomal short arm and 5'-terminus of this base sequence : 83351962
  Distance between 3'-terminus of neighbour sequence of sequence listing upward to telomere on chrosomal short arm and 5'-terminus of this base sequence : 169919
aatgcttagaaactcattcagaacaggccccaagttatctagttaacaaaaaacaggggaaatatatatatatatatatatatgtctatatgtctgtgtgtgtgtgtatgtgtgtttgtgtttgtgtgtgtgtgtgtgtgtgtgtgtgtgtgtgtgtgtgtgtgtgtgtgtgaatatagagacaggtaaaaagaatcaagggtcaatccttgagaaatatctgtgtataaagtagaaagatcaacagaatcagtgaagaaaacagaaattaagaattcaagatgtgtaagtattaaatgaactctctttgactgagccaactgcctggcagataatcctatgtcttctatgcaatactctctgttgattctatgtagattttcaaatgctattaacctgagc

SEQ ID NO: 12335 - DNA, 258 bp, Homo sapiens
  AC004892.2_16481
  Located on chromosome 7
  Distance between a terminus base of telomere on chromosomal short arm and 5'-terminus of this base sequence : 83351962
  Distance between 3'-terminus of neighbour sequence of sequence listing upward to telomere on chrosomal short arm and 5'-terminus of this base sequence : -402
aatgcttagaaactcattcagaacaggccccaagttatctagttaacaaaaaacaggggaaatatatatatatatatatatatgtctatatgtctgtgtgtgtgtgtatgtgtgtttgtgtttgtgtgtgtgtgtgtgtgtgtgtgtgtgtgtgtgtgtgtgtgtgtgtgtgaatatagagacaggtaaaaagaatcaagggtcaatccttgagaaatatctgtgtataaagtagaaagatcaacagaatcagtgaag

SEQ ID NO: 12336 - DNA, 401 bp, Homo sapiens
  AC004892.2_41476
  Located on chromosome 7
  Distance between a terminus base of telomere on chromosomal short arm and 5'-terminus of this base sequence : 83376852
  Distance between 3'-terminus of neighbour sequence of sequence listing upward to telomere on chrosomal short arm and 5'-terminus of this base sequence : 24632
acaaggtgacagtatcctgaagctgtaagatttaaaagaggacaatcaactaataaagataaacagaaaataagatgttttacttcgtgttacattgatgtctgttgcatcctgcctttttaaaaaaaaaatatatatatacacacatatacacacacacacatacatatatatatatatatatatatatatatatatcaggaaaacgactatgtctttaggatataaagaaatttcacggctatgtccaaataaattcaatccatttccaaagtcaactaaaaagtttttttttaatgaaagagaaatagaaaatgtcaagtagaactataatttcagcagttatacagcagtcattatactgttgccaaaaactgaagatctatcaacattcatggcac

SEQ ID NO: 12337 - DNA, 433 bp, Homo sapiens
  HUMUT5227B
  Located on chromosome 7
  Distance between a terminus base of telomere on chromosomal short arm and 5'-terminus of this base sequence : 83404942
  Distance between 3'-terminus of neighbour sequence of sequence listing upward to telomere on chrosomal short arm and 5'-terminus of this base sequence : 27689
cttactctgccctgcactgatgcataatttgctttggtcttgaatacatccctggataattctttattcttgcagaagtctcccctacacaattgaaattcgcctttaatggtttccaagaggacagaactcctcggtttggtgtttccaaagatgcaaaaaaactctaaaaatggagtaactaaacacagcatatgataaaattggtgagattatctgttttatgaatacaaaaatacaaccccaaattttcctagaagactttcgtaaatattcagtaatctaaaatgttgtaaattgattgtccagacacacacaaaatgtctctctctctctctctctctcacacacacacacacacacacacacagaatttagaaaactggttagttttgtaaaattcactttaaagggaagattgccaattctccat

SEQ ID NO: 12338 - DNA, 433 bp, Homo sapiens
  AC005159.1_3671
  Located on chromosome 7
  Distance between a terminus base of telomere on chromosomal short arm and 5'-terminus of this base sequence : 83405045
  Distance between 3'-terminus of neighbour sequence of sequence listing upward to telomere on chrosomal short arm and 5'-terminus of this base sequence : -330
ctttaatggtttccaagaggacagaactcctcggtttggtgtttccaaagatgcaaaaaaactctaaaaatggagtaactaaacacagcatatgataaaattggtgagattatctgttttatgaatacaaaaatacaaccccaaattttcctagaagactttcgtaaatattcagtaatctaaaatgttgtaaattgattgtccagacacacacaaaatgtctctctctctctctctctctcacacacacacacacacacacacacagaatttagaaaactggttagttttgtaaaattcactttaaagggaagattgccaattctccattttgatctaggagaaactggtaacattaaagatacatgtatgttatggtttcttataaaagtcatggtatcttcaccttctggcgtaacataaactattgatt

SEQ ID NO: 12339 - DNA, 407 bp, Homo sapiens
  AC005159.1_32864
  Located on chromosome 7
  Distance between a terminus base of telomere on chromosomal short arm and 5'-terminus of this base sequence : 83434225
  Distance between 3'-terminus of neighbour sequence of sequence listing upward to telomere on chrosomal short arm and 5'-terminus of this base sequence : 28747
ttcactgagtcaatcactgttagattattcttatttaagtgcaaaaaggggaaagcaatgtggggagcaccatatctatattgaataatgtacaggggctcatatgaatacaatacacttccacactcaaaagaacactagattacaaactctatgaggggaggcaattcttttttgttggttctagctcctaaatcagtgcctgacatacattaagcacccaatagataaatatgtgttcaatacaggtatttatgaatgaatgaatgaatgaatgaatgaatgaataatggccaatatattttgttccatgcatcataaaaatgacataacttaaaggaataaaataaaacaagccaaattttattatctgcaaggtcacacagtatgacctaaagcatgtagca

SEQ ID NO: 12340 - DNA, 306 bp, Homo sapiens
  AC004970.2_10805
  Located on chromosome 7
  Distance between a terminus base of telomere on chromosomal short arm and 5'-terminus of this base sequence : 83491966
  Distance between 3'-terminus of neighbour sequence of sequence listing upward to telomere on chrosomal short arm and 5'-terminus of this base sequence : 57334
actgcatctgacctcagttattattttcaatgaaatgtttcaacctctagcaacatggtgtaacaaaaattccaaccaacatacctgctacactacaacaatatcttggatatttgaagaagcataatataaagaaagaaacgaagcatagaaataaaaaagaaatataaagaaagaaagaaagaaagaaagaaagaaagaaagaaagaaagaaagaaagaaagaacgaacagaaaatttttgagggtcaagatatttataaaagatagtaaacaaaaaaacctgaacaatgagtattaagcaaac

SEQ ID NO: 12341 - DNA, 470 bp, Homo sapiens
  AC004970.2_71378
  Located on chromosome 7
  Distance between a terminus base of telomere on chromosomal short arm and 5'-terminus of this base sequence : 83552438
  Distance between 3'-terminus of neighbour sequence of sequence listing upward to telomere on chrosomal short arm and 5'-terminus of this base sequence : 60166
gaaatatgttgctttggatttaaatgcttgagtgcctctataaggcattgggaaaaaaacagacaataaataaatttattagccctaaccctgaaagatacagttatccctttcctacctaatattctaaatttaattttgcacacaggttataggtaattggtcttctaactcagtcctaaaaaattcaaatacaataataaagagacagagagagaggaaggaaggaaggaaggaaggaaggaaggaaggaaggaaggaaggaaggaaggcaggcaggcaggcaggcaggcaggcagggagggagggagggaggcaggcaggaagggagggaggcaggcagggagggaggccgggagggaggggcaataacactttaattgccttgaaacagcacttgcatataaaaattgtagctatatacaaacatgtaggagtttaatgaagtaacagaaatgaatttcatcttg

SEQ ID NO: 12342 - DNA, 334 bp, Homo sapiens
  AC004970.2_138112
  Located on chromosome 7
  Distance between a terminus base of telomere on chromosomal short arm and 5'-terminus of this base sequence : 83619347
  Distance between 3'-terminus of neighbour sequence of sequence listing upward to telomere on chrosomal short arm and 5'-terminus of this base sequence : 66439
caataggaaactaatgcaacctccttggaagctacacagatttttggattataatctctattattgcaaatttgtggggatagagacatatatatgtgtgtgtgtgtgtgtgtgtgtgtgtgtgtgtgtgcgtgtgtgtatatatatatataaagttgtagtcttttttttaaggccagactcatgttttgtttagttcttaacaataggattatcttaaaatttaaagcagggatgtccaatcttttggcttccctgggccacattggaagaagaagaattgtcttcttgggccacagataaaatacagtaacagtaacaatagctgatgagc

SEQ ID NO: 12343 - DNA, 250 bp, Homo sapiens
  AC004894.1_45644
  Located on chromosome 7
  Distance between a terminus base of telomere on chromosomal short arm and 5'-terminus of this base sequence : 83676651
  Distance between 3'-terminus of neighbour sequence of sequence listing upward to telomere on chrosomal short arm and 5'-terminus of this base sequence : 56970
ctcattaaatcatttgattgcacactcggtcttttaagagttcgcaaatgtcatgcagttttaatatgatatttgtgtgtgtgtgtgtgtgtgtgtgtgtgtgtgtattttgggaaaggtgtgcttgctaataaatttaagaaagcatggctgcatttcatatggcacctaacctcactactgtgaaatattgtcatggttacctgcaaagcagcaggatgtatgtgggtgaaagatgaggttcaaacag

SEQ ID NO: 12344 - DNA, 468 bp, Homo sapiens
  chr7.fa.O7frz.83793011
  Located on chromosome 7
  Distance between a terminus base of telomere on chromosomal short arm and 5'-terminus of this base sequence : 83787656
  Distance between 3'-terminus of neighbour sequence of sequence listing upward to telomere on chrosomal short arm and 5'-terminus of this base sequence : 110755
aggtcaatttgttcagattctttttgtatccctatgtcttcagacacaaggacatccctttcctctgggtatagggtggcacctctcatatgagggtcttttgacttgcttcaggggaaaatttaaaaatccttcttaggttttataacatgcttcaggggagaaaggcaaagggaaagcgagagtgaatttcctgcctctgctgttttctcaaatgccatttttgggtaacatatcctgaactccatcactaggtaagggccaggaatcattcagtaacttctttaattaaatgaaattaaggtaaatgtgtgtgtgtgtgtgcgtgtgtgtgtgtgtgtgtcttggggaaaggatagtgggaaagcgggacagaagaatggtgggatctggttgtttccatatattttcatttctcctgaaataccctttctataatcaagtaagaagcgacattagttacatgaa

SEQ ID NO: 12345 - DNA, 274 bp, Homo sapiens
  AC004006.1_64125
  Located on chromosome 7
  Distance between a terminus base of telomere on chromosomal short arm and 5'-terminus of this base sequence : 83859440
  Distance between 3'-terminus of neighbour sequence of sequence listing upward to telomere on chrosomal short arm and 5'-terminus of this base sequence : 71316
gtcaggtaatggttgaacagagattccccggaatgctttgaataaataaatctctcagctcttgccaagggctggctgtgtgtgtgtgtgtgtgtgtgtgtgtgtgtgtgtatttgtgtgtgtgtgtgtgtttgtttgtttgttggggtattgtcagaggcgttttaaccagagcaactcaatcttgaataggagctgggtaaaataaggctgagacctgatgggctgcattcccagtaggttagtcattcttagtcacaggatgaaataggag

SEQ ID NO: 12346 - DNA, 282 bp, Homo sapiens
  AC004006.1_102618
  Located on chromosome 7
  Distance between a terminus base of telomere on chromosomal short arm and 5'-terminus of this base sequence : 83897809
  Distance between 3'-terminus of neighbour sequence of sequence listing upward to telomere on chrosomal short arm and 5'-terminus of this base sequence : 38095
ggtcatctaccagataaaggaccacacgcagctgaggtgtttgctgaaggccaaggaaatacagaatgagtagtgggagaagatagttataaatagcagctcggaccatgtgaccagttatggaaattaggagtatttcctccttagcttgttctgaatatgtgtgtgtgtgtgtgtgcatagatagataaatgatagatgatagatagatagatagatagatagatagatagatacatagatttaccataagaaattgactcatacaattatggaagctga

SEQ ID NO: 12347 - DNA, 316 bp, Homo sapiens
  AC004006.1_113453
  Located on chromosome 7
  Distance between a terminus base of telomere on chromosomal short arm and 5'-terminus of this base sequence : 83908797
  Distance between 3'-terminus of neighbour sequence of sequence listing upward to telomere on chrosomal short arm and 5'-terminus of this base sequence : 10706
ggtcaggttagtgacaactcactttcaaggttatttccacttcaggggtgtgtgtgtgtgtgtgtgtgtgttggaggtggcaagtggttgggaagttaagaatgtgaccaacttggtcttaacatttccctcagcttgaccacactcatgacagtgacaggcttcttcttcttctttcttctttcctccttctccttcttcttcctcctcctcctcctcttccttctctctcctcctccacttttcctcctcctcctcctttttaaaatcaggaatacttttgcagaaaatatagataggcttctagactcaaagc

SEQ ID NO: 12348 - DNA, 250 bp, Homo sapiens
  AC004082.1_77780
  Located on chromosome 7
  Distance between a terminus base of telomere on chromosomal short arm and 5'-terminus of this base sequence : 83992311
  Distance between 3'-terminus of neighbour sequence of sequence listing upward to telomere on chrosomal short arm and 5'-terminus of this base sequence : 83198
aagataatgaaatttgaaggcttctttggtgtatctactttcataaaattatctaaaacattgaaagtattcatttttaatgatttatctggttttcctttactaaacttactacacacacacacacacacacacacacacacacacacacacacacgtttttcaaaattactcctctgaggttatttctcttaatttagaaaaaatacaacttgcatcccattttgtaagctctgtttaatagtgcgat

SEQ ID NO: 12349 - DNA, 251 bp, Homo sapiens
  AC004886.1_15835
  Located on chromosome 7
  Distance between a terminus base of telomere on chromosomal short arm and 5'-terminus of this base sequence : 84065500
  Distance between 3'-terminus of neighbour sequence of sequence listing upward to telomere on chrosomal short arm and 5'-terminus of this base sequence : 72939
cctgtgaaaggtattagcattatttatagagtaagtgactaaagtaaaattaaaaaataagagattaggttatctgtgcaattcacaaagcagtgctgaatttctaccgaagaaggcagaggttaagcatatagatagatagatagatagatagatagatagatagatagatagataggtacacacacacacatacacacacatataagtatacacatatatttgaaatgaaacaaatatggactttaaga

SEQ ID NO: 12350 - DNA, 387 bp, Homo sapiens
  AC004886.1_88686
  Located on chromosome 7
  Distance between a terminus base of telomere on chromosomal short arm and 5'-terminus of this base sequence : 84138335
  Distance between 3'-terminus of neighbour sequence of sequence listing upward to telomere on chrosomal short arm and 5'-terminus of this base sequence : 72584
tagagcaactaattggctgaagtcaccagggaaaccttaataaagtgaaatttattatgagctgtggcagaccaattggatttggaaaacaaagaaaaatgaaccaaagctccaggaacaagaaacacacacacacacacacacaaacacacacacacacacacacacacacacacacacacactccacaaaatgagtatctttcttggtctaggataatagaaacaagtaaaaagctaggtggagaatgaaaacaatgtataattcatatgcaaaagataaatatcagttatagaatttaggctgaagttggcagggatagaaaaaagtccaattttaagtcaatatttaagaaggacttagctcttcagttaaggcatgattgtt

SEQ ID NO: 12351 - DNA, 400 bp, Homo sapiens
  AC004903.2_26022
  Located on chromosome 7
  Distance between a terminus base of telomere on chromosomal short arm and 5'-terminus of this base sequence : 84218875
  Distance between 3'-terminus of neighbour sequence of sequence listing upward to telomere on chrosomal short arm and 5'-terminus of this base sequence : 80153
aattctactcaagcagtcacttctcttaggtgtataaaatcaaatatatatatatattatatttatatattatatataatatatattttatatatacacctttaaaatatatatatatatatatatataaaaatgaaaaataaggtgagatcaactaataaaggaaaggtttggctaaaacacatttatcactatggaattcctggctttaaaagataaaaatacgtagatcacaaaaataaaaatcatgaaaactttcatcctaatatagacaagagtgactataaattatttttgacaaaaaataagagaaagcctaaaatacagtcatgacagaaatttatttaaccaatctccatgcattattgacaaagaacttgacagaagccataaatctaag

SEQ ID NO: 12352 - DNA, 350 bp, Homo sapiens
  AC004903.2_36464
  Located on chromosome 7
  Distance between a terminus base of telomere on chromosomal short arm and 5'-terminus of this base sequence : 84229281
  Distance between 3'-terminus of neighbour sequence of sequence listing upward to telomere on chrosomal short arm and 5'-terminus of this base sequence : 10006
gttcagtgcctaggacatagtaagtttttaataaatatctcaatatataaatacacatgatcataaatgtcactctttatattcttggctcttcacaacatactctaaagattctccacctcccccaccccacccccccgcccacacacacacacacacacacacacacaaagactgatgatataaaacaataatggaagtgaaaagaacccatgagggaggagggaaaagtacaccttcgagccctgtggtggttttaaagatatgctgaccaattctttgatacttcttccctcaagaggtgaagcttgattgccttcttgagtgtggactgaacttaatgactcact

SEQ ID NO: 12353 - DNA, 166 bp, Homo sapiens
  AC004027.1_36105
  Located on chromosome 7
  Distance between a terminus base of telomere on chromosomal short arm and 5'-terminus of this base sequence : 84442193
  Distance between 3'-terminus of neighbour sequence of sequence listing upward to telomere on chrosomal short arm and 5'-terminus of this base sequence : 212562
gtagatttgatatgcctgacctatcaaatttggtttattttaaaatgattctgaatttacacaacttactagtgaggcaactcaccagtgataagatactgtatgtgtgtgtgtgtgtgtgtgtgtgtgtgtatacttttaacttgacattaggttaaaagtggaa

SEQ ID NO: 12354 - DNA, 286 bp, Homo sapiens
  chr7.fa.O7frz.84423465
  Located on chromosome 7
  Distance between a terminus base of telomere on chromosomal short arm and 5'-terminus of this base sequence : 84527601
  Distance between 3'-terminus of neighbour sequence of sequence listing upward to telomere on chrosomal short arm and 5'-terminus of this base sequence : 85242
gtaaaccaaggtccatcttaaccactctgtcatctgtcttcacctgcaaaaacaaaaaagtaaatggcactgaagtacacaggagagaaaataacaatccatcaccctttccactacctatcttgaattttttcattttcactgtcacataatgaaaccctgaaaatcatacatacacaaaaatgctaaataattacatctctctctctctctctgtgtgtgtgtgtgtgtgtgtgtgtgtgtattctgaagatatttacattggtggtcacttcatatcaatgac

SEQ ID NO: 12355 - DNA, 273 bp, Homo sapiens
  chr7.fa.O7frz.84506854
  Located on chromosome 7
  Distance between a terminus base of telomere on chromosomal short arm and 5'-terminus of this base sequence : 84576490
  Distance between 3'-terminus of neighbour sequence of sequence listing upward to telomere on chrosomal short arm and 5'-terminus of this base sequence : 48603
agtctaacctgacttaggcaacccttttctcatatttaaagtcttcctttttttaatactctgtttatacacacacacacacacacacacacacacacagggagagagagagagagagagaattggtagagaaactcaaaatatttcaaattaatattttctctttaatatttatttttctcaaatattgtacctctttattcaagcccctgaagaacttaattactatataattctcattttatagccttgtccaattatgaagctgaagta

SEQ ID NO: 12356 - DNA, 203 bp, Homo sapiens
  D7S2540
  Located on chromosome 7
  Distance between a terminus base of telomere on chromosomal short arm and 5'-terminus of this base sequence : 84647242
  Distance between 3'-terminus of neighbour sequence of sequence listing upward to telomere on chrosomal short arm and 5'-terminus of this base sequence : 70479
actggcaggaggtcgtgtgtgtgtgtgtgtgtgtgtgtgtgtgtgtgtattttatatatatggagagagaggaagagtgaaagagagcaattagtatacatatgtttgaagtcaaaagagaactacatagaaaataaagacattagaaagaaaggaaagatagggtgaaatgcaatatttgcttctactttaacctgtaatca

SEQ ID NO: 12357 - DNA, 174 bp, Homo sapiens
  AC006204.1_98746
  Located on chromosome 7
  Distance between a terminus base of telomere on chromosomal short arm and 5'-terminus of this base sequence : 84699352
  Distance between 3'-terminus of neighbour sequence of sequence listing upward to telomere on chrosomal short arm and 5'-terminus of this base sequence : 51907
tgttcaatctgtcaaacataagacaaagccttctttttgtgttttaagttaacttttttgttttgttttgttgtttctgtgtgtgtgtgtgtgtgtgtgtgtgtgtgtgtgtgtgtgtttgaagtggagtctcactcagttgcccaggttggagtgtagtggctcaatcttggc

SEQ ID NO: 12358 - DNA, 250 bp, Homo sapiens
  AC006204.1_92277
  Located on chromosome 7
  Distance between a terminus base of telomere on chromosomal short arm and 5'-terminus of this base sequence : 84705854
  Distance between 3'-terminus of neighbour sequence of sequence listing upward to telomere on chrosomal short arm and 5'-terminus of this base sequence : 6328
aggtgcttaatgaaacatgttaagatgcattataataaggggtgtgtgtgtgtgtgtgtgtgtgtgtgtgtgtgtgtgtgtgtgttgagaaaggaggggaatatagtgaatgtgggaccactagctctagggctagtggggaggaggaggctgccaaaggcacagagtccagtcttttggtagcatgggagtaagaactggcaaggatggagaagacaaagacaaaacataaccagcatttcctacgtta

SEQ ID NO: 12359 - DNA, 323 bp, Homo sapiens
  AC006204.1_76135
  Located on chromosome 7
  Distance between a terminus base of telomere on chromosomal short arm and 5'-terminus of this base sequence : 84722012
  Distance between 3'-terminus of neighbour sequence of sequence listing upward to telomere on chrosomal short arm and 5'-terminus of this base sequence : 15908
cataggaaggctttctgaacttcctttttatttatttatttatttatttatttatttatttatttattttcagttgtatgtgtgatggaaccactatatcaagagcgctatcttctaaagtaatatcctcccctagctattccctgaaattggcagacatggacagttaaagcaggatatctttatcccagagaaactttcttagacagcctgttcctctgtggcagaggaaatttggttttaactgaacctggcttctaagacctttacaagtggctgtttgcaaattattccagggaaataagtctttaagtcctagcctg

SEQ ID NO: 12360 - DNA, 317 bp, Homo sapiens
  AC006204.1_45357
  Located on chromosome 7
  Distance between a terminus base of telomere on chromosomal short arm and 5'-terminus of this base sequence : 84752679
  Distance between 3'-terminus of neighbour sequence of sequence listing upward to telomere on chrosomal short arm and 5'-terminus of this base sequence : 30344
ccacaactggacaataaactttagttactagctagtagtggagcatcaaatcatttgaagtggggaggggcaagatcataaaatcaaatttatatatttgtaattatctctgaaacctctctctctctctctttcgctctttctctctctctctgtctctctctctctctctctctctctgtgtgtgtgtgtgtgtgtgtgtgtgtgtgtgtgtgtgtgtgtgtgtgtgttggggagggggaaagagttttggagttgagatcagctagaaatacataatctgctctaacacagtcattgtaggattggaaagtaaa

SEQ ID NO: 12361 - DNA, 153 bp, Homo sapiens
  AC006204.1_1580
  Located on chromosome 7
  Distance between a terminus base of telomere on chromosomal short arm and 5'-terminus of this base sequence : 84796538
  Distance between 3'-terminus of neighbour sequence of sequence listing upward to telomere on chrosomal short arm and 5'-terminus of this base sequence : 43542
tttacaactggatcttaagcttcttgagaactgggtttgactaaaagctatgtgtgagagtgtgtgtgtgtgtgtatgtgtgtgtgtgtgtgtgtgtgaaacttcttattttaaaatagttttaaatttacagaacagttatggtgagtacag

SEQ ID NO: 12362 - DNA, 154 bp, Homo sapiens
  AC004954.1_79360
  Located on chromosome 7
  Distance between a terminus base of telomere on chromosomal short arm and 5'-terminus of this base sequence : 84805230
  Distance between 3'-terminus of neighbour sequence of sequence listing upward to telomere on chrosomal short arm and 5'-terminus of this base sequence : 8539
aggcagtaggaaatcaactagaaaatattccacacctcttactacccttgtaccttgtctccttctctctctctctctctctctctctctctctgccttttctcctctttaatcctaatgatcccttcctttccagctctagttaagaacatgt

SEQ ID NO: 12363 - DNA, 307 bp, Homo sapiens
  AC004954.1_41398
  Located on chromosome 7
  Distance between a terminus base of telomere on chromosomal short arm and 5'-terminus of this base sequence : 84843199
  Distance between 3'-terminus of neighbour sequence of sequence listing upward to telomere on chrosomal short arm and 5'-terminus of this base sequence : 37815
aacatgatctgtaattcgcatcaccaggagagaagaatgttggcatatatatatatatatatatatatatatatatatatatatatacacacacacacacacacacacacattagctaacaatccaatgattatatatatatatatgattgttagctaatgtacaacatataaagatatttcagaattatttctactatttatttttatttgtacatcttgggtttttttctccttataattatttaaaggtagtgattgtggtaggttctataatttttattgtcttagaaatagccaaatctgtg

SEQ ID NO: 12364 - DNA, 381 bp, Homo sapiens
  chr7.fa.O7frz.85047326
  Located on chromosome 7
  Distance between a terminus base of telomere on chromosomal short arm and 5'-terminus of this base sequence : 84970889
  Distance between 3'-terminus of neighbour sequence of sequence listing upward to telomere on chrosomal short arm and 5'-terminus of this base sequence : 127383
ttagtcatgtatgacatttgacatttgacatttaaatattcaaattggcattaattgatctgatggcatctttaggtggtcaagataaacacttttaaacaaataatagtgcttaccaataatgtagatttctttttctatgaacttagaaatatataaagctaataatgtttaagctgaataaatgttagatactttttattattattatgaaatacatcacacagatatgtggatatgtgtgtgtgtgtgtgtgtgtgtgtgtatgtaaaggctgaaaaataaagttgtaaacacaaatctatataatgaaatgttactattttctaataaatattagatgaagttctcaggaaaagataagctaatggactatctgtg

SEQ ID NO: 12365 - DNA, 239 bp, Homo sapiens
  AC006322.2_85568
  Located on chromosome 7
  Distance between a terminus base of telomere on chromosomal short arm and 5'-terminus of this base sequence : 85072886
  Distance between 3'-terminus of neighbour sequence of sequence listing upward to telomere on chrosomal short arm and 5'-terminus of this base sequence : 101616
agttcacttaggttaatgaccttcagttccatccatgttgttgcaaagacataattttattctttttcatggctgcatagtattccatggtgtttatctatctatctatctatctatctatctatctatctatctatctgtcatctaactatctgtatgtatgtgtatctatctatatgtgtttgtatatgtagtatatatgtataccatatttgctttatccagtgaactgtttatgg

SEQ ID NO: 12366 - DNA, 184 bp, Homo sapiens
  AC006322.2_51053
  Located on chromosome 7
  Distance between a terminus base of telomere on chromosomal short arm and 5'-terminus of this base sequence : 85107417
  Distance between 3'-terminus of neighbour sequence of sequence listing upward to telomere on chrosomal short arm and 5'-terminus of this base sequence : 34292
tgaatgtaagaatcctacaagtgacttgtttttaaatatgaatacatagatagggctaaaatgtggacatgtttaaattagttcaaacacacacacacacacacacacacacacacacacacagagtacataggtaaaacaacccaagatttgagaatctgtgttccagctaaattagctactc

SEQ ID NO: 12367 - DNA, 419 bp, Homo sapiens
  chr7.fa.O7frz.85274595
  Located on chromosome 7
  Distance between a terminus base of telomere on chromosomal short arm and 5'-terminus of this base sequence : 85189139
  Distance between 3'-terminus of neighbour sequence of sequence listing upward to telomere on chrosomal short arm and 5'-terminus of this base sequence : 81538
tttgcattaggtcttcaataaataaattcatattgtaaatgtattcatccatcatcaactgtcctttcataatttacattattatgcttttgaattacattaggtataaacctagtgtgtgattagattatatgctcttgtcatttgagaatatctgatataatttcattcagaaaataatctctaggaacaatttttttattatctcataaggttacacatttgcacacacatcccttccatatacacacacacacacacacacacacacacattttagaaagtagtaatttggatattgactttgattacatttaaagacacgaagacaaaacagatgtttttaatgagtttctataaaattgaaaagatttgaaggaaaagatgatcgtctttttacattgtcaacgtaagacatg

SEQ ID NO: 12368 - DNA, 328 bp, Homo sapiens
  AC004848.1_87602
  Located on chromosome 7
  Distance between a terminus base of telomere on chromosomal short arm and 5'-terminus of this base sequence : 85398681
  Distance between 3'-terminus of neighbour sequence of sequence listing upward to telomere on chrosomal short arm and 5'-terminus of this base sequence : 209123
attcaagtttgctgtgagctatgattacagtgtgagaccctgtcaaaaaaaaaaagaaaagaaaaagaaaaagtagaggtataggtaaagcataaagccatggtcatcatcattattatcatcatttcaactaacatgggcaagccaagctaggtactgtcctaatctctctctctctctctctctctctctctaacacacacacacacacacacacacacacacacacacacacacacaatttattgtgtatgcattatccttcttctaaaggatatcactgtaggtaaattagtatgagggcagaagtgaaaggtatgaataccag

SEQ ID NO: 12369 - DNA, 319 bp, Homo sapiens
  AC004848.1_103875
  Located on chromosome 7
  Distance between a terminus base of telomere on chromosomal short arm and 5'-terminus of this base sequence : 85414967
  Distance between 3'-terminus of neighbour sequence of sequence listing upward to telomere on chrosomal short arm and 5'-terminus of this base sequence : 15958
taagccttatgagataattgtgaggtcttaaaatctgaggtatcaaaaactcagagggaatatatattcttaagaattataacgattccacatttatcctcattgacagaattgcaccaaatattggtaattaaatgtttactatagactatttagtgagattaaaaaaaactatcaatctgtctatctatctatctatctatctatctatctatctatctatctatctatctatcgttagttcgttctaaactatgacaagtgttctatcataccctttatatatattaaccttaaaataactccatagtcagcctga

SEQ ID NO: 12370 - DNA, 226 bp, Homo sapiens
  D7S820
  Located on chromosome 7
  Distance between a terminus base of telomere on chromosomal short arm and 5'-terminus of this base sequence : 85415001
  Distance between 3'-terminus of neighbour sequence of sequence listing upward to telomere on chrosomal short arm and 5'-terminus of this base sequence : -285
ctgaggtatcaaaaactcagagggaatatatattcttaagaattataacgattccacatttatcctcattgacagaattgcaccaaatattggtaattaaatgtttactatagactatttagtgagattaaaaaaaactatcaatctgtctatctatctatctatctatctatctatctatctatctatctatctatctatcgttagttcgttctaaactatgaca

SEQ ID NO: 12371 - DNA, 300 bp, Homo sapiens
  AC004451.1_103624
  Located on chromosome 7
  Distance between a terminus base of telomere on chromosomal short arm and 5'-terminus of this base sequence : 85451205
  Distance between 3'-terminus of neighbour sequence of sequence listing upward to telomere on chrosomal short arm and 5'-terminus of this base sequence : 35978
cattgtcactacagctttcattacttaatgtccacagaccaatagagaaagcacagcgctcgctcgctctgctttctctctctctctctctctctctctctctgtctctccctctctgccgttggatgtgtggcttgtgtgaatgtaggtggagaaggaggaagaggaggatttaaagagggggagaatggggaaaagggagtaggaattctctctctacttcactagattgactcatcaaacagatcttattgtatttgtcagtttcctcaagcctattgatcagccagtattgttaag

SEQ ID NO: 12372 - DNA, 210 bp, Homo sapiens
  G10054
  Located on chromosome 7
  Distance between a terminus base of telomere on chromosomal short arm and 5'-terminus of this base sequence : 85504217
  Distance between 3'-terminus of neighbour sequence of sequence listing upward to telomere on chrosomal short arm and 5'-terminus of this base sequence : 52712
tgagaccaagatggaaaggaaattagtaaggaggagatttgtgctggtcacagtctctctctctctctctgtctatcatctatctatctatctatctatctatctatctatctatctatctatctatcatctacatatatatagatatatacatatttaacttctttttgccaatacatgcaggtaaaataaacacatctggctttcctg

SEQ ID NO: 12373 - DNA, 363 bp, Homo sapiens
  AC004451.1_31711
  Located on chromosome 7
  Distance between a terminus base of telomere on chromosomal short arm and 5'-terminus of this base sequence : 85523059
  Distance between 3'-terminus of neighbour sequence of sequence listing upward to telomere on chrosomal short arm and 5'-terminus of this base sequence : 18632
gcatgtcattaaacaatggatatggtaccttttccttacggccatggtgattttcctgtaagacggaaggggcaccaaactgagcaaagaaagatttttcctgagagacataagcatgtgtgtgtgtgtgtgtgtgtgtgtgtgtgtgtgtgtgtgtgtgtgcaggtgctctgagagagagaactctgacttttctgcttttccctttggagtcccaaggtaggatgaggctagttgtgacactttccttctcacctccagcttggtaaaacacatggtctgcagtagagaagagtaaagttcacttgggcccaggtgaaaatgagaggggaaggctctgtgaaatatctgagtgcctacttc

SEQ ID NO: 12374 - DNA, 351 bp, Homo sapiens
  AC004028.1_99276
  Located on chromosome 7
  Distance between a terminus base of telomere on chromosomal short arm and 5'-terminus of this base sequence : 85567693
  Distance between 3'-terminus of neighbour sequence of sequence listing upward to telomere on chrosomal short arm and 5'-terminus of this base sequence : 44271
taattaggcaacctttgaatctaaatcacccaagtgcccaagtgttcagtactaccaacgtttctggagtccctatttctttcagaggatattttggtgttgttttatatatatatatatatatatatatatatatatatatatatatatatatacacacacacacacacacacacgtacacacatatatgttacatattgtatataatatacattatacatgtgtatatagatgtgtatgtatattatatatgtaggtatacatacacatatataagtgtatatatatgtataatatatatactatataatataattgttttcattaagccatgatttactagcagttag

SEQ ID NO: 12375 - DNA, 339 bp, Homo sapiens
  AC004028.1_98792
  Located on chromosome 7
  Distance between a terminus base of telomere on chromosomal short arm and 5'-terminus of this base sequence : 85568097
  Distance between 3'-terminus of neighbour sequence of sequence listing upward to telomere on chrosomal short arm and 5'-terminus of this base sequence : 53
gaaagacttaaagctgtcattgatattgctagaaaagttccaaatttaaaatatttccctctctttctcttctctccatccatctcgccttccatttttctctcatgagaggctgggaagatgtatatatatgtattatatacgtgtgtatataatacatatatatatatgtatatgtgtgtgtgtatatatatatatatatatatatatatatatatatatatatatatatataaactatacgtgactcctgataagagagtctttcttggctacagttatgaaccttgatacaatcactattttggaaccttcctaatgtttgcactgtctcctatt

SEQ ID NO: 12376 - DNA, 285 bp, Homo sapiens
  AC004028.1_61102
  Located on chromosome 7
  Distance between a terminus base of telomere on chromosomal short arm and 5'-terminus of this base sequence : 85605792
  Distance between 3'-terminus of neighbour sequence of sequence listing upward to telomere on chrosomal short arm and 5'-terminus of this base sequence : 37356
atagttaacatgattggtcctgacacttggtgtccttgaagagttgcttgtgattgcgaagtgtaaaagtaaggtgagttgtgtatattttgtgattctccttgaagattagattattttcaagacagactattaatagtataaatacaaagttatataaacttagggaaacacacatgcatgcagatgtacacatgcatacacacacacacacacacacacacacacactccctaaaataacacactagaacatatttttgagatacgcatcagaagcttgtag

SEQ ID NO: 12377 - DNA, 297 bp, Homo sapiens
  AC004028.1_35319
  Located on chromosome 7
  Distance between a terminus base of telomere on chromosomal short arm and 5'-terminus of this base sequence : 85631568
  Distance between 3'-terminus of neighbour sequence of sequence listing upward to telomere on chrosomal short arm and 5'-terminus of this base sequence : 25491
catcttcaccagtatttgttactctttctctttttaataatatacattttaacaggtttaagatgacttctcattctggttttgatttgcatttccctgatgattagcaatgttaagcatttgttcatatatttttatgatgtttgtgtgtcttcttttgagaaatgtcaattcagattatttgcatatttttaatcagatttatttttatgtatgtatgtatgtatgtatgtatgttgctcttgagttgtttgagatttttgtatattatgggtgataatccattatcagatgaat

SEQ ID NO: 12378 - DNA, 170 bp, Homo sapiens
  D7S2417
  Located on chromosome 7
  Distance between a terminus base of telomere on chromosomal short arm and 5'-terminus of this base sequence : 85792644
  Distance between 3'-terminus of neighbour sequence of sequence listing upward to telomere on chrosomal short arm and 5'-terminus of this base sequence : 160779
ggtgggagagtcaatcctaaaactgatctgcctttcactcaacccaaataacacttctcaattgtgtgtgtatgtgtgtgtgtgtgtgtgtgtgtgtgtgtgtgtgtgttgtgctgtgctttgattcagtttgttttttactctaggactctaacgattttgactttctg

SEQ ID NO: 12379 - DNA, 424 bp, Homo sapiens
  AC003984.1_47588
  Located on chromosome 7
  Distance between a terminus base of telomere on chromosomal short arm and 5'-terminus of this base sequence : 85821397
  Distance between 3'-terminus of neighbour sequence of sequence listing upward to telomere on chrosomal short arm and 5'-terminus of this base sequence : 28583
aatctagtaacagcttcactacgtctcatgtatgaaaagaatcttctgcctccatttgatggaaaagtaggcaatctgcttaagatatttacaggctaaatatccctgtacaggttgagggtttcatggtgtctattatttgctttaattatttatttatttatttatttatttttatttatagagatgggatcttgctatgttacctaggctgggctcaaactcctggcctcaaactcctggcctcagtgatcctctttctacagtttcccaaaacacttggattatagacatgagccatcatgctcggccaaggtgtctattatttgatagtaaatataatattatttgaaaataatagtagtttattgtactcaatgtatcagccaggcaaaagtttctagtctggagatggttatttgta

SEQ ID NO: 12380 - DNA, 275 bp, Homo sapiens
  AC004957.1_70404
  Located on chromosome 7
  Distance between a terminus base of telomere on chromosomal short arm and 5'-terminus of this base sequence : 86291220
  Distance between 3'-terminus of neighbour sequence of sequence listing upward to telomere on chrosomal short arm and 5'-terminus of this base sequence : 469399
ggctcagaatgtgacagtctataatatttaaccccaaagtattaacagagtaaaattgatccttctagagctgttttcccaattttaatcacacacatacacacacacacacacacacacacacacacacacaatctcccagggaaggtaaaaatatataatttaacatttttgtagtgcaacatcatagtgtaagaactaataactgggagttattgtaagaacaatgaccttgaatttacagtatgatagtaaatagccaagaatttggagtt

SEQ ID NO: 12381 - DNA, 400 bp, Homo sapiens
  AC004957.1_86618
  Located on chromosome 7
  Distance between a terminus base of telomere on chromosomal short arm and 5'-terminus of this base sequence : 86307360
  Distance between 3'-terminus of neighbour sequence of sequence listing upward to telomere on chrosomal short arm and 5'-terminus of this base sequence : 15865
ctacagctggaatctggagtagacttgcataagtataatgggcagctcttccaaaaatgaatagaattcaaaagtaatgcaaaacagccttgaggtgaaaaattgcaagcaagtctcaccgaaagaactagtatttccacccattgacttaaaaggtgggtcttgaagggaaacacacacacacacacacacacacacacacacacacacacacacacacagagacagagtaataaacatcagacagacataaataatgtattttgaaagtactaacttgcaaagtaaatagacacaaatcttttcagtgggtttatttcatgtggttttgcctattcattcaattagcatttaatagctcatcaagaagatctgtgttatttaccatctacgagagcag

SEQ ID NO: 12382 - DNA, 242 bp, Homo sapiens
  D7S524
  Located on chromosome 7
  Distance between a terminus base of telomere on chromosomal short arm and 5'-terminus of this base sequence : 86307431
  Distance between 3'-terminus of neighbour sequence of sequence listing upward to telomere on chrosomal short arm and 5'-terminus of this base sequence : -329
aagtaatgcaaaacagccttgaggtgaaaaattgcaagcaagtctcaccgaaagaactagtatttccacccattgacttaaaaggtgggtcttgaagggaaacacacacacacacacacacacacacacacacacacacacacacacacagagacagagtaataaacatcagacagacataaataatgtattttgaaagtactaacttgcaaagtaaatagacacaaatcttttcagtgggt

SEQ ID NO: 12383 - DNA, 359 bp, Homo sapiens
  AC004957.1_93436
  Located on chromosome 7
  Distance between a terminus base of telomere on chromosomal short arm and 5'-terminus of this base sequence : 86314220
  Distance between 3'-terminus of neighbour sequence of sequence listing upward to telomere on chrosomal short arm and 5'-terminus of this base sequence : 6547
agaataaggctatccgtggtatatattagttgaaaggtaaaataaatagcacttggaaaaatatccatgctttttcctcctcccacctcattgatgtcatactgaaatttatatagcatacatatacagcatatatatatatatatatatatatgtatagcatttagcatcaggcaaaggctggttatataataagtatttaataagtgtgattattattaagatagttatggggctgataagcattatcattacgatgacaatatacaggggttaatagaaaattgagtacatccatgtacttgtaaaaataatatgtcattattaaaaatttagtagatctgtaggtactgacctgg

SEQ ID NO: 12384 - DNA, 389 bp, Homo sapiens
  AC004957.1_103438
  Located on chromosome 7
  Distance between a terminus base of telomere on chromosomal short arm and 5'-terminus of this base sequence : 86324060
  Distance between 3'-terminus of neighbour sequence of sequence listing upward to telomere on chrosomal short arm and 5'-terminus of this base sequence : 9481
tcttagtcaaccactttgctttacatttaatagaacaatgtaaaaaatggcaaatccctacagagcatttagactttataaatgcctaaatatgagaacaaatacattgttttatcactgaaatttatttttgctcagaaacatatctttaaaattctgccttgtataagaagggattaagatactttctgtagtccctgtttatatccatctaaataagctttcaatgaacgatcagggataattcaaccttaagaatgagaatagctaacttctaaaggaaatgtgcgctcacacacacacacacacacacagagagagagagagagagagagagagagagagaactccagctatgtaaagtagacatagataaggtactgcttcca

SEQ ID NO: 12385 - DNA, 177 bp, Homo sapiens
  AC004957.1_103459
  Located on chromosome 7
  Distance between a terminus base of telomere on chromosomal short arm and 5'-terminus of this base sequence : 86324272
  Distance between 3'-terminus of neighbour sequence of sequence listing upward to telomere on chrosomal short arm and 5'-terminus of this base sequence : -177
taaataagctttcaatgaacgatcagggataattcaaccttaagaatgagaatagctaacttctaaaggaaatgtgcgctcacacacacacacacacacacagagagagagagagagagagagagagagagagaactccagctatgtaaagtagacatagataaggtactgcttcca

SEQ ID NO: 12386 - DNA, 361 bp, Homo sapiens
  AC006151.3_134144
  Located on chromosome 7
  Distance between a terminus base of telomere on chromosomal short arm and 5'-terminus of this base sequence : 86383100
  Distance between 3'-terminus of neighbour sequence of sequence listing upward to telomere on chrosomal short arm and 5'-terminus of this base sequence : 58651
ctacaatctactggtcctgattctttgtttttcttcccaacaatcctataaattcaatagttaatcctttaattgagataatttatgggttaaacgtcttgccaacaacctccttcctactctattgatattttgctgtcttcgtgtgtgtgtgtgtgtgtgtgttgtgtgcacatgtgtgtgtgttgtgcatctgggatgaattatggagagaagtaggtgtgatttaaccaaaagtgggtggatttagtgaaatgcataggttatactgcatgctactgtctgtaacaagcttgacctggagccaattaactgcatataatctattccagatgctccctgatagaaacagcactcttgg

SEQ ID NO: 12387 - DNA, 396 bp, Homo sapiens
  AC006151.3_133546
  Located on chromosome 7
  Distance between a terminus base of telomere on chromosomal short arm and 5'-terminus of this base sequence : 86383716
  Distance between 3'-terminus of neighbour sequence of sequence listing upward to telomere on chrosomal short arm and 5'-terminus of this base sequence : 255
taagccaggatcaggtactattaatgtgaaaaagtagcttctatgcacggaacaatgattaaaatatgtaagtcttcttgcatgaaaatctagaacacttagatttaggattctttctcgtgtgtgtgtgtgtgtgtgtgtgtgtgtcgtgtgtgtgtgtgtgtgtgtgtgtgtgtgtgtgtaggttggggaagggaaggaaagaacccctgattttttaattttataaagagctctttgttctttataccttagtggtacatataaggtcacttgagaatgttttttacccaattcagaaagcacaaggaaatatgcctatctcagcattaaaagcaatatctgtattaactcacttttgccaaattgctgctcctattttgagctattgtttga

SEQ ID NO: 12388 - DNA, 414 bp, Homo sapiens
  AC006151.3_133511
  Located on chromosome 7
  Distance between a terminus base of telomere on chromosomal short arm and 5'-terminus of this base sequence : 86383716
  Distance between 3'-terminus of neighbour sequence of sequence listing upward to telomere on chrosomal short arm and 5'-terminus of this base sequence : -396
taagccaggatcaggtactattaatgtgaaaaagtagcttctatgcacggaacaatgattaaaatatgtaagtcttcttgcatgaaaatctagaacacttagatttaggattctttctcgtgtgtgtgtgtgtgtgtgtgtgtgtgtcgtgtgtgtgtgtgtgtgtgtgtgtgtgtgtgtgtaggttggggaagggaaggaaagaacccctgattttttaattttataaagagctctttgttctttataccttagtggtacatataaggtcacttgagaatgttttttacccaattcagaaagcacaaggaaatatgcctatctcagcattaaaagcaatatctgtattaactcacttttgccaaattgctgctcctattttgagctattgtttgattagatggttttcctgta

SEQ ID NO: 12389 - DNA, 300 bp, Homo sapiens
  AC006151.3_106369
  Located on chromosome 7
  Distance between a terminus base of telomere on chromosomal short arm and 5'-terminus of this base sequence : 86410892
  Distance between 3'-terminus of neighbour sequence of sequence listing upward to telomere on chrosomal short arm and 5'-terminus of this base sequence : 26762
gccttaacaaactgtcatgtagagtgcttcctctccaatcacatcagcccaaggacagtgcattagaattattcagagaaacagaacaagtaggagaaatgcatctatctatctatctatctatctatctatctatctatctatctattgaggtttatttaagagattggctcacataattattgaggctgatgagtcccaagatctgcagttggtaaggtgaagatccaggagaaccaacagtgtatgttcaaaagcctggcaaccaggacagcagatgttacagttctagtccaagtg

SEQ ID NO: 12390 - DNA, 301 bp, Homo sapiens
  AC006151.3_23624
  Located on chromosome 7
  Distance between a terminus base of telomere on chromosomal short arm and 5'-terminus of this base sequence : 86493597
  Distance between 3'-terminus of neighbour sequence of sequence listing upward to telomere on chrosomal short arm and 5'-terminus of this base sequence : 82405
ctaccatgagcagaattatgaccatttcaagctgtttcctagtgacactacctgcaacccaagaactcctttttgtaggtcattatatttattaaaacacttgcatttgttggctagatgatttagtattttattttattttattttatttatttatttatttatttatttatttatttatttatttagagatggggtcttgctctgttgcccaggctggagtgcagtggcatgatctcggctcactgcaacctccaacttcccatttcaagcaatgctcctgtctcagccttctgagtag

SEQ ID NO: 12391 - DNA, 390 bp, Homo sapiens
  chr7.fa.O7frz.86485826
  Located on chromosome 7
  Distance between a terminus base of telomere on chromosomal short arm and 5'-terminus of this base sequence : 86552225
  Distance between 3'-terminus of neighbour sequence of sequence listing upward to telomere on chrosomal short arm and 5'-terminus of this base sequence : 58327
tgttgccatttaatagaactattctcatgttcaagggattgggacacaaacatctttgaagagctgactattgaggcccattaaaatttcactgttcttgatagaaaattggtttcttcataaactgataacagaaattttttttttttacccagactgcctctgggtttacctgtatattaatttatgcatggattcatttagaaatgtctgctatgcgactggaaactaggcaaaactaaattattccactccatgacctcccggtctagataggaaactatacacacacacacacacacacacacacacacacacacacacacacacaataattgcagtacaatgtgaattgatttaattcaggttcatttatagttgaatgacagc

SEQ ID NO: 12392 - DNA, 109 bp, Homo sapiens
  D7S2537
  Located on chromosome 7
  Distance between a terminus base of telomere on chromosomal short arm and 5'-terminus of this base sequence : 86552472
  Distance between 3'-terminus of neighbour sequence of sequence listing upward to telomere on chrosomal short arm and 5'-terminus of this base sequence : -143
tccactccatgacctcccggtctagataggaaactatacacacacacacacacacacacacacacacacacacacacacacacaataattgcagtacaatgtgaattga

SEQ ID NO: 12393 - DNA, 148 bp, Homo sapiens
  Z67614
  Located on chromosome 7
  Distance between a terminus base of telomere on chromosomal short arm and 5'-terminus of this base sequence : 86807214
  Distance between 3'-terminus of neighbour sequence of sequence listing upward to telomere on chrosomal short arm and 5'-terminus of this base sequence : 254633
ttcatccatgttgccgaaaatgacagaattgttttacatggctgaatagtgtcctagtgtgtgtgtgtgtgtgtgtgtgtgtgtgtgtgacgttttctttatcctttcatctgttgttgaacacctaacttgataagacctcaaatgc

SEQ ID NO: 12394 - DNA, 467 bp, Homo sapiens
  chr7.fa.O7frz.86858051
  Located on chromosome 7
  Distance between a terminus base of telomere on chromosomal short arm and 5'-terminus of this base sequence : 87015218
  Distance between 3'-terminus of neighbour sequence of sequence listing upward to telomere on chrosomal short arm and 5'-terminus of this base sequence : 207856
attagttgcatttctatacaccagcagcatccaagttgattgccaaatcaagaacacaatcccattcaaaacagacagacagacagacagacacacacacacacacacacacacacacacacacacacacatttagaaatacagctaaccaggaagataaaaaatctttacaatgacaattttaaaatacttctcaaataaatcagagatgacaaaaacaaatggaaaaacattccatgctcatggatttgaagaatcaatattgtttaaatggccatgtctaaagcaatttacagattcaatgctatttctatcaaactaccaattacattcttcacagaattataaaaaaaagtattctgaaattaagaatgaaaaagagaacaaatagccaaagtaatcctaagcaaaaagaacagaactggtagcatcacattacctgaattcaaagtatgctacaaggttac

SEQ ID NO: 12395 - DNA, 194 bp, Homo sapiens
  chr7.fa.O7frz.86942708
  Located on chromosome 7
  Distance between a terminus base of telomere on chromosomal short arm and 5'-terminus of this base sequence : 87082388
  Distance between 3'-terminus of neighbour sequence of sequence listing upward to telomere on chrosomal short arm and 5'-terminus of this base sequence : 66703
tttacagacaatcttaggatcaacttttatttattttcttctttattgtataaatttaaaatgtacaacagcatgttttgatatatatgtgtgtatatatatatatatatatccatgatgtgtatatatatatatatatatatatatatacataattaaatgactgttataggtaagcaatttaacatgcacat

SEQ ID NO: 12396 - DNA, 360 bp, Homo sapiens
  AC048387.2_900
  Located on chromosome 7
  Distance between a terminus base of telomere on chromosomal short arm and 5'-terminus of this base sequence : 87082691
  Distance between 3'-terminus of neighbour sequence of sequence listing upward to telomere on chrosomal short arm and 5'-terminus of this base sequence : 109
ctattctgcttcttgactgagtactttgtctaacttatcaaatgagtgtgttctctttagcaattatttgccatatgattactattattattattattattcattattcatcttgtattggctgaacttcctgctttctgcataagatcggctttttcttgattttgaactattcacaaaagcctcctgaaatatactttcaccaaatgctaaaataaattttgttataaattctttttctcctctagaggattgcaaaactaccagtttgaaaaaagttcaactggcactggctttgtacatatgatgctgttgatttgacagagatgatgataaaggtagttgctcaggagctaattt

SEQ ID NO: 12397 - DNA, 247 bp, Homo sapiens
  AC004413.1_103829
  Located on chromosome 7
  Distance between a terminus base of telomere on chromosomal short arm and 5'-terminus of this base sequence : 87172287
  Distance between 3'-terminus of neighbour sequence of sequence listing upward to telomere on chrosomal short arm and 5'-terminus of this base sequence : 89236
ctgcaagatacatgtattgcagaagatatatatatatatatatatatatatatatatgtatatatatttcaatctgtatgtttcatcctacagattgaaatatgaagaaaatctaaacaataaaatacaagaagttatcctgaaacttaaattaattttcttttaatccctttaaaagaaaattaaaggaattgttaataatggtttcttcaagcttcaattcctaagactgctaaggaagtgctag

SEQ ID NO: 12398 - DNA, 441 bp, Homo sapiens
  AC004413.1_88798
  Located on chromosome 7
  Distance between a terminus base of telomere on chromosomal short arm and 5'-terminus of this base sequence : 87187145
  Distance between 3'-terminus of neighbour sequence of sequence listing upward to telomere on chrosomal short arm and 5'-terminus of this base sequence : 14611
gatgaggatttagctcacttacattacttcctttcctccataactcctaccattatacttatatcatttttaaaaatttattatttaatgagctttacatatttaaatattttctacatatatatgtgtgtttgtatatatatacacatatatgtgtgtacatatatatacatatatgtgtatatacatatatgtgtgtgtgtgtctgtatatatatatatatatatataatttttctttttaaaaggcagtgtctcactctgttgcccaggttagagtgcagtggtgcgaactcggctcactgcaagctccgcctcccagtttcacgccattctccagccccagcctcctgagtagctgggactacaggcgcccaccaccacgaccggctaattttttgtatttttggcagagacgaggtttcatcgtgatagccaggat

SEQ ID NO: 12399 - DNA, 375 bp, Homo sapiens
  AC004413.1_57657
  Located on chromosome 7
  Distance between a terminus base of telomere on chromosomal short arm and 5'-terminus of this base sequence : 87218363
  Distance between 3'-terminus of neighbour sequence of sequence listing upward to telomere on chrosomal short arm and 5'-terminus of this base sequence : 30777
aaagatggatctatgtgcttgtagtaaagaacattcagattccaggccattttcagctcaacttttccccttaattgtagattctgccaatcagtttcaatctctctatctctctctcaccgtgtgtgtgtgtgtgtgtgtgtgtgtgtgtgtatgtgtttgttattggcttcatcaaccaggaatgtggggtggcatgggctaactacacaacgttgtttgcatggcaacaactcctgtcaacctgagatacatgaagaacttaacaagctttcctcgtatccctaacttcttggtctttcctacaaaatcctctgctagtctgacagtctgctacctgcaccaaacagaatctagttcaggctagcagaactg

SEQ ID NO: 12400 - DNA, 122 bp, Homo sapiens
  D7S2555
  Located on chromosome 7
  Distance between a terminus base of telomere on chromosomal short arm and 5'-terminus of this base sequence : 87218448
  Distance between 3'-terminus of neighbour sequence of sequence listing upward to telomere on chrosomal short arm and 5'-terminus of this base sequence : -290
gccaatcagtttcaatctctctatctctctctcaccgtgtgtgtgtgtgtgtgtgtgtgtgtgtgtgtatgtgtttgttattggcttcatcaaccaggaatgtggggtggcatgggctaact

SEQ ID NO: 12401 - DNA, 286 bp, Homo sapiens
  AC004413.1_42400
  Located on chromosome 7
  Distance between a terminus base of telomere on chromosomal short arm and 5'-terminus of this base sequence : 87233697
  Distance between 3'-terminus of neighbour sequence of sequence listing upward to telomere on chrosomal short arm and 5'-terminus of this base sequence : 15127
tagcatgaaatttggtttaattacctaaatccatggattttatttatttatttatttatttatttatttatttattaaggaatgaagggatttattgaaaatgaaagtacagggcacaaaggctctgttacagaatttttgagagtttaaataccccctacaggattccattggttacttggggtaagctttatgtaaatggagaggatgaagtaaagttacgaagtcatttacttggcctacgccctgtggagaggatatttcctgtcatagctgaagtgtgaat

SEQ ID NO: 12402 - DNA, 337 bp, Homo sapiens
  AC004926.2_49519
  Located on chromosome 7
  Distance between a terminus base of telomere on chromosomal short arm and 5'-terminus of this base sequence : 87325292
  Distance between 3'-terminus of neighbour sequence of sequence listing upward to telomere on chrosomal short arm and 5'-terminus of this base sequence : 91309
accattgctctagtctgtttctataagtgtgatttttaaaaataatatccatatgagtgaaataatacagtatttgtctatacctggcttattttattatatataatgttttccaggtccatccatgttgttgcaaatggcaggactatcttctttttcatggctgagtaatattgcactgtgtgtgtgtgtgtgtgcgtgtgtgtgtgtgtgtgtgtgtgtattcatctatttagtgatcacaaaattttttctttattctgaatttaaatgattgctttcccacttagatttttactattaaccccctgtaagttctctagattcctggaattga

SEQ ID NO: 12403 - DNA, 442 bp, Homo sapiens
  AC004926.2_59440
  Located on chromosome 7
  Distance between a terminus base of telomere on chromosomal short arm and 5'-terminus of this base sequence : 87335183
  Distance between 3'-terminus of neighbour sequence of sequence listing upward to telomere on chrosomal short arm and 5'-terminus of this base sequence : 9554
aagagcaggtaatagttacgtttaatgaaagaactattagaatgtcatatcttactggaatgtttcaagttttttgaaagtttatattgttactaaaatatatcattcctttcacaccaataattttaggcaatattaaatcaagaataaaattagaactgatatatatatatcagtatatatatatatttacatatatcagtatgttatgtatctacatagataggaagatagatagatagatagatagatagatagatagatagatagatagatagatatactaccatggaagcacattttacttattaatagtgaagcatgttttacttatgacagttgttttgaaaatctaacattatgtacaatttcactctctagtgaaattccaatttaaatatatatgactattatttatgttctaatcaaattgtatcaaagc

SEQ ID NO: 12404 - DNA, 381 bp, Homo sapiens
  AC004926.2_90791
  Located on chromosome 7
  Distance between a terminus base of telomere on chromosomal short arm and 5'-terminus of this base sequence : 87366572
  Distance between 3'-terminus of neighbour sequence of sequence listing upward to telomere on chrosomal short arm and 5'-terminus of this base sequence : 30947
tgctgagctaaatgatcattaatatactttcatatttgattattcttttctaagcaggttttaagttttcaaataaagaaatgttgatgagagtgggtctgcaagaaaagaaaacagagaagcctggtttagggtactatgattattttgcttttatatatatatatatgtatagtatatatatgtatagtatatatatatatatatatatatatatatatatatatatagtatcacttgccaataggatggtaaaattcttgtattttggctgtgttagaaaaaaattgttcttagtttaacttatcaattctatttatttttttctacaatgcttaagagaatgcacactaaatgtatgtcaagccatacaatattcat

SEQ ID NO: 12405 - DNA, 418 bp, Homo sapiens
  AC006374.2_397
  Located on chromosome 7
  Distance between a terminus base of telomere on chromosomal short arm and 5'-terminus of this base sequence : 87429573
  Distance between 3'-terminus of neighbour sequence of sequence listing upward to telomere on chrosomal short arm and 5'-terminus of this base sequence : 62620
ggcatgtaacaatactcaagtttccagtttttaaaaacaaatctctctctgaagtagtatctcagttcctctaaaagtaagcatgaaaatctcaggttagaaaaacttaaaacttatttcatgcagtattattgccaatacatgtgtacacgtgtgtgtgtgtgtgtgtgtgtgtgtgtgtgatgcatgttttaatagaaaacatacaaagatatctggtgttaaacatgatatatggttatcgtagttaaccctttcaggaggtaaaaaatgaaatgacttgtctttataaatacttgtttattgacatgtcacatatctgaaatttcagcattaaaaatattctttatgtgacttaaattattgggtcttccaaaaccctttttaaaatagaattgatttacttggtttacctcag

SEQ ID NO: 12406 - DNA, 345 bp, Homo sapiens
  AC006374.2_9563
  Located on chromosome 7
  Distance between a terminus base of telomere on chromosomal short arm and 5'-terminus of this base sequence : 87438815
  Distance between 3'-terminus of neighbour sequence of sequence listing upward to telomere on chrosomal short arm and 5'-terminus of this base sequence : 8824
atcaagtacttgcgcaagtaaggttgaggatggctgaaacaggagagtattttgagattctatttaggtttaagggtgtgtgtgtgtgtgtgtgtgtgtgtgtgtgtgtgtgcatgcatgcgcacatgcatgcacgcatgtgtgtgtgatatatatctttataattaaatacagtctgtttatgagattccaataatgttattcatgactggtaaatagaggaatgatgtcactataacacagaatgtattttggtttacatgagaattttctgagaattttcatattttatgccaagtaccagtagttcaacacagtgcacagtgtcagctgagagcaataaac

SEQ ID NO: 12407 - DNA, 325 bp, Homo sapiens
  AC006374.2_93340
  Located on chromosome 7
  Distance between a terminus base of telomere on chromosomal short arm and 5'-terminus of this base sequence : 87522428
  Distance between 3'-terminus of neighbour sequence of sequence listing upward to telomere on chrosomal short arm and 5'-terminus of this base sequence : 83268
tacttatctccatttcacagaaacactgtactaataaccgagaatcctgagatttttaactcaaagcaatgtatcccttccaaaaatcaacctttggactgattttctccaaatatttttaggaaaattcagttaatgtttttttttttcttctttttaatcttctacccgtggtccctgggaaaatgtcagagccctggagaaatttgaaatttagcatatctccctcttttcttgtatatctatctatctatctatctatctatctatctatctatctatctatctctgtgttcttaattggatgccatacttagacttcgtt

SEQ ID NO: 12408 - DNA, 248 bp, Homo sapiens
  AC006374.2_131987
  Located on chromosome 7
  Distance between a terminus base of telomere on chromosomal short arm and 5'-terminus of this base sequence : 87561149
  Distance between 3'-terminus of neighbour sequence of sequence listing upward to telomere on chrosomal short arm and 5'-terminus of this base sequence : 38396
cagctgcaacatgtatactcagcaagctggccaatagctagctgagttaactgacctgggcagctgattctaataatttagttcctcaaaatgaatttaatccaaataaagtcaatttgagggtgtgaaataaaatttgcccagcaattaatgagtgtgtgtctatgtgtgtgtgtgtgtgtgtgtgtgtgtgtgtaagagacagtcctagctgaacagggtaagagtttacctcaaagacatcctga

SEQ ID NO: 12409 - DNA, 145 bp, Homo sapiens
  chr7.fa.O7frz.87518594
  Located on chromosome 7
  Distance between a terminus base of telomere on chromosomal short arm and 5'-terminus of this base sequence : 87735380
  Distance between 3'-terminus of neighbour sequence of sequence listing upward to telomere on chrosomal short arm and 5'-terminus of this base sequence : 173983
ctgatttctagcagagtcaaatacaattttttatagaacctgtttaaagatattcatttcttcaataacaaatatatgtgtgtgtgtgtgtgtgtgtgtgtgtgtgtgtgtattccaagcactactgcatctaacttaggcatta

SEQ ID NO: 12410 - DNA, 406 bp, Homo sapiens
  chr7.fa.O7frz.87614174
  Located on chromosome 7
  Distance between a terminus base of telomere on chromosomal short arm and 5'-terminus of this base sequence : 87830767
  Distance between 3'-terminus of neighbour sequence of sequence listing upward to telomere on chrosomal short arm and 5'-terminus of this base sequence : 95242
tacataggagactgtcaggataagattgatgtatataagactcactctgatggctgggaaaaaatatggtttgaatggtggcaaaacaagaggcaggggggatttattgggagattgttgcaatcatctattcaaaaatgatgacattctaatctaagatggtgaacttacagaaaatggtcagagttgggaagtatacatacagaattagagtcaaatttgatgtgttctctgagggaagcagaggcattaaggactaagtcaggctttatatatatatatatatatatatatatatttctgagaaaggctagtgatattttaattttgcaaggttaagctaatcagcataggcaataagttttactagtcaacaaaagcagtcatatcaatccactggtaatta

SEQ ID NO: 12411 - DNA, 431 bp, Homo sapiens
  chr7.fa.O7frz.87703599
  Located on chromosome 7
  Distance between a terminus base of telomere on chromosomal short arm and 5'-terminus of this base sequence : 87884173
  Distance between 3'-terminus of neighbour sequence of sequence listing upward to telomere on chrosomal short arm and 5'-terminus of this base sequence : 53000
catagtttatggtaaagatggaatgtttttatactaatatcaagagcaagacagctgggcacggtggctcacgtctataatcccagcacttttgggaggccaaggcaggtggatcacctgaggtcaggagttcgagaccagcctggccaacatggtgaaaccgtgtctctactaaaaatgtaaaaattagctgggcgtggtggtgggtgactgtaatcccagctactcggtaggctgaggcaggagaactgcttgaacccgggaggcggaggttgcagtgagacaagaagaagccattacatttcagcctgggtgacaaaggcgaaactccataaaaataaaaataaataaataaataaataaataaataaataaagagcagacaaggatatttgctcccaccatcactgttaatcatttcactggaggtt

SEQ ID NO: 12412 - DNA, 192 bp, Homo sapiens
  AC004829.2_18958
  Located on chromosome 7
  Distance between a terminus base of telomere on chromosomal short arm and 5'-terminus of this base sequence : 87962784
  Distance between 3'-terminus of neighbour sequence of sequence listing upward to telomere on chrosomal short arm and 5'-terminus of this base sequence : 78180
ggccaataggatatggagatatatatatatatatatatatatatatatatatatatatatatatgtatataatctcaaggagttttggtaaaatctataagtgaaagcattttgagagctgaaaaatgctattcaaaggaagaatattaataatgtaaatatggaaaggtctctgaggaagaccatgaacta

SEQ ID NO: 12413 - DNA, 251 bp, Homo sapiens
  AC004829.2_26664
  Located on chromosome 7
  Distance between a terminus base of telomere on chromosomal short arm and 5'-terminus of this base sequence : 87970480
  Distance between 3'-terminus of neighbour sequence of sequence listing upward to telomere on chrosomal short arm and 5'-terminus of this base sequence : 7504
ttctggatctagtggagttcacaatgaaatatatatatatatatatatatatatatatatatgcacatgtgtcttttaaatattgctgtccctctaaaagaatcagtaggtaaaattatttctgtagtttaaaagttctggctaggttacaaaagacagcaattgttaaacaacttaacattaaatattaaagactaaatgtagcatttaaagcattaagtttaattgtgtctggcttcatataattcagt

SEQ ID NO: 12414 - DNA, 200 bp, Homo sapiens
  D7S644
  Located on chromosome 7
  Distance between a terminus base of telomere on chromosomal short arm and 5'-terminus of this base sequence : 87983111
  Distance between 3'-terminus of neighbour sequence of sequence listing upward to telomere on chrosomal short arm and 5'-terminus of this base sequence : 12380
cctccaaagttaggggtggaaggtaggcgaaaacaagatggttataggaaaaaagttcctacctgacaaacttcacactagaccccaagatttttaaggctaactctgtgtgtgtgtgtgtgtgtgtgtgtgtgtgtgggtgggtgggtgtgtgtgtatgtgtgtttacttctctcactattgctgagggtctctcacct

SEQ ID NO: 12415 - DNA, 154 bp, Homo sapiens
  Z23719.1_126
  Located on chromosome 7
  Distance between a terminus base of telomere on chromosomal short arm and 5'-terminus of this base sequence : 87983169
  Distance between 3'-terminus of neighbour sequence of sequence listing upward to telomere on chrosomal short arm and 5'-terminus of this base sequence : -142
ctacctgacaaacttcacactagaccccaagatttttaaggctaactctgtgtgtgtgtgtgtgtgtgtgtgtgtgtgtgggtgggtgggtgtgtgtgtatgtgtgtttacttctctcactattgctgagggtctctcacctcagtttcctcga

SEQ ID NO: 12416 - DNA, 284 bp, Homo sapiens
  AC005009.1_257
  Located on chromosome 7
  Distance between a terminus base of telomere on chromosomal short arm and 5'-terminus of this base sequence : 88073561
  Distance between 3'-terminus of neighbour sequence of sequence listing upward to telomere on chrosomal short arm and 5'-terminus of this base sequence : 90238
cctcatctggctctataatctttattttgtgagtactttgttgatgttctgttcttaagtggaggcagggaggatgggtaatggaaaagtcagaaagaatggcaggataggtcaaatatatccataccactgagaaacaaaactcaatatatgactaatagagggtcagtcatgtattatatatatatatatatatatatatatatatataatcacttcaatagaattctgtgctgcatttaagaggagacaggagtgttttgaacttaagtggatagactgct

SEQ ID NO: 12417 - DNA, 251 bp, Homo sapiens
  AC005009.1_21430
  Located on chromosome 7
  Distance between a terminus base of telomere on chromosomal short arm and 5'-terminus of this base sequence : 88094887
  Distance between 3'-terminus of neighbour sequence of sequence listing upward to telomere on chrosomal short arm and 5'-terminus of this base sequence : 21042
aggaaagagtatcggtcatacttcatatatatatatatatatatatatatatatatatatatatatataaatgaagtatgaaacatttcatatatgtgtatatatatagtctgccatacttcaatcataatttccagatgaatgccagtcatttcacgaatttatattatacccaatattaccactagtaagggcttatatatatgcgctttttctcaccttagtttctcctagtgcaataaatggtactc

SEQ ID NO: 12418 - DNA, 393 bp, Homo sapiens
  AC005009.1_57670
  Located on chromosome 7
  Distance between a terminus base of telomere on chromosomal short arm and 5'-terminus of this base sequence : 88130916
  Distance between 3'-terminus of neighbour sequence of sequence listing upward to telomere on chrosomal short arm and 5'-terminus of this base sequence : 35778
tagcaatatttaggatgctgatagacacttttagaaataaagtaagagtaattaatttgacagcaaaactaggaaaaccagaggctgccctcccagccttctactttttgctgccacttacagtttaagtttaagtcatccaagttacttggctaaggattgaattaactagcatgattccctgagtgcaggcacagcccttttttcgcatcccaagccccagtgtggcaagaggtgtttgtttgtttgtttgtttgtttttccctcatgtttgatggcccaccacaaaagctcactcagtcatgaagctaaaataaagaaattgtcaaaagttcagaatcctgaaattttagtaatcgttgtgaagatgtatgtcagttaacgctttatcat

SEQ ID NO: 12419 - DNA, 166 bp, Homo sapiens
  AC002081.1_91031
  Located on chromosome 7
  Distance between a terminus base of telomere on chromosomal short arm and 5'-terminus of this base sequence : 88235527
  Distance between 3'-terminus of neighbour sequence of sequence listing upward to telomere on chrosomal short arm and 5'-terminus of this base sequence : 104218
tactgccaatgtaagtgaatacacacacacacacacacacacacacacacacacacgagaaattatacaaggctttcaaaatattccatgtttcctactttttactatccttcatttaagaatcagttactaattattaagtataagctacattctaggaatgctc

SEQ ID NO: 12420 - DNA, 221 bp, Homo sapiens
  AC002081.1_129040
  Located on chromosome 7
  Distance between a terminus base of telomere on chromosomal short arm and 5'-terminus of this base sequence : 88273387
  Distance between 3'-terminus of neighbour sequence of sequence listing upward to telomere on chrosomal short arm and 5'-terminus of this base sequence : 37694
caggaactccttcagcttaataatcaaatgaccaaaaaaaagtagagaatgggcaaaacaatttgacttcacaaaagttaataaacacatgaacaataaacacatgaaacatgtttgacattattatccagcagggaaatgcaaattaaaacaaagggataccatttctcacacacacacacacacacacacacacacacgtgtgcatacactggaaagcc

SEQ ID NO: 12421 - DNA, 205 bp, Homo sapiens
  D7S2481
  Located on chromosome 7
  Distance between a terminus base of telomere on chromosomal short arm and 5'-terminus of this base sequence : 88273500
  Distance between 3'-terminus of neighbour sequence of sequence listing upward to telomere on chrosomal short arm and 5'-terminus of this base sequence : -108
tttgacattattatccagcagggaaatgcaaattaaaacaaagggataccatttctcacacacacacacacacacacacacacacacgtgtgcatacactggaaagcctagggctagaacaaaacaagacttaacaatacaaatgttggtaaacatgtagaataactagaactaaaatatactactggtgggagtctacaatgat

SEQ ID NO: 12422 - DNA, 436 bp, Homo sapiens
  AC004519.1_69928
  Located on chromosome 7
  Distance between a terminus base of telomere on chromosomal short arm and 5'-terminus of this base sequence : 88380102
  Distance between 3'-terminus of neighbour sequence of sequence listing upward to telomere on chrosomal short arm and 5'-terminus of this base sequence : 106397
tacttccaactcgagttgtaaactgagttgagaatcaacttcagtatattctgatcacagggtttgttttcttttgttttgttttgttttgttttgttttgttttgtttgagacagggtcttgctctgtcacccagactggagtgcagtggcacaatcacagctccctgcagcctcaacctcccaggttcaatcaattctcccacctcagcatcccaagtagctgggactacaggcccatgccaccatgcccagctgatttttttatttttttgtagagacagggtcttgctatgttgcccaggatggtcttaaactgcttggctcaagtgatttacctacctcagccttccaaagtgttgggattacaggtgtgggccacctcgcccaaactgaccactagggtttatttcagggtcttaaatctggcacaacca

SEQ ID NO: 12423 - DNA, 443 bp, Homo sapiens
  AC006154.1_20165
  Located on chromosome 7
  Distance between a terminus base of telomere on chromosomal short arm and 5'-terminus of this base sequence : 88790421
  Distance between 3'-terminus of neighbour sequence of sequence listing upward to telomere on chrosomal short arm and 5'-terminus of this base sequence : 409883
ggccttcaaatcattaacaacttaatttcatgattctgtttattttgtattctgtgaagaaatcaatctaattatgtttaattggtatctgatttgaataaataattactatacaatcaaaagggataaaggtttaagaaatattatttgatatcccagagctcctgtggtaataaagaacggctagggaaagacattaagtttaaacacacacacacacacacacacacacacaccacatcctttaaaaaagcattcagaatatttcagagggagaatttaaaatagaggaaaatagatgctctgagttttgagataagatccctttagaaggtttaagttagctttaaaaaggcaactcagtagtgaagcacaataaacattacagtgtgtctatatatgcaccttagggaagtcttgcctatggagatccttatgcagaa

SEQ ID NO: 12424 - DNA, 222 bp, Homo sapiens
  AC003083.1_135715
  Located on chromosome 7
  Distance between a terminus base of telomere on chromosomal short arm and 5'-terminus of this base sequence : 89069872
  Distance between 3'-terminus of neighbour sequence of sequence listing upward to telomere on chrosomal short arm and 5'-terminus of this base sequence : 279008
aatagtctccaatctcatccaggtcatcacaaatgctgttaatgcattcctttttatggctgcgtagtattccatcatagataaatagatagatagatagatagatagatagatagatagatagatagatatcatggtttttttaattgagaaaatgagcttttatttgtctataatttatcatgcattcttggaaaatataagcaagagattagctgaaag

SEQ ID NO: 12425 - DNA, 406 bp, Homo sapiens
  AC003083.1_104641
  Located on chromosome 7
  Distance between a terminus base of telomere on chromosomal short arm and 5'-terminus of this base sequence : 89100889
  Distance between 3'-terminus of neighbour sequence of sequence listing upward to telomere on chrosomal short arm and 5'-terminus of this base sequence : 30795
cggatatagtgaacttcgattaacacaattaataaacctgatctaaaatatattaaatgttaacaattagaacatataaccttttcaagcatatatggaacagctatagtggagttatttttgtttggtttgttttgtttttgtcttgtcttgttttgttttgttttgttttgttttgttttgttttgagatggagtctcgctttgtcacccaggctggagtgcagtggcgcgatcttggctcactgaaacctccacctcctgggttcaagtgattctcctgcctcagccttccgagtacctaggactacaggcatgtgacaccacacctggccaatttttgtatttttagtagagacggggtttcacgacgttggctaggctggtctctaactcctgacctcaag

SEQ ID NO: 12426 - DNA, 205 bp, Homo sapiens
  AC003083.1_54514
  Located on chromosome 7
  Distance between a terminus base of telomere on chromosomal short arm and 5'-terminus of this base sequence : 89151058
  Distance between 3'-terminus of neighbour sequence of sequence listing upward to telomere on chrosomal short arm and 5'-terminus of this base sequence : 49763
ccattcctgagttacttcagttagaataatagtctctaatctcatccaggttgctgtaaatgccattaattcattcctttttatgaatgagtagtattccatttcatatatatacacacacacacacacacacacacacacacacatatatatatacacactcacctacatacatacatacataccagtttctgtatccacttgt

SEQ ID NO: 12427 - DNA, 209 bp, Homo sapiens
  AC005164.1_19401
  Located on chromosome 7
  Distance between a terminus base of telomere on chromosomal short arm and 5'-terminus of this base sequence : 89309377
  Distance between 3'-terminus of neighbour sequence of sequence listing upward to telomere on chrosomal short arm and 5'-terminus of this base sequence : 158114
aagacaaatctgtgtttggagtagtttggaatccttatgtttatttcatatatatatatatatatatatatacacacacacacacacacacacacacacacacacacacacatgcatacacaagttttctaagcctctagtaatgctaaaagcttctctagaccctgaagacttagacttgagaagaaaggaaacaaagactttactct

SEQ ID NO: 12428 - DNA, 379 bp, Homo sapiens
  AC005164.1_19361
  Located on chromosome 7
  Distance between a terminus base of telomere on chromosomal short arm and 5'-terminus of this base sequence : 89309377
  Distance between 3'-terminus of neighbour sequence of sequence listing upward to telomere on chrosomal short arm and 5'-terminus of this base sequence : -209
aagacaaatctgtgtttggagtagtttggaatccttatgtttatttcatatatatatatatatatatatatacacacacacacacacacacacacacacacacacacacacatgcatacacaagttttctaagcctctagtaatgctaaaagcttctctagaccctgaagacttagacttgagaagaaaggaaacaaagactttactcttagggaatttgcatctagccagagaaacaaacaatgaacatgttaaataaggtaatttcagagagtgacagtgccatttatagagagtgtctggtgtgaggatgaaaatagcacattcgagaattggttgtccgggacaggccatctctaaggaggtgacatttgaaagt

SEQ ID NO: 12429 - DNA, 293 bp, Homo sapiens
  AC004992.1_48206
  Located on chromosome 7
  Distance between a terminus base of telomere on chromosomal short arm and 5'-terminus of this base sequence : 89373101
  Distance between 3'-terminus of neighbour sequence of sequence listing upward to telomere on chrosomal short arm and 5'-terminus of this base sequence : 63345
actttctctttcgtgagttcaacttttttagattccacatgtaaatgagatcatgtagtatttgtctttctgtgcctggcttatttcatttataatgtcctccaggttcattcgtgttgttgcaaatgacaggatttccttcattttaaggctgagtcgtattctattgtgtgtgtgtgtgtgtgtgtgtgtgtgtgtgtgtgtgtgtgtgtatgtcaccctgttttctttatccattcattcatccatagatacttagtttgaccccatatcttaggtattgcgaatagtgc

SEQ ID NO: 12430 - DNA, 224 bp, Homo sapiens
  AC004992.1_39507
  Located on chromosome 7
  Distance between a terminus base of telomere on chromosomal short arm and 5'-terminus of this base sequence : 89381886
  Distance between 3'-terminus of neighbour sequence of sequence listing upward to telomere on chrosomal short arm and 5'-terminus of this base sequence : 8492
tcatcttagaaacatccttgctccataatcaccattctgttcccttcccctagaactttccaggcctgattaggtgccctcctgtgtgtgtgtgtgtgtgtgtgtgtgtgtgtgtgtgtgtgtgtgattcctctgcacacatggtcggtttcccctgcacgcttctattatggtgctcatcactgtgaattgtgttcgtgggttctttgtacattctttcgcca

SEQ ID NO: 12431 - DNA, 444 bp, Homo sapiens
  chr7.fa.O7frz.89248386
  Located on chromosome 7
  Distance between a terminus base of telomere on chromosomal short arm and 5'-terminus of this base sequence : 89489400
  Distance between 3'-terminus of neighbour sequence of sequence listing upward to telomere on chrosomal short arm and 5'-terminus of this base sequence : 107290
cactgttcacagtctcaaagacatggaatcaacctaaatgcccatcagtggcagactggataaagaaaatgtgtaatacacacacacacacacacacacacacacacacacaccatggaatactatgcagccataaaaaagaacaagatcatgtccttcacagggacatggatggagctggaggccgtcatccttagtaaactaacacaggaacagaaaaccaaataccacatgttctcacttataagtgggagctaaatgatgagaacacatggacacaaagaagggagcaacagacactgggacctatttgagggatgtgatgaggaggagggagtggatgagaaaaaataactattgagtactaggcttagtagctggatgatgaaatattctgcacgacaaaccctcatgacatgagtttacctatattacaatcctgca

SEQ ID NO: 12432 - DNA, 229 bp, Homo sapiens
  AC003991.1_28961
  Located on chromosome 7
  Distance between a terminus base of telomere on chromosomal short arm and 5'-terminus of this base sequence : 89568357
  Distance between 3'-terminus of neighbour sequence of sequence listing upward to telomere on chrosomal short arm and 5'-terminus of this base sequence : 78513
cagaagttctgttaagtgacctattaattgggattattagttgcctaagctactcccatccatccatccatccatccatccatccatccatccatccatccatctatccatccatgcactaattaattaaaacaaatacacactggccgtcttttccatgtcaggctcagagtgttgggctgttaaaaagttaaatcccacaagggatagttctttggaatcatgtaca

SEQ ID NO: 12433 - DNA, 213 bp, Homo sapiens
  AC003991.1_63529
  Located on chromosome 7
  Distance between a terminus base of telomere on chromosomal short arm and 5'-terminus of this base sequence : 89602823
  Distance between 3'-terminus of neighbour sequence of sequence listing upward to telomere on chrosomal short arm and 5'-terminus of this base sequence : 34237
aaatgcttctgatacattgaagagtaacttatactcttttcccaaattctactgaacaaacctttagaagagtgaaggatttttctagaatgtaaacctaattcattatagaaaattgaagtaggaccctgtaaggctatctgtgggctctcatggggtgtgtgtgtgtgtgtgtgtgtgtgtgtgtgtgtgttggagaagtggtagtgaaga

SEQ ID NO: 12434 - DNA, 237 bp, Homo sapiens
  Z67487
  Located on chromosome 7
  Distance between a terminus base of telomere on chromosomal short arm and 5'-terminus of this base sequence : 89631957
  Distance between 3'-terminus of neighbour sequence of sequence listing upward to telomere on chrosomal short arm and 5'-terminus of this base sequence : 28921
tacaaagtgccctagcaaagtgcccaatcttcaggttttgaaggactactgtgttgctgctgttgtgtgtgtgtgtgtgtgtgtgtgtgtttgctagcaacttatcagatttcctaagattttccaaaaaaaaaatgatttttaagtagcatttgataaacacgtctaaattaattatgaagagaactaggtggtaaggatcctaaaacagtggaatgtgttcctgagagtgacaac

SEQ ID NO: 12435 - DNA, 320 bp, Homo sapiens
  AC006005.1_9058
  Located on chromosome 7
  Distance between a terminus base of telomere on chromosomal short arm and 5'-terminus of this base sequence : 89738296
  Distance between 3'-terminus of neighbour sequence of sequence listing upward to telomere on chrosomal short arm and 5'-terminus of this base sequence : 106102
gatctcaatagagcaactgcagaaacatccctgggatgtacaattgtctcttagagtattttaactttcaaccccctggtacatatagacttatgggctattacagaaaatccttgaaatgtgtttgtgtgtgtgcgtgtgtgtgtgtgtgtgtgtgtgtgtgagagagagagagccagagacgagtaaataaacctccactttgttaagatatgaaactacaagcatttaaattatttctacatgtgtctgtatctccatttacattgagtaaattatgaaaattatgactgaattaatttgctctaaactccaaattt

SEQ ID NO: 12436 - DNA, 277 bp, Homo sapiens
  AC002069.1_85796
  Located on chromosome 7
  Distance between a terminus base of telomere on chromosomal short arm and 5'-terminus of this base sequence : 89827960
  Distance between 3'-terminus of neighbour sequence of sequence listing upward to telomere on chrosomal short arm and 5'-terminus of this base sequence : 89344
tatgaaggacgatagaactttcagtgatatatatatatatatatatatatatatatatatataacatgtataatatatataacatatattttatgtatatatattacatgaaaccctaaccattaacatttaaaagatagacagatacaaacatttctcatgatttaggaaattttgaaaaatgtgttgatgaagccagctcccagatagcattatactaactctgaaaagtcagatggtagataacttgggaaaggatagaaatctcatctggatt

SEQ ID NO: 12437 - DNA, 389 bp, Homo sapiens
  chr7.fa.O7frz.88789106
  Located on chromosome 7
  Distance between a terminus base of telomere on chromosomal short arm and 5'-terminus of this base sequence : 89948492
  Distance between 3'-terminus of neighbour sequence of sequence listing upward to telomere on chrosomal short arm and 5'-terminus of this base sequence : 120255
gtatacatatgtaacaaacctgcacgttgtgcacatgtaccctagaacttaaagtataatatatatatatgaaacacaccacacacacacacacacacacacacacacacagtttgccaccaacaggagcccaggcatccccagggactgttgcagcaggaacttgggagcctttgctaaagtgctgcattggcataactcagcgtgtgtgtgtgtgtgtgtgtgtgtgtgtgtgtgtgtgtgcagagagagagagagagacagagatagagaaagagagaaagggagagagagagagagatttattctaaggagttgtctcacgttattacagagactgagaagtccagactcatgagagtcaatggtactgttccaaatgaagtctg

SEQ ID NO: 12438 - DNA, 247 bp, Homo sapiens
  AC002127.1_8478
  Located on chromosome 7
  Distance between a terminus base of telomere on chromosomal short arm and 5'-terminus of this base sequence : 90029154
  Distance between 3'-terminus of neighbour sequence of sequence listing upward to telomere on chrosomal short arm and 5'-terminus of this base sequence : 80273
aatggcctctaattctatccatgtttctgcaaaatatatgatttcatttcattcttttccatggctgaatggtattccattgtgtatgtgtgtatatatatatatacatatatatatacacacacctgatatatatatatacacctatatatatatatatacctgagattttatatatatatatatatatatatatatatatgtctgatcatctgttgatccagttaggatactaagatctggagca

SEQ ID NO: 12439 - DNA, 265 bp, Homo sapiens
  AC002127.1_38330
  Located on chromosome 7
  Distance between a terminus base of telomere on chromosomal short arm and 5'-terminus of this base sequence : 90059045
  Distance between 3'-terminus of neighbour sequence of sequence listing upward to telomere on chrosomal short arm and 5'-terminus of this base sequence : 29644
tgattgttaaatgtcttgacgtagtcttctttagtttaaatctgcttgttgttctataatcttcttgtacttgaatgttatatctttctctgggtttgggaagtgttttttgttgtccctttgaataaaatttctctctctctctctctctctctctctctctctgtctgctctttaagactaataactagctgggcgcggtggctcacgcctgtaatcccagcactttgggaggccgaggggggcagatcacgaggtcaggaga

SEQ ID NO: 12440 - DNA, 405 bp, Homo sapiens
  AC002127.1_88634
  Located on chromosome 7
  Distance between a terminus base of telomere on chromosomal short arm and 5'-terminus of this base sequence : 90109340
  Distance between 3'-terminus of neighbour sequence of sequence listing upward to telomere on chrosomal short arm and 5'-terminus of this base sequence : 50030
gctgaggtgactcattgtttatagtctatttccaaatatctcatctctgcttcttactttagtttcataatttgctgccttataaaagggctttctacaccaatttgtaagtagtgactatcccagcttttgtgtgagtgcgtgtgtgtgtgtgtgtgtgtgtgtgtgtgtgtgttgtgtaatagggcaagagaggagagaaaaagagattgggttggggaggagagggtgacagggtcacacatctgtatctcactcagggaactatggaaagatacactctgagaaaagtccatgggcagctctatcagaaggagatcagaggagggacagggaggacataattaatagaaataatctgcattatttatgcaaagcctttctcgtacagcactgttaaacact

SEQ ID NO: 12441 - DNA, 197 bp, Homo sapiens
  AC002127.1_107224
  Located on chromosome 7
  Distance between a terminus base of telomere on chromosomal short arm and 5'-terminus of this base sequence : 90128010
  Distance between 3'-terminus of neighbour sequence of sequence listing upward to telomere on chrosomal short arm and 5'-terminus of this base sequence : 18265
acatttaaatttggctggaagaatgagcatttaagctgggaattaaaaaatagatatgatttgtgtgtgtgtgtgtgtgtgtgtgtgtgtgtgtgtgtgtgtgcttaaagcataaacagcagagggcatatgttaaagataggaagtgtggcacaccattaagaaaatggaaacaatctgttctggctaaagcacta

SEQ ID NO: 12442 - DNA, 266 bp, Homo sapiens
  AC002127.1_115836
  Located on chromosome 7
  Distance between a terminus base of telomere on chromosomal short arm and 5'-terminus of this base sequence : 90136516
  Distance between 3'-terminus of neighbour sequence of sequence listing upward to telomere on chrosomal short arm and 5'-terminus of this base sequence : 8309
gaaagaatctgccttactaagtaacaggttagctttttaattccatcttaaaatgcataactgagtgatttagatctataattttaaatagaaatcttaccaagttttatataacattgaaacatttaagattttatgtatgtatacagaatctattattgcttgtcatctatctatctatctatctatctatctatctatctatctatctatctatctacctatctatctacctacctacttacttaccaatctaccaacctacc

SEQ ID NO: 12443 - DNA, 218 bp, Homo sapiens
  D7S630
  Located on chromosome 7
  Distance between a terminus base of telomere on chromosomal short arm and 5'-terminus of this base sequence : 90141748
  Distance between 3'-terminus of neighbour sequence of sequence listing upward to telomere on chrosomal short arm and 5'-terminus of this base sequence : 4966
tccattctgaggtttgatgtataatctttctagtcatagaaccatatgaaccaatcactgtctcttacctcccttcaaacacacacacacacacacacacacacacacacacacacacacacagaaagtttaatgataatagcactttttctactcatatactcatagattatgatgagactcagttgaggcaacttagttcattgaaaagaccatgg

SEQ ID NO: 12444 - DNA, 171 bp, Homo sapiens
  AC002127.1_120979
  Located on chromosome 7
  Distance between a terminus base of telomere on chromosomal short arm and 5'-terminus of this base sequence : 90141779
  Distance between 3'-terminus of neighbour sequence of sequence listing upward to telomere on chrosomal short arm and 5'-terminus of this base sequence : -187
agtcatagaaccatatgaaccaatcactgtctcttacctcccttcaaacacacacacacacacacacacacacacacacacacacacacacagaaagtttaatgataatagcactttttctactcatatactcatagattatgatgagactcagttgaggcaacttagttc

SEQ ID NO: 12445 - DNA, 356 bp, Homo sapiens
  AC004746.1_26424
  Located on chromosome 7
  Distance between a terminus base of telomere on chromosomal short arm and 5'-terminus of this base sequence : 90195244
  Distance between 3'-terminus of neighbour sequence of sequence listing upward to telomere on chrosomal short arm and 5'-terminus of this base sequence : 53294
agtaacttgtaccaagccacatgacaagtggtagagtctggctgaaagcagattgtctgatactagacccctcaattgttaactgctggttatactaatatataatgtctgttagcataatcacctattatatatatgtatataaatgtgcaatattcataattctactgtgtgtgtgtgtgagtgtgtgtgtgtgtgtgtgtgtgtgtgtgtgtgtgtgtattatgcttttctttaagcaacaaatgctgccatgacaagatgttttggaataccaaggtcctctatatttcaatgtcgaaggtagtacatagctttggtaaatgacttccctttactgatagcctgactgtacc

SEQ ID NO: 12446 - DNA, 443 bp, Homo sapiens
  AC004746.1_121084
  Located on chromosome 7
  Distance between a terminus base of telomere on chromosomal short arm and 5'-terminus of this base sequence : 90289820
  Distance between 3'-terminus of neighbour sequence of sequence listing upward to telomere on chrosomal short arm and 5'-terminus of this base sequence : 94220
gaactcagtattgctccatcttaggtcatttttgaaaaagcacagaaagaagagttcctaacgaggtggctgcgaatcgataattagaaggaacattctccatgaatgtcttgcttaggaagtatacctaagaattggggtctaagaatatataaaccatgtttttggaaatttatttcatttatggatgtgtgcagttaacgaagtgaccttgtgggatggattgtctgcttttcacagaaaagttataaatgttgttaaactcacatatatatatatatatatatatatatatatatatatatatgaatacgtatttatataattacataattataaatttatagtcttaaaaagagagaaagcatttcattcaaacattagcttagtagtttttttctgtaacagaaatgtgtacagtgctattatgaaggtatgcactc

SEQ ID NO: 12447 - DNA, 381 bp, Homo sapiens
  AC002068.1_7728
  Located on chromosome 7
  Distance between a terminus base of telomere on chromosomal short arm and 5'-terminus of this base sequence : 90334714
  Distance between 3'-terminus of neighbour sequence of sequence listing upward to telomere on chrosomal short arm and 5'-terminus of this base sequence : 44451
ttaatccagctcacaaggttagggtgagtataggattgggttttccgggttcaggaaacacttcaaaggaaatcatactttgaacatgttatctaaagttatccatgattttatatatatatatatatatatatatatatatatatatatgtcaacctaatataatacatataattatatataatataatatatctattataattatatataatatatatttatctattataattatatataatatatatttatatattataattatatatgattatatatatttataaatatatatatttttgtaaaaagctttgaagtatttataaaaagcagctgtatagaagcaaataattattcactgtcttatgttgacagcatg

SEQ ID NO: 12448 - DNA, 248 bp, Homo sapiens
  AC002068.1_48485
  Located on chromosome 7
  Distance between a terminus base of telomere on chromosomal short arm and 5'-terminus of this base sequence : 90375524
  Distance between 3'-terminus of neighbour sequence of sequence listing upward to telomere on chrosomal short arm and 5'-terminus of this base sequence : 40429
cctttgcatcctcatagcttagcccccgcttattagtgagaacatatgatgttcacaaacacacacacacacacacacacaatggaatactactcagctgtaaaaaggaatgaattaatggcatttgcagcaacctgaatgagataagagattattattctaagtgaagtaacgaaggaatgaagtcttttttaaaaggactggtttctgtttaaccttcagggaagaaagcctaatagctgttagcc

SEQ ID NO: 12449 - DNA, 288 bp, Homo sapiens
  DID22N_0030050
  Located on chromosome 7
  Distance between a terminus base of telomere on chromosomal short arm and 5'-terminus of this base sequence : 90426234
  Distance between 3'-terminus of neighbour sequence of sequence listing upward to telomere on chrosomal short arm and 5'-terminus of this base sequence : 50462
caagtacctgcctaaacttcactaaattttgtatttttatacctggtcataagatgaaaatttcttactgaaaagtaggttgtgttgttttaacaagcaaactgaaatgaaatcttgaatgaaaactataattcaacagtgcagtacaattatatacgtttgaatatttatattatatatattatatattatatatatattatatatgtacctatttgaataacatatattcacacacacacacacacatacacacacaccttaaaggtggcatgggaatggaatgtt

SEQ ID NO: 12450 - DNA, 422 bp, Homo sapiens
  AC004015.1_74006
  Located on chromosome 7
  Distance between a terminus base of telomere on chromosomal short arm and 5'-terminus of this base sequence : 90459252
  Distance between 3'-terminus of neighbour sequence of sequence listing upward to telomere on chrosomal short arm and 5'-terminus of this base sequence : 32730
tgataacacgaatcttaggctaagaccccattaaaacctaattggataattttgtacatgaataactaaatgcaaattcaaatgcagatagcatatataaactgcataaaggcaaggtgatattacctatatgattattacatgcatataacaatctccacttattcactgagagtttattgaaataaactcaatactgttctcttcatgggaaggataaggaagtcctagctttcaatgtgctgaaaggcctgtagggaaaagaaaataacaggaatgagaacacacgcacacatacacacacacacacacacacacacacacacacacagtttgatgcaatgagtaattaagtgctacattatagaacacaagactataggtgttcagaaaaaaataaatcagtgagaactggaatactg

SEQ ID NO: 12451 - DNA, 326 bp, Homo sapiens
  AC004015.1_78573
  Located on chromosome 7
  Distance between a terminus base of telomere on chromosomal short arm and 5'-terminus of this base sequence : 90463957
  Distance between 3'-terminus of neighbour sequence of sequence listing upward to telomere on chrosomal short arm and 5'-terminus of this base sequence : 4283
gattctaggtgcttcacatcagtggaattctacaaatcatacaatcattttgtatctggcttatttcacttagcataatgttttcaagggtcatttttgttgtaggatgtatcagaattttttctttttaaggctgaattatatttgtgtgtgtgtgagtgtgtgtgtgtgtgtgtgtgtgtgtgtgcgcgcacgtgtgtgatgatttggctatgtccccaccgatatctcatcttgaattcccacaagttgtaggaggcactgggtgggaggtaattgaataattgggggaggtctttcctgtgctgttctcatgatagtgagta

SEQ ID NO: 12452 - DNA, 437 bp, Homo sapiens
  AC004015.1_97856
  Located on chromosome 7
  Distance between a terminus base of telomere on chromosomal short arm and 5'-terminus of this base sequence : 90483089
  Distance between 3'-terminus of neighbour sequence of sequence listing upward to telomere on chrosomal short arm and 5'-terminus of this base sequence : 18806
ggaagataacaaactctgttgagttgttgtgtctttatatcattgcccattctattatctttctctagaatgccttcctctcaataggaacatttgctttttttcttcccagcactttgtttaaatattgtcttttctaaaaaattccttgaccacccctttcttcctccttccttctctctctttcttctttctttctttctctttctttcccttgctttccctttctctcccttcctaccttccctcctctgtctctctctctttccttccttcctttccttctttctttctttctttctctctttcctttctttctttctttctttctttctttctttctttctttctttctttctttctctctttctctctttcctttctttctttctctctttctctctttccttctttccttctttcatggagtttcactc

SEQ ID NO: 12453 - DNA, 312 bp, Homo sapiens
  AC006350.2_8228
  Located on chromosome 7
  Distance between a terminus base of telomere on chromosomal short arm and 5'-terminus of this base sequence : 90539391
  Distance between 3'-terminus of neighbour sequence of sequence listing upward to telomere on chrosomal short arm and 5'-terminus of this base sequence : 55865
agttacttgaccagtggtttgtagtcctccttgaagaggtccctcacttcccttgttagctgtattcctaggtattttattctctttgtaaatttgctagctttgtatgagatagtggactaaaggtgataaaaattcctctcacctgcccaaatttccatcaggaatttgctttgtagactcaggggaaaatagtattttgtgaaaaataattttatagtgtcacatgcattcagtgatacacacacacacacacacacacacacacacacacacaaacagactgcagaacatccaaacattgagtaccta

SEQ ID NO: 12454 - DNA, 337 bp, Homo sapiens
  AC006350.2_17667
  Located on chromosome 7
  Distance between a terminus base of telomere on chromosomal short arm and 5'-terminus of this base sequence : 90548896
  Distance between 3'-terminus of neighbour sequence of sequence listing upward to telomere on chrosomal short arm and 5'-terminus of this base sequence : 9193
tgagaactgtaggaagtattgaactacctggggtgaatcttccatatcaggtctgcatgccacagcatcccgtgtactctggaatcctgcctaatcaatttgtttttttatcattttcttcaatcttatttctattagctatctaacatgttgataaacaaccttcctcaatatttctattctattctattctattctattctattctattctattctattctattctattctatctatatgcacacttccatctttcatttatttgcttgtttcatttgtttattgactttctgtcattctaactttcctgggtattctccttcattaaacaatga

SEQ ID NO: 12455 - DNA, 284 bp, Homo sapiens
  AC006350.2_20688
  Located on chromosome 7
  Distance between a terminus base of telomere on chromosomal short arm and 5'-terminus of this base sequence : 90551947
  Distance between 3'-terminus of neighbour sequence of sequence listing upward to telomere on chrosomal short arm and 5'-terminus of this base sequence : 2714
tgtcaaagtgtagatgagtggtagggtcagcaacattgaagaaataaagactggagtgcctggaatgaataccttcagtaccataaaataatactctctcctgttccattttgcattctgtaaaccaatatttctggcaaagtatgtgtgtgtgtgtgtgtgtgtgtgtgtgtgtgtgtgtgtatgagtgtgtgtgtgtgtgtatcctggaatcacccagcagtagttgcaacctttattagcagagaagtataagacaaaagaaccaaaggtgatcttagctt

SEQ ID NO: 12456 - DNA, 431 bp, Homo sapiens
  AC006350.2_61241
  Located on chromosome 7
  Distance between a terminus base of telomere on chromosomal short arm and 5'-terminus of this base sequence : 90592477
  Distance between 3'-terminus of neighbour sequence of sequence listing upward to telomere on chrosomal short arm and 5'-terminus of this base sequence : 40246
ctgccaagagtacaaagttgagaaagatagtgtgatcacctctagagtgagaggaaagacttccacaattgatgatagatgaaatggcaagggtgaagaaaagtgaagcatctagctctgaatgtgttatccatgatcttagattataaagttcacaggttaagtcagtgtgtgtgtgtgtgtgtgtgtgtgtgtgcgcgtgcgcgcgcgcacacatgcacgtgcacaggcacacacttgatttgggatattttagtaaataaacagataagcacaaaaaggatgctttaggcaggaagaacaaagtcagagaggagtcaagtggaacttaggggatactaatagaactccataatttaatttgcatagagggaagtttgtagttgatgagagaaatttagattggactcaaattagttaaagccatttgt

SEQ ID NO: 12457 - DNA, 251 bp, Homo sapiens
  AC002382.1_50057
  Located on chromosome 7
  Distance between a terminus base of telomere on chromosomal short arm and 5'-terminus of this base sequence : 90678073
  Distance between 3'-terminus of neighbour sequence of sequence listing upward to telomere on chrosomal short arm and 5'-terminus of this base sequence : 85165
aattaaggcaatgaactttcatactaaaatttttccccaaagaaagtgtgcacattttaagtgtctgaatacattttagctaatgccaaaatgtttctatcatttcttttgcatatattttacttttttatttagaattctgtaaacacacacacacacacacacacacacacacacagtgttgtttttatttcatttttttgtttttgtttttcatacaggcttgttttcaaccaggcataaaggtaata

SEQ ID NO: 12458 - DNA, 286 bp, Homo sapiens
  AC002382.1_53636
  Located on chromosome 7
  Distance between a terminus base of telomere on chromosomal short arm and 5'-terminus of this base sequence : 90681578
  Distance between 3'-terminus of neighbour sequence of sequence listing upward to telomere on chrosomal short arm and 5'-terminus of this base sequence : 3254
tttagtacagcatcactgcagtcccagtgccatcttgctgtcaccacggtgctgatgtgaagctctgctgattctcccaggattctgtgagtaactctagtgtcaaactcagtcagtaacatcctacagcaaaaattacctgaaccccagctatcacagctttcatccacacatgtgcaggtgtacacatgcatgtgcatgcgtgcacacaagcacacgcacacacacacacacacacacacagctgttttctcaacaagatgcctaggatgacatcaccaggtac

SEQ ID NO: 12459 - DNA, 264 bp, Homo sapiens
  AC002382.1_54344
  Located on chromosome 7
  Distance between a terminus base of telomere on chromosomal short arm and 5'-terminus of this base sequence : 90682397
  Distance between 3'-terminus of neighbour sequence of sequence listing upward to telomere on chrosomal short arm and 5'-terminus of this base sequence : 533
cttcagccagaagtttctattatattcttcataacgaaatgaatacattacttatatcaacttgatgtaagacatatcaacatagacagatagatgatagatatagattagatagatagatagatagatagatagatagatagatagatgatagatagatatagctagatgatagatgtgggttcttaatttgaaaatttaatatgataaaaaacactgcattatatgaaccaaaaagtaataatgacacagccttattgtagt

SEQ ID NO: 12460 - DNA, 244 bp, Homo sapiens
  AC002382.1_74962
  Located on chromosome 7
  Distance between a terminus base of telomere on chromosomal short arm and 5'-terminus of this base sequence : 90702992
  Distance between 3'-terminus of neighbour sequence of sequence listing upward to telomere on chrosomal short arm and 5'-terminus of this base sequence : 20331
ccattcctcagttacttcacttagaataatgtcctccagctccatccaggttgctgcaaaaaacattattttgttcctttctatgactaagtagtactccatgggctatatatatatatatatatatatatacacacacacacacacacacacacgcacacatatatatacatacacacacacacacacacacacacacacacatatatctatctcacattttattccactcgctagttaatgg

SEQ ID NO: 12461 - DNA, 401 bp, Homo sapiens
  AC002382.1_96494
  Located on chromosome 7
  Distance between a terminus base of telomere on chromosomal short arm and 5'-terminus of this base sequence : 90724558
  Distance between 3'-terminus of neighbour sequence of sequence listing upward to telomere on chrosomal short arm and 5'-terminus of this base sequence : 21322
tagatcattgtagaccatagcatagataggtgattggttgattgttagatagatagataggtaggtaggtaggtagatagatagataggtaggtaggtagatagatagatagatagatagatagatagatagatatggtgagtattcagcctgttttacaaaatccttagaatcaacctaataatataatgctcattaatcaaagtgacaagttagaacatttagttttgtggctttttattaacataatttaaaaatagttttatattaaaataaagagaaacatagtagaatgctgattttgcaggaatttgaaagttattacgtgagtccctaaggatagtttaaatttgtggacaatttagattaagtttcccaacctcttatttgtacggtatctt

SEQ ID NO: 12462 - DNA, 331 bp, Homo sapiens
  AC002383.1_24205
  Located on chromosome 7
  Distance between a terminus base of telomere on chromosomal short arm and 5'-terminus of this base sequence : 90777505
  Distance between 3'-terminus of neighbour sequence of sequence listing upward to telomere on chrosomal short arm and 5'-terminus of this base sequence : 52546
aacgatgagaatacatggacacatggggcagaacaacacacactggggcctgttgtggggagcagggggagggagaataccgggaagaacagctaatgggtgtggggcttaatacctgggtgatgggttggtctgtgcagtaaataactgtggcacacgtttacctatgtaataaacgtgcacatcctgcacatgtaccctggaacttaaaagttgatgtgaaaaaagaaaacatacacacacacacccatacacacacacacacacacacacacactcacacacacactaaggatttccagaattaattcaatggataattagctggtta

SEQ ID NO: 12463 - DNA, 416 bp, Homo sapiens
  AC002383.1_86532
  Located on chromosome 7
  Distance between a terminus base of telomere on chromosomal short arm and 5'-terminus of this base sequence : 90839802
  Distance between 3'-terminus of neighbour sequence of sequence listing upward to telomere on chrosomal short arm and 5'-terminus of this base sequence : 61966
caaacatcacatttattgctacagagaaagtgatttctaattagatgaaataaaaaaaatagtctgcagggtatgtttccccaatgaccatgaaaacaatttgcatttcagggattagagtatatatttttattagaagaatgacaaggccaaatgaaacccagacaatctgactacaaagccaaagctaagcagaccaatggaagcaaaaccatctggaatatttggcgtcatgctcatagaatacccaaaattggaaatgggtcactttgttgaagttggtgtgtgtgtgtgtgtgtgtgtgtgtgtgtgtgtgtgtgtgtgtgtgtttgtctaacagggactctttgttttcttttctttggtgatgttttcctggtatgcccagatttgttctatgcaaaggctatgtaatt

SEQ ID NO: 12464 - DNA, 401 bp, Homo sapiens
  AC003082.1_28345
  Located on chromosome 7
  Distance between a terminus base of telomere on chromosomal short arm and 5'-terminus of this base sequence : 90879089
  Distance between 3'-terminus of neighbour sequence of sequence listing upward to telomere on chrosomal short arm and 5'-terminus of this base sequence : 38871
acttgactaaccagcattgtaaagagaagcatcatagcatcatatatatgtatatatatatgtgtgtgtgtatatacatatatatcatatatatgtgtgtatatacacacacacacacacacatatacacatatatgtatatgtagctgggcagccgcacgtgtagtcccagctactctagaagctgaggtgggaggttgaagccagaagttccatgctgcagtgcgctatgaccatgcctgtgaatagcctctgcactccagcctaggcaacatactgagatcctatctcttacaaagggagagagagagagagagagagagagagagagagagagagagagaaaattacattcctgtccttagcctttattcacatcagtaagagcactttgcttcaac

SEQ ID NO: 12465 - DNA, 351 bp, Homo sapiens
  AC003082.1_84284
  Located on chromosome 7
  Distance between a terminus base of telomere on chromosomal short arm and 5'-terminus of this base sequence : 90935213
  Distance between 3'-terminus of neighbour sequence of sequence listing upward to telomere on chrosomal short arm and 5'-terminus of this base sequence : 55723
cttggcactgacctattaatagatgtttgaaacaccaaggaaacagaatattcttttgaacttgaactccttgttgacaggaaatggaaagagtagtgggtgttttgtttgaggggtgtgtgtgtgtgtgtgtgtgtgtgtggttttgagaggttcctgcactcagcagccccaaagctgcagctgcttcagagagacttcctgcagagtgacaggctcccttctgaggaaaacaggagtgaaagctgttttggatctcagcactacagggtgctgcacatggcaccagctttcaaagtccctcttatgctcttcaatgggacaatgtcagtttagtgaaatgtgactagg

SEQ ID NO: 12466 - DNA, 422 bp, Homo sapiens
  AC003082.1_143802
  Located on chromosome 7
  Distance between a terminus base of telomere on chromosomal short arm and 5'-terminus of this base sequence : 90994639
  Distance between 3'-terminus of neighbour sequence of sequence listing upward to telomere on chrosomal short arm and 5'-terminus of this base sequence : 59075
cacctcaaatattgagtgtcacatttcacaatgagatttgaaggggacaaacatccaaaccatatcacccagtctcactagcactttattaatgactcagtctttaaaatggccactgccactatccctggcactggtttgtaaattaaaaatagagtggtggcttctctgtctaatgtaactctctagtaagcttgaattattttaatctatctatctatctatctatctatctatctatctatctatctatctatctatcatctatctatccatccatctatctatctatccatctatcatccatctatctgccaacacaaaaagaacaaatcatgaaataaatgtttatttatttgcaatgctttggctaacaccacccctcagagtgtagtgaccagcagtccaggaataccttggtc

SEQ ID NO: 12467 - DNA, 232 bp, Homo sapiens
  AC002541.1_501
  Located on chromosome 7
  Distance between a terminus base of telomere on chromosomal short arm and 5'-terminus of this base sequence : 91023203
  Distance between 3'-terminus of neighbour sequence of sequence listing upward to telomere on chrosomal short arm and 5'-terminus of this base sequence : 28142
ctaggtttaggtgactcagaacagaagagagagagagagagagagagagagagagagagactgactctgtatgtttaggaaaaagtaaggaaagagaataagagtctctacctggtaatccagagaattctcccagatcttgcccaaaaccatgaaggcagtacctctactagtctgcaagaatcaccgagatattgggtttggggtgctcctaaagcagatacagctaaga

SEQ ID NO: 12468 - DNA, 263 bp, Homo sapiens
  AC002541.1_43612
  Located on chromosome 7
  Distance between a terminus base of telomere on chromosomal short arm and 5'-terminus of this base sequence : 91066203
  Distance between 3'-terminus of neighbour sequence of sequence listing upward to telomere on chrosomal short arm and 5'-terminus of this base sequence : 42768
ttggaatgttcctaacatgaagaaataataaatgcttgaggcttgaggtgatgaatacctcaattacccttatttgatcgttaaacattatatggctgtgtcaaaacatcacatgtagcccatatatatatatatatgtgtgtgtgtgtgtgtgtgtgtgtgtgtgtgtgtgtgtgtgtatatatatatatatataactattacatgccagaataattaaaaagtaaaattaaaaaaaaatgaaacataagttccagaacagt

SEQ ID NO: 12469 - DNA, 324 bp, Homo sapiens
  AC002541.1_61651
  Located on chromosome 7
  Distance between a terminus base of telomere on chromosomal short arm and 5'-terminus of this base sequence : 91084215
  Distance between 3'-terminus of neighbour sequence of sequence listing upward to telomere on chrosomal short arm and 5'-terminus of this base sequence : 17749
agaagtagatgaaacgctggtaactgtgtaataaaatttaaataacctctatggaggcattattttgttacataccattttgagttttaattgaagaaaacagctgactaaattgttgccaaaaacattaatgggactattgttgtttgatgaaatttcattcgtgtgtgtgtgtgtgtgtgtgtgtgtgtgtgttacctacaatgtacttgttttcctctttttcttctgtaaaacatgactgagaacacataaaatcagattggaataataatattaataacaataataatagttaccatatatttgatgcctaccatgtgt

SEQ ID NO: 12470 - DNA, 209 bp, Homo sapiens
  AC006155.2_28301
  Located on chromosome 7
  Distance between a terminus base of telomere on chromosomal short arm and 5'-terminus of this base sequence : 91217698
  Distance between 3'-terminus of neighbour sequence of sequence listing upward to telomere on chrosomal short arm and 5'-terminus of this base sequence : 133159
ccttatgtggtcaattaaccagctatattcttctataatagctggacagatcatgtgggcaaaaggatatacatgtatatgtttatatgcatctgtatatttttatgtacatatgtgtgtgtgtgtgtgtgtgtgtgtgtataatatactgtttgttttttctatctaggtgttatagaaagccacttagcatcagctggataaattag

SEQ ID NO: 12471 - DNA, 435 bp, Homo sapiens
  AC006155.2_56654
  Located on chromosome 7
  Distance between a terminus base of telomere on chromosomal short arm and 5'-terminus of this base sequence : 91246068
  Distance between 3'-terminus of neighbour sequence of sequence listing upward to telomere on chrosomal short arm and 5'-terminus of this base sequence : 28161
tgagctaagattacgccactgcactccagcctgctgacagtgaggctccgtcaaagagagaaagagagaaagagggaaagagggaaagagagaaaagaaggaaggaaggaaggaaggaaggaaggaaggaaggaaggaaggaaggaaggaaggaaggatggttaaaaaagctcttatttttaaaaagctaacagagtaactaggatatcatgatgggttaaaggaggccacagacattcctgtcattaagagggaaagtctgttttccttgcccttgtgtctgggctgtcttatggctgctttgaataatggagtatgtgaaagtgatgctatgccagttccaggcctagtctctcttaagagagctggctgactccatcttggtctcttggagacttcactgctatgttagaatgttatcttgaagtcactcca

SEQ ID NO: 12472 - DNA, 335 bp, Homo sapiens
  AC006155.2_75395
  Located on chromosome 7
  Distance between a terminus base of telomere on chromosomal short arm and 5'-terminus of this base sequence : 91264777
  Distance between 3'-terminus of neighbour sequence of sequence listing upward to telomere on chrosomal short arm and 5'-terminus of this base sequence : 18274
cttatttggaaatagtctttgcagatatgaatacttaagaatatcaagatgaaattatcttggatttagggttggccctaaatacaataaccagtgtccttataagaagaagagaggacatacagaggcacacacacacacacacacacacacacacacacacacagacaagcacacacacaaagtccatatgaagatggaggcagagcctggaattacgcctggagccaccagaagctgaaagaagcaataaaagattatttcctgaagttatctgggaaggttgttctacattttatccagttttctagttggttatgtggataagtctcata

SEQ ID NO: 12473 - DNA, 154 bp, Homo sapiens
  D7S492
  Located on chromosome 7
  Distance between a terminus base of telomere on chromosomal short arm and 5'-terminus of this base sequence : 91264833
  Distance between 3'-terminus of neighbour sequence of sequence listing upward to telomere on chrosomal short arm and 5'-terminus of this base sequence : -279
atcttggatttagggttggccctaaatacaataaccagtgtccttataagaagaagagaggacatacagaggcacacacacacacacacacacacacacacacacacacagacaagcacacacacaaagtccatatgaagatggaggcagagcc

SEQ ID NO: 12474 - DNA, 303 bp, Homo sapiens
  AC006155.2_106344
  Located on chromosome 7
  Distance between a terminus base of telomere on chromosomal short arm and 5'-terminus of this base sequence : 91295644
  Distance between 3'-terminus of neighbour sequence of sequence listing upward to telomere on chrosomal short arm and 5'-terminus of this base sequence : 30657
catttaatatggagcactcaagacactgacaactggttctgtaaaatttaaaatagcacctatgttaaggctctgttttcacagatacctgctttcccctgccctccattccaaaaaaagatcaaattttaaagagcactttatattcatgtggcatctgtacacaagttctccagagagaaagaaccaataggatatcataggtaaataagatagatagatagatagatagatagatagatagatagatagatagatagcttttataatgaattggttcacatgattatggaggctaagtca

SEQ ID NO: 12475 - DNA, 156 bp, Homo sapiens
  DID22N_0030096
  Located on chromosome 7
  Distance between a terminus base of telomere on chromosomal short arm and 5'-terminus of this base sequence : 91340889
  Distance between 3'-terminus of neighbour sequence of sequence listing upward to telomere on chrosomal short arm and 5'-terminus of this base sequence : 44942
tccataccagcaaaggttgaaaataagtagctaaatttttcaacaagcaatgaaaactcaaaaattttgttttgaagcagattaagttataaacacacacacacacacacacatacacacacacacacacaacagacatagagggactcatagaag

SEQ ID NO: 12476 - DNA, 179 bp, Homo sapiens
  AC005053.1_95932
  Located on chromosome 7
  Distance between a terminus base of telomere on chromosomal short arm and 5'-terminus of this base sequence : 91405169
  Distance between 3'-terminus of neighbour sequence of sequence listing upward to telomere on chrosomal short arm and 5'-terminus of this base sequence : 64124
ccttgattcaatacgattaatgtccttattaagtagagacactagagaatgctcgtgtgctcgctctcgctctctctctctctctctctctctctctctctctctctctccctccctccctgccttcctccctccctctctctctctttctgcacacagaggataggacatgtgcagac

SEQ ID NO: 12477 - DNA, 214 bp, Homo sapiens
  AC005053.1_152975
  Located on chromosome 7
  Distance between a terminus base of telomere on chromosomal short arm and 5'-terminus of this base sequence : 91462217
  Distance between 3'-terminus of neighbour sequence of sequence listing upward to telomere on chrosomal short arm and 5'-terminus of this base sequence : 56869
gaagacaaggcacatcttacatagcagcaggtgagacagagagagagagagagagagagagaacaaaccaggaagtgccacactttaaaaccatcagctctcatgagaactcactcactatcgtgagaacagcatgggggaaaccacctccatgatccaatcacttcccaccaggttcctcccttgacacctgaggattacaatttgaaatgag

SEQ ID NO: 12478 - DNA, 266 bp, Homo sapiens
  AC004969.1_79254
  Located on chromosome 7
  Distance between a terminus base of telomere on chromosomal short arm and 5'-terminus of this base sequence : 91509210
  Distance between 3'-terminus of neighbour sequence of sequence listing upward to telomere on chrosomal short arm and 5'-terminus of this base sequence : 46779
tgtggctattgtctccatttacttttagaatttcttcgtgtgtgtgtgtgtgtgtgtgtgtgagagagagagagagagagagagagagagacaactagtagaaacagagtaaccaaatctcttaactggaaatgactttatatgttgtattactaaaagacgtccaatttccaacatcctgaatatatacagtgacagaggacagataactcactattttatggggtagtttattcatttttgtaaataccagccattgttcttaa

SEQ ID NO: 12479 - DNA, 338 bp, Homo sapiens
  AC004969.1_85344
  Located on chromosome 7
  Distance between a terminus base of telomere on chromosomal short arm and 5'-terminus of this base sequence : 91515215
  Distance between 3'-terminus of neighbour sequence of sequence listing upward to telomere on chrosomal short arm and 5'-terminus of this base sequence : 5739
tagacctatcctggctaggtacagtggctcatgcctgtaatcccagcactatgagaggcccaagtgagaggatcacttgagcccaggagttccaggctgcaggaagccatgattgtgccatttgaaaatattatagatagatagatgatagatagatagatagatagatagatagatagatagagatagataaatagatatttttctatgttttcaagttttccttttcataataagtattttattttattagaattgatttttgtggggtaaagtacaatttcacatttttcataaaattatttttcacaaagtaacataatgtaaccaaactcagg

SEQ ID NO: 12480 - DNA, 453 bp, Homo sapiens
  AC002064.1_687
  Located on chromosome 7
  Distance between a terminus base of telomere on chromosomal short arm and 5'-terminus of this base sequence : 91535649
  Distance between 3'-terminus of neighbour sequence of sequence listing upward to telomere on chrosomal short arm and 5'-terminus of this base sequence : 20096
tagcctggattacagattcagaccctgaaaaaaaagagaaaggaaggaaggaaggaaggaaggaagggagggagggagggagggagggagggagggagggagggaaggaaggaaggaaggaaggaaggaaggaaggaaggaaggaaggaaggaaggaaggaaggaaggaaaaactagtctataccaatatataaactatatagccattaagaattataagactttagaacatgttgatctctggaaatatgtttatgaaataatgttaattataaatatgtgttttgtacagatgtacattcaagcattttaatagatttataaatccttgtgtatcattttgtgttcaaacacagcgtatttctttttttaatcatacttaaacaatttattttttatttcaatagtttctgaggaacaggtggctttttgtgacatgaacaaattcttttg

SEQ ID NO: 12481 - DNA, 160 bp, Homo sapiens
  DID22N_0030105
  Located on chromosome 7
  Distance between a terminus base of telomere on chromosomal short arm and 5'-terminus of this base sequence : 91568420
  Distance between 3'-terminus of neighbour sequence of sequence listing upward to telomere on chrosomal short arm and 5'-terminus of this base sequence : 32318
tccacgaatggaataattagtgaaaaccagttttatggatgctgttaaaactactccaaagcaataataatgacaacacacataaacatacacacacacacacacacactcacacacatgagcagtgcttctcaaattttgatgtgaggctgaggatctt

SEQ ID NO: 12482 - DNA, 254 bp, Homo sapiens
  AC002064.1_121486
  Located on chromosome 7
  Distance between a terminus base of telomere on chromosomal short arm and 5'-terminus of this base sequence : 91656496
  Distance between 3'-terminus of neighbour sequence of sequence listing upward to telomere on chrosomal short arm and 5'-terminus of this base sequence : 87916
aacagaaccaataggatctagctaacatatgtatatattatattttatataaagatatatatatatatatatatatatatatatgaagagatgtattataaaaaattggttcatgtgattatggaggctgagaagccccacaatctgccatctgcaagctagagacttaggaaagtcagtggtatagttccagcctgagtccaaaggccttaaaacgaggaaagctgacagtgtaagttcaagtctaggcctaa

SEQ ID NO: 12483 - DNA, 178 bp, Homo sapiens
  AC006153.2_6595
  Located on chromosome 7
  Distance between a terminus base of telomere on chromosomal short arm and 5'-terminus of this base sequence : 91697602
  Distance between 3'-terminus of neighbour sequence of sequence listing upward to telomere on chrosomal short arm and 5'-terminus of this base sequence : 40852
agtatcattcagaattgcaaagacatggaatcaaccttagtgcccatcaaccaatgaatgaagaaaattgagtgtgtgtgtgtgtgtgtgtgtgtatctatatatacacacacaccatagaatactactcagccataaaaaagaatgaggacatcttcctaagtgaagtaactcagga

SEQ ID NO: 12484 - DNA, 434 bp, Homo sapiens
  AC006153.2_79461
  Located on chromosome 7
  Distance between a terminus base of telomere on chromosomal short arm and 5'-terminus of this base sequence : 91770381
  Distance between 3'-terminus of neighbour sequence of sequence listing upward to telomere on chrosomal short arm and 5'-terminus of this base sequence : 72601
ggatgtaccatgaaggtaatgaagctgaagtttcagcccccagcccagctgcacaggccacttctttggccagataacttattttgtatttatactcatatatatgaatatatatatgagtataaatatgtatgtatgtatgactgtgtgtgtgtgtatgtgtgtgtgtgtgtgtgtgtgtgtaaccctcaaaaatataagcttcaggttccagaaaacctagattctcccatggagaaagatattatttcctcccctaaaatcctgatacccaaaaacgtaggtaccactattattcccatgttacctaggaagagactgagggaagagggggtaagtaccttgacacccagttctaagtggcagagttttgttttaaactcagatgatgtaaggcctgagtttgtgcttttaaccactgcctttctacattt

SEQ ID NO: 12485 - DNA, 331 bp, Homo sapiens
  AC002456.1_150336
  Located on chromosome 7
  Distance between a terminus base of telomere on chromosomal short arm and 5'-terminus of this base sequence : 91786339
  Distance between 3'-terminus of neighbour sequence of sequence listing upward to telomere on chrosomal short arm and 5'-terminus of this base sequence : 15524
gaggtcaggaaatcgagaccatcctgactaacacggtgaaaccccgtctctactaaaaaaaaaaaaaaaaatacagaaaaaaattagcccggcgtggtggccggcgcctgtagtcccagctacttgggaggctaaggcaggagaatggcgtgaacccaggaggcggagtttgcagtgagcagagttcgcaccactgcactctggtctgggcgacagagcaagactccgtctcaactaactaactaactaactaactaactaactaactaactaactaactaaatatgtcatgccaatctctcctggcctgtaaggtttccactgagaaagt

SEQ ID NO: 12486 - DNA, 337 bp, Homo sapiens
  AC002456.1_66712
  Located on chromosome 7
  Distance between a terminus base of telomere on chromosomal short arm and 5'-terminus of this base sequence : 91870008
  Distance between 3'-terminus of neighbour sequence of sequence listing upward to telomere on chrosomal short arm and 5'-terminus of this base sequence : 83338
aattgaaatcaatttgctgaagagatagctgcactactatgttgactgcagtatattcacaatagccaagatatagaatcaacttgtgtccatcaatggatgaatggattaaaaatgtagtgtgtatgcatacatatatatatgtgtgtgtatgtatacactttatatatgtatagatgctctgtctctctctctctacacacacacacacacacacacacacacacacacacacacgcacacacacaatgggttaccattcagccacaaagaaggaaatcctgtcatttgtgacaacatggatgaacctggagacattgtgctaagtgaaataagc

SEQ ID NO: 12487 - DNA, 238 bp, Homo sapiens
  AC003076.1_3448
  Located on chromosome 7
  Distance between a terminus base of telomere on chromosomal short arm and 5'-terminus of this base sequence : 91948838
  Distance between 3'-terminus of neighbour sequence of sequence listing upward to telomere on chrosomal short arm and 5'-terminus of this base sequence : 78493
tcagaacagtcctttgcacctagtaggtgctgaataaaagttgcttgagagaataaacagataatacttttggagtcttttaggtgaatttgttcccataattcagactttttttccttccttccttccttccttccttccttccttccttccttccttccttccttcctgccttcctgccttcctgccttccttccttccttcctttgccacaggaattcaccaactgtttattcat

SEQ ID NO: 12488 - DNA, 395 bp, Homo sapiens
  AC000059.1_82904
  Located on chromosome 7
  Distance between a terminus base of telomere on chromosomal short arm and 5'-terminus of this base sequence : 91976531
  Distance between 3'-terminus of neighbour sequence of sequence listing upward to telomere on chrosomal short arm and 5'-terminus of this base sequence : 27455
tgtcactatttctcctagagtcagcaacagctctagcctatagtttctttctttctttctttctttctttctttctttctttctttctttctttctttctttctttctttctttctttccttccttccttccttccttccttccttccttccttccttccttccttccttcctttccttccttccttccttccttccttccttctttctttctttctttctttctttccttctttctttctctttccttccttctttccttctttatttctctttctttttttttaattaaagttctagggtacgtgtgcacaacatgcaggtttgttacatagatgtacatgtgccatgttggtttgctgcatccattaactcgtcatttacattaggtatttc

SEQ ID NO: 12489 - DNA, 273 bp, Homo sapiens
  AC000059.1_69083
  Located on chromosome 7
  Distance between a terminus base of telomere on chromosomal short arm and 5'-terminus of this base sequence : 91990218
  Distance between 3'-terminus of neighbour sequence of sequence listing upward to telomere on chrosomal short arm and 5'-terminus of this base sequence : 13292
ctccactttctagctatgcaacctgatcacctcatgcccctgttcagtttactcatctgtaaagtggagatgtgagcatgtactttactgtgaaggctaggggaaatggatgtgaaacctagctgtagcacacaagtattttttgttgttgttgttccctttgcgttgagtggaatgtctacacacactttggggtgattggaactaagatgggaacacacacacacacacacacacacacacacacacacacgtagagttctgttacctcca

SEQ ID NO: 12490 - DNA, 275 bp, Homo sapiens
  D7S2410
  Located on chromosome 7
  Distance between a terminus base of telomere on chromosomal short arm and 5'-terminus of this base sequence : 92077407
  Distance between 3'-terminus of neighbour sequence of sequence listing upward to telomere on chrosomal short arm and 5'-terminus of this base sequence : 86916
tatagaagcaaagccaaaagatcctacccagcattctctgcagttgcaacacagagggagtggggagaagggaaggggaaagaaaacacacacacacacacacacacacacacacacacacacacacacacaccaataatattacagagaaagaaaaagaaaaaatgcaatctgtacaaaaataattacaaaaattatagtgccaacatctccagatgagaaggaaccagcaaaagaattttgttattgtgaaaaatctgaatgtcttggcaccg

SEQ ID NO: 12491 - DNA, 398 bp, Homo sapiens
  AC002065.1_92718
  Located on chromosome 7
  Distance between a terminus base of telomere on chromosomal short arm and 5'-terminus of this base sequence : 92084409
  Distance between 3'-terminus of neighbour sequence of sequence listing upward to telomere on chrosomal short arm and 5'-terminus of this base sequence : 6727
ggttccttctgaggattgttagggagaatctgttccatgcctctgtcctagcttctggtggtgtgctggcaattttgggcattcctggcttgcaggtgcatcacccctcttgttgccttctccacatggcattcttccagtgtgtgtgtgtgtgtgtgtgtgtgtgtgtgtgtgtgtgtgtctgtgtgtgtctgtgtccaagttttccctttctgtcaggacatgagttatatttgattaaggtccaccctaatgatctcattttgatttgattgcctccataaatgactcatttcaaaaaaaaatgcattctgaggtgcttggggttagaacttcaacatatctttttgaacagttcaatccataacacttactagtgtcaaacctcactaacttgg

SEQ ID NO: 12492 - DNA, 243 bp, Homo sapiens
  HUMUT1951
  Located on chromosome 7
  Distance between a terminus base of telomere on chromosomal short arm and 5'-terminus of this base sequence : 92106092
  Distance between 3'-terminus of neighbour sequence of sequence listing upward to telomere on chrosomal short arm and 5'-terminus of this base sequence : 21285
ggttgttccatctgcctggaatgttcttggtttattcttttatcttccttttttcagcttaatcctttcctgtggaatgtaaaaattgaccgaccttccttccttccttccttccttccttccttccttccttccttccttccttcttttctctctcctctctcttttctctctttcttttctttctctcttcttttctcttttttaagacatgggcaactggacacggtggctcacgtctgt

SEQ ID NO: 12493 - DNA, 273 bp, Homo sapiens
  AC002065.1_71070
  Located on chromosome 7
  Distance between a terminus base of telomere on chromosomal short arm and 5'-terminus of this base sequence : 92106110
  Distance between 3'-terminus of neighbour sequence of sequence listing upward to telomere on chrosomal short arm and 5'-terminus of this base sequence : -225
gaatgttcttggtttattcttttatcttccttttttcagcttaatcctttcctgtggaatgtaaaaattgaccgaccttccttccttccttccttccttccttccttccttccttccttccttccttcttttctctctcctctctcttttctctctttcttttctttctctcttcttttctcttttttaagacatgggcaactggacacggtggctcacgtctgtaatcccagcactttggtaggccgaggggtggatcatagtgagttcagg

SEQ ID NO: 12494 - DNA, 358 bp, Homo sapiens
  AC002065.1_8277
  Located on chromosome 7
  Distance between a terminus base of telomere on chromosomal short arm and 5'-terminus of this base sequence : 92168898
  Distance between 3'-terminus of neighbour sequence of sequence listing upward to telomere on chrosomal short arm and 5'-terminus of this base sequence : 62515
ccataacagagcagttgcttacgaagcagcacttacctacagcagcacttccttatgaagtttctgataataatgatattttcatcatatatatatatgtacacacacacacacacacacacacacacacacaggtgtcagctttcccagtggaacaaaaggagctgggaagattctagtgactgtggttacttgagggtacttcttatattcttagtagttccagacacttgcttatggaaaagaggaaactaattttcatggagtgcccactctgtgttgggcactgcggtaggtgtttcgcatgtcctcatgcagcctttaatacaggtaccatccttacactgaagatgaggaa

SEQ ID NO: 12495 - DNA, 387 bp, Homo sapiens
  AC006036.3_113319
  Located on chromosome 7
  Distance between a terminus base of telomere on chromosomal short arm and 5'-terminus of this base sequence : 92290245
  Distance between 3'-terminus of neighbour sequence of sequence listing upward to telomere on chrosomal short arm and 5'-terminus of this base sequence : 120989
atcaactcttagaacgtcaatcagccaagctaaatatactgcatttctattggggtacagcatccaagggtgctatgggatatataaaagctgctctatttggttttagggaaattaacatactgcctgtgtcttgagaatcaaaaataatttttggcccaggatattctcatcttaagagtgtgtgtgtgtgtgtgtgtgtgtgtgtgtgtgtgtgttttaatttagaaatatataggcaggagtgttggcttacacctgtaatcccagcactttgggggccaaggtgggaggatggcatgaggctaggcgtttgagaccagcctgggcaacatgctgagatcccatctcagcaaagtataaaagttcagttaccatggtagagtg

SEQ ID NO: 12496 - DNA, 370 bp, Homo sapiens
  AC006036.3_132036
  Located on chromosome 7
  Distance between a terminus base of telomere on chromosomal short arm and 5'-terminus of this base sequence : 92308928
  Distance between 3'-terminus of neighbour sequence of sequence listing upward to telomere on chrosomal short arm and 5'-terminus of this base sequence : 18296
agaagtaggtcacttggtcttaacccctaggtttatgaagtaaattaaagacacaagtgtttgcttgccctaaattgagtatgggggtgcaggagtggaagaagtgtcccaatatgttcgtggttttattagaatacttgcaagaaacataaacccattcaaatagagccaatgttaaaaatctggagaatttccaggaggtagagagttctagaaacaaaacaaaacaaaacaaaacaaaacactggatcatctgaacatctaagcctccagaagtcaagaaccaagtcatttcaggggacttcatctgcaggaatgtgtagccattcatgctacttccctgacactaatgtgacttagccatctacat

SEQ ID NO: 12497 - DNA, 323 bp, Homo sapiens
  AC006036.3_139234
  Located on chromosome 7
  Distance between a terminus base of telomere on chromosomal short arm and 5'-terminus of this base sequence : 92316230
  Distance between 3'-terminus of neighbour sequence of sequence listing upward to telomere on chrosomal short arm and 5'-terminus of this base sequence : 6932
tttcatccactggttgttaaactattgtgcattatttgactggtacaattgttaaaatagtcctcttcatcaatatatgccattcagaatttgagtgtgtttgtgtgtgagtgtgtgtgtgtgtgtgtgtgtgtgtaatgagccacatgcaactttgaaagctactatagtactcagtctggcttttgagttggattattccttaagccgctgtgctttgcattaaactgactgtggaggtatagtttgcagattcagttcctgtccttgtttcctccacatggctccgattccagggtctttagaactggaaccataatcct

SEQ ID NO: 12498 - DNA, 232 bp, Homo sapiens
  AC073458.4_105948
  Located on chromosome 7
  Distance between a terminus base of telomere on chromosomal short arm and 5'-terminus of this base sequence : 92351413
  Distance between 3'-terminus of neighbour sequence of sequence listing upward to telomere on chrosomal short arm and 5'-terminus of this base sequence : 34860
aaagcgtatcttaaagaagctaagcaacccatccaaaatgatgatgatgatgatgatgatgatgatgatgatgatgataatgatgtcagctgatatttactgagtgccactatatgttataatggtatttttagtacttttcatgtattaccttatttaatctttttaccaagaatccagtgaggtaggtagtctttgttatacctgttttatcaaagaggaaactgactca

SEQ ID NO: 12499 - DNA, 431 bp, Homo sapiens
  AC002458.1_2024
  Located on chromosome 7
  Distance between a terminus base of telomere on chromosomal short arm and 5'-terminus of this base sequence : 92356710
  Distance between 3'-terminus of neighbour sequence of sequence listing upward to telomere on chrosomal short arm and 5'-terminus of this base sequence : 5065
gataggaattgcattgactctatggattgctttgggcagtgtggtcattttcacaatattgatgctttcagtccatgagcatggaatggttttcatttgtttgtatcatttctgtttttttttttaatcggtgttttatagttctccctgtagaaaattttcatctccttggttaagtgtgttcctgaatgggcttccttctctctcctctcctctcctctcctctcctctcctctcctccgctccccactctcctctcccctctccccttccccttctgtttcctgcagctattataaatgggagtgagttcttgatttgattttcagcttggtcattattggtgtgtagcagtgctactgatttgtgtacattgatttttgtaacctgagactttgattttgtaactgaattcatttatcaaatctagg

SEQ ID NO: 12500 - DNA, 257 bp, Homo sapiens
  HUMUT2206
  Located on chromosome 7
  Distance between a terminus base of telomere on chromosomal short arm and 5'-terminus of this base sequence : 92397535
  Distance between 3'-terminus of neighbour sequence of sequence listing upward to telomere on chrosomal short arm and 5'-terminus of this base sequence : 40394
gctttgctagaacacttaccactttctaaaattaactcatttattttgttgttgctgctgctgctgctgctgctggtggtggtggtggtggtggtggtagtgatggtgatggtggtgtttatgtttttattgtctgtctcatgtttctagaataagagctccgtgaagaaagagacttgttctgttttgttcatgcctatattctcagcatgagaagaatccttagcacatattaggaaccattaactatgtgtgga

SEQ ID NO: 12501 - DNA, 316 bp, Homo sapiens
  AC002458.1_50194
  Located on chromosome 7
  Distance between a terminus base of telomere on chromosomal short arm and 5'-terminus of this base sequence : 92404854
  Distance between 3'-terminus of neighbour sequence of sequence listing upward to telomere on chrosomal short arm and 5'-terminus of this base sequence : 7062
gagcatcaggacaaatagctaatgcatgcagggcttaaaacctagatgacgggtagataggtgcagcaaaccaccatggcacaagtatacctacataacaaacctgcatgtcttgcacatgtatcctggaacgtaaagtaaagtaaaaaagaaaaataataatttattttactaaataaaaatttaaatttttatgtggaaaaaagtgtatacttatttcacttttatacacacacacacacacacacacacacacacacgggcaaacttgatcatatacaaaaaaattctataaactgattaccaagaatccaat

SEQ ID NO: 12502 - DNA, 135 bp, Homo sapiens
  Z67000
  Located on chromosome 7
  Distance between a terminus base of telomere on chromosomal short arm and 5'-terminus of this base sequence : 92413964
  Distance between 3'-terminus of neighbour sequence of sequence listing upward to telomere on chrosomal short arm and 5'-terminus of this base sequence : 8794
agctgatccaggtcttcctcactgggcccctgtgggtgtgtgtgtgtgtgtgtgtgtgtatatatcttaattcttaagttttaggacattgaaaactaccacattttacaaagtgaagcatgaacagaaatgcag

SEQ ID NO: 12503 - DNA, 269 bp, Homo sapiens
  AC002458.1_63447
  Located on chromosome 7
  Distance between a terminus base of telomere on chromosomal short arm and 5'-terminus of this base sequence : 92418131
  Distance between 3'-terminus of neighbour sequence of sequence listing upward to telomere on chrosomal short arm and 5'-terminus of this base sequence : 4032
tatccagaatggagtttcaaagcatggcatttcggcagcactgattctgtaggcgctggccatttcacagtctaagctctgtcactcgtcacctgtttgtatctagtgttcctaaatatagaaacacaacttagtaaatgtgctaaaatgtgtcgggctacatagaagcttgacacccagctcattaactaagttggttttgtttgtgtgtgtgtgtgtgtgtgtgtgtatgagcagctgtttacattgactacaaataaagcgtaggt

SEQ ID NO: 12504 - DNA, 257 bp, Homo sapiens
  AC002458.1_76295
  Located on chromosome 7
  Distance between a terminus base of telomere on chromosomal short arm and 5'-terminus of this base sequence : 92430977
  Distance between 3'-terminus of neighbour sequence of sequence listing upward to telomere on chrosomal short arm and 5'-terminus of this base sequence : 12577
atgtagcattagagctaggacaactcttaaagacaatctattccatcttcctcatttctgaggtataaaaactaacctgtacagggaataaggagaatatcctgctctatattcatggtctaagactgtttttcactattcatgttaccttctttcatacatttttttaaaaaactgcaaggagaccgagagagagagagagagaaagagagagagagagagagagagagtgtgtattgcatggataaggactagaa

SEQ ID NO: 12505 - DNA, 381 bp, Homo sapiens
  AC000057.1_28312
  Located on chromosome 7
  Distance between a terminus base of telomere on chromosomal short arm and 5'-terminus of this base sequence : 92464927
  Distance between 3'-terminus of neighbour sequence of sequence listing upward to telomere on chrosomal short arm and 5'-terminus of this base sequence : 33693
attcaggaagttaactacatgcactgtgcacacacacacgcacacacacactcacaccaagataagccctcacttatgagctctacttctaaagacttgtggggggtgtgtgtgtgtgtgtgtgtgtatgtgtgtgtgtgtgtgtttaattggagtaataaaattatgaagtatggaactgtttcaattgtggagttttagagtaagagtcttttgttcacttagatttcagtttcatgtattttgatgagaggtatgtataaagcctgaagaaatttgtactgtgctgagcctcacttcaatactctccagataattgagctaattaaatctttaccaacattaacacaactctggcattccttggacagtggataatta

SEQ ID NO: 12506 - DNA, 271 bp, Homo sapiens
  AC000057.1_37781
  Located on chromosome 7
  Distance between a terminus base of telomere on chromosomal short arm and 5'-terminus of this base sequence : 92474319
  Distance between 3'-terminus of neighbour sequence of sequence listing upward to telomere on chrosomal short arm and 5'-terminus of this base sequence : 9011
aggatgtcgtaatcaaactcacacaaattgggtgggtgtagacaagtcagtttggtaaaagaataaggagcatcatttgcttcatcagcatcgtctgatgatcacctgtgtcatcactttcagggttccaacagccccacctccactagcacctctctctgtctctctctctctctctctctcacacacacacacacacacacacacacacacacacacacacacacttcttcccatggttttaggtattttatcacttggaagaggcaga

SEQ ID NO: 12507 - DNA, 428 bp, Homo sapiens
  chr7.fa.O7frz.92825608
  Located on chromosome 7
  Distance between a terminus base of telomere on chromosomal short arm and 5'-terminus of this base sequence : 92618228
  Distance between 3'-terminus of neighbour sequence of sequence listing upward to telomere on chrosomal short arm and 5'-terminus of this base sequence : 143638
cctttccatttattaaatcatttatgtttccttggcaaatgagatttttcgttcatatatatatatatatatataaaatatatatatatttttttgagacggagtctcgctctgtcacccagggtggaatgcagtggtgtgatctcagctcactgcaacctctgcctcccaggttcaagagattcccctgcctcagcctcccgagtagctgggactacaagcacgtgccaccatgcccggctaatttttttgtgtttttagtagagacggggtttcactgtgttagccgggatggtctccatctcctgacctcttgatccgcctgcctcagcctcccaaagtgctgcaattacaggcatgagccaccgcactggtccgaaaactgttgacattttttaccaataattcaatctgtcaatttattgaat

SEQ ID NO: 12508 - DNA, 441 bp, Homo sapiens
  chr7.fa.O7frz.92921957
  Located on chromosome 7
  Distance between a terminus base of telomere on chromosomal short arm and 5'-terminus of this base sequence : 92769388
  Distance between 3'-terminus of neighbour sequence of sequence listing upward to telomere on chrosomal short arm and 5'-terminus of this base sequence : 150732
tccatgctatcctcttgatagtgagtgagtcttacaagatctgatggttttataagcagctggcatttcatccacttgcactgactccatcctgccaccttgtgaagaaggtgcctgcttctcctttgccttctgccatgattgaaagtttcctgaggcctccccagcaatgcagaactgtgagttgattacctctttcctttataaattacccagtcttgggcacttctttacagcagcatgagaatggactaatgcaggaacgaaggaaggagggaaggaaggaaggaaagaaggaaggagaaaaaagaaagaaagaagagagaaagaaagaaagaagaaaggaaggaaagaaagaagaaagaaagaaagaaagaaagaaagaaagaaagaaagaaagaaagaaagaaagagagagagaaatcctgttctatgatttct

SEQ ID NO: 12509 - DNA, 223 bp, Homo sapiens
  D7S2409
  Located on chromosome 7
  Distance between a terminus base of telomere on chromosomal short arm and 5'-terminus of this base sequence : 92994199
  Distance between 3'-terminus of neighbour sequence of sequence listing upward to telomere on chrosomal short arm and 5'-terminus of this base sequence : 224370
taagttctggggatctaatgtacagtatgttgactattgttaataatatttattgtatactttaaatttgttaagacagtagatcttaagtgttctcaccacacacacacacacacacacacacacacacacaatgtaaggtgatagatgtattaattagtttatgacaacatttccatgatttatatggatatcaaatcatcagttaccccataaatatgta

SEQ ID NO: 12510 - DNA, 435 bp, Homo sapiens
  AC002564.1_46430
  Located on chromosome 7
  Distance between a terminus base of telomere on chromosomal short arm and 5'-terminus of this base sequence : 93039329
  Distance between 3'-terminus of neighbour sequence of sequence listing upward to telomere on chrosomal short arm and 5'-terminus of this base sequence : 44907
tatgaggctagcatcacactaataccaaaaacagataaggagaaaaaagaaaaaaagaaaagaaaagagaaagagagaaagaaagaaagaaagaaagaaagaaagaaagaaagaaagaaagagagagagaggaaggaaggaaggaaggaaggaaggaaagaaagaaagaaagaaagaaagaaagagaaagaaagaaagaaagaaagaaagaaagaaagaaagaaagaaagaaagaaagaaagaaagaaagaaagaaaggcagacaaaaaagagggaggctggaaggaggaagaaggaaggaaagaaggaaggaagaaagagatgggaaggaggaagaaggaaggaaagaaggaaggaaggaagggagggaaggagggaggagacaaggatgtccactttcattattcttatttatgatagtattggaagccatag

SEQ ID NO: 12511 - DNA, 243 bp, Homo sapiens
  AC002564.1_63389
  Located on chromosome 7
  Distance between a terminus base of telomere on chromosomal short arm and 5'-terminus of this base sequence : 93056331
  Distance between 3'-terminus of neighbour sequence of sequence listing upward to telomere on chrosomal short arm and 5'-terminus of this base sequence : 16567
tcctcagttgcctataatgatgtgcagcacataagagtcactgtattatttgcagagggaaggaagggaggaagggaggaaggaaggaagggaggaaggaaggaagggaggaaggaaggaagggaggaaggaaggaaggaaggaagggaagggaagggaagggaagggaagggagggagggagggagggagatgatccagcaattcccctttgaggcacagaccctgccgaaactctgtcata

SEQ ID NO: 12512 - DNA, 238 bp, Homo sapiens
  AC000056.1_42272
  Located on chromosome 7
  Distance between a terminus base of telomere on chromosomal short arm and 5'-terminus of this base sequence : 93129341
  Distance between 3'-terminus of neighbour sequence of sequence listing upward to telomere on chrosomal short arm and 5'-terminus of this base sequence : 72767
tctaaacttgttcatcctacgtaactgctattttatagcctttaacctacatctccccatttccccgcctcctcccctccactcatggtaatcactgtttcattttctaactctgtgtatttgagcctatataagtgtgtgtgtgtgtgtgtgtgtgtgtgtgtgtgtgtgtgtgtattccacatataaaagtgagatcatgcaatatttctctctctgcatctagcttatttcactt

SEQ ID NO: 12513 - DNA, 139 bp, Homo sapiens
  D7S1813
  Located on chromosome 7
  Distance between a terminus base of telomere on chromosomal short arm and 5'-terminus of this base sequence : 93250830
  Distance between 3'-terminus of neighbour sequence of sequence listing upward to telomere on chrosomal short arm and 5'-terminus of this base sequence : 121251
ccttctcaggctatatttagttagctttaacagatgtcaggtaagttttttgtggcaagtgccacacaaaataataataataataataataataataataataataataataataacagagctggagctgggtgcactt

SEQ ID NO: 12514 - DNA, 403 bp, Homo sapiens
  AC003086.1_97379
  Located on chromosome 7
  Distance between a terminus base of telomere on chromosomal short arm and 5'-terminus of this base sequence : 93269092
  Distance between 3'-terminus of neighbour sequence of sequence listing upward to telomere on chrosomal short arm and 5'-terminus of this base sequence : 18123
gtcctatggaatgttaatgcagtctgtgaatggaacttctgaggaccgaaaggttccatatgccaacacctatagaattcctgctttaaataatttagttgttatatatctctctggcgaatcctggttgtgtgtgtgtgtgtgtgtgtgtgtgtgtgaacggttatggaaaagcctgtaaagcaaacaatacaatacacaattatacacaggcatcgttcattgggcttcatgagaaatttaacatatacagaatataagctgcgtagcatatttcttttaaaaattacatatttgagcatatattttgtctgggctcaaaagcccccttcctcccttcaatgaagtcttcttttatggattatattatttttagagataattgttagcagtcatacttgga

SEQ ID NO: 12515 - DNA, 357 bp, Homo sapiens
  AJ010770.1_41578
  Located on chromosome 7
  Distance between a terminus base of telomere on chromosomal short arm and 5'-terminus of this base sequence : 93309242
  Distance between 3'-terminus of neighbour sequence of sequence listing upward to telomere on chrosomal short arm and 5'-terminus of this base sequence : 39747
tagcttgtatttcttgactgaaagtcataaatgctttggtgcttaaactgcctgtatctctgggggcaccccagagttccacgaagtgcatttttctctttacactaaagtgaatattttttaatatgctagtggctgtaggtcagaccctcccatatatgcccatgaaatttggttacaatttgtatagctgttttctcacattgagataatagagcaaattttaatttaatttttttgtcattctaagtattttacgtacgtatgtatgtatgtatgtatgtatgtatgtatgtatgtatgatactttaagttctagggtacctgtgcacaatgtgcaggtttgttacataggta

SEQ ID NO: 12516 - DNA, 246 bp, Homo sapiens
  AC000066.1_63698
  Located on chromosome 7
  Distance between a terminus base of telomere on chromosomal short arm and 5'-terminus of this base sequence : 93345656
  Distance between 3'-terminus of neighbour sequence of sequence listing upward to telomere on chrosomal short arm and 5'-terminus of this base sequence : 36057
aggctgcatgagctatgattgtgccactgtactcctgcctgggcaacagagctcaagacctcatttctaaaaatataacacacacacacacacacacacacacacacacacacacacacacacagagaaatattcaaaactaaatgttctgttttaaggttgggaaacagaaagcagccagacaacaacaaaaactgttttgtccccaaaagagcacttttatagactggatttaaagttcaagcc

SEQ ID NO: 12517 - DNA, 259 bp, Homo sapiens
  AC000120.1_20066
  Located on chromosome 7
  Distance between a terminus base of telomere on chromosomal short arm and 5'-terminus of this base sequence : 93455711
  Distance between 3'-terminus of neighbour sequence of sequence listing upward to telomere on chrosomal short arm and 5'-terminus of this base sequence : 109809
gaaccaaggaataaactggttctacattttattacatttttgtttggttggtttctgtgtgtgtgtgtgtgtgtgtgtgtgtgcgcgtgcgtgtgtgtgtgtgtgtttggttttttgtttctgtttttgagacagggtctcactctgttgccaaggctaaagtgcagtgttgtgatctcggctcactgcaacctccgcctcctgggttcaagcgattctcatgcctcagcctcccaagtagctggaatttacaggtgtg

SEQ ID NO: 12518 - DNA, 337 bp, Homo sapiens
  AC000120.1_124799
  Located on chromosome 7
  Distance between a terminus base of telomere on chromosomal short arm and 5'-terminus of this base sequence : 93560361
  Distance between 3'-terminus of neighbour sequence of sequence listing upward to telomere on chrosomal short arm and 5'-terminus of this base sequence : 104391
gccagtattttctggtaatctaaagaaacaactattaactcagttaaagacaattagagtaactcttaatacaaaaattccatgtaataagaaatataagagcatatttttaaggaaacagaaaaaagatctttttatacacacacacacacacacacacacacacacacacatataaagcaactatagttaactgcttgattacaaatattaaaatcagataaatcaaaagaatttcgagttggaagaaactctagaaatgatctactgcattttatatatggataaataagctgagatgcagagaggtaaagtgaattaccttgctcaatctaat

SEQ ID NO: 12519 - DNA, 235 bp, Homo sapiens
  AC000118.1_39812
  Located on chromosome 7
  Distance between a terminus base of telomere on chromosomal short arm and 5'-terminus of this base sequence : 93617618
  Distance between 3'-terminus of neighbour sequence of sequence listing upward to telomere on chrosomal short arm and 5'-terminus of this base sequence : 56920
actggctaaagcatttagttgtagatttaaggttgttgttatcagtaatgcagataattgcagaagactaaattgagtatatgtatgaaagtgtgtgtgtgtgtgtgtgtgtgtgtgtgtgtgtattgggacctgctgcctgaatgaactttctgcttgtttctctactggctacagagtttagttgtagatttaaggttgttattatcaatagtgcagataactgcagaagact

SEQ ID NO: 12520 - DNA, 398 bp, Homo sapiens
  AC004539.1_24967
  Located on chromosome 7
  Distance between a terminus base of telomere on chromosomal short arm and 5'-terminus of this base sequence : 93699183
  Distance between 3'-terminus of neighbour sequence of sequence listing upward to telomere on chrosomal short arm and 5'-terminus of this base sequence : 81330
taagaacctatggtattcaaccagaagatcagaaattcatgaatccttccttgctagtcaccttccccgctagtcaccttccccagtgagagtcttgagagaggggtgtgtgtgtgtgtgtgtgtgtgtgtgtgtgtgtgtgtgtgtgtgtgtgtgtgtgtgtgtgtatcaaatgattaacaaagtgctgccttatatagatcttttgcaaagctggttttggagcgtacggcttagactcaaggcccaaactaggcccaaatccagtccatatactgtctccatacaattggctctctgtatccatgggtttcatagtgttgggttctgcattcatggattcagccaaccacagatcaaaaatacttagggaaaaaaattgcatctgtatcgaacat

SEQ ID NO: 12521 - DNA, 373 bp, Homo sapiens
  AC005156.1_49009
  Located on chromosome 7
  Distance between a terminus base of telomere on chromosomal short arm and 5'-terminus of this base sequence : 93909368
  Distance between 3'-terminus of neighbour sequence of sequence listing upward to telomere on chrosomal short arm and 5'-terminus of this base sequence : 209787
ctgaagtcaggaattcaagaccagcctggccgacgtggtgaaaccctgcctctactaaaaatacaaaaattagtcaggtatggtggcacacgcctgtaatcctagctactcgggaggttgagacaggagaatcacttgaacccgggaggtagaggttgcagtgagctgagatcgtgccactgcactccagcctgggcgacagagcgactccctctcaaaataaaataaataacataacataacataacataacataacataacataacataaataacataaaataacataacataaaataaaataaattcatttccaaagaagttaaataagatctaactctaaattcattgtttattcaactacatcttgtc

SEQ ID NO: 12522 - DNA, 259 bp, Homo sapiens
  AC005156.1_59327
  Located on chromosome 7
  Distance between a terminus base of telomere on chromosomal short arm and 5'-terminus of this base sequence : 93919716
  Distance between 3'-terminus of neighbour sequence of sequence listing upward to telomere on chrosomal short arm and 5'-terminus of this base sequence : 9975
tctaggcataaccaggagattacattccattttgtggatgagaaaaaccgaggcgaagggaagccgagtaatttgtgccagcttccacagcaagaaagcagagaagctggggattcaaacacaggtgtgtcaaacatgaaagcatttacaagatgcagtctctattaaatacacacatagacacacaggcacgcgtagacacacacacacacacacacacacacacccacccacaccatgaaagcatatgctttcctta

SEQ ID NO: 12523 - DNA, 379 bp, Homo sapiens
  AC000065.1_7748
  Located on chromosome 7
  Distance between a terminus base of telomere on chromosomal short arm and 5'-terminus of this base sequence : 93941936
  Distance between 3'-terminus of neighbour sequence of sequence listing upward to telomere on chrosomal short arm and 5'-terminus of this base sequence : 21961
atgcctgttatttactgaccaccttgagtctttaaaattgaattattcttgtcgtttacaaaaagtaacactttaaaagatcacagaatctctcacatacacacacacacacacacacacacacacacacatgcacacacacactcaaaagtaccaaatcaggcccggcagctgcagagagattacatcataactcagctgtgcctggattacccactccacactggcagcattcaaggttagaaaaatcaaatggcagcacaattggtcagcagcttctcttcttctggaatttttccaggttcttgaaacaaacagacaaacaaacaaacaaatgaacataaagctgcaatcactcttgcattgatttcaaaacagt

SEQ ID NO: 12524 - DNA, 261 bp, Homo sapiens
  AC000065.1_18271
  Located on chromosome 7
  Distance between a terminus base of telomere on chromosomal short arm and 5'-terminus of this base sequence : 93952449
  Distance between 3'-terminus of neighbour sequence of sequence listing upward to telomere on chrosomal short arm and 5'-terminus of this base sequence : 10134
tggaaagaatgatacttacctcataggatcaactaagtgagattatgaatatatctcatctactagaatgcccagcttatagcagagttacaattaagtggtaactaaacacacacacacacacacacacacacacacacacacacacctctcttattcctggccaatattatacagataatcatgtaaagtatttcacacagtgaagtagaaaggaaggaaccatttgccaccatgtggtgaggtccaagtcacatttaa

SEQ ID NO: 12525 - DNA, 192 bp, Homo sapiens
  AC002454.1_68961
  Located on chromosome 7
  Distance between a terminus base of telomere on chromosomal short arm and 5'-terminus of this base sequence : 94235064
  Distance between 3'-terminus of neighbour sequence of sequence listing upward to telomere on chrosomal short arm and 5'-terminus of this base sequence : 282354
atcctaccagcaacgaataagagttctggatggatgtgtgtgcgtgtgtgtgtgtgtgtgtgtgtgtgtgtgtgtgtattctatatatgtatatatgtatatgtgtgtctgtgtgtgtatatacgtgtgtgtatgtaaaacttgacccctacttcacatcagatataaaaatcaatttcagaaggattgaaa

SEQ ID NO: 12526 - DNA, 185 bp, Homo sapiens
  D7S646
  Located on chromosome 7
  Distance between a terminus base of telomere on chromosomal short arm and 5'-terminus of this base sequence : 94302323
  Distance between 3'-terminus of neighbour sequence of sequence listing upward to telomere on chrosomal short arm and 5'-terminus of this base sequence : 67067
ctgtctgcttatcctattcccatgtctgagcagttaaaatggctggaaaaaatacctacacacacacaaacacaaacacacacacagacacacacacacacacacacacacacacacccatccccccagtgttgcttggtctctctttaagttctacagacataaatctcaggtggacactcaac

SEQ ID NO: 12527 - DNA, 320 bp, Homo sapiens
  AC002454.1_153028
  Located on chromosome 7
  Distance between a terminus base of telomere on chromosomal short arm and 5'-terminus of this base sequence : 94319118
  Distance between 3'-terminus of neighbour sequence of sequence listing upward to telomere on chrosomal short arm and 5'-terminus of this base sequence : 16610
aggtatggatattgctgatacaatttttttcatttttatttttaaagaatgtaaatcacacacacacacacacacacacacacacacacacacacacacacacacacacacacgccagactagaaactgtgctattcttgaatttctctaagagcaaaaagctctgtaatcctctaatatctgaaaacgagtctttggctatttttgtttgttatacatcgaggatagatttttaaggtgctcaacacggccttgagaactatttgtacgttaagacctagacttactgaatattttcaaagcaatcaagttaaatacct

SEQ ID NO: 12528 - DNA, 343 bp, Homo sapiens
  AC002454.1_154547
  Located on chromosome 7
  Distance between a terminus base of telomere on chromosomal short arm and 5'-terminus of this base sequence : 94320540
  Distance between 3'-terminus of neighbour sequence of sequence listing upward to telomere on chrosomal short arm and 5'-terminus of this base sequence : 1102
ctacagtgtagatctagcaatccactttaatgtaaacattttaattactatttctaacatttggctttcattaaaagagaaaaactttaaagttttttttaataaagtttatacttaaaacccccttacagagcgtaccccttcctatttccaacacacacacacacacacacacacacacacacacacggttttgatttaaaaacaaaaaggaaaatccataaataaaaggagaacaagaagaaagggaggggaagggaggaaaagaaggaagaaaggaaagaaaaagaaaataccccagtaacccaatagcccaaatgtgaaggcaaggtttaggtcttaa

SEQ ID NO: 12529 - DNA, 325 bp, Homo sapiens
  AC000119.1_67229
  Located on chromosome 7
  Distance between a terminus base of telomere on chromosomal short arm and 5'-terminus of this base sequence : 94406055
  Distance between 3'-terminus of neighbour sequence of sequence listing upward to telomere on chrosomal short arm and 5'-terminus of this base sequence : 85172
tctgacagaacaggctttaaaccaataaagataaaaaaagacaaagaagggcattacataatggtaaggagatcaatgcaactagaagagctaattaccctaaatatatatatatatatatatatacacacacacacacacacacaatacaggagcaccaagtttcataaaataagtttttagagacctacaaagagacttaaactcctatacaataatagtgggagactttaacaccccactgtcaatattagatgatcaacaagacagaaaattaacaagggtattcaggacttgacctcagctctggatcaaatggacctaa

SEQ ID NO: 12530 - DNA, 209 bp, Homo sapiens
  AC000119.1_82533
  Located on chromosome 7
  Distance between a terminus base of telomere on chromosomal short arm and 5'-terminus of this base sequence : 94421412
  Distance between 3'-terminus of neighbour sequence of sequence listing upward to telomere on chrosomal short arm and 5'-terminus of this base sequence : 15032
gagctgagatcatgacactacactcaagcctaggcaatggagccagactctgtgtgtgtgtgtgtgtgtgtgtgtgtgtgtgtgtgtgtatctatatatatctcaagtctgtgattcttttagagttaatttttgaaaaagatgtgagattcaggttgaggttcattgtttggcctatggatatttaattgcttcataccacttattga

SEQ ID NO: 12531 - DNA, 127 bp, Homo sapiens
  D7S689
  Located on chromosome 7
  Distance between a terminus base of telomere on chromosomal short arm and 5'-terminus of this base sequence : 94421446
  Distance between 3'-terminus of neighbour sequence of sequence listing upward to telomere on chrosomal short arm and 5'-terminus of this base sequence : -175
caatggagccagactctgtgtgtgtgtgtgtgtgtgtgtgtgtgtgtgtgtgtgtatctatatatatctcaagtctgtgattcttttagagttaatttttgaaaaagatgtgagattcaggttgagg

SEQ ID NO: 12532 - DNA, 331 bp, Homo sapiens
  AC000119.1_83407
  Located on chromosome 7
  Distance between a terminus base of telomere on chromosomal short arm and 5'-terminus of this base sequence : 94422145
  Distance between 3'-terminus of neighbour sequence of sequence listing upward to telomere on chrosomal short arm and 5'-terminus of this base sequence : 572
gccactgtgcctagctaagacacacacacacacacacacacacacacacacacacacacacacgtcttatatagagtgacatatatataacatgtgatatatatatatgagtcactctcacaaacagactgttatatctcccaaataaacacacacacacacacacacacacacacacacacacacacagcgagagagagagagagagagagagagagagagagaaagcatgatagcatgattggattctggtaagaatgagagagctatcaaactgggatgaaaatctgacccaagtgaaggagaagtgaagcatccttgacttactaga

SEQ ID NO: 12533 - DNA, 262 bp, Homo sapiens
  AC000119.1_83235
  Located on chromosome 7
  Distance between a terminus base of telomere on chromosomal short arm and 5'-terminus of this base sequence : 94422145
  Distance between 3'-terminus of neighbour sequence of sequence listing upward to telomere on chrosomal short arm and 5'-terminus of this base sequence : -331
gccactgtgcctagctaagacacacacacacacacacacacacacacacacacacacacacacgtcttatatagagtgacatatatataacatgtgatatatatatatgagtcactctcacaaacagactgttatatctcccaaataaacacacacacacacacacacacacacacacacacacacacagcgagagagagagagagagagagagagagagagagaaagcatgatagcatgattggattctggtaagaatgag

SEQ ID NO: 12534 - DNA, 334 bp, Homo sapiens
  AC000119.1_119068
  Located on chromosome 7
  Distance between a terminus base of telomere on chromosomal short arm and 5'-terminus of this base sequence : 94457835
  Distance between 3'-terminus of neighbour sequence of sequence listing upward to telomere on chrosomal short arm and 5'-terminus of this base sequence : 35428
ataaggctgtattcacaggagacaaaaatggcttaaaggaagagattcacctgtaaatgggaacaagagaatggagagagttcaagtttatgattactttattttttgaactcttctctctcctggagcaatgagctgggagaagggcaaggggtacaaggagtgtgtgtgtgtgtgtgtgtgtgtgtgtgtgtgtgtgtgtgtgttggggagagtgttatgtggtggatggggaacaatatatttaccttccacataagtttttattgataccaagatgaggtaaatagaactctggtgtggatctgtgggtttgagtccaataagctttctc

SEQ ID NO: 12535 - DNA, 200 bp, Homo sapiens
  AC000119.1_165371
  Located on chromosome 7
  Distance between a terminus base of telomere on chromosomal short arm and 5'-terminus of this base sequence : 94504215
  Distance between 3'-terminus of neighbour sequence of sequence listing upward to telomere on chrosomal short arm and 5'-terminus of this base sequence : 46046
aaattatgctttggtcaagtagagattgagattccttagagaagtggtgtcacttggccactttttgcttgtgtgtgtgtgtgcatgtgtgtgtgtgtgtgtgtgtgtgtgtgtgtgtgttcctggaattcagagaaaagcatagggctagaaattagtttgtaaattatttgcatgtaagtggtgattgaaaccataac

SEQ ID NO: 12536 - DNA, 250 bp, Homo sapiens
  D7S657
  Located on chromosome 7
  Distance between a terminus base of telomere on chromosomal short arm and 5'-terminus of this base sequence : 94504228
  Distance between 3'-terminus of neighbour sequence of sequence listing upward to telomere on chrosomal short arm and 5'-terminus of this base sequence : -187
gtcaagtagagattgagattccttagagaagtggtgtcacttggccactttttgcttgtgtgtgtgtgtgcatgtgtgtgtgtgtgtgtgtgtgtgtgtgtgtgtgttcctggaattcagagaaaagcatagggctagaaattagtttgtaaattatttgcatgtaagtggtgattgaaaccataactatgaagaaattgcctaaggggagattatagagtgagaaggatgccaaaaactgtgctgtgac

SEQ ID NO: 12537 - DNA, 244 bp, Homo sapiens
  AC000119.1_168404
  Located on chromosome 7
  Distance between a terminus base of telomere on chromosomal short arm and 5'-terminus of this base sequence : 94507313
  Distance between 3'-terminus of neighbour sequence of sequence listing upward to telomere on chrosomal short arm and 5'-terminus of this base sequence : 2835
aaacctttcagagctacaatacacacacacacacacacacacacacacacacacacccctccttgatctaggcgtttttgtttctgtataaataaaggtctcactgctgtggagcagcatgatattagagataggaagtgaaattataggtaccccattctagaaatgtaaagaatacaacctcatctttctctctctgcagttaaaagaagtttgcagtcgaccttactgcaacgtaaacatt

SEQ ID NO: 12538 - DNA, 396 bp, Homo sapiens
  AC002453.1_1741
  Located on chromosome 7
  Distance between a terminus base of telomere on chromosomal short arm and 5'-terminus of this base sequence : 94531355
  Distance between 3'-terminus of neighbour sequence of sequence listing upward to telomere on chrosomal short arm and 5'-terminus of this base sequence : 23798
caaagtgaaatacatttcctagacatcttgacttgagaaatttccagatagaaaaaattagtaaattcattttcctgccttgagtctttttcctgttctcttctttaagaaaagttgggaaatataaataaatgtaaaaaatggtagctttctcaggatcacgtacaaattgaaaacatttctattatggataaatctcaaactatgcccacatggccttagggaattctatttatacaattgaatgccttcattaaatgtgaacatttgaatactgatcagatgattacatttccataaacattctctatctatctatctatctatctatctatctatctatctatctatctatcatctctctgtctgtctgtctatacattgcatgtcacaata

SEQ ID NO: 12539 - DNA, 247 bp, Homo sapiens
  HUMUT1257
  Located on chromosome 7
  Distance between a terminus base of telomere on chromosomal short arm and 5'-terminus of this base sequence : 94531553
  Distance between 3'-terminus of neighbour sequence of sequence listing upward to telomere on chrosomal short arm and 5'-terminus of this base sequence : -198
caaactatgcccacatggccttagggaattctatttatacaattgaatgccttcattaaatgtgaacatttgaatactgatcagatgattacatttccataaacattctctatctatctatctatctatctatctatctatctatctatctatctatcatctctctgtctgtctgtctatacattgcatgtcacaatagcaattttggctcagttaaaactttaaagtagggacatctgcattcaag

SEQ ID NO: 12540 - DNA, 398 bp, Homo sapiens
  AC002453.1_15293
  Located on chromosome 7
  Distance between a terminus base of telomere on chromosomal short arm and 5'-terminus of this base sequence : 94544999
  Distance between 3'-terminus of neighbour sequence of sequence listing upward to telomere on chrosomal short arm and 5'-terminus of this base sequence : 13199
aaaggttttaagcactgaggacaaagcagcaaataatacaaagtccctgctcctagggacctcatattctaggtagggaagagaaagaataaacaaataaaaatctataatatgcccaggtagtaataaaagctatgaaaaagagagaagcagaattggagatagagagtgactctctctctctctctttctattttctctgagcatgtgtgtctgtgtgtgtgtgtgtgtgtgtgtgtgtgtgtgtgtgtgttggagaagtgagattacattttatatagggtggtcagtaaaggcttcacagataaagtgacatttgagccaagacctaaaggaaacgaggggagcatgctagtatcttggagaaaagctgtctaggtagagcaaacagcaagtac

SEQ ID NO: 12541 - DNA, 275 bp, Homo sapiens
  D7S652
  Located on chromosome 7
  Distance between a terminus base of telomere on chromosomal short arm and 5'-terminus of this base sequence : 94567422
  Distance between 3'-terminus of neighbour sequence of sequence listing upward to telomere on chrosomal short arm and 5'-terminus of this base sequence : 22025
gggcttgtttcattacacgttgggatgcagtatgtatgatgcattatagcaaagcaaaaaatgcaaacttgataaatttggaatttattatattaaattcttagcctgaaagcagttgtatatatgtgtatgcacacacacacacacacacacacacacacacactctctctctctctctctctcattgatttatctgctgtaatttgtagaaataaagtgaaatagttgactactgactttttatactcctaacattctgtgccaaaaatcatg

SEQ ID NO: 12542 - DNA, 362 bp, Homo sapiens
  AC002379.1_118198
  Located on chromosome 7
  Distance between a terminus base of telomere on chromosomal short arm and 5'-terminus of this base sequence : 94718023
  Distance between 3'-terminus of neighbour sequence of sequence listing upward to telomere on chrosomal short arm and 5'-terminus of this base sequence : 150326
tcctggctaaggaattagaaacaaagaagaaactaggaagcaagacaagatttccttcttatgactcggtagagctgacagttgagcccgacgtggaaggttaggtggttgggttatggtcaactgccatttgccatatgctcactgtattagtcagggttttgtacaaaaccagcaagatgtgtacatagacagagacatttattttaaggaggtgtgtgtgtgtgtgtgtgtgtgtgtgtgtgcattcaagcaagtcaagttttaaaaactaggaaaaaaaaccatgactcacctggtgggaaaagatagttataaccatcagacaaggcatcctatgcttccatgctgtctttaacact

SEQ ID NO: 12543 - DNA, 344 bp, Homo sapiens
  AC003078.1_8718
  Located on chromosome 7
  Distance between a terminus base of telomere on chromosomal short arm and 5'-terminus of this base sequence : 94727125
  Distance between 3'-terminus of neighbour sequence of sequence listing upward to telomere on chrosomal short arm and 5'-terminus of this base sequence : 8740
tctatccacgtgtttatcctatctatctctatctatctatctatctatctatctatctatctatctatctattatctctctctctctctctcctatatctgctttcagaggtattgtgggtatatttatagggactaaaatagaaaagacccatatagtatactgtgatgcaaatcaagttattctcagcatatagtgttcggtttgccctgccttcttttgggaattgtatctctcgtcttctgggaaccattctttccaccactgcagccataacagagctctcatggttttatccaaagttgtcatttcccggctacaaaaattagtccaaggatgtcact

SEQ ID NO: 12544 - DNA, 375 bp, Homo sapiens
  AC003078.1_11520
  Located on chromosome 7
  Distance between a terminus base of telomere on chromosomal short arm and 5'-terminus of this base sequence : 94729739
  Distance between 3'-terminus of neighbour sequence of sequence listing upward to telomere on chrosomal short arm and 5'-terminus of this base sequence : 2270
acatatcctgtggctattaggtaagaagcactatgaaactttttttctagttagaaaagtgtgtgtgtgtgtgtctgtgtgtgtgagtgtgtgtgtgtattcatcgagggctgtggtggaggcagagtgtgggactgaacagtggaggactatgcattcaaactagggaaacttattgtattaggattccccagaaaaactaaaccaataggagatgtgtgtgtgtgtgtgtgtgtgtgtgtgtgcgcgcgcgcgcgcacgcacgtgcacgtgcgcatgctcgtgtgtgatttagatctttaaactgattagatgaggcccacccacattagggatggcaatctacattcctcagtctactgatttcaatgctag

SEQ ID NO: 12545 - DNA, 271 bp, Homo sapiens
  AC003078.1_116133
  Located on chromosome 7
  Distance between a terminus base of telomere on chromosomal short arm and 5'-terminus of this base sequence : 94834446
  Distance between 3'-terminus of neighbour sequence of sequence listing upward to telomere on chrosomal short arm and 5'-terminus of this base sequence : 104332
gaatggactaatacatcaggaaagaataaagtcccaaagggccaaattagaattaatttagggtcagtgaagagtaagcagccttaatgtaacaaggaggcccagaatacttccttgttgaacacacacacacacacacacacacgagtaaatagactaataaggtgagaaagtggttaaaaagaagtggggtcagaaggacaagtcaagtgttatatgtcagttaatgcctgatggagaaaacattagtttaggagcagtacttcaaagg

SEQ ID NO: 12546 - DNA, 319 bp, Homo sapiens
  AC003078.1_163671
  Located on chromosome 7
  Distance between a terminus base of telomere on chromosomal short arm and 5'-terminus of this base sequence : 94881876
  Distance between 3'-terminus of neighbour sequence of sequence listing upward to telomere on chrosomal short arm and 5'-terminus of this base sequence : 47159
tgagaacaaggtagctaaacctacgggaggcagggatgagaaaggactatagcaatacagagtccagcaatagcacattgggaagagcagaaagtttaagacccattagcaggcttatttccagtttaatctaagcattacgttccaaagggaagacccatttcccaggttaggataagtgcagaattctgaaagcaaagatgatagatgttcaaattgccaggccatgtatatatatatatatatatatattatacgtacatgtcattttagaaagtacacaatatcactatttgagcacttattctgcactagtcat

SEQ ID NO: 12547 - DNA, 147 bp, Homo sapiens
  D7S2430
  Located on chromosome 7
  Distance between a terminus base of telomere on chromosomal short arm and 5'-terminus of this base sequence : 94910700
  Distance between 3'-terminus of neighbour sequence of sequence listing upward to telomere on chrosomal short arm and 5'-terminus of this base sequence : 28505
tgcaatgagccatgtccataccactgcactcaagcctgggtgacagaatgagacctagtctaaacacacacacacacacacacacacacacacacacacacacacacaacttaactatgagtatgctatggggattaaactgcactc

SEQ ID NO: 12548 - DNA, 179 bp, Homo sapiens
  Z67718
  Located on chromosome 7
  Distance between a terminus base of telomere on chromosomal short arm and 5'-terminus of this base sequence : 94942068
  Distance between 3'-terminus of neighbour sequence of sequence listing upward to telomere on chrosomal short arm and 5'-terminus of this base sequence : 31221
gtccaaatggagcaaatatacacacacacactctctctctctttcacacacattcacacacacacgcactctttcacacacacacacacacacacacacacccctgagatataatttctatggcacttcttagagttcctcaaaagtatgctccagtaacccagagtggtaatttgcct

SEQ ID NO: 12549 - DNA, 243 bp, Homo sapiens
  D7S1820
  Located on chromosome 7
  Distance between a terminus base of telomere on chromosomal short arm and 5'-terminus of this base sequence : 95050791
  Distance between 3'-terminus of neighbour sequence of sequence listing upward to telomere on chrosomal short arm and 5'-terminus of this base sequence : 108544
acatcaagcagaacacttgcttgttcacactgtacagaagaagaaattttcataggtgtgattctgtatcagtctcaggatatggtttggaagaaacaagatttgaaaacttaagtcagagatagatagatagatagatagatagatagatagatattatatctaatatgtgaatggacttctcagaataagtagagtgtgaagatatttgtattttatatgcatactcaccaaagtcattca

SEQ ID NO: 12550 - DNA, 277 bp, Homo sapiens
  AC006378.2_28462
  Located on chromosome 7
  Distance between a terminus base of telomere on chromosomal short arm and 5'-terminus of this base sequence : 95287714
  Distance between 3'-terminus of neighbour sequence of sequence listing upward to telomere on chrosomal short arm and 5'-terminus of this base sequence : 236680
ctctattgcaccaacgattaatacattaaatatatttggctgtatgactatgcctaaaacaaatgaagaaaacagtaggacagaacaaaatagaaatgtatgtgtaatatatagtacatatgcaaatacttatgtatagtatttgtgtttgtatgtataatttatatatgtatatatgtatatgtgtgtgtttatatattatgtatatatatacactcagacacacacacacacacacacacatacacacatacgtatgttctgacaatgtaggcac

SEQ ID NO: 12551 - DNA, 284 bp, Homo sapiens
  AC003092.1_18425
  Located on chromosome 7
  Distance between a terminus base of telomere on chromosomal short arm and 5'-terminus of this base sequence : 95380167
  Distance between 3'-terminus of neighbour sequence of sequence listing upward to telomere on chrosomal short arm and 5'-terminus of this base sequence : 92176
ggaatgctaggttaacatcaatacacaaaaaccgatttggataacaaatcttgctactaacacaaaatattcacgatataaaagtatttgcaacttagatgaggcaaacatggagattatgtatgtatacacacacacacacacacacacacatacaaacaccatatatattcactatattatagtgaaattatttgtaacaatttttatctgcttttatcttttaaatgcagttcataatgttatacataccctcagatgttagtttcatattcacgtgaacc

SEQ ID NO: 12552 - DNA, 177 bp, Homo sapiens
  HUMUT5786
  Located on chromosome 7
  Distance between a terminus base of telomere on chromosomal short arm and 5'-terminus of this base sequence : 95399558
  Distance between 3'-terminus of neighbour sequence of sequence listing upward to telomere on chrosomal short arm and 5'-terminus of this base sequence : 19107
ttactctgttacccaggctggtaaactttcctgacacaatagatatagatagattagatgatagatagatagatagatagatagatagatagatagatagatagataccacaggaacaccagcaataataaaacttagcaacctaaaagcttctcattagctttgttttatggggtt

SEQ ID NO: 12553 - DNA, 320 bp, Homo sapiens
  AC003092.1_50882
  Located on chromosome 7
  Distance between a terminus base of telomere on chromosomal short arm and 5'-terminus of this base sequence : 95412631
  Distance between 3'-terminus of neighbour sequence of sequence listing upward to telomere on chrosomal short arm and 5'-terminus of this base sequence : 12896
ctagtgattggtctatctggttaaagccataccattggatacctcttcttggattcctatgataaactagatagatagatagatagatagatagatagatagatagatagatgatagatacatagatagatagatagatagatagatagatagatagatagatagatagagtagatagacagatgggttcaagaaagaaaaagttatttttagaacagatgggaaacacctggaagtcactgaacccctgccttccatgggtctataaaataagccatcttaagccagctgtgggatggatagagccactgatttgatct

SEQ ID NO: 12554 - DNA, 378 bp, Homo sapiens
  AC003092.1_60886
  Located on chromosome 7
  Distance between a terminus base of telomere on chromosomal short arm and 5'-terminus of this base sequence : 95422453
  Distance between 3'-terminus of neighbour sequence of sequence listing upward to telomere on chrosomal short arm and 5'-terminus of this base sequence : 9502
tctccaggtagttactgagctaagtgagaaactacagtgatcaacagttcgagtttgtcctgggactcaggactttcagtgctaagattgagaaagccccaggcaaagcaaggccagttggcaaacctcctggcaacttgtctttcacttaccatcagtgcacactttgatctgagatagcataaaaccatatattaactacccaaacactgacaactttgctgggacacacatgtgatggtattcaaaagaagacagaataatgatacacttttcgagattacccccacacacacacactatacacacacacacacacacacacacacacacacacatatatatatttttttggtagatggagtctggttctgttac

SEQ ID NO: 12555 - DNA, 313 bp, Homo sapiens
  AC003092.1_80268
  Located on chromosome 7
  Distance between a terminus base of telomere on chromosomal short arm and 5'-terminus of this base sequence : 95442025
  Distance between 3'-terminus of neighbour sequence of sequence listing upward to telomere on chrosomal short arm and 5'-terminus of this base sequence : 19194
gatctaggccacttggaactagtatttgaaccagtcattctgaagtccaggcccatattcttcaatatttgatacattgcatctatggaaagtagtaacaaaagtaacacacccacacacacacacacacacacacacacacacacacaactttacataaacaggtaaatgaactgcatttttctcattgaaattaatattcctgaccttaatcaaccactttattttgagtgattttcaaaatccagattcaatttttcacaattaagcatattctcaaagaagttatgtaatcactgaaggaaattctgaa

SEQ ID NO: 12556 - DNA, 409 bp, Homo sapiens
  AC003092.1_83251
  Located on chromosome 7
  Distance between a terminus base of telomere on chromosomal short arm and 5'-terminus of this base sequence : 95444946
  Distance between 3'-terminus of neighbour sequence of sequence listing upward to telomere on chrosomal short arm and 5'-terminus of this base sequence : 2608
cactgatcagagtttctgtgacactttattggtctgagaaactcatataagtttactgagagtattaggaattattcttcccctaaagtacaaaacaaacaaatgccaaaaactaaagaaagaaaaggaaagaaagaaagaaagaaagaaagaaagaaagaaagaaagaaagaaggaaagaaagaaagaaagaaagaaaaagaaagaaggaaagaaagagaacaaatgaatgaaagagagaaagagagaacaaagaaatgaaagaagagagaaagagagaaagaaagaaagaaagaaaagaaagaaagaaagaaagaaagaaagaaaaagaaaaagcaagcaagcaataaaaacaacttttgttggtgttgcagctcatactgagagaaattaatgaaggagcaggaat

SEQ ID NO: 12557 - DNA, 462 bp, Homo sapiens
  chr7.fa.O7frz.95769311
  Located on chromosome 7
  Distance between a terminus base of telomere on chromosomal short arm and 5'-terminus of this base sequence : 95543652
  Distance between 3'-terminus of neighbour sequence of sequence listing upward to telomere on chrosomal short arm and 5'-terminus of this base sequence : 98297
gatttcaatcgtcactgtagttacgattctagtgcctaaaatgagcaaaccagataaactgcccttctttgttactgaatagcaagtccctgctgggtgtgccaaatatagcagcaattgcatgctataacaaaagggttttaaaatctatctactgtttttttttcttttttaatctgcttactgtttaaatgctggatgaagttatggcagggttccctagaggaaattgagcttgacaactttttaaaatccctagaaagtgctctttctaactgaactttggaaattgaaaatatatttatctttccaaacataaagaatattaaagttaataaccacatttttcctagaaaaaatttctaagcaggtacatcttaagtattctcacaccacacacacacacacacacacacacacacacacacacacacacacacagtaactatgtgaggtgatgga

SEQ ID NO: 12558 - DNA, 349 bp, Homo sapiens
  AC002074.1_9447
  Located on chromosome 7
  Distance between a terminus base of telomere on chromosomal short arm and 5'-terminus of this base sequence : 95624836
  Distance between 3'-terminus of neighbour sequence of sequence listing upward to telomere on chrosomal short arm and 5'-terminus of this base sequence : 80722
taactagacaccttgctccaaccagatttattgattcatgttaagagctactccctaaccaggaggttgtgatgtccttcttattctcttactcctctctctctctctctctctctctactgtgaaggtttgaatcttgtgtctaacatttatgaattagacatgttatttaatgccactgaacattagtgaattcatctataaaatggagtagaatgtatataaagcctctccccttcccctgcccatagcccatcccactttctaatactttagtgtgggtgttccacttagttgtctattcaaatgtcaaatcactgttctggtcatggtgtaatattcctaccag

SEQ ID NO: 12559 - DNA, 195 bp, Homo sapiens
  AC002074.1_51872
  Located on chromosome 7
  Distance between a terminus base of telomere on chromosomal short arm and 5'-terminus of this base sequence : 95667245
  Distance between 3'-terminus of neighbour sequence of sequence listing upward to telomere on chrosomal short arm and 5'-terminus of this base sequence : 42060
aaccatgtctgactgcaaatacatctctcctttatgccagaatcatcatcatccttaagttatagggacatgtgagtatgactaggaaaaaatgggtcagtaaaacacaaacacacacacacacacacacacacattggcactgattcttaaatcaaagtatttattttctgatgtcgttcttatgagtatttgc

SEQ ID NO: 12560 - DNA, 407 bp, Homo sapiens
  AC002074.1_92539
  Located on chromosome 7
  Distance between a terminus base of telomere on chromosomal short arm and 5'-terminus of this base sequence : 95707782
  Distance between 3'-terminus of neighbour sequence of sequence listing upward to telomere on chrosomal short arm and 5'-terminus of this base sequence : 40342
tggaacgtacttgcattaattcaacccctatctcactcatcttgcttccttccactaacttgtacccatttatcatgaactcaatgtttgtgtccctccaaaatttatctgttgaagctcccaatgtgatgctatttgaaagtggggcctttgaaaggtaattatgtttacatggtgtcatgaagatagggaccccacgatgggattagtgtccctgtaagaagaggcaccagagtgctttctctctctctctctctctctctctctctctctttctctttctctttctctgccatgtaaagacagtcctcacgggcaactaaacttgctggcaccctgatcttagacttcctagccttcattgctgtgacaaataaatgttgtttacgccaaccagtctatttagt

SEQ ID NO: 12561 - DNA, 334 bp, Homo sapiens
  AC002528.1_86358
  Located on chromosome 7
  Distance between a terminus base of telomere on chromosomal short arm and 5'-terminus of this base sequence : 95818139
  Distance between 3'-terminus of neighbour sequence of sequence listing upward to telomere on chrosomal short arm and 5'-terminus of this base sequence : 109950
acattgcgtacagtgtacattacttcggtgttgggtgtaccaaaatctcagaagtcatcactaaaggacttattcatgtaactaaacaccacctgttccccaaaagcctatttaaataaataaataaataaataaataaataagcctaaatcatcattctctaagtataccatgggagtttttgtttcttttttctggctcttagctaactcttgatgtcttgtctaactcttgtccccagccagacctggggacaagtgggtacatcgacgattgatttcatagtcaaaaaagcatctcatgtatatctaagtctgactgtacatagtcaaca

SEQ ID NO: 12562 - DNA, 165 bp, Homo sapiens
  DISO7_10002307
  Located on chromosome 7
  Distance between a terminus base of telomere on chromosomal short arm and 5'-terminus of this base sequence : 95880004
  Distance between 3'-terminus of neighbour sequence of sequence listing upward to telomere on chrosomal short arm and 5'-terminus of this base sequence : 61531
gattctttgcttggtaagctggttattggatgtgagacaatgattaacacagcacatgtatacatatgtaacaaacctgcacgttgtgcacatgtaccctagaacttaaataaataaataaataaataaataaataaaaagaaaatgcaagattgttccaccgaa

SEQ ID NO: 12563 - DNA, 160 bp, Homo sapiens
  DISO7_10002308
  Located on chromosome 7
  Distance between a terminus base of telomere on chromosomal short arm and 5'-terminus of this base sequence : 95954377
  Distance between 3'-terminus of neighbour sequence of sequence listing upward to telomere on chrosomal short arm and 5'-terminus of this base sequence : 74208
ttatctactgtgtttccatgcacaaaatattaaaaaccaccatcaggtaactttagtttcaacacttaaaactcaaattacaatacacacacacacacacacacacacacatatatgtatagttttgctctttctaggtgtaaattacctcaatgattgt

SEQ ID NO: 12564 - DNA, 133 bp, Homo sapiens
  DISO7_10002309
  Located on chromosome 7
  Distance between a terminus base of telomere on chromosomal short arm and 5'-terminus of this base sequence : 96304127
  Distance between 3'-terminus of neighbour sequence of sequence listing upward to telomere on chrosomal short arm and 5'-terminus of this base sequence : 349590
tgtataatgttatgacagggacaagattatatatatatatatatgtatatatatgtatacatacatgtatatatgtgtacacacacacacacacacacacacacacacacgtcccaggagattgtatagtgtt

SEQ ID NO: 12565 - DNA, 426 bp, Homo sapiens
  AC002429.1_59920
  Located on chromosome 7
  Distance between a terminus base of telomere on chromosomal short arm and 5'-terminus of this base sequence : 96384298
  Distance between 3'-terminus of neighbour sequence of sequence listing upward to telomere on chrosomal short arm and 5'-terminus of this base sequence : 80038
atagcagtttcatttgcaatagccaaaactggaaacaacccaatatccatcaacaggtgaatggagaaacaaactgtatcatacccaaacagtggactcagcagtcaaaaggaacaaatggctatatcattatcatcatcatcatcatcatcatcatcattgatgaatttcaaaataattacccttaaagaagccagaccaatagagaaatatttattatataattctacttatatacagttctagaaagtgcaatgaacctgtagtgacataaagcagatcaatgttacctggaaacagggtacagtgagaattggattgtaaagggtctggtagaaatgcttgttatcttaggtgtagtgatggtttcatgggaatatataggtcagaaatcatcaaattgtacagtttacatatccaggtcat

SEQ ID NO: 12566 - DNA, 313 bp, Homo sapiens
  AC002429.1_173392
  Located on chromosome 7
  Distance between a terminus base of telomere on chromosomal short arm and 5'-terminus of this base sequence : 96497675
  Distance between 3'-terminus of neighbour sequence of sequence listing upward to telomere on chrosomal short arm and 5'-terminus of this base sequence : 112951
ctttaaactgtctttggcttgtaggtcgggtttcaccagggacctgtccctgtctgcctaggaatttgtctgcctccttatgctgtcattcatagcaaataagtagcagagcctgcctgtatacctaggatatctgactctagtgcttatacttaaataatatattactttatataatgtcattagtttttataatagactttaaggatatattatgcagtcgtattatatatatatatatatatatatatatatgcacatcatttatatattgttttacgagtatgttgtttcaagatattggtgaggtaag

SEQ ID NO: 12567 - DNA, 377 bp, Homo sapiens
  AC002429.1_215135
  Located on chromosome 7
  Distance between a terminus base of telomere on chromosomal short arm and 5'-terminus of this base sequence : 96539616
  Distance between 3'-terminus of neighbour sequence of sequence listing upward to telomere on chrosomal short arm and 5'-terminus of this base sequence : 41628
cctatcatagtacggatcaataactagttggatggatggatggatggatggatggatggatggatggatgtggagggatggtcagtcaggcagacagatgatgggcaaatagattaatgctataccacaatataatttaatttatgttgcatacccaacttaatcctgaaaaacttgagactatttaggaaagattgaccaggatggtgagaggtataactattttccttctatatataaaagttaaaatattctataaccctttgcctttaaaaaaaaaaaaacttaaaagacatggtaataattataaagcatttgaaaaagtgaactctggaaaaaggattagatttttttttaactccagacaatcattctag

SEQ ID NO: 12568 - DNA, 186 bp, Homo sapiens
  AC004022.1_58386
  Located on chromosome 7
  Distance between a terminus base of telomere on chromosomal short arm and 5'-terminus of this base sequence : 96677970
  Distance between 3'-terminus of neighbour sequence of sequence listing upward to telomere on chrosomal short arm and 5'-terminus of this base sequence : 137977
gagtggaaagtccattgaaagggatatatatgtatatgtgtgtgtgtgtgtgtgtgtgtgtgtgtgtgtgtgtgtctcacatggggaagagaaggaaagataaaaggatggaaaatcactttcaacattttgagtttaaagtgtctataggaaaggaatccaaatagaagtgtccagtaagcacct

SEQ ID NO: 12569 - DNA, 425 bp, Homo sapiens
  AC005021.1_27514
  Located on chromosome 7
  Distance between a terminus base of telomere on chromosomal short arm and 5'-terminus of this base sequence : 96763207
  Distance between 3'-terminus of neighbour sequence of sequence listing upward to telomere on chrosomal short arm and 5'-terminus of this base sequence : 85051
caagatccaattccatttgtagttggccctttaatcttttgaaatcacttatcaccacctctggacccttctttccttatatgtatagtggggctttcaaagagctaatgtagaccaaattcaatgctatacgtttaaacagtaagtaacacaatactatatatagatctagggagtcccacaccattgataatcaaaatgccattaagggggatgcagaatatacatgtggtataattctaaggtataaaattaggggaattacatattatccacatatgtgtgtgtgtgtgtgtgtgtgtgtgtatatatatatatatatataaacaatctagacataaactgaagagtagttactttgagagcagaagattggggtcgtggagagtggggaggtcagtgagtatggaaggagactttgcttt

SEQ ID NO: 12570 - DNA, 236 bp, Homo sapiens
  AC004012.1_9279
  Located on chromosome 7
  Distance between a terminus base of telomere on chromosomal short arm and 5'-terminus of this base sequence : 96809545
  Distance between 3'-terminus of neighbour sequence of sequence listing upward to telomere on chrosomal short arm and 5'-terminus of this base sequence : 45913
agcttaagatgtatgcctttcttatcatcatcttattttcttacttattatcattctcttattttcatatgtgtaattaaaaaaaaagttcctgtagaaacatatggtactattgtgtgtgtgtgtgtgtgtgtgtgtgtgtgtgtatatattcagcaatattgtcaactaattttttggtgccccaagcatgacttttttttgccatagaaaatactctaccatccaggtgcagt

SEQ ID NO: 12571 - DNA, 359 bp, Homo sapiens
  AC004012.1_31543
  Located on chromosome 7
  Distance between a terminus base of telomere on chromosomal short arm and 5'-terminus of this base sequence : 96831838
  Distance between 3'-terminus of neighbour sequence of sequence listing upward to telomere on chrosomal short arm and 5'-terminus of this base sequence : 22057
taaatttcttactattggcgtcagggagtgggatagggtatgctagaggacagagatcacaagtcctcagaaacattgtaaaattgtgtgtgtgtgtgtgtgtgtgtgtatgtatgtgtttatagacctatacagaagatgtgaacttacacctacacacatgtgcaaaaacatattacttaatacattttaaatcaaatttaacttgatctcaagccaccgttgtgtcttggatgggagaaaatctaagctcagtcattgctgatactctcctagccccacctgtgggcagtgcaaaggttcctgaactttccagcggggcttgcataaatggattgtagtctatgctctgcacaacc

SEQ ID NO: 12572 - DNA, 160 bp, Homo sapiens
  D7S2482
  Located on chromosome 7
  Distance between a terminus base of telomere on chromosomal short arm and 5'-terminus of this base sequence : 96857710
  Distance between 3'-terminus of neighbour sequence of sequence listing upward to telomere on chrosomal short arm and 5'-terminus of this base sequence : 25513
tggctctagaattctgaatggagtaaaaaagagatgaaagtgtgtgtgtgtgtgtgtgtgtgtgtgtgtatgtgtgtgtgtgtgtatagctaggttggaggatacattacagaaagacagacaaactttgggttgagttcattcattcctgtgggattaa

SEQ ID NO: 12573 - DNA, 315 bp, Homo sapiens
  AC003079.1_26411
  Located on chromosome 7
  Distance between a terminus base of telomere on chromosomal short arm and 5'-terminus of this base sequence : 96877584
  Distance between 3'-terminus of neighbour sequence of sequence listing upward to telomere on chrosomal short arm and 5'-terminus of this base sequence : 19714
cattctggttgacttcaatcttagcccactgtcagggttttttttgttttttgtttgtttttttttttttttttttttagaaatcgagccaatagaatgtgtgtgtgtgtgtgtgtgtgtgtgtgtgtgtgtgtgttcagagacagggaatggaatgatttattttaaggaattggctcatgcaatgtggaggtgcaagtctgaaatctggagggaaggccagtaggctggagacctagggaatagatacagtctgttgccagagcccttccttgcttgtgggaggttagtcttcgttctatgaagactttcaat

SEQ ID NO: 12574 - DNA, 115 bp, Homo sapiens
  D7S2431
  Located on chromosome 7
  Distance between a terminus base of telomere on chromosomal short arm and 5'-terminus of this base sequence : 96877659
  Distance between 3'-terminus of neighbour sequence of sequence listing upward to telomere on chrosomal short arm and 5'-terminus of this base sequence : -240
tttagaaatcgagccaatagaatgtgtgtgtgtgtgtgtgtgtgtgtgtgtgtgtgtgtgttcagagacagggaatggaatgatttattttaaggaattggctcatgcaatgtgg

SEQ ID NO: 12575 - DNA, 468 bp, Homo sapiens
  AC003079.1_24511
  Located on chromosome 7
  Distance between a terminus base of telomere on chromosomal short arm and 5'-terminus of this base sequence : 96879382
  Distance between 3'-terminus of neighbour sequence of sequence listing upward to telomere on chrosomal short arm and 5'-terminus of this base sequence : 1608
ctggtgacgtagacagtatgacacctaggcatccctgtgtttaacaactgtggtcctccacacactgtgttagcagggaatcttgtttcttcaaggtactccttcctcatatgaattcccagcagagacaacctctgtccaagcaattgtttttctttctttctttctctttctctttctttctttctttctttctttctttctttctttctttctttctttctttctttctttctttttctttctttctttctttccttctttctttctttctctttctttctttctttctttctttctttctttctttctttctttctttcttccttccttccttcctttctttctttctttctttttctttctttcttttctttctttcttttcttttcttttttttcttttcttttctttttcctttctctctctcttttttttttaagacagagtctcattctgtcgctaggt

SEQ ID NO: 12576 - DNA, 251 bp, Homo sapiens
  chr7.fa.O7frz.97158134
  Located on chromosome 7
  Distance between a terminus base of telomere on chromosomal short arm and 5'-terminus of this base sequence : 97174577
  Distance between 3'-terminus of neighbour sequence of sequence listing upward to telomere on chrosomal short arm and 5'-terminus of this base sequence : 294727
ctaaaaccacgtagatacttcttactttcctctttcaaaactgaagacaatgtgtgtgtgtgtgtgtgtgtgtgtgtgtgtgtgtgtgtgtgtgtgtgtgtgttaaagcaccagttaatggatagtaagttaggaatttggccagcatattttgtcatagctatttaacctcttctttgagcttttcttttgactttaagagcaatgactagattaagaggtaaaacgggtacatttgcaatgagcagtat

SEQ ID NO: 12577 - DNA, 139 bp, Homo sapiens
  DISO7_10009081
  Located on chromosome 7
  Distance between a terminus base of telomere on chromosomal short arm and 5'-terminus of this base sequence : 97260953
  Distance between 3'-terminus of neighbour sequence of sequence listing upward to telomere on chrosomal short arm and 5'-terminus of this base sequence : 86125
gctgtttcccagtacttggagaaaaatacccattctgaacataaatgataaatctctctctctgtgtgtgtgtgtgtgtgtgtgtgtgtgtgtgtgtgtgtgacgaagggggccacaaggccaggttcatgtcctcagt

SEQ ID NO: 12578 - DNA, 267 bp, Homo sapiens
  AC002452.1_110795
  Located on chromosome 7
  Distance between a terminus base of telomere on chromosomal short arm and 5'-terminus of this base sequence : 97383103
  Distance between 3'-terminus of neighbour sequence of sequence listing upward to telomere on chrosomal short arm and 5'-terminus of this base sequence : 122011
aagcggaagtagatagcagaagggatttgagtctgaaaaacagaggagtccctccttattttccaagcagccaagaattgcatcttcaattgttctgaattttttgctctgtgtgtgtgtgtgtgtgtgtgtgtgtgtgtgtgtgtgtgtgtgtgtaggcatgtgcatgcatatgtggacagctacacatatagggctgccaaggatggccataaaggctgtgtcttacacgcctcaaggaggctctattcacataggccataatgg

SEQ ID NO: 12579 - DNA, 283 bp, Homo sapiens
  D7S527
  Located on chromosome 7
  Distance between a terminus base of telomere on chromosomal short arm and 5'-terminus of this base sequence : 97400187
  Distance between 3'-terminus of neighbour sequence of sequence listing upward to telomere on chrosomal short arm and 5'-terminus of this base sequence : 16817
taacagaggcatgaaaaccaatttcaaaagggagtcctgtacatgttctcaacagtaggcagcatctttagactaccttgaagaaacaacagtattttgaatatagatgctctacaatctttgtgtttttttgaaaagccatttttctatgactttcttgattttgttggtcctatttccctctgtgtgcctggctcagtattatcctaggctcctggcaggacgtgtgtgtgtgtgtgtgtgtgtgtgtgtgtgtgtgtgtgtatctcctgagtttgcaatg

SEQ ID NO: 12580 - DNA, 356 bp, Homo sapiens
  AC002452.1_82042
  Located on chromosome 7
  Distance between a terminus base of telomere on chromosomal short arm and 5'-terminus of this base sequence : 97411877
  Distance between 3'-terminus of neighbour sequence of sequence listing upward to telomere on chrosomal short arm and 5'-terminus of this base sequence : 11407
attaactgactacaggtttctggaatcaactgtaaattacttgttttaccacacaacaatagttaatactagtattaattgaaaagggcattcttgtgtgtgtgtgtgtgtgtgtgtgtgtgtgtgtgtgtgtgtatctttgggatcattgactaaacatttctccaacaaacattttttttagtttctcccttaatgatccaatatatgtcattgagaagaaaatatactcgtgattttaaaaaaaaagcaagaggtaccctaaatatagtaacaagatagtcataccagagttaccaaaagatgctgagtaaaatagttgattccaaaaacttgtagtcagcactttgatacag

SEQ ID NO: 12581 - DNA, 225 bp, Homo sapiens
  AC002452.1_16534
  Located on chromosome 7
  Distance between a terminus base of telomere on chromosomal short arm and 5'-terminus of this base sequence : 97477381
  Distance between 3'-terminus of neighbour sequence of sequence listing upward to telomere on chrosomal short arm and 5'-terminus of this base sequence : 65148
ggtatcaggaacatcacagaactatgagtatgacttaaagctaagttgaaaagaggctctgctgtcttcagaaaggggaatatatgtgtatgtgtgtgtgtgtgtgtatatatatgtgtgtgtgtgtgtgtgtgtgtgtatgtgtgtgttttctttcattacaggcagcctgcctctttcaatggaggcgcaatatagctgatggttgagccgtagtcattgatt

SEQ ID NO: 12582 - DNA, 398 bp, Homo sapiens
  AC002452.1_15418
  Located on chromosome 7
  Distance between a terminus base of telomere on chromosomal short arm and 5'-terminus of this base sequence : 97478433
  Distance between 3'-terminus of neighbour sequence of sequence listing upward to telomere on chrosomal short arm and 5'-terminus of this base sequence : 827
gatcaccatcttcagaatacatttactgactggtgcagggtatttagttgccctgtggtgctggtttggattcaggcttctttagagtcagtgcttgtttctaagcatcattgttcttctccagaccaaacatatcagaatatttcatggaaagaaatattcatatctctctctctctctctctctctctctctctctctctccctctctcagtgtctctccaattgaaatttgtgtgtttcagggacatactgatgctttaagtcaaaggataagtttatttgtttttaatgagatacaattaatcagacatttaatttccattgctttgtccctgtgatccacaggaaatttgtggctagatttcctactatccaactcactagtggcctaccttt

SEQ ID NO: 12583 - DNA, 350 bp, Homo sapiens
  AC002452.1_2389
  Located on chromosome 7
  Distance between a terminus base of telomere on chromosomal short arm and 5'-terminus of this base sequence : 97491497
  Distance between 3'-terminus of neighbour sequence of sequence listing upward to telomere on chrosomal short arm and 5'-terminus of this base sequence : 12666
gcgaactatatgtcaagtggagaacaacaaaaaggtcttttgaagtgttttgagcaggaaacagctcagcctttttaattaggaagcccacagctggaggatctgaggaggagcacacttccctagtatttgtgtgtgtgtgtgtgtgtgtgtgtgtgtgtgtgtgtgggagggggcagggaaatattcttcaggtgttattattaagtctttgtatcttcaagggtatatacacctataattgctgccaagtagttatcttttaaaaatctttcaatttgagtctatttttgcttttagctacaagaattctgtgacaagaatgagttaggtaatgaagcatctttgaa

SEQ ID NO: 12584 - DNA, 183 bp, Homo sapiens
  AC002540.1_49635
  Located on chromosome 7
  Distance between a terminus base of telomere on chromosomal short arm and 5'-terminus of this base sequence : 97514988
  Distance between 3'-terminus of neighbour sequence of sequence listing upward to telomere on chrosomal short arm and 5'-terminus of this base sequence : 23141
gagccagaatgttgattagataaggaataattcattgactttgagggttttgtgtgtgtgtgtgtgtgtgtgtgtgtgtgtggtaaggaagagggaagctatatgactttatactctggcaaggagcctaaagaatagggtcactcttcgaagtctgaaaaagctgtagcctacattcactag

SEQ ID NO: 12585 - DNA, 291 bp, Homo sapiens
  D7S1812
  Located on chromosome 7
  Distance between a terminus base of telomere on chromosomal short arm and 5'-terminus of this base sequence : 97542969
  Distance between 3'-terminus of neighbour sequence of sequence listing upward to telomere on chrosomal short arm and 5'-terminus of this base sequence : 27798
ggaggaaggtggataataataggaaagtcaatgctctttaggacaaatacctaatgcatgcggggcttaaaacctagatgatggcttgatgggtgcagcaaaccaccatggcacttgtataactatgtaacaaacctgcgcattctgcacatgtatcccagaacttaaagtataataataataataataataataataataataataataataataaaagtcaatgctctatagtaagtgaggcagccagttcccaaaatggccctcaaagatctgcacccttgtgacatt

SEQ ID NO: 12586 - DNA, 200 bp, Homo sapiens
  AC002540.1_21335
  Located on chromosome 7
  Distance between a terminus base of telomere on chromosomal short arm and 5'-terminus of this base sequence : 97543281
  Distance between 3'-terminus of neighbour sequence of sequence listing upward to telomere on chrosomal short arm and 5'-terminus of this base sequence : 21
tcttgaggtgaagtcatagaagacactgcagcttctgccttgcttgctctctctctctctctctctctctctctctctctctctctctcagactttgctctggggaatctactgccatgttgtgagggtatccaagttgaccaatggagaggcccacatgacaaggaactgaggcctcctgtcaacagctatgtcattga

SEQ ID NO: 12587 - DNA, 250 bp, Homo sapiens
  AC002450.1_32064
  Located on chromosome 7
  Distance between a terminus base of telomere on chromosomal short arm and 5'-terminus of this base sequence : 97572125
  Distance between 3'-terminus of neighbour sequence of sequence listing upward to telomere on chrosomal short arm and 5'-terminus of this base sequence : 28644
ttacagtgagccaagattacaccactgcactccagcctgggcgacagaacaagcctctatcttggaaaacaaacaaacaaacaaacaaacaaacagaattttaagaaatcaaatattttagaaaggcaacacaatccagagttctaacgtacagccccattttctctaagtactccaagaacaatggccttcactaaaatcataatatactttaggtccaacagttgtggacaagtaggtttaacagtta

SEQ ID NO: 12588 - DNA, 361 bp, Homo sapiens
  AC002450.1_25150
  Located on chromosome 7
  Distance between a terminus base of telomere on chromosomal short arm and 5'-terminus of this base sequence : 97579013
  Distance between 3'-terminus of neighbour sequence of sequence listing upward to telomere on chrosomal short arm and 5'-terminus of this base sequence : 6638
tgttctttacaggaaactggactgcctcttgttagatgtgattatttttactacaaatggctatgattttcaaaaggattaactttacacacacacacacacacacacacacacacacacaaaagaagcagcagcatccctgttggcaattctcaaaaattagaatggcaaggttttaaaaggaacactttcactttgtaaaatgatctccatctatatgctttctattcttggtgatttgggaattatcattaagtatggcttggagagacaggtgataagttttattgttaatgatgggaaggggtttgactaacattaaagaaaagatataaatgagtccattatcagatttgtcgtt

SEQ ID NO: 12589 - DNA, 433 bp, Homo sapiens
  HUMUT900B
  Located on chromosome 7
  Distance between a terminus base of telomere on chromosomal short arm and 5'-terminus of this base sequence : 97759869
  Distance between 3'-terminus of neighbour sequence of sequence listing upward to telomere on chrosomal short arm and 5'-terminus of this base sequence : 180495
gggcacctgagcaagaccctaagaaggaaggaaagaaagaaagaaagaaagagagagagagagagagagagaaagaaagaaagaaagaaagaaagaaagaaagaaagaaagaaagaaagaaagaaagaaagaaagaaaggaaggaaggaatgggaagggaagggaagggaggggggaggggaagggaagggaggaaagaagagagggagggaggaaggaaggaaggaaaggaaagaaagaaagggaaagaagaaagagagaaagaaaggcaagagaaagaaagaatgaaagaaagagagagagagaaagagaaagaaatagaaagaaagaaaggagagagagaaagaaagaaagaagaaagagaaagaaagaaagaaagaaagaaaaagaaaagatacagaacttactgtagaaatgcacatattggcttcat

SEQ ID NO: 12590 - DNA, 387 bp, Homo sapiens
  AC004458.1_100292
  Located on chromosome 7
  Distance between a terminus base of telomere on chromosomal short arm and 5'-terminus of this base sequence : 97793463
  Distance between 3'-terminus of neighbour sequence of sequence listing upward to telomere on chrosomal short arm and 5'-terminus of this base sequence : 33161
ttttgtccattaaatacatgcttaataatgtaaacatttacagtctctttttaagaaactttgcaagaagattaaattatttcaggctctcaagatgaaagagataaaaggaattttacctatgtgctcacagaatatatatatatgtatgtgtgtgtgtgtgtgtatatatatatatatatatatacagcaactactgatatatatatacacacacacacacacacacacacacacacacacacacatatatataagattttcagcctttggagaaaataactttactctccttgaattctcggtatcaaaaccagaattctttccttcattctgtatatgtttcaagtaatttttgttatgactagaaaggaagactagttgcgt

SEQ ID NO: 12591 - DNA, 256 bp, Homo sapiens
  AC004458.1_76094
  Located on chromosome 7
  Distance between a terminus base of telomere on chromosomal short arm and 5'-terminus of this base sequence : 97817646
  Distance between 3'-terminus of neighbour sequence of sequence listing upward to telomere on chrosomal short arm and 5'-terminus of this base sequence : 23796
gactttgactagaacttatgccattatttcccagggcttcagactcagactggcattataccacttgctttcacgagtcttcagctttcagatggcagatcatgggacttctgactccataaccacatgggcagatttctcataataaatttatgtgtgtgtgtgtgtgtgtgtgtgtgtgtgtgtgtgtgtgtgtgtgtgtataatgtcctattggttctgtttttctggagaacatcaactaatacaatggagg

SEQ ID NO: 12592 - DNA, 444 bp, Homo sapiens
  AC004458.1_51090
  Located on chromosome 7
  Distance between a terminus base of telomere on chromosomal short arm and 5'-terminus of this base sequence : 97842619
  Distance between 3'-terminus of neighbour sequence of sequence listing upward to telomere on chrosomal short arm and 5'-terminus of this base sequence : 24717
ttctagaaatctcagtatgtccagcctcttttcaggaacactcaactgctctataagcagctcttggtataataccaacaaaaccccaagtacgtgagaaggaatgcattgattagtagtagcacatgttttaagatggtgtgtgaagcagtagccactactgtggcctccgcctgtctgtctatctatctatctatctatctatctatctatctatctatctatctatctatgtcttatctatccatccatccacccgtttttgtttgtttgtttgtttgtttgttttttagccatcttttgggactcccagatgcctgtcataggaatgaggcctgcaggtattctcacctcttctgtaagcggctttcacatcctcattatagttccctacctattgccccttggccagcccctccatttcagtagaagccagtatgtaac

SEQ ID NO: 12593 - DNA, 248 bp, Homo sapiens
  D7S821
  Located on chromosome 7
  Distance between a terminus base of telomere on chromosomal short arm and 5'-terminus of this base sequence : 97842696
  Distance between 3'-terminus of neighbour sequence of sequence listing upward to telomere on chrosomal short arm and 5'-terminus of this base sequence : -367
acaaaaccccaagtacgtgagaaggaatgcattgattagtagtagcacatgttttaagatggtgtgtgaagcagtagccactactgtggcctccgcctgtctgtctatctatctatctatctatctatctatctatctatctatctatctatctatgtcttatctatccatccatccacccgtttttgtttgtttgtttgtttgtttgttttttagccatcttttgggactcccagatgcctgtcata

SEQ ID NO: 12594 - DNA, 446 bp, Homo sapiens
  AC004458.1_42282
  Located on chromosome 7
  Distance between a terminus base of telomere on chromosomal short arm and 5'-terminus of this base sequence : 97851431
  Distance between 3'-terminus of neighbour sequence of sequence listing upward to telomere on chrosomal short arm and 5'-terminus of this base sequence : 8487
gagctatcttcagtgcagtttaagagagtaattgttgtaattgcataattatgtatattttgataagtttgcaataaagtatttatgaaatgtactaattcattcattaagccattcaacaaccacttgttgaatatggataaaaccacacattcttgtttaaagaagcttataattttgtgtgtgtttgtgtatgtgtgagagtgtgtgtgtgtgtgtgtgtgtgtgtaagagagaagaatagaggcagagagagagaaagagaggttacacaaggcagcaaaagatctctacaaggaaaactataaaacactgttgaaataaatcacagacaacacaaacaaatagaaaaacgttccatgcttatagattgggagaatcaatatcattaaaatggccagtgttaggtcattcttgtgttgctgtctagaaatactggagactgg

SEQ ID NO: 12595 - DNA, 358 bp, Homo sapiens
  AC004458.1_21569
  Located on chromosome 7
  Distance between a terminus base of telomere on chromosomal short arm and 5'-terminus of this base sequence : 97872217
  Distance between 3'-terminus of neighbour sequence of sequence listing upward to telomere on chrosomal short arm and 5'-terminus of this base sequence : 20340
agactggctctccttacttctaagcttgcagacagcctattgtgagactttgtgatcttgtaagttaatacttaataaactcccaaatatatatatgtatacacacacacaaatatatatatttatgtgtgtgtgtgtgtgtgtgtgtgtgtgtgtatatatatatatatatatatatatcctactagttctgttcctctagagaaccctgactaatacagatttccaattaaagatattaagcaggcagcctaattttcagggcttgctcgagaaggatgaatgcagataaattttgggagttgttggcacagcggatcagaaatacttattgaaaggttcattgataagcttcaga

SEQ ID NO: 12596 - DNA, 125 bp, Homo sapiens
  D7S479
  Located on chromosome 7
  Distance between a terminus base of telomere on chromosomal short arm and 5'-terminus of this base sequence : 98118127
  Distance between 3'-terminus of neighbour sequence of sequence listing upward to telomere on chrosomal short arm and 5'-terminus of this base sequence : 245552
ctgggtgacagagcaccagagcaagaccttgtctcttaaaaacacacacacacacacacacacacacacacacacacacatacataaaagaaccaaagaaaaaaccctaatatctatcaagaagg

SEQ ID NO: 12597 - DNA, 388 bp, Homo sapiens
  chr7.fa.O7frz.98288632
  Located on chromosome 7
  Distance between a terminus base of telomere on chromosomal short arm and 5'-terminus of this base sequence : 98161891
  Distance between 3'-terminus of neighbour sequence of sequence listing upward to telomere on chrosomal short arm and 5'-terminus of this base sequence : 43639
tactcagtcatgacagtccatcattctctttctttttttttattcttttattgtccttcctaccttttttctttccttcttttctcccttccttccttccttccttccttccttccttcctttcttccttcctatctcaagacagggcaggcagtttctattatatatacgaactaaactttcttaagaagcaagattgcctatgaaaaattggcaagaagtcatgatagttaaaacattagtgtatatactaaaaaacaacaacaacaaaatactaaagcaggaaataagagactggttcctaaccctcttgcagtttctctgatattcggcaattgacccttttgagcctctgttttgtcatctgtaagacgactgtattggacaa

SEQ ID NO: 12598 - DNA, 268 bp, Homo sapiens
  D7S2539
  Located on chromosome 7
  Distance between a terminus base of telomere on chromosomal short arm and 5'-terminus of this base sequence : 98170627
  Distance between 3'-terminus of neighbour sequence of sequence listing upward to telomere on chrosomal short arm and 5'-terminus of this base sequence : 8348
ggagggtattccattgtttgtgtgtgtgtgtgtgtgtgtgtgtgtgtgtgtgtgtgtgtgtgtgtgtgtatatatatatatatatatatatatatacataccacagtttctttatccactcgttgattgatgggcatttgggttggttccatcattttgcaattatgaattgtgctgctataaacatgcatgtgcaagtatctttttcatataatgacttcttttcctctggtaaatacccagtagtgggattgctgaatcaactggt

SEQ ID NO: 12599 - DNA, 131 bp, Homo sapiens
  D7S491
  Located on chromosome 7
  Distance between a terminus base of telomere on chromosomal short arm and 5'-terminus of this base sequence : 98280762
  Distance between 3'-terminus of neighbour sequence of sequence listing upward to telomere on chrosomal short arm and 5'-terminus of this base sequence : 109867
tcaaaattatttgacttcttgatttagattatgtgtgtgtgtgtgtgtgtgtgtgtgtgtgtgtgtgtgtgtgtgtgtgactttctaaaatttacaatgatgtcattctaatggagttaggttttggagct

SEQ ID NO: 12600 - DNA, 277 bp, Homo sapiens
  HUMUT1341
  Located on chromosome 7
  Distance between a terminus base of telomere on chromosomal short arm and 5'-terminus of this base sequence : 98311560
  Distance between 3'-terminus of neighbour sequence of sequence listing upward to telomere on chrosomal short arm and 5'-terminus of this base sequence : 30667
gagagaccacatggagaagcctgagacaatatgaagatgatacacagatagatggataggtaggtaggtgggtggataaatggatggatggatagatagatagatagatagatagatagatagatagataagatagagataaatagatgataggtatagatgatagaaagatatatagatagatagatagatagatagatagatagatagatagatagatatggagatatgcctggccagcctccagctcctctaggccactgctatagtaccagct

SEQ ID NO: 12601 - DNA, 394 bp, Homo sapiens
  AC004774.1_29426
  Located on chromosome 7
  Distance between a terminus base of telomere on chromosomal short arm and 5'-terminus of this base sequence : 98337468
  Distance between 3'-terminus of neighbour sequence of sequence listing upward to telomere on chrosomal short arm and 5'-terminus of this base sequence : 25631
gaggccagtagttcaagattagcctgggcagcaaggcaagaccctatctctacaaaaaataaaaattaaaaaattacctgggcatggtggcatgcctgtagtcccagctactcaggagggtgaggcaggaggattgcttgagcccaggagtttgaggctacaatgagctatgatcatgccactgcactccagcttggtgacagagcaagaccctgctcctaagtagatagatagatagatggataaatagatagatagatgatagatagatagatagatagatagatagatagatagatatgatagataaataaataaggcataaggttattataaaggcaaaacaaagaactatcttaaagcaaataataaatgatgaattgcaccatgattc

SEQ ID NO: 12602 - DNA, 290 bp, Homo sapiens
  D7S1796
  Located on chromosome 7
  Distance between a terminus base of telomere on chromosomal short arm and 5'-terminus of this base sequence : 98337611
  Distance between 3'-terminus of neighbour sequence of sequence listing upward to telomere on chrosomal short arm and 5'-terminus of this base sequence : -251
ccaggagtttgaggctacaatgagctatgatcatgccactgcactccagcttggtgacagagcaagaccctgctcctaagtagatagatagatagatggataaatagatagatagatgatagatagatagatagatagatagatagatagatagatatgatagataaataaataaggcataaggttattataaaggcaaaacaaagaactatcttaaagcaaataataaatgatgaattgcaccatgattcatccagctgccaaaaaagaaacttggacaccatccttga

SEQ ID NO: 12603 - DNA, 190 bp, Homo sapiens
  AC004774.1_30810
  Located on chromosome 7
  Distance between a terminus base of telomere on chromosomal short arm and 5'-terminus of this base sequence : 98339002
  Distance between 3'-terminus of neighbour sequence of sequence listing upward to telomere on chrosomal short arm and 5'-terminus of this base sequence : 1101
taattgttttgcaaggacttctgtgaggtgtgaggtgaagttttatctttcttctatacatcccaggacataactgactactttccattcttttttcttctcacctccctacacacacacacacacacacacacacacacacacacacaacccacattcccccctacattccacagaagtatcactagca

SEQ ID NO: 12604 - DNA, 189 bp, Homo sapiens
  Z66944
  Located on chromosome 7
  Distance between a terminus base of telomere on chromosomal short arm and 5'-terminus of this base sequence : 98339015
  Distance between 3'-terminus of neighbour sequence of sequence listing upward to telomere on chrosomal short arm and 5'-terminus of this base sequence : -177
aggacttctgtgaggtgtgaggtgaagttttatctttcttctatacatcccaggacataactgactactttccattcttttttcttctcacctccctacacacacacacacacacacacacacacacacacacacaacccacattcccccctacattccacagaagtatcactagcatctcggaagggt

SEQ ID NO: 12605 - DNA, 174 bp, Homo sapiens
  AC004774.1_83391
  Located on chromosome 7
  Distance between a terminus base of telomere on chromosomal short arm and 5'-terminus of this base sequence : 98391600
  Distance between 3'-terminus of neighbour sequence of sequence listing upward to telomere on chrosomal short arm and 5'-terminus of this base sequence : 52396
gcatatttacatggttcatgaagaaatttttgcataagaaagtgaatgtaagataaattgaaactcagtatatgaaccagaatttgccactttcacacacacacacacacacacatatgcatgcatacacacagagatacacacacaggataaggtcaatttcactgtatccac

SEQ ID NO: 12606 - DNA, 344 bp, Homo sapiens
  AC004774.1_87872
  Located on chromosome 7
  Distance between a terminus base of telomere on chromosomal short arm and 5'-terminus of this base sequence : 98396124
  Distance between 3'-terminus of neighbour sequence of sequence listing upward to telomere on chrosomal short arm and 5'-terminus of this base sequence : 4350
tatgagatgactcagcttcctaagtaatatgatttagggagaatcaaaggatatatatatatatatatatattccattacttttatgtattcattttcaatcagtatttattgagcactttctgtgtgggagttactagaagatgaagataaaatggtcatggggttgtcagatttaacaaataaaaatcccatattttatctggcaattctaaattgtcagcaagagaccatgcctaccacaaggaactcacaatctagtgccctgtgcattccctaaaattttgaaatctcattaacaccttagcaaaactgatttatctgattagcttcaaagtccataac

SEQ ID NO: 12607 - DNA, 376 bp, Homo sapiens
  AC004774.1_129231
  Located on chromosome 7
  Distance between a terminus base of telomere on chromosomal short arm and 5'-terminus of this base sequence : 98437248
  Distance between 3'-terminus of neighbour sequence of sequence listing upward to telomere on chrosomal short arm and 5'-terminus of this base sequence : 40780
cacttatgcacggaatacagagagagtgaaagaaacgtagacacctcaacccggggctctcttttaaagttcagcaagagtcacacactgagaaggaaccggtggtggggtgttttcgtaggaaaggggcggcaggtcaggatgagattctcactgtcatgagtatgggtttgggcgggagggggagggattgccaaacgcgtgttgtacaaacctgccctggggctacaactccccttcctcaaaactaccacccctctggaactgacggagaacctctccagggtgtgtgtgtgtgtgtgtgtgtgtgtgtgtgtgtgtgtcaagttccagggagaagtgtggaggatgagggctgtggtctcaattctgccag

SEQ ID NO: 12608 - DNA, 383 bp, Homo sapiens
  AC004774.1_141806
  Located on chromosome 7
  Distance between a terminus base of telomere on chromosomal short arm and 5'-terminus of this base sequence : 98450021
  Distance between 3'-terminus of neighbour sequence of sequence listing upward to telomere on chrosomal short arm and 5'-terminus of this base sequence : 12397
gcctttaagaactgtaacactcaccatgggggtcagcggcttcattcttgaagtcagtgagaccaataacccaattctggacactgcgtgtgtgtgtgtgtgtgtgtgtgtgtgtgtgtgtgtttgcgtttttttttttgttttttttttgtttttgaggtggagtctcactctgtcacccaggctgcagtgcagtggcacgatctcagttgactgcaacctctgcctaccgggttcatgtcattctcccacctcagcctccggagtagctgggactacaggtgccagccactacgcccagctaattttgtttttgtatgtttagtagagacagggtttcaccgtgttagtcaggatggtctgtatctcctgacctcgtgatc

SEQ ID NO: 12609 - DNA, 428 bp, Homo sapiens
  AC004745.1_42621
  Located on chromosome 7
  Distance between a terminus base of telomere on chromosomal short arm and 5'-terminus of this base sequence : 98705173
  Distance between 3'-terminus of neighbour sequence of sequence listing upward to telomere on chrosomal short arm and 5'-terminus of this base sequence : 254769
ttgactacgtgaaaactgaaacttttaacaaaagataacataattatggtaaaaagacaagccacagactagaagaagccatttgcaacatgtacaagttttgcaacatatatccaagatatatgaagaacttgtataaattttaaaaaagagtatacgacttaatagaaaaagggcagaaaacaccatcatcaattcacagaagagcaatcagaagaggaaacacacacacacacacacacacacacaaaccttactagtagtcattttaatgaaaattaaaatatctatcagattgacaaaattttaaaagtataaaggatgatgtgaagcaagtgtaattttatacactccttgtgagagtatacaaatcaattcaaccactgtagaaagcaatttggtaatagatggtgaactgataatgccta

SEQ ID NO: 12610 - DNA, 318 bp, Homo sapiens
  chr7.fa.O7frz.98970744
  Located on chromosome 7
  Distance between a terminus base of telomere on chromosomal short arm and 5'-terminus of this base sequence : 98834820
  Distance between 3'-terminus of neighbour sequence of sequence listing upward to telomere on chrosomal short arm and 5'-terminus of this base sequence : 129219
taacactttgcttcagtgtatttaatgcctattatcacaaatgctcaaaacatctctgtgagccaggcaggagacagaatttagtggacatgtgcgtgtgtgtgtgtgtgtgtgagagagagagggagagagaggaaggagagagggagagggagaaagggagagggggagagggagggagggagagagagagagagagagagattgagattgagtgtacatgcttccttggctatcctacagatgtaaacagataagaggcaagtccctttagagcagatgtttccccacaagctctgtagaaactgtgatgtaggc

SEQ ID NO: 12611 - DNA, 165 bp, Homo sapiens
  AC003085.1_73828
  Located on chromosome 7
  Distance between a terminus base of telomere on chromosomal short arm and 5'-terminus of this base sequence : 98985649
  Distance between 3'-terminus of neighbour sequence of sequence listing upward to telomere on chrosomal short arm and 5'-terminus of this base sequence : 150511
ttccaaagtgctgatgtttaacacacacacacacacacacacacacacacactcctatctgttttacagagtaatccataggtcagaatctagctcattgattacccttacaagaagtctattaaagagagaaggcaatgtgtcttaatttgaagcttatggaag

SEQ ID NO: 12612 - DNA, 372 bp, Homo sapiens
  AC007875.2_8764
  Located on chromosome 7
  Distance between a terminus base of telomere on chromosomal short arm and 5'-terminus of this base sequence : 99067908
  Distance between 3'-terminus of neighbour sequence of sequence listing upward to telomere on chrosomal short arm and 5'-terminus of this base sequence : 82094
taacctcagatggttagctcagctcaaggaatacaaactaaattgtgggtagagcagtgcctcattccaacatcatgaaagctccgaaagtaagagtggtctaaaaggttttcatgacaataaaatcatttatattttctgccaaagttgaagatacacacacacacacacacacacacacacagagagagagagagagagagagagagagagagagagagagagagagagaaaatgaatcgttatcctacggaaaaaaaataagagatccatatccttattaatgttttaaagaaatctgtatatatccttaacaggatccaacccacagcccaattacctattttgccttgatacaattgaaggacaacc

SEQ ID NO: 12613 - DNA, 455 bp, Homo sapiens
  AC007875.2_29122
  Located on chromosome 7
  Distance between a terminus base of telomere on chromosomal short arm and 5'-terminus of this base sequence : 99088121
  Distance between 3'-terminus of neighbour sequence of sequence listing upward to telomere on chrosomal short arm and 5'-terminus of this base sequence : 19841
gtcactcttacaagcagatagaactctaaatgtgcgtgaattcctcaatgcaaaaaacaaagtaatgctctgagtcttcattcttttctgatgctttcccacaaaagacaattatattttcagttaagaccttactttacacaaggagagtggatgttgtgttctcaccacaaaaatggtaatgatgtgagggaatgcatttgttaattagctagttttcaccattctaccatgtgtgtatgtgtatatacatatatatgtgtgtgtatatatacaatgtgtgtatgtgtatatacatatatatgtatgtgtgtaatatatatatccatatctatctatctatctatctatctatctatctatagagagagagagggaaggagggagggagagagagacagagagagagagagagaggcagtcctcattttattgtgctttgcagatactgagtt

SEQ ID NO: 12614 - DNA, 362 bp, Homo sapiens
  AC007875.2_44466
  Located on chromosome 7
  Distance between a terminus base of telomere on chromosomal short arm and 5'-terminus of this base sequence : 99103708
  Distance between 3'-terminus of neighbour sequence of sequence listing upward to telomere on chrosomal short arm and 5'-terminus of this base sequence : 15132
cagtaagctgagattgtaccactgcactccagcctgagcaacagagaaagacccagtctcaaagaagaaagaaagacagacagacagaaagaaagaaagaaagaaagaaagaaagaaagaaagaaagaaagaaagaaaaagaaagaaagaaagagagaaatatcctcttgttcatcggtttcatcatctgaaaaaaagttttggcaagattatccctaagacacctttcaattcgaaaattccatcaaggatctttctgaaaatacaagaagctaatattaaaataaatctttttcatctcactttccatgtacctcttaaatcctagtttgtttaaagttagctatgccgtaattatgtta

SEQ ID NO: 12615 - DNA, 146 bp, Homo sapiens
  HUMUT901
  Located on chromosome 7
  Distance between a terminus base of telomere on chromosomal short arm and 5'-terminus of this base sequence : 99103755
  Distance between 3'-terminus of neighbour sequence of sequence listing upward to telomere on chrosomal short arm and 5'-terminus of this base sequence : -315
aagacccagtctcaaagaagaaagaaagacagacagacagaaagaaagaaagaaagaaagaaagaaagaaagaaagaaagaaagaaagaaaaagaaagaaagaaagagagaaatatcctcttgttcatcggtttcatcatctgaaa

SEQ ID NO: 12616 - DNA, 263 bp, Homo sapiens
  D7S554
  Located on chromosome 7
  Distance between a terminus base of telomere on chromosomal short arm and 5'-terminus of this base sequence : 99109772
  Distance between 3'-terminus of neighbour sequence of sequence listing upward to telomere on chrosomal short arm and 5'-terminus of this base sequence : 5871
gttccatatttaaaagactcagtgatttcttttatagttcagtgtatttctatcagaaaagttatatgtctccttttatcagatggaaactatttaattcaacattttattttttgttgtagaatgtgtgtgtgtgtgtgtgtgtgtgtgtgtgtgtgtgtttcagggtatttacagtaaataaacactatgaaataatttttacaaattaaaacaaataagaataaaagccaaattttaaagggaaatgtgggtaattagac

SEQ ID NO: 12617 - DNA, 260 bp, Homo sapiens
  AC004140.1_25395
  Located on chromosome 7
  Distance between a terminus base of telomere on chromosomal short arm and 5'-terminus of this base sequence : 99162355
  Distance between 3'-terminus of neighbour sequence of sequence listing upward to telomere on chrosomal short arm and 5'-terminus of this base sequence : 52320
atcaaactaagcatccactgacaggtaaatggataaaaaaaatgcaacacacacacacacacacacacacacacacacacacacacacacctccacacaatgaaatactattcaatcttttcaaagaaggaaatctgatcatttgtaacaacatggataaacctagaagacattatgctaagtaaaataagccaggcacaaatactacatgatctcacttatatgtggagtttgaaaagtcaagctcatagaagcagaga

SEQ ID NO: 12618 - DNA, 392 bp, Homo sapiens
  AC005326.1_27030
  Located on chromosome 7
  Distance between a terminus base of telomere on chromosomal short arm and 5'-terminus of this base sequence : 99282602
  Distance between 3'-terminus of neighbour sequence of sequence listing upward to telomere on chrosomal short arm and 5'-terminus of this base sequence : 119987
taatggcattgatgttatgtagaagaatgtccttattcttaggagataaatgcttatatatttaggagtgtcataatatctgcactgtactctcaaatgattcagcaaaaacatgtgtgtgtgtgtgtgtgtgtgtgtagaaagaaaaatcaagcaactatggcaaaacattaatgactatttaatctaggtgcttgttgttctgttctttactgtatgttaggaattttttcaaaatgaaaagctggggagaaggagaaaaaattctaagagtcaatgaaactgaactgtaatccccatttttatcactttttttgtgaccaagtcatttcactcacctttttattcatcagttccctatttacatacttagagcaaatgagataacgaac

SEQ ID NO: 12619 - DNA, 311 bp, Homo sapiens
  AC004841.2_103509
  Located on chromosome 7
  Distance between a terminus base of telomere on chromosomal short arm and 5'-terminus of this base sequence : 99377000
  Distance between 3'-terminus of neighbour sequence of sequence listing upward to telomere on chrosomal short arm and 5'-terminus of this base sequence : 94006
ttcactgtagtcctcaaattctaccttctgcacaggcatggttcaagcccagttcattctgcacactgcagcccccagcagactccctgcctgcacagcagatcatcaatactcatttgtattttgttcagccaagacctcccaggcatctatgtgccaagcactgagctgagaactgcactgtttgtttgtttgtttgtttgtttgtttgtttgtgacagaatctcactctgtcgcccgggctggagtgcagtggcacgatctcggctcactgcaacctccgccacccgagttcaagtaattatcctgcc

SEQ ID NO: 12620 - DNA, 347 bp, Homo sapiens
  AC004841.2_54122
  Located on chromosome 7
  Distance between a terminus base of telomere on chromosomal short arm and 5'-terminus of this base sequence : 99426519
  Distance between 3'-terminus of neighbour sequence of sequence listing upward to telomere on chrosomal short arm and 5'-terminus of this base sequence : 49208
gtgaataagtcagtactgcgagaaagcgatctatgtattttttaattttttattttattttattttattttattttattttattgagacagagtcttgctctgtcacccaggctggagtgcagtggcacgatctcggctcactgcaacctctgctgcccaggttcaagcaattctcctgcctcagcctcctaagtagctgagactacagatgcccgccaccacgcctggctaatttttttgtatttttagtagagacggggtttcgccatgttggccaggctgatctcgaactcctgacctcaggtgatcctcctgcctcagcctaccaaagtactgagattacagg

SEQ ID NO: 12621 - DNA, 429 bp, Homo sapiens
  AC004841.2_27524
  Located on chromosome 7
  Distance between a terminus base of telomere on chromosomal short arm and 5'-terminus of this base sequence : 99453079
  Distance between 3'-terminus of neighbour sequence of sequence listing upward to telomere on chrosomal short arm and 5'-terminus of this base sequence : 26213
ctcaaacaccttacttcaggtgatccgcctgccttggcctccaaaagtgctgggattacaggcgtgagccaccacgcctggctttatttatttatttatttatttatttatttatttatttacaaggtcttgctctgttgcctaggctggagtgcagtggcatgatctcagcttactgcaacctctgcctccctggttgaagcaattctcatgcttcagcctcccaagtagctggaattacagatgtgcaccaccacacccgactaatttttatatttttaatagagacagggtttcatcatattggccaggttggtctcaaactcctgacctcaggtgatccatctgccttggcctcccagagcactgggattccaggcatgagccaccgcgcctggccgggatcctcactttcaaataccagatctc

SEQ ID NO: 12622 - DNA, 480 bp, Homo sapiens
  chr7.fa.O7frz.99907119
  Located on chromosome 7
  Distance between a terminus base of telomere on chromosomal short arm and 5'-terminus of this base sequence : 99657616
  Distance between 3'-terminus of neighbour sequence of sequence listing upward to telomere on chrosomal short arm and 5'-terminus of this base sequence : 204108
agaaacagagctgataggaaacaggaaaaaggatgtttcggaggcaacagggaggcatactaccatggaaggcagaggagaaaagcatgtttaaaagtgttatgcaggccaggcacagtggctcagcctgtaagcccagcactttgggaagggacaccccagcctaggggacagagtgagatccagttatatatatacacacacacacacacacacacacacacacacacacacacacacacacaccatgtagagttattcactgaactgttatttattatataagctgacagcaagggtccaggagcaggagacaaagaggacataagtgagggatgctgcagctgccaggaaagggtgggatgagaggcatgggtcacaatgccttgttttaaagagctgagagaaagaagaggagaaaaatgacatttgttgactgttccacacgctttttaaaatacctgtccgtgactcttgaaa

SEQ ID NO: 12623 - DNA, 308 bp, Homo sapiens
  HUMUT7164B
  Located on chromosome 7
  Distance between a terminus base of telomere on chromosomal short arm and 5'-terminus of this base sequence : 99745492
  Distance between 3'-terminus of neighbour sequence of sequence listing upward to telomere on chrosomal short arm and 5'-terminus of this base sequence : 87396
agggtgggtgagtgtcagccttgataatctcatgagccagttcccatggtaatcctcttctcatttatctatatcgctatctatctatcatctatctatatctatcatctatcatctatctatcaactatcatctatctatcatctctctatcaatctatcatctgtctatctatctagctgtctatcatctatcatctatcatctatctgtcatctgtcatctatctatcatctatcatctatctatctatctatctatctatctatctatctatctatctatctaatctcctgttggttctgtttc

SEQ ID NO: 12624 - DNA, 356 bp, Homo sapiens
  chr7.fa.O7frz.100296837
  Located on chromosome 7
  Distance between a terminus base of telomere on chromosomal short arm and 5'-terminus of this base sequence : 100080938
  Distance between 3'-terminus of neighbour sequence of sequence listing upward to telomere on chrosomal short arm and 5'-terminus of this base sequence : 335138
ctactcagtaggctgaagcacaagaatttcttgaacccagaggtcggaggttgcagagagccaagattgggcccctgcactacagcctgggcaacagagcgagactccatctcaaaaataaaaaataacataacataacataacataacataacataacataacataaataataaaatataaaataaaataaaaaacttctgcctgtctttgagccttaagccagcacattggtcttctgccttcagaggtggactgggactgaatctatacgatcagttctcctgggcctcccgcgggcagactacactatcttagggcttctcagtctccctaactgcatgagctaattcttta

SEQ ID NO: 12625 - DNA, 417 bp, Homo sapiens
  AC023091.2_156445
  Located on chromosome 7
  Distance between a terminus base of telomere on chromosomal short arm and 5'-terminus of this base sequence : 100091346
  Distance between 3'-terminus of neighbour sequence of sequence listing upward to telomere on chrosomal short arm and 5'-terminus of this base sequence : 10052
gctgtaaatacagatgaagcagccaggcgcagtggctcatacctgtaatcccagcactttgggaggccaaggtgggtggatcacaagggcaagagatcaagaccatcctggccaacatagtgaaaccctgtctctacttaaaatacaaaaaaattagccaggcatggtggcaggtgcctgtagtcccagttactcgggaggctgaggcaggagaatcgcttgaacctgggaggcggagcttgcagtgagtcaagatcatgccactgcactccagcatggcgacagagtgagactccatctcaaataaataaataaataaataaataaataaataaataaaatacagatgaagcttcacttgccagctgctcacctcctgccatgcagccctgttcctaacaggccatagactcctac

SEQ ID NO: 12626 - DNA, 269 bp, Homo sapiens
  chr7.fa.O7frz.100651239
  Located on chromosome 7
  Distance between a terminus base of telomere on chromosomal short arm and 5'-terminus of this base sequence : 100308653
  Distance between 3'-terminus of neighbour sequence of sequence listing upward to telomere on chrosomal short arm and 5'-terminus of this base sequence : 216890
cactttcagaaacaggatcacaataaataaataaataaataaataaataaataaaaataaacactgatgcatgggccccaccctaaagagtctgtgattgaagtgcacagcctggattgggaacagctgtcctggggagagatgcatacatctgggaagaacattgcagcttcctgacccgcaggaaacacccaccaccttggtgttagaggcagatagggatgaaaaggaggatgtgtgctggtcttgtcttcagttccagaatctga

SEQ ID NO: 12627 - DNA, 124 bp, Homo sapiens
  G09841
  Located on chromosome 7
  Distance between a terminus base of telomere on chromosomal short arm and 5'-terminus of this base sequence : 100408637
  Distance between 3'-terminus of neighbour sequence of sequence listing upward to telomere on chrosomal short arm and 5'-terminus of this base sequence : 99715
aactgttgagagcttaaggtgcgccaggcgttgggcgaaaggcctcgaaattcctcttgctgctgctgctgctgctgcttcctcttttcttttttttttttttttaatcttgagacagagtctc

SEQ ID NO: 12628 - DNA, 237 bp, Homo sapiens
  AC004991.1_105114
  Located on chromosome 7
  Distance between a terminus base of telomere on chromosomal short arm and 5'-terminus of this base sequence : 100489011
  Distance between 3'-terminus of neighbour sequence of sequence listing upward to telomere on chrosomal short arm and 5'-terminus of this base sequence : 80250
cttgaatcctgctttcttgtacagctttgagaagggggaaggagagcagctcttgggacctcccaatccagaaggagataacccagaaagcatcaccagtgtgtttattaccaaggtggtatcactatgtgtgtgggtgtgagaagtagcctggcatgtggatgaacatctgtgtgtgtgtgtgtgtgtgtgtgtgtgtgtgtgttaagggggttcattgaaataagtttgttccgc

SEQ ID NO: 12629 - DNA, 175 bp, Homo sapiens
  D7S651
  Located on chromosome 7
  Distance between a terminus base of telomere on chromosomal short arm and 5'-terminus of this base sequence : 100489158
  Distance between 3'-terminus of neighbour sequence of sequence listing upward to telomere on chrosomal short arm and 5'-terminus of this base sequence : -90
agcctggcatgtggatgaacatctgtgtgtgtgtgtgtgtgtgtgtgtgtgtgtgtgttaagggggttcattgaaataagtttgttccgccaacacgtttatttttcatgattgtgttagtttttagcagaccgtcaccttaacgattcttgttagtgagtttttgaaggcagcc

SEQ ID NO: 12630 - DNA, 312 bp, Homo sapiens
  AC004991.1_107086
  Located on chromosome 7
  Distance between a terminus base of telomere on chromosomal short arm and 5'-terminus of this base sequence : 100490955
  Distance between 3'-terminus of neighbour sequence of sequence listing upward to telomere on chrosomal short arm and 5'-terminus of this base sequence : 1622
agatcgttaacctttcatctgtagctctccttaggaacgaaaggagccagtttcttgcatgactcagctttcagcttaatttttttccactgggcagagcaaattggggtcctggggtttttttctcctttcacatatatgtgaaggaaaatggataggatgttattgataacctccttgtaaaacttcatgttacattgtgtgtgtgtgtgtgtgtgtgtgtgtgtgtgtgtgtgtgtgtgtgtgtttttaaggcttaaacctgtcgtatgaccctcagtcagtaacccagttcacaactggaaatgagtc

SEQ ID NO: 12631 - DNA, 383 bp, Homo sapiens
  AC004893.1_2168
  Located on chromosome 7
  Distance between a terminus base of telomere on chromosomal short arm and 5'-terminus of this base sequence : 100498646
  Distance between 3'-terminus of neighbour sequence of sequence listing upward to telomere on chrosomal short arm and 5'-terminus of this base sequence : 7379
catctgttagttgattccatgatacatagtttgaaagatgcttgtctttggaaggatatttgttttttgtttttgtttcgtttttttgagacagtctcactctgtcgcccaggctggattgcagtggcacagtcttggctcactgcaacctccacctcccgggttcaagcgattctcatgcctcaacctcccaagtagctgagactacaggcgtatgccaccatgcctggctttttgtgtgtgtgtgtgtgtgtgtgtgtgtgtgtatttttagtagagacggggtttcaccatgttgaccaggccagcctcaaattcctggcctcaagtgatccatccacttcagcctcccaaagtgctgggattacaggcgtaaccactgc

SEQ ID NO: 12632 - DNA, 217 bp, Homo sapiens
  AC004893.1_33969
  Located on chromosome 7
  Distance between a terminus base of telomere on chromosomal short arm and 5'-terminus of this base sequence : 100530562
  Distance between 3'-terminus of neighbour sequence of sequence listing upward to telomere on chrosomal short arm and 5'-terminus of this base sequence : 31533
ccgagtgatttgatctataggtagagaaaatatgtgaaattttcagcttcagaaaactgtaaagtttacctttctccttagtagtaagtgcatcccaatacacagcagatgccagctgccgtgtgtgtgtgtgtgtgtgtgtgtgtgtttaagttatgaggagtatcttcagctgtgagaagaatcagcattgaagtcagtcttaccagatgttggt

SEQ ID NO: 12633 - DNA, 119 bp, Homo sapiens
  DISO7_10002311
  Located on chromosome 7
  Distance between a terminus base of telomere on chromosomal short arm and 5'-terminus of this base sequence : 100721361
  Distance between 3'-terminus of neighbour sequence of sequence listing upward to telomere on chrosomal short arm and 5'-terminus of this base sequence : 190582
cattgagaagtcaagaggaagagtattataacatcacacagacacacggacacacacacacacacacacacacacagaggaataattcatgcaaaagcccttaagcaggattaaactcg

SEQ ID NO: 12634 - DNA, 422 bp, Homo sapiens
  chr7.fa.O7frz.100957286
  Located on chromosome 7
  Distance between a terminus base of telomere on chromosomal short arm and 5'-terminus of this base sequence : 100801212
  Distance between 3'-terminus of neighbour sequence of sequence listing upward to telomere on chrosomal short arm and 5'-terminus of this base sequence : 79732
taggaccatccttttatttgacagatgtgatgccttgaatcctgcccaggagagactctgctttcactagggtcatccgaggcaggcaggcaggcaggcaggcgggcaggcaggcaggtatgtctaggcgctctaggtagaaggctctgttccgaagactgtgaccttaggacaggcacaaggctgcaggggatggtagcaatggcccagagcctactttccttgggacacacacacacacacacacacacacagtattaaaagaatttgttcaagttgattgatgaagaatcaaataaaaataaaaaagaacttgtacatgaaaatgggtagtggggtctgggagcggtggcttaggcctgaaatcccagcactttgggaggctgaagcgggcagatcacctgagctcagaagtttgagac

SEQ ID NO: 12635 - DNA, 387 bp, Homo sapiens
  chr7.fa.O7frz.102029376
  Located on chromosome 7
  Distance between a terminus base of telomere on chromosomal short arm and 5'-terminus of this base sequence : 101035554
  Distance between 3'-terminus of neighbour sequence of sequence listing upward to telomere on chrosomal short arm and 5'-terminus of this base sequence : 233920
agcactgaataatgttagtcaaacaggatgttaaactggaaattttgattgggatttcgagatgcaatgtttgggaaatacaacacatatcatattccaaagtgatttgctggtctgagatgcagcaattcaaaggaaaagcaaataaataaataaataaataaataaataaataaaggttaagctactcttaaaatctacacccacatcaaagttgtataaaatggcagagttgttggaaattacagggagagagaattaactttggagagaagatatctttgttttttttttttaaatttattttctttttttaggctagttgagtgaagcagtgggagtagagaaggaacaaagacatttgtaactggttgtgataaattgttt

SEQ ID NO: 12636 - DNA, 245 bp, Homo sapiens
  D7S2498
  Located on chromosome 7
  Distance between a terminus base of telomere on chromosomal short arm and 5'-terminus of this base sequence : 101063230
  Distance between 3'-terminus of neighbour sequence of sequence listing upward to telomere on chrosomal short arm and 5'-terminus of this base sequence : 27289
ggaagtacctgtccctgctgctagtggctttgggtgataatgagttccgcatacttcatccccatgtctctactttaaggtagcacccctctccttcctactttttcctaaatatactccctaggttagagtcggtttgggcccatggcattgtggaaagaaacagatgaatggatgcacacacacacgcacacacacacacacacacacacaccctcacactcctaaagatttggtaaaactaa

SEQ ID NO: 12637 - DNA, 478 bp, Homo sapiens
  chr7.fa.O7frz.101900347
  Located on chromosome 7
  Distance between a terminus base of telomere on chromosomal short arm and 5'-terminus of this base sequence : 101113533
  Distance between 3'-terminus of neighbour sequence of sequence listing upward to telomere on chrosomal short arm and 5'-terminus of this base sequence : 50058
agaagtgaggtgattgactgtagtccaatgagtggttttaataaaacaggctgggcacagtggtgcaagcgtgtaatcccagcactttgggaggctgacacaggaggatcattgaggtcaggattttgagaccagcctggccaacatggtgaaaccccatctctactaaaattacaaaaaaacccacaactgggtgtggtggtgggcacctgtagtcccagctactcgggaggctgaggcaggagaattgcttgaacctgggaggcagaggttgcagtgagccaagatcagaccacttcactccagcctgggtgacagagtgagactccatctcaaataataataataataataataataataataataataataataataatacagcaggaagaatgcatgtatagatgggcattggccaacatgaaatataaaaacaatagggtctagtgagtggaattcatagtgcctattccat

SEQ ID NO: 12638 - DNA, 167 bp, Homo sapiens
  D7S647
  Located on chromosome 7
  Distance between a terminus base of telomere on chromosomal short arm and 5'-terminus of this base sequence : 101301368
  Distance between 3'-terminus of neighbour sequence of sequence listing upward to telomere on chrosomal short arm and 5'-terminus of this base sequence : 187357
ccaatcttttggcttccctgggccacagtggaagaagaagtgtcgtgggccacacataaaatacacacacacacacacacacacacacacacacacacacacacacacaaatggtctgtgtatagttttcattatatatctaccaccacagataagcaaaaatgtcc

SEQ ID NO: 12639 - DNA, 294 bp, Homo sapiens
  Z67357
  Located on chromosome 7
  Distance between a terminus base of telomere on chromosomal short arm and 5'-terminus of this base sequence : 101325620
  Distance between 3'-terminus of neighbour sequence of sequence listing upward to telomere on chrosomal short arm and 5'-terminus of this base sequence : 24085
attggaatggatgtatcagtgtacattcatacttttctagatagatagatggatagatagacagatgatagatagataatagatagttgatagataattagatgtaaatatatgtgtttgtatgtgtgagcatgcatgtgtgtgtgtgtgtgtgtgtgtgtgtgtgtgtgtgtgtgtataaaacatatattccctacttcactgatagggctagataacaatgacatttcaatagcaatgagtatacttagtgcctagatcttggcttatgaatatcattttccactgaaggga

SEQ ID NO: 12640 - DNA, 309 bp, Homo sapiens
  chr7.fa.O7frz.101650337
  Located on chromosome 7
  Distance between a terminus base of telomere on chromosomal short arm and 5'-terminus of this base sequence : 101406434
  Distance between 3'-terminus of neighbour sequence of sequence listing upward to telomere on chrosomal short arm and 5'-terminus of this base sequence : 80520
acttaacttctctgagcctcagtttcctcagatataaaataggagcagtgtcatctgctcacagggttatggtaaggattaaatgagatatatacacatatcctttatatatatatatacacacacacacacacacacatataaatgtcctatgtctgtgtgtgtgtatatacatatgtgtgtgtgtgtgtatacatacatatatatagtacccaataacatattggctgctcaataaatactaaatagctgtgacaatggaaaacattctgtgcaaaataactgtagtccttcatgacatcaagttaa

SEQ ID NO: 12641 - DNA, 336 bp, Homo sapiens
  chr7.fa.O7frz.101366626
  Located on chromosome 7
  Distance between a terminus base of telomere on chromosomal short arm and 5'-terminus of this base sequence : 101619193
  Distance between 3'-terminus of neighbour sequence of sequence listing upward to telomere on chrosomal short arm and 5'-terminus of this base sequence : 212450
aggatcatgaggtcaggagatcgagaccatcctggctaatacggtgaaaccccatctctacgaaaaatacagaaaattagccgggtgtggtggcaggcgcctgtagtcccagctactccggaggctgaggcaagagaatggcgtgaacccaggaggcacagcttgcagtgagctgagattgcgccactgcactccaggctgggcaacagagcgagacaccgtctctaaaataacataacataacataacataacataacataacataacataacataacataacataaactaaactaaactaaactaaaataataaatcatgataggtaagtccag

SEQ ID NO: 12642 - DNA, 311 bp, Homo sapiens
  AC005072.2_10670
  Located on chromosome 7
  Distance between a terminus base of telomere on chromosomal short arm and 5'-terminus of this base sequence : 101812524
  Distance between 3'-terminus of neighbour sequence of sequence listing upward to telomere on chrosomal short arm and 5'-terminus of this base sequence : 192995
ataatttcaggtggcggtaagagctcagacagaacaagatggcagtgagtgatcaaggatgggcgaaggtactttggggagtcagagaacgtgttttgatcttaagaatgcaaaatgactttttgtatcacctgtcaacacaacacacacacacacacacacacacacacacggaggctttagtgcaaattttgaaataaccattgattaattttggcaagctgttagcagtggagtcccccacatttcttccatgtaaagccctgatcatcttggctgtaaccactcacttactttgaagcgtcagattc

SEQ ID NO: 12643 - DNA, 419 bp, Homo sapiens
  AC005072.2_22581
  Located on chromosome 7
  Distance between a terminus base of telomere on chromosomal short arm and 5'-terminus of this base sequence : 101824373
  Distance between 3'-terminus of neighbour sequence of sequence listing upward to telomere on chrosomal short arm and 5'-terminus of this base sequence : 11538
acatggtgatacttcgcctctactaaaaacacaaaaattagctgggcatggtggtgtatgtctgtaatcccagctacttgggaggctgaggcaggagaatcgcttgaacctgggagatggaggttgcagtgagccaagatcgtgccactgcagtccagcctgggcaacaagaccaaaactctgtctcaaaaaaaaaaaaaatacatatatatatatatatatatatatatatatatatatatatatatatatatatatatgatggttccactgtcccccctattctcccaggcctctatgtagtcagtcccttcccccaccctcagcccatggtaaccacttatctgttttttgctggcatcattttgtattttctggagtgttacatagagggatcataccatatgcagtcttcgagt

SEQ ID NO: 12644 - DNA, 310 bp, Homo sapiens
  AF006752.1_15351
  Located on chromosome 7
  Distance between a terminus base of telomere on chromosomal short arm and 5'-terminus of this base sequence : 101844678
  Distance between 3'-terminus of neighbour sequence of sequence listing upward to telomere on chrosomal short arm and 5'-terminus of this base sequence : 19886
attggatggtgcctatagattcaggaaaaacagacttttcccccagaatgttttccttacctagctctatgtgtgtgcagtgtgtgtgtgtgtgtgtgtgtgtgtgtgtgtgtgtgcaagagagcgtggctaagacaagggtattcacctggcatcctcattcccaagttgccaatactcctctccccttttttcttaactcaccacctgggaagttttcctatttctctccctcctatcccagataagaagaattgccttctttcctcccagctgatttgcttttctcgtcattatatggcaaaccagg

SEQ ID NO: 12645 - DNA, 138 bp, Homo sapiens
  D7S2433
  Located on chromosome 7
  Distance between a terminus base of telomere on chromosomal short arm and 5'-terminus of this base sequence : 101888741
  Distance between 3'-terminus of neighbour sequence of sequence listing upward to telomere on chrosomal short arm and 5'-terminus of this base sequence : 43753
tgatcccacaaggggcgggggtctctggccaggcacagcccctccccactaagcccagcacctggtgccgaacacacacacacacacacacacacacacacacacacacacgcccgccccccgctccactgttctgtt

SEQ ID NO: 12646 - DNA, 162 bp, Homo sapiens
  D7S515
  Located on chromosome 7
  Distance between a terminus base of telomere on chromosomal short arm and 5'-terminus of this base sequence : 101946026
  Distance between 3'-terminus of neighbour sequence of sequence listing upward to telomere on chrosomal short arm and 5'-terminus of this base sequence : 57147
gggagttactaccctcacttaatggacgaagagatcaaggcttcagtatatatatacacacacacatatatacatatatatatatacacacacacaaataaacacacacacacacacacacacacacacacacacacacacacacactttgctgcccagtcc

SEQ ID NO: 12647 - DNA, 167 bp, Homo sapiens
  D7S666
  Located on chromosome 7
  Distance between a terminus base of telomere on chromosomal short arm and 5'-terminus of this base sequence : 101989765
  Distance between 3'-terminus of neighbour sequence of sequence listing upward to telomere on chrosomal short arm and 5'-terminus of this base sequence : 43577
gccttctcaagcaaattgatatttaatattacacacacacacacacacacacacacacacacacacacacacagactctctgatgtatttaatattacacacacgcgcacacacacaatctcagtggattttttggtattgcctctttcattacctcacatatcagg

SEQ ID NO: 12648 - DNA, 183 bp, Homo sapiens
  D7S518
  Located on chromosome 7
  Distance between a terminus base of telomere on chromosomal short arm and 5'-terminus of this base sequence : 102103566
  Distance between 3'-terminus of neighbour sequence of sequence listing upward to telomere on chrosomal short arm and 5'-terminus of this base sequence : 113634
caggaggcaggggtgggaagatcacttgagcccaggaggcagaggctgcagtgagccaagattgcaccattacactccaacctggacaacagatcaagaccctgcctcaaaacacacacacacacacacacacacacacacacacacacactatggctatatagttgtcacacagacacaccc

SEQ ID NO: 12649 - DNA, 447 bp, Homo sapiens
  chr7.fa.O7frz.104930802
  Located on chromosome 7
  Distance between a terminus base of telomere on chromosomal short arm and 5'-terminus of this base sequence : 102301862
  Distance between 3'-terminus of neighbour sequence of sequence listing upward to telomere on chrosomal short arm and 5'-terminus of this base sequence : 198113
tgattatggataaagcttcaacagacatttgtgtgctactgtttttttgtgtttttgtgtgtgtgtgtgtgtgtgtgtgtgtgtgtgtgtgtgtgtgtgtgtgtgtttttgagatggagtctctctgtcgcccaggctggagtgcagtggcgcaatctcaggtcactgcaacctccgccccctgggttcacaggtttaagcaattctcttgtctcagccttcagagtagctaagccaggcatctgccaccacgcctggctaatttttgtatttttagtggagatgggttttcgccgtgttggccaggctggtctcgaactcgtgacctcaagtgatctgcccgccttggcctcccaaagtgctgggattacaggcatgagccaccgtgcctggccttgtgtgctagtttttgtgtgcacataagtttcacatcaactgagtacatct

SEQ ID NO: 12650 - DNA, 101 bp, Homo sapiens
  DISD22_0005252
  Located on chromosome 7
  Distance between a terminus base of telomere on chromosomal short arm and 5'-terminus of this base sequence : 102577092
  Distance between 3'-terminus of neighbour sequence of sequence listing upward to telomere on chrosomal short arm and 5'-terminus of this base sequence : 274783
cagcatggctagctgaagtcagtggctgcagagtgtgggaatgagtgagtgagtgagtgagtgaatgaatgaatgaatgggggagaactgagtgacccgag

SEQ ID NO: 12651 - DNA, 367 bp, Homo sapiens
  AF053356.1_145418
  Located on chromosome 7
  Distance between a terminus base of telomere on chromosomal short arm and 5'-terminus of this base sequence : 102783407
  Distance between 3'-terminus of neighbour sequence of sequence listing upward to telomere on chrosomal short arm and 5'-terminus of this base sequence : 206214
ttggctaacatggtgaaaccccgtctctactaaaaatacaaacattagctgggcccggtggcatgcatctgtaattccagctattccggaggctcggacaggagaatcacttgaacccaggaggtggaggctgctgtgagccgagattgtgccattgcactccagcctgggcaacagagcaagactttgtctcaagaaaaagaaaaaaaagagaaagaaagaaagagagaaagagaaagaaaaaaagaaagaaagagagagagagaaaggaaggaaggaaggaaggaaggaagactcaagcatgaaagaaagatcagatcagattagatagaagcatagatggccctttcaagcatagctagatgtg

SEQ ID NO: 12652 - DNA, 352 bp, Homo sapiens
  chr7.fa.O7frz.102761501
  Located on chromosome 7
  Distance between a terminus base of telomere on chromosomal short arm and 5'-terminus of this base sequence : 102892230
  Distance between 3'-terminus of neighbour sequence of sequence listing upward to telomere on chrosomal short arm and 5'-terminus of this base sequence : 108456
gatcgtaccattgtactccagcctgggtgacaagagtgaaactccgtctctctctctctctctctctctctctctctctctctatatatatatatatatatacacacacacacacatacttacacacatatacgtatatatatgtgtatacatatacacacatatacatatatacttatatatatatgtatacatatatgtgtgtgtatatatatacacacacatacataaaatcctaaatctctttctaactaaaatgacaaatacagagcctccctgacttatgatggaactgtgtcctgattaattcattataaaatcaagaaaatccttaagtcaaaccatcctagct

SEQ ID NO: 12653 - DNA, 221 bp, Homo sapiens
  D7S2480
  Located on chromosome 7
  Distance between a terminus base of telomere on chromosomal short arm and 5'-terminus of this base sequence : 102954772
  Distance between 3'-terminus of neighbour sequence of sequence listing upward to telomere on chrosomal short arm and 5'-terminus of this base sequence : 62190
accttgactgtggtagttggatacatgaacctgcatactggataaaacttggtaaaattatacacacacacacacacacacacacacacacacacacacacacaccagtgagtacaagtacaactggggaaatctacataagatcagtagattggatcaatgtcaatatcctgactatgatataatagtatagatttgcaagattttcctatgaggtgaac

SEQ ID NO: 12654 - DNA, 370 bp, Homo sapiens
  AC073842.1_79400
  Located on chromosome 7
  Distance between a terminus base of telomere on chromosomal short arm and 5'-terminus of this base sequence : 103148402
  Distance between 3'-terminus of neighbour sequence of sequence listing upward to telomere on chrosomal short arm and 5'-terminus of this base sequence : 193409
tttaggctgatcgcttgagctcaggaattggagaccagcggaggcaacatggtgggaccccgactctgcaaaaaatacaaaaaaattagctaggtatgatggcgcctgcctgtgatcccaactacttaggaggctgaggtgggaggattccttgagcctaggaggtagaggttgcagtgagccgagattgcaccactgtactccagcctggacaacataatgagactctgtctcatcatcatcatcatcatcatcatcatcatcttaacaataataacaacaacctgcagacaatagggcaaacctgactatgtgatcatgctacctttagtccagccagagaactctcatgagtccttaaacctaacac

SEQ ID NO: 12655 - DNA, 160 bp, Homo sapiens
  DISO7_10002314
  Located on chromosome 7
  Distance between a terminus base of telomere on chromosomal short arm and 5'-terminus of this base sequence : 103244956
  Distance between 3'-terminus of neighbour sequence of sequence listing upward to telomere on chrosomal short arm and 5'-terminus of this base sequence : 96184
tgcgcctttctccttatctttgtgtcatagtctctctgtccctctgtctctctctctctgtttctctgtgtgtgtgtgtgtgtgtgtgtgtgtctctctctctttctgtctccctctccagccccaccctttcagtctcctccgggtgcactgataaggt

SEQ ID NO: 12656 - DNA, 130 bp, Homo sapiens
  DISO7_10002313
  Located on chromosome 7
  Distance between a terminus base of telomere on chromosomal short arm and 5'-terminus of this base sequence : 103265365
  Distance between 3'-terminus of neighbour sequence of sequence listing upward to telomere on chrosomal short arm and 5'-terminus of this base sequence : 20249
aattagaaacagtaccttggaatgatacacacacacacacacacacacacacacacacacatcacacaatatatgtaaacattagaaatttttgttttaaataatttctaaacctgttgccatattaatg

SEQ ID NO: 12657 - DNA, 115 bp, Homo sapiens
  DISD22_0005257
  Located on chromosome 7
  Distance between a terminus base of telomere on chromosomal short arm and 5'-terminus of this base sequence : 103621096
  Distance between 3'-terminus of neighbour sequence of sequence listing upward to telomere on chrosomal short arm and 5'-terminus of this base sequence : 355601
ggtgacacctcatggctacataaattttatttatttatttatttatttatttatttatttatgagatggaatcttgcaggtatgagccactgtgcccggcccaagactctgtctc

SEQ ID NO: 12658 - DNA, 180 bp, Homo sapiens
  D7S477
  Located on chromosome 7
  Distance between a terminus base of telomere on chromosomal short arm and 5'-terminus of this base sequence : 103765985
  Distance between 3'-terminus of neighbour sequence of sequence listing upward to telomere on chrosomal short arm and 5'-terminus of this base sequence : 144774
ttgcaccactgcgctccagtctgtgtgacagtgagaccctgtctcttacacacacacacacacacacacacatgcacacacacagagagagagaaattagaagatactgaattggcagaagagaagggaaatagaaattaaaatactgaataggggagcagtgaacaggggatacccaaa

SEQ ID NO: 12659 - DNA, 238 bp, Homo sapiens
  DISD22_0005262
  Located on chromosome 7
  Distance between a terminus base of telomere on chromosomal short arm and 5'-terminus of this base sequence : 103801732
  Distance between 3'-terminus of neighbour sequence of sequence listing upward to telomere on chrosomal short arm and 5'-terminus of this base sequence : 35567
ttagtcctgaggtcccattcgccctcagacccccacccactcctgagtgggggaggggagacccagcaagcgggggagggcaacgccgcagagatgagtcaccaagaaagagagagagaaagagacagagatggggagagacacgaagagagagccactggagagactaacacacacacacacacacacactcaaatacacacacagacacacacacaccatcaaggtggtatccacc

SEQ ID NO: 12660 - DNA, 281 bp, Homo sapiens
  chr7.fa.O7frz.103738782
  Located on chromosome 7
  Distance between a terminus base of telomere on chromosomal short arm and 5'-terminus of this base sequence : 103907639
  Distance between 3'-terminus of neighbour sequence of sequence listing upward to telomere on chrosomal short arm and 5'-terminus of this base sequence : 105669
cttgcattcagcttctcatttcataagggaagaatcaggcatatgtcttgtgttgaagcaacacacacacacacacacacacacacacacacacacacacacaacgcgttgtttggcgaaagtcggaccagaagaaagctttctctaatcctcatcaactgattgcttctctcctaccagcctcgttccttgtccttggaccagcattctaagtcttccaaaatacattcttgcctctccctacagtaactctcccattgagttcttaatagaggtgagtt

SEQ ID NO: 12661 - DNA, 210 bp, Homo sapiens
  D7S662
  Located on chromosome 7
  Distance between a terminus base of telomere on chromosomal short arm and 5'-terminus of this base sequence : 104153213
  Distance between 3'-terminus of neighbour sequence of sequence listing upward to telomere on chrosomal short arm and 5'-terminus of this base sequence : 245293
gttgacagacaagcacagacacatacacacacacacacacacacacacacacacccccgtgttcttgcatgtttttgctccagcagggggacatgtggagtggtcttccttttgctcccctctcatgctccttccccagcagcagggccctgactctctctataagcccctttatgttttttctggacttagtggaaatgggaaacagct

SEQ ID NO: 12662 - DNA, 138 bp, Homo sapiens
  D7S2536
  Located on chromosome 7
  Distance between a terminus base of telomere on chromosomal short arm and 5'-terminus of this base sequence : 104438548
  Distance between 3'-terminus of neighbour sequence of sequence listing upward to telomere on chrosomal short arm and 5'-terminus of this base sequence : 285125
acactccgccaccttgccttcttgcctgctccagcaaacacacacacacacacacacacacacacacacacacacaccccaccaccaccaccaccaccaataccaccagactgatacaggctttaggaacagttgttg

SEQ ID NO: 12663 - DNA, 479 bp, Homo sapiens
  chr7.fa.O7frz.105223827
  Located on chromosome 7
  Distance between a terminus base of telomere on chromosomal short arm and 5'-terminus of this base sequence : 104601854
  Distance between 3'-terminus of neighbour sequence of sequence listing upward to telomere on chrosomal short arm and 5'-terminus of this base sequence : 163168
caagaattctggtcattgtacttgggtaagggcttctattttttaaggcacttgcattttatgaaatgttagtgtttgcaggtgtcttggctaaataatttagggaatacattttaggaggaagtaggggcacagagggggagagagaaaccaggcaggaaagaagaaaaaaagaaaaaagaagaaaataaatctttctgttcccattattttactgcctatagaattataaaaggtaaacacacacacacacacacacacacacacacacacacacaccccttatagggtcatttagaaccatctttcttcattttaaaactaaagaaacaggtctaggtgacacagatgaagcagtggcagagccaggaaaataatctgacccttgtccctgctctttccaccgcaccatggtgactctcttttttgtgtcttttttttttttttcactctaaaactgaggatcatttgtagtcaaa

SEQ ID NO: 12664 - DNA, 421 bp, Homo sapiens
  AC005250.1_2423
  Located on chromosome 7
  Distance between a terminus base of telomere on chromosomal short arm and 5'-terminus of this base sequence : 104688089
  Distance between 3'-terminus of neighbour sequence of sequence listing upward to telomere on chrosomal short arm and 5'-terminus of this base sequence : 85756
ctcagtgataagaatccatgaggaaataacacttaaaagtttacaactcagcagttatacaagaacaaaacaatccacaaaagtaaacctaaccgtaattgtaaaaatatatttaaaaagcaataggagtagaaattggaaaccatgatgaaggaaggaaggaaggaaggaaggaaggaaggaaggaaggaaggaaggaaagaaaagaaagaaagaaagaaagaaagaaagaaagaaagaaagaaagaaagaaagaaaagagaagacaagagaaaagaaaaaggaggaaatttcctcccccaaaatgtgagaattattataattatctacatgtgctcaatcattctaagaattctgcctcattatgaagcagctcctcttagaatacaaagttagagacctcagtaaatggtagtttacc

SEQ ID NO: 12665 - DNA, 174 bp, Homo sapiens
  AC005250.1_3215
  Located on chromosome 7
  Distance between a terminus base of telomere on chromosomal short arm and 5'-terminus of this base sequence : 104689060
  Distance between 3'-terminus of neighbour sequence of sequence listing upward to telomere on chrosomal short arm and 5'-terminus of this base sequence : 550
tagcttgatttaaccattccacaatgtgtgtgtgtgtgtgtgtgtgtgtgtgtgtgtgtgtgtatcaaaacagcatgttgtacttcataaatatatacaatttttatttgtcagttaaaaattttaagccattaaaaagaataaatgttaactactatcaggatttgcacatga

SEQ ID NO: 12666 - DNA, 313 bp, Homo sapiens
  AC005250.1_55751
  Located on chromosome 7
  Distance between a terminus base of telomere on chromosomal short arm and 5'-terminus of this base sequence : 104741465
  Distance between 3'-terminus of neighbour sequence of sequence listing upward to telomere on chrosomal short arm and 5'-terminus of this base sequence : 52231
acttgaacaagacaggtgatttacacacagacatgacagtttgaaaagtgctaactgggaggaaatgaagaacaaaaacaaagtatatcagtcagggttctccagagaaacagaaccaataggatatacttacatccaagtatatatacatacatacacacacacacacacacacacacaaacatccaagtgtgtgtatgtgtgtgtatggagagagaaagagacagagtgagaaatgtattttaaggaattggtcatgtgattgtgggggctggcaaatctgaaattggtataccaggctggtagtctagaa

SEQ ID NO: 12667 - DNA, 405 bp, Homo sapiens
  chr7.fa.O7frz.105440494
  Located on chromosome 7
  Distance between a terminus base of telomere on chromosomal short arm and 5'-terminus of this base sequence : 104841024
  Distance between 3'-terminus of neighbour sequence of sequence listing upward to telomere on chrosomal short arm and 5'-terminus of this base sequence : 99246
tttagcttcatttctgtttatcacaccataattcacaattgcaaagatatggaccaaactaagtgcccatcaattaatgagtagataaagaaaatgtgatacacacacacacacacacacacatatacacatacatacacacaccatagaatactaagccataaaaaaaaaatgtattttgcagcaatttggatggaactggaggccattattctaagtgaaataactcaggaagggaaaaccaaatactgtatgttctcacttgtaagtgggagctaagctatgggtattcaaaggtatacagagtggtataatagacactggagactctgaaagggagagggcgagagaggagtgaggaataaaaaaatagtatactatgtacactattcaggtgacaggtac

SEQ ID NO: 12668 - DNA, 366 bp, Homo sapiens
  DISO7_00036974
  Located on chromosome 7
  Distance between a terminus base of telomere on chromosomal short arm and 5'-terminus of this base sequence : 105067946
  Distance between 3'-terminus of neighbour sequence of sequence listing upward to telomere on chrosomal short arm and 5'-terminus of this base sequence : 226517
acatggacttccttgctgtctgttgttgttgtttgtttgtttgtttgttttgagacagagtctcactctgttgcccaggctggagtgcagtggtgcgatcacagctcgctgcaacatctgcttcccaggttcaagtgattctggcacctcagcctaccgagcagctgggattacaggcatgcgcaaccatgcccacctaatttttgtgtttttagtagaaatgggatttcaccatgttggtcaggctggtctcggactcctggcctcaagcgatctgcccgctttggcctcccaaaagtgcttggatgatagacgtgagccaccgcagttggcctccttgctgttttatgaacatgccaagcactt

SEQ ID NO: 12669 - DNA, 109 bp, Homo sapiens
  Z66799
  Located on chromosome 7
  Distance between a terminus base of telomere on chromosomal short arm and 5'-terminus of this base sequence : 105180315
  Distance between 3'-terminus of neighbour sequence of sequence listing upward to telomere on chrosomal short arm and 5'-terminus of this base sequence : 112003
taattactacggccaagtgaattaacctatctatcaccttccatagttaccttctgtgtgtgtgtgtgggtgtgtgtgtgtgtgtgtgtggtaagagcatctaaaatct

SEQ ID NO: 12670 - DNA, 190 bp, Homo sapiens
  Z67605
  Located on chromosome 7
  Distance between a terminus base of telomere on chromosomal short arm and 5'-terminus of this base sequence : 105293742
  Distance between 3'-terminus of neighbour sequence of sequence listing upward to telomere on chrosomal short arm and 5'-terminus of this base sequence : 113318
tccatctccgtgtccaaaccaatttaaatatcatacatatggtgtgtgtgtgtgtgtgtgtgtgtgtatatatatatatatatataaaatctgtatatgtaaaatagctcttgatagctgagctccctctgtccctcagccacacctttcacttcttcacaattgtcttggctactgttgcccttgttaa

SEQ ID NO: 12671 - DNA, 318 bp, Homo sapiens
  AC005101.2_14289
  Located on chromosome 7
  Distance between a terminus base of telomere on chromosomal short arm and 5'-terminus of this base sequence : 105400599
  Distance between 3'-terminus of neighbour sequence of sequence listing upward to telomere on chrosomal short arm and 5'-terminus of this base sequence : 106667
caaacatttatgaggtgcatactgtgcaccacatattgtgagaagctttagagattccatagtaaaaagcacagcccttaccctcaaggagcatatatctcatggcagacaaggcattgtgatgatgttcttatgacaacatgcaataaatagttgtcaaatgaatgaatgaatgaatgaatgaatgaatgaatgcacaagtaagttgctctccctgtgcctttgtttcctcatcttcaaagtgtagataataatggtttctttttcagagggttgctgtgaagattagatgagttgtgaagattagatgagtgcttg

SEQ ID NO: 12672 - DNA, 437 bp, Homo sapiens
  AC002067.1_116038
  Located on chromosome 7
  Distance between a terminus base of telomere on chromosomal short arm and 5'-terminus of this base sequence : 105594663
  Distance between 3'-terminus of neighbour sequence of sequence listing upward to telomere on chrosomal short arm and 5'-terminus of this base sequence : 193746
tgtgatcctaaagttatcagaaacctgtattcaagagtgcttgtcagggtccttttcatcctttctgtgaatcaagctaccaaggtttatagccagtttgtaaaagtcctggatatttaacattcagctcttccaaggaagtaagagcaggcttaaggacaagcatggaagctccctgactttcagtgttatttatttatttatttatttatttatttatttatttatttgagagatagagactcactttgttgcccaggctgttctcaaactcctgggcccaagccatcctcccaccccagcctttcaaatttctgggattacaggcatgagccaccacagctggcctgactttcagtgttgttggaagcttggagaaaggcctgacatcacgacaaccaataagtaaatagctatggttatagtcaagccattaa

SEQ ID NO: 12673 - DNA, 264 bp, Homo sapiens
  D7S658
  Located on chromosome 7
  Distance between a terminus base of telomere on chromosomal short arm and 5'-terminus of this base sequence : 105646657
  Distance between 3'-terminus of neighbour sequence of sequence listing upward to telomere on chrosomal short arm and 5'-terminus of this base sequence : 51557
catcacacaccagggcctgttggcatggggggttaggggaaggatagtattaggagaaatacctaatgtagatgacaggttgatgggtgcagcaaaccaccatggcacgtgtatacctatgtaacaagcctgcacattccacacgtgtatccaaaacttaaagtgtaatttaaaaaaagaaagaaaatatggcacacacacacacacacacacacacaaacaacataaaagttttacattttgatgaagttcagtccttctgtt

SEQ ID NO: 12674 - DNA, 277 bp, Homo sapiens
  AC002067.1_64056
  Located on chromosome 7
  Distance between a terminus base of telomere on chromosomal short arm and 5'-terminus of this base sequence : 105646717
  Distance between 3'-terminus of neighbour sequence of sequence listing upward to telomere on chrosomal short arm and 5'-terminus of this base sequence : -204
acctaatgtagatgacaggttgatgggtgcagcaaaccaccatggcacgtgtatacctatgtaacaagcctgcacattccacacgtgtatccaaaacttaaagtgtaatttaaaaaaagaaagaaaatatggcacacacacacacacacacacacacaaacaacataaaagttttacattttgatgaagttcagtccttctgttttttcttttgtgattgttcttttggtgtcattgtctaagaaatagttgtctaatccaaggtcatgaaatttac

SEQ ID NO: 12675 - DNA, 190 bp, Homo sapiens
  AC007393.3_38301
  Located on chromosome 7
  Distance between a terminus base of telomere on chromosomal short arm and 5'-terminus of this base sequence : 105748976
  Distance between 3'-terminus of neighbour sequence of sequence listing upward to telomere on chrosomal short arm and 5'-terminus of this base sequence : 101982
tcataccatttctacatggaaaacattaaaatacatatatacacatatatgtatacacacacacacacacacacacatatatatatattcaagcaaaatgttcatttaccagatgtctgagctctttcaaatctcgacaaacagtgtagaaaactccaagaagaatgttaatgtaggcagcatagaaatc

SEQ ID NO: 12676 - DNA, 213 bp, Homo sapiens
  AC007393.3_70356
  Located on chromosome 7
  Distance between a terminus base of telomere on chromosomal short arm and 5'-terminus of this base sequence : 105780927
  Distance between 3'-terminus of neighbour sequence of sequence listing upward to telomere on chrosomal short arm and 5'-terminus of this base sequence : 31761
tcatgttattccatgtattagcagttcattcctttttattgatgagcaaaaatccattacatagatcatcatagtttattctctaggttaaggacactttgtttacatcaagtttttaacattatgaatagagtcactataaacaatcatgaacaggggtgtgtgtgtgtgtgtgtgtgtgtgtgtgtgtgtatggtaatcacctgacaggtt

SEQ ID NO: 12677 - DNA, 342 bp, Homo sapiens
  AC002432.1_26571
  Located on chromosome 7
  Distance between a terminus base of telomere on chromosomal short arm and 5'-terminus of this base sequence : 105870463
  Distance between 3'-terminus of neighbour sequence of sequence listing upward to telomere on chrosomal short arm and 5'-terminus of this base sequence : 89323
atattaattggccagttggttctcctcttttatgaagcacctgtccaaaccttttacacatttttctgttgtattgtctttttcttatgaattggtaaaagatacacgcgtgcacacacacacacacacacacacacacacacacacacacacatatcttctggatattattccttgtcagatatagatattactaatatcttctctcaaacattgttttccctttttactttcttaatagtgccttttagataacagaagttcctaattttaatgcaatccaacttatcaacagcatagtggttaaataaataggctctgaagttggacagatacatgtta

SEQ ID NO: 12678 - DNA, 204 bp, Homo sapiens
  D7S2446
  Located on chromosome 7
  Distance between a terminus base of telomere on chromosomal short arm and 5'-terminus of this base sequence : 105921477
  Distance between 3'-terminus of neighbour sequence of sequence listing upward to telomere on chrosomal short arm and 5'-terminus of this base sequence : 50672
gggaggttgatttccacagtgagttgttgggtttttttaaaaaagtgcttccgtgtgtgtgtgtgtgtgtgtgtgtgtgtgtgtgtgtgtgtgtgtgtgtatacatttacatacttcttgcccaggatgaaaacaagaaatactttgaagaaagacttcagaggagagtggaaatagggagatcaactgctgtgaagactcaaa

SEQ ID NO: 12679 - DNA, 346 bp, Homo sapiens
  AC002432.1_85483
  Located on chromosome 7
  Distance between a terminus base of telomere on chromosomal short arm and 5'-terminus of this base sequence : 105929240
  Distance between 3'-terminus of neighbour sequence of sequence listing upward to telomere on chrosomal short arm and 5'-terminus of this base sequence : 7559
gcttaacaagaaactccaggacccaggtcaaggcaacatgcttgcagacatccgctacctgaatgcagtggatgaggtagggtcccatttctgcggcgcgtaatctcctcctttatgttcaccagtacttcttggctcttttatttctttgttcctgcctctacctaatctttcctttccttttctgcccctgactttcggccttagcatctttgtccttttccagacatggtgtgcacacatgtacgtgtgtgtgtgtgtgtgtgtgtgtgtgttgttttgttttgtttttgtctgcatggccttcccaaagaccaacaattttgtggtttccatgtggataact

SEQ ID NO: 12680 - DNA, 263 bp, Homo sapiens
  D7S2494
  Located on chromosome 7
  Distance between a terminus base of telomere on chromosomal short arm and 5'-terminus of this base sequence : 105969962
  Distance between 3'-terminus of neighbour sequence of sequence listing upward to telomere on chrosomal short arm and 5'-terminus of this base sequence : 40376
ggcctcccaaaatgctgggattagaggcgtgagccacggcgcccggcctagtgttgtaattttctaaccctgttgacagggagggaggaaatagctctcaatccctgctttttgtttagaaaatcagacaagtggccttcccacatcttgaattgctaaaaacttacttatgtgtgctgtgtgtgtgtgtgtgtgtgtgtgtgtgtgtgtgtgtctgtgtgaaagttatcaagtcttacaactgaaagcatattgggtgaccc

SEQ ID NO: 12681 - DNA, 182 bp, Homo sapiens
  D7S1799
  Located on chromosome 7
  Distance between a terminus base of telomere on chromosomal short arm and 5'-terminus of this base sequence : 106115390
  Distance between 3'-terminus of neighbour sequence of sequence listing upward to telomere on chrosomal short arm and 5'-terminus of this base sequence : 145165
atggtattaggagatggggccttggaaagtatattagtcagaattccccacagaggcagaactaataggatagattagatagacagatagatagatagatagatagatagatagatagatagatagatagatagacagacagatgatgagaggggatttattatggaaattggcttatgcaa

SEQ ID NO: 12682 - DNA, 303 bp, Homo sapiens
  AC007558.3_29140
  Located on chromosome 7
  Distance between a terminus base of telomere on chromosomal short arm and 5'-terminus of this base sequence : 106126428
  Distance between 3'-terminus of neighbour sequence of sequence listing upward to telomere on chrosomal short arm and 5'-terminus of this base sequence : 10856
agattacttatggcctggtactttaatgaaaaccattaaacaaatgcatgcacttcatcttactggataacagttagacttttttttttcaatttctcaagtttccctgcaccttcctgtctgtctgtctatctatctatctatctatctatctatctatctatctatctatctatctaatctatctatctgtctaatctatctatcattccccacaattttgccatatgacctatcactccaaatgttcgattagtcaacagaaactctcggctcccatcctggagtaaccattgttaagtg

SEQ ID NO: 12683 - DNA, 306 bp, Homo sapiens
  AC007558.3_66556
  Located on chromosome 7
  Distance between a terminus base of telomere on chromosomal short arm and 5'-terminus of this base sequence : 106163756
  Distance between 3'-terminus of neighbour sequence of sequence listing upward to telomere on chrosomal short arm and 5'-terminus of this base sequence : 37025
catgacaattaacctactcctaagataacattattaatcatattcatgaggccagagccatcatgacctaatcgcctcttaaaggttccacctctcaacactgttacaatgaggattaagttttcttttttttctttctttctttttctttctttctttctttctttctttctttctttctttctttctttctttctttctttctttcttttttcccttccttccttccttccttccttcctttctttctttctttctttcttcctttctttctttctttctctttctttcaagacatggtcttgc

SEQ ID NO: 12684 - DNA, 370 bp, Homo sapiens
  AC007558.3_78072
  Located on chromosome 7
  Distance between a terminus base of telomere on chromosomal short arm and 5'-terminus of this base sequence : 106175382
  Distance between 3'-terminus of neighbour sequence of sequence listing upward to telomere on chrosomal short arm and 5'-terminus of this base sequence : 11320
tacagtacggtactgtccaaagagcctcctcttctcttctctctcttctcttctcttctcttctcttctcttctcttctcttctcttctcttctcttctcttctctccttccttccttccttccttccttccttctttctttctttctttctttctttctttctttctttctttctttctttctttctttctctttctctcttttcttttctttctttttgagatagggtctcactttgtcacccaggctagaatgcagtggcacaatcacagctcactgcaaccccaacctcccagactcaagtgatcctcccacctcagcctcccaagtagctgggaccacagacacgtgctacagtgattggctaat

SEQ ID NO: 12685 - DNA, 255 bp, Homo sapiens
  AC002430.1_53661
  Located on chromosome 7
  Distance between a terminus base of telomere on chromosomal short arm and 5'-terminus of this base sequence : 106480403
  Distance between 3'-terminus of neighbour sequence of sequence listing upward to telomere on chrosomal short arm and 5'-terminus of this base sequence : 304651
ctagcttggatgacagagtgagaacctgtctcaaaaataaacaaacaacaaatatatatatatatacacacacacacacacacacacacacacatatatatatacatatatatatgaaagagatgtcccactagtatcctattaaaccacagagactagtgggcttcttacattagcttttttatttacatctttgatttttaccataattaaagcagttcatttctcctagataaacaaatacaatcctggatg

SEQ ID NO: 12686 - DNA, 214 bp, Homo sapiens
  HUMUT7932
  Located on chromosome 7
  Distance between a terminus base of telomere on chromosomal short arm and 5'-terminus of this base sequence : 106487140
  Distance between 3'-terminus of neighbour sequence of sequence listing upward to telomere on chrosomal short arm and 5'-terminus of this base sequence : 6482
gtagtgagccgagattgcaccactgtactccagcctgggcaacagagctaaactctgtctcaagatagatagatagatagatagatagatagatagatagatagatagatagatagataatagaacaaataataagaatggcttacctaatgtagggctgaagactgtgtttattagctcatttcatcctcaaaacatgccatgaggtagtagt

SEQ ID NO: 12687 - DNA, 443 bp, Homo sapiens
  AC005065.1_37326
  Located on chromosome 7
  Distance between a terminus base of telomere on chromosomal short arm and 5'-terminus of this base sequence : 106615115
  Distance between 3'-terminus of neighbour sequence of sequence listing upward to telomere on chrosomal short arm and 5'-terminus of this base sequence : 127761
caggtcattgtatcagatgaacctaatgatggttgatgtaccctgtgttctgtacctcataaaaaatgaaggcaaatcattaagacacttggctctgtagttgaaggaactcaaggaaaaaaaaaggaaaaaattggggaattatttgttgtaaaagcaagttgctctgtctgtctgtctatctatctatctatctatctatctatctatctatctatctatctatctatctatctgtctgtctgtctatttgagatggagttttgctcttgttgcccaggctggagtgcaatggtgcagtcagctcactgcaacctctgcttcctgggttcaagcgattctcttccctcagcctcccgagtagctgggattataggcatgagccaccatgcctggctaattttgtatttttagtagagtcagggtttcaccatgttggtcag

SEQ ID NO: 12688 - DNA, 131 bp, Homo sapiens
  D7S2545
  Located on chromosome 7
  Distance between a terminus base of telomere on chromosomal short arm and 5'-terminus of this base sequence : 106637646
  Distance between 3'-terminus of neighbour sequence of sequence listing upward to telomere on chrosomal short arm and 5'-terminus of this base sequence : 22088
accgttaaacagcagtttctagtttatattatgttcttttgtatagattgccgttaattttgtgtgtgtgtgtgtgtgtgtgtgtgtgtgtgtgtgtgtgtgtgtgtaagtccgtaagtccagatactaaa

SEQ ID NO: 12689 - DNA, 358 bp, Homo sapiens
  AC005070.1_104657
  Located on chromosome 7
  Distance between a terminus base of telomere on chromosomal short arm and 5'-terminus of this base sequence : 106766217
  Distance between 3'-terminus of neighbour sequence of sequence listing upward to telomere on chrosomal short arm and 5'-terminus of this base sequence : 128440
atgaagactcaacagttacagctccctgggtaacagacatcaggattgtagtgatgataacactccaagttaaccattctcttcacagagccctgaaagagaataatattcattctctctctctctctctctctcacacacacacacacacacacacacacacacacacacacacacacacacacaccacttccagaatacattcaaaacttccaacaggccttacagaagtacaagaatctttctggaagccatgtaaatgctcgcttctttttaacacatgtgcccttactgaaagtggaatggtcccaggcaaaagagagttctgaaggaggagaggcaagtaaggaacttcagt

SEQ ID NO: 12690 - DNA, 360 bp, Homo sapiens
  AC004884.1_19398
  Located on chromosome 7
  Distance between a terminus base of telomere on chromosomal short arm and 5'-terminus of this base sequence : 106793755
  Distance between 3'-terminus of neighbour sequence of sequence listing upward to telomere on chrosomal short arm and 5'-terminus of this base sequence : 27180
agaatcacttgatcactgaacttgggaggcggaggttgtggtgagctgagataacgccactgcactccagcctaggcaaaggaaaggagggagggaaagaaaggaaaagagaagagagaagagagggagagagggagggagcaaggaaggaaggaaggaaaggaaggaaagaaggaaggaaggaaggaaggaaggaaggaaggaaggaaggaaggaaggaaggaaggaaggggaaagggaaggaaggagtttaatgaaggcacaggtcaattaatagtctttgatagaaactgagtggctgtctatagtcacgccaccctgaaaacacctaatcgcatctgaaactaagcagttgacaag

SEQ ID NO: 12691 - DNA, 227 bp, Homo sapiens
  AC004884.1_21767
  Located on chromosome 7
  Distance between a terminus base of telomere on chromosomal short arm and 5'-terminus of this base sequence : 106796184
  Distance between 3'-terminus of neighbour sequence of sequence listing upward to telomere on chrosomal short arm and 5'-terminus of this base sequence : 2069
gctttatcacatgcacctttaccatcattgtactcatcagtaaagccatctctttagtctaaagtcagttttctgaaatgcagcattttcacttctacgttgtctgggattgtgtgtgtgtgtgtgtgtgtgcatgtgcatgcattttaaatatgtatggtattgccaaaggaagtgttccccaagtcaaaaataactactcattctcgttcatgtcagttagcttt

SEQ ID NO: 12692 - DNA, 434 bp, Homo sapiens
  AC004884.1_31341
  Located on chromosome 7
  Distance between a terminus base of telomere on chromosomal short arm and 5'-terminus of this base sequence : 106805660
  Distance between 3'-terminus of neighbour sequence of sequence listing upward to telomere on chrosomal short arm and 5'-terminus of this base sequence : 9249
agttactgaaaggtctccaaagacaaacgggtcctcaagttcatcaagaaaagggtgtgggcgcacatccgcgccaagaggaagcgggaggagcaaagcaacgtcctggccgccatgaggaaagccgctgccaagaaagactgagcccccttccctgccctctccctgaaataaagaacagcttgagaggaaaaacaaaacaaaacaaacacacacacacacacacacacacacacacacacacacacctctttttcttagtatttcctaaccaagtgggaaagaaataaaaatctttattcaaataaaatttgtgtctataggccaaagaacgtgctaggcaccagaaacgtgaacatgagacagttaaagctccttgcgtctcgagctagtggagtgagaagcactgagtctcagtacaaaggtctagatgg

SEQ ID NO: 12693 - DNA, 344 bp, Homo sapiens
  AC004884.1_33838
  Located on chromosome 7
  Distance between a terminus base of telomere on chromosomal short arm and 5'-terminus of this base sequence : 106808257
  Distance between 3'-terminus of neighbour sequence of sequence listing upward to telomere on chrosomal short arm and 5'-terminus of this base sequence : 2163
gacgatgtcctttaagtacatcactgatgatcaaagtgccaataatgcctacacaactacaaataacaccggagtgccatacataccaaaaaacacacacacacataaacacacacacacacacacacacacacacacagaagttataccttttcttggtttttaattgttcaaagtttttaactattaactgaacaaaatatgacaattaaatggtacctaacaaaatgcatcactaaaaagaagaagtttaattcttggtattttaattgactgtattaaccacctattttttttaaaaaaaagttttttatttttatagagatggtacctcactatgttgc

SEQ ID NO: 12694 - DNA, 199 bp, Homo sapiens
  AC004884.1_110274
  Located on chromosome 7
  Distance between a terminus base of telomere on chromosomal short arm and 5'-terminus of this base sequence : 106884714
  Distance between 3'-terminus of neighbour sequence of sequence listing upward to telomere on chrosomal short arm and 5'-terminus of this base sequence : 76113
gaccaactcaagtatgctcaagaaaaataaatttttggaaggattcaaactatctttccttaaaaagactttggtcagactattctttgtgtgtgtgtgtgtgtgtgtgtgtgtgtgtgtgtgtgtgtgtgtgtgtggtggagtctcacattgtcgcccgggctggagtgcaatggcgctatcttggcttactgcaacc

SEQ ID NO: 12695 - DNA, 201 bp, Homo sapiens
  D7S1841
  Located on chromosome 7
  Distance between a terminus base of telomere on chromosomal short arm and 5'-terminus of this base sequence : 106984947
  Distance between 3'-terminus of neighbour sequence of sequence listing upward to telomere on chrosomal short arm and 5'-terminus of this base sequence : 100034
tcaagtttgatcatgagattgcagaaattcagctacatcttatggctcactttctttcttccttccttcccccctccctccttccctccctctcttccttcccttccttccttccttccttccttccttccttccttcctttctgtctttctttctctctctctctctctctcccccccaccccccaactttctttttttc

SEQ ID NO: 12696 - DNA, 482 bp, Homo sapiens
  chr7.fa.O7frz.109007315
  Located on chromosome 7
  Distance between a terminus base of telomere on chromosomal short arm and 5'-terminus of this base sequence : 107088415
  Distance between 3'-terminus of neighbour sequence of sequence listing upward to telomere on chrosomal short arm and 5'-terminus of this base sequence : 103267
ttagtggagtacaaccttcagtagcttcccgagaaaggagaaataaatgaaagcttgctgggcgcggtggctcacacccgtgattccactttgggaggccaaggcaggcgaatcacctgaggtcaggagttcgagaccagcctgagcatggcaaaaccctgtctctactaaaaatacaaaaactagcttggcatggtggtgggcgcctgtaatcccaactactcgggaggctgaggcgggagaattgcttgaacctgggaggcagaggttgcagtgagccaagatcgtgccattgcactccagtctgggtgacagagtgagactctgtctcaaataaataaataaataaataaataaataaataaataaataaaacaaaagctaaattttttgagatctttaatgtctatttttattcttgactacaagagtgttaaaaaaaaccccacatttttattctaacctcacatttgattcatagt

SEQ ID NO: 12697 - DNA, 168 bp, Homo sapiens
  chr7.fa.O7frz.108803843
  Located on chromosome 7
  Distance between a terminus base of telomere on chromosomal short arm and 5'-terminus of this base sequence : 107263318
  Distance between 3'-terminus of neighbour sequence of sequence listing upward to telomere on chrosomal short arm and 5'-terminus of this base sequence : 174421
aattaggacttctggtcactttagatataacccagccccttacacacacacagacccacaacacacacacacacacacagacacacatacacacacacacagggcgaatcacatcttttaaataggaaagagaaatgcagcagggtaacaatgcctataaagtgctag

SEQ ID NO: 12698 - DNA, 223 bp, Homo sapiens
  AC005099.1_108412
  Located on chromosome 7
  Distance between a terminus base of telomere on chromosomal short arm and 5'-terminus of this base sequence : 107345119
  Distance between 3'-terminus of neighbour sequence of sequence listing upward to telomere on chrosomal short arm and 5'-terminus of this base sequence : 81633
gaactgaattaaatcgtaggacactgaattggtacctgcagagaatccccttggtatggaaaactcacaatttggtatcagaaatgttgagtaagcaacagttttcctttaaccacaaatttctgaagtccccataactgactggctaaacacacacacacacacacacacacttttttcaatttaagttaaatgactagtataccaagatcttgaacactgc

SEQ ID NO: 12699 - DNA, 420 bp, Homo sapiens
  AC004964.2_43307
  Located on chromosome 7
  Distance between a terminus base of telomere on chromosomal short arm and 5'-terminus of this base sequence : 107496580
  Distance between 3'-terminus of neighbour sequence of sequence listing upward to telomere on chrosomal short arm and 5'-terminus of this base sequence : 151238
ttgcatagttgcattcatgtactcaatcaacagataacaattaacttctgacatgtgtccagcatgctttcaggctctaggaatacagcactgcacaaggtacctgcccttataaggcttacatgctggtggaggaaagaaacagaaacaaataaacaaattaataaatataacttaggtttgataatacaaaaagtaaagcaggattcaggcacagtgacaagtaatggtgtgtgtgtgtgtgtgtgtgtgtgtgtgtgtgtgtgtgtgtgtcctttgattagttagattcattagggaaggctgcttggaagagatgacatttgaacagacagactcgaatgagatgagggggtgagtcacgtaagagtccctcagctaaaactaaaccacgtatcaccattatagtgaactgaccta

SEQ ID NO: 12700 - DNA, 193 bp, Homo sapiens
  D7S2453
  Located on chromosome 7
  Distance between a terminus base of telomere on chromosomal short arm and 5'-terminus of this base sequence : 107578307
  Distance between 3'-terminus of neighbour sequence of sequence listing upward to telomere on chrosomal short arm and 5'-terminus of this base sequence : 81307
cttgaacccaggaagtggaggttgcaatgagccgagatcgcaccactgcactccagcctgggcgacagagtgagactccgtcacacacagacacacacacacacacacacacacacacacacacacacacacacaaagatataaattgtctattacacctcacaggactgcttggatcatagggtcagttacc

SEQ ID NO: 12701 - DNA, 447 bp, Homo sapiens
  chr7.fa.O7frz.108451805
  Located on chromosome 7
  Distance between a terminus base of telomere on chromosomal short arm and 5'-terminus of this base sequence : 107615301
  Distance between 3'-terminus of neighbour sequence of sequence listing upward to telomere on chrosomal short arm and 5'-terminus of this base sequence : 36801
actggatctgagttaatccaagagatagacaaaggggtattgagtgaacaagatgaccagcacatcctaggttcccagagttcccaaagctgggttgagacctcacaggccgggctggtggtaatgcccagggtgtgtgtgtgtgtgtgtgtgtgttcgttccttggcactcacatatgtttgtgtgtctgtgaggctgtgtgatgggatctgggaactggtggaggatgagaataaaggatggagcgctaaggagtcaggcaggcaaaaacaacccccacacaccatgcgggtgtatgcctcccgggtcccatgcacctgggtatgtgaaccctgccaccctcctgcacaagagcccagtctactgtgcctgaagaggctggacctgacgccggccttccctttgcttcatttgtgagatgccggctagtccagtctgacttcagg

SEQ ID NO: 12702 - DNA, 208 bp, Homo sapiens
  AC005095.2_95298
  Located on chromosome 7
  Distance between a terminus base of telomere on chromosomal short arm and 5'-terminus of this base sequence : 107730670
  Distance between 3'-terminus of neighbour sequence of sequence listing upward to telomere on chrosomal short arm and 5'-terminus of this base sequence : 114922
atgaatagccactgcactctagcctgggcaatgtagtaagagccggtgtttaaaaatatatctagatacacacacacacacacacacacacacacacacacatatttaggcaatacacacacagatgatatctttcataaagcaaaccaactcatacagcttttatgtcatggttgagtgtctgagagataagtgataccatccaccg

SEQ ID NO: 12703 - DNA, 358 bp, Homo sapiens
  AC007032.2_104802
  Located on chromosome 7
  Distance between a terminus base of telomere on chromosomal short arm and 5'-terminus of this base sequence : 107859702
  Distance between 3'-terminus of neighbour sequence of sequence listing upward to telomere on chrosomal short arm and 5'-terminus of this base sequence : 128824
ttctcagtaaactatcgcaagaacaaaaaaccaaacactgcatattctcactcgtaggtgggaattgaacaatgagaacatatggacacaggaaggggaacatcacactctggggactgttgtggggtggggggagggggaagggatagcattgggagatatacctaatgctagatgacgggttagtgggtgcagtgcaccagcatggcacatgtatacatatgtaactaacctgcacattgtgcacatgtaccctaaaacttaaagtataattaaatatatatatatatatatatatatataaaggacatcttcgtggccttagagcatgcagatgtagttctaccaggttgctcaa

SEQ ID NO: 12704 - DNA, 167 bp, Homo sapiens
  DISO7_10002315
  Located on chromosome 7
  Distance between a terminus base of telomere on chromosomal short arm and 5'-terminus of this base sequence : 107911995
  Distance between 3'-terminus of neighbour sequence of sequence listing upward to telomere on chrosomal short arm and 5'-terminus of this base sequence : 51935
acactgcagaaggaaagactagtaaacttgaagattttatatatatatatatatgtatttatatgtgtatatatatgtatatatatatacatatatatatatatgatccaaaataaaacatacagagaaaaaatattaaacagagaaatgggaacctgtaggaggct

SEQ ID NO: 12705 - DNA, 228 bp, Homo sapiens
  AC007031.2_33246
  Located on chromosome 7
  Distance between a terminus base of telomere on chromosomal short arm and 5'-terminus of this base sequence : 107994875
  Distance between 3'-terminus of neighbour sequence of sequence listing upward to telomere on chrosomal short arm and 5'-terminus of this base sequence : 82713
aagccaattttatcactgttacagaatggaataaggctgggggaataagagaataaactattgtgagatgagaagtagagatatcaatttgaacttgggatcaatatgaactcaaatctgtgtgtgtgtgtgtgtgtgtgtgtgtgtgtgtgtgtttgtatgcatctatattcttagctttatctatgttctaaggactaggagtaatgacactccagtaccaactag

SEQ ID NO: 12706 - DNA, 254 bp, Homo sapiens
  AC007031.2_46231
  Located on chromosome 7
  Distance between a terminus base of telomere on chromosomal short arm and 5'-terminus of this base sequence : 108007835
  Distance between 3'-terminus of neighbour sequence of sequence listing upward to telomere on chrosomal short arm and 5'-terminus of this base sequence : 12732
aattaggcaggtgactgtaatcccagctacttgggagtctgaggcaggagaattgcttgaacctgggaggtggaggttgcagtaagctaagattgcaccattgcactccagcctgggcaacaagagcaagactgtctcaaaaggaaaagaaaagaaaagaaaagaaaagaaaagaaaagaaaagaaaagaaaagaaaagaaaagaagactgtttcattggtgaaactttagtacttaagctttggctagaatct

SEQ ID NO: 12707 - DNA, 243 bp, Homo sapiens
  AC005050.2_118458
  Located on chromosome 7
  Distance between a terminus base of telomere on chromosomal short arm and 5'-terminus of this base sequence : 108126856
  Distance between 3'-terminus of neighbour sequence of sequence listing upward to telomere on chrosomal short arm and 5'-terminus of this base sequence : 118767
gttttcctagcttctaagccaggaaatgtgaggaaacagaccctcttctggagcccccagaaggaaccagccctgtgaatgccttggttttagcccagtaagcttcatttcaaacttctgacctctagaactataaaagaataaatttgtgttgatttttaaaaaatctactattctttatatatagacatacacacacacacacacacacacacacacacattgtattcacaacctagcgat

SEQ ID NO: 12708 - DNA, 211 bp, Homo sapiens
  D7S2504
  Located on chromosome 7
  Distance between a terminus base of telomere on chromosomal short arm and 5'-terminus of this base sequence : 108258901
  Distance between 3'-terminus of neighbour sequence of sequence listing upward to telomere on chrosomal short arm and 5'-terminus of this base sequence : 131802
ctggaaaccagtgttttcactttctttcaaaacagagtgtgtgtgtgtgtgtgtgtgtgtgtgtgtgtgtgtgtgtgtgtgtgtttgcttcattttagctagagttgctattttatttcagtgggaagaatttctgctatgccagttcagtcttccatgatgccagaaatcctctacaaacatatttttatgtgtctgaaattgtaccaca

SEQ ID NO: 12709 - DNA, 151 bp, Homo sapiens
  D7S818
  Located on chromosome 7
  Distance between a terminus base of telomere on chromosomal short arm and 5'-terminus of this base sequence : 108297429
  Distance between 3'-terminus of neighbour sequence of sequence listing upward to telomere on chrosomal short arm and 5'-terminus of this base sequence : 38317
gtctcttccatttatgcttttgttctatctatctatctatctatctatctatctatctatctatctatctatctatctatcttctcaatctttctccctctctggctgtctcaccccatgttcttcccacccctgtctctctgttcctttc

SEQ ID NO: 12710 - DNA, 285 bp, Homo sapiens
  D7S2509
  Located on chromosome 7
  Distance between a terminus base of telomere on chromosomal short arm and 5'-terminus of this base sequence : 108384179
  Distance between 3'-terminus of neighbour sequence of sequence listing upward to telomere on chrosomal short arm and 5'-terminus of this base sequence : 86599
gtgggaaacagtatgattgattcctcaggaaattaaaaataattaccatgccacctagcaattcgatttctggatgtgtatccaaaagaactgaaaacaggatctcaaagagatatttgtacatccatgtccataagcagcattagtcatgatacccataaggtggaagcaacccaagtgtccatctacatatgaatggataaacaaaatgtgatacacgcatgcgcgctcacacacacacacacacacacacacacacacacacattattcagccttaaaaagg

SEQ ID NO: 12711 - DNA, 317 bp, Homo sapiens
  AC004668.1_7905
  Located on chromosome 7
  Distance between a terminus base of telomere on chromosomal short arm and 5'-terminus of this base sequence : 108384290
  Distance between 3'-terminus of neighbour sequence of sequence listing upward to telomere on chrosomal short arm and 5'-terminus of this base sequence : -174
gatatttgtacatccatgtccataagcagcattagtcatgatacccataaggtggaagcaacccaagtgtccatctacatatgaatggataaacaaaatgtgatacacgcatgcgcgctcacacacacacacacacacacacacacacacacacattattcagccttaaaaaggaatgaaattctagtataagctacaacacagatgaaccttgaagacattatgctaagtgaataagtcagtcacaaaaaagacaaatactatatgattccacaaatatgaagtacctagaggtgtcaaattcctaaagacaaagt

SEQ ID NO: 12712 - DNA, 235 bp, Homo sapiens
  chr7.fa.O7frz.105728537
  Located on chromosome 7
  Distance between a terminus base of telomere on chromosomal short arm and 5'-terminus of this base sequence : 108520275
  Distance between 3'-terminus of neighbour sequence of sequence listing upward to telomere on chrosomal short arm and 5'-terminus of this base sequence : 135668
atagctagatctgcaactgctatattttaaaaaattaagatccaagacttataaatacattactagtttccagacacaccacaacctgaactatgcatgtgcactagcaggggcatgtgcatacacacacacacacacgcacacacatgtccctgcagccagtcaagtttcatacacacacacgcacacgcacatacacacatacaaacatccctacagctagccaagtttcata

SEQ ID NO: 12713 - DNA, 361 bp, Homo sapiens
  AC002487.1_138066
  Located on chromosome 7
  Distance between a terminus base of telomere on chromosomal short arm and 5'-terminus of this base sequence : 108741646
  Distance between 3'-terminus of neighbour sequence of sequence listing upward to telomere on chrosomal short arm and 5'-terminus of this base sequence : 221136
aatgcaacacttagataagtctgacgatattaataaaaatacccattcactgcacatcagcctgggcaacatggtgagaccatgtccctaatatatatatctatgtgtgtgtgtgtgtgtgtgtgtgtgtgtgtgtgtgtgtgtgtgtataatctccacttactctattttcagcaccctgaattatctctgcttccttgtgggtctcttgttctttatagtcatcttgatatttctcttttaggctgttggcgattattcgtttaccatttacatttataagcaaagggcaatgcataagtgttcacatttgtgcaggtttccctgcattgtttcattaagtaacttcactaagcattgc

SEQ ID NO: 12714 - DNA, 377 bp, Homo sapiens
  AC002487.1_122303
  Located on chromosome 7
  Distance between a terminus base of telomere on chromosomal short arm and 5'-terminus of this base sequence : 108757413
  Distance between 3'-terminus of neighbour sequence of sequence listing upward to telomere on chrosomal short arm and 5'-terminus of this base sequence : 15406
ggttgctattaaattcggacttttatccagatgcctcagtcatattccaaaaccagaaactgcctttgttcactgcaccatgattattatttgatggtggtgatgtaagtgtgagtgtgtgtgtgtgtgtgtgtgtgtgtgtgttgggggtgttgggggtaggggctgtaagtaaactttctttttcgttgggcctttttttcttttaaaaccccacatagaaacaagaccaaaccatgtgtttttagatgtactaaaacaaaacagatatgcaaactgaaaatatcaaaatagtatttaaatgaaaacaagattgtttcattttgtgcccatctttgatcctagatatgtaaacctggaaacctggataagataca

SEQ ID NO: 12715 - DNA, 309 bp, Homo sapiens
  AC002487.1_97129
  Located on chromosome 7
  Distance between a terminus base of telomere on chromosomal short arm and 5'-terminus of this base sequence : 108782630
  Distance between 3'-terminus of neighbour sequence of sequence listing upward to telomere on chrosomal short arm and 5'-terminus of this base sequence : 24840
agaaactaccaaaggcagaaagaagaaccatcttcctacagtgatcgtctatgcctctctctctctctctctctctctctctctctctctctctctctctcgctcatattctatatcttgctctttctattctgggagattttctgctctactctttgactttaatatctgacctatttaccatgttcttgttgttagttttgaaataatatccttagtttttaagagttctttcttggttttgcttttatgaggtattgaccttgttttctcagtccttatcttctttatcctgaagctcatacaaga

SEQ ID NO: 12716 - DNA, 368 bp, Homo sapiens
  AC002487.1_78009
  Located on chromosome 7
  Distance between a terminus base of telomere on chromosomal short arm and 5'-terminus of this base sequence : 108801673
  Distance between 3'-terminus of neighbour sequence of sequence listing upward to telomere on chrosomal short arm and 5'-terminus of this base sequence : 18734
ttccaaatacgtgacttgtttctgttttttctgggaaatgggggtattctcaaattatttcatcagattctagttttctagtcctgagaagacattacccttaattcctcgaactgttttccttctcctcctacacacatacacacacacacacacacacacacacacacacacacacttgcatttatttgtcttctcttcctctacgtagtagtcaaaagaatctgaattaaagatacaacatagattgccaaaataagataaaccaaggacaaaaacagactctacagacacttagttggataaaacatctgaaacaggcttatagtcagtagcagtctcaagtaggtcttgtcctattcataacg

SEQ ID NO: 12717 - DNA, 244 bp, Homo sapiens
  D7S2425
  Located on chromosome 7
  Distance between a terminus base of telomere on chromosomal short arm and 5'-terminus of this base sequence : 108801750
  Distance between 3'-terminus of neighbour sequence of sequence listing upward to telomere on chrosomal short arm and 5'-terminus of this base sequence : -291
ctagtcctgagaagacattacccttaattcctcgaactgttttccttctcctcctacacacatacacacacacacacacacacacacacacacacacacacttgcatttatttgtcttctcttcctctacgtagtagtcaaaagaatctgaattaaagatacaacatagattgccaaaataagataaaccaaggacaaaaacagactctacagacacttagttggataaaacatctgaaacagg

SEQ ID NO: 12718 - DNA, 167 bp, Homo sapiens
  D7S692
  Located on chromosome 7
  Distance between a terminus base of telomere on chromosomal short arm and 5'-terminus of this base sequence : 108809197
  Distance between 3'-terminus of neighbour sequence of sequence listing upward to telomere on chrosomal short arm and 5'-terminus of this base sequence : 7203
ctgatgattgctatagatattcatcattatacacacacacacacacacacacacacacacacatatacacagacagagttaggaataaaatttaactaaaaaagggaagtaacagtgtttctagtattcaaagtagatagcaaggttcttctacaaaagtgtttaca

SEQ ID NO: 12719 - DNA, 305 bp, Homo sapiens
  AC002487.1_6482
  Located on chromosome 7
  Distance between a terminus base of telomere on chromosomal short arm and 5'-terminus of this base sequence : 108873298
  Distance between 3'-terminus of neighbour sequence of sequence listing upward to telomere on chrosomal short arm and 5'-terminus of this base sequence : 63934
agacactgccttattgctgtatcctcacatggtcattcttttgtgcatgtgtggatagagagagagagagagagagagagggagatctgatctctcttctgcttcttaaaagggcactactcctatcagattagggccccacacttctgacctcacttaaccttagttaactccttaaaggccctatctccaaataagatcacattggaggttagggcttcaacacatgaattttatgaggacacaattcagtctgtaatatgtagctattacatggcagacactaaactagagctggaaatgca

SEQ ID NO: 12720 - DNA, 218 bp, Homo sapiens
  AC005058.1_125991
  Located on chromosome 7
  Distance between a terminus base of telomere on chromosomal short arm and 5'-terminus of this base sequence : 108989798
  Distance between 3'-terminus of neighbour sequence of sequence listing upward to telomere on chrosomal short arm and 5'-terminus of this base sequence : 116195
gtccataagatttcaactgcatatgtagattttcattttttaatttcttaatatatgtgtgtgtgtgtgtgtatatatatatatatatatatatatatatatatatatattcatgtgcatatagcttatatagaactgcagattgcttttttttaaagacttttttaagaatagtttttaggttcacaggaaaattgagaggaaggtacagacgtttc

SEQ ID NO: 12721 - DNA, 158 bp, Homo sapiens
  AC005058.1_27310
  Located on chromosome 7
  Distance between a terminus base of telomere on chromosomal short arm and 5'-terminus of this base sequence : 109088496
  Distance between 3'-terminus of neighbour sequence of sequence listing upward to telomere on chrosomal short arm and 5'-terminus of this base sequence : 98480
ggtacagatgttctgaaaggatattcttttgtagattcaaatacttgaaaattaaaaataaacacacacacacacacacacacacacacacacgatggaactaaaatatttgtaagtacttaaatttgtaaattcttggtttgctaccaaataactag

SEQ ID NO: 12722 - DNA, 231 bp, Homo sapiens
  AC005058.1_25831
  Located on chromosome 7
  Distance between a terminus base of telomere on chromosomal short arm and 5'-terminus of this base sequence : 109089952
  Distance between 3'-terminus of neighbour sequence of sequence listing upward to telomere on chrosomal short arm and 5'-terminus of this base sequence : 1298
ctaagtgcttacgtgctcaataattgttcacacatgggtgaatatatatatacttagtgatagcaactttcagtgcgtgtgtgtgtgtgtgtgtgtgtgtgtgtgtgtgtgtgtgtataatatgtataccagataaaagacctctcccttcccagccagtgtgtggtcaggccaatgctgctttcacaggcaggctgtggtgctgaccacttcaagtcagaatgtcatcgt

SEQ ID NO: 12723 - DNA, 283 bp, Homo sapiens
  AF172277.1_130727
  Located on chromosome 7
  Distance between a terminus base of telomere on chromosomal short arm and 5'-terminus of this base sequence : 109343881
  Distance between 3'-terminus of neighbour sequence of sequence listing upward to telomere on chrosomal short arm and 5'-terminus of this base sequence : 253698
tagttaacacatcgcctgtaagagcaaatgctgccagcattctagaatgcctcagtttaccattacgctgcctcccttttcccagttcacaatgcttcatcctttggggctgctgggttaactccagtgtgaaagcaccgtcttccactgcccctgctcctgctcctgctcctcctctcctctcctctcctctcctctcggttccgcggtgtaaggatgtcaatatttggcatgaaagcctatcattggctaatttttaaactctgcattcatgatctacttc

SEQ ID NO: 12724 - DNA, 243 bp, Homo sapiens
  D7S2456
  Located on chromosome 7
  Distance between a terminus base of telomere on chromosomal short arm and 5'-terminus of this base sequence : 109465612
  Distance between 3'-terminus of neighbour sequence of sequence listing upward to telomere on chrosomal short arm and 5'-terminus of this base sequence : 121448
ctggaaattgacctgaaaccttactctctgtacacatacacacacacacacacacacacacacacacacacacacacagagattgagagagagagatgattaatgtgaagaggctttattttccataaccatttttcaaattcaataatttaacattttatacatgaattggcaattggagcatccattacaatctcttcaatcacttcattattctacttaatatgtgtgagagacccctgt

SEQ ID NO: 12725 - DNA, 177 bp, Homo sapiens
  AC005048.2_36985
  Located on chromosome 7
  Distance between a terminus base of telomere on chromosomal short arm and 5'-terminus of this base sequence : 109465614
  Distance between 3'-terminus of neighbour sequence of sequence listing upward to telomere on chrosomal short arm and 5'-terminus of this base sequence : -241
ggaaattgacctgaaaccttactctctgtacacatacacacacacacacacacacacacacacacacacacacacagagattgagagagagagatgattaatgtgaagaggctttattttccataaccatttttcaaattcaataatttaacattttatacatgaattggcaattgg

SEQ ID NO: 12726 - DNA, 400 bp, Homo sapiens
  chr7.fa.O7frz.111217852
  Located on chromosome 7
  Distance between a terminus base of telomere on chromosomal short arm and 5'-terminus of this base sequence : 109557509
  Distance between 3'-terminus of neighbour sequence of sequence listing upward to telomere on chrosomal short arm and 5'-terminus of this base sequence : 91718
ataagaacctgtatttaattgcaaaataaattaacactgattgtttaaaaaacaatctaacaaatctagccctgcccataagtataggtagtcaagagtggatgtgcatactctcccggcctcacaccctggggtaaagtttgtttctgtgtgtaagcacacacacacacacacacacacacacacacacacacaccacaaatacacacagagctgctttttaaaatacttttaaccaaggtgggaccatgtgaaccctatgtttggcaaagtgactttttatcccctctgaacagtattttgtggccaacttccttgatggcacaagaagaggtaaatggttatcctagtaagatcactggattcagtggatcaactagactctgttgacagtttaagc

SEQ ID NO: 12727 - DNA, 397 bp, Homo sapiens
  AC002467.1_80000
  Located on chromosome 7
  Distance between a terminus base of telomere on chromosomal short arm and 5'-terminus of this base sequence : 109744075
  Distance between 3'-terminus of neighbour sequence of sequence listing upward to telomere on chrosomal short arm and 5'-terminus of this base sequence : 186166
ctgagtcatggactccttatagagtctcatacaccctatggactttgggggaaaaaatacacacacacacacacacacacacacacacacacacacacacacacacaatttacatataaaatgcctcacaaatcttgggttaagaacttctcctctaaaaagagtaggaagtcgaaattgaaaacaggagcctatttactcaatcatttggcttgaagttgaggcaaatgccttatatataggattgtcgctgaggtctccatcttcccaagcaaaggtgccctctgcactcttcttgccaaccaaaccaaaccaaaccaaacaaaaacaaaaaactcaagaaacaagcacaagcactccaattcttgtgcccacatcacagtacattcaaccttaa

SEQ ID NO: 12728 - DNA, 336 bp, Homo sapiens
  AC002467.1_7068
  Located on chromosome 7
  Distance between a terminus base of telomere on chromosomal short arm and 5'-terminus of this base sequence : 109817006
  Distance between 3'-terminus of neighbour sequence of sequence listing upward to telomere on chrosomal short arm and 5'-terminus of this base sequence : 72534
caagtcactgttggagtcattagttttttcagttattctcgtatatatatatgagaatatatatatatatatatgtttgtgtgtgtgtgtgtgtgtgtgtgtgtgtgtatatatatatttgacacagagtctagctcttgtcgcccaggctggaatgtagtggcacgatattggctcactgcaacctccacctcccaggttcaagtgattctcctgcctcagcctcccaagtagctgggattacaggcatctaccaccacacctggctaatttttgcatttttagtagagaaggggtttcaccatgttggccatgttagtctcgaactcctgacct

SEQ ID NO: 12729 - DNA, 142 bp, Homo sapiens
  D7S2459
  Located on chromosome 7
  Distance between a terminus base of telomere on chromosomal short arm and 5'-terminus of this base sequence : 109817431
  Distance between 3'-terminus of neighbour sequence of sequence listing upward to telomere on chrosomal short arm and 5'-terminus of this base sequence : 89
ccgccttagtaaaacccatttgaagactgtgaagactgtgcatgtgtgtgtgcatgtgtgtgtgtgtgtgtgtgtgtgtgtgtgtgtgtattgcactatgtagtttgggtttgttgttctttggagtctcaatgcacttctt

SEQ ID NO: 12730 - DNA, 308 bp, Homo sapiens
  AC004839.1_45557
  Located on chromosome 7
  Distance between a terminus base of telomere on chromosomal short arm and 5'-terminus of this base sequence : 109896125
  Distance between 3'-terminus of neighbour sequence of sequence listing upward to telomere on chrosomal short arm and 5'-terminus of this base sequence : 78552
acctaccaaggagctacaagtcatatgtcagcagattcagggccttagatagaagtaaaataaatatatatatatatatatatatatatatatatatatatatatatatataaaacaatacattgtgaagaaggtgctaatgagcaaaatatgtagaagagctgtacaaaatggggtagaaaaattagagttgtcatacttgaaacttttatctcatatagtgctttcagaaatcatttttccaaactctgggaatcctgaagtagctctatatcatatgtagccttcagaagttctacatttggaag

SEQ ID NO: 12731 - DNA, 137 bp, Homo sapiens
  D7S496
  Located on chromosome 7
  Distance between a terminus base of telomere on chromosomal short arm and 5'-terminus of this base sequence : 109994224
  Distance between 3'-terminus of neighbour sequence of sequence listing upward to telomere on chrosomal short arm and 5'-terminus of this base sequence : 97791
gctataacctcataataaaccaaaatataaaatatgtgtgtgtgtgtgtgtgtgtgtgtgtgtgtgtgtgtgtgtaaaataggccatgtttatatagaaaatgtattttatgttaggattgtgggttgactgttgtt

SEQ ID NO: 12732 - DNA, 394 bp, Homo sapiens
  AC002381.1_97667
  Located on chromosome 7
  Distance between a terminus base of telomere on chromosomal short arm and 5'-terminus of this base sequence : 110016319
  Distance between 3'-terminus of neighbour sequence of sequence listing upward to telomere on chrosomal short arm and 5'-terminus of this base sequence : 21958
acgtcagttacatggaaagagtactgtttgttttggaggaagaagaatgatttttgaagctcttctctagaaagacattagagttaaaacaaagcaaaataaactacacacacacacacacacacacacacacacacacactacccattgttgtttttggttttttgtttactatgttttggctcttctgacagaaaagtgccagaattgtaagacgttttattgccagaaactagatatttttttatacacagatacaaaatattaactgatgatttaaaaataaacagctgtaatgggatattgcttataaaatatcttttatatgtgtccatctgtttatgtgtctgttttggaattatgcagattaatgaagttcattcttagtctttgg

SEQ ID NO: 12733 - DNA, 302 bp, Homo sapiens
  AC002381.1_73919
  Located on chromosome 7
  Distance between a terminus base of telomere on chromosomal short arm and 5'-terminus of this base sequence : 110039976
  Distance between 3'-terminus of neighbour sequence of sequence listing upward to telomere on chrosomal short arm and 5'-terminus of this base sequence : 23263
gttgtgagttgcatttctatagaagttgagagtaatatggtggaaaattttgttgtgaatttctaaaatcttctgcacagctttgggtggcaaggctttggtaattctaaaaatgaaaatgttgtgctgctattcatgcgttttgaaagttggggaaaaggatcttgctagaatgccagccatttataaagaaaacttacacacaccgaaacacacacacacacacacacaccacagcacacacattcatttaagcttaaaactaagaccagagaaagcatagcatcagtggaaatatgtga

SEQ ID NO: 12734 - DNA, 351 bp, Homo sapiens
  AC004855.1_66103
  Located on chromosome 7
  Distance between a terminus base of telomere on chromosomal short arm and 5'-terminus of this base sequence : 110122394
  Distance between 3'-terminus of neighbour sequence of sequence listing upward to telomere on chrosomal short arm and 5'-terminus of this base sequence : 82116
cggatggtctaagtttagtctttaaagaagctatttagatagactcctctatattcctatgttaattacccttgctatagctcaaagaggattagactaccttcaactgtaactctatcctgaggcttttgtaaaaaccttctggacttccaagaaggtttattttacagtttttcccaccatcctgactcaaccctaacagaactcaaccacacacacacacacacacacacacacacacacacaaaacctggtttaaagctgggcaaaagacttaaatagatatttctccaaagaagatatacagatggccagcaatcatgtgaaaagatgcttactgtcattaatcgt

SEQ ID NO: 12735 - DNA, 373 bp, Homo sapiens
  AC004492.1_103948
  Located on chromosome 7
  Distance between a terminus base of telomere on chromosomal short arm and 5'-terminus of this base sequence : 110249957
  Distance between 3'-terminus of neighbour sequence of sequence listing upward to telomere on chrosomal short arm and 5'-terminus of this base sequence : 127212
gagtccatcagctgtgaagtataaatggagctgttcttcccgtgcaagaccaattgtgcttccacatccatggtgttttctctacacagattgctggttttacctcaagtccaaagctttaagttgacctgaatatttccagttaacattctctttgtcagaggggcatgaacttctccccggttaaagaatgtgtgtgtgtgtgtgtatgtgtgtgtgtgagagagagagagagagagagagagaattatcattctgacacattcttttgaaattgaattcttacagctctccacacaaggagatgcaagtcaggtgattgggcctcttactgaaggacagagaagaaatgtggcagtagtgaattcattgt

SEQ ID NO: 12736 - DNA, 278 bp, Homo sapiens
  AC004492.1_95213
  Located on chromosome 7
  Distance between a terminus base of telomere on chromosomal short arm and 5'-terminus of this base sequence : 110258759
  Distance between 3'-terminus of neighbour sequence of sequence listing upward to telomere on chrosomal short arm and 5'-terminus of this base sequence : 8429
acatgacgctcaaaggaaggtgctcactggacactttcagattttggattttgggttactcaacatgcataacgttttaactattctcactagactctgagctcctgtatggagggcaaactatatgtatacacacacacacacacacacacacacacacacacacacacacacacacaatcctgtacgttgtatatttatttttaccagagattaagggttatagattaggaatttaatgattaagggtcctatattttacctttgctcattgattt

SEQ ID NO: 12737 - DNA, 284 bp, Homo sapiens
  D7S2420
  Located on chromosome 7
  Distance between a terminus base of telomere on chromosomal short arm and 5'-terminus of this base sequence : 110258862
  Distance between 3'-terminus of neighbour sequence of sequence listing upward to telomere on chrosomal short arm and 5'-terminus of this base sequence : -175
cctgtatggagggcaaactatatgtatacacacacacacacacacacacacacacacacacacacacacacacacaatcctgtacgttgtatatttatttttaccagagattaagggttatagattaggaatttaatgattaagggtcctatattttacctttgctcattgattttgatcatttgtatgagccaaaactatctatcttcattatattatctttgaagtgtgtataatatatttacatttttgattttacgtgttttgagcctcagtcattattt

SEQ ID NO: 12738 - DNA, 446 bp, Homo sapiens
  AC004492.1_16569
  Located on chromosome 7
  Distance between a terminus base of telomere on chromosomal short arm and 5'-terminus of this base sequence : 110337317
  Distance between 3'-terminus of neighbour sequence of sequence listing upward to telomere on chrosomal short arm and 5'-terminus of this base sequence : 78171
gatcacgaggtcaggagattgagaccatcctgctcaaaatggtgaaaccccgtttctattaaaaatacaaaaaaattagttgagagtggtggcgctcacctgtagtcccagctactcaggaggctgaggcaagagaatcgcttgaacccagaaggtggaggttgcagtgagccgagatcgcacccctgcactccagcctggcgacagagcgagactccctctcaaaaaaaaaaaaaaatatatatatatatatatatatatatatttatacatgtatatgttatatattttatatatatacatgtatatgttatatattttatatatatacatgtatgttatatattttatatatatacatgtatatgttatatattttatacatatacatatgtatatagtgaagaaaacaactcttacagtgacagtatcatgtttgacgtctg

SEQ ID NO: 12739 - DNA, 343 bp, Homo sapiens
  AC004492.1_7502
  Located on chromosome 7
  Distance between a terminus base of telomere on chromosomal short arm and 5'-terminus of this base sequence : 110346535
  Distance between 3'-terminus of neighbour sequence of sequence listing upward to telomere on chrosomal short arm and 5'-terminus of this base sequence : 8772
tgtcacaggtaacgtgtatgttaaaatatctgcactaagccctagtacatatggatatgtagaaaacaatacacacacacatacatacacacacacacacacacacacacacacctttatttaaaataagggaaagcaccgtcactcttggggaaaaagtcctcacccctttccttagccacgcatgatacacgagaggctctgtccttgaatgaatggtcaacagagaattctcacatagtaaggagtgttgattaataattaaataatgacatccacaagtcaaacttgagctgttttaatcagataattttacacataaattcctagttagccagattga

SEQ ID NO: 12740 - DNA, 462 bp, Homo sapiens
  chr7.fa.O7frz.110320454
  Located on chromosome 7
  Distance between a terminus base of telomere on chromosomal short arm and 5'-terminus of this base sequence : 110455019
  Distance between 3'-terminus of neighbour sequence of sequence listing upward to telomere on chrosomal short arm and 5'-terminus of this base sequence : 108141
tgagtcaattaacttaccgagtgactgtcttttaaaaaagacacacacacacacacacacacacacacacacacacacacacactctttataatctagaagcttgaatcagggaaccaaaattgatcatggctactttatatattactagagtatcaatttaagtggtattgtttacagctgtagtctccaaaacggggttcatgtatgccaaaacagtgtataaggctatatgttgggatgtaggagaaaattacaacttgcttagaattgctttttactttctcctttcaaaatttatattgtaggaagctttatcatacatataagtcaatatattgtcacatgtataaaatttatcaacatatattggggtgtacactcaaatatattttgctaataaaggtatataataaaataaatttagagaattaagcagctcagtacatgaggtgattatttc

SEQ ID NO: 12741 - DNA, 254 bp, Homo sapiens
  chr7.fa.O7frz.110192686
  Located on chromosome 7
  Distance between a terminus base of telomere on chromosomal short arm and 5'-terminus of this base sequence : 110539072
  Distance between 3'-terminus of neighbour sequence of sequence listing upward to telomere on chrosomal short arm and 5'-terminus of this base sequence : 83591
tggtatatgccagtaggctagccttgttatatccttcaacttaaatatatatataagtttattttttatttacattatcaatatgaatgcatatatttatatgtaaattttctaaatttgcaggagatgtgtgtgtgtgtgtgtgtgtgtgtgtgtgtgtatctccattaatcagtcaatgtagatttggtagctccaatggttctatagtcctgttaaaaaagaattaaaaatactctggtacatccaaatga

SEQ ID NO: 12742 - DNA, 152 bp, Homo sapiens
  AC002384.1_61513
  Located on chromosome 7
  Distance between a terminus base of telomere on chromosomal short arm and 5'-terminus of this base sequence : 110665078
  Distance between 3'-terminus of neighbour sequence of sequence listing upward to telomere on chrosomal short arm and 5'-terminus of this base sequence : 125752
ctgaacatcctaccattgtttatttccttagacttttgtgtgtgtgtgtgtgtgtgtgagtgttgtaccttttgcctggaatgccccttcgttaacacctgtgctggaagaacccttggcctttccatattcttgtaaactgccttacattt

SEQ ID NO: 12743 - DNA, 416 bp, Homo sapiens
  AC002384.1_34113
  Located on chromosome 7
  Distance between a terminus base of telomere on chromosomal short arm and 5'-terminus of this base sequence : 110692383
  Distance between 3'-terminus of neighbour sequence of sequence listing upward to telomere on chrosomal short arm and 5'-terminus of this base sequence : 27153
caaatgccggagaacatagagcagtccaagggcagcagaacaagagccagagaacatagagcagtccaagggcaggagaacaagaatgtcccatttgcagggagtgagaatgagagaaagagagagagagagagagagagagagagagagagaattttttctgcctttgtgttctatccaggcacccagctgattggatggtgcccagccacattaagggtagatctttcccactcactctaccaactcacatgccaatctcctttggaaacaccctcacagacacactcagagataatgctttaccagttctctaggtattcttcaattcagtcaagtttacacctaaaattagccatcacagttatgattgggatttgacctttgaccttgtgtcctatcttgccacttgagta

SEQ ID NO: 12744 - DNA, 385 bp, Homo sapiens
  AC002384.1_18147
  Located on chromosome 7
  Distance between a terminus base of telomere on chromosomal short arm and 5'-terminus of this base sequence : 110708199
  Distance between 3'-terminus of neighbour sequence of sequence listing upward to telomere on chrosomal short arm and 5'-terminus of this base sequence : 15400
ctggttggaagttggattaacgatgatgggggcaagtttgaggcttgccagtttgatattgggtgcctagcagagtggctaatgtctacattttgtcacatatattttactctggccagaatggaaggagataatttgtcctttgtgttgcatcttggcccccagggctgtggtgcagccagctggatcactagggccactcagggaaagggaacccagaagactggcatgctggcaagagggtaagaatttcttaccagtcagacttctggcctctgtgtgtgtgtgtgtgtgtgtgtgtgtttgtgtgtaaagtggatgaggtttccctgtggtcagtcatgtccttggaagcttgaccttgtaagcatgtggcagtactttc

SEQ ID NO: 12745 - DNA, 163 bp, Homo sapiens
  D7S501
  Located on chromosome 7
  Distance between a terminus base of telomere on chromosomal short arm and 5'-terminus of this base sequence : 110708447
  Distance between 3'-terminus of neighbour sequence of sequence listing upward to telomere on chrosomal short arm and 5'-terminus of this base sequence : -137
atttcttaccagtcagacttctggcctctgtgtgtgtgtgtgtgtgtgtgtgtgtttgtgtgtaaagtggatgaggtttccctgtggtcagtcatgtccttggaagcttgaccttgtaagcatgtggcagtactttctcttggtctctgccatcacaacggtg

SEQ ID NO: 12746 - DNA, 219 bp, Homo sapiens
  AC004917.2_69212
  Located on chromosome 7
  Distance between a terminus base of telomere on chromosomal short arm and 5'-terminus of this base sequence : 110803350
  Distance between 3'-terminus of neighbour sequence of sequence listing upward to telomere on chrosomal short arm and 5'-terminus of this base sequence : 94740
tgttcagctggaaatgatagtcatataatcatataatataaacagtgaatattgatgtaactataattatgacattaatggaattagatattcgattggggaagtgtgtgtgtgtgtgtgtgtgtgtgtgtgtgttttgtgagagagttaaatactcatttttcattgggaaaaaataatatttaagattaaaaaattgagacagtataagcgtggtat

SEQ ID NO: 12747 - DNA, 414 bp, Homo sapiens
  AC004917.2_13195
  Located on chromosome 7
  Distance between a terminus base of telomere on chromosomal short arm and 5'-terminus of this base sequence : 110859360
  Distance between 3'-terminus of neighbour sequence of sequence listing upward to telomere on chrosomal short arm and 5'-terminus of this base sequence : 55791
agaggaaagacttagctttgtctaaaacccaacagttgactgggggagatttatggccttggcattggttgggtaggttccttggtggtgtgtacaccaacagtctgtgggaaactctgtgtgtgtgtgtgtgtgtgtgtgtatgtgtgatagagagagagaaaaaaagatcacagtggagggatctcttatttattctgattgtctattcaaaatgtggcattttcctttaaaaaaaagtcctaaaaataacagataataaaattaggtgtagaaattgatgtgctagaagtgtacattgttaaaaaatcctaaatacatttctttgattttagaagttggctttggtctctctggaagatgtagtggaatattaaggatggtttggaatagaactttcactggtgtaattca

SEQ ID NO: 12748 - DNA, 329 bp, Homo sapiens
  AC004014.1_10991
  Located on chromosome 7
  Distance between a terminus base of telomere on chromosomal short arm and 5'-terminus of this base sequence : 111088247
  Distance between 3'-terminus of neighbour sequence of sequence listing upward to telomere on chrosomal short arm and 5'-terminus of this base sequence : 228473
aatttgtagcatctaaatgcctactaatagaataaatagcatgtggtatatttatacaaagtatcattttcaaaaatattaaagttacatgtattatcacagaaggtttgctgagacactaaacaaagcaagttttggaatttgatgctacaagttgagtgggtgtgtgtgtgtgtgtgtgtgtgtgtgtgtgtatcaatacacaaaaactctaggatacacaccatcaaaccattaactatggttttcagtggggagagaaatgggatttggaggttgccagattaagtggtagtcacagagcagtgtggaattcttacattgtaccg

SEQ ID NO: 12749 - DNA, 384 bp, Homo sapiens
  chr7.fa.O7frz.112460438
  Located on chromosome 7
  Distance between a terminus base of telomere on chromosomal short arm and 5'-terminus of this base sequence : 111281866
  Distance between 3'-terminus of neighbour sequence of sequence listing upward to telomere on chrosomal short arm and 5'-terminus of this base sequence : 193290
gtgacaaattgctaacttgaacaagcatcaatgttgttagtccagattttggcatttgcacttgaataaaatttttcctttcattcagtgggagcccaaatgaagctcctgtctttaaagtttatttttccttaaaatcttcttatttaaataaaacttaaataaaaacttatctacaataaactgaaaagttaaaaagctgagagatgcttgaaatatatatatgtttgaaataaacacacacacacacacacacacacacacacacacacacactagaataagctcttcatggagccacaaagaggcatctatttatttatgatttctgggtgtctttcatgatttattttcaaacatgacttacacttgcactcagaaata

SEQ ID NO: 12750 - DNA, 383 bp, Homo sapiens
  AC002386.1_103123
  Located on chromosome 7
  Distance between a terminus base of telomere on chromosomal short arm and 5'-terminus of this base sequence : 111317292
  Distance between 3'-terminus of neighbour sequence of sequence listing upward to telomere on chrosomal short arm and 5'-terminus of this base sequence : 35042
atagcagtatggaaatggactaacagatataatgctgttaaagagactacaggctcaggaagaagaataattaatagatcaataaaccttggttctctctctctctcttcttccctccctccatccccctctctctttcttcctttcttttcttcttttcttttctctttctttttcctccctcccttgtttctttctttcctttctttcttttccctttctttcttccttccttccttccctccctccctccctccctccctccctccctctctctctctctctctctctctctttctttctttctttctttctttctttctttctttctccattaggcatttcttcccttcatccttctatttgtccaaacatctttcaac

SEQ ID NO: 12751 - DNA, 417 bp, Homo sapiens
  AC002386.1_76196
  Located on chromosome 7
  Distance between a terminus base of telomere on chromosomal short arm and 5'-terminus of this base sequence : 111344342
  Distance between 3'-terminus of neighbour sequence of sequence listing upward to telomere on chrosomal short arm and 5'-terminus of this base sequence : 26667
caatatggtcttggatcttcatcttttatttgtctccactatttaaaagtgatcctaaccatttgcagatcttaaaataatacttaactgctaaaatcccaaggtatatttgtactccagaattctcttctgtgtctcacacacacacacacacacacacacacacacacacctcacgtacatacacagacataaatgtgtacgtgaaatctcccctcctatgtttaacaggaacttttcaagcacagcacttccgaaacaaaaaatatttacctcaaatcctctagttgccacatagttctctaattctcacctcactaaatatcctttttcatataattcttcatacagaaaacctgggagtcactactggcattttattgttcctaacttctcacatttcatctagatttcctc

SEQ ID NO: 12752 - DNA, 379 bp, Homo sapiens
  AC002386.1_16065
  Located on chromosome 7
  Distance between a terminus base of telomere on chromosomal short arm and 5'-terminus of this base sequence : 111404477
  Distance between 3'-terminus of neighbour sequence of sequence listing upward to telomere on chrosomal short arm and 5'-terminus of this base sequence : 59718
cctaagctacattgccatctactgctcacacttgtggcctttcatggtggcaaacagatgaagctccctctctctctctctttctctctgtgtgtgtttgtatatgtgtgtgtgtatgtggggagggggagagagagagagagagagagagagagagagagagagagactgacctcgttggcttttatctacacattttatgcacttctctgtctttatgcttttgttttatttagtttttgtctgacgagagtccctccagcccccactaccatcccacagatttctttctcaggactttgttctccaatggtcatattgtgaaaatataaattttactgtgttcttttaacacaagtctttaatccatacaggtgga

SEQ ID NO: 12753 - DNA, 122 bp, Homo sapiens
  D7S1817
  Located on chromosome 7
  Distance between a terminus base of telomere on chromosomal short arm and 5'-terminus of this base sequence : 111657664
  Distance between 3'-terminus of neighbour sequence of sequence listing upward to telomere on chrosomal short arm and 5'-terminus of this base sequence : 252808
ccccccattgaggttattacatacatatgtaatatagatagatagatagatagatagatagatagatgatagatagacattaagttggtacaaaagtaattgcagtttttgccattaatttg

SEQ ID NO: 12754 - DNA, 312 bp, Homo sapiens
  AC067880.2_35909
  Located on chromosome 7
  Distance between a terminus base of telomere on chromosomal short arm and 5'-terminus of this base sequence : 111800287
  Distance between 3'-terminus of neighbour sequence of sequence listing upward to telomere on chrosomal short arm and 5'-terminus of this base sequence : 142501
caggtcaggacttactaaatgtacctcaagaagtatctcaagctaatatgagaagtgaaggcagaaactgcacaactggcaaccagtaaaaactaattctatctgcattattaactatagttattctgtacatgaaatcccccagaactttttcatcttgtagctgaagtttataccctttgatcaatgcctccccatttcatctattcctcagcctcattgactgatagatagatagatagatagatagatagatagatagatagatagatagaatcccaagtacatctgctagtctcactttatcaacat

SEQ ID NO: 12755 - DNA, 433 bp, Homo sapiens
  chr7.fa.O7frz.113302167
  Located on chromosome 7
  Distance between a terminus base of telomere on chromosomal short arm and 5'-terminus of this base sequence : 111943994
  Distance between 3'-terminus of neighbour sequence of sequence listing upward to telomere on chrosomal short arm and 5'-terminus of this base sequence : 143395
gtttcctttagaccatcaagagactaaagtctgacaatggtgaaaatgagctgtgtgaaatgaagagtgccttattcttgaaataatacactaatcaatcatcctgggtgcataaatcaattgaactgtcaaaatgtatattgtataattcattcgaagcccattacctgaaagaacaagtaaaatgcatttacaaacttgaagatcatgtaaccatcttgtgcaagatggtagtaagctctgcctaagtatatgatggatggatagatagatagatagatagatagatagatagatagatacagattttttaaacaagaaaatcttgaggaacaaaaagaaagaaaactaaccatgcagctggctactcctctctgcccaaagaagaaaaagtaataagatccatgtgctgtaatgaggtaaagaatcagac

SEQ ID NO: 12756 - DNA, 342 bp, Homo sapiens
  AC004161.1_32392
  Located on chromosome 7
  Distance between a terminus base of telomere on chromosomal short arm and 5'-terminus of this base sequence : 112003572
  Distance between 3'-terminus of neighbour sequence of sequence listing upward to telomere on chrosomal short arm and 5'-terminus of this base sequence : 59145
gtagtgccaagttgatgttaagtaaatttagttatgtgtgtgtgtatatatatatatatatatatatatatataatataatatatatatactatatatattttatatatataataacatttaaaagtatgtctacatatttaccatattcatttaaaccaaatatttagctgactttaatgagaagatgatttttttctggccatgtctatatgaattaaacataagaaatcataatgaatgttttatttaaaaagtgttttacctctatgcctatagtgaagagaagatattattatctttaagtttaatgtaagttgttaatgcgtattagatgcaaagt

SEQ ID NO: 12757 - DNA, 300 bp, Homo sapiens
  AC004161.1_32727
  Located on chromosome 7
  Distance between a terminus base of telomere on chromosomal short arm and 5'-terminus of this base sequence : 112003723
  Distance between 3'-terminus of neighbour sequence of sequence listing upward to telomere on chrosomal short arm and 5'-terminus of this base sequence : -191
tttaaaccaaatatttagctgactttaatgagaagatgatttttttctggccatgtctatatgaattaaacataagaaatcataatgaatgttttatttaaaaagtgttttacctctatgcctatagtgaagagaagatattattatctttaagtttaatgtaagttgttaatgcgtattagatgcaaagtgaagtaattgtctattgcctaataacatggtttatttattcattcattcattcattcattcattcattcattcattcatgattttctatgccatagacattgtactagg

SEQ ID NO: 12758 - DNA, 192 bp, Homo sapiens
  AC004161.1_55157
  Located on chromosome 7
  Distance between a terminus base of telomere on chromosomal short arm and 5'-terminus of this base sequence : 112026261
  Distance between 3'-terminus of neighbour sequence of sequence listing upward to telomere on chrosomal short arm and 5'-terminus of this base sequence : 22238
ggctatgacattactaggcagtaggaatttccagctccattataatgtacgagaccatcaaagtataaggagtccactgttgactaaaatgctgttatgtagtacatgattgtatgtacatgtgtgtgtgtgtgtgtgtgtgtgtgtgtataatatatatacaacatcaggtggtaatggattacatggaaa

SEQ ID NO: 12759 - DNA, 319 bp, Homo sapiens
  AC004161.1_92753
  Located on chromosome 7
  Distance between a terminus base of telomere on chromosomal short arm and 5'-terminus of this base sequence : 112063837
  Distance between 3'-terminus of neighbour sequence of sequence listing upward to telomere on chrosomal short arm and 5'-terminus of this base sequence : 37384
aagtcaatcagacagcaagaatttttctatcaactggaaataagaaagggctacgtgccaaaacacagataaaatttcaggactcagaatgaacactaagaaaccttatgaacaaaaataaaatttgcataaaacaagtatgtgtgtgtgtgtgtgtgtgtgtgtgtgtgtgtgaaagagagagagagagggagaatgccagaatatcacttggtatatacttgttcccacagaaatagaagagcaatatgaaccaggtgagaataaagactacttatttaaaaacatttcaagagttaattagtgtggaggcatagaa

SEQ ID NO: 12760 - DNA, 229 bp, Homo sapiens
  D7S525
  Located on chromosome 7
  Distance between a terminus base of telomere on chromosomal short arm and 5'-terminus of this base sequence : 112064415
  Distance between 3'-terminus of neighbour sequence of sequence listing upward to telomere on chrosomal short arm and 5'-terminus of this base sequence : 259
gttagccgagattgccccactgcactccagcctgggtgacagagcaagactctgtctcaaagaaaaaaagaaagaaaaaaaaaaagagtttatacacacacacacacacacacacacacacacacacacacaatttgttttcttttatgaaaattagttttgtcattatcaacctaaattcccatcaatggtagactgcataaagaacttgtggtacttaaacagcaag

SEQ ID NO: 12761 - DNA, 477 bp, Homo sapiens
  chr7.fa.O7frz.113670041
  Located on chromosome 7
  Distance between a terminus base of telomere on chromosomal short arm and 5'-terminus of this base sequence : 112268170
  Distance between 3'-terminus of neighbour sequence of sequence listing upward to telomere on chrosomal short arm and 5'-terminus of this base sequence : 203526
atgccacttttctaagatagaaactttataagaaacaggataggctgggagtggtggctcatgcctgtaatcccagcactttgggaggtggaggtaggtagatcatctgaggtcaggagtttgagactagcctggccaacatggtgaaaccctgtgtctacttaaaacacaaaaatcagccaggcgtactggagcacacctgtaatcccagctactcaggaggctgagacaagagaattgcttgaacctgggaggcagagattgccatgagccaagatcgggccaagatccagcctggacaacaatagcaaaactcttgtcaaaaaaaaaaaaaaaaaaaagaaagaaagaaagaaagaaaaagaaaagagacaggttaaagtataaaataaacctcagtttctggcctggcctctgattctaagaatgctcacaatgtctaaaaggaggcttttctatgactgatcacctgcatat

SEQ ID NO: 12762 - DNA, 325 bp, Homo sapiens
  AC003081.1_14660
  Located on chromosome 7
  Distance between a terminus base of telomere on chromosomal short arm and 5'-terminus of this base sequence : 112301828
  Distance between 3'-terminus of neighbour sequence of sequence listing upward to telomere on chrosomal short arm and 5'-terminus of this base sequence : 33181
tggaggctcagataattgttagcaattttttagcaataaagtatgtttaattaaggtacatacattgattttcaccacaatgctgttgtatacttattagaatatagtataatgtaaacataacttatatatgtcctggaaaacaaaaaaaagttgttgtttttacttgctttatttaacttgcaaatgacttgctttattgtgatacttgctttattgtggtggcctaccatagaacctacaatatctccaagttatgcctgtggtgtgtgtgtgtgtgtgtgtgtgtgtgtgtgtgtgtgtgtacttgaatactatttggcct

SEQ ID NO: 12763 - DNA, 373 bp, Homo sapiens
  AC003081.1_36850
  Located on chromosome 7
  Distance between a terminus base of telomere on chromosomal short arm and 5'-terminus of this base sequence : 112324095
  Distance between 3'-terminus of neighbour sequence of sequence listing upward to telomere on chrosomal short arm and 5'-terminus of this base sequence : 21942
ttaactgtcaaaggattagcattcagaatgtttgaaggactcctaaaaccaataagagaaaaacaaataatcactaattaaaatttgaaaatttgaaaatgcatgtaagaagagtccatttacacaagagagaatacaaaaggaaaaaacgtaaaacctcatgaaaaatcagagatgtgcaattttatacacacacacacacacacacacacacaaacacacacacatataactgtgtggatatagtcaaaatagtcatgagctgcgtaatgatgttttggccaacagaacacaatgcaatggtggtcccctaagattataatgaagctgaaaaatttttatcacctagttgtgtcatagtgcaatgcattac

SEQ ID NO: 12764 - DNA, 384 bp, Homo sapiens
  AC003081.1_50137
  Located on chromosome 7
  Distance between a terminus base of telomere on chromosomal short arm and 5'-terminus of this base sequence : 112337467
  Distance between 3'-terminus of neighbour sequence of sequence listing upward to telomere on chrosomal short arm and 5'-terminus of this base sequence : 12999
tgtaacctgaataaaatccttcacaaaactctcacttttccaactgttaaattactgtcttctttcccaatccttattgctctctccatctttcaagacactaatatatatatatatatatatatatatatatatatatatatatataaaattcttctataaattaaaaaaagtgctacaaattcaaaaggtgacaatgcatggataatgaaaagcaaatatccccactaccattgtccccagccacccaaattctctttgcagaagaaaccaggatttccagtttcttgaatatatttccgtagatattttatgcatacacaattatattccttttttatatgagtagtataattacctgttaggtagcaaacttttaggctt

SEQ ID NO: 12765 - DNA, 418 bp, Homo sapiens
  AC003081.1_51846
  Located on chromosome 7
  Distance between a terminus base of telomere on chromosomal short arm and 5'-terminus of this base sequence : 112339047
  Distance between 3'-terminus of neighbour sequence of sequence listing upward to telomere on chrosomal short arm and 5'-terminus of this base sequence : 1196
cagttctattaatgtcatgccttctttctttaaaacgtaattcctaggtcagatactaacttctaccagtgaagaatataagttactttcaagtgtgaagtaagtatttttaaaagttagtcccaacataagctacaaaaaatatattcccaaattggaaattaggaaaatcatactttctgatcagaatttaataaaactagcaataaatagcagaatcacacacacacatacacacacacacacacacacacacacacacacacatatcatgcaaattggaaagctgaaaaacagaagggaaaaactaattagttggggaaataaaaatatacatatagataatttagactataagataaaacagtgttcaaaacagtataattggtgaacagttcaactgataaaacagttcgat

SEQ ID NO: 12766 - DNA, 168 bp, Homo sapiens
  D7S2418
  Located on chromosome 7
  Distance between a terminus base of telomere on chromosomal short arm and 5'-terminus of this base sequence : 112399990
  Distance between 3'-terminus of neighbour sequence of sequence listing upward to telomere on chrosomal short arm and 5'-terminus of this base sequence : 60525
tccataatcgcatgagtgatcatggaggcttaaaataaattgggatgtgtgtgtgtgtgtgtgtgtgtgtgtgtgtgtgtgtgtacatcctattggctctgtttcactggataatcctaataaaggagtctaaagaagtacctatgtcacatacacctgcttccaatt

SEQ ID NO: 12767 - DNA, 352 bp, Homo sapiens
  AC003081.1_146000
  Located on chromosome 7
  Distance between a terminus base of telomere on chromosomal short arm and 5'-terminus of this base sequence : 112433338
  Distance between 3'-terminus of neighbour sequence of sequence listing upward to telomere on chrosomal short arm and 5'-terminus of this base sequence : 33180
cacagattgcatcgatattaaccaacctatttagttcaactaataggtataattgagcatttactatcaggccaccacagaattaggaatacagtgatagatagatagatagatagatagatagatagatagatagatagatagattgacagatatatatatatatatcccttaaagaatgtataatatttcatgggaaaatgtttatttaataaagatcttaaataactattaggatagtataagttcaagtgctggaatgaatgttataaacaatgtgtgcagttggaatttttaaaaagcatatggccataaacaggagttgatggtgaatgcttaatggaacatataa

SEQ ID NO: 12768 - DNA, 225 bp, Homo sapiens
  AC006339.3_2888
  Located on chromosome 7
  Distance between a terminus base of telomere on chromosomal short arm and 5'-terminus of this base sequence : 112439549
  Distance between 3'-terminus of neighbour sequence of sequence listing upward to telomere on chrosomal short arm and 5'-terminus of this base sequence : 5859
acataattacctgagcatgcacatatcttggaaggatatcaagacagttgtatttgaaattattctctaacttccacagcaactcaaccattaatgaaataacgagcgctaccaaagtcttttactgaaaggaaaaaatgtgtgtgtgtgtgtgtgtgtgtgtgtgtttcaagttcatatctgcagggtgtatctattcataggtgactatgctttgaaatgctc

SEQ ID NO: 12769 - DNA, 328 bp, Homo sapiens
  AC003088.1_20360
  Located on chromosome 7
  Distance between a terminus base of telomere on chromosomal short arm and 5'-terminus of this base sequence : 112516649
  Distance between 3'-terminus of neighbour sequence of sequence listing upward to telomere on chrosomal short arm and 5'-terminus of this base sequence : 76875
ttgtaagagtgttagaacaaggagaaagaaatacactgttggattcagctaggtttatttatatgagtgcactaacaagtaattttggattccatatattattttgaattgttaggaataagtctaatagccttgttttattcagggtttcccaaagagacaaaacccacagaagattggtagatataaagattagatagatgatagatagatagatagatagatagatagatagatagatagatagatagatagatataaaatttattaggggaaatgactcatgctgttatggatattaagtctcaggataatctgactgtaagac

SEQ ID NO: 12770 - DNA, 265 bp, Homo sapiens
  chr7.fa.O7frz.114085486
  Located on chromosome 7
  Distance between a terminus base of telomere on chromosomal short arm and 5'-terminus of this base sequence : 112641794
  Distance between 3'-terminus of neighbour sequence of sequence listing upward to telomere on chrosomal short arm and 5'-terminus of this base sequence : 124817
ttccagatctaaagaatgaactagaagaaacacaagaatgaacttgagataatatactaagagaaataagataaatggaaaaattatgaaagttaaaataaatgaagatatatacaagatacaagagacagtgacagacacagaataagtaaaagtaaaatcatatatatatatatatatatatgtatatatatatataggaaggaaaacagcaaaatgcagtagaacaaatacaaaaaattttaatcctacaaacttggaaata

SEQ ID NO: 12771 - DNA, 464 bp, Homo sapiens
  chr7.fa.O7frz.114175166
  Located on chromosome 7
  Distance between a terminus base of telomere on chromosomal short arm and 5'-terminus of this base sequence : 112730236
  Distance between 3'-terminus of neighbour sequence of sequence listing upward to telomere on chrosomal short arm and 5'-terminus of this base sequence : 88177
acttgcatactggctgtattagttaggttctccagagaaactgaaccaacagtatgtgtgtgtgtgtgtgtgtgtgtgcgtgtgtgtgtgtgtgtgtgtgtgtgtgtgtgtgtgtgtatatgtatatatatatatagagagagagagagagaaagagagatttatctttaaggaattagcacatgtgattatggaggcttggcaagtccaaaatctgacaagggaggtcagccgactggagacccaggaaaaagttgcagttcgttgcagttcgagtccaaaggcagactgctggtgaaccaggaagagtcaatgttgcaggtgaggtctgaagacgatctgctggtgtgttccttcttactcaggggaagtcatcctgttgttctattcaggccttcaactgattgaagaggcttacccacattacagacagtaatctgctttactgaaagtcgatcaattta

SEQ ID NO: 12772 - DNA, 101 bp, Homo sapiens
  DISO7_10002318
  Located on chromosome 7
  Distance between a terminus base of telomere on chromosomal short arm and 5'-terminus of this base sequence : 112795945
  Distance between 3'-terminus of neighbour sequence of sequence listing upward to telomere on chrosomal short arm and 5'-terminus of this base sequence : 65245
ggcagacagttagggtgggtcctcagttaatttgtttcaaacaaacaaacaaacaaacaaacaaaaaaccagcctaaaaaatcaagttgctggcacaaata

SEQ ID NO: 12773 - DNA, 186 bp, Homo sapiens
  DISO7_10002319
  Located on chromosome 7
  Distance between a terminus base of telomere on chromosomal short arm and 5'-terminus of this base sequence : 112863573
  Distance between 3'-terminus of neighbour sequence of sequence listing upward to telomere on chrosomal short arm and 5'-terminus of this base sequence : 67527
caagaacacaagatagtacatcatgtctgatttttcaaaagaaaagcagccaaagagaaatggccaaaaaggtaagaggctttcatttgaaagtgtgtgtgtgagtgtggggtgtgtgtgtgtgtgtgtgtgtgtgtggttagtagaagacgaaaaaagacaaaatagggcgggaatatagacagc

SEQ ID NO: 12774 - DNA, 101 bp, Homo sapiens
  DISO7_10002320
  Located on chromosome 7
  Distance between a terminus base of telomere on chromosomal short arm and 5'-terminus of this base sequence : 112885152
  Distance between 3'-terminus of neighbour sequence of sequence listing upward to telomere on chrosomal short arm and 5'-terminus of this base sequence : 21393
tttacgagtgcataatgcttaagtcagctgtgtgtgtgtgtgtgtgtgtgtgtgtgtgtggttctgatctaatacagcttgtatgtgtagcttaaagtgtg

SEQ ID NO: 12775 - DNA, 131 bp, Homo sapiens
  DISO7_10002321
  Located on chromosome 7
  Distance between a terminus base of telomere on chromosomal short arm and 5'-terminus of this base sequence : 112912192
  Distance between 3'-terminus of neighbour sequence of sequence listing upward to telomere on chrosomal short arm and 5'-terminus of this base sequence : 26939
ctggtggtatggattgtatttcaaaaggaatttttcttttaaagacagtgtgtatgtgtgtatgtgtgtatgtgtgtgtgtgtgtgtgtgtgtgtgtgtgtgtgtgtgcctgtgtctgtgttggtaagtac

SEQ ID NO: 12776 - DNA, 287 bp, Homo sapiens
  AC005161.1_10241
  Located on chromosome 7
  Distance between a terminus base of telomere on chromosomal short arm and 5'-terminus of this base sequence : 112962022
  Distance between 3'-terminus of neighbour sequence of sequence listing upward to telomere on chrosomal short arm and 5'-terminus of this base sequence : 49699
atcatttggtgaggaaactattatatcagaaactgtgaagggtctgagattttatctttcttccaagtgaacaatttagactgccacaggatggatgggtggatggaaggatggatggatggatggatggatggatggatggatggatggatgtatacacatatatagccataaacatccatattaaaattatgaatattgcttgattcacacacatacatatacatacacacaagaaacatgaggcctctgagtcatagacaaatacagttcattactcacagcaa

SEQ ID NO: 12777 - DNA, 309 bp, Homo sapiens
  AC005161.1_26159
  Located on chromosome 7
  Distance between a terminus base of telomere on chromosomal short arm and 5'-terminus of this base sequence : 112978023
  Distance between 3'-terminus of neighbour sequence of sequence listing upward to telomere on chrosomal short arm and 5'-terminus of this base sequence : 15714
ctgaataccaggttcttgtgaggtttgtgtgtgtgtgtgtgtgtgtgtgtgtaaccaagctgaaaattcagtgatacggagagacaagcatgacgtattagatgagcaagactaactaaatcaagccgagacaaagaacacctggtgtatattattttgactaaggatttcttcgtttttcttatttcccaagcccatttttctgtttgaaacaaaagaggcatgaaatttatagattcagtaattacaggaatagtaattatgttggatgaagacaaccctttgagctagtttagcgataagcaccaa

SEQ ID NO: 12778 - DNA, 197 bp, Homo sapiens
  AC005161.1_60521
  Located on chromosome 7
  Distance between a terminus base of telomere on chromosomal short arm and 5'-terminus of this base sequence : 113012301
  Distance between 3'-terminus of neighbour sequence of sequence listing upward to telomere on chrosomal short arm and 5'-terminus of this base sequence : 33969
cttaactaatggtccatactcctttaaaaaaaaaagattaattctgattgggctgatcctgatctggaaaattagaaaaataaaatataaatatgtcatgaatgataaaatatatatatatatatatatatagtatcaagggttcatgttggaaaaaccctgagttctttggtttgtctgaaatgtggtttaatgga

SEQ ID NO: 12779 - DNA, 213 bp, Homo sapiens
  AC006392.1_13341
  Located on chromosome 7
  Distance between a terminus base of telomere on chromosomal short arm and 5'-terminus of this base sequence : 113060738
  Distance between 3'-terminus of neighbour sequence of sequence listing upward to telomere on chrosomal short arm and 5'-terminus of this base sequence : 48240
ccgtagacagatgaatggatacacaaaatgtggcatatatatatatatatatatatatatatatgtatatatatgcaccaagttcatgtatatatatgccaaatatatatatatatgaacttcaaatatttttcaagtattagtaaaagggaatcctgtcacatgcaacaacatgaatgaacctcgacagtattatgctgagttaagccagtt

SEQ ID NO: 12780 - DNA, 444 bp, Homo sapiens
  AC006392.1_93881
  Located on chromosome 7
  Distance between a terminus base of telomere on chromosomal short arm and 5'-terminus of this base sequence : 113141144
  Distance between 3'-terminus of neighbour sequence of sequence listing upward to telomere on chrosomal short arm and 5'-terminus of this base sequence : 80193
atcagtagcaatgagcatacctagtgcccagaccttggtttctaacatcactccccaataaaaggcatccatgctccttgagaaaagggatgcttctaggacaagaacaggaaatataaaaagtgagcctggaacattttgtagtgctagaaaataaggggtgtaggggtgtgtgtgtgtgtgtgtgtgtgtgtgagagaaagagaaatcctatattgatgtggatatgtcaaagggacaccaaagccaactaaaacagctcccaatggccaaagctgaaataatttaatgaccaaaattttaaaaacatatcggattataacaaaaagtgtaaaataaatatccacaagcctacacagatataaataaatgactgaatacataaatgaatgaagataaagaggcaagtatatccaacggaggaaatccaaatgatttatgcct

SEQ ID NO: 12781 - DNA, 411 bp, Homo sapiens
  AC004142.1_25271
  Located on chromosome 7
  Distance between a terminus base of telomere on chromosomal short arm and 5'-terminus of this base sequence : 113330305
  Distance between 3'-terminus of neighbour sequence of sequence listing upward to telomere on chrosomal short arm and 5'-terminus of this base sequence : 188717
aatcagatggtgtttctgaatatgtaaaataaatttctttaaaagatttggaggcataaaagctagatttaattgcagatttaaaagatggtttaatatcagaaaatttattatattaaatgcaagaaaaataattgttaaattaaatattcatttgagataaaaagttttctgtattactcaggcttctccagagaaacatgatggatggatggatggatggatggatggatggatggatggatggatacagagggagagagagagaagacagacagagactgatagatatacacacacatatatttactgtaaggtataggctcaagtgatcatggaagtaaagtcccataattttccaactgaaagctggagcctcaggaaagacagtgatgtagtctgaagacctga

SEQ ID NO: 12782 - DNA, 377 bp, Homo sapiens
  AC004142.1_16888
  Located on chromosome 7
  Distance between a terminus base of telomere on chromosomal short arm and 5'-terminus of this base sequence : 113338862
  Distance between 3'-terminus of neighbour sequence of sequence listing upward to telomere on chrosomal short arm and 5'-terminus of this base sequence : 8146
gtgcaaagaggtaattcaataaacactagcaatgcgtgtgtgtgtgtgtgtgtgtgtgtgtgtgtgtgtgtgtgtatcagcccgaaacctcagaattgctagtttttttaaccacttactattaatgtcatactcaacccggattttacataccaacaatttaccaacacactaacagtttacaaaacatccagttctacgcggttgcctttattacaaagtaacttctttccacactgatgacagatataatcaaatagaaacacaaattaattcttaatatttttataatacttttttaaaactactgatttaataaccctcaatttccctttgaaaggaaataccgagagtatttaatgtatcctgaccatgaa

SEQ ID NO: 12783 - DNA, 290 bp, Homo sapiens
  AC004142.1_14839
  Located on chromosome 7
  Distance between a terminus base of telomere on chromosomal short arm and 5'-terminus of this base sequence : 113340774
  Distance between 3'-terminus of neighbour sequence of sequence listing upward to telomere on chrosomal short arm and 5'-terminus of this base sequence : 1535
caaaggtacatgtcttaggcttagggttactgaggaaggtggatgatgaaaaacttctttgaagaagaaatgctggaattgataactaatgaatgggtgcaaattaatgggaagggagtgacatctgacaaaggcaacaaaatgtacagaagccctatgatgtaggtaaataagtagtggctgtgtgtgtgtgtgtgtgtgtgtgtgtgtgtacatataaacaaaaagaaagcttttataatactgaaaccaataaattttcagatgtcctatcagcaatcagattactt

SEQ ID NO: 12784 - DNA, 390 bp, Homo sapiens
  AC006002.1_24365
  Located on chromosome 7
  Distance between a terminus base of telomere on chromosomal short arm and 5'-terminus of this base sequence : 113379698
  Distance between 3'-terminus of neighbour sequence of sequence listing upward to telomere on chrosomal short arm and 5'-terminus of this base sequence : 38634
gacctatcaaatgcaaactcaccacacagaaatgctatcctaaagtatatcatcaaaatccactcagaaattttcctggagttgcaccatttttggctacctatacctgctctaaggagaagctcttatcatgttctgatttgagaatacctctttcaatattggctaactcttcttgtctttcaagattcagggcaggcatcactctttggtactgcatgttattatattaacctatacaaaccctattcctattgtaccatctttgtgtgtgtgcatgcatgtgtgtctgtgtgtgtgtgtgtgtgtgtgtgtgtgtgtgtgtgtgtatcctccccactgatttgaaaatcaccgattttcttttcctagtgcctacaatgtagctgc

SEQ ID NO: 12785 - DNA, 212 bp, Homo sapiens
  AC003989.1_15814
  Located on chromosome 7
  Distance between a terminus base of telomere on chromosomal short arm and 5'-terminus of this base sequence : 113447337
  Distance between 3'-terminus of neighbour sequence of sequence listing upward to telomere on chrosomal short arm and 5'-terminus of this base sequence : 67249
ttgcagtatctaactgaaggtattaattaagttatttggatggaaggatggatggatggatggatggatggatggatggatggatggatggatgaaatggaccaatgaatgggcagatggatggacagttgaatgggcaggtaggctgacaaataaaagaatcaaccattcagcaagatgagccaagtctgacctcaaattagttaaaccta

SEQ ID NO: 12786 - DNA, 153 bp, Homo sapiens
  HUMUT6596
  Located on chromosome 7
  Distance between a terminus base of telomere on chromosomal short arm and 5'-terminus of this base sequence : 113606743
  Distance between 3'-terminus of neighbour sequence of sequence listing upward to telomere on chrosomal short arm and 5'-terminus of this base sequence : 159194
tgcacatagcctataatgaaacttcttagcctccatgatcacatgacccaattcccctaataaattccctctcatagatagatacatagatagatagatagatagatagatagacagacagacagataaatatcctattcgttctgtctctcc

SEQ ID NO: 12787 - DNA, 312 bp, Homo sapiens
  AC005166.1_57357
  Located on chromosome 7
  Distance between a terminus base of telomere on chromosomal short arm and 5'-terminus of this base sequence : 113606743
  Distance between 3'-terminus of neighbour sequence of sequence listing upward to telomere on chrosomal short arm and 5'-terminus of this base sequence : -153
tgcacatagcctataatgaaacttcttagcctccatgatcacatgacccaattcccctaataaattccctctcatagatagatacatagatagatagatagatagatagatagacagacagacagataaatatcctattcgttctgtctctccggtgagatctaattataatataatttcttaatttttcttttaaaagcaagcctgtaaaactacattaataaaataaaagtgaacatataacatattgatttaattcagaattacactaggttgttaatttttcattctcctaatcttaactgcatgttc

SEQ ID NO: 12788 - DNA, 420 bp, Homo sapiens
  AC005166.1_99656
  Located on chromosome 7
  Distance between a terminus base of telomere on chromosomal short arm and 5'-terminus of this base sequence : 113648837
  Distance between 3'-terminus of neighbour sequence of sequence listing upward to telomere on chrosomal short arm and 5'-terminus of this base sequence : 41782
tcaggatgttcaagaccagcctggccaacatggtgaaaccccgtctctactaaaaaaacaaaaattagccaggtgtggtggcgcatgcctgtagtcccagctactcgggaggctaaagcaggagaattgcttgaacctgagagacggaggttgcagtgagcagatcatgccactgcactccagccttggcgacagaacaagactccatctcacaaaaagaaaagaaaaggaaggaaggaaggaaggaaggaaggaaggaaggaaggaaggaaggaaggaaggaaggagggagaaagaaagaaagaaagaaagaaagaaagaaagaaagaaagaaagaaagaaagaaagaaagaaagaaagaaagagaacatacgtcgattactacatatatatctgtatattgaacttcaggaagttgac

SEQ ID NO: 12789 - DNA, 210 bp, Homo sapiens
  AC003077.1_57446
  Located on chromosome 7
  Distance between a terminus base of telomere on chromosomal short arm and 5'-terminus of this base sequence : 113901096
  Distance between 3'-terminus of neighbour sequence of sequence listing upward to telomere on chrosomal short arm and 5'-terminus of this base sequence : 251839
catttaacataaggctgaagaaagataacataggtgaagtttttcaatataattaagcaaaaaagcaagtgcaatacagtatgtataggaatatttttaatttaaaaaatacacacacacacacacacacacacacacatatatcttagtctagagtattatatccctaatgttaaccacagaggttatctctggatggtgagattacgg

SEQ ID NO: 12790 - DNA, 165 bp, Homo sapiens
  AC003080.1_73666
  Located on chromosome 7
  Distance between a terminus base of telomere on chromosomal short arm and 5'-terminus of this base sequence : 114015548
  Distance between 3'-terminus of neighbour sequence of sequence listing upward to telomere on chrosomal short arm and 5'-terminus of this base sequence : 114242
catagcatgtaaaccactgtacactgtcccagcggctttatctattttttatatatatgcatgtatgtgtgtgtgtgtgtgtgtgtgtgtgtgcacgtgtattgcgtatacacacacacacaagctggatatttgttaagagttatggaaccaaataaaatttcc

SEQ ID NO: 12791 - DNA, 426 bp, Homo sapiens
  AC003080.1_104467
  Located on chromosome 7
  Distance between a terminus base of telomere on chromosomal short arm and 5'-terminus of this base sequence : 114046312
  Distance between 3'-terminus of neighbour sequence of sequence listing upward to telomere on chrosomal short arm and 5'-terminus of this base sequence : 30599
gactgttaaggttcttgaggactggatctaggactggctgatatttgagtttcctttagtactttgaatgctgtggatgcttaaaaactgtcagtggtatgaatggatggatggatggatggatggatggatggatggatggatggacggatggatggatgtccctctgcctggtaactcataatgatttgtaagcatgtggttctgttatccatccttactgccactactctcccagattggctggggaaaagttccttcatctgaacatatgtgtaaattcactactttattagccatgaatgcatcctcccaagaggcctgaacatcaagattctgtacactatcaatcaaaatctcccacagcgcaggttctgtttcctagtgatcaagtctgaggcagataattcataattgtttgctcac

SEQ ID NO: 12792 - DNA, 279 bp, Homo sapiens
  AC004111.1_97310
  Located on chromosome 7
  Distance between a terminus base of telomere on chromosomal short arm and 5'-terminus of this base sequence : 114313559
  Distance between 3'-terminus of neighbour sequence of sequence listing upward to telomere on chrosomal short arm and 5'-terminus of this base sequence : 266821
ccactacacttggtaacaaagatctgtgcccataagatcttttctttaacatctgtaagaactacatgagaaaaacacaaacattaaccaaggttaaaagaaaaaacaaacaacttgcaatataagcagctataaacagtgccctccatggtgaaaaataaagtccacacataagtatcctagcaaaaatttcactacacacacacacacacacacacacacacacacacacacacgcctaacagatggattctaaaaaacagctaagcattccacaat

SEQ ID NO: 12793 - DNA, 229 bp, Homo sapiens
  DISO7_10002324
  Located on chromosome 7
  Distance between a terminus base of telomere on chromosomal short arm and 5'-terminus of this base sequence : 114380803
  Distance between 3'-terminus of neighbour sequence of sequence listing upward to telomere on chrosomal short arm and 5'-terminus of this base sequence : 66965
ctaagcagctgggagtagcaaaaaataaaataaaaataaaaataaaataaaatacaaaacatatcccagccatacattagaatctctgtgtaaaaaaatcagcatattttcaaagctcccaagttgattcatacatactgttaggattgagaattgttgcctgaaagtaaaaataatggtattcattaggatgtcattttcagtaaagttccatttagacattccattg

SEQ ID NO: 12794 - DNA, 396 bp, Homo sapiens
  chr7.fa.O7frz.116267218
  Located on chromosome 7
  Distance between a terminus base of telomere on chromosomal short arm and 5'-terminus of this base sequence : 114648564
  Distance between 3'-terminus of neighbour sequence of sequence listing upward to telomere on chrosomal short arm and 5'-terminus of this base sequence : 267532
atgcttcacatagaatagctgtactaaagatacagaaagcatttagagtgtggggggcgtgtgtgtgtgtgtgtgtgtgtgtgtgtgtgtgtgtgtatatatgtgtcagcctgggtgacacgagtgggaccttgtctcaaaagcaaaacagagaaaagaatattgctgcttgtttgcccattaggtgtatttctttcattttatgaaacatattttgacaacacgttaaaatttaatatgtacatatatattttacgtataattctatcttaatataggaacggtgttcattatttgtttctttttattctttggagtttttatgtttaagaataagtatttacatagtccttttgtatcagataatagcctgctaagtgaagtaccagactcgtt

SEQ ID NO: 12795 - DNA, 289 bp, Homo sapiens
  chr7.fa.O7frz.116389089
  Located on chromosome 7
  Distance between a terminus base of telomere on chromosomal short arm and 5'-terminus of this base sequence : 114770364
  Distance between 3'-terminus of neighbour sequence of sequence listing upward to telomere on chrosomal short arm and 5'-terminus of this base sequence : 121404
agctgaattcaatacagtttaaagttgtttctttcaagagttaactcatttttctgggcttcagacattgaacaagtaatggcctggccttatccaaaacttgtgtgtatatatatatatatatatatacacacacacacacacacacacacacacatatgtgtatgtgtatgtgtgtgtgtgtgtgtgtatatatgaccaattttagatttcaagatacctactctcctgaataataacatagttggggaagtgaggatacacggacttcatcttgtaatggaagatg

SEQ ID NO: 12796 - DNA, 227 bp, Homo sapiens
  AC002466.1_77446
  Located on chromosome 7
  Distance between a terminus base of telomere on chromosomal short arm and 5'-terminus of this base sequence : 114984151
  Distance between 3'-terminus of neighbour sequence of sequence listing upward to telomere on chrosomal short arm and 5'-terminus of this base sequence : 213498
tatgctggtgagctaagtataaagagattccacaaaataataaactgttaatggtgtactgatacaaagacatacacacacacgtaattaggatataggagatctatctatctatctatctatctatctacctatctatctgtctatcatctatctatctatctatctatctatctatctatctatctatcatctatctatctatctcatctccttgtttgatgtaa

SEQ ID NO: 12797 - DNA, 246 bp, Homo sapiens
  AC002466.1_33799
  Located on chromosome 7
  Distance between a terminus base of telomere on chromosomal short arm and 5'-terminus of this base sequence : 115027763
  Distance between 3'-terminus of neighbour sequence of sequence listing upward to telomere on chrosomal short arm and 5'-terminus of this base sequence : 43385
tgagatactattgaaggttgctaacatttgttcccctatcttctgatttcttttgacattggatttagtagaagtctaagaccagtctgacatttcacctctcattatttatatacacatatacatgtgcgtgcacacgcacacacacacacacacacacacacaattttttctggctaaagaataatttctttacctacaaagtttaaaatttcgtctggactttcttggtttagattgctgtag

SEQ ID NO: 12798 - DNA, 358 bp, Homo sapiens
  AC002461.1_145487
  Located on chromosome 7
  Distance between a terminus base of telomere on chromosomal short arm and 5'-terminus of this base sequence : 115153066
  Distance between 3'-terminus of neighbour sequence of sequence listing upward to telomere on chrosomal short arm and 5'-terminus of this base sequence : 125057
aaaggatgcttattccttgaaggagagttttattgccagtggaaactgtacaatattaatgtggaaacttaatttctagggcaaactaaacaaaacaaaagcaagaaactaaagaaaggctctccacatactggggtagtgagaaatgcccactcccctgacacacacagacacacacacacacacacacacacactcatgcacagcaggaagtatgaaggataagagagatgtgaacaggatttattgttgcctcatgttctgtaggcactgtgaaaaacactttataaactgtgagctctcacaagttttaacaaatttggatggtgatccagtgcatctgatctaagaactgatt

SEQ ID NO: 12799 - DNA, 289 bp, Homo sapiens
  AC002461.1_123934
  Located on chromosome 7
  Distance between a terminus base of telomere on chromosomal short arm and 5'-terminus of this base sequence : 115174648
  Distance between 3'-terminus of neighbour sequence of sequence listing upward to telomere on chrosomal short arm and 5'-terminus of this base sequence : 21224
aatctttatctggtatggcaacttctgcgctttgatggaaatatttagagcatatatgtacatttagtctaattttctttttggtggtatttaattctcccttcatggtgttagttttatattttctcatctccttccttccttccttccttccttccttccttcctgctctgtcactcagtctggaatgcagtgacatgatctcagctcacagcaacctccgcctcccaggttcaagtgattctcctgcctcagcctcccatgtagcttgaactacaggcatcactac

SEQ ID NO: 12800 - DNA, 206 bp, Homo sapiens
  AC002461.1_52791
  Located on chromosome 7
  Distance between a terminus base of telomere on chromosomal short arm and 5'-terminus of this base sequence : 115245779
  Distance between 3'-terminus of neighbour sequence of sequence listing upward to telomere on chrosomal short arm and 5'-terminus of this base sequence : 70842
attaggatcttggataacgtgatccaaaccccaaaatactgaatataagtcttaatgtagagacttgcacaagagaaagccaaaagtgattttttttctttgtcaagttatatacatatataacttttggcatatatatgtgtgtatatatatgtgtgtgtgtgtgtgtgtgtgtgtgtatgtaatagttccaggtgattcagata

SEQ ID NO: 12801 - DNA, 187 bp, Homo sapiens
  AC002461.1_34913
  Located on chromosome 7
  Distance between a terminus base of telomere on chromosomal short arm and 5'-terminus of this base sequence : 115263720
  Distance between 3'-terminus of neighbour sequence of sequence listing upward to telomere on chrosomal short arm and 5'-terminus of this base sequence : 17735
aagaacatacaaagtcgaccttacttcaggttcaagtgacctattcaaccccacatagcgcctctctctttctctttcactctctctcagtgtgtgtgtgtgtgtgtgtgtgtgtgcgcgcgcgtgtgtgtgcgccagttggatggtgagaataatggttgaagggtatgttcaggattccacttca

SEQ ID NO: 12802 - DNA, 237 bp, Homo sapiens
  AC002461.1_3601
  Located on chromosome 7
  Distance between a terminus base of telomere on chromosomal short arm and 5'-terminus of this base sequence : 115295064
  Distance between 3'-terminus of neighbour sequence of sequence listing upward to telomere on chrosomal short arm and 5'-terminus of this base sequence : 31157
tacaatgaatagaagtggcgagtgtgggtatccttgttttgttcctgatcttttatatatatatatatatatatatatatatatttaattatactttaagttctagggtacatgtgcacaacatgcaggtttgtaggagatatacctaatagttcctgatcttagagaaaaaactttcaacttttcacagttgaatttgatcttagctatgggcctgtcacatatggcctttatcgt

SEQ ID NO: 12803 - DNA, 267 bp, Homo sapiens
  DISO7_10002334
  Located on chromosome 7
  Distance between a terminus base of telomere on chromosomal short arm and 5'-terminus of this base sequence : 115394077
  Distance between 3'-terminus of neighbour sequence of sequence listing upward to telomere on chrosomal short arm and 5'-terminus of this base sequence : 98776
gcttcctatctcacttgaaggaaaagccttagtcatctctcacctctctcatcttgtctcatctcatctcatctcatctcatctcatctcatctcatcatctcatctcacctcatctcactcttccttctgctgatacgctcaagccacacagcccttcctctccctcaaacataccggatgcagtcttaagagatatatgaatactaccttttctaacactatgatgatataatagtaggtgctattataattgcaaagtaatgga

SEQ ID NO: 12804 - DNA, 168 bp, Homo sapiens
  DISO7_10002336
  Located on chromosome 7
  Distance between a terminus base of telomere on chromosomal short arm and 5'-terminus of this base sequence : 115476945
  Distance between 3'-terminus of neighbour sequence of sequence listing upward to telomere on chrosomal short arm and 5'-terminus of this base sequence : 82601
ccatctaaggttgagctttattctaagttcatatatatatatatatatatatatatatatatatatatatatatctgctgttttatctgctgtttaaagtttttcattttctaggtataatctttttgtttgtttgtttgttttggaatctatcactttaagtcctga

SEQ ID NO: 12805 - DNA, 241 bp, Homo sapiens
  D7S2502
  Located on chromosome 7
  Distance between a terminus base of telomere on chromosomal short arm and 5'-terminus of this base sequence : 115749457
  Distance between 3'-terminus of neighbour sequence of sequence listing upward to telomere on chrosomal short arm and 5'-terminus of this base sequence : 272344
ccagtggttttagtcatttgttttggttacacacacacacacacacacacacacactgtctcctctaagttagtttaacttctgtcaaattgttctgaaaatgtaggaatatattcaaggttacataaaatgttaatagcatcagtaattctgtttatataacatacttatatcaatctttacctaccttataaaaggtgtgaatatatctaaattaaatttccaaccatgagcatacatg

SEQ ID NO: 12806 - DNA, 101 bp, Homo sapiens
  DISO7_10002340
  Located on chromosome 7
  Distance between a terminus base of telomere on chromosomal short arm and 5'-terminus of this base sequence : 115965982
  Distance between 3'-terminus of neighbour sequence of sequence listing upward to telomere on chrosomal short arm and 5'-terminus of this base sequence : 216284
ctgctctccctccttctatctgttacacacacactaacacgcacaggcatgcatacacacacacacacacacacacacacagcaaccagagtggttctctt

SEQ ID NO: 12807 - DNA, 188 bp, Homo sapiens
  DISO7_10002341
  Located on chromosome 7
  Distance between a terminus base of telomere on chromosomal short arm and 5'-terminus of this base sequence : 115970690
  Distance between 3'-terminus of neighbour sequence of sequence listing upward to telomere on chrosomal short arm and 5'-terminus of this base sequence : 4607
gggagtaggcagatagttgaagatgataataactttgataaccatgatttggggataaaaactaaaacaaaagaaaattctgtgtgtgtgtgtgtgtgtgtgtgtgtgtctgtgtgtgtgtgtgttcatcagtattatgattcttgttctcaagatatatgccaaaagcaccttccagaatctatctg

SEQ ID NO: 12808 - DNA, 102 bp, Homo sapiens
  DISO7_10002343
  Located on chromosome 7
  Distance between a terminus base of telomere on chromosomal short arm and 5'-terminus of this base sequence : 116094383
  Distance between 3'-terminus of neighbour sequence of sequence listing upward to telomere on chrosomal short arm and 5'-terminus of this base sequence : 123505
aacacagaggcaacatatgtggcacacacacacacacacacacacacacacaaaacaccaaacaaacaaaaagaaaggcctgttgatctatttctgaagaga

SEQ ID NO: 12809 - DNA, 142 bp, Homo sapiens
  D7S486
  Located on chromosome 7
  Distance between a terminus base of telomere on chromosomal short arm and 5'-terminus of this base sequence : 116186056
  Distance between 3'-terminus of neighbour sequence of sequence listing upward to telomere on chrosomal short arm and 5'-terminus of this base sequence : 91571
gcccaggtgattgatagtgcgacactccgtctcaaaaaaaatatatatatatgtgtgtgtgtgtgtgtgtgtgtgtgtgtgtgtgtgtgtagcatcatttcttttatgtttactttctcagtgggatataccattggccttt

SEQ ID NO: 12810 - DNA, 232 bp, Homo sapiens
  AC002066.1_149108
  Located on chromosome 7
  Distance between a terminus base of telomere on chromosomal short arm and 5'-terminus of this base sequence : 116277141
  Distance between 3'-terminus of neighbour sequence of sequence listing upward to telomere on chrosomal short arm and 5'-terminus of this base sequence : 90943
gtaaggaaacagaggatttaaacagcccaataaaccaaccagatctattagatctaatatatatatatagtgtgtgtgtgtgtgtgtgtgtgtgtgtgtgtgtgtatatatatatatacacacacacacacacacacacacacacacacacagaacattctacccaacaacaatgtacacattcttctcaattgtatctgggatgtttttcaggattcactacatattaggc

SEQ ID NO: 12811 - DNA, 378 bp, Homo sapiens
  AC002066.1_101918
  Located on chromosome 7
  Distance between a terminus base of telomere on chromosomal short arm and 5'-terminus of this base sequence : 116324350
  Distance between 3'-terminus of neighbour sequence of sequence listing upward to telomere on chrosomal short arm and 5'-terminus of this base sequence : 46977
gtgcttgttatctacaagccagttccctcctcagatccctgacacaacatcacaccacacacacacacacacacacacacacacactcacttggcttctgtcatctgaaaaatgggataatgctttttaatgtttaacataaagttttaatgtttaacatagttaaagtaaattttaaaacaactgagaaaatacatatcataattataccaagtttggggtgaaggaaagacaagctgatgatatgtctttcattgtatcaacaatgaagtatttattcaacaaatattcaaggagcatattttggatgttaggctcctggaagaaaacaagaatgagatggaaagagtgagggcaatctaaaggtgaaatggaagg

SEQ ID NO: 12812 - DNA, 440 bp, Homo sapiens
  AJ133269.1_55758
  Located on chromosome 7
  Distance between a terminus base of telomere on chromosomal short arm and 5'-terminus of this base sequence : 116330006
  Distance between 3'-terminus of neighbour sequence of sequence listing upward to telomere on chrosomal short arm and 5'-terminus of this base sequence : 5278
ttaaattggtggactttgaataaggcagagtggcctccgtaatgtggataagccccatccaattagttgaacctcataatagaacaaaggctgacctctcccaaggaagaaggaattttgccaggggaatgcttttggatttgaatggcaacacttccgtaagtctccagcccactggcctgccccatcagattttggatttatcaagcctccacaaccaactgagccagtttcttaaaataaatctctctctctctctctgtcctctgtatctttctatgtatacacacacacacacacacacacacacacacacagtttgttccacttcttagagaaccctaattcacagggcaattgccccatctcaaaatctttaactaaatcacaccagcaaagttccttttgctgtgaaggtaacatactagctgattccagga

SEQ ID NO: 12813 - DNA, 243 bp, Homo sapiens
  AC002066.1_96031
  Located on chromosome 7
  Distance between a terminus base of telomere on chromosomal short arm and 5'-terminus of this base sequence : 116330203
  Distance between 3'-terminus of neighbour sequence of sequence listing upward to telomere on chrosomal short arm and 5'-terminus of this base sequence : -243
gatttatcaagcctccacaaccaactgagccagtttcttaaaataaatctctctctctctctctgtcctctgtatctttctatgtatacacacacacacacacacacacacacacacacagtttgttccacttcttagagaaccctaattcacagggcaattgccccatctcaaaatctttaactaaatcacaccagcaaagttccttttgctgtgaaggtaacatactagctgattccagga

SEQ ID NO: 12814 - DNA, 217 bp, Homo sapiens
  D7S522
  Located on chromosome 7
  Distance between a terminus base of telomere on chromosomal short arm and 5'-terminus of this base sequence : 116363936
  Distance between 3'-terminus of neighbour sequence of sequence listing upward to telomere on chrosomal short arm and 5'-terminus of this base sequence : 33490
gccaaactgccacttctctcagatgtggattctcccattccactgtccctgtgtcatatgagcctcctaacttccaagattcaagatgagtggcaggacatgagatgactgattcgcatactcccacttaaagttagttgtatcatgtcctactcacacacacacacacacacacacacactccagactcccaatgtgagggagtggcataacacgt

SEQ ID NO: 12815 - DNA, 311 bp, Homo sapiens
  AC002066.1_62237
  Located on chromosome 7
  Distance between a terminus base of telomere on chromosomal short arm and 5'-terminus of this base sequence : 116364035
  Distance between 3'-terminus of neighbour sequence of sequence listing upward to telomere on chrosomal short arm and 5'-terminus of this base sequence : -118
atgagatgactgattcgcatactcccacttaaagttagttgtatcatgtcctactcacacacacacacacacacacacacactccagactcccaatgtgagggagtggcataacacgtggtccctacaatgcttctaacttacttattttctaagctctccattcctatgaaatcattttatccagtatgaaattcacaaagagaaacttactgcttcttggccttttgctaaagagcaagtgcagaaagacacacatattctctttggcagtgggcctacatcaaatcgttatggtctcgtaccaagatg

SEQ ID NO: 12816 - DNA, 169 bp, Homo sapiens
  AJ133269.1_107452
  Located on chromosome 7
  Distance between a terminus base of telomere on chromosomal short arm and 5'-terminus of this base sequence : 116381941
  Distance between 3'-terminus of neighbour sequence of sequence listing upward to telomere on chrosomal short arm and 5'-terminus of this base sequence : 17595
ttggtcaattattgccaattagaattagtcagaaatatgcacacacacacacacacacacacacacacacacacacaggacaaaacatatctctgcatagttcaactttgttccaaaaggaaataataatcaatccctaaaacaacagaaatgtcactagcctgtcaaa

SEQ ID NO: 12817 - DNA, 169 bp, Homo sapiens; identical to SEQ ID NO: 12816
  AC002066.1_44336
  Located on chromosome 7
  Distance between a terminus base of telomere on chromosomal short arm and 5'-terminus of this base sequence : 116381941
  Distance between 3'-terminus of neighbour sequence of sequence listing upward to telomere on chrosomal short arm and 5'-terminus of this base sequence : -169

SEQ ID NO: 12818 - DNA, 161 bp, Homo sapiens
  AC002066.1_32239
  Located on chromosome 7
  Distance between a terminus base of telomere on chromosomal short arm and 5'-terminus of this base sequence : 116394019
  Distance between 3'-terminus of neighbour sequence of sequence listing upward to telomere on chrosomal short arm and 5'-terminus of this base sequence : 11909
ttgcagttaagaattccatagatctttttttttagaaactgacaaggtgattctctctctctctttctcacacacacacacacacacacacacacatcttagattactatatatttgtgaaaaacatacatatatttgtacatgcgtgtacaaagaatgta

SEQ ID NO: 12819 - DNA, 161 bp, Homo sapiens; identical to SEQ ID NO: 12818
  AJ133269.1_119559
  Located on chromosome 7
  Distance between a terminus base of telomere on chromosomal short arm and 5'-terminus of this base sequence : 116394019
  Distance between 3'-terminus of neighbour sequence of sequence listing upward to telomere on chrosomal short arm and 5'-terminus of this base sequence : -161

SEQ ID NO: 12820 - DNA, 361 bp, Homo sapiens
  AJ133269.1_123237
  Located on chromosome 7
  Distance between a terminus base of telomere on chromosomal short arm and 5'-terminus of this base sequence : 116397598
  Distance between 3'-terminus of neighbour sequence of sequence listing upward to telomere on chrosomal short arm and 5'-terminus of this base sequence : 3418
gagccatcatttcaaccacttaggaaaaatggagagaagaaagtcacgttcaattattatttgacactaacaccacatacaaaacaaaaataagtttaagataacatctataagtataaatgctatataaatactagaaaatatttaatgtgtgtgtgtgtgtgtgtgagagagagagagagagagagagagagagagagagagagagacagagagaggagattgcttactatttggtataacttgcaaaaaaaaatattcatttggttgtagggcaaacctagattggaaggataagaatcattgcacttcacttcctccaggatccatctgtcatctttggcttagagacagataactg

SEQ ID NO: 12821 - DNA, 314 bp, Homo sapiens
  AJ133269.1_133819
  Located on chromosome 7
  Distance between a terminus base of telomere on chromosomal short arm and 5'-terminus of this base sequence : 116408322
  Distance between 3'-terminus of neighbour sequence of sequence listing upward to telomere on chrosomal short arm and 5'-terminus of this base sequence : 10363
gcataccaacaggacatagactgactgtgtgtgtgtgtgtgtgtgtgtgtgtgtgtgtgtgtgttcatgtgcaagtgtacatgtctatgttttgactgggggtgaaagggaggctatggaatgttttacattccaggaatatctgcatcacaatccagacagtgaaaaatacattttaataggctattaaaaactcactgaaatttcagaagccatcaaaatggtacctacataatttatagtttataatgtatacattttactcttttaaattcctttagtattttcaaaatccaaaggattctgaagtatct

SEQ ID NO: 12822 - DNA, 316 bp, Homo sapiens
  AC002066.1_17968
  Located on chromosome 7
  Distance between a terminus base of telomere on chromosomal short arm and 5'-terminus of this base sequence : 116408322
  Distance between 3'-terminus of neighbour sequence of sequence listing upward to telomere on chrosomal short arm and 5'-terminus of this base sequence : -314
gcataccaacaggacatagactgactgtgtgtgtgtgtgtgtgtgtgtgtgtgtgtgtgtgtgttcatgtgcaagtgtacatgtctatgttttgactgggggtgaaagggaggctatggaatgttttacattccaggaatatctgcatcacaatccagacagtgaaaaatacattttaataggctattaaaaactcactgaaatttcagaagccatcaaaatggtacctacataatttatagtttataatgtatacattttactcttttaaattcctttagtattttcaaaatccaaaggattctgaagtatctta

SEQ ID NO: 12823 - DNA, 414 bp, Homo sapiens
  AJ133269.1_179995
  Located on chromosome 7
  Distance between a terminus base of telomere on chromosomal short arm and 5'-terminus of this base sequence : 116454270
  Distance between 3'-terminus of neighbour sequence of sequence listing upward to telomere on chrosomal short arm and 5'-terminus of this base sequence : 45632
cctatagtttcagcattctatcaggaaactgaagtggatcacttgggcccaagaggtccaggctgcagtgacctatgaatgcaccactgcattccagcttgggtgacagaggacaccctgtcagaaagaaaagaaaaaaagaaaaggaaggaaggaaggaaagaaggaaggaaggaaggaaggaaggaaggaaggaaggaaggaaggaaggaaggaaggaaggaaggaaagaaagaaagaaagaaagaaagaaagaaagaaagaaagaaagaaagaaaagaaaggaaggaaggaaggaaggaaggaaggaaggaagaccctaattatttgtttactcataaataagcttattttaaagcattccaaattttttaacttttattttaggttcaagagtacatgtgcaggtttgtt

SEQ ID NO: 12824 - DNA, 410 bp, Homo sapiens
  AJ133269.1_180046
  Located on chromosome 7
  Distance between a terminus base of telomere on chromosomal short arm and 5'-terminus of this base sequence : 116454274
  Distance between 3'-terminus of neighbour sequence of sequence listing upward to telomere on chrosomal short arm and 5'-terminus of this base sequence : -410
tagtttcagcattctatcaggaaactgaagtggatcacttgggcccaagaggtccaggctgcagtgacctatgaatgcaccactgcattccagcttgggtgacagaggacaccctgtcagaaagaaaagaaaaaaagaaaaggaaggaaggaaggaaagaaggaaggaaggaaggaaggaaggaaggaaggaaggaaggaaggaaggaaggaaggaaggaaggaaagaaagaaagaaagaaagaaagaaagaaagaaagaaagaaagaaagaaaagaaaggaaggaaggaaggaaggaaggaaggaaggaagaccctaattatttgtttactcataaataagcttattttaaagcattccaaattttttaacttttattttaggttcaagagtacatgtgcaggtttgtt

SEQ ID NO: 12825 - DNA, 433 bp, Homo sapiens
  AC002080.1_9177
  Located on chromosome 7
  Distance between a terminus base of telomere on chromosomal short arm and 5'-terminus of this base sequence : 116527051
  Distance between 3'-terminus of neighbour sequence of sequence listing upward to telomere on chrosomal short arm and 5'-terminus of this base sequence : 72367
gccatttagtcctaaattaccttctgctaatcattattactaacacatgggagttccagaacaccctgaagtgggggtattgacctcaaagcatgtgccccttgtgtcagtgggaaagccttcttcaattcataatggtagaataagaaggaactggagagagtgggcaggtttcttcccacctgctggtttctgtccaaggggtgtgtgtgtgtgtgtgtgtgtgtgtgtgtgtgtgtgtgtgtgtgtgtaaagtttgtctttcctttatttgagctctgtcattataagaggaatctagataatagtctcagataataaaatcatctattcacatgcaaggcagtgtctgccatatcaatgccattgtaatatattctgtgcaccacaacttttcatttgaatacttagaagactcttccttgaggtcaac

SEQ ID NO: 12826 - DNA, 394 bp, Homo sapiens
  AC002080.1_14237
  Located on chromosome 7
  Distance between a terminus base of telomere on chromosomal short arm and 5'-terminus of this base sequence : 116532176
  Distance between 3'-terminus of neighbour sequence of sequence listing upward to telomere on chrosomal short arm and 5'-terminus of this base sequence : 4692
cttcagattcaagctgtaacatcaactcttcccagggtctctagtcttccagtttacctactcctcagattttggaattgccaacctccacaattgtttgtcaattccttaaaataaatcaatagatagatgatagatgatagatagatagatagatagatagatagatagatagatagatagatagatgatagatagatagataatagatgatacatagatagatagatagatagatgatagatgatagatagatagatagatagatagataatagatagatagataaacttgttcagtacactatggtttttttcaacacagacctccaaattcctatgtttcttcctctccaagcctgcccctttagtcctgtgttattctgcaagttgat

SEQ ID NO: 12827 - DNA, 173 bp, Homo sapiens
  AC002080.1_45129
  Located on chromosome 7
  Distance between a terminus base of telomere on chromosomal short arm and 5'-terminus of this base sequence : 116563173
  Distance between 3'-terminus of neighbour sequence of sequence listing upward to telomere on chrosomal short arm and 5'-terminus of this base sequence : 30603
aaattcaagatgttcaattctcacccatctgcggtgtgtgtgtgtgtgtgtgtgtgtgtgtatatatatatgtgtgtgtgtgtgtgtgtgtgtgtgtgtgtgtatttatcctgacagtatatgacagatcaaaattttcaattggtgaagtttcctataaacaaggaaagacc

SEQ ID NO: 12828 - DNA, 302 bp, Homo sapiens
  AF046925.1_1070
  Located on chromosome 7
  Distance between a terminus base of telomere on chromosomal short arm and 5'-terminus of this base sequence : 116601865
  Distance between 3'-terminus of neighbour sequence of sequence listing upward to telomere on chrosomal short arm and 5'-terminus of this base sequence : 38519
aacctgttaaggcaactacataatgtgatctaaaaatccagttaacatattgctatggaaaccaggaaatagaaacagcactctaatcattcctttagacaactatggctctgtgtgtgtgtgtgtgtgtgtgtgtgtgtgtgtgtaaaactttttaaattcattaatttattcatcttttattgaaagctgttactgaacccaaaatctgtaattgatctgtccataaataggcccagtgccttattaccagtaaattagtgttttttaatgagctatagtcattgataaattatgccatg

SEQ ID NO: 12829 - DNA, 193 bp, Homo sapiens
  D7S2460
  Located on chromosome 7
  Distance between a terminus base of telomere on chromosomal short arm and 5'-terminus of this base sequence : 116699282
  Distance between 3'-terminus of neighbour sequence of sequence listing upward to telomere on chrosomal short arm and 5'-terminus of this base sequence : 97115
tatctgggactttacgcttctaatatgcatatatatatatatgtgtgtgtgtgtgtgtgtgtgtgtgtgtgtgtatacatatgtgtgtgtgtgtatatatatatatatataactgatagtagttgcttatataagtcactacttaccatgtgtcctttggtatctacatataaaatgagacacagtggatgtg

SEQ ID NO: 12830 - DNA, 443 bp, Homo sapiens
  AC002543.1_112827
  Located on chromosome 7
  Distance between a terminus base of telomere on chromosomal short arm and 5'-terminus of this base sequence : 116834433
  Distance between 3'-terminus of neighbour sequence of sequence listing upward to telomere on chrosomal short arm and 5'-terminus of this base sequence : 134958
atcagtagtggattggcagactaaattatgttataatcacgtcatgggacattatgcagccatttaaaagaatggtgagaaatatatcacttgactttgagggatttccataggatgtttatattgaaagaagccagatgcagagaagagtgtgtgtgtgtgtgtgtgtgtgtgtgtgtgtgtgtgtacgtacacacacacattttcattgcattcttataaaataatgaccagtcgcttctcggccttttggctaagatcaagtgtagtaaaataatgaccaaaaaattctgtgtgtatgcaagtatagacatgtgtatatctttatctgtaagattttatgactatgaaaaaaaatttagaaaggtatatcctgtgttgttagcatgatatatatcagagggatggataagtcccgacatagctaaggagtcaaagactgg

SEQ ID NO: 12831 - DNA, 353 bp, Homo sapiens
  AC002543.1_132289
  Located on chromosome 7
  Distance between a terminus base of telomere on chromosomal short arm and 5'-terminus of this base sequence : 116853957
  Distance between 3'-terminus of neighbour sequence of sequence listing upward to telomere on chrosomal short arm and 5'-terminus of this base sequence : 19081
gctgaaacaattgcttgagcctgggaggcagaggttgcagtgagccaagatcacgccattgcactccaaagagtgaaactccatctctgaatgaatgaatgaatgaatgaatgaacgaatgaatgaatgaatagtatagatttgggggcttgaaactgaggacttcttaaaggcagatgctgtgtagacatatccaaatttgacattctgagtattatgcaaaagctttattgtaagtttgaccagtagtgctagctattgcagaatacgcaaaatattcacaggttaagattaaaatagccgattaaatttttaaggtctagttagcattagaaattaatgtcaggtcattc

SEQ ID NO: 12832 - DNA, 211 bp, Homo sapiens
  AC002542.1_157001
  Located on chromosome 7
  Distance between a terminus base of telomere on chromosomal short arm and 5'-terminus of this base sequence : 117078773
  Distance between 3'-terminus of neighbour sequence of sequence listing upward to telomere on chrosomal short arm and 5'-terminus of this base sequence : 224463
atcctcttcgtctatcagaatttccgtggggaacgggtcctgggattcactggccctatctgtcaagaattagccacagatttctaatatacagtatgcagtgtgctctaaatatctaactttagcagatacacacacacacacacacacacacacacacacggtgccttggaggcagtgaataatagtcttagttctaatgagacatcgg

SEQ ID NO: 12833 - DNA, 388 bp, Homo sapiens
  AC002542.1_172753
  Located on chromosome 7
  Distance between a terminus base of telomere on chromosomal short arm and 5'-terminus of this base sequence : 117094370
  Distance between 3'-terminus of neighbour sequence of sequence listing upward to telomere on chrosomal short arm and 5'-terminus of this base sequence : 15386
gtacaaatcctcaactagatgacagggaaacattgatagttgtgccatagtctccattctgtataccaggactcttctacctttcactgtctttcataaacttccacggacagaaaaatacataggcaattatttctgatgctaaaatttttgaacacctttttaagcgcttgatcttgctgtccatatccctctgtagtctactagtctccattttacaggagattgcatgggctgttgttatgtttgtctttggtggtggtggtggggtgggtgtatgtgtgggtgtgtgtgtgtgtgtgtgtgtgtgtgtgtgtgtgtgtgtgtcagggatggatccaggaggggagaatgccagccagaaaagaaaggttaacatttgcaatta

SEQ ID NO: 12834 - DNA, 343 bp, Homo sapiens
  AC003987.1_14880
  Located on chromosome 7
  Distance between a terminus base of telomere on chromosomal short arm and 5'-terminus of this base sequence : 117125261
  Distance between 3'-terminus of neighbour sequence of sequence listing upward to telomere on chrosomal short arm and 5'-terminus of this base sequence : 30503
aaggtactcaatctgctttgttagggttctccagagaaacagcaacaatagcagatattaatacacacacacacacacacacacacacacacacacacacacacaccctttggctcacaagctagagacccaggaaagctgaaggactgagaacatggggagccaatgatgttcaccccagttcaagggcaggagaacatgagatgggatgtctgagttcacgggcaggaaagaagggacgaattcctctgtgctctgccttttgctccattcaggccctcagtgaacaggatgatggccacccccatgagggaaggcagcctactgagtccacctatccaga

SEQ ID NO: 12835 - DNA, 426 bp, Homo sapiens
  AC002465.1_42819
  Located on chromosome 7
  Distance between a terminus base of telomere on chromosomal short arm and 5'-terminus of this base sequence : 117208058
  Distance between 3'-terminus of neighbour sequence of sequence listing upward to telomere on chrosomal short arm and 5'-terminus of this base sequence : 82454
ggtctgtagctttgcattaaagccatagtctctaactggaggcagcaaaatgttcttccgccccactggggtgaacctggaatgtggaaggacgggaaataatacaaagtcacacgctttaggttctacaactcctgactggctgaattggcccgtcgatttaccttgaggcagttttggcggggtgggggctgggatgggggaggcggttgtagttttcaaggtgaatttacacacacacacacacacacacacacacacacacacgtctgtgctagagctggagaccaggctagcacgtctctcaacaggataagaaattggctgattttgctgtcgctcagctggatccaaataaaccaaacatcggagctctcatttgagggggaatgtggttttatggagttgtcaaagctgaaatgatct

SEQ ID NO: 12836 - DNA, 180 bp, Homo sapiens
  X60680.1_85
  Located on chromosome 7
  Distance between a terminus base of telomere on chromosomal short arm and 5'-terminus of this base sequence : 117208168
  Distance between 3'-terminus of neighbour sequence of sequence listing upward to telomere on chrosomal short arm and 5'-terminus of this base sequence : -316
cacacgctttaggttctacaactcctgactggctgaattggcccgtcgatttaccttgaggcagttttggcggggtgggggctgggatgggggaggcggttgtagttttcaaggtgaatttacacacacacacacacacacacacacacacacacacgtctgtgctagagctggagacca

SEQ ID NO: 12837 - DNA, 431 bp, Homo sapiens
  AC002465.1_91087
  Located on chromosome 7
  Distance between a terminus base of telomere on chromosomal short arm and 5'-terminus of this base sequence : 117256401
  Distance between 3'-terminus of neighbour sequence of sequence listing upward to telomere on chrosomal short arm and 5'-terminus of this base sequence : 48053
ataagatgccacattctagcagaatgacaaaaattaagtagatcattaatatcaagagttgacaagtgtattagatgacctttctggggagtcctttaacagtatctactgaaataaaaatacaataaaaattactattattggaccaaaggtaattgtgtgtgtgtgtgtgtgtgtgtgtgtgtgtgtgtgtgtgtgtgtgacagagtcttgctctgttgcccaggctggagtgcagtgatgcgaggctcactgtaacctctgctcctgggttcaagtgattctcatgcctcagccacctgagtagttgggattacaggtgtgtaccaccatgcccagctaatttttgtatttttagtagagatggggtttcaccatgttggcccggctcgccttgaactcctggcctcatgtgatcaatctgcctcagc

SEQ ID NO: 12838 - DNA, 170 bp, Homo sapiens
  D7S633
  Located on chromosome 7
  Distance between a terminus base of telomere on chromosomal short arm and 5'-terminus of this base sequence : 117256483
  Distance between 3'-terminus of neighbour sequence of sequence listing upward to telomere on chrosomal short arm and 5'-terminus of this base sequence : -349
tctggggagtcctttaacagtatctactgaaataaaaatacaataaaaattactattattggaccaaaggtaattgtgtgtgtgtgtgtgtgtgtgtgtgtgtgtgtgtgtgtgtgtgtgacagagtcttgctctgttgcccaggctggagtgcagtgatgcgaggctca

SEQ ID NO: 12839 - DNA, 179 bp, Homo sapiens
  AC002465.1_99451
  Located on chromosome 7
  Distance between a terminus base of telomere on chromosomal short arm and 5'-terminus of this base sequence : 117264833
  Distance between 3'-terminus of neighbour sequence of sequence listing upward to telomere on chrosomal short arm and 5'-terminus of this base sequence : 8180
ttaagtacattgaacacggaagtagttacatgaagctataaatgtgataaaattatatatatatatatatatatatatatatatatatacacacacacacacacacacacacacaaatgagtgcataactcacaaaatatgagtaagccgtatgggtcataccaatgtaaattttctgg

SEQ ID NO: 12840 - DNA, 260 bp, Homo sapiens
  AC000111.1_30020
  Located on chromosome 7
  Distance between a terminus base of telomere on chromosomal short arm and 5'-terminus of this base sequence : 117375959
  Distance between 3'-terminus of neighbour sequence of sequence listing upward to telomere on chrosomal short arm and 5'-terminus of this base sequence : 110947
gttatccttatctttacatggcacagtattattatgatatcaaaaattcattgagtatttactctgcatattagtcaaggttctccagagaagtagaaccaatgatacacacacacacacacacacacacacacacacacacacacacaatttattataaggaattgacttacatgattatgatggctaacaagtccaaaatctgcagtatgggtcagctggcaggaaacccaggagagtcaatgttccagtttgagtct

SEQ ID NO: 12841 - DNA, 375 bp, Homo sapiens
  AC000111.1_39137
  Located on chromosome 7
  Distance between a terminus base of telomere on chromosomal short arm and 5'-terminus of this base sequence : 117384929
  Distance between 3'-terminus of neighbour sequence of sequence listing upward to telomere on chrosomal short arm and 5'-terminus of this base sequence : 8710
tatccatgaccttcatctgaagttttggcagatgaaaatgtcagatgcgtcttttggattaataaaaggcaaaagtcagatcgaaaaatgagtataagctttaattatatgactttaggaggatatgttatgaaaatcaaagctttaatagtgattataattggcaagttctttttttataaggaattacaagtcactctatacaaaaattggaatttttgtcctaagaaatgaaatttactatagtttcatctgtgtgtgtgtgtgtgtgtgtgtgtgtgtgtgtttaaaaaatcaagtgatagggcttttcctcaataaaatctgaaatctcttatagttaagtgaacagaacagtgtatctaggatgctaga

SEQ ID NO: 12842 - DNA, 279 bp, Homo sapiens
  D7S677
  Located on chromosome 7
  Distance between a terminus base of telomere on chromosomal short arm and 5'-terminus of this base sequence : 117385112
  Distance between 3'-terminus of neighbour sequence of sequence listing upward to telomere on chrosomal short arm and 5'-terminus of this base sequence : -192
gaattacaagtcactctatacaaaaattggaatttttgtcctaagaaatgaaatttactatagtttcatctgtgtgtgtgtgtgtgtgtgtgtgtgtgtgtgtttaaaaaatcaagtgatagggcttttcctcaataaaatctgaaatctcttatagttaagtgaacagaacagtgtatctaggatgctagacttttttttcaaagttagtttaaaacttatacatagtaaaatctgtatgccttagggatctctgtttgctatcccatagtgaatgat

SEQ ID NO: 12843 - DNA, 244 bp, Homo sapiens
  AC000111.1_88041
  Located on chromosome 7
  Distance between a terminus base of telomere on chromosomal short arm and 5'-terminus of this base sequence : 117433981
  Distance between 3'-terminus of neighbour sequence of sequence listing upward to telomere on chrosomal short arm and 5'-terminus of this base sequence : 48590
agtcacagtctacagctttgaaagaggaggattataaaatctatctcatgttaatgctgaagattaaataatagtgtttatgtaccccgcttataggagaagagggtgtgtgtgtgtgtgtgtgtgtgtgtgtgtgtatgtgtatgtatacatgtatgtattcagtctttactgaaattaaaaaatctttaacttgataatgggcaaatatcttagttttagatcatgtcctctagaaaccgta

SEQ ID NO: 12844 - DNA, 419 bp, Homo sapiens
  AC000111.1_98261
  Located on chromosome 7
  Distance between a terminus base of telomere on chromosomal short arm and 5'-terminus of this base sequence : 117444031
  Distance between 3'-terminus of neighbour sequence of sequence listing upward to telomere on chrosomal short arm and 5'-terminus of this base sequence : 9806
ttcattctatgtgactctagttcactaatatgagctctgataaaatcagtgctttttcgaggttaggagatcaagaccatcctggctaacacagtgaaactccgtctctactaaaaatacaaaaaattagccagacgtgatggcgggtgcccgtagtcccagctactcgggaggctgaggcaggagaatggcgtgaacccaggaggcagaacttgcagtgagccgagatcgcgccactgcactctagcctgggtgacagagtgagactctgtctctaaataaataaataaataaataaataaataaataaaatcagtgctttttcttcctctgctacctcctttccttctactcagttttagtcagtagtattatcttttttcagatttatctttgtattgttaaatctgcttatgctt

SEQ ID NO: 12845 - DNA, 420 bp, Homo sapiens
  AC000111.1_105956
  Located on chromosome 7
  Distance between a terminus base of telomere on chromosomal short arm and 5'-terminus of this base sequence : 117451861
  Distance between 3'-terminus of neighbour sequence of sequence listing upward to telomere on chrosomal short arm and 5'-terminus of this base sequence : 7411
ttcagtagccaagatataatggacatctgaaacaggtatttgaggccaggcgtggtgtctcatgcctgtaataatagcactttgggaggccgaggtgggtggatcacaggaggccaggagttcaagaccagcctactaaaacacacacacacacacacacacacacacacacacacactagccaggcgtggtggtgcacgtttgtagtccaagctacttgggaggctgaggcatgagaatagcttgaacccagaaggcggaggttgctgtgagctgagattgcgccactgcactctagcctgggtgacagagtgagactctgtctcaaaaataaaataaaacatatatttgaaacacattgaattatgtcccttaaacaagaataaacatcactaaatgactgtaccttgaactacctgt

SEQ ID NO: 12846 - DNA, 444 bp, Homo sapiens
  AC000061.1_8832
  Located on chromosome 7
  Distance between a terminus base of telomere on chromosomal short arm and 5'-terminus of this base sequence : 117503968
  Distance between 3'-terminus of neighbour sequence of sequence listing upward to telomere on chrosomal short arm and 5'-terminus of this base sequence : 51687
atgtttcagaaaccatatcttgatgaatcttggaaggccgaggcaggcgaattacttgaggtcgggagtttgagaccagcctggccaacgtggtgaaaccccatctctcctaaaaatacaaaaattacctggccgtggtggcatgcacccagctacttgagaggctgaggcacaagaatcgcttgaacctgggaggtggaggtttcagtgagccgagatcctgccactgcactccagcctgagcaatagaggagactccgtctcacacacacacacacacacacacacacaaagaaaataaaccatctcttgatgaatcataaatttgtgtctctagtttagacctctatcctgctctctaaatgatgtatccaactatcatcttgacaccatcatatgttcataaaacataattatagaatatctttcagtaggcttgacatt

SEQ ID NO: 12847 - DNA, 371 bp, Homo sapiens
  AC000061.1_38357
  Located on chromosome 7
  Distance between a terminus base of telomere on chromosomal short arm and 5'-terminus of this base sequence : 117533603
  Distance between 3'-terminus of neighbour sequence of sequence listing upward to telomere on chrosomal short arm and 5'-terminus of this base sequence : 29191
aacttaggatcttgatttgttcacattgaacagatttttattatacagattgaatttataagaaaatgttgcagacattgtcaaaaagggacgtccaaaccactgtgatatttataagcatttgggccacattttgatagaactatacacggagtgtgtgtgtgtgtgtgtgtgtatatatatatacacacacacattatttatatatatgtatatatgtatatatatatatgtatttatatatatatgtgtatatgtatgtacacattatttacctacctactgtgtgagtgtgtgcatatatacacgcacacacacacacacaaatatatatatttcccttctgagacaaagccaaacagcactgtatg

SEQ ID NO: 12848 - DNA, 233 bp, Homo sapiens
  AC004240.1_81690
  Located on chromosome 7
  Distance between a terminus base of telomere on chromosomal short arm and 5'-terminus of this base sequence : 117659351
  Distance between 3'-terminus of neighbour sequence of sequence listing upward to telomere on chrosomal short arm and 5'-terminus of this base sequence : 125377
aaaataggagtaggcagctgagaataaagcttgggagttgcttagagttaacacacacacacacacacacacacacacacacacacacacacacacacacacacacacaccccaaaaaacaaaaagcagaaaaacaaatagaaagcctggtcagcaaagttggagaggaagtgagaaaagggcagtgttctggaagcccagggagagaggagtatgcattaaatcgtcaactt

SEQ ID NO: 12849 - DNA, 363 bp, Homo sapiens
  AC002431.1_41663
  Located on chromosome 7
  Distance between a terminus base of telomere on chromosomal short arm and 5'-terminus of this base sequence : 117704909
  Distance between 3'-terminus of neighbour sequence of sequence listing upward to telomere on chrosomal short arm and 5'-terminus of this base sequence : 45325
ggagttcaagtagaccaacattaaataacactaaaattaaaagctcttttaagaaggaagggggaaaatcctatttgtaaataaaagggaatgggaagccagagataagccatggtcctcagaactcattctcgctctaagaggggttgaatagcagaggagtgagtttacacattcacatactctttctcttttctccttctctctctctcacacacacacacacacacacacacacacacacacacacacacacacggaatggctgggtgactgcagagtggaatagcaatataaaagttacacagtcatctggagaaggataattacttcccaatgcccttcaatgatcagaaagcctta

SEQ ID NO: 12850 - DNA, 250 bp, Homo sapiens
  AC002431.1_94140
  Located on chromosome 7
  Distance between a terminus base of telomere on chromosomal short arm and 5'-terminus of this base sequence : 117757489
  Distance between 3'-terminus of neighbour sequence of sequence listing upward to telomere on chrosomal short arm and 5'-terminus of this base sequence : 52217
ccattctgagtggattaagtaaacaaattcaacctttctggggaacaagaaacacaccacacacacacacacacacacacaccctctttctttttcgtccttccccttcacacacacacacacacacacacacacacaccctctttctttttcctcgtccttccccttcccaccttttggggatgaaggcaccaaatcatttccacttgccagagagccttgtctcaatagctagtttccttactgtgcc

SEQ ID NO: 12851 - DNA, 208 bp, Homo sapiens
  AC002431.1_110275
  Located on chromosome 7
  Distance between a terminus base of telomere on chromosomal short arm and 5'-terminus of this base sequence : 117773659
  Distance between 3'-terminus of neighbour sequence of sequence listing upward to telomere on chrosomal short arm and 5'-terminus of this base sequence : 15920
gaacttagtgacaatgtttggatcattatatgatcttgatgaatgttcattgactataagctaattgttttattgtgtgtgtgtgtgtgtgtgtgcgggggggcgggggtggagtttggtaaggaaaagcatcataaaatgatggaatttttgaatggagaagaccttgtctgtcacctatccttggaagtgaaactaaggccaagat

SEQ ID NO: 12852 - DNA, 480 bp, Homo sapiens
  AC003084.1_57106
  Located on chromosome 7
  Distance between a terminus base of telomere on chromosomal short arm and 5'-terminus of this base sequence : 117857386
  Distance between 3'-terminus of neighbour sequence of sequence listing upward to telomere on chrosomal short arm and 5'-terminus of this base sequence : 83519
tcgttaggtttactcaatctaaagatagatgtattttcaattctggaaagggctcagtaattatcttttaaaataacatctcttcccctttcttttaattctctccttctggatctccgatgggacatattttaggcatgtattctctgtgtctcaagttctccttcatagcttttatctctttttctgtctgtgctgcattctggaaaaatttttggaatctattttccaatttgtaattcacattctttctcccttccttccttccttccttccttccttccttccttccttccttccttccttccttccttccttcctccctcccttctctctttctctctttcttctttctgccaaggtctctctctctcacccaggctggcatgcaattgttcaatctcggctctctgcaacctctgccttccaggttcaagtggttctcctgcctcagcctcctaagtagctggattacacgtg

SEQ ID NO: 12853 - DNA, 358 bp, Homo sapiens
  AC003084.1_85320
  Located on chromosome 7
  Distance between a terminus base of telomere on chromosomal short arm and 5'-terminus of this base sequence : 117885701
  Distance between 3'-terminus of neighbour sequence of sequence listing upward to telomere on chrosomal short arm and 5'-terminus of this base sequence : 27835
gaatcatacagtgacatgtgaaagcattccatgaaatttaaaataccagaaaagtgttttttttaaaaagtcatgtcaacacaaaaacatgaaccattgcactgttgaattcaaacatgcatgtatttggccattttgaattttggtcatatctgtgtgtgtgtgtgtgtgtgtgtgtgtgtgtgtgtgtgtgtgtgtataagctatttttaaataaatctttaaaatgaagataactttttggtaatttatgggatatttttaattgaagtttttctattcaaaccaagatgaccccatggatcagtttaccagcctgcaatgagaggcctcgtgaccatgtggcctacttatttaa

SEQ ID NO: 12854 - DNA, 360 bp, Homo sapiens
  AC003084.1_127823
  Located on chromosome 7
  Distance between a terminus base of telomere on chromosomal short arm and 5'-terminus of this base sequence : 117928284
  Distance between 3'-terminus of neighbour sequence of sequence listing upward to telomere on chrosomal short arm and 5'-terminus of this base sequence : 42225
gcctcaaagctatcacttgtatccctctccctgctcaaggcccatcttcagtagactaaacaaataccagaatcacacacacacacacacacacacacacacacacacacacacacacacacaatcctgtatactagtaaaggagtgagaaggaaaatactctaagataaaaggataataagtttttacacagtaattctgtttaacaggtaaataaatgcaggataacagaaggcagaaacctgatttattgcagaaaacggatggaaaaaattctaaacacaacagatgaactccagagccctgctgtgaaaacaaggaatttcaattctggtcaaattctcaacagtggcataactc

SEQ ID NO: 12855 - DNA, 296 bp, Homo sapiens
  AC003084.1_139491
  Located on chromosome 7
  Distance between a terminus base of telomere on chromosomal short arm and 5'-terminus of this base sequence : 117939830
  Distance between 3'-terminus of neighbour sequence of sequence listing upward to telomere on chrosomal short arm and 5'-terminus of this base sequence : 11186
gcctatccaacatagtgaaatcccatctctactaaaaatacaaaattagccgggcatggtggcatgcacctgtgatcccagctacttgggaggctgaggcagaagaatcacttgaactccagaggcggaggttgcagggagccaagatcatgccattgcactccagcctgggcaacaagagtgaaactccatctcaataaataaataaataaataaataaataaataaataaataaataaataaagtaaaataaaataaaaaattaaaaataaaataagtggagcagataatcatg

SEQ ID NO: 12856 - DNA, 240 bp, Homo sapiens
  AC004536.1_28223
  Located on chromosome 7
  Distance between a terminus base of telomere on chromosomal short arm and 5'-terminus of this base sequence : 117994646
  Distance between 3'-terminus of neighbour sequence of sequence listing upward to telomere on chrosomal short arm and 5'-terminus of this base sequence : 54520
atagcgttaggagaaatacctaaggtatatgatgagttgatgggtgcagcaaaccaacatggcacatgtattcctatgtaacacacctgcacgttgtgcacatgtaccctagaacttgaagtataatgaaaaataaataaataaataaataaataaataaatagcaaaaaagaattcctcttcttcttctaaatgttcattcaacattcagccaaattgtcattgctagttaaatgttgg

SEQ ID NO: 12857 - DNA, 283 bp, Homo sapiens
  AC006389.2_93930
  Located on chromosome 7
  Distance between a terminus base of telomere on chromosomal short arm and 5'-terminus of this base sequence : 118104702
  Distance between 3'-terminus of neighbour sequence of sequence listing upward to telomere on chrosomal short arm and 5'-terminus of this base sequence : 109816
ccaaagagaaggaacagacatctggtggaagcaggtttgagaaagaatgcgaggagaaaaactagaaaaatcattccacacaactccattaaggaatttttgtgctaagagaaaatgagatctaggcagcagctgtgcgtctgtgtgtgtgtgtgtgtgtgtgcgcgtgtgtgcataagcacactataaagcactgagaaattatagtatctgttgaataaaggaaaaagaaaacatcgtattgaaatcagaaaagggagaattagtggagcaatatccttca

SEQ ID NO: 12858 - DNA, 143 bp, Homo sapiens
  Z67224
  Located on chromosome 7
  Distance between a terminus base of telomere on chromosomal short arm and 5'-terminus of this base sequence : 118121937
  Distance between 3'-terminus of neighbour sequence of sequence listing upward to telomere on chrosomal short arm and 5'-terminus of this base sequence : 16952
acctgataggattgtgtgtgtgcgtatgtgtgtgtgtgtgtgtgtgtgtgtgtgtccacaaaacacaatatatatgatattgggaaaatatagaaccataagacccgtaggatgtatgctcacatgcttttggacagattacc

SEQ ID NO: 12859 - DNA, 253 bp, Homo sapiens
  Z67019
  Located on chromosome 7
  Distance between a terminus base of telomere on chromosomal short arm and 5'-terminus of this base sequence : 118237040
  Distance between 3'-terminus of neighbour sequence of sequence listing upward to telomere on chrosomal short arm and 5'-terminus of this base sequence : 114960
aggcaacgctgctctaggatgatcaaaatggcagtaggaattagaaggcgatgcagtgaggagacaccaaagtcttcatagccatgtggctgattactgactgtggctaggtgaaaattaatcaatattttaactgggcatatgacagcaagaatggaaagtggggtgtgtgtgtgtgtgtgtgtgtgtgtctgtgtgtctgtgtgtctgtgtgtctgctatgtctttgtatgtatggtgtctgaagtggggg

SEQ ID NO: 12860 - DNA, 292 bp, Homo sapiens
  AC004029.1_114618
  Located on chromosome 7
  Distance between a terminus base of telomere on chromosomal short arm and 5'-terminus of this base sequence : 118237071
  Distance between 3'-terminus of neighbour sequence of sequence listing upward to telomere on chrosomal short arm and 5'-terminus of this base sequence : -222
cagtaggaattagaaggcgatgcagtgaggagacaccaaagtcttcatagccatgtggctgattactgactgtggctaggtgaaaattaatcaatattttaactgggcatatgacagcaagaatggaaagtggggtgtgtgtgtgtgtgtgtgtgtgtgtctgtgtgtctgtgtgtctgtgtgtctgctatgtctttgtatgtatggtgtctgaagtgggggacatgtttatgaagtttaatagaatttcaagttttattagctgaaaggatggcttgatgttataatcagg

SEQ ID NO: 12861 - DNA, 435 bp, Homo sapiens
  AC004029.1_141997
  Located on chromosome 7
  Distance between a terminus base of telomere on chromosomal short arm and 5'-terminus of this base sequence : 118264367
  Distance between 3'-terminus of neighbour sequence of sequence listing upward to telomere on chrosomal short arm and 5'-terminus of this base sequence : 27004
aatcagattagatgttcatctgagaaaatggttctgacttttgcgaataggtaatgatctcatatggcagaatcactgacaaggtgaggaatgcatggggaaggaaggaagacagaggagcacagcacattctctctctctctctgtgtgtgtgtgtgtgagagagagagagagagagagacagagagagagagacaaagagagagaaagatacagaaaggaaggaaggaaggaaggaaggaaggaaggaaggaaggaaggaaggaaggaagggggctgcatctcctgggggttgtgccagtacagggaggatgcagtttcttcagatggcagcagagtgtggtattgaaaccaatgagatggcagagggctctatagtctggaacctaatttccctgtgaaacattcatacttcagtgaaattaccaaattaac

SEQ ID NO: 12862 - DNA, 358 bp, Homo sapiens
  AC004029.1_141939
  Located on chromosome 7
  Distance between a terminus base of telomere on chromosomal short arm and 5'-terminus of this base sequence : 118264428
  Distance between 3'-terminus of neighbour sequence of sequence listing upward to telomere on chrosomal short arm and 5'-terminus of this base sequence : -374
atatggcagaatcactgacaaggtgaggaatgcatggggaaggaaggaagacagaggagcacagcacattctctctctctctctgtgtgtgtgtgtgtgagagagagagagagagagagacagagagagagagacaaagagagagaaagatacagaaaggaaggaaggaaggaaggaaggaaggaaggaaggaaggaaggaaggaaggaagggggctgcatctcctgggggttgtgccagtacagggaggatgcagtttcttcagatggcagcagagtgtggtattgaaaccaatgagatggcagagggctctatagtctggaacctaatttccctgtgaaacattcatacttcagtg

SEQ ID NO: 12863 - DNA, 358 bp, Homo sapiens
  AC006926.1_21821
  Located on chromosome 7
  Distance between a terminus base of telomere on chromosomal short arm and 5'-terminus of this base sequence : 118297784
  Distance between 3'-terminus of neighbour sequence of sequence listing upward to telomere on chrosomal short arm and 5'-terminus of this base sequence : 32998
atgaacagttaatccaagtaccaggaataacagtgaatttagaagcattcttattttatgcaggctaccataatttcctccctccctcccttcctttttccttcatctttctttcttcttccctttcttcccttcaatgaccaaaaagagcctaaggattgtgtgtgtgtgtgtgtgtgtgtgtgtgtgtgtatatcgttgtcgtcgtcgttttcttaaataacaatcttggttttatatcaaagtcaattcaataaaacaatgacaaaacacacaagatgcagctctgtaaaaggtacagacatcttgccagagcgtagaagggggggaagttgaatgaaggtattggtgttaaaca

SEQ ID NO: 12864 - DNA, 188 bp, Homo sapiens
  AC006926.1_61067
  Located on chromosome 7
  Distance between a terminus base of telomere on chromosomal short arm and 5'-terminus of this base sequence : 118337112
  Distance between 3'-terminus of neighbour sequence of sequence listing upward to telomere on chrosomal short arm and 5'-terminus of this base sequence : 38970
ggttctgattgaattagaatcaacctcaatacagattgttgatttttatacagtgtgcaattcaattcaaatttactacacacacacacacacacacacactcaactttatttgtatcccaaaatgtgtgaaagtataatctatggctgcttttttactgcaacgaaagaattgagtgcttctacttg

SEQ ID NO: 12865 - DNA, 449 bp, Homo sapiens
  AC006926.1_72367
  Located on chromosome 7
  Distance between a terminus base of telomere on chromosomal short arm and 5'-terminus of this base sequence : 118348324
  Distance between 3'-terminus of neighbour sequence of sequence listing upward to telomere on chrosomal short arm and 5'-terminus of this base sequence : 11024
attacatttgcaccaacctaatagattggcactttttgttgtaacaagccataagtgctggcatgtgaccgtgaccctggcttaatgaaactaagggttctgttcctaatatatggcaaacacacacacacacacacacacacacacacacacacacacacacacagagagagagagagagagagagagagagagagagagaacaacataaaccagataaggatcagagcttgaaatgaagccagttctatgaatcccaagtctttttatctagggctttaaagagaatataaacttttcctcctccaaaattgcatagattacacaataggtgcttgaatatggtagtcgtagtggcaggggatggagcctatgcctggagtcacaactacaggctcccatttaccaagattaatctaactactgttactgccaaatatctaacctga

SEQ ID NO: 12866 - DNA, 355 bp, Homo sapiens
  AC006926.1_72321
  Located on chromosome 7
  Distance between a terminus base of telomere on chromosomal short arm and 5'-terminus of this base sequence : 118348324
  Distance between 3'-terminus of neighbour sequence of sequence listing upward to telomere on chrosomal short arm and 5'-terminus of this base sequence : -449
attacatttgcaccaacctaatagattggcactttttgttgtaacaagccataagtgctggcatgtgaccgtgaccctggcttaatgaaactaagggttctgttcctaatatatggcaaacacacacacacacacacacacacacacacacacacacacacacacagagagagagagagagagagagagagagagagagagaacaacataaaccagataaggatcagagcttgaaatgaagccagttctatgaatcccaagtctttttatctagggctttaaagagaatataaacttttcctcctccaaaattgcatagattacacaataggtgcttgaatatggtagtcgtagt

SEQ ID NO: 12867 - DNA, 331 bp, Homo sapiens
  AC006926.1_75903
  Located on chromosome 7
  Distance between a terminus base of telomere on chromosomal short arm and 5'-terminus of this base sequence : 118351907
  Distance between 3'-terminus of neighbour sequence of sequence listing upward to telomere on chrosomal short arm and 5'-terminus of this base sequence : 3228
tcaaacaatccatgtatcagatagaaaagcaactgagagttgagtgttgttgtagggaatagtggaaaacctttcataatcaaagacagaaatttatctctgtctctgtctctttcatacacacacacacacacacacacagagaaatatacacaaaaatcacatagaaaaatgtgcattttatcaatagtttactaatgtgaacttttcctccaactctcacgatttaaatatgaatagaagccaacacttgaataatatcaactacccatggcatcactaaatgctgctaaaatgttatttctttgattgctaaagaaattaatgacca

SEQ ID NO: 12868 - DNA, 320 bp, Homo sapiens
  AC002529.1_10468
  Located on chromosome 7
  Distance between a terminus base of telomere on chromosomal short arm and 5'-terminus of this base sequence : 118373118
  Distance between 3'-terminus of neighbour sequence of sequence listing upward to telomere on chrosomal short arm and 5'-terminus of this base sequence : 20880
ctaccattgatccagcaattacactactggatatatatctagaggaaaagaagtcattatgcaaaaaaaaaaatacttgcacacacatgtttatagcagcacaattcacatttgcaaaaatgtggaaccaaaccaaatgcccatcaatcaacaagtggttaaagaaactgtgatacagacacacacacacacacacacacacacacacacacacacacaatggaatactactcagccataaaaggaataaattaatggcattttcaatgacctgaatgagattggagactattattctaagtgaagtaactcaggaatgg

SEQ ID NO: 12869 - DNA, 202 bp, Homo sapiens
  AC002529.1_28202
  Located on chromosome 7
  Distance between a terminus base of telomere on chromosomal short arm and 5'-terminus of this base sequence : 118390921
  Distance between 3'-terminus of neighbour sequence of sequence listing upward to telomere on chrosomal short arm and 5'-terminus of this base sequence : 17483
tggtcaatggaacctactttagggtggctcctggttccttttgcagcattatgtatatatatacacacagaatatactacatggatatcatatatatactatatactacgtgtgtgtgtgtgtgtgtgtgtgtgtgtgtgtgtgtgtgtgtatgtgtgtccttactttctgacaatacaagttactccaggcttatcttggt

SEQ ID NO: 12870 - DNA, 359 bp, Homo sapiens
  AC002529.1_38993
  Located on chromosome 7
  Distance between a terminus base of telomere on chromosomal short arm and 5'-terminus of this base sequence : 118401706
  Distance between 3'-terminus of neighbour sequence of sequence listing upward to telomere on chrosomal short arm and 5'-terminus of this base sequence : 10583
aggtttatgactcaggactacaacatcaactttttacctgaattttcagcctgccgtatagatttcaaacttgccggttcccataattgcatgatctcattccctaaaataaatctgtgtgtgtgtgtgtgtgtgtgtgtgtgtgtgtgtgtgagtgtttatgtatgtgtgtgtataatttccatcctggttgttattaagtacaatattgattgcaaatttatgacaggatttaggtccatggaaaaagccttataaattgcatttttatgtaatcacgatgatagaataacactgcaaaaatttataagatggtaatttctgcagcaaaacaacttaaagaacctcatgtatcttgc

SEQ ID NO: 12871 - DNA, 407 bp, Homo sapiens
  chr7.fa.O7frz.122510299
  Located on chromosome 7
  Distance between a terminus base of telomere on chromosomal short arm and 5'-terminus of this base sequence : 118491408
  Distance between 3'-terminus of neighbour sequence of sequence listing upward to telomere on chrosomal short arm and 5'-terminus of this base sequence : 89343
ataccatggatgaacctagaagacattatgctgagtgaaatatgccagcctcagaaagaaaaatactgtgattctgcttatataagttatctaaaatagtcaaatgcttagaagcagagattagaatggtagttgccagtggctggggggaaggaaaatggggcattgtttcatagacataagtttcagttaagcaagacaaattctagagatctactgtacaatatattacctatagttaacatcactacttattgtttacttgaaaatttattaaaagagtagatctcatgttaagcattcttaacacacacacacacacacacacacacgacagaaagaaagttttagatgtgatgcatatgtttattagtttgattgtggtgatactatcatgattgtatgca

SEQ ID NO: 12872 - DNA, 383 bp, Homo sapiens
  chr7.fa.O7frz.122664174
  Located on chromosome 7
  Distance between a terminus base of telomere on chromosomal short arm and 5'-terminus of this base sequence : 118645833
  Distance between 3'-terminus of neighbour sequence of sequence listing upward to telomere on chrosomal short arm and 5'-terminus of this base sequence : 154018
cattctaaacataatgctcaaattgaaaatccatttttggcagagtagcttagaattcccaaagttacattttctggccaaagaagcaaaataagtctgaacacagtttttaaaactaccaacagaaatcctttaaaaatattttacatatgtaacttggtaaaaaaggtctgcagatattttactaggaaataaaatgatgttgtctttagaaactactctagtaaatgaaaatcttcttcagtgtactaaactaagccagcatgctatcattctaaaacaaaacaaaacaaaacaaaacaaaacaaaacaaaacacaagtgcctaaatcttttccactgtctcctttggcctaaagtataatgtctagctccaattaagtg

SEQ ID NO: 12873 - DNA, 265 bp, Homo sapiens
  D7S655
  Located on chromosome 7
  Distance between a terminus base of telomere on chromosomal short arm and 5'-terminus of this base sequence : 118921544
  Distance between 3'-terminus of neighbour sequence of sequence listing upward to telomere on chrosomal short arm and 5'-terminus of this base sequence : 275328
caaaatagtggggtattggtaaaagaatagacaaatagatcaatataatagaatacagagccctaaagtacagtcacataaatatactcaatttatcatgactatgcaaaaggcatatgatggagcaaagataatcttttcaacaaatggtgctggaacaattagacatctatccacacacacacacacacacacacacacacacacacacacacaaagcctgaatctagataaaagttttacactttcacaaagattaacttgg

SEQ ID NO: 12874 - DNA, 436 bp, Homo sapiens
  chr7.fa.O7frz.123042079
  Located on chromosome 7
  Distance between a terminus base of telomere on chromosomal short arm and 5'-terminus of this base sequence : 119191688
  Distance between 3'-terminus of neighbour sequence of sequence listing upward to telomere on chrosomal short arm and 5'-terminus of this base sequence : 269879
tttactaattcatcgcagctagctatcctagcctctttgctctctctctctctccctctttctctctttctctctctgtgtgtgtgtgtgtgtgtgtgtgtgtgtgtgtgtgtgtttaaatatatcaggcaccctccagcccctccaccttctttctatttttttaatttaatatgtgatattatcatttagtaaactagtaatttactttttatgtctcctattcgtagttggcctctcctcactaggatgtaagctccatggaagcagcttatttattcttgaatgtatcacaagatgctaaaacaatatttggtacagaattgttcttatttattaattaaaggaatgaatccccgtaatgcacattttacgatacaaataatgtgcctgctactaagaagacagacaaagatgtattactattctggagtgg

SEQ ID NO: 12875 - DNA, 326 bp, Homo sapiens
  chr7.fa.O7frz.123342453
  Located on chromosome 7
  Distance between a terminus base of telomere on chromosomal short arm and 5'-terminus of this base sequence : 119334450
  Distance between 3'-terminus of neighbour sequence of sequence listing upward to telomere on chrosomal short arm and 5'-terminus of this base sequence : 142326
tccaaggtcctgattatttaacccttggttttgctaaggttttttgtttgtttgtttgtttgtttgtttttacagttttaggtctaacatttatattaacctattttgagtttttttttccgtgtgtgtgtgtgtgtgtgtgtgtttatgatatcaggtagtggtccaaagttattcatttttttacgtgcagatttctttttagttccagcacaatttgctaatgagaatatttcttctccgttgaatggtcttggcatcctgtggaaaactgaccgtagatgcactattttatttccaggctattgcttctattcgttcatcta

SEQ ID NO: 12876 - DNA, 179 bp, Homo sapiens
  DISD22_0005286
  Located on chromosome 7
  Distance between a terminus base of telomere on chromosomal short arm and 5'-terminus of this base sequence : 119592665
  Distance between 3'-terminus of neighbour sequence of sequence listing upward to telomere on chrosomal short arm and 5'-terminus of this base sequence : 257889
acatacctgtgtaactcttaaggtgttagtattttctttcgcttacttaaacatatactttgtgaaaaatgaccaataggaaaaaagaacaaaacaataattaattttatattgtgtgtgtgtgtgtgtgtgtgtgtgtgtgtgtgtgtgtgtaacttaaagtctcacttggattgaag

SEQ ID NO: 12877 - DNA, 303 bp, Homo sapiens
  AC005016.1_17352
  Located on chromosome 7
  Distance between a terminus base of telomere on chromosomal short arm and 5'-terminus of this base sequence : 119754805
  Distance between 3'-terminus of neighbour sequence of sequence listing upward to telomere on chrosomal short arm and 5'-terminus of this base sequence : 161961
ttagaaggtagcttcctttgacagagagtaactctggaagaagcactcagctataaaccatcagtgggcaacactcccagcagctggtgaaaagtatgtttcattgcacaagccactattggcactattttccacttctcagtttatcccaagaagggagataggacaagcttgggacaatcatttagttctcaattctttagttttaaatgtatacacaaagatagatagatagatagatagatagatagatagatagatagatagatagatatagatagacagatagacaggtatgaaagc

SEQ ID NO: 12878 - DNA, 340 bp, Homo sapiens
  AC004915.1_12394
  Located on chromosome 7
  Distance between a terminus base of telomere on chromosomal short arm and 5'-terminus of this base sequence : 119877971
  Distance between 3'-terminus of neighbour sequence of sequence listing upward to telomere on chrosomal short arm and 5'-terminus of this base sequence : 122863
gtatgaatagcagaattaaccaagccgaggaaagaatctcagagctcaaaactggctctctgaagtaagtcaaacagaggaaggaaggatggaaggaaggaaggaaggaaggaaggaaggaaggaaggaaggaaagaaagagggagggacggagggaacaaacaaacctgagaaatatgggatcatgtaaagagaccaaatctatgacacattggcttccttgaaagagagggagagaaatcaagcaaattggaaaacatatttcaggattttgtccatgaaaatttctcctcactcactcctcactcactagagaggtcaacattctaattcaggaagt

SEQ ID NO: 12879 - DNA, 288 bp, Homo sapiens
  G12394
  Located on chromosome 7
  Distance between a terminus base of telomere on chromosomal short arm and 5'-terminus of this base sequence : 119878027
  Distance between 3'-terminus of neighbour sequence of sequence listing upward to telomere on chrosomal short arm and 5'-terminus of this base sequence : -284
tctctgaagtaagtcaaacagaggaaggaaggatggaaggaaggaaggaaggaaggaaggaaggaaggaaggaaggaaagaaagagggagggacggagggaacaaacaaacctgagaaatatgggatcatgtaaagagaccaaatctatgacacattggcttccttgaaagagagggagagaaatcaagcaaattggaaaacatatttcaggattttgtccatgaaaatttctcctcactcactcctcactcactagagaggtcaacattctaattcaggaagtgcag

SEQ ID NO: 12880 - DNA, 374 bp, Homo sapiens
  AC004915.1_24966
  Located on chromosome 7
  Distance between a terminus base of telomere on chromosomal short arm and 5'-terminus of this base sequence : 119890345
  Distance between 3'-terminus of neighbour sequence of sequence listing upward to telomere on chrosomal short arm and 5'-terminus of this base sequence : 12030
ctctgtaaagctcgtttcctaacaaggtcattattgtaacaaggaagctctatctaccttccctgaagtttgttaagaattataggtaaaggattccttttccatgaaacatagtttatactgcatacaatctatgcccagacttagcatgcacctctgtgtgataaattagttcctcctttatcttgtgcaccatgagctgcctccactttcaagttttatttgatagacactatttcatattgaaaaatatgtctccagtattgtggtcatgcctccttttcaaactatatatatatatatatatatatatatatatatatatattttatattcataaaggaacaggggttcactccagttctagacttcaa

SEQ ID NO: 12881 - DNA, 268 bp, Homo sapiens
  AC004915.1_117125
  Located on chromosome 7
  Distance between a terminus base of telomere on chromosomal short arm and 5'-terminus of this base sequence : 119982629
  Distance between 3'-terminus of neighbour sequence of sequence listing upward to telomere on chrosomal short arm and 5'-terminus of this base sequence : 91910
gaccttgacacttctaaacagtactgctcaggcattttgtagaatgctccacagtgtgagtttacctgatgttttttcatgaatagattgaggctatggattttggagaaaaatatcataaaggtacagtgcctttctcatcacatcatgacatcacatcacgacatcacatcacatcacatcacatcacatcacatcacatcatcacatcacatcacctcacatcaaattgtacaggcatcaaaatgacattgctagtggtattaac

SEQ ID NO: 12882 - DNA, 246 bp, Homo sapiens
  AC004915.1_122172
  Located on chromosome 7
  Distance between a terminus base of telomere on chromosomal short arm and 5'-terminus of this base sequence : 119987764
  Distance between 3'-terminus of neighbour sequence of sequence listing upward to telomere on chrosomal short arm and 5'-terminus of this base sequence : 4867
gccagctacaaatttcataaacagaaacaaagaaagaaattcatgatgtttagcttctagattctagacattcgggtgtgtgtgtgtgtgtgtgtgtgtgtgtgtgtgtgtgtgtttgacaaaatagaaaatttcctctagatatgatggacaaggtagcaaggtactttgagaaatcaaatctagatgacttttcgaagtaatcaaaagtttctgcacacacttgaaaggtggctagaattaata

SEQ ID NO: 12883 - DNA, 316 bp, Homo sapiens
  AC004872.1_11023
  Located on chromosome 7
  Distance between a terminus base of telomere on chromosomal short arm and 5'-terminus of this base sequence : 119999335
  Distance between 3'-terminus of neighbour sequence of sequence listing upward to telomere on chrosomal short arm and 5'-terminus of this base sequence : 11325
attgcaagattctttatgagtcagggtgagctaagctgccataacaaaaatacagatataacatacgtttagcaagatgttaggatgaaaaaaatatgtacgtgtatttttatatgtttatcaaaatgtcaagacttgagctatatatatatatatatatatatatatatatatatatatatgtatttcttaattaagagacaatccctctatcccttccctggggaagatattataggtcaatgagaaaagatgcatttatgtatacttgtggggtaagagtgaagagagggtttccagattcaaatagttacgt

SEQ ID NO: 12884 - DNA, 193 bp, Homo sapiens
  AC004946.1_6845
  Located on chromosome 7
  Distance between a terminus base of telomere on chromosomal short arm and 5'-terminus of this base sequence : 120068333
  Distance between 3'-terminus of neighbour sequence of sequence listing upward to telomere on chrosomal short arm and 5'-terminus of this base sequence : 68682
gttggtacaggtggtaataggatggaaaaatagccatggagcaatgaagtcatttttacatattcagggatgccaaagctacaacaaaaacccagcctatagttttgctcttcctaaatccttgttttggcgtgtatgtgtgtgtgtgtgtgtgtgtgtgtgtgtgtgtgtgttctgatgcctgttaatcatt

SEQ ID NO: 12885 - DNA, 304 bp, Homo sapiens
  AC004946.1_23121
  Located on chromosome 7
  Distance between a terminus base of telomere on chromosomal short arm and 5'-terminus of this base sequence : 120084644
  Distance between 3'-terminus of neighbour sequence of sequence listing upward to telomere on chrosomal short arm and 5'-terminus of this base sequence : 16118
tgtaggtctattcctagtggttcttttcttggctttgatctatttatttatacctacactattactacagtcttgatgttatatattcctgagatatatattctctctctctctctctctctctctatatatatatatatatatattcaagaatatatatcttcttgagtgttacaccacatatgtggttgaataaattaatgaataaatgaatgctttatatataatgttatagtcactctgaaggcaatttggaaggatataccgacatttaaagtatttgaatccatacctcagaatctac

SEQ ID NO: 12886 - DNA, 315 bp, Homo sapiens
  AC004946.1_28398
  Located on chromosome 7
  Distance between a terminus base of telomere on chromosomal short arm and 5'-terminus of this base sequence : 120089817
  Distance between 3'-terminus of neighbour sequence of sequence listing upward to telomere on chrosomal short arm and 5'-terminus of this base sequence : 4869
tattctacgttaccaggaattaagagaaaagagtatggtcaactccaggtgttaaattaaactacatagcatctttataaaaagccaagttgcgtctggtttaactgtgagaatgaggatctagacagataatcctcatcagtgcaggcatgatgggggctgaatagattaacagaggtattttggtctggtcatgttcaaaaaaaaagaaagaaagaaagaaagaaagtggatgaggtagcaactggcccaagtcagaggaaatatagcccagtgggacattaaggatatcagtaagcaatagtaagtcatcca

SEQ ID NO: 12887 - DNA, 290 bp, Homo sapiens
  AC004946.1_73787
  Located on chromosome 7
  Distance between a terminus base of telomere on chromosomal short arm and 5'-terminus of this base sequence : 120135252
  Distance between 3'-terminus of neighbour sequence of sequence listing upward to telomere on chrosomal short arm and 5'-terminus of this base sequence : 45120
ttctatccaagtgatgtagctacactgaagaccaaggatatgtgaagattatatgcaaatactatgccattttatgtaggggacttgagcatccttggattttggcatctgcaggcatgctggatccaattctccatggatactgagggacaactgcatacacacacacacacacacacacacacacacacacacacacacacacaaatattcagccttaaaaagatgatcctaccatttgccacaatatagatggacctggaggacactctacatgcaataagccagac

SEQ ID NO: 12888 - DNA, 405 bp, Homo sapiens
  AC004946.1_77466
  Located on chromosome 7
  Distance between a terminus base of telomere on chromosomal short arm and 5'-terminus of this base sequence : 120138867
  Distance between 3'-terminus of neighbour sequence of sequence listing upward to telomere on chrosomal short arm and 5'-terminus of this base sequence : 3325
tttcttactcatttccaagcatgctggtctccctgttcttgcttaaaaatgctaatgaggcccttttctcttggctttagaattttctcttatcttcctggaacactctgtttccaaatattcacatttacttttctcttacttctttaagttctctgcttgaagggcacattactggaggggtccaccctgacctccctagctaaaaatcactctctctctcgtgtgtgtgtgtgtgtgtgtgtgtgtgtgtgtgtgtctgtatctgtgggtctgtctccactttctccattctttcttcattgtcttcatagaatttatccatactttttgtatttatatttatgtatttatttacctgtttattttctcatcacagaagactatgtattccatgaagtcagc

SEQ ID NO: 12889 - DNA, 442 bp, Homo sapiens
  AC006332.3_18680
  Located on chromosome 7
  Distance between a terminus base of telomere on chromosomal short arm and 5'-terminus of this base sequence : 120188571
  Distance between 3'-terminus of neighbour sequence of sequence listing upward to telomere on chrosomal short arm and 5'-terminus of this base sequence : 49299
taagaattcgtattgatgccagggaagcaaattcaataaaacaccagtttagttcagctttggctgcaagattattgtaatgttctgtttcagtagttattagaaaatatcaagatctcttctttcatttattcagcaaatatttgagtgcctacactgggccatgttctttctaagtgttaatgatacaacgattaatgaggcatattttctgccctgaaaaaatatgtcatagagtaacacacacacacacacacacacacacacacacacacacacacacagacacacacacacacacaaacacacccacacacattctacattacagtgcaaagagtaaggtaataaaacttatgtcaggaaattatggtgcttggggagggaaaccaaatctcgtgaggagtttcacagaaggcttgctaatggtagattctgaatg

SEQ ID NO: 12890 - DNA, 253 bp, Homo sapiens
  D7S2487
  Located on chromosome 7
  Distance between a terminus base of telomere on chromosomal short arm and 5'-terminus of this base sequence : 120209070
  Distance between 3'-terminus of neighbour sequence of sequence listing upward to telomere on chrosomal short arm and 5'-terminus of this base sequence : 20057
ccttatgggatagtccctaaagcccccagaaagtcagtcacttgaaatagttcccctctatcagcatactgtaaatttcatagtcataaatcattgttgtcaatgtagggaaagtcaagcagtgagacacgaaatgttttgtggtttttccataagcagtgtgtgtgtgtgtgtgtgtgtgtgtgtgtgtgtgtgtgtgtgtgtgtgtgtaatatttgagatttttaagacatagtgagatggactaaaaatt

SEQ ID NO: 12891 - DNA, 400 bp, Homo sapiens
  AC006332.3_72660
  Located on chromosome 7
  Distance between a terminus base of telomere on chromosomal short arm and 5'-terminus of this base sequence : 120242633
  Distance between 3'-terminus of neighbour sequence of sequence listing upward to telomere on chrosomal short arm and 5'-terminus of this base sequence : 33310
cttctacatccactatggaagactcaccatgcttttctgatgcctttatgtggctgattagatggacatctgaagtagtgagacggacatgagaccaccaccattgccaccacatctaagctgctatacacacacacaaacacacacacacacacaaacacacacacacacacacacacagacacacgaggatgctttcctagggaatgtgagcattttaacaatgtctttctggaattaatgcacctgtctttgttgtttaacccagtgagataaattattagtaaaatgtcctgaactactattactagagtttctgataatatccttgcatggattttcattgcagaccacattcaattttggaatttttttttcctggagtaaatagcattcatgc

SEQ ID NO: 12892 - DNA, 212 bp, Homo sapiens
  AC006332.3_121328
  Located on chromosome 7
  Distance between a terminus base of telomere on chromosomal short arm and 5'-terminus of this base sequence : 120291366
  Distance between 3'-terminus of neighbour sequence of sequence listing upward to telomere on chrosomal short arm and 5'-terminus of this base sequence : 48333
gctgtttccaaggacttgtacaattttgaaaaaaagtacatatacataactatatgtgtgtgtatataagtgtgtgtgtgtgtgtgtgtgtgtatatatatatatatatatatatatatatatatatatatatatttgctctttttccagccaaatatgttttagttaattaaatttcagctagctggttgtaaagttggctacgttctgaa

SEQ ID NO: 12893 - DNA, 319 bp, Homo sapiens
  chr7.fa.O7frz.124320042
  Located on chromosome 7
  Distance between a terminus base of telomere on chromosomal short arm and 5'-terminus of this base sequence : 120416910
  Distance between 3'-terminus of neighbour sequence of sequence listing upward to telomere on chrosomal short arm and 5'-terminus of this base sequence : 125332
gactaagtcatccatttaggtttaatataattttttagagttgacatgatttttatatcacaagtttaacattttgaaacaactcagtgagaagtggaaaaaaattgctattctcgataagccaaaaaaaaacatacacacacacacacgtacacacatatatgcacatatacacatatatagtatgtatatacaatacatacatattatatattgtccacatatatttatacacagatatacacacacacacactctgtgtgtgtgtgtgtgtgtgtgtgtgtgtgtgtgtgtgtgtgtatgtctttggcctatcaag

SEQ ID NO: 12894 - DNA, 313 bp, Homo sapiens
  AC004888.1_6138
  Located on chromosome 7
  Distance between a terminus base of telomere on chromosomal short arm and 5'-terminus of this base sequence : 120516063
  Distance between 3'-terminus of neighbour sequence of sequence listing upward to telomere on chrosomal short arm and 5'-terminus of this base sequence : 98834
gaaccattaagctaacgtcattaccatcttctctcaggctttaaagtaacacttccttttccttacacacacacacacacacacacacactctctctctctctctctctctctctcacacacacacacacacacacaaacacatgcacatgcaaacattttatacccccttccttttcctgtatacatctgtggctaaaccaagccactatatgccctttactatcaaacttgaaaaaaattctcctctggggaattgttaattttcagatatcaatgaaatatttatttagtgacttcaatccatttcgtag

SEQ ID NO: 12895 - DNA, 197 bp, Homo sapiens
  AC004888.1_123221
  Located on chromosome 7
  Distance between a terminus base of telomere on chromosomal short arm and 5'-terminus of this base sequence : 120633209
  Distance between 3'-terminus of neighbour sequence of sequence listing upward to telomere on chrosomal short arm and 5'-terminus of this base sequence : 116833
catcttggtacaataactttggagggaaatttggtaagacttaacaaaagaaacacacacacacacacacacacacacacacacacgcactccctttggtccaggaataattttgctttcagaaatatgtcttgtagataagctcatcatcatattcaaagcaggcagccttgcttatagttgccaaagatgcttta

SEQ ID NO: 12896 - DNA, 420 bp, Homo sapiens
  AC004888.1_152197
  Located on chromosome 7
  Distance between a terminus base of telomere on chromosomal short arm and 5'-terminus of this base sequence : 120661903
  Distance between 3'-terminus of neighbour sequence of sequence listing upward to telomere on chrosomal short arm and 5'-terminus of this base sequence : 28497
tctaattgcacttggaattaaatgtgtagaaatacaagccaggtgtggtggctcacacctgtaatcccagcactttgggaggccgaggagggtgggattacctcgggtcaggagttcaagaccaggttcgccaacaaggtgaaacccccgcctctactaaaaatgaaaaaaaaaaaaaattagccacgcatggtggcacacacctgtaatcccagctacttgggaggctactcaggagaattgcctgagcccggaaggcagaggttgcagtgagccaagatcgtgccactgcactccagcctgactgacagagtaagactctgtctcaaaaagaaaagaaagaaagaaagaaagaaagaaagaaagaaagaaagaaagaaagaaagaaagaaagaaagaaagaccattacactaaagctg

SEQ ID NO: 12897 - DNA, 193 bp, Homo sapiens
  AC004456.1_36781
  Located on chromosome 7
  Distance between a terminus base of telomere on chromosomal short arm and 5'-terminus of this base sequence : 120703950
  Distance between 3'-terminus of neighbour sequence of sequence listing upward to telomere on chrosomal short arm and 5'-terminus of this base sequence : 41627
tgagtaagccaccgatatctaggtaatccataatttgtcatcctggctttcaaagtgaccatatctgaccattgtactggaacctggtgataaaaagcaaaatatcaacagctgtagctcacacacagacacagattcacacacacacacacacacacacacacacacgtacacacgcatactcggaatgtct

SEQ ID NO: 12898 - DNA, 376 bp, Homo sapiens
  AC004456.1_88195
  Located on chromosome 7
  Distance between a terminus base of telomere on chromosomal short arm and 5'-terminus of this base sequence : 120755474
  Distance between 3'-terminus of neighbour sequence of sequence listing upward to telomere on chrosomal short arm and 5'-terminus of this base sequence : 51331
caagaactatggttctaccataactggtttgttttgttttgttttgttttgttttgttttgttttgtttgagacagagtctcactctgtcacccaggcttgagtgtagtggctccatctctgctcacttaacctctgcctcccgagttcaagtgattctcatgccttagcctctcgagaagctgggactacaggtatgcaccaccacgtcgtgctaattttgtctttgtagagacagagtttcaccatgttgcccaggctggtctcaaactcctgtcctaaggtgatccacccacctcagcctcccaaagtgctaggattacaggtgtgagccaccatgactggccaggttttaaaccaatcaagatgtattacct

SEQ ID NO: 12899 - DNA, 158 bp, Homo sapiens
  AC004456.1_89402
  Located on chromosome 7
  Distance between a terminus base of telomere on chromosomal short arm and 5'-terminus of this base sequence : 120756686
  Distance between 3'-terminus of neighbour sequence of sequence listing upward to telomere on chrosomal short arm and 5'-terminus of this base sequence : 836
gccttagcaacagagcaagaccctctctctctctctctctctctcaaacagcaacaacaacaacaataacaaagaactcttctcttaattttcagttatttgaaacaaaatgtaaggaaaaggaaggaatacacgtctatttacaaacagctgccaat

SEQ ID NO: 12900 - DNA, 266 bp, Homo sapiens
  AC004456.1_97890
  Located on chromosome 7
  Distance between a terminus base of telomere on chromosomal short arm and 5'-terminus of this base sequence : 120765109
  Distance between 3'-terminus of neighbour sequence of sequence listing upward to telomere on chrosomal short arm and 5'-terminus of this base sequence : 8265
tttaaaccgctatagtgttaccacttgcttagtgacaatttttgaatgttgtctaccatctgcccccacaactatgaccacccttcaacacacacacacacacacacacacacacactctcagtgttgaatttccttagatactttggacactaaaacctgcaagaagcaagccagggtctgctttgacctttctgacatgtccctcaagccctagagctggggtattttcccagcccctgcctacatgaacctgtggatattagc

SEQ ID NO: 12901 - DNA, 377 bp, Homo sapiens
  AC004537.1_77546
  Located on chromosome 7
  Distance between a terminus base of telomere on chromosomal short arm and 5'-terminus of this base sequence : 120887908
  Distance between 3'-terminus of neighbour sequence of sequence listing upward to telomere on chrosomal short arm and 5'-terminus of this base sequence : 122533
taaattaacacggtgataggaaactgacaattacaagactactttttgaatgttgagaaggaactagagagggtagagaaagaaaaaagtattacatgcagattagcctgcatatgcaaataagaaatgaaatagctggatagcctgatacatttggagaattcaaagtatttgttatactgtgtgtgtgtgtgtgtgtgtgtgtgtgtgtgtgttgttgttgttgttactgatggaagcaggaaggcaaatacacaaagtagaaaagtcagcagggtctagatgttggaaatgtgcacatgataaggagtctggattctattccaaaggcaacagagaatccctgaagaatgctaagcaaagactggcataaatac

SEQ ID NO: 12902 - DNA, 257 bp, Homo sapiens
  D7S643
  Located on chromosome 7
  Distance between a terminus base of telomere on chromosomal short arm and 5'-terminus of this base sequence : 120986835
  Distance between 3'-terminus of neighbour sequence of sequence listing upward to telomere on chrosomal short arm and 5'-terminus of this base sequence : 98550
agctaatattgctccctttttctgtacacacacacacacacacacacacacacacagttgtttgtttgtttctccaggacttgtggctactgagaagactagggccaaaacttgtatttaccaagtacagtgtagagtttgtgctgaatattctctatttgcccctcagattcactctacacccatctccagggagccgtcctccacagactgcatccacagggcaaccttgtcccctggcatctagcaagagattg

SEQ ID NO: 12903 - DNA, 292 bp, Homo sapiens
  AC006364.3_99507
  Located on chromosome 7
  Distance between a terminus base of telomere on chromosomal short arm and 5'-terminus of this base sequence : 121188484
  Distance between 3'-terminus of neighbour sequence of sequence listing upward to telomere on chrosomal short arm and 5'-terminus of this base sequence : 201392
aagagtgccatgacatgtttagggtaccatgtttgaatcagtggcctggcaaaggcacaccagtgcctttcctattgtagtactatgtcaaactgtatgtcagtgtgcctggcctgaaaacacacacacacacacacacacacacacacacacaaagactagaagataaatcatctgagactgttccttagttgcattggagacagctgcaatgaggtaagaaaagtgacaaagttgaattttaaccttggtctttttcgaaacataagttatagccattcctggttatgta

SEQ ID NO: 12904 - DNA, 193 bp, Homo sapiens
  D7S480
  Located on chromosome 7
  Distance between a terminus base of telomere on chromosomal short arm and 5'-terminus of this base sequence : 121218481
  Distance between 3'-terminus of neighbour sequence of sequence listing upward to telomere on chrosomal short arm and 5'-terminus of this base sequence : 29705
cttggggactgaaccatctttcaggtagacaagttcctgtcaatggctaaggtttcctcctcctgcagtcccccagcaaatgcagtttccccctccccaccatgtgcgcgcgcgcacacacacacacacacacacacacacacacacacacacacacacgtaccactctcctccctccagccctatggtagct

SEQ ID NO: 12905 - DNA, 197 bp, Homo sapiens
  AC006364.3_69505
  Located on chromosome 7
  Distance between a terminus base of telomere on chromosomal short arm and 5'-terminus of this base sequence : 121218499
  Distance between 3'-terminus of neighbour sequence of sequence listing upward to telomere on chrosomal short arm and 5'-terminus of this base sequence : -175
tttcaggtagacaagttcctgtcaatggctaaggtttcctcctcctgcagtcccccagcaaatgcagtttccccctccccaccatgtgcgcgcgcgcacacacacacacacacacacacacacacacacacacacacacacgtaccactctcctccctccagccctatggtagctccagtaagagattcagatctga

SEQ ID NO: 12906 - DNA, 307 bp, Homo sapiens
  AC006364.3_58651
  Located on chromosome 7
  Distance between a terminus base of telomere on chromosomal short arm and 5'-terminus of this base sequence : 121229258
  Distance between 3'-terminus of neighbour sequence of sequence listing upward to telomere on chrosomal short arm and 5'-terminus of this base sequence : 10562
tcaccagctttccttatgtaagataaacgtcttaatcagactttatttttctgtaaaattgaaatcataagtacctgcttattaactagctattatgtgcaacaaatatcttcctctaaaactaaatcaggtaaaatatttattaaaatatgctctgagaagcagaattctaattctgtagaattaaactttgtgtgtgtgtgtgtgtgtgtgtgtgtgtgtgtgtgtgtgtgtgtatctgtccttgaattttgcatttcatcagtcctgagtggtgattacactgctttattctaattccagattg

SEQ ID NO: 12907 - DNA, 153 bp, Homo sapiens
  AC006364.3_12991
  Located on chromosome 7
  Distance between a terminus base of telomere on chromosomal short arm and 5'-terminus of this base sequence : 121275100
  Distance between 3'-terminus of neighbour sequence of sequence listing upward to telomere on chrosomal short arm and 5'-terminus of this base sequence : 45535
gctgtactcaaagaacatccacacacacacacacacacacacacacacacacacgcatgcaacataaaaagacattgcaacacatttatttagaccacaaacaagttcttcgtttctgagaatatttttcttgaacaattgtaccgttacttt

SEQ ID NO: 12908 - DNA, 274 bp, Homo sapiens
  D7S650
  Located on chromosome 7
  Distance between a terminus base of telomere on chromosomal short arm and 5'-terminus of this base sequence : 121308338
  Distance between 3'-terminus of neighbour sequence of sequence listing upward to telomere on chrosomal short arm and 5'-terminus of this base sequence : 33085
ggctgcttagcccataatcttctgctttcattttgttagaaaacctttttgacaaatctattataattcaattataataaacacaataatcatttttctcaaaaaatattgtgatcactaattattagatttttcaatgcttttagcaatttttcttctggtattatcaactagaagccatcctgaacacacacacacacacacacacacacacacacacacacacacatgagttcgcttccacatgtctttctgatgtacttataccagtggt

SEQ ID NO: 12909 - DNA, 373 bp, Homo sapiens
  AC004875.1_101451
  Located on chromosome 7
  Distance between a terminus base of telomere on chromosomal short arm and 5'-terminus of this base sequence : 121474695
  Distance between 3'-terminus of neighbour sequence of sequence listing upward to telomere on chrosomal short arm and 5'-terminus of this base sequence : 166083
ggaagtcatctttgtcaacagctcaaaagggtgagttgcccccattctgtctcttcacttcctctggcaaactgtgtttccctagtcagggcatttattatcatttatggtgattgctgattttattgttttttcttcccttcttgttggtaagctttaccagaggagaaatagtttcttttgcataccttggagttcctgatatataatatatattaaactaataataataataataataaaattgtcaaatcaggagtggtaagaggaaaatcaggagagtaatttctgaaattcaactgacaaatgtgtttcaacaagagattatttaacagtgtcagtgttaggagagaagtcaggtaagctaaagact

SEQ ID NO: 12910 - DNA, 383 bp, Homo sapiens
  AC004875.1_79595
  Located on chromosome 7
  Distance between a terminus base of telomere on chromosomal short arm and 5'-terminus of this base sequence : 121496640
  Distance between 3'-terminus of neighbour sequence of sequence listing upward to telomere on chrosomal short arm and 5'-terminus of this base sequence : 21572
taagtttatttgttagagccaaagacataatcatggtgccatgataggagaaaaggcttttttattttagtagagatgcacaacacatacacgttctctctctgtgtcgcttccttccttccttccttccttccttccttccttccttccttctctctctctttctttccttccttccttctttctttctttctttctttctttctctttctttcttttcttttccttccttccttccttccttccttccttccttccttccttctttctttctttctttctttctttctttctttctttctttctttctttctttctttctttctttctttctttcctacaaatcacactcagataatatgaataaacatttctggagcatt

SEQ ID NO: 12911 - DNA, 379 bp, Homo sapiens
  HUMUT5085
  Located on chromosome 7
  Distance between a terminus base of telomere on chromosomal short arm and 5'-terminus of this base sequence : 121496713
  Distance between 3'-terminus of neighbour sequence of sequence listing upward to telomere on chrosomal short arm and 5'-terminus of this base sequence : -310
agatgcacaacacatacacgttctctctctgtgtcgcttccttccttccttccttccttccttccttccttccttccttctctctctctttctttccttccttccttctttctttctttctttctttctttctctttctttcttttcttttccttccttccttccttccttccttccttccttccttccttctttctttctttctttctttctttctttctttctttctttctttctttctttctttctttctttctttctttcctacaaatcacactcagataatatgaataaacatttctggagcattggtgcatgcccagcattgggctaagtgctcacacaagccctttgaagtaggctgccttatccccacttt

SEQ ID NO: 12912 - DNA, 202 bp, Homo sapiens
  AC004875.1_30551
  Located on chromosome 7
  Distance between a terminus base of telomere on chromosomal short arm and 5'-terminus of this base sequence : 121545674
  Distance between 3'-terminus of neighbour sequence of sequence listing upward to telomere on chrosomal short arm and 5'-terminus of this base sequence : 48582
caaagataaagcctactttatcgtggtggataagctttttgatgtgctgctggatttggtttgctagtatttcagttaggatgtttgcatctacgctcatcaaggatattggcctgaagttttctttgtgtgtgtgtgtgtgtgtgtgtgtgtgtgtgtgtgtctctgccaagttttggtatcagagtgattctggtctcat

SEQ ID NO: 12913 - DNA, 182 bp, Homo sapiens
  D7S685
  Located on chromosome 7
  Distance between a terminus base of telomere on chromosomal short arm and 5'-terminus of this base sequence : 121545767
  Distance between 3'-terminus of neighbour sequence of sequence listing upward to telomere on chrosomal short arm and 5'-terminus of this base sequence : -109
cgctcatcaaggatattggcctgaagttttctttgtgtgtgtgtgtgtgtgtgtgtgtgtgtgtgtgtgtctctgccaagttttggtatcagagtgattctggtctcattgattaagttagggaagattccctcctcctcaattttttgcaatagttttagtaagaactgttgccaggtctt

SEQ ID NO: 12914 - DNA, 411 bp, Homo sapiens
  AC006979.2_43517
  Located on chromosome 7
  Distance between a terminus base of telomere on chromosomal short arm and 5'-terminus of this base sequence : 121619469
  Distance between 3'-terminus of neighbour sequence of sequence listing upward to telomere on chrosomal short arm and 5'-terminus of this base sequence : 73520
tggtttcttgactattgcaaactgtttgtctatggcccttatacttggaagtcagttgggccagaaaatgattccttcagttatattttttttctttataggattgtttagatcactgtcttctgacattaaatgttgctgtggaggttgaagaagcataatatggcaagttttacagttatttttcaatattgacttttctagattaatttttcctggcatgtggtgtgtcttacacacacacacacacacacacacacacacacacacacacacacagacacatccaagccttctttataatttcaagaaaatttctttgaattatatttaaatatttgttctgtacttttatcttgatttaggttttttaggaattccaattatgtgtatgttgcaccatctttgtct

SEQ ID NO: 12915 - DNA, 308 bp, Homo sapiens
  AC006979.2_94911
  Located on chromosome 7
  Distance between a terminus base of telomere on chromosomal short arm and 5'-terminus of this base sequence : 121670975
  Distance between 3'-terminus of neighbour sequence of sequence listing upward to telomere on chrosomal short arm and 5'-terminus of this base sequence : 51095
ctgatttgatcctttcagtcaccacccaagtgaagaaaattctttggaatttggggtcatctgcaaaaaatagagactgcctcaaacttccccttgggcaacaagattggagatctgccttctgtgtgtgtgtgtgtgtgtgtgtgtgtgtgtgtgtgtgtgtgtgtgcgtgtgtgtgtgtatgtttaaacagaactggggaaagatagcagcaagggagcattattagagcaatctgtactcccaccatttacccagatggaaattgccaggagggtatatccacgtttgagctgtctcactacgat

SEQ ID NO: 12916 - DNA, 328 bp, Homo sapiens
  AC006353.3_8677
  Located on chromosome 7
  Distance between a terminus base of telomere on chromosomal short arm and 5'-terminus of this base sequence : 121688131
  Distance between 3'-terminus of neighbour sequence of sequence listing upward to telomere on chrosomal short arm and 5'-terminus of this base sequence : 16848
agcttacagatagcctattgtgagaccttgtgatcatgtgagttaatactacttaataaacccccatatatatatatatatatatatatatatatacacacacacacacacacacacacacatatatacatatacacatatacatatatacacatatacatatatatacacatatacatatatatacacatatacatatatatacacacacatatacatatatatatatatatatatatatatatatatatctccatcctattagttctgccccactagggaaccatgacatgactaacatagagtgtgaaggcatttgtttatcagt

SEQ ID NO: 12917 - DNA, 404 bp, Homo sapiens
  AC006353.3_8799
  Located on chromosome 7
  Distance between a terminus base of telomere on chromosomal short arm and 5'-terminus of this base sequence : 121688131
  Distance between 3'-terminus of neighbour sequence of sequence listing upward to telomere on chrosomal short arm and 5'-terminus of this base sequence : -328
agcttacagatagcctattgtgagaccttgtgatcatgtgagttaatactacttaataaacccccatatatatatatatatatatatatatatatacacacacacacacacacacacacacatatatacatatacacatatacatatatacacatatacatatatatacacatatacatatatatacacatatacatatatatacacacacatatacatatatatatatatatatatatatatatatatatctccatcctattagttctgccccactagggaaccatgacatgactaacatagagtgtgaaggcatttgtttatcagtaactaatggatgttcacagcaacccacaaaggtgttcatctcttatctaaaactctacaatcacctctgaacttgg

SEQ ID NO: 12918 - DNA, 307 bp, Homo sapiens
  AC006353.3_42015
  Located on chromosome 7
  Distance between a terminus base of telomere on chromosomal short arm and 5'-terminus of this base sequence : 121721386
  Distance between 3'-terminus of neighbour sequence of sequence listing upward to telomere on chrosomal short arm and 5'-terminus of this base sequence : 32851
aactttcagttacagcatggtaactatcactaataatagttaatgataatatattatatatatttaaaatttactgagagtagatcttttatatatatatatatttattatactttaagttctaggttacatgtgcacaatgtgcaggtttgttacatatgtactttagtgttctcaccacacacacacacacacacacacacacacacacacaaaggtaacaaaaattttcagctttttaagccgataaattcctgtttgcctgtgtaaatggtactttcaggttcttacgaccttgagtgttcta

SEQ ID NO: 12919 - DNA, 168 bp, Homo sapiens
  AC006353.3_54418
  Located on chromosome 7
  Distance between a terminus base of telomere on chromosomal short arm and 5'-terminus of this base sequence : 121733939
  Distance between 3'-terminus of neighbour sequence of sequence listing upward to telomere on chrosomal short arm and 5'-terminus of this base sequence : 12246
aatgtaacacctgtttccagtaacacgttatatatatatatatatatatatatatatatatatatatatgtttgtgtgtgtgtgtgtgtgtatatatatatataacaagttgtctactaatcccacaagttagaaattattatggtttatcacttgatgctaaccaac

SEQ ID NO: 12920 - DNA, 211 bp, Homo sapiens
  AC006353.3_106601
  Located on chromosome 7
  Distance between a terminus base of telomere on chromosomal short arm and 5'-terminus of this base sequence : 121786063
  Distance between 3'-terminus of neighbour sequence of sequence listing upward to telomere on chrosomal short arm and 5'-terminus of this base sequence : 51956
acaagtattaaatttggcttttcagtttcaccatttaaagggcaaaatcattctgcctgatatatcttagagttcttcaagcatctcatatatatatatatatatatatatatatatatatatatatatatgtaatgtttatataaatgtcttgcagtgactcttaagaaaataatcagttctccataataaggcagttaggatttacctg

SEQ ID NO: 12921 - DNA, 222 bp, Homo sapiens
  AC006353.3_119572
  Located on chromosome 7
  Distance between a terminus base of telomere on chromosomal short arm and 5'-terminus of this base sequence : 121798960
  Distance between 3'-terminus of neighbour sequence of sequence listing upward to telomere on chrosomal short arm and 5'-terminus of this base sequence : 12686
agcatgagaatcattcagaaagatctaaaatatctgcaacaagtggaaattgacatctatagggagattcaaatctaagattttgttgaaagttaatctgaagtacatgtaacacttaacagtgatttctgcacccggccgaattctgggttctattctttacacacacacacacacacacacacacaaatggtgggcatctgtgctttaaaggtgaaagaa

SEQ ID NO: 12922 - DNA, 408 bp, Homo sapiens
  AC006020.2_40766
  Located on chromosome 7
  Distance between a terminus base of telomere on chromosomal short arm and 5'-terminus of this base sequence : 121945133
  Distance between 3'-terminus of neighbour sequence of sequence listing upward to telomere on chrosomal short arm and 5'-terminus of this base sequence : 145951
aaggactcataaatccttgaagtcttatctaaatatgcaaaatgtatagaaaaattagcttacagatcagagacacttcaacttgaaaaatgtagctatattttacatctggcatggggaaaagatggtacagtgctgtgagcatgagttgttttgttttgttttgttttgttttgttttacaatgaatgttctgtgttccagtggaaagatcaagggttggcatttcatccctgagtggagaaggcacagactacatcaatgcctcctatatcatggtaagtcagagaagtcactgaggagactgccagcttgtgttacagggatcaaaaccagaatgggctgccagaagcaaagactacaggcatgggcaaatgagtggtaaatttaagttaaatctgttgactgc

SEQ ID NO: 12923 - DNA, 208 bp, Homo sapiens
  AC006020.2_46903
  Located on chromosome 7
  Distance between a terminus base of telomere on chromosomal short arm and 5'-terminus of this base sequence : 121951286
  Distance between 3'-terminus of neighbour sequence of sequence listing upward to telomere on chrosomal short arm and 5'-terminus of this base sequence : 5745
aacgtaccacctgaaattgactttttgtattatattttgtgagacaagggttcggtttcattattttccatgtgatacccattgtcccaccattatttatgaattagcaatatcagttcagtcattcatatagtgtgtgtgtgtgtgtgtgtgtatatatatacatatatatatacatatatatatgtgtgcttgttctaggacattt

SEQ ID NO: 12924 - DNA, 437 bp, Homo sapiens
  AC073471.4_124428
  Located on chromosome 7
  Distance between a terminus base of telomere on chromosomal short arm and 5'-terminus of this base sequence : 121962495
  Distance between 3'-terminus of neighbour sequence of sequence listing upward to telomere on chrosomal short arm and 5'-terminus of this base sequence : 11001
ctaacgagctagcctattgatatatcagctcccatgggtcattggttggctgaagagactggaagtgaggagggtcacaattcctggcatttctgggctgctgtgattatgagcaaagagagttttcactgtcaaagaaagccttcaggcaaagagaggctgacggttggaagtccaaagtgtgcagtgtgatggtaaggccaagatgtgagtgcaactggtgtgctagaaatagttttgtctgtatggtgtatgactcagcggggatttatttatttatttatttatctattgaccttggaaagggaaatcaaagactgcttttattgatgcacaaatagacccacccatgatttgaaagggatgataatattaacataatcattatcatcaaagcaaattaaaatgcaaaggtatctgaaatggctttacagtta

SEQ ID NO: 12925 - DNA, 297 bp, Homo sapiens
  AC006020.2_128904
  Located on chromosome 7
  Distance between a terminus base of telomere on chromosomal short arm and 5'-terminus of this base sequence : 122033365
  Distance between 3'-terminus of neighbour sequence of sequence listing upward to telomere on chrosomal short arm and 5'-terminus of this base sequence : 70433
taagtgaagatcatgccattacactcccacctggacaacaaagtgagactgtctcaaacaaacaaacaaacaaacaaacaaacaaatgatgtatttaatttttgcagtttttataagggaacggggtagatgaagagagctgagattttcatagagctttttactcttccatcaaatagctaaaattctttaagtctcttcaaccctttccatagcaccaacccaatcagaatactttttaagcttatagatcacctacctaagcaaaacaatgcacaagcattacaagagcttaag

SEQ ID NO: 12926 - DNA, 366 bp, Homo sapiens
  AC006020.2_139320
  Located on chromosome 7
  Distance between a terminus base of telomere on chromosomal short arm and 5'-terminus of this base sequence : 122043673
  Distance between 3'-terminus of neighbour sequence of sequence listing upward to telomere on chrosomal short arm and 5'-terminus of this base sequence : 10011
agtctcagtctggatcaactgaatgaaagcaacctttcacagtagtcatttcactattgagatgagaaggaaataaaaagaatatatatatatgtatatatggcatgttctcacttataagtggaagctaaatgatgagaacacatgaacagatgggggaatacacacacacacacacacacacacacacacacacacacacacacacacatatatagccatgtaagaagtagcagctaagaaaaataatcaaagtataggcaaggccacagcaaaaaaatgtaaagtaaaatggagaaagtatccccaacattcaactgactctcatgataattgccatctgtgtagttcctcagaaacagacat

SEQ ID NO: 12927 - DNA, 368 bp, Homo sapiens
  chr7.fa.O7frz.126081264
  Located on chromosome 7
  Distance between a terminus base of telomere on chromosomal short arm and 5'-terminus of this base sequence : 122168754
  Distance between 3'-terminus of neighbour sequence of sequence listing upward to telomere on chrosomal short arm and 5'-terminus of this base sequence : 124715
ctgaatgagtaaccaaagtcactatttcttgtacttcttgtacttcttgttcttattgtatttcttgtagtattccttccaggaatactataggcatttaaaagcagaacacatttttcttacaatgatagcatgctactacactgctttaaaacctttctctctctctctctttctctctctctccccccctctctctccctggatgtgtgtgtgtgtgtgtgtgtgtgtgtgtgtatgtgtttgacttaactttgtaaaatctgacttggagatgattccattcacatttataaagcactttttcatcatttttatgattgcctggtttctgttgtataaatgtagtgcaataaatttaaccaaat

SEQ ID NO: 12928 - DNA, 397 bp, Homo sapiens
  chr7.fa.O7frz.126205010
  Located on chromosome 7
  Distance between a terminus base of telomere on chromosomal short arm and 5'-terminus of this base sequence : 122292046
  Distance between 3'-terminus of neighbour sequence of sequence listing upward to telomere on chrosomal short arm and 5'-terminus of this base sequence : 122924
gcaagcacagtggactaagaaaattaataagtcgctctccatgttgacaaatgcatataatgaagacctccatcacagaaacagaaaatatgaatatgggcttcaggagaaaagccagcagaactgcagtctagaacagcattatgtaaaaggaaaacactcttctctctctctctctctctctctctcccgccgccctccccacccctcaccccttcctccctccctgagatttaggaatagcacccagccaagaatctggcacattaagtaggcactctataaatgtctgattattgaataaatatcaataaaaatctacctcctaagggaaactccaagaacatcccatttaagtagactaggaaacacactggattctattgtccttttaatt

SEQ ID NO: 12929 - DNA, 419 bp, Homo sapiens
  AC006009.2_35012
  Located on chromosome 7
  Distance between a terminus base of telomere on chromosomal short arm and 5'-terminus of this base sequence : 122420854
  Distance between 3'-terminus of neighbour sequence of sequence listing upward to telomere on chrosomal short arm and 5'-terminus of this base sequence : 128411
tgctaccagatttctaactctcactaatatgctaaaaaaaaaaaaaacacaaaactgtctgatattgacagttggaatctctgaggagaccaagtaattcagtatctcttttctttgcccgagttctgaacaaattgacttaaaagagtagacagagtacaaaacatcacctttaatactggtaaagataatactgaatagagagagagagagagagagagagagagagagagagtgtgtgtgtgtgtgtgtgtgtgtgtgtgtgtgtgtttcctgcaagtggtgggcttccttatgaggttcagtattattatgacacgtattttccccagcccagtcacagatagtgctaagaggacaggctgttccatgagaagatcttgcccatgacaggcttgtgcagaatgaacagagaacat

SEQ ID NO: 12930 - DNA, 202 bp, Homo sapiens
  D7S2486
  Located on chromosome 7
  Distance between a terminus base of telomere on chromosomal short arm and 5'-terminus of this base sequence : 122421028
  Distance between 3'-terminus of neighbour sequence of sequence listing upward to telomere on chrosomal short arm and 5'-terminus of this base sequence : -245
aatactggtaaagataatactgaatagagagagagagagagagagagagagagagagagagtgtgtgtgtgtgtgtgtgtgtgtgtgtgtgtgtgtttcctgcaagtggtgggcttccttatgaggttcagtattattatgacacgtattttccccagcccagtcacagatagtgctaagaggacaggctgttccatgagaa

SEQ ID NO: 12931 - DNA, 287 bp, Homo sapiens
  AC006009.2_72242
  Located on chromosome 7
  Distance between a terminus base of telomere on chromosomal short arm and 5'-terminus of this base sequence : 122458183
  Distance between 3'-terminus of neighbour sequence of sequence listing upward to telomere on chrosomal short arm and 5'-terminus of this base sequence : 36953
cctacgtttatcacagcgttagtcacaataacaaagtcatagaatcaaccaaaatgtctatcaacagataactgcataaaatttttaattgcataaacatatgtgtgtacacagacacacacatacacacacatgcacacacacacacacacacacacacacacaaaacactacccagacataagagagaatgaaattatgtcttttacagcaacatggatggagctggaggccattatcctaagtgaaataattcagaaacagaaagtcaaatacagcatgttctc

SEQ ID NO: 12932 - DNA, 390 bp, Homo sapiens
  AC006009.2_86845
  Located on chromosome 7
  Distance between a terminus base of telomere on chromosomal short arm and 5'-terminus of this base sequence : 122472625
  Distance between 3'-terminus of neighbour sequence of sequence listing upward to telomere on chrosomal short arm and 5'-terminus of this base sequence : 14155
tccaacctattgaggtcattagtatagattaatggctctcaggcagggttgattttgcactaccctccaggagacatttagcaatgtctggagacattttttatttgactagaggttagggatgttgttaaatatcataaaatatacaaaaaagcacctgccaacaaagaattaccctgctcaaaacatcaatagtgctaaggttgggaaaccctgtaatagatagaaaagttgtctttctagtatgaagagagtaagggagcataagcggtttctcagatataaaattgcatcgaatatatatatatatatatatatatatatatgtcacttatgtatccaatttagaaactgcttaactatattatttgaccagctgataaacaaatt

SEQ ID NO: 12933 - DNA, 304 bp, Homo sapiens
  AC004986.2_101753
  Located on chromosome 7
  Distance between a terminus base of telomere on chromosomal short arm and 5'-terminus of this base sequence : 122655336
  Distance between 3'-terminus of neighbour sequence of sequence listing upward to telomere on chrosomal short arm and 5'-terminus of this base sequence : 182321
catgcaccggtaatcctagctactacggaagcttgggtacaagattctcttgaacccaggaggcagatgttgcagttagccatgatcatgccactacactctagcctgggtgaaaagtgagactctgcctcaaaaaaaaaaaaaaaaaatatatatatatatatacacacacacacacacacacacacacacgtatatttatgtgtgtatatataaaagtgtatatatgtgtaatatacatgtgtatatatgtatatgtatatataaaacaacagaaaagaagtactcaatagaggcgttggaa

SEQ ID NO: 12934 - DNA, 228 bp, Homo sapiens
  D7S2529
  Located on chromosome 7
  Distance between a terminus base of telomere on chromosomal short arm and 5'-terminus of this base sequence : 122667598
  Distance between 3'-terminus of neighbour sequence of sequence listing upward to telomere on chrosomal short arm and 5'-terminus of this base sequence : 11958
aatttcaatcactattgccatatatattaatctctaaaagtctaaattattgaaagttgattttgaagttaaaaattaatttgctaaaatttattcaagtctcttcaacaacaaatatatatatatagacatagatagatatacacacacacacacacacacacacacacacacacacacacactctggaaacaaaagaactgacaaaaaagtcatctcaaaccaatt

SEQ ID NO: 12935 - DNA, 244 bp, Homo sapiens
  AC004838.2_115510
  Located on chromosome 7
  Distance between a terminus base of telomere on chromosomal short arm and 5'-terminus of this base sequence : 122784409
  Distance between 3'-terminus of neighbour sequence of sequence listing upward to telomere on chrosomal short arm and 5'-terminus of this base sequence : 116583
ctctccagttagaatctgagtcagtaatgaagaactgttctgggaccacacattttacaggtaatgggtgaaaatatatgcagatgataagcataaattgacaaataaatgagtagttcccagttctcacacacacacacacacacacacacacgcacactacactcaaagggttgttgtgaagaataaataaaataatgcatacgaagtacttaaaatacttgataatgcgtacaaagtactg

SEQ ID NO: 12936 - DNA, 223 bp, Homo sapiens
  AC004838.2_38778
  Located on chromosome 7
  Distance between a terminus base of telomere on chromosomal short arm and 5'-terminus of this base sequence : 122861179
  Distance between 3'-terminus of neighbour sequence of sequence listing upward to telomere on chrosomal short arm and 5'-terminus of this base sequence : 76526
gtatacctatgtatcaaacctgcacgttgtgcacatgtaccctagaacttaaagtataattttaaaaagttttatttaatatgagccacacacacacacacacacacacacacacaaaaaaatggaatagtattcagccataaaagaataaaatactgtcatttgcagcaacatggatgagcctagagaacacaatattaagtgaaataagtcaggcacagaa

SEQ ID NO: 12937 - DNA, 264 bp, Homo sapiens
  AC004838.2_35462
  Located on chromosome 7
  Distance between a terminus base of telomere on chromosomal short arm and 5'-terminus of this base sequence : 122864474
  Distance between 3'-terminus of neighbour sequence of sequence listing upward to telomere on chrosomal short arm and 5'-terminus of this base sequence : 3072
ttaatccactttaaatcagcagcctgtctgcctgccattctactcccctgccccataccccacgactatatattccttccttccttccttccttccttccttccttccttccttccttccttccttccttccttcctcatgatagttagtgtgttctcgtgagatctggttgtttaataatgtgtggcatctcccctcatcttgctactgctcttgccttgcgaactgcctgctcctttttgccttccactgtgattgtaagct

SEQ ID NO: 12938 - DNA, 215 bp, Homo sapiens
  D7S1809
  Located on chromosome 7
  Distance between a terminus base of telomere on chromosomal short arm and 5'-terminus of this base sequence : 122864478
  Distance between 3'-terminus of neighbour sequence of sequence listing upward to telomere on chrosomal short arm and 5'-terminus of this base sequence : -260
tccactttaaatcagcagcctgtctgcctgccattctactcccctgccccataccccacgactatatattccttccttccttccttccttccttccttccttccttccttccttccttccttccttccttcctcatgatagttagtgtgttctcgtgagatctggttgtttaataatgtgtggcatctcccctcatcttgctactgctcttgcct

SEQ ID NO: 12939 - DNA, 384 bp, Homo sapiens
  AC004838.2_14843
  Located on chromosome 7
  Distance between a terminus base of telomere on chromosomal short arm and 5'-terminus of this base sequence : 122884993
  Distance between 3'-terminus of neighbour sequence of sequence listing upward to telomere on chrosomal short arm and 5'-terminus of this base sequence : 20300
tggcattatagattccatagctttctaagaattttctcatgtttagactttaaagattctaaatcaaacactaatctcatatccaattaacggcttcttctcttctcctatcttaggcgtggtgtagaggctggagaacagcagggaagaaagtggggtaaattctttcactcccctatcacgtcctctcccttcttctgtattgtgtgtgtgtgtgtgtgtgtgtgtgtgtgtgtgagagagagagagagaaagttatcaggcaacacactatacttttaataaaaagcattatataggataaagtatttacaaattggacaacacaggtgcattagctccttggtatcttaatttcatatctagctaaaggaagctgtcaaa

SEQ ID NO: 12940 - DNA, 413 bp, Homo sapiens
  AC006354.2_65630
  Located on chromosome 7
  Distance between a terminus base of telomere on chromosomal short arm and 5'-terminus of this base sequence : 123234787
  Distance between 3'-terminus of neighbour sequence of sequence listing upward to telomere on chrosomal short arm and 5'-terminus of this base sequence : 349410
ttgctggtgataatctcagtactgaatatttggtttttatattctcttgggggtagggtgggagaataatgccagctaccttctctactgttattttggaaccagaagactcttctcatgtctcaaaagaagaagtgactatataaagcttgctccttggtacctctaccattagggtaatagaatacatacagagaaatacagaaatacagatgcacccttactcaagggatatatatatatagatagatagatagatggatagatagatagatagatagatagatagatagatagatagataggtgataaaaggacaaaccacacattggtcaaaaacagaattcagacaacataaattttcaaggcagatttcaaaaattaagattaactaaccaaagatggataggaag

SEQ ID NO: 12941 - DNA, 251 bp, Homo sapiens
  AC006354.2_84219
  Located on chromosome 7
  Distance between a terminus base of telomere on chromosomal short arm and 5'-terminus of this base sequence : 123253534
  Distance between 3'-terminus of neighbour sequence of sequence listing upward to telomere on chrosomal short arm and 5'-terminus of this base sequence : 18334
tttcaatgaccatttactccattccctattgtgagaaaggatattgttctctggtcttttttcctgtttctctctctctctctctgtctctctctctctctctgtgtgtgtgtgtgtgtgtgtgtgtgtgtgtgtgtgtgtgtgactctgtgtgtgattctctcaacatttctttaaaaaatcgggagtatttgaatcttctaccaaaaaggaggtacagaaatctaagattctttgaatgtctcctttaa

SEQ ID NO: 12942 - DNA, 286 bp, Homo sapiens
  AC006354.2_98535
  Located on chromosome 7
  Distance between a terminus base of telomere on chromosomal short arm and 5'-terminus of this base sequence : 123267829
  Distance between 3'-terminus of neighbour sequence of sequence listing upward to telomere on chrosomal short arm and 5'-terminus of this base sequence : 14044
aaaggcagaggctaaattaaagaaatgagaacactggagagaaactaaaagtcacatggtaaaagaatgcctacagtccatggaaaaagaaagtctctggtgtttttttttgtttgtttttattgtgtgtgtgtgtgtgtgtgtgtgtgtgtgtgtgtgtgtgtgtgtgtgtttgctacagattacccccttatagggacagcccaattgctctccttgcttctgtggcttgacagctgcctttctttcttctcctagaagtgtctctttcattacagagccagtg

SEQ ID NO: 12943 - DNA, 247 bp, Homo sapiens
  AC006354.2_98996
  Located on chromosome 7
  Distance between a terminus base of telomere on chromosomal short arm and 5'-terminus of this base sequence : 123268382
  Distance between 3'-terminus of neighbour sequence of sequence listing upward to telomere on chrosomal short arm and 5'-terminus of this base sequence : 267
caaagataaccagtaaggaacaattatttaaacacacacacacacacacacacacacacacacacaatcttcgaggagtgtgggggaagaaaagaaaaaaaaatcagggtcagttaagattgaagaaagcaatttcctaaaatcaaaacaaagtacaaagtctataacccacaaagatgacagcccattacgttactgtgcatagcagcatcagtccccttttgtcatctatttgagacacctgaat

SEQ ID NO: 12944 - DNA, 183 bp, Homo sapiens
  D7S2434
  Located on chromosome 7
  Distance between a terminus base of telomere on chromosomal short arm and 5'-terminus of this base sequence : 123479070
  Distance between 3'-terminus of neighbour sequence of sequence listing upward to telomere on chrosomal short arm and 5'-terminus of this base sequence : 210441
catatccatcaccttacatagttactatttgtgtgtgtgtgtgtgtgtgtgtgtgtggtgagaacaattaagcaaactctcttagcaaactttaagtatactataaattatcattaactatagttaccatgctgtacattagatctctaaaacttataactgaaactctgtttctatgaattc

SEQ ID NO: 12945 - DNA, 355 bp, Homo sapiens
  chr7.fa.O7frz.127551610
  Located on chromosome 7
  Distance between a terminus base of telomere on chromosomal short arm and 5'-terminus of this base sequence : 123579402
  Distance between 3'-terminus of neighbour sequence of sequence listing upward to telomere on chrosomal short arm and 5'-terminus of this base sequence : 100149
gacagtggctgagtaattgtacttgataatgataaaaagccagtaagactaggtgacatacgtgtgggttacatgtacagaacacagaacaatctttttcttctatttttctcatgtaaaattgattgtgtgaaggtagtatttgaagaagtactggagctctagtattagaacttgaaaattaacagaagcccaagagaagcaacattatcttctcttagccctaaactaagttgttacttttaaaacgataattatttattatttatttatttatttatttaagtctcatggtcagctctaaattgttacagaatttatttggaaaggagttcaattgagtcatgttaatttc

SEQ ID NO: 12946 - DNA, 188 bp, Homo sapiens
  D7S487
  Located on chromosome 7
  Distance between a terminus base of telomere on chromosomal short arm and 5'-terminus of this base sequence : 123633249
  Distance between 3'-terminus of neighbour sequence of sequence listing upward to telomere on chrosomal short arm and 5'-terminus of this base sequence : 53492
tctaggctatttaaggtttttcatattcaagtcccacaatgatatacctatctctcctctctattattcaaatcttttatacatttatatatgtgtgtgtgtgtgtgtgtgtgtgtgtgtgtgtgtgtgtatatatatatatatatgctggtttgcagcatatatctttttgtgcataatttttgtct

SEQ ID NO: 12947 - DNA, 218 bp, Homo sapiens
  AC006029.2_130323
  Located on chromosome 7
  Distance between a terminus base of telomere on chromosomal short arm and 5'-terminus of this base sequence : 123776236
  Distance between 3'-terminus of neighbour sequence of sequence listing upward to telomere on chrosomal short arm and 5'-terminus of this base sequence : 142799
ttccaactacagatcttggaacttctcagcctccataactgtgaacccatttattagagtaaatctctctctctctttctctctgataaacacacacacacacacacacacacacacacacacacacacacacactattggttctgtttctcgggagaatgcagactaatacaccaagaaaagtaattttctgctgtcaaatttattgctatccacaa

SEQ ID NO: 12948 - DNA, 210 bp, Homo sapiens
  AC004690.1_103627
  Located on chromosome 7
  Distance between a terminus base of telomere on chromosomal short arm and 5'-terminus of this base sequence : 123841010
  Distance between 3'-terminus of neighbour sequence of sequence listing upward to telomere on chrosomal short arm and 5'-terminus of this base sequence : 64556
ctcaaagattgaatttgctgagattaaaacaccacacacacacacacacacacacacacacacacacacacacagacaggttcacacactaacatttcaaaagattaaatcttcctttaattgactgggcaaagggctgtcttttctcacccaacaggttaaatactgcagagctaatagattggagtgacttctgacctagtcacatct

SEQ ID NO: 12949 - DNA, 171 bp, Homo sapiens
  AC004690.1_69516
  Located on chromosome 7
  Distance between a terminus base of telomere on chromosomal short arm and 5'-terminus of this base sequence : 123875150
  Distance between 3'-terminus of neighbour sequence of sequence listing upward to telomere on chrosomal short arm and 5'-terminus of this base sequence : 33930
taatatttggttgcatacaaacacacacacacacacacacacacatatatatgatttatataataaaccactcctaggttatacctaagagaaatgtatagaatgcgcaccaaagaagaggttcaagaatgcccatagcaacactagtccaacttaaatgtctagtcaaca

SEQ ID NO: 12950 - DNA, 271 bp, Homo sapiens
  D7S2520
  Located on chromosome 7
  Distance between a terminus base of telomere on chromosomal short arm and 5'-terminus of this base sequence : 123890834
  Distance between 3'-terminus of neighbour sequence of sequence listing upward to telomere on chrosomal short arm and 5'-terminus of this base sequence : 15513
actgatttggcaactggaggtcacttgtggcagtgaaaagaaaaatttccttgagtggtagagacaaaacttttcttcaagagaaaaagaacaatgaggaagtaaagactgcatatgtgggaatctttttcagagagttttgctatgaaggctagcagagaaacaaaagctgtaggagatttgtgaaggcagggaagttttgttttgtgtgtgtgtgtgtgtgtgtgtgtgtgtgtgtgtgttttagaagggagggagctattaaagtaca

SEQ ID NO: 12951 - DNA, 440 bp, Homo sapiens
  AC004690.1_16883
  Located on chromosome 7
  Distance between a terminus base of telomere on chromosomal short arm and 5'-terminus of this base sequence : 123927506
  Distance between 3'-terminus of neighbour sequence of sequence listing upward to telomere on chrosomal short arm and 5'-terminus of this base sequence : 36401
ggaaatgctttgttctagctactgtggggtctcaggtggagaatagtacctcgtcctggcacaccccgctgctgggttcttcttttggcagaactaggtcatcccagaaatggagagtgacataaagggccagggtttatctttttctatcttttccctccctcccttcacctctcccctcttctcccttccctcattccctacttcctcccctcccctcccctcccctccaatccctccctccctctctctctcccttcctccctctttatctccttccttccttccttccttccttccttccttccttccttccttccttggttgagagagtggaaggggttcagaatgttggtgtgttggttccaccattctctccaattttgaatcagtcttggaactggaaagagcctcgggggtgaattataccgattacctcc

SEQ ID NO: 12952 - DNA, 194 bp, Homo sapiens
  D7S648
  Located on chromosome 7
  Distance between a terminus base of telomere on chromosomal short arm and 5'-terminus of this base sequence : 124110994
  Distance between 3'-terminus of neighbour sequence of sequence listing upward to telomere on chrosomal short arm and 5'-terminus of this base sequence : 183048
ctgaggcacaaaaattgcttgaatcccgggaggcagaggtttcagtgggccgagattacacaactgcactccagcctgggtggcagagtgagactctctcctctttctgtgtatgtacgtgtgtgtgtgtgtgtgtgtgtgtgtgtatatgtatataaaattaaattttctgttttttcaaggaagtccatcga

SEQ ID NO: 12953 - DNA, 246 bp, Homo sapiens
  AC006148.3_112911
  Located on chromosome 7
  Distance between a terminus base of telomere on chromosomal short arm and 5'-terminus of this base sequence : 124171796
  Distance between 3'-terminus of neighbour sequence of sequence listing upward to telomere on chrosomal short arm and 5'-terminus of this base sequence : 60608
taccatgcctaacctagatgacactcaaaattaactattagagacacttggtttcatatatatatatatatatatatatatatatatatatgaaacatatatatatatgaaacatatatacatgaaactatatatatgaaacatatatatgaaacatatatgaaacatatatatatgaaaccaagtgtatatatgtatgtatatatcctgtaatcctaatgatagtggataagtcattcagctcat

SEQ ID NO: 12954 - DNA, 364 bp, Homo sapiens
  AC004930.1_57750
  Located on chromosome 7
  Distance between a terminus base of telomere on chromosomal short arm and 5'-terminus of this base sequence : 124244896
  Distance between 3'-terminus of neighbour sequence of sequence listing upward to telomere on chrosomal short arm and 5'-terminus of this base sequence : 72854
taatctccaaagtctatggcattttagcaaaacatcctaacaatatttcagcttgactacttgaaaatataattcattattttgaagatggtaaagcatagttattataaatgattcctcatgaatatttgtgacttcaacagcaatttcttgcatatatatacatatacacacacacccctacacacacacacacacacacacacacacccctacaaacacatctttcaggaatgccatcccttacataaagatgcatataaatgtgggtatgcatacacatacacacatatatctacacactcacagacacacatctttcaggatggccatgacttatgtgaagatggagtcctaacattta

SEQ ID NO: 12955 - DNA, 240 bp, Homo sapiens
  AC005521.1_48453
  Located on chromosome 7
  Distance between a terminus base of telomere on chromosomal short arm and 5'-terminus of this base sequence : 124353950
  Distance between 3'-terminus of neighbour sequence of sequence listing upward to telomere on chrosomal short arm and 5'-terminus of this base sequence : 108690
ctgaatcattgaggtataatgacacatcataaactacatatttaacatataaaatttgataaacttaaatatatttatatatacacacacacacacacacacacacacatatatatatatatatgaaactgccaccacattcaaggcactgaaacatatttgtcaccccaaaggtttacacaggcctctgtttaaacactttctcctagccctccccaatcctaaggtaaacacggatct

SEQ ID NO: 12956 - DNA, 434 bp, Homo sapiens
  AC005521.1_78880
  Located on chromosome 7
  Distance between a terminus base of telomere on chromosomal short arm and 5'-terminus of this base sequence : 124384232
  Distance between 3'-terminus of neighbour sequence of sequence listing upward to telomere on chrosomal short arm and 5'-terminus of this base sequence : 30042
gcataattccatgttggtctatcttcatttctttgttgattcagtcaatatgtgaaacgaacaacctagcaagataaaatgtattgattatcatcctgttatacgcatgccttatgactatcatttctctcggtaaataaataaaatggctatcaattatttttccaaagtgcctaagagtaaggagttttattatatatttaatatatttagaatgtatatagggttatatatatatatatatatatatatatatatatatatatatatatacacacacatatatatgattgttcatattttggctttctggcttctgcctcaagcaaatgtgaatgaagcttggatacctctgggtactaaaaaagggaagttgttcaggtcgtcaaagcaacagttgtgatccagccatccttacattaaatcacaatgct

SEQ ID NO: 12957 - DNA, 351 bp, Homo sapiens
  AC005521.1_104362
  Located on chromosome 7
  Distance between a terminus base of telomere on chromosomal short arm and 5'-terminus of this base sequence : 124409724
  Distance between 3'-terminus of neighbour sequence of sequence listing upward to telomere on chrosomal short arm and 5'-terminus of this base sequence : 25058
gatcagaaattcatgctttgtatccaatctttgataaatattgattgcttaaatataccaaattaataaatctttctattttttcttttcattttttaatttcaaagccctttgtttttaataaaaagattttaattctaatttctatcccccccacactcatatatataacacatatacacatatatacacacacacatatatatatacacatgtatgtgtgtgtgtgtgtgtgtgtgtgtgtgtatggcagaaatttgatgcaatttatactatatatatttttaacttttacttttatgttcaggtgtacatgtgcagttttgttatataggtacattgcgtgtcaca

SEQ ID NO: 12958 - DNA, 234 bp, Homo sapiens
  AC005521.1_135241
  Located on chromosome 7
  Distance between a terminus base of telomere on chromosomal short arm and 5'-terminus of this base sequence : 124440723
  Distance between 3'-terminus of neighbour sequence of sequence listing upward to telomere on chrosomal short arm and 5'-terminus of this base sequence : 30648
aaatcatttagatggctgaattatatataagttgggttagatagacatatgatgatagatgatacagatgatgataatgaagatagatgatacagagagatagatagatagatagatagatagatagatagatagatagatagatagatgatagttttatttttctcattttctccttgccaataaaaatctgcttgcagaatttcagctaataaatcatttggttgcctacag

SEQ ID NO: 12959 - DNA, 435 bp, Homo sapiens
  chr7.fa.O7frz.128565384
  Located on chromosome 7
  Distance between a terminus base of telomere on chromosomal short arm and 5'-terminus of this base sequence : 124475745
  Distance between 3'-terminus of neighbour sequence of sequence listing upward to telomere on chrosomal short arm and 5'-terminus of this base sequence : 34788
aaggtagatgaaatatcaatctgagaaataaaaataatcagccaatctgcagaaatttttgtgatcatttcaatatgcaaatttttagaaactagaaggtagatgaaatatcaatctctgtccaaataaattaatcattagcatcttctactttaacacacacacacacacacacacacacacacaaacaggctgaaataactagatttttccttcctttatcatgatataatcctcatatataaaaaatgaagctgcaataataccatcaggatatttgacaaccatttttttgataatggtaacagattgtgtctagttattcttacctactgagtcccattattatatgactaaccacaatcatctgcaagctgagaaaccaggattaatttctagcctcagaacagaaagtaatgacaaattgacatttgg

SEQ ID NO: 12960 - DNA, 414 bp, Homo sapiens
  AC004925.1_120694
  Located on chromosome 7
  Distance between a terminus base of telomere on chromosomal short arm and 5'-terminus of this base sequence : 124622353
  Distance between 3'-terminus of neighbour sequence of sequence listing upward to telomere on chrosomal short arm and 5'-terminus of this base sequence : 146173
actgatgttagcctcaggaatatggactagtctgcaagagtatcagattgtgtgttgaatatctgatggtaaaggcattttcagtagggtcaatttatctcctaatccagtgattctttaaaaagtggaacattgtggttcacataaacagactttgtagtgctaagtaactctgaaggtgggaagaaataaggtgtgtgtgtgtgtgtgtgtgtgtgtgtgtgtgtgtttttttaagttcatagcgcccttagagattgtgatacatgtcaggcctctgagcccaagctaagttatcatatcccttgtgacctgcacatacacatccagatggccggttcctgccttaactgatgacattccaccacaaaagaagtgaaaatggcctgttcctgccttaactgatgacattgt

SEQ ID NO: 12961 - DNA, 233 bp, Homo sapiens
  AC004925.1_14537
  Located on chromosome 7
  Distance between a terminus base of telomere on chromosomal short arm and 5'-terminus of this base sequence : 124728637
  Distance between 3'-terminus of neighbour sequence of sequence listing upward to telomere on chrosomal short arm and 5'-terminus of this base sequence : 105870
atagcacgtgtatacctacgtaacaaacctccatgttcagcacatgaccccagaacttaaaagtataataaacaaaacaaaacaaaacaaaacaaaacaaaatacccatagtgatgtattgttccttgtataagaaatggtgctgaaaggtccaaaagttccaggtcttcgtggccagatctcacaggaattacactattaaacttgttcgagagtttgcaaatttcactgag

SEQ ID NO: 12962 - DNA, 101 bp, Homo sapiens
  DISD22_0005298
  Located on chromosome 7
  Distance between a terminus base of telomere on chromosomal short arm and 5'-terminus of this base sequence : 124987944
  Distance between 3'-terminus of neighbour sequence of sequence listing upward to telomere on chrosomal short arm and 5'-terminus of this base sequence : 259074
atatgcacgcacatccactcacatcccccatcacacacacacacacacacacacacacacacacacacacacacacatgctctacgaacagctgtctgagc

SEQ ID NO: 12963 - DNA, 207 bp, Homo sapiens
  Z24327.1_34
  Located on chromosome 7
  Distance between a terminus base of telomere on chromosomal short arm and 5'-terminus of this base sequence : 125123248
  Distance between 3'-terminus of neighbour sequence of sequence listing upward to telomere on chrosomal short arm and 5'-terminus of this base sequence : 135203
atctgtcctcctggatacaaacacacacacacacacacacacacacacacacacacacacacacacacacacacacgatgaaggacaagacaaataggggaccattttagtttacctcagtacatatgtatttatttaggggatgggggcttaacgcattttgggagcaggggcttgtatttgttgtaatgaaaggtagttgctgga

SEQ ID NO: 12964 - DNA, 164 bp, Homo sapiens
  DISD22_0005306
  Located on chromosome 7
  Distance between a terminus base of telomere on chromosomal short arm and 5'-terminus of this base sequence : 125227739
  Distance between 3'-terminus of neighbour sequence of sequence listing upward to telomere on chrosomal short arm and 5'-terminus of this base sequence : 104284
atggctaagatgacacaagctatatatatatatatatatatatatatatatatatatatatatacacacacacacacacgcacacacacacacacacacacacatatatatatatatatatatacacatatatatatataatgataatggctaagatgacacgt

SEQ ID NO: 12965 - DNA, 121 bp, Homo sapiens
  DISD22_0005316
  Located on chromosome 7
  Distance between a terminus base of telomere on chromosomal short arm and 5'-terminus of this base sequence : 125482174
  Distance between 3'-terminus of neighbour sequence of sequence listing upward to telomere on chrosomal short arm and 5'-terminus of this base sequence : 254271
ggcccagaccagttagagtttctgaaattagccttgggtgtgtgtgtgtgtgtgtgtgtgtgtgtgtgtgtgtgtgtgttttaaagcctccctcttttccagtgattctaatgtaaagcac

SEQ ID NO: 12966 - DNA, 302 bp, Homo sapiens
  chr7.fa.O7frz.116709801
  Located on chromosome 7
  Distance between a terminus base of telomere on chromosomal short arm and 5'-terminus of this base sequence : 125637130
  Distance between 3'-terminus of neighbour sequence of sequence listing upward to telomere on chrosomal short arm and 5'-terminus of this base sequence : 154835
caatagctgagccacatactatgttggtgaagttatagagaaatgggtattcttacttacttatttatttatttatttatttatttatttatttgctggtgaaactgcaaaatgatataacctctacacagggcaatttggcagcacatctaataaaatcacatatgcatttaatctccattcctgcaattccacacctaggaatctacaaatatacaatgacaaaaatacaaaatgcacacacacaaggttattcattacagcactatttgtagtagcaaaagcttgtaaacaagtcatga

SEQ ID NO: 12967 - DNA, 460 bp, Homo sapiens
  chr7.fa.O7frz.116906640
  Located on chromosome 7
  Distance between a terminus base of telomere on chromosomal short arm and 5'-terminus of this base sequence : 125784865
  Distance between 3'-terminus of neighbour sequence of sequence listing upward to telomere on chrosomal short arm and 5'-terminus of this base sequence : 147433
gtgtccttgcagatgtaactagttgagatgaggtcacagtgggatagggtggagctctaatatgactcatgtccttataaaatggggagatttggacacacacacaccacacacacacacacacacacacacacacacacacacacacagagaacaccatgtgaagatgaaggcagaggcagagatggggtaatgcttttacaggacaaagaatgccaaagattgccaatagaccaccagaagctaggcaagaagtgtggaacagcttttccctcacaggttttagaaggaaccaacctggccaacaccttgatctctcagacttatatgctctagaccaatgagagaataccttgcttttatttaagccacccagtttgtgatcctttgttatatgacctaatttcaatgacccccatttcagttggtccaccaggactaatcaagtctccaaaccttt

SEQ ID NO: 12968 - DNA, 188 bp, Homo sapiens
  chr7.fa.O7frz.117088610
  Located on chromosome 7
  Distance between a terminus base of telomere on chromosomal short arm and 5'-terminus of this base sequence : 125984732
  Distance between 3'-terminus of neighbour sequence of sequence listing upward to telomere on chrosomal short arm and 5'-terminus of this base sequence : 199407
ttatcagatgtcatttgacaaacaggaaaaaacaagttggccacattttgatcttggttaacataaaacacacacatgcacacacacacacacacacacacacacacacacacacaacacacaccccaatacatattattattttttttctgaataatttgagaggaagctgtattgtaatgttccat

SEQ ID NO: 12969 - DNA, 308 bp, Homo sapiens
  chr7.fa.O7frz.117205377
  Located on chromosome 7
  Distance between a terminus base of telomere on chromosomal short arm and 5'-terminus of this base sequence : 126142182
  Distance between 3'-terminus of neighbour sequence of sequence listing upward to telomere on chrosomal short arm and 5'-terminus of this base sequence : 157262
ttgaggaacttatagtcaaatgagagtcacgagtacagaagcaaacacgtaagatataatggggcaagtctgaagatgcataatctgtccacccaaaaataaatactgttaaaccataattttgtaagaggtatgacttacttagtttgcccattgttttagtcagagaaacaaagtcagtattgtatacacatatgcacacacacacacacacacacacacacacacacatacgagagagagagagagagagagagagagagaggaaagagatttatcatgaggaactgtctcatacaattctggag

SEQ ID NO: 12970 - DNA, 255 bp, Homo sapiens
  AC002385.1_194974
  Located on chromosome 7
  Distance between a terminus base of telomere on chromosomal short arm and 5'-terminus of this base sequence : 126343159
  Distance between 3'-terminus of neighbour sequence of sequence listing upward to telomere on chrosomal short arm and 5'-terminus of this base sequence : 200669
aaacaaataactgatgcaagtttctttttataaaaatcttccagctaagacaggaaagcagaaacaatacaattacaagatcataattgtttaacctctagtgagttaaataagctaggtaatgatcccaatggctgctggcaacacatacacacacacacacacacacacacacacacacacacaccagacattatgtgtcttctgaaagaattgtagaatccccaaaatgtcaaactttagtctgaccaattc

SEQ ID NO: 12971 - DNA, 261 bp, Homo sapiens
  AC002385.1_185519
  Located on chromosome 7
  Distance between a terminus base of telomere on chromosomal short arm and 5'-terminus of this base sequence : 126352688
  Distance between 3'-terminus of neighbour sequence of sequence listing upward to telomere on chrosomal short arm and 5'-terminus of this base sequence : 9274
cctttagtatgcaactgcaaactagaattagaatccttaaacaacaacttcctaggacagaaaagagaaaacacacacacacacacacacacacacacacacacacacacacagccaagaccatttcccgtaaactgtagtcagtcacccataactttgtagctcttctccaccattacacatgccaaggtcaaagcctctcacagtgcaaattaatctctggtaccccaaagctaaaaagtgtcaggtcatgcaatacag

SEQ ID NO: 12972 - DNA, 131 bp, Homo sapiens
  DISO7_10002325
  Located on chromosome 7
  Distance between a terminus base of telomere on chromosomal short arm and 5'-terminus of this base sequence : 126410227
  Distance between 3'-terminus of neighbour sequence of sequence listing upward to telomere on chrosomal short arm and 5'-terminus of this base sequence : 57278
ttaggttaagaagtgagccaagttaaataaaaaacaaaaaatgtgaaacaacaacaaaaaccagtacaaggagaaagagagagagagagagagagagagagagagagagaaagctagagcacccagattca

SEQ ID NO: 12973 - DNA, 251 bp, Homo sapiens
  DISO7_10002327
  Located on chromosome 7
  Distance between a terminus base of telomere on chromosomal short arm and 5'-terminus of this base sequence : 126524024
  Distance between 3'-terminus of neighbour sequence of sequence listing upward to telomere on chrosomal short arm and 5'-terminus of this base sequence : 113666
tccaaatcaaccacagattccaaaaattctgagaacttcagaagaataaataggaagaaacacacctaagtgcatcatcatcatcatcatcatcatcatcaaactgctgtaaaccaaaggtagaaaagctagatgaataccaaagaaaaaagacatagcatctacagaaaaggaaagataagaatcatcataaacctctcttcaaaaaaaaagcaagtcagaagaaaatgaaccatgaaccaatatcatca

SEQ ID NO: 12974 - DNA, 109 bp, Homo sapiens
  DISO7_10002331
  Located on chromosome 7
  Distance between a terminus base of telomere on chromosomal short arm and 5'-terminus of this base sequence : 126700895
  Distance between 3'-terminus of neighbour sequence of sequence listing upward to telomere on chrosomal short arm and 5'-terminus of this base sequence : 176620
ttgaatattccaaagcacttgttttacatacagaacaactatatatatatatatatatatatatatatgtagagagagagagatctatacacagcactatgtaatccca

SEQ ID NO: 12975 - DNA, 283 bp, Homo sapiens
  DISO7_10002332
  Located on chromosome 7
  Distance between a terminus base of telomere on chromosomal short arm and 5'-terminus of this base sequence : 126706445
  Distance between 3'-terminus of neighbour sequence of sequence listing upward to telomere on chrosomal short arm and 5'-terminus of this base sequence : 5441
gagacatgttgggcagtgttcaaaatagacaatgttaagtgaaatgatgaaattatttcctcaaggttataaaatgaaactagcatctctctctctccctctttttctgtctcctgctccctcccttttcccttcctccctccctctctctctccttcccctgctctctctctctctctctcacacacacacacacacacacacacacacacacacacagtgtataatattccctttctattcatagtatttgttattgtattttctcttctggccctcacat

SEQ ID NO: 12976 - DNA, 174 bp, Homo sapiens
  DISO7_10002328
  Located on chromosome 7
  Distance between a terminus base of telomere on chromosomal short arm and 5'-terminus of this base sequence : 126741852
  Distance between 3'-terminus of neighbour sequence of sequence listing upward to telomere on chrosomal short arm and 5'-terminus of this base sequence : 35124
tgcacatatagttagctatacccagcatacacacacccacacacacacacacacacacacacagagagagagagagagagagagagaaagaaatctagatgaaatagagcaaaatgttaacagatacaatctctaaaactgtaggatttgggggttacttggtggtttcttctt

SEQ ID NO: 12977 - DNA, 370 bp, Homo sapiens
  chr7.fa.O7frz.118002199
  Located on chromosome 7
  Distance between a terminus base of telomere on chromosomal short arm and 5'-terminus of this base sequence : 126883855
  Distance between 3'-terminus of neighbour sequence of sequence listing upward to telomere on chrosomal short arm and 5'-terminus of this base sequence : 141829
ggtttatgaagacctcaactagtattttagcacattatatactataattattagggttaaggttaagaaaaagtacagctagttgtacatataaatgggattttctctatcatgaaaagtatattttctgtgtgtgtgtgtgtgtgtgtgtgtgtgagtagttcagttctttatcacaaagggatgcatttccatattgataatgtaattttagccacactaaagctatatcctgtgaagaagagtctggcatactcctctgacacatctggtagatatggatggcattaattagcatacgtattgttctaaatgacatgtcagtccaggacaacaaaaagtatttgttattgatgtcaatcatttatcc

SEQ ID NO: 12978 - DNA, 259 bp, Homo sapiens
  chr7.fa.O7frz.118122241
  Located on chromosome 7
  Distance between a terminus base of telomere on chromosomal short arm and 5'-terminus of this base sequence : 127003181
  Distance between 3'-terminus of neighbour sequence of sequence listing upward to telomere on chrosomal short arm and 5'-terminus of this base sequence : 118956
tgagtctatttaaacctgctttagcaattctactaatagcatttctgaatttttctttgctggttttttctaatttagtcctaccagactctcaggcaaataaataaataaataaataaataaataaataaataaataaataaaaacaggtggtttttgaagaaattcttttttcttgacttgctggtgtattttttgagccctcaactgagcacatgcccccgtagaatgaattaagtccagtctgttctaacctagg

SEQ ID NO: 12979 - DNA, 237 bp, Homo sapiens
  AC003992.1_115029
  Located on chromosome 7
  Distance between a terminus base of telomere on chromosomal short arm and 5'-terminus of this base sequence : 127204844
  Distance between 3'-terminus of neighbour sequence of sequence listing upward to telomere on chrosomal short arm and 5'-terminus of this base sequence : 201404
tctacctttattgaaggtaggatcaagtcacctctaggaaattcccccagagtatttaattccctggctcaagtaaatgttactattactgttcgttgcagatgatctcatatggaaactctatctatctatctatctatctatctatctatctatctatctatctatatatctatctatctaatctataatggttagaagttgtaacccggtaaatagaaaggcctgatttatagc

SEQ ID NO: 12980 - DNA, 204 bp, Homo sapiens
  AC003992.1_15733
  Located on chromosome 7
  Distance between a terminus base of telomere on chromosomal short arm and 5'-terminus of this base sequence : 127304128
  Distance between 3'-terminus of neighbour sequence of sequence listing upward to telomere on chrosomal short arm and 5'-terminus of this base sequence : 99047
cctgaagagtaagatagcacagagaagttgcaacacaagacactgggtaaaggaagaatgagccagcaaagaatgtgaatctatagcagtagagaaccaggagccagcagtcaaaggccaatagaagatacactcacataaacacatgcacacacacacacacacacacacacacacacaagcacacggacagattggatttgt

SEQ ID NO: 12981 - DNA, 93 bp, Homo sapiens
  D7S2554
  Located on chromosome 7
  Distance between a terminus base of telomere on chromosomal short arm and 5'-terminus of this base sequence : 127531031
  Distance between 3'-terminus of neighbour sequence of sequence listing upward to telomere on chrosomal short arm and 5'-terminus of this base sequence : 226699
atggctttttgcatactaaatgcttaatcagcccaacacacacacacacacacacacacacacacacacacatactcagcagccagaaccatg

SEQ ID NO: 12982 - DNA, 410 bp, Homo sapiens
  AC002089.1_75847
  Located on chromosome 7
  Distance between a terminus base of telomere on chromosomal short arm and 5'-terminus of this base sequence : 127556579
  Distance between 3'-terminus of neighbour sequence of sequence listing upward to telomere on chrosomal short arm and 5'-terminus of this base sequence : 25455
actttcaagaaggcctacatacacagacgagtttttgcagttgttttatttgtaattaacagtaaactccaaagttgtaagttagtcataacatagcttcctacatggagtttcaggttttgcctatgtaagtcagaaatacccagatgagaacactaagttctgttatagtccaacttactgattcatctcttttctttggtgatttgcaaactgggattatgaaacttttctttctttctttctttctttctttctttctttctttctttctttctttctttccttctttctttctttctctctttctttttcttttgacaggatgtcactctggactgcagtggcaggagcacagctcattgcagctttgactttcctggctcaagtaatccttctgcctcagtatc

SEQ ID NO: 12983 - DNA, 314 bp, Homo sapiens
  AC002089.1_36096
  Located on chromosome 7
  Distance between a terminus base of telomere on chromosomal short arm and 5'-terminus of this base sequence : 127596450
  Distance between 3'-terminus of neighbour sequence of sequence listing upward to telomere on chrosomal short arm and 5'-terminus of this base sequence : 39461
tcagctgtaatttatggatctttcctccatgggaaatagatagttatatctggtttttcataaaaattgccttataacactgtaaaagctgagagatcttattaggaccactgactacacacacacacacacacacacacacacacacacacacacacacacacaacagagcaacagcaaaacagcagccacattttgtgtctttaatgaaggatacattctgtatgtagccccattagatttctcattctcagtctaatgttattatattccttttttaaaatgtttaaatttcattgatactcttccaattc

SEQ ID NO: 12984 - DNA, 244 bp, Homo sapiens
  D7S687
  Located on chromosome 7
  Distance between a terminus base of telomere on chromosomal short arm and 5'-terminus of this base sequence : 127669248
  Distance between 3'-terminus of neighbour sequence of sequence listing upward to telomere on chrosomal short arm and 5'-terminus of this base sequence : 72484
acagtgaagcgacaccatcaattaatattaatttttctatttaacccgtaatatgcataaactgataacaggcaataggcaacatttcatgttttaattagacaagaaaaggaacagaagcaacagaagcaacattttgatctcagtctttgcggggatttctaaggtaggaagaagagtgtgtgtgtgtgtgtgtgtgtgtgtgtgtgttactgtgcttacactcaggcatgtgtaatatttt

SEQ ID NO: 12985 - DNA, 340 bp, Homo sapiens
  chr7.fa.O7frz.128834567
  Located on chromosome 7
  Distance between a terminus base of telomere on chromosomal short arm and 5'-terminus of this base sequence : 127898732
  Distance between 3'-terminus of neighbour sequence of sequence listing upward to telomere on chrosomal short arm and 5'-terminus of this base sequence : 229240
ttggtactggagtcataaagatagacatataggtaagtggaatggaattgaaagtccagaattaaacccttataactaaagtcaaattattttggacaatggtactgtattagtcagagttctccagagaaacagaccaaacaagatgcgtgtatgtatgtgtatatgtggaatgacggataccagtctgcctctctctgtctctctctctctctctctctcacacacacacacacacacagtgagagagaaagagggagagatttattttaaggaattggctcatgtaattgtggagacttggcaagcccgaaatatgtagagtaggctggcagactat

SEQ ID NO: 12986 - DNA, 113 bp, Homo sapiens
  D7S2527
  Located on chromosome 7
  Distance between a terminus base of telomere on chromosomal short arm and 5'-terminus of this base sequence : 127996615
  Distance between 3'-terminus of neighbour sequence of sequence listing upward to telomere on chrosomal short arm and 5'-terminus of this base sequence : 97543
tcaaagtccaaatagtgtcagaccaagaggaaagatcttttcatatattcattcatttaatagatacacacacacacatgaatttaggaattaagcacctcttgtatatcggg

SEQ ID NO: 12987 - DNA, 351 bp, Homo sapiens
  chr7.fa.O7frz.129063237
  Located on chromosome 7
  Distance between a terminus base of telomere on chromosomal short arm and 5'-terminus of this base sequence : 128091968
  Distance between 3'-terminus of neighbour sequence of sequence listing upward to telomere on chrosomal short arm and 5'-terminus of this base sequence : 95240
catctttagtctaaccaaatcaactttctgtgcctcagtttttaatctgcaaaataaaagggttggagtttatgacctctgaagaattctctttcagctttaaaaatgggatatttcattaatctattgctactcttatggaatagcctttaactcaagagataaatattgatgcatttaggatgattcaggcaaattatgtctatatctgtttatctgtctatctatctatctatctatctatctatcatctatctatctgtctatttaaagcagagactacctccttactgtatagagtcaggatgagtaaattatctatatgttatattagtgccatagcaagtacag

SEQ ID NO: 12988 - DNA, 232 bp, Homo sapiens
  chr7.fa.O7frz.129298396
  Located on chromosome 7
  Distance between a terminus base of telomere on chromosomal short arm and 5'-terminus of this base sequence : 128278002
  Distance between 3'-terminus of neighbour sequence of sequence listing upward to telomere on chrosomal short arm and 5'-terminus of this base sequence : 185683
ataaagacatactcatccgtgtacatgagtcttagtattttatgttcacctgcacagggtatcatatactatacacttattttacaaagaagcagtttgtttcagggaaccgttatctataaacagaacattctccctaggtatagtttagagaatagaataaagattgtgtgtgtgtgtgtgtgtgtgtgtgtgtgtgtgtgtgtgtgtgtttaagtaatttccttcaggc

SEQ ID NO: 12989 - DNA, 407 bp, Homo sapiens
  chr7.fa.O7frz.129470252
  Located on chromosome 7
  Distance between a terminus base of telomere on chromosomal short arm and 5'-terminus of this base sequence : 128449424
  Distance between 3'-terminus of neighbour sequence of sequence listing upward to telomere on chrosomal short arm and 5'-terminus of this base sequence : 171190
gtcaacatgtggtatggtttatttcttatagctaagcaaaatatttaaaggttcatttcacacaaacttcttcttttgctgaggatgactgctcctgaatatgttcaaaaggagtctgtgcaaacctttcaaggagtttggctgtagaagagaagagagacagagagaaaactagctaaaaggaagacttctgtatatctgtgtgtgtgtgtgtgtgtgtgtgtgtgtgtgtgtgtgtacctatacatacacataaacatacacatatgtgattgggagagacttaagtatgtttaaaatgactttaataatccagttgatattagagagaaaaggcaattgatgagcataactcacactcttttttttcttttttttgaatggtctaggcataatgcctttcttac

SEQ ID NO: 12990 - DNA, 289 bp, Homo sapiens
  AC004391.1_19467
  Located on chromosome 7
  Distance between a terminus base of telomere on chromosomal short arm and 5'-terminus of this base sequence : 128543460
  Distance between 3'-terminus of neighbour sequence of sequence listing upward to telomere on chrosomal short arm and 5'-terminus of this base sequence : 93629
tccttctgtttacaagtttaggactcccttatgcatttcttgtatgacctgtcaggttgcaatgaatcccctcagcatttggttgtctaggatatgaaagacttgatttctccttaatttatcatgaataggttagctggatatagtattcttggttggcagatatatatatatatatatatatatatatatatatatatatatatattttatttatttatttatttttgtactttgaatatatcatcccattctcttctggcctgtaaggttgctactgagacatctt

SEQ ID NO: 12991 - DNA, 336 bp, Homo sapiens
  AC004391.1_26700
  Located on chromosome 7
  Distance between a terminus base of telomere on chromosomal short arm and 5'-terminus of this base sequence : 128550741
  Distance between 3'-terminus of neighbour sequence of sequence listing upward to telomere on chrosomal short arm and 5'-terminus of this base sequence : 6992
tagttcagtgagccaattgtactggattaccttaaggaatatgtttttagctttggaataaacctggagaagtcatatataggccagctgaactctttttggaggtatgtggaaagatagatagatagatagatagatagatagagatatattaattaaagtatctaaaccttttttgatccatccattttaaaataaatccacttttctgagacagggcttctgaacaaggtatgacatgtgtccaattgacatgtcctggacacgcctcagcctgaaatttttactttagaattaaaccaaaactaaaatatctgagtttcacaaaccagttag

SEQ ID NO: 12992 - DNA, 225 bp, Homo sapiens
  G08633
  Located on chromosome 7
  Distance between a terminus base of telomere on chromosomal short arm and 5'-terminus of this base sequence : 128550750
  Distance between 3'-terminus of neighbour sequence of sequence listing upward to telomere on chrosomal short arm and 5'-terminus of this base sequence : -327
gagccaattgtactggattaccttaaggaatatgtttttagctttggaataaacctggagaagtcatatataggccagctgaactctttttggaggtatgtggaaagatagatagatagatagatagatagatagagatatattaattaaagtatctaaaccttttttgatccatccattttaaaataaatccacttttctgagacagggcttctgaacaaggta

SEQ ID NO: 12993 - DNA, 402 bp, Homo sapiens
  AC004107.1_15738
  Located on chromosome 7
  Distance between a terminus base of telomere on chromosomal short arm and 5'-terminus of this base sequence : 128572043
  Distance between 3'-terminus of neighbour sequence of sequence listing upward to telomere on chrosomal short arm and 5'-terminus of this base sequence : 21068
tgtttcaatgagtgatactgtagagatgtcattaatattatgattcaaatattatgattatgataatattattattcaaagattattcaaaagaattttacttaaaaatgcctaataaacatttgttttgtgaaagccggcatcaggcaggtaggtaggcagggaggaaaaagaggaaagaaggaaggaaggaagaaagggagggacaaagaggagaaagtttgcttgtaagcattttcctccctccctcccttccccctccctctctttctccctgtccatcgctcgctccttccttccttccttccttccttccttccagatttttgttatatattttgtttatgtattttgttttatagatgctggataccagaagttaatgaagacttgaagctatga

SEQ ID NO: 12994 - DNA, 430 bp, Homo sapiens
  AC004398.1_26975
  Located on chromosome 7
  Distance between a terminus base of telomere on chromosomal short arm and 5'-terminus of this base sequence : 128611560
  Distance between 3'-terminus of neighbour sequence of sequence listing upward to telomere on chrosomal short arm and 5'-terminus of this base sequence : 39115
ctagaaatcaatgacaagaggaattttggaaactatacaaacacatgaaaattaaacaaaatgctcctgaatgaccagtgggtcaatgaagagattaagaagaaaattgaaaaatttattgaaacgaatgataatggaaacacaacataccaaaacctatgggatatagccaaacagtattaagagggaagtttatagatattatatacatatagaagactatctcaaggcatatatatatatatatatatatatatagagagagagagagagagagagagagagagagagagagagaaacttcaagtaaacaacctaatgatgttgtcttacagaactagaaaagtgagagcaaatcaatcccaaaattattagaagaaaagaaataaaaatcagagcagaaagaaactaaattgaaatgaggaaagca

SEQ ID NO: 12995 - DNA, 407 bp, Homo sapiens
  AC003975.1_1769
  Located on chromosome 7
  Distance between a terminus base of telomere on chromosomal short arm and 5'-terminus of this base sequence : 128853759
  Distance between 3'-terminus of neighbour sequence of sequence listing upward to telomere on chrosomal short arm and 5'-terminus of this base sequence : 241769
taatgttaagcaggagcttcagctatgaattccaaagcaaagttacctgaaatcaggtacaattaaactgcttttggagaaaacatcctatatgacatgaaatgtaaccaaaaacaggtaaataaacactaagagaactaatcactgtggtttatgaactgacagcttttactgtttatctgcatgcattatgaatagaaaaactaattttccttgttttttgtatataaataattcaaccagcagaaattctactaaagatgctgaacacacacacacacacacacacacacacacacacacactcttgttgaatgaattgtcctaaatttgaattaagactgtgagcaacttgatctctttggaaatttgagtcattcttagaaattggttccaggttgaatatt

SEQ ID NO: 12996 - DNA, 354 bp, Homo sapiens
  AC003980.1_37884
  Located on chromosome 7
  Distance between a terminus base of telomere on chromosomal short arm and 5'-terminus of this base sequence : 128927096
  Distance between 3'-terminus of neighbour sequence of sequence listing upward to telomere on chrosomal short arm and 5'-terminus of this base sequence : 72930
tttccttacctcaaatttgaatacctcagagtcttgagttttcagtacaagaagtaaagacttgtgacataacaagcctgagcacatgtgcatacacacacagacacacacacacacacacacacacacacacacacacacagtgtcaaacttaaatcctggacactttcaacaaaaagaaccatcttaagaagacacacaaggaaaacttttttttcttagtgtaatttagggtgacaaatcttttcgctgaatctgtgaattaacacatttattattgaagtaacagtgtttctagtaaagaaaacccaaataacagaaatcatctttcttacctgaaggatatgctagaaa

SEQ ID NO: 12997 - DNA, 319 bp, Homo sapiens
  AC003960.1_16295
  Located on chromosome 7
  Distance between a terminus base of telomere on chromosomal short arm and 5'-terminus of this base sequence : 128983417
  Distance between 3'-terminus of neighbour sequence of sequence listing upward to telomere on chrosomal short arm and 5'-terminus of this base sequence : 55967
aggagttcaatatggtgactaatacggtgaaatgccgtctctactaaaaataccaatatggtgaaacatcgtctctactaaaaatacaaaaattagtcggtcgtggtggcaagcgcctgtaatcccagctactcagaaggctgaggcaggagaatcacttgaagcggagaggcagaggttgcagtgagctgagttcatgccactgcactccagcctgggcaacagagtgagactccatctcaaataaataaataaataaataaataaataaataaataaataaataaataataaaatagctacaattgtgtaattggat

SEQ ID NO: 12998 - DNA, 221 bp, Homo sapiens
  AC003960.1_31943
  Located on chromosome 7
  Distance between a terminus base of telomere on chromosomal short arm and 5'-terminus of this base sequence : 128999268
  Distance between 3'-terminus of neighbour sequence of sequence listing upward to telomere on chrosomal short arm and 5'-terminus of this base sequence : 15532
ccttaccaaggaagaatcttaaagatagacataccgattgtgtgtgtgtgtgtgtgtgtgtgtgtgataaatgagatagataatagatgacaaggtgaagatttgtaaatttatttctgagaattaaatttgtcaattatgtgaggaaagaaacaatagatttggcattcattttgctagtgtgcaagatgtcatgttggtggcaatgatacaggacatat

SEQ ID NO: 12999 - DNA, 258 bp, Homo sapiens
  D7S686
  Located on chromosome 7
  Distance between a terminus base of telomere on chromosomal short arm and 5'-terminus of this base sequence : 129015213
  Distance between 3'-terminus of neighbour sequence of sequence listing upward to telomere on chrosomal short arm and 5'-terminus of this base sequence : 15724
tgacccctatataaaatgtaaaatgtatatcaaactctattatgcagaatgaaaaaattaactgtaaaaatagaagaagagacaaattctgaaaactttatttaaatttctttctctggtggctcatttttattgtcaatttcaaaatgagtaagtgagtgtgtgtgtgtgtgtgtgtgtgtgtgtgtgtgtgacagagagagagagagagagaaatagagtgaaaaaagagagagaacggttctcaccaggctttga

SEQ ID NO: 13000 - DNA, 328 bp, Homo sapiens
  AC003961.1_30029
  Located on chromosome 7
  Distance between a terminus base of telomere on chromosomal short arm and 5'-terminus of this base sequence : 129031328
  Distance between 3'-terminus of neighbour sequence of sequence listing upward to telomere on chrosomal short arm and 5'-terminus of this base sequence : 15857
gaagtaacatgtaagtgcggagctaaggaagattagagctgaatatatatatatataaatattcagccctattatatatgtgtgtgtgtgtgtgtgtgtgtgtgtgtagaactgggtgtgttactaaagaagacagttcatatagataagagaaaagggatcagaaaaaatgtcccaaagcacgtacaatgtacaattacagataaggcacaagatgaacaactataaaaagaaaaccatgttgtagtccttagtttggaaggatgaaagcaaaggataaccaagagaaaagtgtgtcagaccacccttacaagaaatgctcaaagga

SEQ ID NO: 13001 - DNA, 363 bp, Homo sapiens
  AC003961.1_36018
  Located on chromosome 7
  Distance between a terminus base of telomere on chromosomal short arm and 5'-terminus of this base sequence : 129037240
  Distance between 3'-terminus of neighbour sequence of sequence listing upward to telomere on chrosomal short arm and 5'-terminus of this base sequence : 5584
gaaatggagaatagcaaccatatgtgttaaacaataatagaatgcagactttcagtatgagaattttttattaccacttactgggcagtcaatagaagtaattagtagattatttgtgttgaattgttcatgttctaaatgtttgtgtctgtgtctgtgtgtgtgtgtgtgtgtgtgtgtgtgagagagagagagagagagagagagaaatatctatgacagtctccattacatacagaagttagaggagattcctattacagtgaaactgttccagtgtgtatgcagaatctattaagtacttgacactctcgactttcattgtatgattttggcattgtctgaagtctgacttcatctgat

SEQ ID NO: 13002 - DNA, 354 bp, Homo sapiens
  AC002507.1_9147
  Located on chromosome 7
  Distance between a terminus base of telomere on chromosomal short arm and 5'-terminus of this base sequence : 129104088
  Distance between 3'-terminus of neighbour sequence of sequence listing upward to telomere on chrosomal short arm and 5'-terminus of this base sequence : 66485
taaggcttctggtcaacagtaggctatttgtagttaagttttagcaaagtcaaaaattatacgcaattttcaactgggcaggggatggcgtccttaatttctgcattcttcaagggccaactgcttgtgtgtgtgtgtgtgtgtgtgtgtgtgtgtgtgcgcgtgtgtgtatgctatgttccttccatttattgatatgttggataatgattaaacagcagctaaaacactcagaaattatagaatcagccataatattcactaaatatttggcttactatccgtataactttgggccagttacccaaacatactctttggtttctacatgtgtaagttggaaaggtatacctg

SEQ ID NO: 13003 - DNA, 324 bp, Homo sapiens
  AC002500.1_28081
  Located on chromosome 7
  Distance between a terminus base of telomere on chromosomal short arm and 5'-terminus of this base sequence : 129157907
  Distance between 3'-terminus of neighbour sequence of sequence listing upward to telomere on chrosomal short arm and 5'-terminus of this base sequence : 53465
tccttagttccagcatagtttaacacaaggacagggaattatcttgggttcatttcccatagcttagaagaattgaattccagtggctctgtgtttgtgtgtgtgtgtgtgtgtgtgtgtgtgtgtgtttctgtgtgtgtgtgtttgtatgtgtgtatgtgagagagagagaaagagtgagagagagaggctgaaagagagactaagagaaaattataatttcatgaatggggactgttattccaataattcttcctgagagttcccgaactgccaaatataattctgatattctgtctgttatgtcaatactgtatgctgacc

SEQ ID NO: 13004 - DNA, 390 bp, Homo sapiens
  AC002500.1_34612
  Located on chromosome 7
  Distance between a terminus base of telomere on chromosomal short arm and 5'-terminus of this base sequence : 129164212
  Distance between 3'-terminus of neighbour sequence of sequence listing upward to telomere on chrosomal short arm and 5'-terminus of this base sequence : 5981
ttgccgcagttacatacttaaaatcagtataaaatcttaatggtttggctgggcacggtagctcacctataatcccagcactttaggaggccaaagcaggagcatcaattgaggccaggagtttgagaccagcctagccacatagagagactgcatctctacaaaaaaatttaaaaattagctgagcatggttgtgtgaacctgtagtcctagctacttgggggctgaggtgggaggatcactttagcctaggaattccaggctgcagtgagctatgatcacaccactgcataccagctggggtgacagagcaagaacatctaaataaataaataaataaataaataaatattgtaatggttttaggaacaggttactcagatcactttg

SEQ ID NO: 13005 - DNA, 312 bp, Homo sapiens
  AC002499.1_29127
  Located on chromosome 7
  Distance between a terminus base of telomere on chromosomal short arm and 5'-terminus of this base sequence : 129197945
  Distance between 3'-terminus of neighbour sequence of sequence listing upward to telomere on chrosomal short arm and 5'-terminus of this base sequence : 33343
caaggtgaggtcttacatctttccctctttttataagggcatttatcatgggcctccactcacatgacctcatctaaacctaattctctcccaaaagtcccatctcctatcttggggataaagctctctctctctctctctttctctgtctctctctctctctctctctctctctctctctctatatatatatatatatatatatatacacacacacacacacacacatatacgtgtgtgtgtgtgtgtgtctctatctcagattaaatttaaatttactgatccagcttcttgctcaactacctaaaggtg

SEQ ID NO: 13006 - DNA, 375 bp, Homo sapiens
  AC005584.1_250
  Located on chromosome 7
  Distance between a terminus base of telomere on chromosomal short arm and 5'-terminus of this base sequence : 129233729
  Distance between 3'-terminus of neighbour sequence of sequence listing upward to telomere on chrosomal short arm and 5'-terminus of this base sequence : 35472
agatactttaaatgacttacgcatggcccagaaatttatttatttatttatttatttatttatttattttttctgaaatggactctagccctctcacccaggctggagtgcagtgatgcgatcctggctcactccaacttccacttcccgggttcaagcgattctcctgcctcagcctccagattcgctgggattacaggcacccaccatcatgcctggttaatttttgtatttttagtagagacggggtttcaccatgttggccaggttggtcttgaactcctgccctctggtgatccacccacctcggcctcccaaagtgctgggattacaggcatgagcaacagcgcccagctgaaatttcttaataggatg

SEQ ID NO: 13007 - DNA, 376 bp, Homo sapiens
  AC005584.1_16367
  Located on chromosome 7
  Distance between a terminus base of telomere on chromosomal short arm and 5'-terminus of this base sequence : 129249664
  Distance between 3'-terminus of neighbour sequence of sequence listing upward to telomere on chrosomal short arm and 5'-terminus of this base sequence : 15560
tggctttctctatgtaagaacaagatatcactgtagttcaagttttcttttgtgtatcaatacaatcttaaattatgtttacacatatcctgaaaatgtcttcttaggtttatttctaggtgttttgtgttttgttactgttttaaaaggcatctttactgcatagaaaagctatttttttttaatgtccaatttgacctggtcatttatatgatgtgtgtgtgtgtgtgtgtgtgtgtgtgtgtgtgtgtatgtgtgtttcaataaaggtagtaaagagagtaacctgaaaaagaaggatatggtaatcagagaagagagagagtaattattgatattgataatgacaagttttagaatctatccacagacttgg

SEQ ID NO: 13008 - DNA, 282 bp, Homo sapiens
  AC005584.1_26258
  Located on chromosome 7
  Distance between a terminus base of telomere on chromosomal short arm and 5'-terminus of this base sequence : 129259680
  Distance between 3'-terminus of neighbour sequence of sequence listing upward to telomere on chrosomal short arm and 5'-terminus of this base sequence : 9640
gttccttgtcagtggtcattattttcaggtatttttgctattacaaacaatgttacaataaagatccttaaataaataaatatatatatatatatatatggcataaatttgcaagtgcatctatagggataattcttattcatagaattgatggctcagagagtgtggccatttttcagtttgttgaatattgactacttgcactccaaagcaggagtgttcatggcatacctgtattcctcacagtgcttatactgttactaactgttgccaaattggtaa

SEQ ID NO: 13009 - DNA, 276 bp, Homo sapiens
  AC002995.1_9165
  Located on chromosome 7
  Distance between a terminus base of telomere on chromosomal short arm and 5'-terminus of this base sequence : 129337132
  Distance between 3'-terminus of neighbour sequence of sequence listing upward to telomere on chrosomal short arm and 5'-terminus of this base sequence : 77170
cttttcataactgcattaaccaacaatgttttgtttaaacgtttttgttttaaaataattatagactcagactcacagaaagtagcaaaaatagtatagacaggtcttatgtacctatcatctacacacacacacacacacacacacacacacacgtttcatttctctaggataaataaccaaaagtgcaagtgctggctcctatggtaagtatatgtttaattttgcaatgaacttccagactaatttattgattggctgtatcatttatgtttc

SEQ ID NO: 13010 - DNA, 265 bp, Homo sapiens
  AC005583.1_16499
  Located on chromosome 7
  Distance between a terminus base of telomere on chromosomal short arm and 5'-terminus of this base sequence : 129379876
  Distance between 3'-terminus of neighbour sequence of sequence listing upward to telomere on chrosomal short arm and 5'-terminus of this base sequence : 42468
cgtcagaaacgcttaacactacttctctctcaaaatcagcttcaagacttttagcctttatagcagaaacacacacacacacacacacacacacacacacacacacacacatacaagcaaaatggtttattcataaggaaatatactttatgtttgtgggaaactttagagtcaccacagcaaagaattatagtccaatttaactctgggaaaaatcaccgtcctgagtgttgtgtttctcctgtcaggtagaaatcacagtgct

SEQ ID NO: 13011 - DNA, 235 bp, Homo sapiens
  D7S1873
  Located on chromosome 7
  Distance between a terminus base of telomere on chromosomal short arm and 5'-terminus of this base sequence : 129379913
  Distance between 3'-terminus of neighbour sequence of sequence listing upward to telomere on chrosomal short arm and 5'-terminus of this base sequence : -228
agcttcaagacttttagcctttatagcagaaacacacacacacacacacacacacacacacacacacacacacatacaagcaaaatggtttattcataaggaaatatactttatgtttgtgggaaactttagagtcaccacagcaaagaattatagtccaatttaactctgggaaaaatcaccgtcctgagtgttgtgtttctcctgtcaggtagaaatcacagtgctgctgacc

SEQ ID NO: 13012 - DNA, 210 bp, Homo sapiens
  AC005583.1_28776
  Located on chromosome 7
  Distance between a terminus base of telomere on chromosomal short arm and 5'-terminus of this base sequence : 129392095
  Distance between 3'-terminus of neighbour sequence of sequence listing upward to telomere on chrosomal short arm and 5'-terminus of this base sequence : 11947
atagcaaacctcaatacttggtagtatatgtcttccaacttaatttttttctccagactgtcttcgctcttcttggtcctgtataattccataaaaattttagagtcagcttgccagttttcgatacacacacacacacacacacacacacatccctactgggattttgattaggattgcattaatgtatagctcaatctcggtatttga

SEQ ID NO: 13013 - DNA, 247 bp, Homo sapiens
  AC002057.1_16502
  Located on chromosome 7
  Distance between a terminus base of telomere on chromosomal short arm and 5'-terminus of this base sequence : 129455405
  Distance between 3'-terminus of neighbour sequence of sequence listing upward to telomere on chrosomal short arm and 5'-terminus of this base sequence : 63100
catgactcctgtcatctaactttcagcaaaataaatatgagttattagtacaaaaaaacacaccatacagagacaaaagaagttgtgtgtgtgtgtgtgtgtgtgtgtgtgtgtgtttgtatttattttaaataatcaacccttttcctgcttttccccagaatatatgaactcaagtcttctctagttcgagaacagggctgggggtgatggcagggggttgctttacattgctttgtattggaat

SEQ ID NO: 13014 - DNA, 394 bp, Homo sapiens
  AC005494.1_31354
  Located on chromosome 7
  Distance between a terminus base of telomere on chromosomal short arm and 5'-terminus of this base sequence : 129459526
  Distance between 3'-terminus of neighbour sequence of sequence listing upward to telomere on chrosomal short arm and 5'-terminus of this base sequence : 3874
gtgagctttgtcaatcttcaaccttgccaaggaggacacattaaagtgtttttcatggaaaatcaggctttgtcaacacaaattcaaagcaatgtgaccttgacggatggagatatatatatatatatatatatatatatatatatatatatatatatatatatgcatgctaagtaagaatagcacagactgaagcatctttagagaatataagtgaaccaaataaaaggaggaaaagcatcctaaaagaagatgttaaatccaggaaaaagttgtcaagtgtatttccttctacttaccttttctgctgactgggctgtaccaaaaaagatggggatgaaagctaaccaaatgatgcaggtggtatacatggtaaatccaataggtttggctt

SEQ ID NO: 13015 - DNA, 321 bp, Homo sapiens
  AC002084.1_10301
  Located on chromosome 7
  Distance between a terminus base of telomere on chromosomal short arm and 5'-terminus of this base sequence : 129552795
  Distance between 3'-terminus of neighbour sequence of sequence listing upward to telomere on chrosomal short arm and 5'-terminus of this base sequence : 92875
tttcattctgtaacagaaatcctcttttcatcttatgtacttgaagccctttattattttttctggggtacattaaatactttacatataaaaatgtgtatatatgacttccattataaaaaggactttgctttattaatcattgtatctctaatagtgatgattacatatatgagagaagtgtgtgtgtgtgtgtgtgtgtgtgtgtgtacatatggtccaaccttttcaaatttgctgtactaggaaaaggtctttcatcaactagtccattgtgttggtggaaaaagaaagattctctttccatctggatttacaaga

SEQ ID NO: 13016 - DNA, 359 bp, Homo sapiens
  AC002084.1_27519
  Located on chromosome 7
  Distance between a terminus base of telomere on chromosomal short arm and 5'-terminus of this base sequence : 129569945
  Distance between 3'-terminus of neighbour sequence of sequence listing upward to telomere on chrosomal short arm and 5'-terminus of this base sequence : 16829
tttgagcataggaatttgagaccagcctgggcaacatggcaagacccgtctctaccaaaatacaaaaaaatggctgggcatggtgaagcatgcctgtggtcccagctacttgggaggctgaggtagaaagatggcttgagccccatggggcagaagtttcagtgagctgagattgtgccactgtactccagcatgggtgacagagtgagaacttgtctcaaaaaaaaaaaaaaaaaaaaaaaaaaaaaatatatatatatatatatatatatatatatatatatagtttgaagcaatgatcactgtaggtaaaaaaaaaaaatgtgtattatcatgttataaatccaacatcaagtggt

SEQ ID NO: 13017 - DNA, 326 bp, Homo sapiens
  AC002084.1_30462
  Located on chromosome 7
  Distance between a terminus base of telomere on chromosomal short arm and 5'-terminus of this base sequence : 129573056
  Distance between 3'-terminus of neighbour sequence of sequence listing upward to telomere on chrosomal short arm and 5'-terminus of this base sequence : 2752
ggtttactttaggattaaaggaagaagtgacttcagggtggaagagagagaagaagaaaaggaagagagaaggagggaaagaaggaaggaaggaaggaaggaaggaaggaaggaaggaaggaaagaaggaaggaaggaagaaaggaaggaaggaagttcctttgataccctgatccttcttcagctaccaccgtatctttctacttttcttttcagccaaaggtctcaaaaaagttacctaaaagactatctccactcactaacccatcttccttcatccttcatccctctgtaatttcctccctctctcagcattgaaacttcca

SEQ ID NO: 13018 - DNA, 160 bp, Homo sapiens
  D7S1874
  Located on chromosome 7
  Distance between a terminus base of telomere on chromosomal short arm and 5'-terminus of this base sequence : 129666238
  Distance between 3'-terminus of neighbour sequence of sequence listing upward to telomere on chrosomal short arm and 5'-terminus of this base sequence : 92856
tcaccttgagattccatccaaagttactcaaaattgtgtttgcacacacacacacacacacacacaccacatacaaaacatagtttatattagtaaagtataaataaatatgttatattcacctcttagcatcttacatctttgataagaccacggtgtt

SEQ ID NO: 13019 - DNA, 406 bp, Homo sapiens
  AC002533.1_33210
  Located on chromosome 7
  Distance between a terminus base of telomere on chromosomal short arm and 5'-terminus of this base sequence : 129690122
  Distance between 3'-terminus of neighbour sequence of sequence listing upward to telomere on chrosomal short arm and 5'-terminus of this base sequence : 23724
aatcaaataaaccttcgcctacattttcttttattcttttgcttctttttcacataattctaaaataaatttcaaatggataatactttcttatgtggaaaaatcatctcagttgaatctactgtaaactcttaatcaataaaatgttatttcccagtgagttctaaaagccaccattatcatatgataaattcatatatatatatatatatatatatatatatacacacacacacacacacacacacaattgtagaattatttacttatttatcatcattctatgtttctgactatttctatttggtttcatttatcacatgtctattttggtactagtttcatactggattgattattgtagtttatcacatgtctattctggtattagtttcatactggattg

SEQ ID NO: 13020 - DNA, 456 bp, Homo sapiens
  chr7.fa.O7frz.131081383
  Located on chromosome 7
  Distance between a terminus base of telomere on chromosomal short arm and 5'-terminus of this base sequence : 129893899
  Distance between 3'-terminus of neighbour sequence of sequence listing upward to telomere on chrosomal short arm and 5'-terminus of this base sequence : 203371
aagaactttgcatctattgttagatttattcatcctgagagatagaatgcctaggccataacataacctatattaggatcatgggtgacagatgggtttctggtagttgttggcactgccttgtttactctgtgtgtgtgtttgtgtgtgtgtgtgtacacctttctccctttatatatcatgtatcaagattattggatttgatcaaatacatggttagaccaggaaagatttgaatacacttataaacttgacttaaacaaattccaaatccatttaacagcaatggaagatgaaattcttccactttttactttgttcatgtcaattcagagacaccactggttattaagacttcctcctatgactcacatcatcaaagctacatattcacacacatttttcaaagggaaaataacccacactttatttctgtaaagttcaatggataacagt

SEQ ID NO: 13021 - DNA, 123 bp, Homo sapiens
  D7S680
  Located on chromosome 7
  Distance between a terminus base of telomere on chromosomal short arm and 5'-terminus of this base sequence : 129964661
  Distance between 3'-terminus of neighbour sequence of sequence listing upward to telomere on chrosomal short arm and 5'-terminus of this base sequence : 70306
cagatgctgaattccagacatgtgcatgcacgtgcatgcgcatccgtgtgtgtgtgtgtgtgtgtgtgtgtgtgtgtttagttacactatatatagtgtcaggaaaaaactgccaacttggat

SEQ ID NO: 13022 - DNA, 290 bp, Homo sapiens
  chr7.fa.O7frz.131233728
  Located on chromosome 7
  Distance between a terminus base of telomere on chromosomal short arm and 5'-terminus of this base sequence : 130046230
  Distance between 3'-terminus of neighbour sequence of sequence listing upward to telomere on chrosomal short arm and 5'-terminus of this base sequence : 81446
tgactgtagtcctagctactcaagaggctgaggtatgagaatcacttgaacccgggagacagagtttgcagtgagccaagattgtgccattgcactccagcctgggtgacagagcgagatcctgtctctctctctctctctctcacacacacacacacatgcacacacacacacatacacaagaaagaaagaaaaaagaaaagaaaaggtagaagatgactgaaaggtgttccaggcataggggacagcatctgacagaaacaaacctatgaaaggctatagattgctta

SEQ ID NO: 13023 - DNA, 195 bp, Homo sapiens
  chr7.fa.O7frz.131398230
  Located on chromosome 7
  Distance between a terminus base of telomere on chromosomal short arm and 5'-terminus of this base sequence : 130210824
  Distance between 3'-terminus of neighbour sequence of sequence listing upward to telomere on chrosomal short arm and 5'-terminus of this base sequence : 164304
gttcaaacaagtgactcatgacaatattagttatacatttaaatataaatgcgtgtgtgtgtgtgtgtgtgtgtgtgtgtgtgtgtgtgtgtgtatgcacagacaacagtaaatttctttggcaagcttgggttcttctccaacctgtggccaactgaactgaatagcatccttggaactttatcttctaccact

SEQ ID NO: 13024 - DNA, 153 bp, Homo sapiens
  D7S514
  Located on chromosome 7
  Distance between a terminus base of telomere on chromosomal short arm and 5'-terminus of this base sequence : 130314706
  Distance between 3'-terminus of neighbour sequence of sequence listing upward to telomere on chrosomal short arm and 5'-terminus of this base sequence : 103687
tgggcaacacagcaaaactgactcaaaataaataaacaaattaattaattaattaatttaggtgtattttagattaattaagaacacacacacacacacacacacacacacacacactcattttgagaatatctgacattggcactaactgca

SEQ ID NO: 13025 - DNA, 391 bp, Homo sapiens
  AC000359.1_9773
  Located on chromosome 7
  Distance between a terminus base of telomere on chromosomal short arm and 5'-terminus of this base sequence : 130520818
  Distance between 3'-terminus of neighbour sequence of sequence listing upward to telomere on chrosomal short arm and 5'-terminus of this base sequence : 205959
gcatgcaagaatacagtcactgcaactgcgaagagtttgggcaggagacaggtgacaaagcaaacccatgctggcaccagttttctgagtggccaagctgtgtgtgtgtgtgtgcgcgcgcgcgtgtgtgtgcgtgagtgtatgtgtgtgtgtgtgtgtatgtacttgcctgtatatgaaagtatactggaaccggttttctgagtggccaagctgtgtgtgtgtgtgtgtgtgtgtgtgtgtgtgtgtgtacttgcctgtatatgaaagtatactggaaccagttttctgagtggccaagctgtgtgtgtgtgtgtgtgtgtgtgtgtgtgtgcgcacttgcctgtatatgaaagcagggtgtactctcaacctaatcactttcctaggt

SEQ ID NO: 13026 - DNA, 290 bp, Homo sapiens
  AC009181.5_27235
  Located on chromosome 7
  Distance between a terminus base of telomere on chromosomal short arm and 5'-terminus of this base sequence : 130634503
  Distance between 3'-terminus of neighbour sequence of sequence listing upward to telomere on chrosomal short arm and 5'-terminus of this base sequence : 113294
gagtcattctcagcatcttgatatgcatagtggacattgccaggcgagtaataatacaagaatttgaacaattagaaatgctgaagctcttgaaaatttcaaggcaagccagtaggagtgtgtgtgtgtgtgtgtgtgtgtgtgtgtgtgtgtgtgtgtgtttattgtagggggtttagaaaccattagactatttaaatttctttgtaaattagctaacttcaaactagcttgaaatatctctcatagtttaggacttcttttttatctgcctagcaaatagcattatc

SEQ ID NO: 13027 - DNA, 401 bp, Homo sapiens
  AC009181.5_78526
  Located on chromosome 7
  Distance between a terminus base of telomere on chromosomal short arm and 5'-terminus of this base sequence : 130685616
  Distance between 3'-terminus of neighbour sequence of sequence listing upward to telomere on chrosomal short arm and 5'-terminus of this base sequence : 50823
aaagtagcaggctaggcacggtggctcatgcctgtgatctcagcactttggggaggctgaggcaggaggatcacttaagcccagaaatttgagaccagcctagaaacatagggaaaccgtatctctacaaaaaattaaaaaattagctgggcatggtggtgcatgcctgtggtcctggctcctcgggagacaaaaatgggagcatcgcttgagcccagaaggttgaggctacagtgagctgtgattgtgccactgcactctggcctgggcgacatagcaagatgctgtctcaaaaatagatagatagatagatagatagatagatagatagatagataggcaggcaggcagataggtggtagcagatacatactgcttagtagacaacttgcagacaagtc

SEQ ID NO: 13028 - DNA, 279 bp, Homo sapiens
  D7S2501
  Located on chromosome 7
  Distance between a terminus base of telomere on chromosomal short arm and 5'-terminus of this base sequence : 130799308
  Distance between 3'-terminus of neighbour sequence of sequence listing upward to telomere on chrosomal short arm and 5'-terminus of this base sequence : 113291
cccagcatttctgtttggccatatacatttgttttgttgtgctcttctcactcttcacctattttttataatttagatgaggatttttttttcctgttaaagtgttgatatgacacagtatcttacattagaccttttttaacacacacgcacacacacacacacacacacacacacacacacacacacacgactctgccacgcagtgaatcttttttagaatgttggtttcctcttttctaagctttagaaaacaaacataataagctaagctaaaag

SEQ ID NO: 13029 - DNA, 164 bp, Homo sapiens
  AC006529.1_96536
  Located on chromosome 7
  Distance between a terminus base of telomere on chromosomal short arm and 5'-terminus of this base sequence : 130826073
  Distance between 3'-terminus of neighbour sequence of sequence listing upward to telomere on chrosomal short arm and 5'-terminus of this base sequence : 26486
aattacatgctgaactgagtgatacctgcacacaacacacacacacacacacacacattatactaccatttcaaaggagttcacctaggaccccaggttaaaaatttctgttctcccaactattttacgattgtagtgaggttgtggctacagataggtgatac

SEQ ID NO: 13030 - DNA, 277 bp, Homo sapiens
  Z67717
  Located on chromosome 7
  Distance between a terminus base of telomere on chromosomal short arm and 5'-terminus of this base sequence : 130842768
  Distance between 3'-terminus of neighbour sequence of sequence listing upward to telomere on chrosomal short arm and 5'-terminus of this base sequence : 16531
ttatctgaagaacagtgagaaatctttgaaatgggagtagaataattagaacagcatatgtgtgtgtgtgtgtgtgtgtgtgtgtgtgtgtgtgtttatgtgtgtatatgtatacatatatatatagagagagagagagttagctaggtatatatctattaatttttctttttttccattgtggcttttatttggagatagacttgaaacaatggttaggggagaatttgcagttcacctggtgattgctgaatagtggctggaactaggattgtgg

SEQ ID NO: 13031 - DNA, 151 bp, Homo sapiens
  D7S504
  Located on chromosome 7
  Distance between a terminus base of telomere on chromosomal short arm and 5'-terminus of this base sequence : 130902182
  Distance between 3'-terminus of neighbour sequence of sequence listing upward to telomere on chrosomal short arm and 5'-terminus of this base sequence : 59137
gcgcgtgtgtatgtgagagattgactcccctcgtgtgtgtgtgtgtgtgtgtaagagagattgactcccctcgtgtgtgtgtgtgtgtgtgtgtgtgtgtaagagagattgactcccctctgcttgcaccccagagcagccagcaatcaga

SEQ ID NO: 13032 - DNA, 230 bp, Homo sapiens
  AC008039.1_82143
  Located on chromosome 7
  Distance between a terminus base of telomere on chromosomal short arm and 5'-terminus of this base sequence : 130970189
  Distance between 3'-terminus of neighbour sequence of sequence listing upward to telomere on chrosomal short arm and 5'-terminus of this base sequence : 67856
taaagaatgttaccttgcagctaccagatgttcaggagcaggattcttatttctgccccttttcagataatatatctttatatatgtatttatatattgtgtataaatacacaatatgtaaagatacaatattgtgtatctttatatatgtatatatgtgtgtatatatatacacatatacacacacacacacacacacacacacgtaataaacgttgcaacacttagag

SEQ ID NO: 13033 - DNA, 160 bp, Homo sapiens
  AC018662.3_33435
  Located on chromosome 7
  Distance between a terminus base of telomere on chromosomal short arm and 5'-terminus of this base sequence : 131027247
  Distance between 3'-terminus of neighbour sequence of sequence listing upward to telomere on chrosomal short arm and 5'-terminus of this base sequence : 56828
acatagacactttgcctcagacctgaaatctggatttagacagcagaaggaagttagtggtaggggttggggtgtgtgtgtgtgtttgtgtgtgtgtgtgtgtgtgtgtgtgtgtgtagatgcctcttggaggagccagttctgattcacagacctgaaa

SEQ ID NO: 13034 - DNA, 200 bp, Homo sapiens
  D7S1875
  Located on chromosome 7
  Distance between a terminus base of telomere on chromosomal short arm and 5'-terminus of this base sequence : 131037131
  Distance between 3'-terminus of neighbour sequence of sequence listing upward to telomere on chrosomal short arm and 5'-terminus of this base sequence : 9724
gcctaagggaatgagacacatgtctgagaagagacagaaagagagaatgtgtgtgtgtgtgtgtgtgtgtgtgtgtggcaactactgaaggtgggtaggatgctaggggcctgggttccccagggaaggccctgggtttgaaaagagccccaaatgaagccaggattgctgaagacaagcatgtgagtttgccaagagct

SEQ ID NO: 13035 - DNA, 384 bp, Homo sapiens
  AC018662.3_61764
  Located on chromosome 7
  Distance between a terminus base of telomere on chromosomal short arm and 5'-terminus of this base sequence : 131055969
  Distance between 3'-terminus of neighbour sequence of sequence listing upward to telomere on chrosomal short arm and 5'-terminus of this base sequence : 18638
ccatgattgtaagtttcctgaggcctcccgagccatatggaactgtgagtcaattaaacctctttcctttatgaattacgtagtctcagggaagttctttataccagtgtgaaaatggactaatacatctcccctgagacaaatacccaaattcttgctgcctgacccaaagtgctgtgtgtgtgtgtgtgtgtgcatgtgtgtgtgcgcatgtgtgtgcgcgcatgtgtgcactcgcattctggcagcttcaaccaatctccggtcaggggttcctgggtctttccctcccagaatccacctctggtcctgaagctccttctggtactgggagacatcccaggatatgtttctaactgtgttgactcaacttgtcttttcaat

SEQ ID NO: 13036 - DNA, 319 bp, Homo sapiens
  AC008039.1_169543
  Located on chromosome 7
  Distance between a terminus base of telomere on chromosomal short arm and 5'-terminus of this base sequence : 131057708
  Distance between 3'-terminus of neighbour sequence of sequence listing upward to telomere on chrosomal short arm and 5'-terminus of this base sequence : 1355
caatgttaaactggaattggacgcagcagtataaactaatggctacacacacacacacagacacacacacacacacacacacacacacacacagagaagatagatagatagatagatagatagatagatagatagatagatagatagatagagaaatcgagatgaaaatctgtggagagagagaaatgttctcactctccactgagagggcctgggagcagcaccatccaatgcaaggagcatgctgagcactcaggtcttggcccctaaacaccactgccccctaaaaggaaccaggttcctagagaaatggctgatt

SEQ ID NO: 13037 - DNA, 259 bp, Homo sapiens
  AC008039.1_173436
  Located on chromosome 7
  Distance between a terminus base of telomere on chromosomal short arm and 5'-terminus of this base sequence : 131061494
  Distance between 3'-terminus of neighbour sequence of sequence listing upward to telomere on chrosomal short arm and 5'-terminus of this base sequence : 3467
gatggattgtctacgtggatttcggagcctgttattttggcagtcacctttctaattttctaaattcttacttgttcccctttgaaaagcattctgttcttgttctgtggctataaaattttctgaatctttctaaggatattagagcgtctccctctctctctctccacacacacacacacacacacacacacacacacacttttgttcttcaaatcatctttttctttggagttggttgcactcctggtttatctag

SEQ ID NO: 13038 - DNA, 150 bp, Homo sapiens
  DISD22_0005323
  Located on chromosome 7
  Distance between a terminus base of telomere on chromosomal short arm and 5'-terminus of this base sequence : 131187990
  Distance between 3'-terminus of neighbour sequence of sequence listing upward to telomere on chrosomal short arm and 5'-terminus of this base sequence : 126237
tacagcctgggttgactgtacacacacacacacacacacacacacacacacatatgcacacacacacagaactggctccagggctcacccacaggtctgcccaccttccccaccagcactgccggaagccccctccattagtctcctgtc

SEQ ID NO: 13039 - DNA, 109 bp, Homo sapiens
  DISD22_0005326
  Located on chromosome 7
  Distance between a terminus base of telomere on chromosomal short arm and 5'-terminus of this base sequence : 131275164
  Distance between 3'-terminus of neighbour sequence of sequence listing upward to telomere on chrosomal short arm and 5'-terminus of this base sequence : 87024
tccatttagagctgccatacagaaaaggagtgtatgtgcagaagtgtgtgtgtgtgtgtgtgtgtgtgtgagagagagagagagagagagaccaatagacaggccaaca

SEQ ID NO: 13040 - DNA, 103 bp, Homo sapiens
  DISO7_10002351
  Located on chromosome 7
  Distance between a terminus base of telomere on chromosomal short arm and 5'-terminus of this base sequence : 131855842
  Distance between 3'-terminus of neighbour sequence of sequence listing upward to telomere on chrosomal short arm and 5'-terminus of this base sequence : 580569
ctattgcttgtgcatttgcacatcataaacacaaacacacacacacacacacacacacacacacacacacacacaggcttgcttccagagccatacatgctct

SEQ ID NO: 13041 - DNA, 264 bp, Homo sapiens
  AC008085.1_163866
  Located on chromosome 7
  Distance between a terminus base of telomere on chromosomal short arm and 5'-terminus of this base sequence : 131934029
  Distance between 3'-terminus of neighbour sequence of sequence listing upward to telomere on chrosomal short arm and 5'-terminus of this base sequence : 78084
ggaactctgatggtatgagatagatagatagagaaagaaagaaagaaagaaagaaagaaagaaagaaagaaagaaagaaagaaagaaagaaagaaagaaagaaagagaaagaaagaaagaaagaaagaaagaaagaaagaaagaaaatagatagatgatagatagatagatagatagatagatagatagatagatagatagataatagagatagattagatagaaagatgattagatagatagataaacaatgtttggataggt

SEQ ID NO: 13042 - DNA, 264 bp, Homo sapiens; identical to SEQ ID NO: 13041
  AC009518.7_104646
  Located on chromosome 7
  Distance between a terminus base of telomere on chromosomal short arm and 5'-terminus of this base sequence : 131934029
  Distance between 3'-terminus of neighbour sequence of sequence listing upward to telomere on chrosomal short arm and 5'-terminus of this base sequence : -264

SEQ ID NO: 13043 - DNA, 169 bp, Homo sapiens
  AC008085.1_129825
  Located on chromosome 7
  Distance between a terminus base of telomere on chromosomal short arm and 5'-terminus of this base sequence : 131968056
  Distance between 3'-terminus of neighbour sequence of sequence listing upward to telomere on chrosomal short arm and 5'-terminus of this base sequence : 33763
agacgcagaagtaaagtgtcatagattgaagggggttcctgacaagttaatggcagcaccctccccagccctctcgacacacacacacacacacacacacacacacacacacacacacacttgttctcctcccctccccctggggctcctgctaatgagaacagattta

SEQ ID NO: 13044 - DNA, 226 bp, Homo sapiens
  AC009518.7_141840
  Located on chromosome 7
  Distance between a terminus base of telomere on chromosomal short arm and 5'-terminus of this base sequence : 131971279
  Distance between 3'-terminus of neighbour sequence of sequence listing upward to telomere on chrosomal short arm and 5'-terminus of this base sequence : 3054
ctgagacattacaagcttgaacccaggaggcagaggttgcagtgaaccgagatcacgccactgcactccagcctgggtgacagagcaagactctgtctcgaaaaataaataaataaataaataaataaataaataaataaataaacaaacaaacaaataaaagaaaatagggccattgcagatgtaatgggttaagatgaggtcatactggagtaggatagactct

SEQ ID NO: 13045 - DNA, 319 bp, Homo sapiens
  AC008085.1_75201
  Located on chromosome 7
  Distance between a terminus base of telomere on chromosomal short arm and 5'-terminus of this base sequence : 132022631
  Distance between 3'-terminus of neighbour sequence of sequence listing upward to telomere on chrosomal short arm and 5'-terminus of this base sequence : 51126
gcaagtatttcttaggatgcaaaaagtatgaatatcaaaagaaaaaaatgacaaattttaaactttgaaagacattattaagaaaataaaaaggcaagccacagactgggagaaacatttgctatatgtgtgtgtgtgtgtgtgtgtgtgtgtgtgtgtgtgtgtgtgtatcatatgtataaatacaaatttaaatttaaatataccccagaggaacttattaagaatcaagaatcttattaataagaataagacaattcaaagcaaaaaaaagatatgctacaaaagaaaatatatggataggcaataaacaaattta

SEQ ID NO: 13046 - DNA, 302 bp, Homo sapiens
  AC008085.1_71765
  Located on chromosome 7
  Distance between a terminus base of telomere on chromosomal short arm and 5'-terminus of this base sequence : 132026063
  Distance between 3'-terminus of neighbour sequence of sequence listing upward to telomere on chrosomal short arm and 5'-terminus of this base sequence : 3113
ggagtaaggaagtaattcggtattcatgcttaattaagcttaaatgaggtcatagggcggagtcctaatttgataaggttactgtccttatatgagaagatgccaaagagttgagtgcgctcgctctctctctctctctctctctctctctctctctctctctctctctctcttcctccccccaccccagcacccccactccaccatgtaagggcacagtgagaaggcagctgtctgcaagccaggaagacaaccctcactagaaactaaattggccagcatgttgatcttggacttctcag

SEQ ID NO: 13047 - DNA, 343 bp, Homo sapiens
  AC008085.1_44795
  Located on chromosome 7
  Distance between a terminus base of telomere on chromosomal short arm and 5'-terminus of this base sequence : 132053073
  Distance between 3'-terminus of neighbour sequence of sequence listing upward to telomere on chrosomal short arm and 5'-terminus of this base sequence : 26708
taactcaaaccagcttaagcacaaagagaatgccaagaattcctgtccagattcagaattaaggaattaatttgaaaaatatcattagatctctatctctctctctctctctctctctctctctctctctctcgcttttctgagttgattttattctcaggcaattttctcccgcatgctaaaaaattcgcttagggtgtgatatggtttggctgtgtccccacccaaatctcatcttgaattgtagctcccataatccccatgggtcatgggaggtacctggtgggaggtaattgaatcatgcaggcaggtttttcccatgctgatttcatgatagtgaata

SEQ ID NO: 13048 - DNA, 139 bp, Homo sapiens
  DISD22_0005347
  Located on chromosome 7
  Distance between a terminus base of telomere on chromosomal short arm and 5'-terminus of this base sequence : 132372956
  Distance between 3'-terminus of neighbour sequence of sequence listing upward to telomere on chrosomal short arm and 5'-terminus of this base sequence : 319540
atcaactaaatgaaccaggttgttaaaaagttataaaacaatatttaaagtatgatctcattttggttttacagacacacacacacacacacacacacacacacacacacacacttacagtgatgttctccaggaggca

SEQ ID NO: 13049 - DNA, 284 bp, Homo sapiens
  DISO7_10002344
  Located on chromosome 7
  Distance between a terminus base of telomere on chromosomal short arm and 5'-terminus of this base sequence : 132587320
  Distance between 3'-terminus of neighbour sequence of sequence listing upward to telomere on chrosomal short arm and 5'-terminus of this base sequence : 214225
tctactcatctgcctggaagtttgactaataaacttctgagccccttcatcatcatatatatatatatatatataatttttaataattttaattttttatttctcttacatttccccttgtttattcacaagaattatatataattaacatgtttgtctaaataaattcaaaaggccatttaaatagaaaagttaaaacacagataaaaatattgtattggtttatttggcagttttttttcttagtggtacataatatttgcataattacaattggtgacatg

SEQ ID NO: 13050 - DNA, 389 bp, Homo sapiens
  AC018639.8_75017
  Located on chromosome 7
  Distance between a terminus base of telomere on chromosomal short arm and 5'-terminus of this base sequence : 132719196
  Distance between 3'-terminus of neighbour sequence of sequence listing upward to telomere on chrosomal short arm and 5'-terminus of this base sequence : 131592
gaaagtgaagtaacagtccacaacatggaagggaatgtgcaaataacatatctgataactgattagtatccagagtatataaagaactcttacaattcaacaatgaaaagacaactcagtttttgggtttgttttgtgtgtgtgtgtgtgtgtgtgtgtgttttgtttttttgttttgagttggagtcttgctctgttgcccaggctagagtacaatggcacaatctcagctcactgaaacctccacctcctgggttcaagcgattcttgtacctcatcctcccacgtagttgggattacaggtgcccacaaccatgcctggctgatttttgtatttttagtagaaacagggcttcaccacgttggccaggttggtctcgaactcctga

SEQ ID NO: 13051 - DNA, 435 bp, Homo sapiens
  chr7.fa.O7frz.132954051
  Located on chromosome 7
  Distance between a terminus base of telomere on chromosomal short arm and 5'-terminus of this base sequence : 132790391
  Distance between 3'-terminus of neighbour sequence of sequence listing upward to telomere on chrosomal short arm and 5'-terminus of this base sequence : 70806
atggtactagatgcataaagacaccaaatgaatgcttaccacttattttccccaataatttctgtattgttttttgttttttgtgttgttgttgttgttgttgttgttgagacggagtctcactctgtcatccaggctggagtgcaatggtgcgatctgggctcactgcaacctccgcctcccaggttcaagtgattctcctgcctcagccgcccaagtagctgggattacaggtgcctggcaccatgcccagctaatttttgtatttttagtagagacagggtttcaccagtttggccaggctggtctcaaactcctgaactcaggtgatccacctgcttcagcctcccaaagtgctgggattacaggcatgggccactgcgcctggcctgtatttgttgtttgagtagctggtcattcacatggtttacagtc

SEQ ID NO: 13052 - DNA, 407 bp, Homo sapiens
  chr7.fa.O7frz.133298818
  Located on chromosome 7
  Distance between a terminus base of telomere on chromosomal short arm and 5'-terminus of this base sequence : 132856538
  Distance between 3'-terminus of neighbour sequence of sequence listing upward to telomere on chrosomal short arm and 5'-terminus of this base sequence : 65712
ttgcttacattcataattggaggaagggccaaattttagttaggtgtaatttttttcccattgaaattcatggacctctgaatttttccaagaatcctttgtgaaccatagggtaagaatgttacttacagaatatcactatctagtagagagtctgagctattcttgattgtgtgtgtgtgtgtgtgtgtgtgtgtgttttaatagagacagggtttgaccctattgtcccggctggtcttgaactcctgggctcaagtgatcctcctgccttggcctcccaaaatgctcctttgtgttttaatataaaaatacttggtgattttttattgggattgcattgactatatagattaacttggaaaaaaaaagagacatctttacaatactgagtcttccaaacattg

SEQ ID NO: 13053 - DNA, 102 bp, Homo sapiens
  DISO7_10002346
  Located on chromosome 7
  Distance between a terminus base of telomere on chromosomal short arm and 5'-terminus of this base sequence : 132927586
  Distance between 3'-terminus of neighbour sequence of sequence listing upward to telomere on chrosomal short arm and 5'-terminus of this base sequence : 70641
ccaagttattgagttcactcaaggggtgtgtgtgtgtgtgtgtgtgtgtgtgtgtgtgtgtgtgtacaccctccaacttattgagttcaatcaagccttatt

SEQ ID NO: 13054 - DNA, 415 bp, Homo sapiens
  AC018640.3_95770
  Located on chromosome 7
  Distance between a terminus base of telomere on chromosomal short arm and 5'-terminus of this base sequence : 133191391
  Distance between 3'-terminus of neighbour sequence of sequence listing upward to telomere on chrosomal short arm and 5'-terminus of this base sequence : 263703
aaaggacaaatattctatgactcacctagatgagtaatttagaataggtgagttcattgacacaatgtagaatagtgctggtggtggtggtggtggtggtggtggtggtggtggtggtggtgtgtgggaggggggtgttgctgaggaggggctggaatggaaactcattattgtttgtttttgtttttgtttttttttgagacagagtctcgctctgtcacccaggctggaatgcagtggcacaatcgtgcctcactgaaacctccacctcccaaggctcaagtaatcctcaggcctcagcctcccaagtagctgggactgggactgcagggtgtgtcaccacacctggctgggaagttattgtttagagcatttgtttgggatgatgaaaaggttctaaatgcatgtcagtgat

SEQ ID NO: 13055 - DNA, 108 bp, Homo sapiens
  D7S530
  Located on chromosome 7
  Distance between a terminus base of telomere on chromosomal short arm and 5'-terminus of this base sequence : 133222984
  Distance between 3'-terminus of neighbour sequence of sequence listing upward to telomere on chrosomal short arm and 5'-terminus of this base sequence : 31178
tgcattttagtggagcacagcctgcagtggcttacacacacacacacacacacacacacacacacacacacacaaaagggtgcacagcaccaaagttcccaatgcctg

SEQ ID NO: 13056 - DNA, 416 bp, Homo sapiens
  chr7.fa.O7frz.133942896
  Located on chromosome 7
  Distance between a terminus base of telomere on chromosomal short arm and 5'-terminus of this base sequence : 133391954
  Distance between 3'-terminus of neighbour sequence of sequence listing upward to telomere on chrosomal short arm and 5'-terminus of this base sequence : 168862
gtgaaggctaccagattaattccttcctttacttgtttgtttgtttgtttgtttgtttgtttgttttgagacagggtctcactctgtcacctagactggttcactgcagccttgacctcaggctaaagctatcctcccacctcagcctactgagacgctgggaccacaggtgcgcactgccacaccgcgctaattttttaaattatattttttgtagagatgggatctccctttgttgcccaggctggtctcaaactcctgggctcaaaatgatcctcccgccttagtctcccaaagtgttaggattataggcatgagccactacacccggccctttacttcattttttgaacatagttatctcaatactcttttcatcttatacaccttaatgtaagaagtcatacagttcagcc

SEQ ID NO: 13057 - DNA, 450 bp, Homo sapiens
  chr7.fa.O7frz.134016965
  Located on chromosome 7
  Distance between a terminus base of telomere on chromosomal short arm and 5'-terminus of this base sequence : 133479946
  Distance between 3'-terminus of neighbour sequence of sequence listing upward to telomere on chrosomal short arm and 5'-terminus of this base sequence : 87576
gagcttgcagtgagtcaagatcgcaccactgcactccagcctgggcaacagagcgagactctgtctcaaaaaataataaataaataaataaataaataaataaataaataaataaataaaaataaagctgattagaagctgcgtgcatggatgagcttgtcaactgatgaccttcaccaattgtaatctgatagggcgatttcattgggaaactcctaatgttagtatctttgggtccttcctcttgagttggtctgagtacttacagaggagcccttccatttcctgcctgaatggaataagccttgctcccaggcttgtgggagctgcgttagggagggagaccgtgataccattctgcacattaactgtcactttaaacctagatttttggtatggtaatttcccctcagctgtgttcatatcccctcctagcagaatcctctagtc

SEQ ID NO: 13058 - DNA, 287 bp, Homo sapiens
  AC023880.4_36053
  Located on chromosome 7
  Distance between a terminus base of telomere on chromosomal short arm and 5'-terminus of this base sequence : 133506529
  Distance between 3'-terminus of neighbour sequence of sequence listing upward to telomere on chrosomal short arm and 5'-terminus of this base sequence : 26133
ctatttatgaaccagtgaccacaagttatttctttttcctctatttcctttgaaataaatggaaaatttcaagctgggcaaggtggttcatgtctgtaatcctagcactttgggaggccaaggcaggaagacggcctgagcccaggagttcaataacagcctgggcaacatagggagatccggtctctacaaaataataataataataataataataataataataataataattgggcatggtggcatgtgcctgtggttccaactactcaggagagtaggtgctc

SEQ ID NO: 13059 - DNA, 381 bp, Homo sapiens
  chr7.fa.O7frz.134348829
  Located on chromosome 7
  Distance between a terminus base of telomere on chromosomal short arm and 5'-terminus of this base sequence : 133707857
  Distance between 3'-terminus of neighbour sequence of sequence listing upward to telomere on chrosomal short arm and 5'-terminus of this base sequence : 201041
ggtcaagaccttgttaatagtttataagacagaaattcggggccaggtttggcggctcaggcctgtactcccaaccctctgggaggctgtggcagcataattgcttgaggccaggagttcgagacctgcctgggcaacatagcaagactttgtctacacacacacacacacacacacacacacacacacacacacgggtaggggtgcaaacttggcaggaaaaaaaagcagctggagctactaaagacttctctcaaagcaaggtgatgtgaacagcttttaaggtggctccaatgatccctgccttcttatattcatgcccttgtgttatctgctcctcttgagtatgggctggcctagtgacttgcttctaatgcataa

SEQ ID NO: 13060 - DNA, 409 bp, Homo sapiens
  AC024085.5_85422
  Located on chromosome 7
  Distance between a terminus base of telomere on chromosomal short arm and 5'-terminus of this base sequence : 133928413
  Distance between 3'-terminus of neighbour sequence of sequence listing upward to telomere on chrosomal short arm and 5'-terminus of this base sequence : 220175
tgtattccactggagttcgtaggaaattgcatggagcttggtttcagaagacccatattctggtccctgtacatggctcattgtattgattccttccccactgcacaaacagttggggcagtgacttaggaagtctgcctacgtggagaaaggctagaaggggaaactctgtcaccaagggaactcttcctaaagagatgtgcttgattgttttgagatttctctttcctgttcatccttcattccctattaagggggtgtgtgtgtgtgtgtgtgtgtgtgtgtgtgtgtgtgtgtttgtaaagagaggcacggcacataatttgtcagggtcccaactatctctggccatgccccatgtttgggccccatgaatggggtctggggatggaaccttgatacattttca

SEQ ID NO: 13061 - DNA, 162 bp, Homo sapiens
  D7S2544
  Located on chromosome 7
  Distance between a terminus base of telomere on chromosomal short arm and 5'-terminus of this base sequence : 133928639
  Distance between 3'-terminus of neighbour sequence of sequence listing upward to telomere on chrosomal short arm and 5'-terminus of this base sequence : -183
tcctgttcatccttcattccctattaagggggtgtgtgtgtgtgtgtgtgtgtgtgtgtgtgtgtgtgtgtttgtaaagagaggcacggcacataatttgtcagggtcccaactatctctggccatgccccatgtttgggccccatgaatggggtctgggga

SEQ ID NO: 13062 - DNA, 210 bp, Homo sapiens
  AC024085.5_141021
  Located on chromosome 7
  Distance between a terminus base of telomere on chromosomal short arm and 5'-terminus of this base sequence : 133984165
  Distance between 3'-terminus of neighbour sequence of sequence listing upward to telomere on chrosomal short arm and 5'-terminus of this base sequence : 55364
ctcatcttacaggtcctaaatcactcatctggcctggataatctcactgccctggcacattcccatttgtgctgtggtgtatcctgtgtttccttgtcctggtttgtgtgtgtgtgtgtgtgtgtgtgtgtgtgtgtgtgtgtgtttgtgtgtgtgtgtctgtctattttgtatcctggaccacaagttcctaagtagagcaagaattca

SEQ ID NO: 13063 - DNA, 124 bp, Homo sapiens
  D7S2519
  Located on chromosome 7
  Distance between a terminus base of telomere on chromosomal short arm and 5'-terminus of this base sequence : 133984235
  Distance between 3'-terminus of neighbour sequence of sequence listing upward to telomere on chrosomal short arm and 5'-terminus of this base sequence : -140
gctgtggtgtatcctgtgtttccttgtcctggtttgtgtgtgtgtgtgtgtgtgtgtgtgtgtgtgtgtgtgtgtttgtgtgtgtgtgtctgtctattttgtatcctggaccacaagttcctaa

SEQ ID NO: 13064 - DNA, 457 bp, Homo sapiens
  AC024085.5_149760
  Located on chromosome 7
  Distance between a terminus base of telomere on chromosomal short arm and 5'-terminus of this base sequence : 133992660
  Distance between 3'-terminus of neighbour sequence of sequence listing upward to telomere on chrosomal short arm and 5'-terminus of this base sequence : 8301
atacttgagcaaggtaaagctcagagggaagttgttgcttaggacttgacggccctgtgttctaaatctttgttttcaacatcctgacgcatctctcaactttctcatgatctcaatgcccagggtatttctgtggtcccgggaaaggataggccttactctttatttatttatttatttatttatttatttatttatttattatactttaagttctagggtacatgtgcacaacgtgcaggtttgttacatatgtatacatgtgggccttactcttattgcaagaatcatcttccagagtcaggctaccttcttccctacatgatacattcctgaacatatctatacatctatctatctatctatctatctatcatctatctatctatcattcatctatctgtatgtatgtatatacatctatataaagccttaagtatgcaagtctagcagtaga

SEQ ID NO: 13065 - DNA, 309 bp, Homo sapiens
  AC007938.1_13371
  Located on chromosome 7
  Distance between a terminus base of telomere on chromosomal short arm and 5'-terminus of this base sequence : 134018143
  Distance between 3'-terminus of neighbour sequence of sequence listing upward to telomere on chrosomal short arm and 5'-terminus of this base sequence : 25026
agtatcttgcattcttatgctcaggggtccttgagttttcatcattgtaaaaatctttcaaattgaaagaatagtacaatggagtttttagctgttgttaacacttgcatgctctttctgtctacacacatatgcatacacacagacataaacatatctgtgtatgtgtgtgtttttgtgcctctgtgtgtgtgtgtgtgtgtgtgtgtgtgtgtgtgtgtgtgtttagaaatagggtgtcactctgttgcccagcctggagtacagtggtacgatcataactcactctcaatcatagctcactctagc

SEQ ID NO: 13066 - DNA, 404 bp, Homo sapiens
  AC007938.1_106440
  Located on chromosome 7
  Distance between a terminus base of telomere on chromosomal short arm and 5'-terminus of this base sequence : 134111333
  Distance between 3'-terminus of neighbour sequence of sequence listing upward to telomere on chrosomal short arm and 5'-terminus of this base sequence : 92881
ttcatatccagtaggatggttattacattattattagaaagaaagaaagaaagaaagaaagatagaaagaaagaaagaaagaaagaaagaaagaaagaaagaaagaaagaaagaaagaaagaaagaaaaccagtgttggttagaatgtggagaagttggaacccttgggcattgctggtgggaatataaaatggtgggctgctgtggaaaacagtttggtggttcctcaaaaacttaaatatagacttactagatgacccagcaatttcactcctcagtggtatatactcaaaatacttgaaaacagagactcaaacagaaacttgtccaccaatgttcatagcagcattattcacactagttaaaggtggaaccaacccaagtgtctatcaactgatgaatgg

SEQ ID NO: 13067 - DNA, 412 bp, Homo sapiens
  AC007938.1_114088
  Located on chromosome 7
  Distance between a terminus base of telomere on chromosomal short arm and 5'-terminus of this base sequence : 134118820
  Distance between 3'-terminus of neighbour sequence of sequence listing upward to telomere on chrosomal short arm and 5'-terminus of this base sequence : 7083
tatttgaggtttcactttccattcgtggttttagttacccacagtcaaccgtggtctaaaatattaagaaattttgagagagtgagagcacacattcacataacttttattacagtttattgttataattgttctattttattgcctatttttgttaattgcttattttgcctaattcacaaattaaactttatcatgggtctgtatgcatagaaaaaaacatagtgtgtgtgtgtgtgtgtgtgtgtgtgtgtgtgtgtgtgtgtatagagagagagagagagagagctatatatattgttcagtatccactggggggctgggaacgtactccccatggttaaagggggactactgtattgtagctttagtaagttttgaaattggaaagtggaagtgtgagtctttcaac

SEQ ID NO: 13068 - DNA, 357 bp, Homo sapiens
  chr7.fa.O7frz.135385814
  Located on chromosome 7
  Distance between a terminus base of telomere on chromosomal short arm and 5'-terminus of this base sequence : 134258891
  Distance between 3'-terminus of neighbour sequence of sequence listing upward to telomere on chrosomal short arm and 5'-terminus of this base sequence : 139659
attggtatggaaagtaaggaagtgtggaaagaagcatctacccttcatgaaaaaaggtagtggcacagaatgccaagcaagggtagtttgccccatttttgtcttctttcattctttctttttctttctttctttcttcttctttctttctttctttctttctttctttctttctttctttctttccttctttctttctttctttctttctttctttccttctctctctctctctctctctctctctctctctctctttctttctgtctttctttcttgcattttcagacagggtctcattctgttacccaggctgaagtgcagtggcatcatcataggtcactgcagcttcaaact

SEQ ID NO: 13069 - DNA, 414 bp, Homo sapiens
  chr7.fa.O7frz.135775127
  Located on chromosome 7
  Distance between a terminus base of telomere on chromosomal short arm and 5'-terminus of this base sequence : 134650648
  Distance between 3'-terminus of neighbour sequence of sequence listing upward to telomere on chrosomal short arm and 5'-terminus of this base sequence : 391400
gttatctatggtcctaaatccaactacatcatcagcttttccctctatacaggatgattccaatcaccatagaaggtctgtggatttaggaagggagggaggagggagggaggagggaggaagggagggagggagggagggagggagggagggaggccttcttgcctactggcctttcctcttgaccccagggtcccacgaattaactccccatttctctaatccagttttataagaatactcaaaagagctgactccatccactgtctccagttctttcttcccattcccatcaggctttgtccccactgctcccctaaaactgctattgttaaagccagcaatgtcttcaactgtgaaatacccaaaagccaggtacaggaagaggtgctttaaaggaattatctcatccat

SEQ ID NO: 13070 - DNA, 277 bp, Homo sapiens
  D7S649
  Located on chromosome 7
  Distance between a terminus base of telomere on chromosomal short arm and 5'-terminus of this base sequence : 134769130
  Distance between 3'-terminus of neighbour sequence of sequence listing upward to telomere on chrosomal short arm and 5'-terminus of this base sequence : 118068
attttgatccccagcatatgagaaatgactgagtcaaatttgtagaagttgattaaaaattacttgatttaaacaaatgaaaatcaggtggattctgtaacatgatatttgcattagtgaatatgtgttttccttgaatgaattgacaaaaatcaatattttctttaaacttgcatttataacactattcaaatacttatgtatacatcatattttgtatatacaaacacacacacacacacacacacacacattcatacaacagacataataaagc

SEQ ID NO: 13071 - DNA, 161 bp, Homo sapiens
  D7S2531
  Located on chromosome 7
  Distance between a terminus base of telomere on chromosomal short arm and 5'-terminus of this base sequence : 134847250
  Distance between 3'-terminus of neighbour sequence of sequence listing upward to telomere on chrosomal short arm and 5'-terminus of this base sequence : 77843
aagcaatttgaagactgttctggacagacagccagcagcaatggggcccagatgtgtgtgtgtgtgtgtgtgtgtgtgtgtgtgtaccattttgaccatcttaaagtgtataattcagtggcattaagtatattcgcaatcttgtgtaaccaccatcacca

SEQ ID NO: 13072 - DNA, 451 bp, Homo sapiens
  AC009362.8_73552
  Located on chromosome 7
  Distance between a terminus base of telomere on chromosomal short arm and 5'-terminus of this base sequence : 134859250
  Distance between 3'-terminus of neighbour sequence of sequence listing upward to telomere on chrosomal short arm and 5'-terminus of this base sequence : 11839
agttagacctaaaggcttgataagagtgaaacgttttggtaagaattcttcacaggtaatgctgtggacttcctactgcctcatattaggctgtacataatgtctggttgtcctggtattgatgaggccaataccgattactgggttaaggtgacaatatgcctgttgaaagtaagtttttaagaccgggcatggtggctcatgcctgtactcccagcactttgggaggccgagacaggattactttagcccagaagttcaagaccagcctggacaatatagtgagacctcatctctacaattattaataataataataataataataataaaattagctgggtgtggtggcatatgcctgtagtcccagctacttgggaggctgaggtgggaagactgctcgagcctgggagattgaggctgcagtgacccatgattatgccagtgcact

SEQ ID NO: 13073 - DNA, 218 bp, Homo sapiens
  chr7.fa.O7frz.136015729
  Located on chromosome 7
  Distance between a terminus base of telomere on chromosomal short arm and 5'-terminus of this base sequence : 134887660
  Distance between 3'-terminus of neighbour sequence of sequence listing upward to telomere on chrosomal short arm and 5'-terminus of this base sequence : 27959
cttcaaatttctcatttgtgatatgtagtaagagtacttatgtacagagttgtgacaattaaaaataatatatatataatgcagaatacatatgtaatatatataacacagaatacagctttcatttattatatatatatatatatatataatacagctttcttttatttaacatatataatgcagaatgcagttttcattatggctgtacttaggaa

SEQ ID NO: 13074 - DNA, 480 bp, Homo sapiens
  chr7.fa.O7frz.136398997
  Located on chromosome 7
  Distance between a terminus base of telomere on chromosomal short arm and 5'-terminus of this base sequence : 135161925
  Distance between 3'-terminus of neighbour sequence of sequence listing upward to telomere on chrosomal short arm and 5'-terminus of this base sequence : 274047
gatagagacaaacctggctaacacagtgaaaccccgtctctactaaaaatacaaaaacattaaccaggcgtggtggcgggcacctgtagtcccggctactcgggaggcggaggcaggagaatggcgtgaacccgggaggcggagcttgcagtgagccgagatcgcgccactgcactccagcctgggtgacagagctagactccctctcaaaaaaaatttaaaataaaataaataaataaataaataaataataaatgaccagatctcacaagaactcactcatttttgcaaggacggcaccaaaagggatggtgctaggacattcatgagaaatccacccccatgatccaatcagctccccctaggccccacctccaacattggagattacatttctatatgagatttgggatgagacgatatcaatgtggctttgttatgtggccctgctgcctgacgttgacatgtatgcagctaatt

SEQ ID NO: 13075 - DNA, 101 bp, Homo sapiens
  DISO7_10002355
  Located on chromosome 7
  Distance between a terminus base of telomere on chromosomal short arm and 5'-terminus of this base sequence : 135338878
  Distance between 3'-terminus of neighbour sequence of sequence listing upward to telomere on chrosomal short arm and 5'-terminus of this base sequence : 176473
gcgtggatcctatttaagttctcttcttagtttctgggcaaaaataaataaataaataaataaataaataaaatttggcaaatctctagttaggtagtcat

SEQ ID NO: 13076 - DNA, 180 bp, Homo sapiens
  DISO7_10002358
  Located on chromosome 7
  Distance between a terminus base of telomere on chromosomal short arm and 5'-terminus of this base sequence : 135340762
  Distance between 3'-terminus of neighbour sequence of sequence listing upward to telomere on chrosomal short arm and 5'-terminus of this base sequence : 1783
gctgcatttcctagcaggtaatgcataaaaaggaaacacagttctcattatctaatgataataatttttaaataattaattagcttttaaaatcatgttatgagtgtctcttggtgtgtgtgtgtgtgtgtgtgtgtgtgtgtgtgactgatttcaaggagaaatgtaccttgagcttat

SEQ ID NO: 13077 - DNA, 108 bp, Homo sapiens
  DISO7_10002356
  Located on chromosome 7
  Distance between a terminus base of telomere on chromosomal short arm and 5'-terminus of this base sequence : 135390597
  Distance between 3'-terminus of neighbour sequence of sequence listing upward to telomere on chrosomal short arm and 5'-terminus of this base sequence : 49655
tcaacattgatgccctctagttaaaacacacacacacacacacatacacacacacacacacatacacacacacacacacacacacaaccctaatgcctttcggtagca

SEQ ID NO: 13078 - DNA, 116 bp, Homo sapiens
  DISO7_10002353
  Located on chromosome 7
  Distance between a terminus base of telomere on chromosomal short arm and 5'-terminus of this base sequence : 135408342
  Distance between 3'-terminus of neighbour sequence of sequence listing upward to telomere on chrosomal short arm and 5'-terminus of this base sequence : 17637
ttaagtgtaaataattgcatctgcaatacacacacacacacacacacatctttttccacataagcatagaaaacttcttagaggatatgaaagaaatatgaatagtggtgacttcc

SEQ ID NO: 13079 - DNA, 448 bp, Homo sapiens
  AC018643.3_90427
  Located on chromosome 7
  Distance between a terminus base of telomere on chromosomal short arm and 5'-terminus of this base sequence : 135517697
  Distance between 3'-terminus of neighbour sequence of sequence listing upward to telomere on chrosomal short arm and 5'-terminus of this base sequence : 109239
gtaacttgcagtacctcttcaaatggtacttgtgcccatcttaaagtatccccaccaaccttcccagagaggaaaggaaaggaaaggaaaggaaaggaaaggaaaggaaaggagagagagagagagagagagagagagagagagagaaagagagagagagagagagagagagagagagagagagaagattgtgcacacaggcttcgatgcagggatggtcctaaagagacagagttgaactcagggaagttaaaatagatgggggttggtgctccctggcagcctgtgggtgagggttcttagaaggggtagaagtgagtaatccctgcaggtgttgctggggcactatcaaggggctcactggtggggagaggatgttatggatacatgttttagagttgtgagaagctattaattattcaagccatgcttcataaatatttcacgg

SEQ ID NO: 13080 - DNA, 243 bp, Homo sapiens
  AC009364.8_1892
  Located on chromosome 7
  Distance between a terminus base of telomere on chromosomal short arm and 5'-terminus of this base sequence : 135563284
  Distance between 3'-terminus of neighbour sequence of sequence listing upward to telomere on chrosomal short arm and 5'-terminus of this base sequence : 45139
ccacaggtatccaagtcaatagactgggagggacattgagagcttgagcagaccacagggcttttctaatttatatgggaagatggcatttttgacttaccattctctggtcatgaagcatgtgttttgtgtgtgtgtgtgtgtgtgtgtgtgtgtgtgtatgtgtattgggggcttggcggggggcagggttaaaaaagaaaaggcccatttccttaagtcatactatgtctctgctaagcc

SEQ ID NO: 13081 - DNA, 372 bp, Homo sapiens
  AC009364.8_132628
  Located on chromosome 7
  Distance between a terminus base of telomere on chromosomal short arm and 5'-terminus of this base sequence : 135693982
  Distance between 3'-terminus of neighbour sequence of sequence listing upward to telomere on chrosomal short arm and 5'-terminus of this base sequence : 130455
ctcattgaagtctatgtctggttcatttaactgctccttcaataagctgagagagctcagcagtgagtccataaaaagcactagtgaataatggtcccttgagtacactgcagaaggtgtcccttcaggggtttccatgccctgctcccccggtctttcctacggcccgcgtgtgtgtgtgtgtgtgtgtgtgtgtgtgtgtgcgtgcgcgcgcatgcatggggcaagagtgtgatggtgagtggggttaggctgaaagtcagaaaactggattctatgctcacctctgtcttcagcaagaccctccccctttgggggctcagtttcctcatctctaaaataaaagttgtacagtttcatttctggaatgac

SEQ ID NO: 13082 - DNA, 237 bp, Homo sapiens
  Z67425
  Located on chromosome 7
  Distance between a terminus base of telomere on chromosomal short arm and 5'-terminus of this base sequence : 135713462
  Distance between 3'-terminus of neighbour sequence of sequence listing upward to telomere on chrosomal short arm and 5'-terminus of this base sequence : 19108
ctgggatggttctgagcactgagttaattacatgatgctgcagtacggtgggctccatcctctctgccctgtgtatgcacacacacctttaaacacagataagcatacacacacacacacacacacacacacacacacacacacacacacactggccaggcgacttggctgcagaagtggacagatgagcataaggttatcctaccatatatcaggcccaagagataactatattcc

SEQ ID NO: 13083 - DNA, 202 bp, Homo sapiens
  AC011625.2_52619
  Located on chromosome 7
  Distance between a terminus base of telomere on chromosomal short arm and 5'-terminus of this base sequence : 135713469
  Distance between 3'-terminus of neighbour sequence of sequence listing upward to telomere on chrosomal short arm and 5'-terminus of this base sequence : -230
ggttctgagcactgagttaattacatgatgctgcagtacggtgggctccatcctctctgccctgtgtatgcacacacacctttaaacacagataagcatacacacacacacacacacacacacacacacacacacacacacacactggccaggcgacttggctgcagaagtggacagatgagcataaggttatcctaccata

SEQ ID NO: 13084 - DNA, 292 bp, Homo sapiens
  AC011625.2_142087
  Located on chromosome 7
  Distance between a terminus base of telomere on chromosomal short arm and 5'-terminus of this base sequence : 135802969
  Distance between 3'-terminus of neighbour sequence of sequence listing upward to telomere on chrosomal short arm and 5'-terminus of this base sequence : 89298
agtggaagcaaagaatccttacggggtcagacccacagggctgagccaagatcagatctctctgtctcacacacacacacacacacacacacacacacacacacacatgcacacaccagctgcagcactagggcgtttgggaaagacacaaaattagtttagattgtaaaacatttatcctgtagaggcaacgtgagatttttttctgtagttcttttaattaaaagtgagctcataaatcaaagcccctgtttccagcctgcaggaggtagtaggagtgaacctaagcctt

SEQ ID NO: 13085 - DNA, 287 bp, Homo sapiens
  D7S1804
  Located on chromosome 7
  Distance between a terminus base of telomere on chromosomal short arm and 5'-terminus of this base sequence : 135923687
  Distance between 3'-terminus of neighbour sequence of sequence listing upward to telomere on chrosomal short arm and 5'-terminus of this base sequence : 120426
tgggtctagtccagtggtgtttccattcagacatagatagataggtagatagatagatagatagatagatagatagatagatagatagatagatagataattgatagataatagatagatagatagatagatagatagatagatagatagatagacagacagacagacagacagacagatagatagagagctttgctaggcttagatcctgttagatcctagagactcggtcccactctagactctagtcaccatctcaagttccacagtgaacccaaccacttgaa

SEQ ID NO: 13086 - DNA, 408 bp, Homo sapiens [sequence omitted]

SEQ ID NO: 13087 - DNA, 210 bp, Homo sapiens
  chr7.fa.O7frz.138119256
  Located on chromosome 7
  Distance between a terminus base of telomere on chromosomal short arm and 5'-terminus of this base sequence : 136169611
  Distance between 3'-terminus of neighbour sequence of sequence listing upward to telomere on chrosomal short arm and 5'-terminus of this base sequence : 170445
acagtttgccataatacaaattagtcagttcctctctgctttgccatgccaaatgcagtaaaattattactaattttgttaactttcctataggatgttaaaacacacacacacaatcacacacacacacacacgcaatcacacacaaaacccagtacctgtgttgcttgaaaacttagcacatagttctcaaattaaagctttaggctt

SEQ ID NO: 13088 - DNA, 268 bp, Homo sapiens
  AC008038.1_17088
  Located on chromosome 7
  Distance between a terminus base of telomere on chromosomal short arm and 5'-terminus of this base sequence : 136211217
  Distance between 3'-terminus of neighbour sequence of sequence listing upward to telomere on chrosomal short arm and 5'-terminus of this base sequence : 41396
gtttcaactgtaggatgaccacttcccaggctgatcttcaaaaaggaaaacaatatattctatatatatatatatatatatatatatatatatatatattcacaataatttgatcttatcatatcgtgtctatctaatcttctaccacttgttctacttggtgccaaaaagcctaacagtttatttgttgagcagttgttgagcagataagttcaatctgccagaaacaaatcttctcagacgtttgtaccaatcaaattggtgagtc

SEQ ID NO: 13089 - DNA, 433 bp, Homo sapiens
  AC008038.1_48750
  Located on chromosome 7
  Distance between a terminus base of telomere on chromosomal short arm and 5'-terminus of this base sequence : 136242705
  Distance between 3'-terminus of neighbour sequence of sequence listing upward to telomere on chrosomal short arm and 5'-terminus of this base sequence : 31220
ccaggtatttcaaggtgtacttatcaacagaaaaaggctctgtaaacgttttctttttctttttttttttttttttttttgagatggagtcttgctctattgcccaggcttccaggctggagtgcaatggcatgatcttggctcactgcaacctctgcctcttgggttgaagtgacactcctgtctcagcctcccgagtagctgggattacagatgcccaccaccatgcctggcgtgtgtgtgtgtgtgtgtgtgtgtgtgtgtgtgtgtgtgtgtgtttagtagagatggggtttcaccatgttggccaggatgatcttaaactcctgacctcatgatccgcccaccttggcctcccaaagtgccgggattacaggcatgagccgacacacccggcctaaggctctataacttgattagtttagcagacagc

SEQ ID NO: 13090 - DNA, 112 bp, Homo sapiens
  D7S640
  Located on chromosome 7
  Distance between a terminus base of telomere on chromosomal short arm and 5'-terminus of this base sequence : 136283939
  Distance between 3'-terminus of neighbour sequence of sequence listing upward to telomere on chrosomal short arm and 5'-terminus of this base sequence : 40801
gcacatcaccaacaacgtcaaggtagaaaggaggctttttccctcagagggtgtgtgtgtgtgtgtgtgtgtgtgtgtgtgtgtgtgtgtgttgcggggtgggctggaagac

SEQ ID NO: 13091 - DNA, 473 bp, Homo sapiens
  AC008038.1_102252
  Located on chromosome 7
  Distance between a terminus base of telomere on chromosomal short arm and 5'-terminus of this base sequence : 136296292
  Distance between 3'-terminus of neighbour sequence of sequence listing upward to telomere on chrosomal short arm and 5'-terminus of this base sequence : 12241
tatttggtgatgttaagatcctaggtatttctggccgggtgctgtggctgacgcctgtaatcccagcactttgggaggcaaaggagggaggatctcctgagcacaggagtttgagaccagcctgggcaacgtggcaaaatgctgtttcttaaataaataaataaataaataaataaataaataaataaataaaataaaacaaaattagccagacatggtggaatgtgcctccagtcccagctactcaggaggttgaggtgggaggatcacttgagcctgggaggtcaaggctgcaatgagccgtgatcatgcactgcactccagcctgggcaacaagtaagaccctgtctcaaaaaaaaaaaaaaaagaacctaggcatttctgccgacctagatgaggaaagcgggtctgacaatgtacatttcagaaatatattaatctgggcaagttttcaggatacaagcaaactttaa

SEQ ID NO: 13092 - DNA, 170 bp, Homo sapiens
  AC008038.1_125578
  Located on chromosome 7
  Distance between a terminus base of telomere on chromosomal short arm and 5'-terminus of this base sequence : 136319685
  Distance between 3'-terminus of neighbour sequence of sequence listing upward to telomere on chrosomal short arm and 5'-terminus of this base sequence : 22920
ctatacctgcatttagcttctcagatgtggagctgagaggtggatgtgagtggcctttctgctcccctacacagacacacatacacacacacacacacacacacacacacacaacctaactcattctgtctctttttatactagatgtgctaaatgttaaagcttagcat

SEQ ID NO: 13093 - DNA, 219 bp, Homo sapiens
  chr7.fa.O7frz.138693825
  Located on chromosome 7
  Distance between a terminus base of telomere on chromosomal short arm and 5'-terminus of this base sequence : 136580670
  Distance between 3'-terminus of neighbour sequence of sequence listing upward to telomere on chrosomal short arm and 5'-terminus of this base sequence : 260815
gttatttcctcatttgaatgttacataatttatttaattcttctgtgttatttaaaaaatgtcaatactctatatttctttaggaacaaagtccctagaactggaattattgggccaaaggttatgaatacttttaagttatcgtgtgtgtgtgtgtgtgtgtgttatcttcaactaatttttaaaaatgtgaacttctaccagctcgatgtctattta

SEQ ID NO: 13094 - DNA, 219 bp, Homo sapiens
  AC009178.4_10838
  Located on chromosome 7
  Distance between a terminus base of telomere on chromosomal short arm and 5'-terminus of this base sequence : 136844081
  Distance between 3'-terminus of neighbour sequence of sequence listing upward to telomere on chrosomal short arm and 5'-terminus of this base sequence : 263192
catggagattactccaatcagtagcccaagtgtgcatacacacacacacacacacacacgtatacatatatgtgtaattatgtataaatatatgcacatatatacatatatatacacgtgtatatatgtacacacatttatacgtgtgtattttacatatacatatacatatagtgagagagaaagagagagagagactgtttcattctgttaccttgg

SEQ ID NO: 13095 - DNA, 271 bp, Homo sapiens
  AC009178.4_53695
  Located on chromosome 7
  Distance between a terminus base of telomere on chromosomal short arm and 5'-terminus of this base sequence : 136886894
  Distance between 3'-terminus of neighbour sequence of sequence listing upward to telomere on chrosomal short arm and 5'-terminus of this base sequence : 42594
gatcaaagaaacatgcctattaaaacacccacggtgaaatacttcctgaaaggaaatgctagctggtattttggttccttctcttttcttttcttttcttttcttttcttttcttttcttttcttttcttttcttttcttttcttttcaaataaaagcactttttgccctgtaatctgttataaatgtaaatcctgtgaaatatgtaagagggaaatctaataaagtatcagaattatggcttctttgaattcagctataacttggaattt

SEQ ID NO: 13096 - DNA, 251 bp, Homo sapiens
  AC009178.4_87075
  Located on chromosome 7
  Distance between a terminus base of telomere on chromosomal short arm and 5'-terminus of this base sequence : 136920223
  Distance between 3'-terminus of neighbour sequence of sequence listing upward to telomere on chrosomal short arm and 5'-terminus of this base sequence : 33058
aactagatcctgttcaggcatgctatagcaagcttattttgatacaaaaatgtttgaaacccatgcatagttttttcatatgcattttctgtgaactttttaaagatctggtgtgtgtgtgtgtgtgtgtgcgtgtgtgtgtgtgtgtgtgtgtgtgtattttctagcaacactgtctcttttctttcattttgcactctgtatattttttgtaaagaatacatctttggatctaagtggccgatatgaat

SEQ ID NO: 13097 - DNA, 267 bp, Homo sapiens
  AC007790.1_9743
  Located on chromosome 7
  Distance between a terminus base of telomere on chromosomal short arm and 5'-terminus of this base sequence : 136948626
  Distance between 3'-terminus of neighbour sequence of sequence listing upward to telomere on chrosomal short arm and 5'-terminus of this base sequence : 28152
tgttatgtctggtaatgccttctcaatgattctttgacatacacaagaccacccctacaagagccaggtgagagagcctagagaagaaaatattaatactttctttctctgcgtgctgcctaccttctctgtctccctgttttctgtgtgtgtgtgtgtgtgtgtgtgtttgtttttttttgttgttgttagtttgttttgagacagagtctccctctgttacccaggctggagtgcagcggcctaatcttggtttactgcaacttc

SEQ ID NO: 13098 - DNA, 195 bp, Homo sapiens
  D7S2452
  Located on chromosome 7
  Distance between a terminus base of telomere on chromosomal short arm and 5'-terminus of this base sequence : 137067947
  Distance between 3'-terminus of neighbour sequence of sequence listing upward to telomere on chrosomal short arm and 5'-terminus of this base sequence : 119054
ggcattgaagtttatcgtgacatctacctaccttacagaagcacatgtagaggggtttgtgtgtgtgtgtgtgtgtgtgtgtgtgtgtgtgtgtgtgtataaaaagagatttgtttcaggaacttgacctcgtttaattgtgggatctggctaaacagtctctgtaagatttttgtcttctcaactcatgctgga

SEQ ID NO: 13099 - DNA, 394 bp, Homo sapiens
  AC007790.1_177721
  Located on chromosome 7
  Distance between a terminus base of telomere on chromosomal short arm and 5'-terminus of this base sequence : 137116649
  Distance between 3'-terminus of neighbour sequence of sequence listing upward to telomere on chrosomal short arm and 5'-terminus of this base sequence : 48507
gttcaatccatagcacttgtaaaggttaaataacttattcaaggtcacacaggtagcaacctagatacttcttccctgtgcatatatttatatatttatatatatatatatatatatatatatatatatatatatatatatatatggaattttctagaggaaagggagcttgaataaggttcatatagcttctaaacactgcacttgctgggttcttggttggttcttctgctttacatgctgttgcttttcctttgctggcccctactcatcttctctacctcttaattggagtatctcagggctcagttttagacctctcctttcctctattccatcagatccactccctagtcttacagctttaaataacagctgtacaagaatagcatct

SEQ ID NO: 13100 - DNA, 217 bp, Homo sapiens
  Z67259
  Located on chromosome 7
  Distance between a terminus base of telomere on chromosomal short arm and 5'-terminus of this base sequence : 137174089
  Distance between 3'-terminus of neighbour sequence of sequence listing upward to telomere on chrosomal short arm and 5'-terminus of this base sequence : 57046
gccaactagcatgataggcaggttagtagtgtgtgtgtgtgtgtgtgtgtgtgtgtgtgtgtaaaatacaatattatatataatatacatattatactatattttatatatatcttatatatactagatatataagatatatataaaagaaatacaacgtttgcccattatactaactgaagatacttgtgagttaggctcatcccaaactgtccag

SEQ ID NO: 13101 - DNA, 231 bp, Homo sapiens
  D7S2437
  Located on chromosome 7
  Distance between a terminus base of telomere on chromosomal short arm and 5'-terminus of this base sequence : 137181992
  Distance between 3'-terminus of neighbour sequence of sequence listing upward to telomere on chrosomal short arm and 5'-terminus of this base sequence : 7686
gatggaatacctgcttcatgtagttggctgggctctgttaccatctgtttctttctttgtttctttctgtttgtctgtccctcgccctctctttctctctccctctctttctgtctctctctctctctctctttaacacacacacacacacacacacacacacacacacacacacacacacacacacaactttttagagtcatggagagagggtctcattatgttgcccag

SEQ ID NO: 13102 - DNA, 257 bp, Homo sapiens
  D7S681
  Located on chromosome 7
  Distance between a terminus base of telomere on chromosomal short arm and 5'-terminus of this base sequence : 137204967
  Distance between 3'-terminus of neighbour sequence of sequence listing upward to telomere on chrosomal short arm and 5'-terminus of this base sequence : 22744
actcatattgcttaggctaaggaaaagaatgaagaggtgtgtgtgtgtgtgtgtgtgtgtgtgtgtgtgtgtagactgtagagcagggaatcatattgggccctttgagcaggaaaataatatttggaaatatacaactgggaaataaaatttcaggggacatcattacctcgagtgagtcttcccaggttgttctttcttcattggaggatgtgagtaggtggtttctttcttaaaggccaaatgtccatacatga

SEQ ID NO: 13103 - DNA, 257 bp, Homo sapiens
  chr7.fa.O7frz.139532353
  Located on chromosome 7
  Distance between a terminus base of telomere on chromosomal short arm and 5'-terminus of this base sequence : 137364402
  Distance between 3'-terminus of neighbour sequence of sequence listing upward to telomere on chrosomal short arm and 5'-terminus of this base sequence : 159178
gtacctagctttacagacctttaactttaaactactttctctaaaacaaggaaagctcctgcaagacatgtgatttttttttacaaaccatcctagaggcctatattggtgactttctctcagtgatgatgatgatgatgatgatgatgatgatgacatattccaagtataatatgagtaattataattactgttatataatgatctcagcacatgacatgaacgttagtaaatgctttacctacattggttcactg

SEQ ID NO: 13104 - DNA, 457 bp, Homo sapiens
  chr7.fa.O7frz.139614533
  Located on chromosome 7
  Distance between a terminus base of telomere on chromosomal short arm and 5'-terminus of this base sequence : 137446654
  Distance between 3'-terminus of neighbour sequence of sequence listing upward to telomere on chrosomal short arm and 5'-terminus of this base sequence : 81995
ttctacgctacaagaaatgaagtgaaatggtaaaacaacaacaacgacaaaaaaacatacacacacacacacaaaaagcaaaaaacaaaataacccacccaattaatccatttggaggttgttctcatctagtgaaatgtgtgtgtgtgtgtgtgggtgtgtgtgcacttcagtactgttaacaaagaaaaggtctggtcagtggcaaaaactacttgaatgctgctttcagcaaagtcatccctctcttcagaaggatgaagtactcttgtttgtcaaggaaggtccctctcaactagaaaaacagctgcaggaactccaacccaaggtccccacagcccacaggggtgatctcttgctttgctctcctggctgtctcaggaagcagaagtggaaacatttgagatgacagcagctctgctttctttgtagagttaattagctggtgaatactgag

SEQ ID NO: 13105 - DNA, 262 bp, Homo sapiens
  D7S2438
  Located on chromosome 7
  Distance between a terminus base of telomere on chromosomal short arm and 5'-terminus of this base sequence : 137571298
  Distance between 3'-terminus of neighbour sequence of sequence listing upward to telomere on chrosomal short arm and 5'-terminus of this base sequence : 124187
tggacaaggtagaaattcccatctccaatgtgtgtgtgtgtgtgtgtgtgtgtgtgtgtgtgtgtgtgtgtgtgtgtgtgtgtgtttctggttctgtttctgtttctctgaagcaccattcccacttatgttaaagattgcattctttctctcccgctcaaatccacctcaaaactcactgtgtacatgaggccttctctataccgcctctgtaatctaatattctcttcccttggccatcgcatgcaatgacatgtgtgta

SEQ ID NO: 13106 - DNA, 391 bp, Homo sapiens
  AC008154.6_13888
  Located on chromosome 7
  Distance between a terminus base of telomere on chromosomal short arm and 5'-terminus of this base sequence : 137574300
  Distance between 3'-terminus of neighbour sequence of sequence listing upward to telomere on chrosomal short arm and 5'-terminus of this base sequence : 2740
cagcctggctaacatatctactaaaaatacaaaaattagccaggcatagtggcacacgtctgcagtcccagctacatgggaggctgaggcatgagaatcgcttgaacctgggagactggagttgcagtgagctgagatcgcgccactgcgctccagcctgggtgacagagggagactccatctcaaaaaaaaaaaaaatctatctatctatctatctatctatctatctatctatctatctatctatgttcagtaacatccaaagtgtcaaatatttaaaaacaaattaataaaaggtgtataatgcctctattcagaaaaatgtaaaacatattttctagaaaaattaaagacctaaaaagtggagagatagaccatgtttatggattga

SEQ ID NO: 13107 - DNA, 191 bp, Homo sapiens
  AC008154.6_39735
  Located on chromosome 7
  Distance between a terminus base of telomere on chromosomal short arm and 5'-terminus of this base sequence : 137600113
  Distance between 3'-terminus of neighbour sequence of sequence listing upward to telomere on chrosomal short arm and 5'-terminus of this base sequence : 25422
agttacaaagctagtggatcttgtgtaacactcaaccacatgccagtttccgttctgggaatgtgacatatgttatctcaacacacacacacacacacacacacacacacaaatttataactactacccggcgagaaaaaaatgctgtcattttcctcattttaaaaatgtgacaactgaggcaagttaat

SEQ ID NO: 13108 - DNA, 108 bp, Homo sapiens
  D7S631
  Located on chromosome 7
  Distance between a terminus base of telomere on chromosomal short arm and 5'-terminus of this base sequence : 137600143
  Distance between 3'-terminus of neighbour sequence of sequence listing upward to telomere on chrosomal short arm and 5'-terminus of this base sequence : -161
ctcaaccacatgccagtttccgttctgggaatgtgacatatgttatctcaacacacacacacacacacacacacacacacaaatttataactactacccggcgagaaa

SEQ ID NO: 13109 - DNA, 409 bp, Homo sapiens
  AC055757.12_135496
  Located on chromosome 7
  Distance between a terminus base of telomere on chromosomal short arm and 5'-terminus of this base sequence : 137806068
  Distance between 3'-terminus of neighbour sequence of sequence listing upward to telomere on chrosomal short arm and 5'-terminus of this base sequence : 205817
taacatgctctgaaccagtaatctcccatcatgggaatttttcctaaggaaataatttaaaaggaaaacacacacacacacacacacacacacacacacacacacacacacacactaggtatagggctgggctgggaccaaggtaagacaaatgaggtacacaggtacaatattttcatgccagaaggtaggagcttttttacatttatgtccttggtacttgccttcccttagtcccaggcctgcacacagatatacacatatgcgtatgtatttttaaaatgctgtatacttaaagtaaaactgtaaatatccaacaatagcaagagataaggtgtagccatcaaaagtaaagatgacaaagacacagagaaaaatgtatatgaggtaatgttaaggtgaaagtaga

SEQ ID NO: 13110 - DNA, 392 bp, Homo sapiens
  AC055757.12_194783
  Located on chromosome 7
  Distance between a terminus base of telomere on chromosomal short arm and 5'-terminus of this base sequence : 137844525
  Distance between 3'-terminus of neighbour sequence of sequence listing upward to telomere on chrosomal short arm and 5'-terminus of this base sequence : 38048
ttcaaagtgtctcaaagtgaagacaggaggatacagccatgcccgttccattcaggtgatttaacaacttcatttttgaaagtgaaaatccaaaacctatgtacacacacacacacacacacacacacaggttcctatatataggttaacaaatataggtgactatatatatgtgtgtgtgtgtatatatatatatagagagagaaacatttaatacaactatgtttaaaacatagctagtgttctatactattcacttttgagtgaattactctgaagaatagtcacttaaagatttaaagagccgggcgcggtggctggctttcacctacaatcccagcactttggaaggccgaggcgggtggatcacctgaagtcaggagtttaagacc

SEQ ID NO: 13111 - DNA, 188 bp, Homo sapiens
  D7S2533
  Located on chromosome 7
  Distance between a terminus base of telomere on chromosomal short arm and 5'-terminus of this base sequence : 138089370
  Distance between 3'-terminus of neighbour sequence of sequence listing upward to telomere on chrosomal short arm and 5'-terminus of this base sequence : 244453
agaaaatcagaagtcttgcctctttaaagttggttttaaacatttattttatttttttctatcaggaagtcgtgtgtgtgtgtgtgtgtgtgtgtgtgtgtgtgtgtacatgtgcagaaagaatgagagagagcaagattaatttaataattttatgtatgaaatgttggacatattgaaagcagagg

SEQ ID NO: 13112 - DNA, 282 bp, Homo sapiens
  AC019014.1_140994
  Located on chromosome 7
  Distance between a terminus base of telomere on chromosomal short arm and 5'-terminus of this base sequence : 138103286
  Distance between 3'-terminus of neighbour sequence of sequence listing upward to telomere on chrosomal short arm and 5'-terminus of this base sequence : 13728
tgactgcctgttgactctagtatatttcatttataaatatataggcacacacatttataacatatataatcaaccatattaatcatattactagcaaatgaatgaaaaattcatgtacatttaaactttaagtgaactggtcatttgggatataagcatgtgaagttagctctcctttcttttaaatatctgcagctcccattggggtgtgtgtgtgtgtgtgtgtgtgtgtgtgtgtgtgtgtttccaagaacacagcagtggagaagttactaattgcca

SEQ ID NO: 13113 - DNA, 168 bp, Homo sapiens
  DISO7_10002361
  Located on chromosome 7
  Distance between a terminus base of telomere on chromosomal short arm and 5'-terminus of this base sequence : 138242266
  Distance between 3'-terminus of neighbour sequence of sequence listing upward to telomere on chrosomal short arm and 5'-terminus of this base sequence : 138698
gcattatctacatcagtgttctcagttttcattttttttttcctgtgaccttctgaaataaatgcattttattttgtaaccccagtacctatatacaatatatatatataaatatatatatatatatttgaagcaaatatttcacaaaacggtgctcacacttgctgt

SEQ ID NO: 13114 - DNA, 257 bp, Homo sapiens
  Z67732
  Located on chromosome 7
  Distance between a terminus base of telomere on chromosomal short arm and 5'-terminus of this base sequence : 138477977
  Distance between 3'-terminus of neighbour sequence of sequence listing upward to telomere on chrosomal short arm and 5'-terminus of this base sequence : 235543
gatccctactgtgaaagatgttattctctatgtagaaaatcctaataaatttaccaaaacacacacgcacgcatgcgtgcacacacacacacacacacacacacacacacaacctttagaattaataagttatgctaggcctcagaatacaagataaatgtacaaaattaattgctcttctataaataagcaatgaacatgtgaacaccaaaattacaaaatatctcaaaaaaaatacttggttttacagggtttct

SEQ ID NO: 13115 - DNA, 213 bp, Homo sapiens
  AC009330.5_79589
  Located on chromosome 7
  Distance between a terminus base of telomere on chromosomal short arm and 5'-terminus of this base sequence : 138581150
  Distance between 3'-terminus of neighbour sequence of sequence listing upward to telomere on chrosomal short arm and 5'-terminus of this base sequence : 102916
tgtaatgccaacactttaggaggctgacgcgggaggttcacttgaacccaggcatttaagaccagcctgggcaacatagtgagaccccatctttatatatatatatgtgtgtgtgtatgtgtgtgtgtgtgtgtgtgtgtgaactagagagatttcttgcctcatccaaaatcacaaagtcacaaggttggttagcctgaagatgtggttatg

SEQ ID NO: 13116 - DNA, 299 bp, Homo sapiens
  AC009330.5_95325
  Located on chromosome 7
  Distance between a terminus base of telomere on chromosomal short arm and 5'-terminus of this base sequence : 138596833
  Distance between 3'-terminus of neighbour sequence of sequence listing upward to telomere on chrosomal short arm and 5'-terminus of this base sequence : 15470
aggttccgagtacatctagctccaggtgaggaagagggtgtgagatagcatgtgcccctgtgtgggtggatgtgagattgtgtgtgcgcaggtgtgtatgtgtgagtttgcatgtgcatgaatgtggtaagtcagagacagagagaggagacagagggagagagagagagtgtgtgtgtgtgtgtgtgtgtgtgtgtgtgtgcacccctgctggggtgttcaggggcctctcctctgcagtccctagatgggtgttgtattagtccattctcacactgctacaaagaactacctgagac

SEQ ID NO: 13117 - DNA, 206 bp, Homo sapiens
  D7S500
  Located on chromosome 7
  Distance between a terminus base of telomere on chromosomal short arm and 5'-terminus of this base sequence : 138768963
  Distance between 3'-terminus of neighbour sequence of sequence listing upward to telomere on chrosomal short arm and 5'-terminus of this base sequence : 171831
ccagaattgaaaactcagcatttctgtgttttaaaagccaccaaaacaaacaaacaaacaaaacacacacacacacacacacacacacacacacacacacacacacacacacattttttattaaaacataaattatttcttgcattttaatttaaggaaccaaacagttaaagatctattaaggtaagttcagttcctcaatcaat

SEQ ID NO: 13118 - DNA, 345 bp, Homo sapiens
  chr7.fa.O7frz.141164238
  Located on chromosome 7
  Distance between a terminus base of telomere on chromosomal short arm and 5'-terminus of this base sequence : 138841427
  Distance between 3'-terminus of neighbour sequence of sequence listing upward to telomere on chrosomal short arm and 5'-terminus of this base sequence : 72258
attcttagtgtactcagtggtcagtgaccctcacaccaccaagccaaaggattctttctctattctcattctcctcgaacttcgtattggactatgtccacctctgtgcccttcttcctgaaacctccttggctacctagaagcaacactatcctgaatcttcctattcctctctctctctctctctctctctgacctttcccttagaaaatctcttcctttggattctgagccaaacttttccatcttccttttacctctcctactgttcttattaaagtatctttttcacttctacccctgaaacgtaggaaccccaaaagtttaagttgagtccactgttct

SEQ ID NO: 13119 - DNA, 422 bp, Homo sapiens
  chr7.fa.O7frz.141360105
  Located on chromosome 7
  Distance between a terminus base of telomere on chromosomal short arm and 5'-terminus of this base sequence : 139205877
  Distance between 3'-terminus of neighbour sequence of sequence listing upward to telomere on chrosomal short arm and 5'-terminus of this base sequence : 364105
ctcttcctcgtttgtagacacagctgccttgtcactgtgtgctcatatggcctttccttggtgtgtgcttgtggagaggagagaagaggggaggagagaggaagatagatagagagagagagagagagagactctccatcttcctcttctcataaggcactaatcccatcatgagggcctgtattagtctgttttcatgctgttgataaagacatacctgagactgggtaatttataaagaaaaagtggtttaatggattcacagatccacgtggctgggaaggcctcacaatcatggtggaaggtgaaagatatgtcttacatggtggcaggcaaggcatagaatgagaaccaagcaaaaggggtttcttcttataaaaccatcagatctcgtgagacttattcactaccatgagaacagt

SEQ ID NO: 13120 - DNA, 185 bp, Homo sapiens
  AC024084.4_2131
  Located on chromosome 7
  Distance between a terminus base of telomere on chromosomal short arm and 5'-terminus of this base sequence : 139376983
  Distance between 3'-terminus of neighbour sequence of sequence listing upward to telomere on chrosomal short arm and 5'-terminus of this base sequence : 170684
agcctgaatgacagagcaggactctctctctctctgtctctctctctctctctctcacacacacacacacacacacacacacacactaatagagttataaatgagatgctatagtaagacaaagaagtatttaactctgaaaagatcagggtgagttaaaatctgaaataagtcctgaaggataa

SEQ ID NO: 13121 - DNA, 389 bp, Homo sapiens
  AC024084.4_35723
  Located on chromosome 7
  Distance between a terminus base of telomere on chromosomal short arm and 5'-terminus of this base sequence : 139410310
  Distance between 3'-terminus of neighbour sequence of sequence listing upward to telomere on chrosomal short arm and 5'-terminus of this base sequence : 33142
caaatcagagtttctgttactgagaaagaagggtggctgggcgcggtggctcatgcctgtaatcccagcactttgggaggcaaggcgggtggatcacctgaggtcaggagtttgagaccagcctggccaacatggtgaaaccccgtctctactaaaaatacaaaaattacctgggcatggtggcgggtgcctgtaatcccagctactcgggaggcagaggtggtagaactgcttgaacctgagaggcggaggttgccatgagtcgagatcacgccattgcattccagcctgggcgacaagagttaaactgcatctcaaaaataaataaataaataaataaataaataaataaagagaagaatgatggatgttggaaatagctaacagtc

SEQ ID NO: 13122 - DNA, 252 bp, Homo sapiens
  AC024084.4_141424
  Located on chromosome 7
  Distance between a terminus base of telomere on chromosomal short arm and 5'-terminus of this base sequence : 139516256
  Distance between 3'-terminus of neighbour sequence of sequence listing upward to telomere on chrosomal short arm and 5'-terminus of this base sequence : 105557
gtggctttatgtacacagtgacacatggctgttgtgttagggttctctggaaaaacagaaccaatagaatatctctatctatctatctatctatctatctatctatctatctatctatctatctaatctatctatctatctattatgggaattggttattcacatgattacagagtctgagaagtaccaccatctgtggttttcaagctggagaaccaggaaagctggtgatgtaattcagtttgagtccaa

SEQ ID NO: 13123 - DNA, 239 bp, Homo sapiens
  AC009784.2_65420
  Located on chromosome 7
  Distance between a terminus base of telomere on chromosomal short arm and 5'-terminus of this base sequence : 139564179
  Distance between 3'-terminus of neighbour sequence of sequence listing upward to telomere on chrosomal short arm and 5'-terminus of this base sequence : 47671
attggctgacagaattgataagcctgaagataaatgagtttaagtagggatttataatttactgatgattaaactgaggaatatttttgggatttctggatgtgtgtgtgtgtgtgtgtgtgtgtgtgtgtgtgtgtaaacctgcactttgtggattgatgtgatgcagctacacttaaaggcagaagttagttaatgaggtataaagacttagagggtccgaaactgagtaaggtttc

SEQ ID NO: 13124 - DNA, 369 bp, Homo sapiens
  AC009784.2_100057
  Located on chromosome 7
  Distance between a terminus base of telomere on chromosomal short arm and 5'-terminus of this base sequence : 139598764
  Distance between 3'-terminus of neighbour sequence of sequence listing upward to telomere on chrosomal short arm and 5'-terminus of this base sequence : 34346
atgcaggattatgctgaaattccttggcatgtcccccacttcattattggcctacttttcgtttttttctttttttttttttgaggtttattgaagtatgactgacaaataaaaatattatctattcaaggtgtacaatgtgctatttggagatatatatatatatatatatatatatatatatatatatatacacacacagtggccagatacagaaaaataaatactgcacgatctcacttacatgtggaatctaaaaaagtcaaacttacagaaacaaagagaaggctgattttccaattttataacctgcctagtgttttctcttgagctctagccatgaggaactatcaactaattcgcttcctg

SEQ ID NO: 13125 - DNA, 101 bp, Homo sapiens
  DISO7_10018077
  Located on chromosome 7
  Distance between a terminus base of telomere on chromosomal short arm and 5'-terminus of this base sequence : 139719830
  Distance between 3'-terminus of neighbour sequence of sequence listing upward to telomere on chrosomal short arm and 5'-terminus of this base sequence : 120697
ggtagagaccagagggcacaaaaggagtgtgtgtgtgtgtgtgtgtgtgtgtgtgtgtgtgtgtgtgtttgtggagtgatgtgagcatgctggtgacataa

SEQ ID NO: 13126 - DNA, 316 bp, Homo sapiens
  AC009541.16_90422
  Located on chromosome 7
  Distance between a terminus base of telomere on chromosomal short arm and 5'-terminus of this base sequence : 139862939
  Distance between 3'-terminus of neighbour sequence of sequence listing upward to telomere on chrosomal short arm and 5'-terminus of this base sequence : 143008
atacattcgtttgccaataattatgtcatattttgtcttgttcatgggtgcaatatttcctcaaatctatcttgggtgaaacattattgtcacttcctattcatgaatgaagcatgtgagtgattagtacaggtgatgggtatgtcccatggaaaagatgaccatctgttccacataaatatcatgctgacaggaggtcttctcttgagctgcagtagaggtgaagaaggcagaggttttgaagttgaggattttaatctggagtgtgtgtgtgtgtgtgtgtgtgtgtgtggtgtagctcttggactatgaattc

SEQ ID NO: 13127 - DNA, 387 bp, Homo sapiens
  AC009541.16_90283
  Located on chromosome 7
  Distance between a terminus base of telomere on chromosomal short arm and 5'-terminus of this base sequence : 139863098
  Distance between 3'-terminus of neighbour sequence of sequence listing upward to telomere on chrosomal short arm and 5'-terminus of this base sequence : -157
gaccatctgttccacataaatatcatgctgacaggaggtcttctcttgagctgcagtagaggtgaagaaggcagaggttttgaagttgaggattttaatctggagtgtgtgtgtgtgtgtgtgtgtgtgtgtggtgtagctcttggactatgaattccctgggaatggagaacatgtctccttttctcttcctttcctttcccttcctttcctttcctttcccttcccttcccttcccttcccttcccttcccttcccttcccttcccttcctttttttttggtgagtgggggagaggggtaggggtgggggtggcagtttctcctctgtcaccaaggctggagggcagtggtgcaatcatagctcactgtagcctagacctgtcag

SEQ ID NO: 13128 - DNA, 253 bp, Homo sapiens
  AC009541.16_40739
  Located on chromosome 7
  Distance between a terminus base of telomere on chromosomal short arm and 5'-terminus of this base sequence : 139912804
  Distance between 3'-terminus of neighbour sequence of sequence listing upward to telomere on chrosomal short arm and 5'-terminus of this base sequence : 49319
ctgcaatctagtcctgcctcctctctgcaatgacccccaaatgacaacaatttttttaaagactgaacaatagtccattggatggagatatatatatatatatatatatacacacacacacacacacacatgtatatacacacacacacatatatatacatacatatatatacacacacacacacatatatatatatatatgcaccacattttctttattcatccatttatggatgcataggttaattcttta

SEQ ID NO: 13129 - DNA, 104 bp, Homo sapiens
  DISD22_0005359
  Located on chromosome 7
  Distance between a terminus base of telomere on chromosomal short arm and 5'-terminus of this base sequence : 140336620
  Distance between 3'-terminus of neighbour sequence of sequence listing upward to telomere on chrosomal short arm and 5'-terminus of this base sequence : 423563
atatcgtcaggtcccaggcatgcttacagattctctctctctctctctctctctctctctcggatctaagtttctacatgttttcctgcattcatcacaatttc

SEQ ID NO: 13130 - DNA, 128 bp, Homo sapiens
  Z67323
  Located on chromosome 7
  Distance between a terminus base of telomere on chromosomal short arm and 5'-terminus of this base sequence : 140576314
  Distance between 3'-terminus of neighbour sequence of sequence listing upward to telomere on chrosomal short arm and 5'-terminus of this base sequence : 239590
tgagtagtttctaactcctgactgtatcattcttggggtttggtgtggttatttaaaattaagtgtgtgtgtgtgtgtgtgtgtgtgtgtgtgagagagagagagaaacttggtgccaaatgaaatca

SEQ ID NO: 13131 - DNA, 313 bp, Homo sapiens
  AC020581.7_58953
  Located on chromosome 7
  Distance between a terminus base of telomere on chromosomal short arm and 5'-terminus of this base sequence : 140616138
  Distance between 3'-terminus of neighbour sequence of sequence listing upward to telomere on chrosomal short arm and 5'-terminus of this base sequence : 39696
atccactgtaggaattgaaattgcaataaaaattccagtgaacgatgtaaatgaataaataaagttggatttcagtcctcaagctaaaaacaacaaaaaaagaaaaagaaaataaaaacagatgaagaagttgcaaaaagtagcgtagcaaattggtagaagattctgaaccaggactgaacaagtccagtgcttttacagaatagcatgaacccccaacctgttgttgttgttgttgttgttgttgttgttgttgttgttgttgtttcgagagagagaatcttgctctgtatctcaggttacaatactgtgg

SEQ ID NO: 13132 - DNA, 353 bp, Homo sapiens
  AC009329.20_34868
  Located on chromosome 7
  Distance between a terminus base of telomere on chromosomal short arm and 5'-terminus of this base sequence : 140634064
  Distance between 3'-terminus of neighbour sequence of sequence listing upward to telomere on chrosomal short arm and 5'-terminus of this base sequence : 17613
atgcaattaccatatgatccagcaaccccacttctgggtgtatatccaaaggaactaatatcagtatgttgaagagatatctgcactccaatgttcattttagtattattcacaacagccaagacatggtaacaacccaaaggtctattggcagatgaatggataaataaaatgtgatatatattgtatataccatatgtatatattttattatatatattgtattatcataaatatatatatatatatatatatacagacaataaatcactatctagccttaaaaaacaaatacattttgtcatgtgctgcaatatggatgaaactggaggacattatgcggagtgaaataa

SEQ ID NO: 13133 - DNA, 291 bp, Homo sapiens
  AC009329.20_69615
  Located on chromosome 7
  Distance between a terminus base of telomere on chromosomal short arm and 5'-terminus of this base sequence : 140668880
  Distance between 3'-terminus of neighbour sequence of sequence listing upward to telomere on chrosomal short arm and 5'-terminus of this base sequence : 34463
attgcaagttctccttgtacagcatgttgtcacattccactgatgctttatgagaaattttccttaacctttagaagaacagagacattctttctttcttttcttcttatatgttattaccctttcctcctcaactaacatacttgatgtatgcatatgcatgcatgcatacacacacacacacacacacacacacacacacacacacacacacacacacacacacacacacactagttaggtgaataaatacaggcccaggcccaaacctctcagcttcctatttccttc

SEQ ID NO: 13134 - DNA, 281 bp, Homo sapiens
  D7S1837
  Located on chromosome 7
  Distance between a terminus base of telomere on chromosomal short arm and 5'-terminus of this base sequence : 140689213
  Distance between 3'-terminus of neighbour sequence of sequence listing upward to telomere on chrosomal short arm and 5'-terminus of this base sequence : 20042
ttgtgtgagcatcctagggtatacatacacaaatctatatggtatagcctacgtattagtcagtgttctcttacagggacagaactagatagatagatgatagatagatagatagatagatagatagatagatagatagatagatagatgatagacagatacatacatacatatacataaagatatatatgggtatttatatatatatgtataaatgggagtttattaagtcttaacttacatgattataaggtctcacagtaagctgtctgcaagctgag

SEQ ID NO: 13135 - DNA, 231 bp, Homo sapiens
  AC009329.20_89864
  Located on chromosome 7
  Distance between a terminus base of telomere on chromosomal short arm and 5'-terminus of this base sequence : 140689252
  Distance between 3'-terminus of neighbour sequence of sequence listing upward to telomere on chrosomal short arm and 5'-terminus of this base sequence : -242
tggtatagcctacgtattagtcagtgttctcttacagggacagaactagatagatagatgatagatagatagatagatagatagatagatagatagatagatagatagatgatagacagatacatacatacatatacataaagatatatatgggtatttatatatatatgtataaatgggagtttattaagtcttaacttacatgattataaggtctcacagtaagctgtc

SEQ ID NO: 13136 - DNA, 320 bp, Homo sapiens
  AC009517.5_9534
  Located on chromosome 7
  Distance between a terminus base of telomere on chromosomal short arm and 5'-terminus of this base sequence : 140883017
  Distance between 3'-terminus of neighbour sequence of sequence listing upward to telomere on chrosomal short arm and 5'-terminus of this base sequence : 193534
gatgctgagatgctcaaagtacatgtgtcttttatctttctcagtgttcctgatcttctatccctccttcggccctctactcaattctgtgagccacctaatatccttttaggaaaattctttacacacacacacacacacacacacacacacacacacacacaaacttcagtttgagaatagtttctattgcttgcagtcaaaaaatgctgaatgcaaaagcaaaagggtggagaatggaattaattattgagttaatatgtcatgaaaaagccataggactgatattaatattttaagctgagaaattaagaggctac

SEQ ID NO: 13137 - DNA, 275 bp, Homo sapiens
  DISO7_10002364
  Located on chromosome 7
  Distance between a terminus base of telomere on chromosomal short arm and 5'-terminus of this base sequence : 140989773
  Distance between 3'-terminus of neighbour sequence of sequence listing upward to telomere on chrosomal short arm and 5'-terminus of this base sequence : 106436
agtagttctgtggccttgctaaaaattaacattcttaagctgggcactgtggtgtatgcctatagtctcagctactcggaacgtggagaaagaaggaccgcctaagcccaggagtgaattcctgggctcaagctgtagtgtgcaatgattatgcctgtgaatagcaactgcactccagcctgggcagcacagcgagaccctgtctctaaaaaaaaaaaaaaaaaaaaatatatatatatatatatatataaattaaccttcctaagccctcatct

SEQ ID NO: 13138 - DNA, 219 bp, Homo sapiens
  D7S509
  Located on chromosome 7
  Distance between a terminus base of telomere on chromosomal short arm and 5'-terminus of this base sequence : 141291760
  Distance between 3'-terminus of neighbour sequence of sequence listing upward to telomere on chrosomal short arm and 5'-terminus of this base sequence : 301712
actgaacctggggtggtcttgaggacccctgatatgttcctctcctcccagataaggactcctgctatttcttcctctgtcaatgacagtatcttttcccaagaagaaaaaaagtgcttctgacacacacacacacacacacacacacacacacacacacacacggacttaagtgctgaattttgatgtccatgtgtttactactacagggccagcaac

SEQ ID NO: 13139 - DNA, 397 bp, Homo sapiens
  AC009245.10_46558
  Located on chromosome 7
  Distance between a terminus base of telomere on chromosomal short arm and 5'-terminus of this base sequence : 141348837
  Distance between 3'-terminus of neighbour sequence of sequence listing upward to telomere on chrosomal short arm and 5'-terminus of this base sequence : 56858
aattcaacctggcatactagactccaataacagcatcaatcactcttttatccttgtcactcttttatccttgtcactctttttgtttgtgtttgtttgtttgtttgtttgtttttgagacagggccttgctctgttgcccaggctggactgcaatggcatcaccacagctcactgcagcctcaaactgctggattcaagcaatcctcccacctcagcctcctgagtagctgcattacaggcatatgccaacacactgggctccctgtcactcttcttgaaacatacctcgcatttccctttttggtgccacgtttttgttcattctactgtccctacctggaaacatctttctctcttctctacacatgcatctcgaaataccatctcaaatagta

SEQ ID NO: 13140 - DNA, 394 bp, Homo sapiens
  chr7.fa.O7frz.143570916
  Located on chromosome 7
  Distance between a terminus base of telomere on chromosomal short arm and 5'-terminus of this base sequence : 141453952
  Distance between 3'-terminus of neighbour sequence of sequence listing upward to telomere on chrosomal short arm and 5'-terminus of this base sequence : 104718
tccacttctaaactggaacactcaattgctcctccttctgaacttttcaatggttcccaatgtcgaaatccaacctcccagacatgacttctcttgatggctacgtctccagactgttcttctaccaatcatccatgtgttttctaaattctcctgctcatggccaaggactcctcgcctgtatatctctattcttgttggtctagattggttggaatgccctgcatacccaaacccataaatacacacacacacacacacacacacacacatacacacacacacacacctccatccccctgccatacacacacacatctaggccctaaccagaaaatgcctatctggtaacccaaatgtcacctccctgcagtcatttctatgctttctaggc

SEQ ID NO: 13141 - DNA, 266 bp, Homo sapiens
  chr7.fa.O7frz.143658612
  Located on chromosome 7
  Distance between a terminus base of telomere on chromosomal short arm and 5'-terminus of this base sequence : 141541823
  Distance between 3'-terminus of neighbour sequence of sequence listing upward to telomere on chrosomal short arm and 5'-terminus of this base sequence : 87477
agtcatcctggatttacctataaggcacatttaaggcacaaatgagcatgtaagggaggaatgtgcacgtgtgtgtgtgtgtgtgtgtgtgtgtgtgtgtgtgtgtcagagagagaagaagggagagagaagtataagcatttgggtcttttgaataactattattaatgtttcctcaatcccttctattccccaatattccctagggcctcaggcaacactcttccttatgaaactgaaaagtcttaggagtaactgaatgagtg

SEQ ID NO: 13142 - DNA, 314 bp, Homo sapiens
  AC009263.6_84842
  Located on chromosome 7
  Distance between a terminus base of telomere on chromosomal short arm and 5'-terminus of this base sequence : 141635219
  Distance between 3'-terminus of neighbour sequence of sequence listing upward to telomere on chrosomal short arm and 5'-terminus of this base sequence : 93130
cattgaggttgtttagcagaatttttttttttcaaagataccagctaaagtatttagagatgaaatgtcataatgtctcaactaactttcaagggtcatcaaacacacacacacacacacacacacacacacacaacatacacatacgcagaaagacagaaaaataagttaatatggtaaaatattagcaactgatggatttagtcaaatgatatatgtcttgactgtattatttttacaacctttctcaggtttgaactttttcaaaataaaaaagaaaagaaattatgaaataggcacaacctaagaaacaa

SEQ ID NO: 13143 - DNA, 305 bp, Homo sapiens
  AC009263.6_114472
  Located on chromosome 7
  Distance between a terminus base of telomere on chromosomal short arm and 5'-terminus of this base sequence : 141664875
  Distance between 3'-terminus of neighbour sequence of sequence listing upward to telomere on chrosomal short arm and 5'-terminus of this base sequence : 29342
tccataacacttatttcatccaacataatcacttctttataatgtttattgtttatgttcccctacacacacacacacacacacacacacacacacacacacacgaatataagcttctagaagtcagggattttgtctgcttctgttcactcatgtttccaagtgctttatatattccacaaatattaatcgaaagaacaaatatctctctgactgaatgaataatcaggccatcctttttctacataaagattcagctagagtaacaaacagctctgcccctggatatctaacagagttcagga

SEQ ID NO: 13144 - DNA, 332 bp, Homo sapiens
  AC009263.6_176114
  Located on chromosome 7
  Distance between a terminus base of telomere on chromosomal short arm and 5'-terminus of this base sequence : 141726482
  Distance between 3'-terminus of neighbour sequence of sequence listing upward to telomere on chrosomal short arm and 5'-terminus of this base sequence : 61302
cggaagtaatgactctggaagagattgccaagagaataaaaagagactaattcagttggaaaaaaggaaaaaagaaactaaggcactatgcaaccacatacacacacacacacacacacacacacacacacacacacaatcaaaacatacccctcacctggtataaatgagttgctgctgcgtctccactgacagttttaagccttttcattcctcttgtttcatcgataaaaattatgatactaaatcattggattgtccccactttctgccagtgctcaatcctgatcaaacctctgattcttgaactctctcagaaataaccttaggcc

SEQ ID NO: 13145 - DNA, 265 bp, Homo sapiens
  AC024082.6_106053
  Located on chromosome 7
  Distance between a terminus base of telomere on chromosomal short arm and 5'-terminus of this base sequence : 141797318
  Distance between 3'-terminus of neighbour sequence of sequence listing upward to telomere on chrosomal short arm and 5'-terminus of this base sequence : 70504
tacattgtgaaatgatttgcacaattaagctaattaacgtatccattatctcacagttaccttttcctttgatttttcttgtgtgtgtgtgtgtgtgtgtgtgtgtgtgtgtgtgtgtgtgtgtgtgttgagaatactcaagctctatcttagcaaatttcaagtatacaatatagtattattgaccatagtcaccatgccataccttaggtctccagaacttattcatcttctaactgcaaggttgtatcctttgaccaacatc

SEQ ID NO: 13146 - DNA, 157 bp, Homo sapiens
  D7S495
  Located on chromosome 7
  Distance between a terminus base of telomere on chromosomal short arm and 5'-terminus of this base sequence : 141988407
  Distance between 3'-terminus of neighbour sequence of sequence listing upward to telomere on chrosomal short arm and 5'-terminus of this base sequence : 190824
gtggcatcatttacaatagccaagaaatggaaacaacctaagtgtctatcaatagacgaacagatacacatgcacacacacacacacacacacacacacacacacacaaaatggactattattcagccataataaagaagaaaattggaccaggtgc

SEQ ID NO: 13147 - DNA, 477 bp, Homo sapiens
  AC025593.5_40324
  Located on chromosome 7
  Distance between a terminus base of telomere on chromosomal short arm and 5'-terminus of this base sequence : 142101891
  Distance between 3'-terminus of neighbour sequence of sequence listing upward to telomere on chrosomal short arm and 5'-terminus of this base sequence : 113327
tgaagaaatcttcagactgtaaagtaaaaggggtaagtcacagaaaaaatatatatagcacaattctatgtgtgtgtgtgtgtgtgtgtgtgtgtgttgggttggggaagacaaaccccaggctccaagtgcacatgtgtatatgaatacatatgcagagaaaaataccctggaagtatgtacaacaactgttaccatggttaccataaggaggagagtaagaggtgggtagagctgtgggagccattattattattattattattattatttattttttttttagacggagttttgctcttgttgcccaggctggagtacaatggcatgatctcggctcactgcagcctccacctccctggttcaagtgattcttctgcctcagactctcgagtagctgggattacaggcatgcaccaccatgcctggctaatttttgtatttttagtagaaacggagtttcaccatgttagccag

SEQ ID NO: 13148 - DNA, 151 bp, Homo sapiens
  D7S2560
  Located on chromosome 7
  Distance between a terminus base of telomere on chromosomal short arm and 5'-terminus of this base sequence : 142174117
  Distance between 3'-terminus of neighbour sequence of sequence listing upward to telomere on chrosomal short arm and 5'-terminus of this base sequence : 71749
taatttcttaggattcttcagaggtgactaataagaggagtgtgtgtgtgtgtgtgtgtgtgtgtgtgtgcgcgcgcgtgtgtgcgtgtgtgtgtgcgtgtgtgtgtgtgtgtgtgtgtgtgtcactctgtttgagtctgcaatagtcatt

SEQ ID NO: 13149 - DNA, 103 bp, Homo sapiens
  D7S2450
  Located on chromosome 7
  Distance between a terminus base of telomere on chromosomal short arm and 5'-terminus of this base sequence : 142297408
  Distance between 3'-terminus of neighbour sequence of sequence listing upward to telomere on chrosomal short arm and 5'-terminus of this base sequence : 123140
tgaagtggctcagactgccatggctcagtcccttctgctctgatatcacacacacacacacacacacacatacacacacccctacaccccacctggttctaag

SEQ ID NO: 13150 - DNA, 480 bp, Homo sapiens
  AC020983.6_169769
  Located on chromosome 7
  Distance between a terminus base of telomere on chromosomal short arm and 5'-terminus of this base sequence : 142358918
  Distance between 3'-terminus of neighbour sequence of sequence listing upward to telomere on chrosomal short arm and 5'-terminus of this base sequence : 61407
cctaggagttccaatccagcctggatgatagaacccagaagaaagaaagaagagagagaaagagagagagaaagaagggaaggaaagaaagaagaaaagaaagaaaaagaaagaaagaaagaaagaaagaaagaaagaaagaaagaaagaaaaaaggaaagaaagaaaaaaggaaagaaagaaaaaagaaagaaagaaaaaagaagaaagaagggagggagggaaaaagaaagagagagggagggagggagcgaggaaggaaagaaggaaggaagggaggcagggagggaaggaatttctttggggatgtgggaagctgaagcaggagatcacttatttctgttataaactcattttactattggatttgttgccatgtgcccttattacttcaacaaaaaaatttataaatttaaagaaagctaaacaaaaaaacaatatgaaacttacatgtttaatagaatctcttacagctcagga

SEQ ID NO: 13151 - DNA, 395 bp, Homo sapiens
  chr7.fa.O7frz.144670612
  Located on chromosome 7
  Distance between a terminus base of telomere on chromosomal short arm and 5'-terminus of this base sequence : 142443651
  Distance between 3'-terminus of neighbour sequence of sequence listing upward to telomere on chrosomal short arm and 5'-terminus of this base sequence : 84253
gaggtcaggaattcgagacaagcctggccaacgtggtgaaacaccatctttactaaaaatacaaaaaaattagcggggcgtggtggtgggtgcctgtagtcccagctacacaagaggctgaggcaggagaatcgcaaaggttgcagtgagccaagatcgcgccactgcactccagcctgggcaacagagtgagactgtctcaaaaacaaaaaaaaaatcatgcatgacttttgtgtttagacttgggtcccatccccaagacatctcattttatatatatatatatatatatgcaaatattccaaaatctgaaaaagtctgaaatctaaaacacttctggtctgagcatttcagataagggacagataatcaatctgtatattccggactcagtg

SEQ ID NO: 13152 - DNA, 179 bp, Homo sapiens
  D7S684
  Located on chromosome 7
  Distance between a terminus base of telomere on chromosomal short arm and 5'-terminus of this base sequence : 142524435
  Distance between 3'-terminus of neighbour sequence of sequence listing upward to telomere on chrosomal short arm and 5'-terminus of this base sequence : 80389
gcttgcagtgagccgacattgtgccactgcactccagcctgggtgacagagcgagactccatctcaaaacacacacacacacacacacacacacacacacacacacacacacgaacagaaactgattttctcataattttctcgtagttatggaggctggaaagtcttacatcaacatc

SEQ ID NO: 13153 - DNA, 220 bp, Homo sapiens
  D7S2505
  Located on chromosome 7
  Distance between a terminus base of telomere on chromosomal short arm and 5'-terminus of this base sequence : 142899143
  Distance between 3'-terminus of neighbour sequence of sequence listing upward to telomere on chrosomal short arm and 5'-terminus of this base sequence : 374529
ttaacagtaataaatcatgctgagctgggcttagtggctcatgcctgtaatcccagcagtttgggaggctgaggcaagaggaatgcttgagcccaggcactcgagaccagcctgggcaaaatagtgagacactgtctctatacacacacacacacacacacacacacacacacacacacacacaaattagccaggtatggtggcactagcctggtcccag

SEQ ID NO: 13154 - DNA, 241 bp, Homo sapiens
  D7S2468
  Located on chromosome 7
  Distance between a terminus base of telomere on chromosomal short arm and 5'-terminus of this base sequence : 143099271
  Distance between 3'-terminus of neighbour sequence of sequence listing upward to telomere on chrosomal short arm and 5'-terminus of this base sequence : 199908
ttttcacaagaggccaccttcgccctttgaatatctgcttgtagaagttaacaataacaacacacacacacacacacacacacacgtcagttactacaagtaaaataaacttagtgaatcattgactattcttggatataacccacttttctgtgctctttaaacttggcataagtaatataggagacagcattggaataacaagagtaccttgcaagtcacattggtaaggtgcgctaga

SEQ ID NO: 13155 - DNA, 360 bp, Homo sapiens
  AC005531.1_76503
  Located on chromosome 7
  Distance between a terminus base of telomere on chromosomal short arm and 5'-terminus of this base sequence : 143310365
  Distance between 3'-terminus of neighbour sequence of sequence listing upward to telomere on chrosomal short arm and 5'-terminus of this base sequence : 210853
atactcacattgtcttggcaacgggaatttgattgctttttaaattgttttattgtaaactgacaaattatatatatatatatatatatatctatatatatctttttttttttttttttttttttgagaccgagtctcactttgtcacccaggctggagtgcagtggtacaatcgcctcagcctcctgagtagctgggactacaggcacctgctaccacacctggctaatttttgtatttttggtagagacgggatttcaccatattggccaggctggaatgtttttaattaaaaaaatttttttttagcaataaggtcttgctctttgccaaggctggattgcagtggcatagtcatag

SEQ ID NO: 13156 - DNA, 336 bp, Homo sapiens
  chr7.fa.O7frz.145642158
  Located on chromosome 7
  Distance between a terminus base of telomere on chromosomal short arm and 5'-terminus of this base sequence : 143401587
  Distance between 3'-terminus of neighbour sequence of sequence listing upward to telomere on chrosomal short arm and 5'-terminus of this base sequence : 90862
aagatcaccaaatatctggaacctacatctgagagcaagcaagtatgaagtaaaattcttagctgtgactatagcttaattgagaattactttgatttctcaaagcaaaaatgagagagaggcggaagtcactgcttgaacctaatttttctaagaaatctaaaatgaacgtttgtgattcttccttgatagattcactggtgtgtgtgtgtgtgtgtgtgtgtgtgtatgttgtgttttaagctcttttaatccatgatcactattctgcttgtctttggtcattagatgattcagactgaataccactgcctaaagttggacacttaaagcata

SEQ ID NO: 13157 - DNA, 213 bp, Homo sapiens
  DISD22_0005385
  Located on chromosome 7
  Distance between a terminus base of telomere on chromosomal short arm and 5'-terminus of this base sequence : 143599769
  Distance between 3'-terminus of neighbour sequence of sequence listing upward to telomere on chrosomal short arm and 5'-terminus of this base sequence : 197846
tgttcccgtaggaacgagtgcattagttcagggtgctccagaaaaacagaaccagtagcatgtgtgtgtgttctatgtatagatacacaatacacacacgaacacatacacacatgaacacacacacacacacacacacacacatgaacttctttggaatgggtgataagcctggctgcccatcctaaaatgctataactgaagtcctgttgg

SEQ ID NO: 13158 - DNA, 252 bp, Homo sapiens
  HUMUT6716
  Located on chromosome 7
  Distance between a terminus base of telomere on chromosomal short arm and 5'-terminus of this base sequence : 143708235
  Distance between 3'-terminus of neighbour sequence of sequence listing upward to telomere on chrosomal short arm and 5'-terminus of this base sequence : 108253
gggcaacaagaacgaaactccgtttcaaagaaagaaaggaaagaaaggaaaggaaaggaaaggaaagggagggagggaaggaaggaaggaaggaaggaaggaaggaaggaaggaaggaaggaaagaaaggaaagaaagaaagaaatggagaattagatcagcgactctttgcctgggggtgggtgacagaacaacacttcttcctcccctaacaaaaattacctatggagctgtgagggctttccccactga

SEQ ID NO: 13159 - DNA, 395 bp, Homo sapiens
  AC004849.1_42317
  Located on chromosome 7
  Distance between a terminus base of telomere on chromosomal short arm and 5'-terminus of this base sequence : 143741564
  Distance between 3'-terminus of neighbour sequence of sequence listing upward to telomere on chrosomal short arm and 5'-terminus of this base sequence : 33077
actcatggttctatggctgtacaggaagcgtggtgccagcatctgctcctggtgaggcctcaggaagctttcaatcatggcagaaggcgaagggggagtaggtgctctcatggtgagaagaggtacaagggagtgggagggaggtgctatacatttttaaaccagatctcatgagaactcactgaccatccctaggacagcacaagacattcctgagggatctgcccctatgacccaaacaattcacaccgggctccacctccaacattgtggattacgtttcagcatgagggtgtgtgtgtgtgtgtgtgtgtgtgtgtatggtggggacagacatctggaacctcaggtggatttggactctgaacactagctagcaatcttattgtgtttct

SEQ ID NO: 13160 - DNA, 215 bp, Homo sapiens
  chr7.fa.O7frz.146216384
  Located on chromosome 7
  Distance between a terminus base of telomere on chromosomal short arm and 5'-terminus of this base sequence : 143827071
  Distance between 3'-terminus of neighbour sequence of sequence listing upward to telomere on chrosomal short arm and 5'-terminus of this base sequence : 85112
ggcagtcatttaaaggtttatctttgggttctcagggcatggtgccaatgtctggctcaccctggtgcttatcagacgcttgtggatggaaagaatggaggaagagagcaaaaaaaaaaaagctaggttcagggctctgtgtgtgtgtgtgtgtgtgtgtgtatacacgcctgcacgcatgcacatatgtaacctataatgataagatgccatgc

SEQ ID NO: 13161 - DNA, 458 bp, Homo sapiens
  chr7.fa.O7frz.146116029
  Located on chromosome 7
  Distance between a terminus base of telomere on chromosomal short arm and 5'-terminus of this base sequence : 143927490
  Distance between 3'-terminus of neighbour sequence of sequence listing upward to telomere on chrosomal short arm and 5'-terminus of this base sequence : 100204
ttagtaagtcattcgatgcaacagttttaaaatttttagcctgattccacagccaggctagggatgcgtgtgtgtgtgtgtgtgtgtgtgtgtgtgtgaacactctcaaaaggtggcccttagtagcaatgttgagggttgaaaatggttctttctttatcccttctccccctggctccagcctcactctgcggagaaacatgaacctggatcagaatgttctgtccttttaggcttcagagctggggcagggatgccagttagctgcttcttcccgcacctccaaggacatgcgagttgagttcacagtggtgtgggccgagggggctgcaagcttgcctacaccttcccatgccttctggatctagacacgtttgctgcacagttctccgggcgtgaagctgcacaggacgcggctgctgcccaaggccgctcggtgtatcaagccactaattgac

SEQ ID NO: 13162 - DNA, 443 bp, Homo sapiens
  AC004914.1_103825
  Located on chromosome 7
  Distance between a terminus base of telomere on chromosomal short arm and 5'-terminus of this base sequence : 144006476
  Distance between 3'-terminus of neighbour sequence of sequence listing upward to telomere on chrosomal short arm and 5'-terminus of this base sequence : 78528
cttgaggtcaggagttgagaccagcctggccgacatgttgaagccccgtctttaccaaaaatacaaaaatttgctgggcgtgatggcacatgcctgtattcccagcaacttggttggctgaggcaccagagaatcacttgaacctcggaggtggaggttgccatgagctgagatcgtgccactgcactccagcctgcatgacagagcaagactctgcctcaaaaggcaaaacaaaacaaaacacacacacacacacacacacacacacacacacacacacacacacaaaatgagataaagggaaaaggagctttgaatggcggcctttaggagttgctaatgacctgaacttagggcactgtgtaaatatttattcttacttaactataagtaattaataaaggtttatcatctactgggttacaaagtccagctacaaattg

SEQ ID NO: 13163 - DNA, 437 bp, Homo sapiens
  AC004914.1_135539
  Located on chromosome 7
  Distance between a terminus base of telomere on chromosomal short arm and 5'-terminus of this base sequence : 144038252
  Distance between 3'-terminus of neighbour sequence of sequence listing upward to telomere on chrosomal short arm and 5'-terminus of this base sequence : 31333
ctacgtaactgacagctttgacatatacccaaaattaacagaatcaaatgttgcaaagcggccaggcatggtggctcatgcctgtaatcccagtactttggaaggccgaggtgggaggatcatttgacctcaggcgtttaagaccagcctgggcaacatagcaaaatcctgtctttacaaataaataaataaataaataaataaataagtaaaacataaaattagccagggatggttgcatgcacctatagtcccagctacttgggaggctgaggtaggagggtcacttgaggccaagagcttgagaccagcctgggaaatatagcaagacctcactctacaaaaaatttaaaaattaactgggcatggtggcacatgtctatagttctagctacttgagaggctgaggtgaaaggatcacttgaggtcagaagttt

SEQ ID NO: 13164 - DNA, 247 bp, Homo sapiens
  AC006021.2_50894
  Located on chromosome 7
  Distance between a terminus base of telomere on chromosomal short arm and 5'-terminus of this base sequence : 144097278
  Distance between 3'-terminus of neighbour sequence of sequence listing upward to telomere on chrosomal short arm and 5'-terminus of this base sequence : 58589
aattgtgattatgctactgcaagtgcactccagcctgggcaacagagcaagaccctgtggagaaagggagaaagaaagagagagagagagagagagagagagagattaaacatattaaatgtataagcattttctataacttctcaaattattataaaaaaggcaaaaagtgaatatgtatatctagtgggggtgctaaacaaagtgagaatgacaccccatcacactaacgacctccatttaccag

SEQ ID NO: 13165 - DNA, 306 bp, Homo sapiens
  AC006021.2_88503
  Located on chromosome 7
  Distance between a terminus base of telomere on chromosomal short arm and 5'-terminus of this base sequence : 144134899
  Distance between 3'-terminus of neighbour sequence of sequence listing upward to telomere on chrosomal short arm and 5'-terminus of this base sequence : 37374
cagtttagtgcctagcactaagtgatggtttgtgtgcatggttggcccagcagaaatatgtttgtccatccatccatccatccatccatccatccatccatccatctatccatccaaccatccatccatccatccctccctccctccctccctccctccctccaaatcattcatcaaataagggaaccttccccaaaggtcccagctgttctctctccccttcttataggctataactgggtaacatgcctagcccagatcattcactcccaggcacagcaaacaattagcttagactagccagga

SEQ ID NO: 13166 - DNA, 112 bp, Homo sapiens
  DISO7_10002369
  Located on chromosome 7
  Distance between a terminus base of telomere on chromosomal short arm and 5'-terminus of this base sequence : 144251131
  Distance between 3'-terminus of neighbour sequence of sequence listing upward to telomere on chrosomal short arm and 5'-terminus of this base sequence : 115926
tgggctccatcatattaacccctcatcattctcaacacacacacacacacacacacacacacacacacacacacacacacacgacagagagagaaatgtatccattccaaga

SEQ ID NO: 13167 - DNA, 121 bp, Homo sapiens
  DISO7_10002370
  Located on chromosome 7
  Distance between a terminus base of telomere on chromosomal short arm and 5'-terminus of this base sequence : 144374648
  Distance between 3'-terminus of neighbour sequence of sequence listing upward to telomere on chrosomal short arm and 5'-terminus of this base sequence : 123405
acttcacgttgaccaggcgctggctgtgagctgggtgagggagggagagagaaagagagaaagagagagagagagagagagagagagagagagagagagagacagagtgagcaaagagcct

SEQ ID NO: 13168 - DNA, 127 bp, Homo sapiens
  chr7.fa.O7frz.146770440
  Located on chromosome 7
  Distance between a terminus base of telomere on chromosomal short arm and 5'-terminus of this base sequence : 144484360
  Distance between 3'-terminus of neighbour sequence of sequence listing upward to telomere on chrosomal short arm and 5'-terminus of this base sequence : 109591
gtttacagtgaaccatgatcacaccaccgcactccagcctgggtgacagagtgagatcccatctcaaacaaacaaacaaacaaacaaacaaacaaacaaaaaactctgttagacgctagtaagcaaa

SEQ ID NO: 13169 - DNA, 242 bp, Homo sapiens
  AC006006.2_53142
  Located on chromosome 7
  Distance between a terminus base of telomere on chromosomal short arm and 5'-terminus of this base sequence : 144741391
  Distance between 3'-terminus of neighbour sequence of sequence listing upward to telomere on chrosomal short arm and 5'-terminus of this base sequence : 256904
ggaggcaaatattctaattactcagagatgcatatatatatatatatatatatatatatatatatatatatatatgtatctctcttacattattcagaattagtgtggttttgtagatggcacttttcatataagaatttctcttcataaatataggctgggtgtggtggctcaagtctgtaatcccagcactttgggaggccgagatgggaggatcagtgtaggttaagagtttgagacca

SEQ ID NO: 13170 - DNA, 319 bp, Homo sapiens
  AC006006.2_80414
  Located on chromosome 7
  Distance between a terminus base of telomere on chromosomal short arm and 5'-terminus of this base sequence : 144768535
  Distance between 3'-terminus of neighbour sequence of sequence listing upward to telomere on chrosomal short arm and 5'-terminus of this base sequence : 26902
cagtaacagcacaaaggagtagggggagaatgcagtttatagaaataaggtttttgtaggctattaaaattaagttgctactaacccaaactagagtattataaattaagatgctaattacaaactagatagaatctttcctgtctcttaccacttttcccttccttccttccttccttccttccttccttccttccttccttccttccttccctccttccctcctttctctttctctctctctctctccctccctccctccctccctctctctctctctctctctttatttctttctttctttcgaaggagtcttgct

SEQ ID NO: 13171 - DNA, 357 bp, Homo sapiens
  AC006006.2_93736
  Located on chromosome 7
  Distance between a terminus base of telomere on chromosomal short arm and 5'-terminus of this base sequence : 144781994
  Distance between 3'-terminus of neighbour sequence of sequence listing upward to telomere on chrosomal short arm and 5'-terminus of this base sequence : 13140
catcagagtgaggctcagtctctaaataaataaataaataaataaataaataaaaataagtaagtaaataaattaaaaaacccataatatttcaaactgaaacccctgggatccttgggaatggtgtgaggatgaagtcaatagtgggatcatcacctgaactgagtgcccttcccaagtgatggccaactcagttcagagaggacaatggttcatcaaacttcattttcttcagtatctcctattgagaagagctaaaactcacaggtaaagattcccaaggtggcagtagttacagtctcattatcaaataaaataaaatatatgaaagacaaacttgcaagagctatttaagga

SEQ ID NO: 13172 - DNA, 261 bp, Homo sapiens
  D7S1779
  Located on chromosome 7
  Distance between a terminus base of telomere on chromosomal short arm and 5'-terminus of this base sequence : 144978262
  Distance between 3'-terminus of neighbour sequence of sequence listing upward to telomere on chrosomal short arm and 5'-terminus of this base sequence : 195911
agtcctgtgcctgaccctgaatacgccaaactgcaaggcacagtcggcattcctctgtcaatcaatgtcatgtgacttacatgttctacttcactctgtgattgatctacagcctttgaatggttattacaggttcagactacacatcacacacacatacacacacacacacacacacacacacacacacacacacacacacacaccctaaatataaattaaaataaatacttgaagtgtaactcttcacttttgaatctt

SEQ ID NO: 13173 - DNA, 196 bp, Homo sapiens
  AC006396.1_41270
  Located on chromosome 7
  Distance between a terminus base of telomere on chromosomal short arm and 5'-terminus of this base sequence : 145023753
  Distance between 3'-terminus of neighbour sequence of sequence listing upward to telomere on chrosomal short arm and 5'-terminus of this base sequence : 45230
gccactaggcttacaaatctaattgtaaagaaagaataaactccatagggagtaaaggccagaggatgaagcctgtgtgtgtgtgtgtgtgtgtgtgtgcgcgcgcgcgcgcgtgtgtgtgtgtgggtgtgtggtggggaagaagggtgatctttgtggatgaggttcaaatgctgagttgtccaggtgaactggt

SEQ ID NO: 13174 - DNA, 458 bp, Homo sapiens
  AC006396.1_80813
  Located on chromosome 7
  Distance between a terminus base of telomere on chromosomal short arm and 5'-terminus of this base sequence : 145063084
  Distance between 3'-terminus of neighbour sequence of sequence listing upward to telomere on chrosomal short arm and 5'-terminus of this base sequence : 39135
ctgtaccgatatgaatctgtagactggatattgtccccgacccctgcctttttttaagatacagggtctcgctatgatgcccaggctggtctcaaactcttgggctccagccatcctctcaccttggccccccaaagtgctggaattacaggcatgagccactgcacctggccatttggggcttctaactaaagcaaaaggtcaggatggatcaggcatcgagagaactgtggtctctgctgaggatacttacatttcccatacctaggcgtgagagaaacctgtcatccatccatccatccatccatctatccatccttccatccattcatccatccctccatccttccatctgtctgtccatccttccatccatccctccatccctccatccatccctccctctgtctatctattcacttatttattcattcagtgaatatttaaggagcacctac

SEQ ID NO: 13175 - DNA, 169 bp, Homo sapiens
  AC004928.2_1354
  Located on chromosome 7
  Distance between a terminus base of telomere on chromosomal short arm and 5'-terminus of this base sequence : 145065505
  Distance between 3'-terminus of neighbour sequence of sequence listing upward to telomere on chrosomal short arm and 5'-terminus of this base sequence : 1963
ggaaactttgctccaatagaactttatttctttcttctcctttatgctattattatctcatatatatatatatatatatatgcatgttatatatgtatgtatttcatcttcatatgttataaacccccagatatggttcttatattgttgtttaacattgtttagcagg

SEQ ID NO: 13176 - DNA, 454 bp, Homo sapiens
  AC004928.2_93148
  Located on chromosome 7
  Distance between a terminus base of telomere on chromosomal short arm and 5'-terminus of this base sequence : 145157021
  Distance between 3'-terminus of neighbour sequence of sequence listing upward to telomere on chrosomal short arm and 5'-terminus of this base sequence : 91347
caattatctgttatggcagaaggcaatcgtttcatggaacaaaggaaagattcagcagaataaggggacaggagtgccagtggttggatcactgattttcttaaagaggggaagaagctataataacagtgtcaaggccttttaattcttgggtgaggtagggtgggcatgtgctggataggaagaacaaggcagagccagggcagaatgtagtgttaaactgcatggtcagggtaagcctcatggagaaggcagccccctcgttgtttatttactgagttctcactatttgctgaaaccctgaggaagaatccatgcatccatccatgcatccatgcatccatccatccatccatccatccatccatccatccatccatgcatgcatccatccatgcatctatctgtccatccatccatctatccatccatctagtaagattgagtgcctcct

SEQ ID NO: 13177 - DNA, 426 bp, Homo sapiens
  AC004928.2_112509
  Located on chromosome 7
  Distance between a terminus base of telomere on chromosomal short arm and 5'-terminus of this base sequence : 145176524
  Distance between 3'-terminus of neighbour sequence of sequence listing upward to telomere on chrosomal short arm and 5'-terminus of this base sequence : 19049
ctcaactgttcctctggtatttctttccccagtggacccacccattccccataaggtacaaatattcagtatttgtttgtatttgttgaattaataaagatgtagtttcttaagtgatactacctagtataatttcctctcattattattcttttccagtctcatctctctttctctctgtctctccgcgccgacgtgtgtgtgtgtgtgtgtgtgtgtgtgtgtgtgtgtgtgtgtatgtgtgtgtgtttatgtagaggagaaagaaaataaatatcaccatagagaaggtaaaattctgttgatctctttggctctgcctttctctcaaagcagcaactccttgcagggtttctgggcttctccagctgtttaaaatggctggcctcctgtgtgcttccttgtttgtatgtctgagcaaagtgg

SEQ ID NO: 13178 - DNA, 417 bp, Homo sapiens
  AC004928.2_120352
  Located on chromosome 7
  Distance between a terminus base of telomere on chromosomal short arm and 5'-terminus of this base sequence : 145184457
  Distance between 3'-terminus of neighbour sequence of sequence listing upward to telomere on chrosomal short arm and 5'-terminus of this base sequence : 7507
taacagctgatttccaggtagtagaaatgtgatagtttgctttgatttttaatttttacttgtctatattttgtaattttctgtaatccatgggggctacttctgtatttatttatttatttatttatttatttatttatttatttgagatggagtttcgctcttgtcacccaggctggagtgcaatggagctatctcggctcactgcaacctccgcctcccgggttcaagtgattcttctgtctcagcctccctagcagctgggattacaggcgcttaccaccacgcccagctaatttttgtatttttagcagggacggggtttcaccacgttggccggctgatcttgaactcctgatgtcaggtgatctgcctgcctcggcctccctgcttctattttaagaaatcacttcgtga

SEQ ID NO: 13179 - DNA, 399 bp, Homo sapiens
  AC005692.1_35564
  Located on chromosome 7
  Distance between a terminus base of telomere on chromosomal short arm and 5'-terminus of this base sequence : 145236531
  Distance between 3'-terminus of neighbour sequence of sequence listing upward to telomere on chrosomal short arm and 5'-terminus of this base sequence : 51657
atagaactgccatacaatccagcaattccactactgactatatacccaaagaaattgaaatcagtatgttaacgagatatctgcactttcatgctcatttagattattcacaatagctaagacgtggaatcatatcacctgagtgtcaaccaatggatgaatggataaagaaaatgtaatacacacacacacacacacacacacacacacactcatacaatagaatattattcagccataaaaaagaatgaaatcctgccatttgcaacaacatagatgaacctggaggacactatgctaagtcaggcacagaaacacaagtactgcatgatctcactcatatgtggaatctaaaaagttgatcacatagaagtagagaatagaacagtggttaccaga

SEQ ID NO: 13180 - DNA, 390 bp, Homo sapiens
  AC004918.1_53618
  Located on chromosome 7
  Distance between a terminus base of telomere on chromosomal short arm and 5'-terminus of this base sequence : 145491776
  Distance between 3'-terminus of neighbour sequence of sequence listing upward to telomere on chrosomal short arm and 5'-terminus of this base sequence : 254846
atgtaattaggttacctgcatgatgaaaaaaatgtaaagtaactaatcgttttgctgcttctgttaaaaattctcttcctatgccaggcaccttggctcatgcctataatctcagctctttggcaggctgaggcaggaggatcacttgactgcaggagttcaggaccagcctgggcaatatagtaagagcctgtctctaccaaaaaaaaaaaaaaaaaatatatatatatatatatatatatatatatttttaagttctctttctattatcccaatcatagtaagaatcccaataataaaagaagtaggctttaagaaagtttaggatttctttgcctacttggggcaaggaggtaactattgcggctttgcataaacaaagatcatgta

SEQ ID NO: 13181 - DNA, 443 bp, Homo sapiens
  AC004918.1_72131
  Located on chromosome 7
  Distance between a terminus base of telomere on chromosomal short arm and 5'-terminus of this base sequence : 145510355
  Distance between 3'-terminus of neighbour sequence of sequence listing upward to telomere on chrosomal short arm and 5'-terminus of this base sequence : 18189
gaagtagctgtggatgtttgaccaagttactgatgacctccagagctcatcccttggagcactgacagcaaataagtcaagacggagcacagtagagatccatctctgagaatgtctcctccatacctgctcatttcttcccagtgaggcactgtgtgtgtgtgtgtgtgtgtgtgtatgtatgtatgtgatgtgggagaggcagaaacagacatacacacatacatacacacacagagacagacagagagagagagagatcttatttctgtggccgggggcggtggggctggccttggtgcaggtcacacaggtgacccattacctgttctaatcttagggactccgggaatgaccacagcccaactgtgactaacagagaaaaggtcagactagtgggtctgtaccatcgttttaaaatgtctgctccttaaagtatcggt

SEQ ID NO: 13182 - DNA, 202 bp, Homo sapiens
  AC004918.1_76251
  Located on chromosome 7
  Distance between a terminus base of telomere on chromosomal short arm and 5'-terminus of this base sequence : 145514537
  Distance between 3'-terminus of neighbour sequence of sequence listing upward to telomere on chrosomal short arm and 5'-terminus of this base sequence : 3739
gcctggcttatttcacttaatatccccctggttcatccatgttatcacaaatggcagcctttccttttttatgactgagtaatattctattgtgtgtgtgtgtgtgtgtgtgtgtgtgtgtgtgtgtgtattcaccacattttctttattcatctgtccatggctatttaggtggtttccatatcttggctgttgaggataa

SEQ ID NO: 13183 - DNA, 163 bp, Homo sapiens
  D7S2513
  Located on chromosome 7
  Distance between a terminus base of telomere on chromosomal short arm and 5'-terminus of this base sequence : 145514582
  Distance between 3'-terminus of neighbour sequence of sequence listing upward to telomere on chrosomal short arm and 5'-terminus of this base sequence : -157
cacaaatggcagcctttccttttttatgactgagtaatattctattgtgtgtgtgtgtgtgtgtgtgtgtgtgtgtgtgtgtgtattcaccacattttctttattcatctgtccatggctatttaggtggtttccatatcttggctgttgaggataatgctgc

SEQ ID NO: 13184 - DNA, 101 bp, Homo sapiens
  DISD22_0005390
  Located on chromosome 7
  Distance between a terminus base of telomere on chromosomal short arm and 5'-terminus of this base sequence : 145766478
  Distance between 3'-terminus of neighbour sequence of sequence listing upward to telomere on chrosomal short arm and 5'-terminus of this base sequence : 251733
agatgacagtagcaacggccacctcctaccggagatcatgcagagagagagagagagagagagtaagagtgtcagatcttctcacaggaaccctagtgtcc

SEQ ID NO: 13185 - DNA, 410 bp, Homo sapiens
  chr7.fa.O7frz.148346874
  Located on chromosome 7
  Distance between a terminus base of telomere on chromosomal short arm and 5'-terminus of this base sequence : 145918947
  Distance between 3'-terminus of neighbour sequence of sequence listing upward to telomere on chrosomal short arm and 5'-terminus of this base sequence : 152368
aattaatgtttgtaggctatgaagactgtgagaaatcattttgataggtgggggtgtagatgccatgtgcttgtgagtgtgtgtgtgtgtgtgtgtgtgtatgagtatgtgagagaaagagggagagagagagagagagagagaaagagagtcttgtagtagtggtttttctccattggcctgtggaatcagttcagtgtgggatgtgttgactgtttactgtggctattcctaagggttgaggaactggaggaatagttcttaacagaatttaagctaatgatactgcttgttggatattatttcattttcagaaaggactggctgaggaggggttgggaaactgacattggatgtcaggtacttatgtcagcttaggctcaaagtaacatcatgaagtactcatgatc

SEQ ID NO: 13186 - DNA, 156 bp, Homo sapiens
  D7S2473
  Located on chromosome 7
  Distance between a terminus base of telomere on chromosomal short arm and 5'-terminus of this base sequence : 146262604
  Distance between 3'-terminus of neighbour sequence of sequence listing upward to telomere on chrosomal short arm and 5'-terminus of this base sequence : 343247
ggggattcaccagtagatgacaacactaccaaagtgtgtgtgtgtgtgtgtgtgtgtgtgtgtgtgtgtgtgtgatacctttctggcagtgctggtctctggttttcctcctggaggttcctgccctggggccattgactgaggcactgaggtctg

SEQ ID NO: 13187 - DNA, 294 bp, Homo sapiens
  U07977.1_4248
  Located on chromosome 7
  Distance between a terminus base of telomere on chromosomal short arm and 5'-terminus of this base sequence : 146262606
  Distance between 3'-terminus of neighbour sequence of sequence listing upward to telomere on chrosomal short arm and 5'-terminus of this base sequence : -154
ggattcaccagtagatgacaacactaccaaagtgtgtgtgtgtgtgtgtgtgtgtgtgtgtgtgtgtgtgtgatacctttctggcagtgctggtctctggttttcctcctggaggttcctgccctggggccattgactgaggcactgaggtctgagtgctggaccttgctgacaagagcaggaggagctgcagccctgccacacccccgaggttgggtggttgatggctggcagaggagaggagtaccatgggcaagaataaaggggactgtggtcctcaacattagataattc

SEQ ID NO: 13188 - DNA, 348 bp, Homo sapiens
  X61444.1_1212
  Located on chromosome 7
  Distance between a terminus base of telomere on chromosomal short arm and 5'-terminus of this base sequence : 146287419
  Distance between 3'-terminus of neighbour sequence of sequence listing upward to telomere on chrosomal short arm and 5'-terminus of this base sequence : 24519
ctctgctcctactcacagtgactctgatctggtaaagctcccatcctgccctgaccctgccatgggcacaaggctcctctgctgggcagccatatgtctcctgggggcaggtgattcctcagatgccaagcagtctcctgtgtgtgtgtgtgtgtgtgtgtgtatgtgtgtgagatgtgtgtgtgagagagagagagagagagctgactatagttgtttttctcattcagttcccaatttctgtctccacagatcacacaggtgctggagtctcccagtccctgagacacaaggtagcaaagaagggaaaggatgtagctctcagatatgatccaatttcaggtcata

SEQ ID NO: 13189 - DNA, 364 bp, Homo sapiens
  U07978.1_473
  Located on chromosome 7
  Distance between a terminus base of telomere on chromosomal short arm and 5'-terminus of this base sequence : 146297353
  Distance between 3'-terminus of neighbour sequence of sequence listing upward to telomere on chrosomal short arm and 5'-terminus of this base sequence : 9586
aatcttaggttgaggactcagaactcacagaagtggaaatatatatgcttgatgattcatttgatgaaattacctgcagaacatagcgtacatgccttctcagacattttaaaatcagcacaattgatatataaattgtacaatataaacattacacatgttaaataaacagatcaatggttttatatatatatatatatatatatatagacatatatatgggttataaggatatatatgtatatccttataaccactatccctataaaaaggtctctatcacccagaaatctctctcatacccctttgccatgactctctccatctctgacaaccaatgatgtgatttctatcactggagaat

SEQ ID NO: 13190 - DNA, 328 bp, Homo sapiens
  U07978.1_11070
  Located on chromosome 7
  Distance between a terminus base of telomere on chromosomal short arm and 5'-terminus of this base sequence : 146308131
  Distance between 3'-terminus of neighbour sequence of sequence listing upward to telomere on chrosomal short arm and 5'-terminus of this base sequence : 10414
aacatagtgtacatgcctccacagacattttaaaatcagcattatttatctataaattatacaatataaacattacacatgttaaataaacaaatcagtgagctatatatatatatatatatatatatatatatatatatatagagagagagagagagagagagagagacatatatatatgggttataaggttatatatgtatatccttataaccactatccctatacaaatgtctctatcacccagaaagttctctcacaccccttggcaatgactgtttccatctctgacaaccaaatgatatgatttctatcactggagaataca

SEQ ID NO: 13191 - DNA, 342 bp, Homo sapiens
  U07976.1_7705
  Located on chromosome 7
  Distance between a terminus base of telomere on chromosomal short arm and 5'-terminus of this base sequence : 146329882
  Distance between 3'-terminus of neighbour sequence of sequence listing upward to telomere on chrosomal short arm and 5'-terminus of this base sequence : 21423
cagtgatcctgatctggtaaagctcccatcctgccctgaccctgccatgggcaccaggctcctcttctgggtggccttctgtctcctgggggcaggtgagtcctcagacaccaaccattctcattgtgtgtgtgtgtgtgtgtgtgtgtgtgtgtgtgtgtgtgtgtgtgtaggggtgggctgtgtgcattcgtgtgatgactaaaattattttcctcattctgttcccaactttgtctccacagatcacacaggagctggagtctcccagtcccccagtaacaaggtcacagagaagggaaaggatgtagagctcaggtgtgatccaatttcaggtcatac

SEQ ID NO: 13192 - DNA, 409 bp, Homo sapiens
  chr7.fa.O7frz.148964507
  Located on chromosome 7
  Distance between a terminus base of telomere on chromosomal short arm and 5'-terminus of this base sequence : 146607586
  Distance between 3'-terminus of neighbour sequence of sequence listing upward to telomere on chrosomal short arm and 5'-terminus of this base sequence : 277362
tatctgctcattctatgaccagtgacctcactcactgctgccttatacttcagggcttacacgtagacacacacacacacaggcacacacacacacacacacacacacacacactaagaaaagtagcttaaaattagaccatagagaatctaaaattttaaaatttagaacagatcttcatctgagccaggaaccattcatctatggcttctgtcatttaatagaataaacaaaatctgcatatgaatccatgcagaactccaagttcagcatggtttctcactgttctcagagctggtacctgaagctgcaggtgtgcattctctgccacactctgtaatggatgagtggaaattcttccataaagcttttgtctattgggagcaggtaagtctaggcaaagtatgca

SEQ ID NO: 13193 - DNA, 375 bp, Homo sapiens
  chr7.fa.O7frz.149502734
  Located on chromosome 7
  Distance between a terminus base of telomere on chromosomal short arm and 5'-terminus of this base sequence : 147038637
  Distance between 3'-terminus of neighbour sequence of sequence listing upward to telomere on chrosomal short arm and 5'-terminus of this base sequence : 430642
ggtgcatcaataacagtgagaaaaagctcaaaggtggtgaacagtgccatggggtagtcatagaattgccccagactggttgggtcctctgtctggaaaatgatatagaacgctgctccgcccaggaagaggacatggagatgggataatggagttatcacaataagcatggacatggttagcacttattctatctctgatctatctatctatctatctatctatctatctatctatctatctatctaaatacacttgcacacatgcacagataattacatactaataaatgtagtttcctgtggaactgtctaaccctaagatgtcctatgattaagttcaccactctgggtaatggtcatggtaatagtcatt

SEQ ID NO: 13194 - DNA, 217 bp, Homo sapiens
  DISO7_10002375
  Located on chromosome 7
  Distance between a terminus base of telomere on chromosomal short arm and 5'-terminus of this base sequence : 147124434
  Distance between 3'-terminus of neighbour sequence of sequence listing upward to telomere on chrosomal short arm and 5'-terminus of this base sequence : 85422
tgatataacaggtcaatgggtatctttctaacccttttcctaatcatatcctaagacacacagacacacacacacacacacacacagaaatgtttttaaacaaaatatatgataccttgtatggtattctatagctttctttttatttattttaaagtagtcaattttatatatcaatatatatagtattccccacttctatttaatggttacgtag

SEQ ID NO: 13195 - DNA, 387 bp, Homo sapiens
  chr7.fa.O7frz.149590398
  Located on chromosome 7
  Distance between a terminus base of telomere on chromosomal short arm and 5'-terminus of this base sequence : 147166794
  Distance between 3'-terminus of neighbour sequence of sequence listing upward to telomere on chrosomal short arm and 5'-terminus of this base sequence : 42143
ttgctcttgtcagcttactaacatctaccatgctcttctataccccaagacgacctgtactagtgtgttacataacatgttttatttaattctgaaattaaccttatgagggaggcattactatccccataatattggggattttttattgaataaaattccagatttttatctgcgttacatttacttaatgaatgcttagtcaacaactactatgtaaatgttacatttcaaacccaggtcgaactccaaagccccccaccacacacacacacacacacacacacacacacacacacacacacaactgaggtgctggacccagttctcatctgcctcttgttgctgtctgactgtacccattgttagtttaagcatcagcgttgt

SEQ ID NO: 13196 - DNA, 373 bp, Homo sapiens
  chr7.fa.O7frz.149900327
  Located on chromosome 7
  Distance between a terminus base of telomere on chromosomal short arm and 5'-terminus of this base sequence : 147427281
  Distance between 3'-terminus of neighbour sequence of sequence listing upward to telomere on chrosomal short arm and 5'-terminus of this base sequence : 260100
tgaaactcatttgcagttactctccatttcttcctctgcctccccacccctagcaaattctaatctactttctgtctcttgtattattattattattattattattattattatattaatttttgagacagggtctggaatgcagacaggctggaatgcaatggcatgatcacggctcactgaagcctcgacctccatgactcaagcaatccacccacctcagcctcctgtgtacctggaactataggcgtgtgccgccacctccagctaatttttgtatttttttgtggcatgatcacagctcactgcagcctcaacctccagggctcaagcggtcctcccacttcagcctcctgagtagctggaactatag

SEQ ID NO: 13197 - DNA, 389 bp, Homo sapiens
  chr7.fa.O7frz.150028612
  Located on chromosome 7
  Distance between a terminus base of telomere on chromosomal short arm and 5'-terminus of this base sequence : 147708141
  Distance between 3'-terminus of neighbour sequence of sequence listing upward to telomere on chrosomal short arm and 5'-terminus of this base sequence : 280487
aaatttccactctgaaccttactctttgtgtgtccacgtcctagttttccgtggctgtgagacaacaaacctcagatattaccccagatgaatgatgccatttcaatctcaatgtaatctgccaccacagtgagtgtgtgtgtgtgtgtgtgtgtgtgagagagaaaccactgaaactatgcaaaactatgcaaaataaaatggttataataaatttccccaaagtgactaagaatcaacgaatatcatgcctgagacagtcttacataatataaaatttgtccatagtagttaaaaatagtaaatgtaaaaagtcaatatattgaaagcatgctccttggaagataatgctataatgcagaatagtattgactgagaacctttgatag

SEQ ID NO: 13198 - DNA, 215 bp, Homo sapiens
  AC004742.1_883
  Located on chromosome 7
  Distance between a terminus base of telomere on chromosomal short arm and 5'-terminus of this base sequence : 147849767
  Distance between 3'-terminus of neighbour sequence of sequence listing upward to telomere on chrosomal short arm and 5'-terminus of this base sequence : 141237
aacggtgacgtctgagaagggagggggctggggagtggggggcagccggcagggaggaggggagctcctccatgcgcgtaaacacacacacacacacacacacacacgaacgctcactcaagtctccaggggccagtgccagtgggagatagagctcagtcccaaagccagtgttcacaaagatcaaagggcagtaggacagtaggccacaagta

SEQ ID NO: 13199 - DNA, 421 bp, Homo sapiens
  AC004742.1_21243
  Located on chromosome 7
  Distance between a terminus base of telomere on chromosomal short arm and 5'-terminus of this base sequence : 147870130
  Distance between 3'-terminus of neighbour sequence of sequence listing upward to telomere on chrosomal short arm and 5'-terminus of this base sequence : 20148
tgaaatctatcggttctagctatagtttttaattaaaaaagcaagttgtattaaaatggagagtaggatctctctttccccctcccctcccctcccctcccctcccctcccctcccctcccctccagggggagggtctgcttctgccacccaggctggagtgcagtggtgccatcacagctcactgcagcttcaacctcccaggctcaagcgatccttccacctcagaggctgggaccacaagtgcgccgccaccacgcccagctaactttttgattttttgttagagacagggttttactttgttgcccaggctggtctcgaacgccagggctcaagtgatcctcccgcctcggcctcccaaagtgctgggatcacaggcctgagccactgcatcagctttagcattacattcgtgtatg

SEQ ID NO: 13200 - DNA, 268 bp, Homo sapiens
  D7S661
  Located on chromosome 7
  Distance between a terminus base of telomere on chromosomal short arm and 5'-terminus of this base sequence : 147872549
  Distance between 3'-terminus of neighbour sequence of sequence listing upward to telomere on chrosomal short arm and 5'-terminus of this base sequence : 1998
tggagcatgaccttggaattcagatgccagcgctcttgcagtacaaagtccttgaggctgagatcactggctagtcctctcggcgcctcatgtttctgtgtgtgtgtgtgtgtgtgtgtgtgtgtgtgtgtgtgtgtgtgtgtgtttgtgtgtgtatatgttttagggtatggaaggacacggagccagtgcagcagagaaaaccccttcaccagcaagcacaccaagactcctgaacctgggccagtgcgagttctgggccagccaa

SEQ ID NO: 13201 - DNA, 362 bp, Homo sapiens
  AC004853.1_28935
  Located on chromosome 7
  Distance between a terminus base of telomere on chromosomal short arm and 5'-terminus of this base sequence : 147914574
  Distance between 3'-terminus of neighbour sequence of sequence listing upward to telomere on chrosomal short arm and 5'-terminus of this base sequence : 41757
ttgcatcagacaattatcttgtagtgtgctaaacattttcaaaataaattttatgctaatcttcaattttatcatttccagggttctgtgtgtgtgtgtgtgtgtgtgtgtgtgtgtgtgtgtgtttacatatccaactttctgtctgctataatatttcttttgcatagagacctgtcattgaaacttctcatttaggtctgctggaaatgtatttattcagtttttgtttgtctgtagacgaatttatttcccctttgttttcaaaaatgttttctttttctacatacagaactattaggtgatagatttcttcttcctgcctcagggtttgaaaaatgtaactctattgtcctctggcc

SEQ ID NO: 13202 - DNA, 433 bp, Homo sapiens
  AC004853.1_99462
  Located on chromosome 7
  Distance between a terminus base of telomere on chromosomal short arm and 5'-terminus of this base sequence : 147984857
  Distance between 3'-terminus of neighbour sequence of sequence listing upward to telomere on chrosomal short arm and 5'-terminus of this base sequence : 69921
cacttgaatagacatctaaagtcagggccaagaatggttaaaacacagccaagaggctgggtgcggtggctcacgcctgcaatcccagcactttgggaggccaaggcgggcggtcaggagttcgggaccagcctgaccaaagtggtgaaaccccgtcgctactaaaaacacaaaaaaattagccaggtgtggtggcgggtgcctatggtcccagctactcaggaggctgaggcaggagaatcacttgaatccgggtggcagaggttgcagtgagccgagatcacgccattgcactccagcctgggtgacagagcgatactccgtctcaaaaaacaaacaaacaaacaaacaaacaaacaaaaacatagccaagagagctgttatttattctctctaatcacctgtaccctgagagtatgagcagactgcatcc

SEQ ID NO: 13203 - DNA, 428 bp, Homo sapiens
  AC004853.1_108570
  Located on chromosome 7
  Distance between a terminus base of telomere on chromosomal short arm and 5'-terminus of this base sequence : 147994099
  Distance between 3'-terminus of neighbour sequence of sequence listing upward to telomere on chrosomal short arm and 5'-terminus of this base sequence : 8809
ccttcagacttgaactaaagattaaacattctgcttccctgattctgaggtttttggacttagactgagccacagtgctggcatcccagcaagtctgcagcttgatggcttgttaccatactcctcagcctccataattgtgtgagccaattctcctaacaaatcccctctcaaattatctatctatctatctatcatctatctatctatctatctatctatctatctatctatctatctatctatcatctatctatctatcctcacacatatcctattggttctgtctctttggagaaccctaacacatgggcataaagtttcacttatgcaagatgaatatgacatagagatctgctatatacaatacaatattgtgcactttaaaatatgttaaaaggacagatctcatgttaagtggtcttaca

SEQ ID NO: 13204 - DNA, 190 bp, Homo sapiens
  G10037
  Located on chromosome 7
  Distance between a terminus base of telomere on chromosomal short arm and 5'-terminus of this base sequence : 147994227
  Distance between 3'-terminus of neighbour sequence of sequence listing upward to telomere on chrosomal short arm and 5'-terminus of this base sequence : -300
cctccataattgtgtgagccaattctcctaacaaatcccctctcaaattatctatctatctatctatcatctatctatctatctatctatctatctatctatctatctatctatctatcatctatctatctatcctcacacatatcctattggttctgtctctttggagaaccctaacacatgggcataa

SEQ ID NO: 13205 - DNA, 172 bp, Homo sapiens
  D7S794
  Located on chromosome 7
  Distance between a terminus base of telomere on chromosomal short arm and 5'-terminus of this base sequence : 147994244
  Distance between 3'-terminus of neighbour sequence of sequence listing upward to telomere on chrosomal short arm and 5'-terminus of this base sequence : -173
gccaattctcctaacaaatcccctctcaaattatctatctatctatctatcatctatctatctatctatctatctatctatctatctatctatctatctatcatctatctatctatcctcacacatatcctattggttctgtctctttggagaaccctaacacatgggcata

SEQ ID NO: 13206 - DNA, 403 bp, Homo sapiens
  AC004853.1_113832
  Located on chromosome 7
  Distance between a terminus base of telomere on chromosomal short arm and 5'-terminus of this base sequence : 147999327
  Distance between 3'-terminus of neighbour sequence of sequence listing upward to telomere on chrosomal short arm and 5'-terminus of this base sequence : 4911
gtttacgtaaactgctcagaaatagagttcattggattcattggctcaaagccagagatattggttcattggtggagatgctattactcggcaagtgttaagggaacatcttatcggaattgctgcaatcctaaagaatgtttagtgataaaccttatcataaaagtatgtgtatatatgagaaacatgcaagaatttctcgtggggttattttttaaagtcctttagactgtgtgtgtgtgtgtgtgtgtgtgtgtgtgtgtgtgtgtatctcagacaagtaagcatgagttcctttccttcatgccctcctgaccccaatttgtgtgtgtttgactggttacttcatcctggtatcggcagctttcacatttccccattctgatcaagatctttctccaaa

SEQ ID NO: 13207 - DNA, 382 bp, Homo sapiens
  D7S1803
  Located on chromosome 7
  Distance between a terminus base of telomere on chromosomal short arm and 5'-terminus of this base sequence : 148120810
  Distance between 3'-terminus of neighbour sequence of sequence listing upward to telomere on chrosomal short arm and 5'-terminus of this base sequence : 121080
tccatcaactcccagtgcggagggatggtggtcatctaaattggcccaactctattaattgagaaggcaactaaaagtaagagagcttcaaatgcaggcaatgcctctggataaggatattttggataagccaaaaggatgaaaggatcttagatagatgagatagatagatgatagatagatagatagatagatagatagatagatagatagatagatagatagatgatagattaactagacaggcagacagagagagagaactacatatacataatatatatttattatatagattatatacatatgtaatctatcacagatgaagatattcgaagaaacttctgttactagaaaataaaattctggtagcagctgcagt

SEQ ID NO: 13208 - DNA, 166 bp, Homo sapiens
  D7S676
  Located on chromosome 7
  Distance between a terminus base of telomere on chromosomal short arm and 5'-terminus of this base sequence : 148353238
  Distance between 3'-terminus of neighbour sequence of sequence listing upward to telomere on chrosomal short arm and 5'-terminus of this base sequence : 232046
gcaacatgatccagaaaacacgaatcaaggtggtgttttcaaagcagttcattgtccttgcacaagcagggccttaaagaactgaagagtcctctgtgtgtgtgtgtgtgtgtgtgtgtgtgtgtgtgtgtgtgtgtgtgtgtgtagaggtggctgcttagattca

SEQ ID NO: 13209 - DNA, 402 bp, Homo sapiens
  AC004534.1_71613
  Located on chromosome 7
  Distance between a terminus base of telomere on chromosomal short arm and 5'-terminus of this base sequence : 148383764
  Distance between 3'-terminus of neighbour sequence of sequence listing upward to telomere on chrosomal short arm and 5'-terminus of this base sequence : 30360
tcttaactgttcttgaaggctaacaatttaggaaagagcaaacattttagaagcccacctccttattcaagatggagaagagtaatcagatatgtctctgaataaaacaaagtccaccagaatgttaaacacacacacacacacacacacacactcacacactcacacactcttactcttactctctctctctcttctgagtttgtttacttgcctgccagacaaaggagtatacactgtcaacaaaattcactgaatacttaatgggagggggtcagggtgaggaacaaaaggctttattcactagaaaagggcttcaaggtggttatactaagtagtgattgaaaactccctctctgaatggaaaaaaatgagttcttgtccatacatgtttggcttaat

SEQ ID NO: 13210 - DNA, 177 bp, Homo sapiens
  AC005677.1_11309
  Located on chromosome 7
  Distance between a terminus base of telomere on chromosomal short arm and 5'-terminus of this base sequence : 148479294
  Distance between 3'-terminus of neighbour sequence of sequence listing upward to telomere on chrosomal short arm and 5'-terminus of this base sequence : 95128
ttagcacagtggtacctggtacatggacaccacttaaataaatgtctgtgtgtgtgtgtgtgtgtgtgtgtgtgtgtgtgtgtgtgaatatatgaatataatgaatatacttagaaggtgagttagaggaagacgcccagtggtagggtcagaatttgcatctaaggcttatctgac

SEQ ID NO: 13211 - DNA, 139 bp, Homo sapiens
  D7S498
  Located on chromosome 7
  Distance between a terminus base of telomere on chromosomal short arm and 5'-terminus of this base sequence : 148634112
  Distance between 3'-terminus of neighbour sequence of sequence listing upward to telomere on chrosomal short arm and 5'-terminus of this base sequence : 154641
aaagacatgacacaaaagggaaggaatttaaatagcagatatataatctctaatcatacacacacacatacacacacacacacacacacacacacatattttccaatgccaaagacttccatattgctaaatctaatgg

SEQ ID NO: 13212 - DNA, 284 bp, Homo sapiens
  AC004743.1_25069
  Located on chromosome 7
  Distance between a terminus base of telomere on chromosomal short arm and 5'-terminus of this base sequence : 148692172
  Distance between 3'-terminus of neighbour sequence of sequence listing upward to telomere on chrosomal short arm and 5'-terminus of this base sequence : 57921
cagagcatacgtttaagctcttagggatgctgaatgtgttgaatcccaagcgcaaaccactgctgcaaatttaagcactaagatccaaatcaaagcctgaaaaaatgttttgtcacattacaaacaacaatataactagataaaagtttacagtctgttttccctagtaagatgtgtgtgtgtgtgtgtgtgtgtgtgttttgtttgtttgtttttgagatggagtttcactctttttgcccaggctggagtgcaatggcacaatctcagctcactgcaactga

SEQ ID NO: 13213 - DNA, 341 bp, Homo sapiens
  AC004743.1_110130
  Located on chromosome 7
  Distance between a terminus base of telomere on chromosomal short arm and 5'-terminus of this base sequence : 148777288
  Distance between 3'-terminus of neighbour sequence of sequence listing upward to telomere on chrosomal short arm and 5'-terminus of this base sequence : 84832
acttgcactaggaactgacaataatttccgtagttcttccctcttttctcctacattataaattaattccctttctgctggagcacatataatgctgttaattctccatgctttaaaacacacacacacacacacacacacacacacacacacacaattcctcctcaggctaccccatcatttctctgccctgttatagcaaaatgcctcaaaaagtcttttgagaattttgttttaaaatagtaagtggatacaaatccaaaataaatgaaagaacactcaaaagaagtaagaggtttatttgtttttttaaaaagatttgcaaactttctctagatttg

SEQ ID NO: 13214 - DNA, 406 bp, Homo sapiens
  chr7.fa.O7frz.151452377
  Located on chromosome 7
  Distance between a terminus base of telomere on chromosomal short arm and 5'-terminus of this base sequence : 148973963
  Distance between 3'-terminus of neighbour sequence of sequence listing upward to telomere on chrosomal short arm and 5'-terminus of this base sequence : 196334
aaggcagaatcttcctgacatcagtgtgtggatttttaacaccatcacgagtctgaaaggaacacaggtttttctgcagctattttctagcatttgccagtccctgtgcctagactgatttgaatactttgtttttttcgctgtgccatttacccccccaccccccacctttccttcctgccatctaccacccttggatgaatgaattttataattctagctgttgtattttgtggattggttttgcatgcgcgtgtgcgcacgtgtgtgtatgtgtgtgtgtttctgtgtttctgtgaagcacatacgtttgatgtgggaggtaaaggagtgttccagttgctcctggtcactccctttatggccatcaccgtcttgttttttgtaactcagtttagctattggt

SEQ ID NO: 13215 - DNA, 217 bp, Homo sapiens
  chr7.fa.O7frz.151540496
  Located on chromosome 7
  Distance between a terminus base of telomere on chromosomal short arm and 5'-terminus of this base sequence : 149061447
  Distance between 3'-terminus of neighbour sequence of sequence listing upward to telomere on chrosomal short arm and 5'-terminus of this base sequence : 87078
gtgttgacaaacctaagtgataagtactatggagatactccaaagattataggagtacaaagattcagcactaaaaagaggcaactgagttagccttgggtgtggtttgtatatgtgtgtgtgtgtgtgtgtgtatgtgtgcacacaggcattcttgcagagggaagagatgctgtaaacaagaattgaaatactgattcaacttagtttaatctgg

SEQ ID NO: 13216 - DNA, 254 bp, Homo sapiens
  AC004981.1_117211
  Located on chromosome 7
  Distance between a terminus base of telomere on chromosomal short arm and 5'-terminus of this base sequence : 149155656
  Distance between 3'-terminus of neighbour sequence of sequence listing upward to telomere on chrosomal short arm and 5'-terminus of this base sequence : 93992
agaactaacatgactgcatctttcagttctttacttttggaattaatcttgagaattctccagaaatgtatatcatgttagttttgttttattcagggttcttggaggggcatttgctcttggccatttctactctagcagtccacacacacacacacacacacacacacagcttagagatgttgacagttgtgtaatacgcttttccaaaaaataaaactcagaatggtccctcaggtctactggactcattg

SEQ ID NO: 13217 - DNA, 288 bp, Homo sapiens
  AC004911.1_118358
  Located on chromosome 7
  Distance between a terminus base of telomere on chromosomal short arm and 5'-terminus of this base sequence : 149229285
  Distance between 3'-terminus of neighbour sequence of sequence listing upward to telomere on chrosomal short arm and 5'-terminus of this base sequence : 73375
ttgagcctcttgaatttatgagttcataatattcattaaacttaacaaaattaataattttttattcaaatattttgtctctccttagtcctcttctttgactattccaatgtatgatatacatttaaatgtgtgtgtgtgtgtgtgtgtgtgtgtgtgtagtcatttaaagttgtctcagagccactaatactgtttattattttgggggctttatatcctttttgtgttttattttggattgtgcgatttctatataaatttgtttaccagcaatgtttaagattt

SEQ ID NO: 13218 - DNA, 382 bp, Homo sapiens
  AC004911.1_94846
  Located on chromosome 7
  Distance between a terminus base of telomere on chromosomal short arm and 5'-terminus of this base sequence : 149252682
  Distance between 3'-terminus of neighbour sequence of sequence listing upward to telomere on chrosomal short arm and 5'-terminus of this base sequence : 23109
ttgaggcctagtgttcaagaccagcctgagcaacagagtgagatccagtctctacagaaaatttaatagttagctgggagtggtggcttgtgcctgtagttccagctacttgggaggctgagttgggaggattgcttgagcccaggaagtcaaggcagcaatgaaccacaatcatgccactgcactccagcctgggtgacagagtgaaaccttgtctcaaatatatatatatatatatatatatatatatatatatatatatatatatatatataaaatgtgatatgataaatttaaaaatgagaggcttaattctccttgctaaaattaagagaaaagattcctgtccacttcccatgttataaacatatggcatagccag

SEQ ID NO: 13219 - DNA, 422 bp, Homo sapiens
  chr7.fa.O7frz.151811115
  Located on chromosome 7
  Distance between a terminus base of telomere on chromosomal short arm and 5'-terminus of this base sequence : 149331895
  Distance between 3'-terminus of neighbour sequence of sequence listing upward to telomere on chrosomal short arm and 5'-terminus of this base sequence : 78831
agtcagccacaatacataatttactttgtttatatgcaacaacatcaatgaatctcaaaataatttttctgaaataagccagataaaaaagaagatatactctatgatttcatgtatataaaattctacataatttaaagtaatctatagagacaaaaaacagattcgagattccctggggatggtggtgaggagtaaagagggaggatgagtgatttcaaaggtatacacgtaaacttttgggggtaataaatatttttgttactttgttgtgatggttttgttgtgtgtgtgtgtgtgcgtgtgtgtgtgtgtgtaaaaactgattttaaaaagcatgcaataggctgggcgcggtggctcacgcctgtgatcccagcactttgggaggccgaggcgggtagatcacgaggtcaagagat

SEQ ID NO: 13220 - DNA, 221 bp, Homo sapiens
  AC004942.1_20816
  Located on chromosome 7
  Distance between a terminus base of telomere on chromosomal short arm and 5'-terminus of this base sequence : 149402728
  Distance between 3'-terminus of neighbour sequence of sequence listing upward to telomere on chrosomal short arm and 5'-terminus of this base sequence : 70411
accatgcttactgtgaagctaggaagagtggctgatgaggtctgagccttttaatatagagtctttccaaatacgtgcatgtgagcgaatgcgcacgcgcacaacacacacacacacacacacacacacacacacacaaccaactactcaccctgtctttactcaaggaaagtatgtaaaagacattagcttctagactttcttacttcataatgctccac

SEQ ID NO: 13221 - DNA, 282 bp, Homo sapiens
  chr7.fa.O7frz.151990849
  Located on chromosome 7
  Distance between a terminus base of telomere on chromosomal short arm and 5'-terminus of this base sequence : 149541483
  Distance between 3'-terminus of neighbour sequence of sequence listing upward to telomere on chrosomal short arm and 5'-terminus of this base sequence : 138534
ccttgtaagatagctgtccttctgcatagccgttagatatttgtttccttaatttttcccaatatagtattataaacaatttcaaattcatggcaaagttgacacaatgtgagccagtgaatacttgtgttactaccacatattatgctatatctgcttcatttctctctcatacacacacacatacacacacacacacacacacacacgcacgtgcacacacacacacgtattccaatatctattttctttggatgacttgcaaacttaatcttagatttg

SEQ ID NO: 13222 - DNA, 283 bp, Homo sapiens
  AC006007.1_53661
  Located on chromosome 7
  Distance between a terminus base of telomere on chromosomal short arm and 5'-terminus of this base sequence : 149637167
  Distance between 3'-terminus of neighbour sequence of sequence listing upward to telomere on chrosomal short arm and 5'-terminus of this base sequence : 95402
gaaatgttcctgacagttcaagaaagatgaagactgaggcttgacctttgggttgagcaacatggaaagtgctggtgattttgacaaaacaatttaagtagaattgtgggagaaaaggcctaattgttgctttctttgtaaatgtgtgtgtgtgtgtgtgtgtgtgtgtgtgtgtgtgtgcgagagagagagaaagagagagaaatacagagagagagagagagaagagagaaggatacagtgagagattaaattaatgatgtggtaggtcgctcctgacatg

SEQ ID NO: 13223 - DNA, 364 bp, Homo sapiens
  AC006007.1_43436
  Located on chromosome 7
  Distance between a terminus base of telomere on chromosomal short arm and 5'-terminus of this base sequence : 149647329
  Distance between 3'-terminus of neighbour sequence of sequence listing upward to telomere on chrosomal short arm and 5'-terminus of this base sequence : 9879
cagtgctaaatgtgaattgttttaatcatcacatagacatggcatttaaaatccacctggtaatagttgatgttttttcttcatgcctactatttgtgggtaacaggtgagtagtatgtaaaaacaccgtagcatagcacgggcatccataccacataaaaagtacaagatttccaaaagagatgatggatggatggatagatagatagatagatagatagatagatagatagatagatagattccacaatcacagaaacataaatatttatatacttatataatcaactgtgtgtgaatgtgtatctttgtgtcccacaggctgattgtataggagcacaaattagaaactaggtgaccatct

SEQ ID NO: 13224 - DNA, 263 bp, Homo sapiens
  chr7.fa.O7frz.152249006
  Located on chromosome 7
  Distance between a terminus base of telomere on chromosomal short arm and 5'-terminus of this base sequence : 149770113
  Distance between 3'-terminus of neighbour sequence of sequence listing upward to telomere on chrosomal short arm and 5'-terminus of this base sequence : 122420
aggacagttcacgatacatagtagatccttaattagtatttgttaaatgaatgaatgaagaatggatgtgtgtgtgtgtgtgtgtgtgtgtttccatgaaaagttctgaaaggatgaatgtgtagctgataatgagataactgggtatcttttaaatcaggagaatgaagtcatagagacaagtatatgaagatctaggagggaataatagtaaaataatgtcctaaaagaaatggaaaggggtcgaatacagctcattgatc

SEQ ID NO: 13225 - DNA, 465 bp, Homo sapiens
  chr7.fa.O7frz.152470698
  Located on chromosome 7
  Distance between a terminus base of telomere on chromosomal short arm and 5'-terminus of this base sequence : 150123465
  Distance between 3'-terminus of neighbour sequence of sequence listing upward to telomere on chrosomal short arm and 5'-terminus of this base sequence : 353089
cctgaatgtcagtaattgaaactccacaaaaaatagcattgtattccatacttggcatttatgaaaatgacataagatcaaagaatttgaattaggatacatatggtatatttgaagttaattttcttacgacaatagaggcttagacttctacaagtagctatacatgcattctagtcccaaagaaatataagcaagacaatatttttaaaattactgtttattactacctagtgtttgggctaattcttgaccactggaattgcagaactctgaaaaaacacacacacacagatacacacacacacacacacacacacacacacacaaaggagtgaaattagatcagcctgccccaaagatctcaggcagagtttgctccattcacctctcttgcctctcagacacagctttattcctatttggtctttcaggggactaaagagttaccttccaagtggtaag

SEQ ID NO: 13226 - DNA, 340 bp, Homo sapiens
  chr7.fa.O7frz.152562357
  Located on chromosome 7
  Distance between a terminus base of telomere on chromosomal short arm and 5'-terminus of this base sequence : 150171543
  Distance between 3'-terminus of neighbour sequence of sequence listing upward to telomere on chrosomal short arm and 5'-terminus of this base sequence : 47613
gcaatgaggaatagaggttaagaagaaaggaaataagtaattacataagtaataattatatagtaattacataagtaaatacaattataaataattgcataaaacaatatcattattattattattattattattattattcgaaatggagtctcgctcttgtcgcccaggctgaagtgcaatggcgggatcttggctcactacaacctcctcctcccaggttcaagtgattctcctgcctcaacctcccaagtagctgggattacaggtgcccaccaccatgcctgactaatttttttttgtatttttagttaagatggggtttcaccatgttggtcag

SEQ ID NO: 13227 - DNA, 349 bp, Homo sapiens
  chr7.fa.O7frz.152658638
  Located on chromosome 7
  Distance between a terminus base of telomere on chromosomal short arm and 5'-terminus of this base sequence : 150238252
  Distance between 3'-terminus of neighbour sequence of sequence listing upward to telomere on chrosomal short arm and 5'-terminus of this base sequence : 66369
tttctgtaaactgctatcaagaacatagtaatgtcctgtagcccaatgatggaaggaggctggaaaatggcaagagagcaaataaatttggagaataattgcttgagcaaaatttgaacacttaagagaaaatcaatggtcagatatgttaaaaagatggaattcctggtagagaggatggcaaatgaaaggattggggcatgaaactgtggtgaaatttccctaaacattcagttagtttggtatgactaaagcatagtgtgtgtgtgtgtgtgtgtgtgtgtgtgtgtgtgcgtgcacatgtatgtaggtatatgtgcatgtgtatgcatacatggatgtatagaac

SEQ ID NO: 13228 - DNA, 204 bp, Homo sapiens
  Z67238
  Located on chromosome 7
  Distance between a terminus base of telomere on chromosomal short arm and 5'-terminus of this base sequence : 150318933
  Distance between 3'-terminus of neighbour sequence of sequence listing upward to telomere on chrosomal short arm and 5'-terminus of this base sequence : 80332
ttggctggtagaaacaggtaagtacatgattaaatctaaagtaataggtactaaagtaatggtattgagattcagagatgggagaaactaggtacacctttgtgtgcatgtgtgtgtgtgtgtgtgtgtgtgtgtgtgtgtgtgcgcatgcatacatgaacacgtgtcatgggagacatgggtagggattcacaaagggattga

SEQ ID NO: 13229 - DNA, 187 bp, Homo sapiens
  AC006315.2_29944
  Located on chromosome 7
  Distance between a terminus base of telomere on chromosomal short arm and 5'-terminus of this base sequence : 150371969
  Distance between 3'-terminus of neighbour sequence of sequence listing upward to telomere on chrosomal short arm and 5'-terminus of this base sequence : 52832
cttcagctagaagtcttcatcaagaaaacatatatgaagtatacatacgaatacacacacacacacacacacacacacacacacacacacacacgggagtttacaaccatacattacagagttctgcaaactcaaatagcattccattttctggacaattctatctgtagacatcagatgtactcgc

SEQ ID NO: 13230 - DNA, 197 bp, Homo sapiens
  AC006315.2_42921
  Located on chromosome 7
  Distance between a terminus base of telomere on chromosomal short arm and 5'-terminus of this base sequence : 150384884
  Distance between 3'-terminus of neighbour sequence of sequence listing upward to telomere on chrosomal short arm and 5'-terminus of this base sequence : 12728
acttgtgttattgaattaagccagccagtcaaaagcttgaaattaaacatagtattttcctatgaaatatattttttaacattataaaataaaatttggaataaaagcattatgtatatatatatatatatatatacatatatatatatactcataactcttcattcatttttgtgaatcagtctcattcgtagttt

SEQ ID NO: 13231 - DNA, 262 bp, Homo sapiens
  AC006315.2_69718
  Located on chromosome 7
  Distance between a terminus base of telomere on chromosomal short arm and 5'-terminus of this base sequence : 150411588
  Distance between 3'-terminus of neighbour sequence of sequence listing upward to telomere on chrosomal short arm and 5'-terminus of this base sequence : 26507
taaatcaccttagattaatgccagtaaataccaagacagttaaaaagtgcattcgatgtaaataactacaatgacaagttcacaaatagcaacacaactaggaattccacgtaggagcagaatataaagtaaaatgaaatgatgatctagatagacagatgatagatagatagatagatagatagatagatagatagatagatagaggagagagagagagagagagagagagagagattagatggacaggtatgtagtttca

SEQ ID NO: 13232 - DNA, 230 bp, Homo sapiens
  AC006315.2_69671
  Located on chromosome 7
  Distance between a terminus base of telomere on chromosomal short arm and 5'-terminus of this base sequence : 150411633
  Distance between 3'-terminus of neighbour sequence of sequence listing upward to telomere on chrosomal short arm and 5'-terminus of this base sequence : -217
agtgcattcgatgtaaataactacaatgacaagttcacaaatagcaacacaactaggaattccacgtaggagcagaatataaagtaaaatgaaatgatgatctagatagacagatgatagatagatagatagatagatagatagatagatagatagatagaggagagagagagagagagagagagagagagattagatggacaggtatgtagtttcacctataagcaaag

SEQ ID NO: 13233 - DNA, 357 bp, Homo sapiens
  AC006315.2_100277
  Located on chromosome 7
  Distance between a terminus base of telomere on chromosomal short arm and 5'-terminus of this base sequence : 150442235
  Distance between 3'-terminus of neighbour sequence of sequence listing upward to telomere on chrosomal short arm and 5'-terminus of this base sequence : 30372
agagcagacattcaagcactagcaccatggtaccagagctcatgtgttgctgttttaggctcacgtttgcctcagtgtctttctggggtgtttctgtgtgcacgtatgaaaacaaaatgtatatatatatatatatatatatacacacacacacatatacacacacatttatacacacatatacataaatgtgtgtgtatatatataaacacacacacatatacacatatatatctacttgtacacgtgtgtatattataaaacattttaaaaaatttaaaaatatttaagagcattaatcagttaaatcagttttaagccaaaagtattacagtgactcatttcaataacaccttt

SEQ ID NO: 13234 - DNA, 323 bp, Homo sapiens
  AC006016.2_153991
  Located on chromosome 7
  Distance between a terminus base of telomere on chromosomal short arm and 5'-terminus of this base sequence : 150493486
  Distance between 3'-terminus of neighbour sequence of sequence listing upward to telomere on chrosomal short arm and 5'-terminus of this base sequence : 50894
ggagttgtactggattaatctcaaccatttttaatttaactattactttgtagttgaacttgagcttcctctattcaaagattccagtaatcattcttcttcagcaaacacacacacacacacacacacacacacacacacacacacacacacacacatcttctggattgtatactaaaaatttatatattttggattgaaattaatttgtaaccaacaaagtttattatttagagactgtgattctgcccagattaagatttgtggcgttatgtttaaaaggaagacaataatacctaaattagatggtcagtgttaggatt

SEQ ID NO: 13235 - DNA, 337 bp, Homo sapiens
  AC006016.2_76125
  Located on chromosome 7
  Distance between a terminus base of telomere on chromosomal short arm and 5'-terminus of this base sequence : 150571251
  Distance between 3'-terminus of neighbour sequence of sequence listing upward to telomere on chrosomal short arm and 5'-terminus of this base sequence : 77442
aagaaacctttgctttagattaacattaattaagtcatgcattagactaacataagactttatctattatctatctaatctaatcttttattctatccatctatctaccatctattatgtatcatctatttactgaattatatatctaatcttctatctcatctatttatcgatttatccatctatatgtaatctactctgtatcatctgtctgtctatctatctatctatctatctatctatctatctatctatctatgcgatatctatcacttttcaacacctaattcacaaaaaagaagccatgagggagattgtagactgtaggagaggtaca

SEQ ID NO: 13236 - DNA, 366 bp, Homo sapiens
  AC006016.2_35026
  Located on chromosome 7
  Distance between a terminus base of telomere on chromosomal short arm and 5'-terminus of this base sequence : 150612386
  Distance between 3'-terminus of neighbour sequence of sequence listing upward to telomere on chrosomal short arm and 5'-terminus of this base sequence : 40798
aatcagaaacatcgtgattagaagagtgcataggttatgagctgatgaggctaagccctaaacaccaccactttttaataaatgtgcctacattattacccaaaaagagttctttcaaagaatttttggccacattcacccccccagcctccaagaaagagagagatagaagggagacagagagagagagagagagagagagagagagagagagagagagagaaattgttgaggggctaatgtgagccatggtggttttattcatcactataacagtagtttagagactacaggttcaggggccagacagcatggattcgaaagtgagcaatatcatttcttttgtgaccttaggcaagtgactta

SEQ ID NO: 13237 - DNA, 344 bp, Homo sapiens
  AC005997.2_106243
  Located on chromosome 7
  Distance between a terminus base of telomere on chromosomal short arm and 5'-terminus of this base sequence : 150684358
  Distance between 3'-terminus of neighbour sequence of sequence listing upward to telomere on chrosomal short arm and 5'-terminus of this base sequence : 71606
gcatctgtatttgtcagaggtattggcctgtaattttcctgtgtgtgtgtgtgtgtgtgtgtgtgtgtgtgtgtgtgtgtgtgtccttatctggttttgttattagatttagactgggcttgcagaatgagtttggaagaattccctcggcttcaattttttgaaatagtttgagaatgatttgtattaattctccttcatagattgaatagaatccagtgatgaagccatccagttaagtacttttcttttttgtgagactttttattactgattcaatcatgttacttattattggtctattcaggttttctccttcttcctggtccaatcttggtaagtta

SEQ ID NO: 13238 - DNA, 320 bp, Homo sapiens
  AC005997.2_103264
  Located on chromosome 7
  Distance between a terminus base of telomere on chromosomal short arm and 5'-terminus of this base sequence : 150687192
  Distance between 3'-terminus of neighbour sequence of sequence listing upward to telomere on chrosomal short arm and 5'-terminus of this base sequence : 2490
caccatgagttacataggaggtttcccaagacccatcacctgtgtgaaggtctatatacctagactttggaaaggaatgaaaataagaggcaagctacttttagtctctgtctttgctatcatactcttcctttaaactatttctctctatcccacctctgtctctttctttttctgtctccctgtttctctctttttttgtcactcacacacacacacacacacacacggacacacatatacaaaagcaaccctgtaaaaatcactgcttgtgtaaagcctaaaccataattggggttagaatttggagctccactagt

SEQ ID NO: 13239 - DNA, 160 bp, Homo sapiens
  Z66707
  Located on chromosome 7
  Distance between a terminus base of telomere on chromosomal short arm and 5'-terminus of this base sequence : 150687285
  Distance between 3'-terminus of neighbour sequence of sequence listing upward to telomere on chrosomal short arm and 5'-terminus of this base sequence : -227
gctacttttagtctctgtctttgctatcatactcttcctttaaactatttctctctatcccacctctgtctctttctttttctgtctccctgtttctctctttttttgtcactcacacacacacacacacacacacggacacacatatacaaaagcaacc

SEQ ID NO: 13240 - DNA, 380 bp, Homo sapiens
  AC005997.2_20137
  Located on chromosome 7
  Distance between a terminus base of telomere on chromosomal short arm and 5'-terminus of this base sequence : 150770261
  Distance between 3'-terminus of neighbour sequence of sequence listing upward to telomere on chrosomal short arm and 5'-terminus of this base sequence : 82816
agcatgtatagttaagcctgctataaacagtaaaagaagcaacataaggtagaacattttcccctccaaggagaaaaaatcatgtccgttaagtatattttgattcattttttattgtaatttttgttatccctggaaatagaacaaaaacatgtgtcagctgactaccattgaacctgtacacaccctgcttcagcttttatccaatgagaaataaaattaagtcatgtaggttgttagagtctctctctctctctctctgtctctctctctctctctctctctctttttaactgaacctggctgcaataataatactgaccttgactgtgacctctctgtgtgatagttccattgctgtgccttagagtcgaatggta

SEQ ID NO: 13241 - DNA, 387 bp, Homo sapiens
  AC006456.2_23267
  Located on chromosome 7
  Distance between a terminus base of telomere on chromosomal short arm and 5'-terminus of this base sequence : 150842594
  Distance between 3'-terminus of neighbour sequence of sequence listing upward to telomere on chrosomal short arm and 5'-terminus of this base sequence : 71953
aatgcatgagtgataactggagcccggtaaaacttactgagacagaattctaagcagaattccacactcctttcctagtgtggtccactctgagtgctagagttttaatacaatccaaggatttctccaagataattgttaatgacttaattttatgaggattttatttatgtaaacaatcaaataatttttaagaatgaatgaatatatgtatatatatatatatatatatagagagagagagagagagagagacttgagtaagaatatctgcataaaataaattaagccaagaataaaatctagaataaatacagtaactgctctggagaagtctaattctgctctactggagatacaatgagaaccactaacatgattaaggag

SEQ ID NO: 13242 - DNA, 263 bp, Homo sapiens
  D7S2511
  Located on chromosome 7
  Distance between a terminus base of telomere on chromosomal short arm and 5'-terminus of this base sequence : 150867425
  Distance between 3'-terminus of neighbour sequence of sequence listing upward to telomere on chrosomal short arm and 5'-terminus of this base sequence : 24444
gtaccataaactgggtggctcaaacaacagaaatttactctctcacagttctggaggccagaagtccaatattgaggggttggcagggttgactcctcctctgagggaggtgagggaacagcctgctccaggactctctccttggctcgcaggtggttatcttctccctgtgttgctttatatcatctttcttctgtgtgtgtgtgtgtgtgtgtgtgtgtgtgtgtgtgtgtgtgtgtgtgtgttttgatggtattgctctg

SEQ ID NO: 13243 - DNA, 266 bp, Homo sapiens
  chr7.fa.O7frz.153472051
  Located on chromosome 7
  Distance between a terminus base of telomere on chromosomal short arm and 5'-terminus of this base sequence : 151048991
  Distance between 3'-terminus of neighbour sequence of sequence listing upward to telomere on chrosomal short arm and 5'-terminus of this base sequence : 181303
taatgctgttcttaatgcttctagtacgattattctaaaatgctttcacaacattgacaacattaagaagacaagatgtatttatttgggtaaagagcagtagggtctagagaggatattgctgcatatatatatatgtatatatatatatatatatatatatatatatatatatatatatggaatatgttggcatgtctcacaatgtttgacatgattttgcaataaaaaagagtgtatttttagcatagttcaagtgaattacc

SEQ ID NO: 13244 - DNA, 378 bp, Homo sapiens
  chr7.fa.O7frz.153665694
  Located on chromosome 7
  Distance between a terminus base of telomere on chromosomal short arm and 5'-terminus of this base sequence : 151241682
  Distance between 3'-terminus of neighbour sequence of sequence listing upward to telomere on chrosomal short arm and 5'-terminus of this base sequence : 192425
actccaagtactttaagttaggaaggaaagaaggaaggaaggaaggaaggaaggaaggaaggaaggaaggaaggaaggaaggaaggaaagaaagaaagaaggaaagaaggaaagaaggaaggaaggagggaaagaaggaaggagggaaagaaggaaggagggaaagaaggaaggaaggaaggaaggaaggaaagaaggaaggaaggaaagaaggaaggaaagaaggaaggaaaggaagaaagagagaaaggaagaaagagagaaagaaagagagaaagaaagaaagaaagaatgaaagaaagaaagaaaactaagaagttatttatgctttgtacaacagaatgggcacacaaggattctaacaaggatttcaattct

SEQ ID NO: 13245 - DNA, 314 bp, Homo sapiens
  chr7.fa.O7frz.153745024
  Located on chromosome 7
  Distance between a terminus base of telomere on chromosomal short arm and 5'-terminus of this base sequence : 151317458
  Distance between 3'-terminus of neighbour sequence of sequence listing upward to telomere on chrosomal short arm and 5'-terminus of this base sequence : 75398
ctgtatgttacatgtttgcctctgaaaatgtttctatttgtatttacatatctactttgtttaattaaatatatagttatatagctctctctctctctctctctgtgtgtgtgtgtgtgtgtgtgtgtgtgtgtgtgtgtgtgtgtgtgtgtgtgttctagtttttagagtaaggtgacatgagagcagccaccttgtttatctcataccctgctatattcctcaaggtcctagaaaaaatcctggaatgttgtagatgaacaataaatatttatgaaagacttagtaaattctacaaattaagcaagacgtca

SEQ ID NO: 13246 - DNA, 477 bp, Homo sapiens
  AC004896.1_152848
  Located on chromosome 7
  Distance between a terminus base of telomere on chromosomal short arm and 5'-terminus of this base sequence : 151484528
  Distance between 3'-terminus of neighbour sequence of sequence listing upward to telomere on chrosomal short arm and 5'-terminus of this base sequence : 166756
taaatcctttagtcagacgattagacttactgcataattatattttagacatgagatcatatagtagcctcaaattgtatgacagatttgagagaaaagggataaataatctaaaactcacttgaaagtcagcagcctgagacattctctgtttctgtgtacaaatatgttagaaaaatggttctgaaacactttgacattcctcactacttaaagattatgtaagaaagtagcaggatggaaactgccttattattttcttttttcttcttcttcttcttcttttttttttttccccccagacagagtgtcactctttcacccaggctggaatgcagtgacacaatctgagctcactgcaacctccgcctcctgggttcaagccattcgcaagcctcagcttcccaagtgcgccatcacgccaggctgatttttgtatttttagtagagatggggtttcaccatgttggacagatt

SEQ ID NO: 13247 - DNA, 242 bp, Homo sapiens
  AC004896.1_134775
  Located on chromosome 7
  Distance between a terminus base of telomere on chromosomal short arm and 5'-terminus of this base sequence : 151502789
  Distance between 3'-terminus of neighbour sequence of sequence listing upward to telomere on chrosomal short arm and 5'-terminus of this base sequence : 17784
atttggcatgaatcacataattacaagaagagagtcaactgttggttagtgtgtgcatacgtatgtgcctgtgtgtgtgtgtgtgtgtgtgtgtgtagggaaggaagagcaagagaaaaagagagattcaaccttctctcaatatgcccaaacactgaaactctaatatctaaatcctccgattatacaaacagatttcactttacttttaggaaatggtgacaagcaaactatctcagagt

SEQ ID NO: 13248 - DNA, 307 bp, Homo sapiens
  AC004896.1_118949
  Located on chromosome 7
  Distance between a terminus base of telomere on chromosomal short arm and 5'-terminus of this base sequence : 151518498
  Distance between 3'-terminus of neighbour sequence of sequence listing upward to telomere on chrosomal short arm and 5'-terminus of this base sequence : 15467
acaaactttcaattacaagatgaataagttctggggagctaatatacaacatggtgactacagttaattatactgtattgtatacttgaaatttgctaaaagagtagatctgaagtgttctcacacaaaaaagaatatctgagttgatgggtgtgttaattaacccgattgtggtaatcatttcacaatgtgtgtgtgtgtgtgtgtgtgtgtatatatatatatatataaaacaaatcatcatgttgtacattttaaatatatacaattttatttgtcatgtgtacctccatgagactgaaattaa

SEQ ID NO: 13249 - DNA, 289 bp, Homo sapiens
  AC004896.1_48957
  Located on chromosome 7
  Distance between a terminus base of telomere on chromosomal short arm and 5'-terminus of this base sequence : 151588619
  Distance between 3'-terminus of neighbour sequence of sequence listing upward to telomere on chrosomal short arm and 5'-terminus of this base sequence : 69814
ctgaaactcttgcctagtctacagtaatcaactattcaaacaggatgggaaacacacacacacacacacacacacacacacacatgttgggaaattcaattaagatcaactcatttctttgcaatcaaaaatcaaaaaccacaggaataatctcatacttttttttaactaggaatttctctcttccggctaaacttaaagccaataataactgtttctgtttctccaaactttaggtttttccaatttgtggatcaccttttatttcttctgaggatgtcaagtttca

SEQ ID NO: 13250 - DNA, 362 bp, Homo sapiens
  AC004896.1_38159
  Located on chromosome 7
  Distance between a terminus base of telomere on chromosomal short arm and 5'-terminus of this base sequence : 151599237
  Distance between 3'-terminus of neighbour sequence of sequence listing upward to telomere on chrosomal short arm and 5'-terminus of this base sequence : 10329
tagaatcagcatgaaaggaattacataaatcacatgaattgatgacatacggctaagcctgtttgttgcattattttgctacttcagtctgctggataaaattcctctccattggatagtgctttgacaatcaccaaccacttctgctcctacaactctattttttttccaaacttttaaaatggaacaaataccattctgctcatttcttatatatatatataaaagacatgacatatatatatatatatatatatatatataatgtcaaacagattaaaattagttctttctgacttacaaatcaatccatctcatataggttagtttacatttttctattctgatccatgtaccaattt

SEQ ID NO: 13251 - DNA, 205 bp, Homo sapiens
  HUMUT625
  Located on chromosome 7
  Distance between a terminus base of telomere on chromosomal short arm and 5'-terminus of this base sequence : 151601676
  Distance between 3'-terminus of neighbour sequence of sequence listing upward to telomere on chrosomal short arm and 5'-terminus of this base sequence : 2077
ttctatggaatttctgtggtgttttacctctctaaaagtgtgtgtgtgtctgtttgtgtgtatatatatgtgtgtgtgtgtgtatatatgtgtgtgtgtatatatatctacatatgtatgtgtttatatataatactttataggctatatgtcagtaaaatatttgaaaagttttattctgagccaaatatgagtgaccaatggc

SEQ ID NO: 13252 - DNA, 392 bp, Homo sapiens
  chr7.fa.O7frz.154386250
  Located on chromosome 7
  Distance between a terminus base of telomere on chromosomal short arm and 5'-terminus of this base sequence : 151920663
  Distance between 3'-terminus of neighbour sequence of sequence listing upward to telomere on chrosomal short arm and 5'-terminus of this base sequence : 318782
ggtaggatgtctgcttactttctgaaagttatatttcttctagtaaatataacaaattacaaagcctatctatttcaatggcttagaatgtgtgtgtatatgtgtgtaaaatacttgtaaatagctatcattaatctttaattatggattattgtaaagaagagatcatgataatttttaattttatttctttgaaagatgtatctacacacacacacacacacacacacacacactgtatacaaagattggaagttgggaatggagttaaaagggcatggtctttgaaattaaccttttattcattcgttcaatcattcattcagtgaatcatccaatcagtcattcattcaacaaatattgatcaaatacttatgagtcagcaactcttc

SEQ ID NO: 13253 - DNA, 413 bp, Homo sapiens
  AC004856.1_42646
  Located on chromosome 7
  Distance between a terminus base of telomere on chromosomal short arm and 5'-terminus of this base sequence : 152054699
  Distance between 3'-terminus of neighbour sequence of sequence listing upward to telomere on chrosomal short arm and 5'-terminus of this base sequence : 133644
attaagcaggatggtaactgactccattaaagcaagtaatccaactgttttaggcttctccaaagagagagagagaagcaataggatggatggatagatggatggatggatggatggatggatggatggatggatggatggatagatagataaggaatttattaggggaattggctcatacaattatgaaagctaagtcccacaacaggccctctttttgttaaatcctttttgtattagttaagggcctccagagagacagaaccaatagaagatatacatctgtatctgtacatatgagaagagatttattaggagaattggctcatgcaattgggaggttgagaaatcctacgctaggctctctgcaagctggagaaccagggaagctggtagcatggctcagtctaatc

SEQ ID NO: 13254 - DNA, 213 bp, Homo sapiens
  AC004891.1_97625
  Located on chromosome 7
  Distance between a terminus base of telomere on chromosomal short arm and 5'-terminus of this base sequence : 152112101
  Distance between 3'-terminus of neighbour sequence of sequence listing upward to telomere on chrosomal short arm and 5'-terminus of this base sequence : 56989
atggtcaaatgtaaactttggaaattattacttgatttctgttagtggaggaattagaagagtttttgttccactatgttattccaacctcatctcctcgtttgtcaagattcttaagctgaacgtttttctgcgtgcatgcatgcatgtgtgtgtgtgtgtgtgtgtgtgtgtgtgtgtgtggtcacagtgaaacatagattaaggctgaga

SEQ ID NO: 13255 - DNA, 303 bp, Homo sapiens
  AC004891.1_94480
  Located on chromosome 7
  Distance between a terminus base of telomere on chromosomal short arm and 5'-terminus of this base sequence : 152115316
  Distance between 3'-terminus of neighbour sequence of sequence listing upward to telomere on chrosomal short arm and 5'-terminus of this base sequence : 3002
aatggaataaggattggagaagaaaaatttgctatggccagtgagaattccttgcaagaaaaaagcattgcaattgtgtgtgtgtgtgtgtgtgtgtgtgtgtgtgtgtgtgttggatatgggcagttgtagtgtggaacacctcagcagcacccaggcctcacttgtggatggtacaacctcaggaaacttactcttcctcagtataaatgagaaggtccccttttcccccaatggctgcagtgttggtctaggatgaggtcttctctaccctcatctgcgtagttccaggatggactttct

SEQ ID NO: 13256 - DNA, 361 bp, Homo sapiens
  AC004891.1_92547
  Located on chromosome 7
  Distance between a terminus base of telomere on chromosomal short arm and 5'-terminus of this base sequence : 152117140
  Distance between 3'-terminus of neighbour sequence of sequence listing upward to telomere on chrosomal short arm and 5'-terminus of this base sequence : 1521
tacctaatgctaaatgacgagttcatgggtgcagcacaccagcatggcacatgtatacatatgtaactaacctgaacattgtacacatgtactctaaaacttgaagtattataataataaaattaaaaaacaaacaaacaaatcactcacaccatggaagcacaaaactaaaaagttcagtgtgtgtgtgtgtgtgtgtgtgtgtgtgtgtgtgtgtgtgtggtgttctacttgaggtagaaggtaaaagattaaggagaaaaccaagtggattgaaatctgcaataaagcgaccattctccagtactaaatgcacttgaaatttattcccctgcatctgtaggtaaatgtccttctgttc

SEQ ID NO: 13257 - DNA, 438 bp, Homo sapiens
  AC004891.1_84539
  Located on chromosome 7
  Distance between a terminus base of telomere on chromosomal short arm and 5'-terminus of this base sequence : 152125219
  Distance between 3'-terminus of neighbour sequence of sequence listing upward to telomere on chrosomal short arm and 5'-terminus of this base sequence : 7718
aaagaggttccactgttattctgttcctggaccaaatagggtcgagctgcttattctcaccacccaataagagatgcagatgaactgggaaagaagagaggtgttttgttttgttttgttttgttttgttttgttttgttttgttttgtttgagatggagtttcgctcttgttgcccaggctggagtacaatggtgcgatctcggctcaccgcaacctccgcttcccaggttcaagtgattctcctgcctcagcctcccaagtagctgggattacaggcatgcaccatcatgcctggctaactttgtatttttagtagagacagggtttctccatgttggtcaggctggtttcaaactcccgacctcaggtgatctgcccgccttggcctcccaaagtgctgggattacaggcgttgagattctatttctgtaactgg

SEQ ID NO: 13258 - DNA, 227 bp, Homo sapiens
  AC004891.1_51806
  Located on chromosome 7
  Distance between a terminus base of telomere on chromosomal short arm and 5'-terminus of this base sequence : 152157941
  Distance between 3'-terminus of neighbour sequence of sequence listing upward to telomere on chrosomal short arm and 5'-terminus of this base sequence : 32284
ctctttcaaggaatttggaaacaaaagggtgcatagaaatgaaatggtaacttttgggatagataaggtcaaaagaaaggttttatagtgccagtggttgttaagagtagagatatgtctctgtgtgtgtgtgtgtgtgtgtgtgtgtgtgtgtgtgtgtgtttgtataacaacccagttgtagagggaggggagaattgtcagagtggtgtccttgagctggtagg

SEQ ID NO: 13259 - DNA, 160 bp, Homo sapiens
  chr7.fa.O7frz.154745045
  Located on chromosome 7
  Distance between a terminus base of telomere on chromosomal short arm and 5'-terminus of this base sequence : 152305451
  Distance between 3'-terminus of neighbour sequence of sequence listing upward to telomere on chrosomal short arm and 5'-terminus of this base sequence : 147283
tgaccaataaacaccaacttacttggtttttttcattcctttttccctgtgtccaagaagcaaaatgataatgtaaatgaatacacacacactcacactcacacacacacacacacacaccccatgttggggaggcgggtaaaggaacagaattgctctc

SEQ ID NO: 13260 - DNA, 341 bp, Homo sapiens
  AC006974.2_35723
  Located on chromosome 7
  Distance between a terminus base of telomere on chromosomal short arm and 5'-terminus of this base sequence : 152579746
  Distance between 3'-terminus of neighbour sequence of sequence listing upward to telomere on chrosomal short arm and 5'-terminus of this base sequence : 274135
gagcctggaaagatgagtatacaaaagctattctgtaggtgaagttgttaaatacaccatttcagggatacatatgtaatagaaggagaagataattaaaggaaaaggaaggaaggaaaggaaggaaacgaaaggaaagaaaggaaggaaaggaaggaagggagggaagggaaggaagggaaggaaggaaggaaggaaggaaggaaggaaggaaggaaggaaaggaaggaaggaaggaaggggaaggaaggaaggaaggggaagggaagggaagggaagggaagggaaggaaacccgtttggaaatgagaagatgtaaataacactgagctacattacagg

SEQ ID NO: 13261 - DNA, 204 bp, Homo sapiens
  AC005229.1_29033
  Located on chromosome 7
  Distance between a terminus base of telomere on chromosomal short arm and 5'-terminus of this base sequence : 152644543
  Distance between 3'-terminus of neighbour sequence of sequence listing upward to telomere on chrosomal short arm and 5'-terminus of this base sequence : 64456
acctcataaggttcttagttggaatagaccccatttaaaaaaaaaatacacacacacacacacacacacacacacacgagaaaaacaagtttatttacatgtatatttcacatctacatggcagacacccaggaaaggagtagttctcatggcagacacccagggaaggagtagttctcaaagaaatagctttgaattccagct

SEQ ID NO: 13262 - DNA, 226 bp, Homo sapiens
  D7S2442
  Located on chromosome 7
  Distance between a terminus base of telomere on chromosomal short arm and 5'-terminus of this base sequence : 152688928
  Distance between 3'-terminus of neighbour sequence of sequence listing upward to telomere on chrosomal short arm and 5'-terminus of this base sequence : 44181
ctggaagcaacagatgtcactattaacaatccctttttcctggcacagagttcgattgttaggatattctgggagagactgggagggatggatcatggaagactcttaattctgtgtgcgtgtgtgtgtgtgtgtgtgtgtgtgtgtgtgtgtgtgtaattatttttttgagatggagtctcgttctgtcacccaggctggagtgcagtgctgtgatcttggctca

SEQ ID NO: 13263 - DNA, 178 bp, Homo sapiens
  AC005229.1_73490
  Located on chromosome 7
  Distance between a terminus base of telomere on chromosomal short arm and 5'-terminus of this base sequence : 152688971
  Distance between 3'-terminus of neighbour sequence of sequence listing upward to telomere on chrosomal short arm and 5'-terminus of this base sequence : -183
cacagagttcgattgttaggatattctgggagagactgggagggatggatcatggaagactcttaattctgtgtgcgtgtgtgtgtgtgtgtgtgtgtgtgtgtgtgtgtgtgtaattatttttttgagatggagtctcgttctgtcacccaggctggagtgcagtgctgtgatcttg

SEQ ID NO: 13264 - DNA, 341 bp, Homo sapiens
  AC005229.1_100045
  Located on chromosome 7
  Distance between a terminus base of telomere on chromosomal short arm and 5'-terminus of this base sequence : 152715382
  Distance between 3'-terminus of neighbour sequence of sequence listing upward to telomere on chrosomal short arm and 5'-terminus of this base sequence : 26233
tggtcaacatggtgaaatcccatctctactaaaaatacaaaaattagccggacgtggtggcaggtgcctgtaatcccagctacttgggaggctgaggcaggagaattgcttgaacccaggaggcagaggtagcagtgagccaagatcatgccatgccattgcactccaccctgagcaacatgagtgaaacaccatctcaaaaaaaaaaaaaaaagaaagaaaggaaggaaggaaggaaggaaggaaggaaggaagcaagaaagaaacctaaacgcagcaagagaaaagaaacaaataacatacatatggccagcagtgtatttctcagtggaacattacag

SEQ ID NO: 13265 - DNA, 413 bp, Homo sapiens
  chr7.fa.O7frz.155306804
  Located on chromosome 7
  Distance between a terminus base of telomere on chromosomal short arm and 5'-terminus of this base sequence : 152806940
  Distance between 3'-terminus of neighbour sequence of sequence listing upward to telomere on chrosomal short arm and 5'-terminus of this base sequence : 91217
tgcacgttcttatgagtacacataatttttttaatttaaaaactcatttcaaaattacccttcagtttttatgactttatttccaagctaaatgttcctttaaagggcctgattcacacacacacacacacacacacacacacacacacacacacacacacacacaaaacgctcaccctcctgtgattcagaaggggtcaattcggtgaagacattttttcagtaatataaggtgccttcccagttgttgattcagaactcaatttacctatatgggcagcagagccaagtaaatgacttgactttccttgaaatgagttaagtgggaagtctgttatttcatcagatagattaatgaagcagtttttgcttttttcatttaaattgctatatactaggtatgagattggcct

SEQ ID NO: 13266 - DNA, 422 bp, Homo sapiens
  chr7.fa.O7frz.155396899
  Located on chromosome 7
  Distance between a terminus base of telomere on chromosomal short arm and 5'-terminus of this base sequence : 152896838
  Distance between 3'-terminus of neighbour sequence of sequence listing upward to telomere on chrosomal short arm and 5'-terminus of this base sequence : 89485
taaaatctagttggacagaaacagttaaaaacaaagtgtcaggtgcagtagctcatgcctgtgatcccagcactttgggaggctgaagcaggtggatgacctgaggccaggagttcaagaccagcctggccaagacggtgaaaccccgtctctactaaaaatacaaaaattagccaggagtggtggcacacacctgtagtcccggctactaaggaggctgaggcatgagaatcacttgagcccaggaagcagggatttcagtgagccaagatgtgccactgcaccagcctgggcaacagagcaagactctgtctcaaaaacaacaacaacaacaacaacaacaacaacaaagtaaaatgtttacatgtaagatgatgttgagtgctatgggagaaaaaacaatacaggtaagtgagttaagg

SEQ ID NO: 13267 - DNA, 423 bp, Homo sapiens
  chr7.fa.O7frz.155496400
  Located on chromosome 7
  Distance between a terminus base of telomere on chromosomal short arm and 5'-terminus of this base sequence : 152985915
  Distance between 3'-terminus of neighbour sequence of sequence listing upward to telomere on chrosomal short arm and 5'-terminus of this base sequence : 88655
gcaattgtattcgtttcattagcctcaatgccttctacataggagttgcttgttttaaaaacaagaacccaggctggggtggtggctcacccctgtaatcctagcactttgggaggcggaggtgagaggatcacttgaggtcaggagttcaagaccagcctggccaacatgatgaaaccctgtctttactaaaaatacaaaaattagctgggtatggtggcaggcaactgtagtcccagctactagggaggctaaggcaggagaattgcttgcacccaggagacggaggttacagtgaaccgagattgcaccactgcactccagcctgggtgacagagctagctagactccatctcaaacaacaacaacaacaacaacaaaacataaaaattaagctgggtgtggtagctcacgcctgtaatg

SEQ ID NO: 13268 - DNA, 364 bp, Homo sapiens
  chr7.fa.O7frz.155573014
  Located on chromosome 7
  Distance between a terminus base of telomere on chromosomal short arm and 5'-terminus of this base sequence : 153090997
  Distance between 3'-terminus of neighbour sequence of sequence listing upward to telomere on chrosomal short arm and 5'-terminus of this base sequence : 104659
gcagtgagtccaagatcatgccactgcactccagcctgggcaacagagtgagactttgtctcaaataaataaataaataaataaataaataaataaatagatggaagaaacacagggttggatcaggctgaatttattgatttgggcctactaattagggactctgcatttaatgttgcagctcagggagttaaaaaaaaggttctaatagtttatttgcttagtcagctgaaatatggattagaagatggcccactgtgagcgagctgtaaatgcctgatctcccttggtttaatgtagagcaagggatctgaaagcttagggagattgggatggtggagtgcattagtcactttagacctac

SEQ ID NO: 13269 - DNA, 459 bp, Homo sapiens
  AC005378.2_15612
  Located on chromosome 7
  Distance between a terminus base of telomere on chromosomal short arm and 5'-terminus of this base sequence : 153233227
  Distance between 3'-terminus of neighbour sequence of sequence listing upward to telomere on chrosomal short arm and 5'-terminus of this base sequence : 141866
gcttactacctggttaatgaaataatctgtacaacaatccccatgacacagtttacctgtgtaacaaacctgcacatgtaccccagaacttaaaataacaggttttttatttatttatttatttatttatttattgagatggagtctcgctctgttgcccaggctagagtgtagtggcgtgatctctgctcaccgcaacttccgctccccaggttcaagggattctctcttctcaacctcccgagtagctgggactacaggtgcccaccaccatgcccagctattttttgtatttttagtagagacagggtttcaccatgttggccaagctggtcttgaactgctgaccttgtgatccacccgcctcagcctcccaaagtactgggattacaggcatgagccaccacgcctggccaaggtttttctttaattgctctttaatagttgaggattcatgaa

SEQ ID NO: 13270 - DNA, 327 bp, Homo sapiens
  chr7.fa.O7frz.157058184
  Located on chromosome 7
  Distance between a terminus base of telomere on chromosomal short arm and 5'-terminus of this base sequence : 153358470
  Distance between 3'-terminus of neighbour sequence of sequence listing upward to telomere on chrosomal short arm and 5'-terminus of this base sequence : 124784
atttctatgaccataggctctaagaaacctaaccctgtgttttccatagaaaccatagtccagcgtttgctctgttcccagcaacttcatagaacacagctaccatgaataatgagaattgacaccacctctttttaagcgctttaacttcgacatttcaatttggtttaaaattttaatccctccgtgtgtgtttgtgtatgtgtctgtgtgtgtgtgtgtgtgtgtgcatgtgtgtgtgtgtgtgtgtgcaatgaaagaaaatacatacactaattctccaaaattcctatgggtgacttaatcaacatgtatttctgaagttct

SEQ ID NO: 13271 - DNA, 459 bp, Homo sapiens
  chr7.fa.O7frz.156879234
  Located on chromosome 7
  Distance between a terminus base of telomere on chromosomal short arm and 5'-terminus of this base sequence : 153532330
  Distance between 3'-terminus of neighbour sequence of sequence listing upward to telomere on chrosomal short arm and 5'-terminus of this base sequence : 173533
attccttgaatttgacaaagtcatacacattaacttgtgtgtgtctgtgtgtgtgtttgagatggggtttgtccttgttgcccaggctggactgcagtgatgcaatcttggctcactgcgacctccaacacccgggctcaagtgatcctcccacctcagcctcctgagtagctgagatgacaggcgtgtgccaccacgaccagctaattccttccttccttccttctttccttccttccttccttcttgccttccttcctccctccctccctccctccctccccctctctctctctttcttttttattgtagagacggggtttcaacatgttgcccaggctggtctggcactcctggactcaagtgatcggcctgccttggtctcccctcaaaacatttgtttttttgtattgagtaaaggctcttcagttgttagttgtatagcatttaagtttgagg

SEQ ID NO: 13272 - DNA, 459 bp, Homo sapiens
  chr7.fa.O7frz.157266465
  Located on chromosome 7
  Distance between a terminus base of telomere on chromosomal short arm and 5'-terminus of this base sequence : 153655267
  Distance between 3'-terminus of neighbour sequence of sequence listing upward to telomere on chrosomal short arm and 5'-terminus of this base sequence : 122478
cgtatggatacctatgtaacaaacctgcacgttctgcacatgtatcccagaacttaaagtataataaaaataaataaataattaaatactttaaagaaaaaagaaaattatgagttttttcttctttaatgagttgtcaaataataaaaaccaaaaacagtgttcaaggctagaatctaatgacaggtatgttataggtttcttttgaaatacaatttctttctttctttctttctttctttctttctttctttctttctttctttctttctttccttcttctttctttctttctttctttccttctttcttctttctttctttctttctttccttctttctctctctctctctttctctctctctctctctggatccctttttgtaccagatacaaattataataaaactaatttgtgtgcaaagtagattttagtctggttaaatgtggtctaatta

SEQ ID NO: 13273 - DNA, 270 bp, Homo sapiens
  D7S505
  Located on chromosome 7
  Distance between a terminus base of telomere on chromosomal short arm and 5'-terminus of this base sequence : 153901242
  Distance between 3'-terminus of neighbour sequence of sequence listing upward to telomere on chrosomal short arm and 5'-terminus of this base sequence : 245516
actggcctggcagagtctgcattgcagcctgatggttcctcctgctcaatcctgctccccctcttttcatttcataggtgtcataccccaataagccgttcacacacccaactccgactcagaagagaactcctcttcttcctggaaaacccaactgtcaccacctccacatcctaccagcatctcggatttgtcacatccaaatcccctactaccacacacacacacacacacacacacacacacacacacacacctctcgaatggctg

SEQ ID NO: 13274 - DNA, 297 bp, Homo sapiens
  chr7.fa.O7frz.157560056
  Located on chromosome 7
  Distance between a terminus base of telomere on chromosomal short arm and 5'-terminus of this base sequence : 154017445
  Distance between 3'-terminus of neighbour sequence of sequence listing upward to telomere on chrosomal short arm and 5'-terminus of this base sequence : 115933
aggccagtatagtggaatagagagagtgaaagttacatcgctcccactcatcagaaaattcaacacacacacacacacacacatgcgcacacacacctgccatacatgcacacacacaccctgctatgtgcacacacatatgcacgtgcacacacacagagacatgtgcacaccctgccacacacacgtacgtgcacccatgcacacaccctgccacacacaagggcctgggagctatcctcctacatatgtcttaggaagttgtgcacgtgcctgagctcttcaaactagatgtag

SEQ ID NO: 13275 - DNA, 157 bp, Homo sapiens
  D7S1826
  Located on chromosome 7
  Distance between a terminus base of telomere on chromosomal short arm and 5'-terminus of this base sequence : 154033692
  Distance between 3'-terminus of neighbour sequence of sequence listing upward to telomere on chrosomal short arm and 5'-terminus of this base sequence : 15950
tatttaacacacctgtctcaatccaagacaaatcaactagataaatagataaatagatgatagagatagatagatgatagatagatagatagatagatagatagatagatagatagatagatagatagaagagagagatgagagagatagatggatg

SEQ ID NO: 13276 - DNA, 156 bp, Homo sapiens
  D7S636
  Located on chromosome 7
  Distance between a terminus base of telomere on chromosomal short arm and 5'-terminus of this base sequence : 154108904
  Distance between 3'-terminus of neighbour sequence of sequence listing upward to telomere on chrosomal short arm and 5'-terminus of this base sequence : 75055
ggagtgactgggcaggaacctctgcccaacacacacacacacacacacacacacacacacacacacacacacacacacacacacacacacacacacacgccaggatggaaagggagatgctaagagacccctggagcctgaaaccccacacaagct

SEQ ID NO: 13277 - DNA, 155 bp, Homo sapiens
  HUMUT7926
  Located on chromosome 7
  Distance between a terminus base of telomere on chromosomal short arm and 5'-terminus of this base sequence : 154313194
  Distance between 3'-terminus of neighbour sequence of sequence listing upward to telomere on chrosomal short arm and 5'-terminus of this base sequence : 204134
ggagaggttgcagtgagcagagatggcaccactgcactccagcctggacaacaaagcgaaactctgtctcaaagatagatagatagatagatagatagatagataaacagattctgctccagatctgaggggggacccaagagcctgcctttcta

SEQ ID NO: 13278 - DNA, 191 bp, Homo sapiens
  D7S642
  Located on chromosome 7
  Distance between a terminus base of telomere on chromosomal short arm and 5'-terminus of this base sequence : 154365920
  Distance between 3'-terminus of neighbour sequence of sequence listing upward to telomere on chrosomal short arm and 5'-terminus of this base sequence : 52571
agctccaaaaaggtaggggctgtgtgtgtgtgtgtgtatgtgtgtgtgtgtgtgtttctaaaggaggcagggctttttatctgttttcttcactgctaaatcccaagtacctggcacatggcagaacctccaacatgtgatgggtggaggtgaagagagcccactccaagcccgttcaggatcttcagcac

SEQ ID NO: 13279 - DNA, 98 bp, Homo sapiens
  D7S2461
  Located on chromosome 7
  Distance between a terminus base of telomere on chromosomal short arm and 5'-terminus of this base sequence : 154393633
  Distance between 3'-terminus of neighbour sequence of sequence listing upward to telomere on chrosomal short arm and 5'-terminus of this base sequence : 27522
caccagtgttgttagggatttctctctctctctctctcacacacacacacacacacacacacacacacacacacacacacactctgacccacaggaaa

SEQ ID NO: 13280 - DNA, 181 bp, Homo sapiens
  AF108083.1_49596
  Located on chromosome 7
  Distance between a terminus base of telomere on chromosomal short arm and 5'-terminus of this base sequence : 154458341
  Distance between 3'-terminus of neighbour sequence of sequence listing upward to telomere on chrosomal short arm and 5'-terminus of this base sequence : 64610
acctggtactcactagctcattagttttgaattactattttttttccctaatgtattaatagcttgctatgaccttcagcacggtgttttatctgatttcaggctgttggcccatctgtaaaacacacacacacacacacacgtttgccacatactagtgaaatcctaactttgagatctg

SEQ ID NO: 13281 - DNA, 311 bp, Homo sapiens
  AC005996.2_78928
  Located on chromosome 7
  Distance between a terminus base of telomere on chromosomal short arm and 5'-terminus of this base sequence : 154548403
  Distance between 3'-terminus of neighbour sequence of sequence listing upward to telomere on chrosomal short arm and 5'-terminus of this base sequence : 89881
cagctttaggttcaagttgaattcagcaaaaggtacagcaatttcctgtataccccctgcccctacacacacacacacacacacacacacacacacacacacacacacagagcctcctccacaatcagcgcccccattagagtggtacatttgtcacagccgatgaacctatgttatacatcgggatacaggatgagaagttgagagaatgcggcgtagactttgttaaaataacacatttttaaagcctccccacataatgtggttgatttttcacagcttgctactctttgtccagttgagtatgtaag

SEQ ID NO: 13282 - DNA, 201 bp, Homo sapiens
  D7S2439
  Located on chromosome 7
  Distance between a terminus base of telomere on chromosomal short arm and 5'-terminus of this base sequence : 154548426
  Distance between 3'-terminus of neighbour sequence of sequence listing upward to telomere on chrosomal short arm and 5'-terminus of this base sequence : -288
cagcaaaaggtacagcaatttcctgtataccccctgcccctacacacacacacacacacacacacacacacacacacacacacacagagcctcctccacaatcagcgcccccattagagtggtacatttgtcacagccgatgaacctatgttatacatcgggatacaggatgagaagttgagagaatgcggcgtagacttt

SEQ ID NO: 13283 - DNA, 269 bp, Homo sapiens
  chr7.fa.O7frz.158579660
  Located on chromosome 7
  Distance between a terminus base of telomere on chromosomal short arm and 5'-terminus of this base sequence : 154832765
  Distance between 3'-terminus of neighbour sequence of sequence listing upward to telomere on chrosomal short arm and 5'-terminus of this base sequence : 284138
catgctgagcctcaactaccaggtgaggcaaagcacctgcgtgtgcgcagagccggatggtggcagaagagagctggcatgcagggcgccaggttaggaagcctggggaagtgaagacacagcacctgcttacagaatcaccagggaggcaggacacacacacacacacacacacacacacacgcacacacacacagagctgatgccacattatttactatggctgcgtgcgtaccctactaccagtaatcttagtacgagtccaacag

SEQ ID NO: 13284 - DNA, 455 bp, Homo sapiens
  chr7.fa.O7frz.156268316
  Located on chromosome 7
  Distance between a terminus base of telomere on chromosomal short arm and 5'-terminus of this base sequence : 155117965
  Distance between 3'-terminus of neighbour sequence of sequence listing upward to telomere on chrosomal short arm and 5'-terminus of this base sequence : 284931
gagaacctcagttgaggtagagtggacaggaccccacttgggttactttttatttatttatttatttatttatttatttatttgagacagggtctggccccgttgcccaggttggaatgcaactggcacaatcatggctcactgcagcctcatactcctgggctcaagccatcctcctgcctcagcctcccaactagcagggactgcagtcatgtgccaccatactcggcgtttggtggttatttatttatttttttttttgagatggagtcttgctctgtcgcccaggctggagtgcagtggcgcgatctcggctcactgcaagctccgcctcccgggttcatgccattctcctgcctcagcctcccaagtagctgggactacaggtgcctgccaccacgcccagctaattttttgtatttttagtagagacggggtttcaccatgttagccag

SEQ ID NO: 13285 - DNA, 316 bp, Homo sapiens
  AC004941.2_80633
  Located on chromosome 7
  Distance between a terminus base of telomere on chromosomal short arm and 5'-terminus of this base sequence : 155220203
  Distance between 3'-terminus of neighbour sequence of sequence listing upward to telomere on chrosomal short arm and 5'-terminus of this base sequence : 101783
tctttatcattagctttcagcaactttatcatgatgtgctttggtttggttttctttatgatacttatgcttggcgtttgttgagatgatctgtggatttccaattttcatcaaatttgaaaacttttggaccacttattaaaatttttttctgtatttctctctgttcttttcttcagagaccacacacacacacacacacacacacacacacaccacaccacaccacgctttttttaaaaaaaaaacaggtcttgctctgtcacccatgctggaatgcagtggcatgatcatagctcactgtaacctcaaactc

SEQ ID NO: 13286 - DNA, 471 bp, Homo sapiens
  AC004941.2_119137
  Located on chromosome 7
  Distance between a terminus base of telomere on chromosomal short arm and 5'-terminus of this base sequence : 155258585
  Distance between 3'-terminus of neighbour sequence of sequence listing upward to telomere on chrosomal short arm and 5'-terminus of this base sequence : 38066
tatttaagcaaatagatggcagggcgcagtggctcatgcctgtaatcccagcactttgggaggccgaggcggctagatcacctgaggtcgggagtttgacaccagcctgaccaatatggtgaaacccccgtctctactaaaaatacaaacattagccggcctgtggtggtgcgtgcctgtgatcccagctactcaggaggctgaggtgggagaatagcttgaacccgggaggcagaggttgcagtgagccaagattgcaccactgcactctagcctgggccacagaggaagaccctgtctcaaaaaataataataataataataataataataattaaacaaatagaagcagaaatgcctaatattagagaggtggttaagaaactggcatatctacatgatagaaaactagctatttaaaatgtttgatataattcacaagaaaatgtgaattacatcttaagtcagtgg

SEQ ID NO: 13287 - DNA, 274 bp, Homo sapiens
  AC004897.1_12983
  Located on chromosome 7
  Distance between a terminus base of telomere on chromosomal short arm and 5'-terminus of this base sequence : 155508398
  Distance between 3'-terminus of neighbour sequence of sequence listing upward to telomere on chrosomal short arm and 5'-terminus of this base sequence : 249342
tttctgttcctgagataatggtgccagggaggataaaatgctgaagttcaatggttctccctgattagttaacaagaacaccagggaatgggttctacttaccaaattctacctacgtgtgtgtgtgtgtgtgtgtgtgtgtgtatatatatatatatatatttctatatttccaataatccagaaagtttttttctaacagttaactcatgtgcacacacgcacatttgatattgctcattttgagtgtctatggtggcctatcctttctgct

SEQ ID NO: 13288 - DNA, 206 bp, Homo sapiens
  AC004877.1_14163
  Located on chromosome 7
  Distance between a terminus base of telomere on chromosomal short arm and 5'-terminus of this base sequence : 155600089
  Distance between 3'-terminus of neighbour sequence of sequence listing upward to telomere on chrosomal short arm and 5'-terminus of this base sequence : 91417
gtgactgaataaatgaccttgttcaaatgacttaattgctctgtgcctcagtttcctcatctaaaaaaacttggggataataatgattaccatgaagattgactgtggaaatatatatgacatgtgtatatatatatgtgtgtgtgtgtgtgtgtgtgtgtgcgtgaagaactcaggttggagagcctgatacagcaagtattaga

SEQ ID NO: 13289 - DNA, 123 bp, Homo sapiens
  D7S2426
  Located on chromosome 7
  Distance between a terminus base of telomere on chromosomal short arm and 5'-terminus of this base sequence : 155617010
  Distance between 3'-terminus of neighbour sequence of sequence listing upward to telomere on chrosomal short arm and 5'-terminus of this base sequence : 16715
ggtggcttgcccagagccccatgttaatttgtggtagtgcctgagagtgtgaaaatacacacacacacacacacacacacacacacacacacacacacacacaaagggaaacagatgcactgg

SEQ ID NO: 13290 - DNA, 349 bp, Homo sapiens
  AC004877.1_101888
  Located on chromosome 7
  Distance between a terminus base of telomere on chromosomal short arm and 5'-terminus of this base sequence : 155687895
  Distance between 3'-terminus of neighbour sequence of sequence listing upward to telomere on chrosomal short arm and 5'-terminus of this base sequence : 70762
tttctagtgcttagaacaatacctggcacccagctgttgcacagtagataatcactgaatgaatgaatgaatgaatgaacagctgtctgctaagttctagggatttatcttttctttcctcttttgataagaccctcctgttcaggggttggcttagccaggccagatgacatcttggcattacgtaaaataactgcgttaacccagcccctactgtgggagaagagggaggtggggaacaagatcctgtatgaatcaaatcacagaagtttgttttcccttgtgatttctctcagaccacaaagagctctagacagctttgtgactctggaaagtatcatagagacaa

SEQ ID NO: 13291 - DNA, 239 bp, Homo sapiens
  AC004877.1_102888
  Located on chromosome 7
  Distance between a terminus base of telomere on chromosomal short arm and 5'-terminus of this base sequence : 155688770
  Distance between 3'-terminus of neighbour sequence of sequence listing upward to telomere on chrosomal short arm and 5'-terminus of this base sequence : 526
gaagattgtacgtttcatagatcagattgcaaagacttccttttggccggttgtatctgtcctttaaattcaaaaaacaaaaaggagggggagggttccgtaaagcccatccctttggctttattctggataggtgagggaagggcctgcagacttggccaggactagaagaaaattcaggtgtgtgtgtgtgtgtgtgtgtgtgtgtgtgtgtgtgtgtgctttccgtctttcatatt

SEQ ID NO: 13292 - DNA, 350 bp, Homo sapiens
  AC004877.1_107633
  Located on chromosome 7
  Distance between a terminus base of telomere on chromosomal short arm and 5'-terminus of this base sequence : 155693456
  Distance between 3'-terminus of neighbour sequence of sequence listing upward to telomere on chrosomal short arm and 5'-terminus of this base sequence : 4447
tggcataagctatttgtatgtttaaaagtggtatataatagtattaaattgggatataaagtagtgttaaaacatagtggagattctttaattgttattattatttttactttggcttgtttttttttttatttcccacactttaccctccataacaaatgctctaagagttgaaaaccaaatattattttgcattatcttttaatacacaaaacaacttcttggggtgaactcagttttgtgtgtgtgtgtgtgtgtgtgtgtgtgtgtgtgtgagagagagagagagagacaggctgtcactctgtcacccaggctggagtgcagtggtgccatcatagctcactgta

SEQ ID NO: 13293 - DNA, 336 bp, Homo sapiens
  chr7.fa.O7frz.156684536
  Located on chromosome 7
  Distance between a terminus base of telomere on chromosomal short arm and 5'-terminus of this base sequence : 155977949
  Distance between 3'-terminus of neighbour sequence of sequence listing upward to telomere on chrosomal short arm and 5'-terminus of this base sequence : 284143
taataggcttgtcacgattaaccaaagtctgaactctgagagaaagaaagaaagaaagaaaggaaacgaaacgaaagaaaggaaagaaagaaaagaaaagaaaagaaaggaaagaaagggaagaaagaaaaggaaaaggaaaaggaaaagaaaagaaaagaaaaggaaagaaagaagccatggagaagaatgtggagcatcagagccaagccagctctcacgcaacctgctacagattcttgccaggcatctcacagacacgaaaccctgtcatgatgaagaaatcaccacaggatgttggcgccggtggcccaagcagcctactgttcctggaat

SEQ ID NO: 13294 - DNA, 292 bp, Homo sapiens
  AC006019.2_20243
  Located on chromosome 7
  Distance between a terminus base of telomere on chromosomal short arm and 5'-terminus of this base sequence : 156185001
  Distance between 3'-terminus of neighbour sequence of sequence listing upward to telomere on chrosomal short arm and 5'-terminus of this base sequence : 206716
gattggattcagcttttcttaccagttccacctggggtccctggtgccctcaacaacccactgaacctctgtgcttctcagctcaacggaccagaagcagcaagtccagcctctgcaggcgcctctatgggcaatggtggtggtggtggtggtggctttgtattcccaaaaaaatatactttttgatacacaaggggtctgtatttaaaatgaaacatttttcaaggttttattcttcctgttacggatgggaatacaaaccctagatttcataacatacttctcaataggc

SEQ ID NO: 13295 - DNA, 315 bp, Homo sapiens
  AC006019.2_32455
  Located on chromosome 7
  Distance between a terminus base of telomere on chromosomal short arm and 5'-terminus of this base sequence : 156197248
  Distance between 3'-terminus of neighbour sequence of sequence listing upward to telomere on chrosomal short arm and 5'-terminus of this base sequence : 11955
gctcgtatctaagacactttcaagattttctgacattttggaatcttgcttcatcttcaaggtgaaagatatatgtgagtctagcaatgccttaaaatggtgtgtgtgtgtgtgtgtgtgtgtgtgtgtgtgtgtgtacatatgcactgaagtttgaaagtcgtaatataaattgagaaaacaaatattctttaaacattctatattaagccccttttctgtgcttttttcagaatctcattgtggtgctaaaatttctgaaggattcaatgaaagcagatgacaacacaactaccttcagcacacttaatgtct

SEQ ID NO: 13296 - DNA, 235 bp, Homo sapiens
  AC006019.2_113228
  Located on chromosome 7
  Distance between a terminus base of telomere on chromosomal short arm and 5'-terminus of this base sequence : 156278089
  Distance between 3'-terminus of neighbour sequence of sequence listing upward to telomere on chrosomal short arm and 5'-terminus of this base sequence : 80526
aatgagcattctcagtttgaatacaaaacaggtgtgtgtgtgtgtgtgtgtgtgctgtgcactcatactcaaagagaataaaaaaatcctctattatagggaagcaagctggaagcaaggagatgggccttaagtgatcaccaggtgaatgcctggcttacagcaggtgctcaataaaacatgggatgaatgaaactgacatagaaactgtgtgttatttactcgttcaccagat

SEQ ID NO: 13297 - DNA, 194 bp, Homo sapiens
  AC005588.1_2326
  Located on chromosome 7
  Distance between a terminus base of telomere on chromosomal short arm and 5'-terminus of this base sequence : 156291507
  Distance between 3'-terminus of neighbour sequence of sequence listing upward to telomere on chrosomal short arm and 5'-terminus of this base sequence : 13183
aaggagaaatagctctgacctaacaattgagataaattgtttctaatcctgggatacccacaaatttgctgtgtgagtgatattcaaagacatctaatgacttgcccaaaatttcacttgtgacacgtgtgtgtgtgtgtgtgtgtgtgtgtgtgtgtgtgtgtgtgtgtgtgtgttatggacagaatggttgt

SEQ ID NO: 13298 - DNA, 190 bp, Homo sapiens
  AC005588.1_12753
  Located on chromosome 7
  Distance between a terminus base of telomere on chromosomal short arm and 5'-terminus of this base sequence : 156302038
  Distance between 3'-terminus of neighbour sequence of sequence listing upward to telomere on chrosomal short arm and 5'-terminus of this base sequence : 10337
gactgaaacatcctaccattagacacacacacacacacacacacacacacacacacacacacacacgagcgatggtgaacacgttactctaagtgccggattccccaccagactcccacccctgttgcttgacccaggactagagatggattcatggattgacttaagctgtgagttagcttaccataat

SEQ ID NO: 13299 - DNA, 390 bp, Homo sapiens
  AC005588.1_21599
  Located on chromosome 7
  Distance between a terminus base of telomere on chromosomal short arm and 5'-terminus of this base sequence : 156310624
  Distance between 3'-terminus of neighbour sequence of sequence listing upward to telomere on chrosomal short arm and 5'-terminus of this base sequence : 8396
tgtatgaggaaactaatagagcagaaattattaataggtttgtcacaattaaccaaagtctgaattctgagagaaagaaaggaaggaaggaaggaaggaaggaaggaaggaagaaaggaaggaaggaaggaagggaaaagaaatgaaagaaagaaagagagaaagaaagaaaaagaaagaaagaaagaaagaaagaaaggaaaagaaaagaagggaaagaaagggaagaaagaaaaaaaggaaaggaaaggaaagggaaaaggaaaaggaaaaggaaaaggaaaaggaaaggaaaggaaaggaaaggaaaggaaaggaaaggaaaggaaaggagccacggagaagaatgtggagcatcagagccaagccagctctcatgcaacctgctac

SEQ ID NO: 13300 - DNA, 241 bp, Homo sapiens
  D7S1807
  Located on chromosome 7
  Distance between a terminus base of telomere on chromosomal short arm and 5'-terminus of this base sequence : 156310653
  Distance between 3'-terminus of neighbour sequence of sequence listing upward to telomere on chrosomal short arm and 5'-terminus of this base sequence : -361
attaataggtttgtcacaattaaccaaagtctgaattctgagagaaagaaaggaaggaaggaaggaaggaaggaaggaaggaagaaaggaaggaaggaaggaagggaaaagaaatgaaagaaagaaagagagaaagaaagaaaaagaaagaaagaaagaaagaaagaaaggaaaagaaaagaagggaaagaaagggaagaaagaaaaaaaggaaaggaaaggaaagggaaaaggaaaagga

SEQ ID NO: 13301 - DNA, 316 bp, Homo sapiens
  AC005588.1_67962
  Located on chromosome 7
  Distance between a terminus base of telomere on chromosomal short arm and 5'-terminus of this base sequence : 156357053
  Distance between 3'-terminus of neighbour sequence of sequence listing upward to telomere on chrosomal short arm and 5'-terminus of this base sequence : 46159
aagcaatgatctgtagtggtctgcttggctacacagagatgatatcaccagtagtgagagagacagagagagagagagagagagagagagagagagagagagagagagagagagagactgtgtgtgtgtgtgtgtgtgtgtgtgtgtgtgtgtgtgtgttttaattacctcttctttttgccttggcagaaaaagagagagagagagagagagagagtgtgtgtgtgtgtgtgtgtgtgtgtgtgtgtgtgtgtgttttaattaactcttctttttgccttggcagaaatagtcaaactgactaacgtattcaatc

SEQ ID NO: 13302 - DNA, 300 bp, Homo sapiens
  AC005588.1_67810
  Located on chromosome 7
  Distance between a terminus base of telomere on chromosomal short arm and 5'-terminus of this base sequence : 156357053
  Distance between 3'-terminus of neighbour sequence of sequence listing upward to telomere on chrosomal short arm and 5'-terminus of this base sequence : -316
aagcaatgatctgtagtggtctgcttggctacacagagatgatatcaccagtagtgagagagacagagagagagagagagagagagagagagagagagagagagagagagagagagactgtgtgtgtgtgtgtgtgtgtgtgtgtgtgtgtgtgtgtgttttaattacctcttctttttgccttggcagaaaaagagagagagagagagagagagagtgtgtgtgtgtgtgtgtgtgtgtgtgtgtgtgtgtgtgttttaattaactcttctttttgccttggcagaaatagtcaaactg

SEQ ID NO: 13303 - DNA, 236 bp, Homo sapiens
  AC005588.1_90665
  Located on chromosome 7
  Distance between a terminus base of telomere on chromosomal short arm and 5'-terminus of this base sequence : 156379903
  Distance between 3'-terminus of neighbour sequence of sequence listing upward to telomere on chrosomal short arm and 5'-terminus of this base sequence : 22550
cttatccaacagatcttcagctatgctggacaatggtgccagtattttacatctgagatgtatgaacattgtgtgtgtgtgtgtgtgtgtgtgtgtgtgtgtgtgcacgcatgcacatgcatgtatatggtgtgctacacacacacatatacagtcttcctgggtcatcaaggctggtgcatgaatgctctagattttgtgtccaataggactatacattgatgccatctatttgt

SEQ ID NO: 13304 - DNA, 207 bp, Homo sapiens
  AC005588.1_100276
  Located on chromosome 7
  Distance between a terminus base of telomere on chromosomal short arm and 5'-terminus of this base sequence : 156389551
  Distance between 3'-terminus of neighbour sequence of sequence listing upward to telomere on chrosomal short arm and 5'-terminus of this base sequence : 9412
aaccagattcagagctgatagacacatcaggctgtgtgtgtgtgtgtgtgtgtgtgtgtgtgtgtgtgtgtgtaagggcgtgccagcgcctgaggggaagggcatggcgggagctggagtctgggaggggtttgggaagcttttccattatttacattcacaaaaaaatctccgtttgtaaaaaagaataagaggtcactttcgagc

SEQ ID NO: 13305 - DNA, 225 bp, Homo sapiens
  AC005588.1_112149
  Located on chromosome 7
  Distance between a terminus base of telomere on chromosomal short arm and 5'-terminus of this base sequence : 156401386
  Distance between 3'-terminus of neighbour sequence of sequence listing upward to telomere on chrosomal short arm and 5'-terminus of this base sequence : 11628
tttacaaacatgctaaagtccatatctaataagttctttctggttcttctgttattctggtgtgtgtgtctgtgtgtgtgtgtgtgtgtgtgtgtgtgcatgtgcgcacgcgcgcttatgtgttgctgttgctctttgttcaattattttgttctttcttggtaatttttggctcaatacttcatatttccaatactaggtgtgcagataatttgaagctctaga

SEQ ID NO: 13306 - DNA, 426 bp, Homo sapiens
  AC006973.2_2424
  Located on chromosome 7
  Distance between a terminus base of telomere on chromosomal short arm and 5'-terminus of this base sequence : 156410869
  Distance between 3'-terminus of neighbour sequence of sequence listing upward to telomere on chrosomal short arm and 5'-terminus of this base sequence : 9258
taagtgtcgataaactgccatccatctcagtaatcaagaagagtaaagcctgcatgtttacagttgtaagcttcatcatgtatctgtggctgaagcctacataacacatacattatattttccctgttaaaagttccccaagcacgtgtgtgtgtgtgtgtgtgtgtgtgtgtgtgtgtgtgtgtgtgtgtgtgtattattattattttttgagacagagtcttgctctgttgcccaggctggagtgtagtggtgcaatcttggctcactgccacttctgcctcctgggttcaagcaattgtccctgcctcagcctcctgagtagctgggattagaggcgcccaccaccatgcccagctaatttttggtatttttagtagagacggggttttgccatgttggccagtctggtcttgaactcatgac

SEQ ID NO: 13307 - DNA, 141 bp, Homo sapiens
  D7S2462
  Located on chromosome 7
  Distance between a terminus base of telomere on chromosomal short arm and 5'-terminus of this base sequence : 156410993
  Distance between 3'-terminus of neighbour sequence of sequence listing upward to telomere on chrosomal short arm and 5'-terminus of this base sequence : -302
tgttaaaagttccccaagcacgtgtgtgtgtgtgtgtgtgtgtgtgtgtgtgtgtgtgtgtgtgtgtgtgtattattattattttttgagacagagtcttgctctgttgcccaggctggagtgtagtggtgcaatcttggc

SEQ ID NO: 13308 - DNA, 246 bp, Homo sapiens
  AC006973.2_9786
  Located on chromosome 7
  Distance between a terminus base of telomere on chromosomal short arm and 5'-terminus of this base sequence : 156418323
  Distance between 3'-terminus of neighbour sequence of sequence listing upward to telomere on chrosomal short arm and 5'-terminus of this base sequence : 7189
actttaaatgttgaccatagcaactagcaccagcaattttatatacacatgctgagagagagagagagagagagagagagagagagagagaaaacctttgagttctaaggacacatattaataagtatagattagggttatggccaatgttttctaaataactattaaaaattgtgcttaactattttgcaaagataaatgcttaaaaattttagataaaatctttagtccagattgtgacctaaa

SEQ ID NO: 13309 - DNA, 264 bp, Homo sapiens
  AC005998.3_36870
  Located on chromosome 7
  Distance between a terminus base of telomere on chromosomal short arm and 5'-terminus of this base sequence : 156515682
  Distance between 3'-terminus of neighbour sequence of sequence listing upward to telomere on chrosomal short arm and 5'-terminus of this base sequence : 97113
gcctaatatacatgcacttgaaacccctgacagagaacacactcactcacatacagatagagagagagagagagagagagagatacagaaacagagagagacagagagagagacagaaacagagagagagagagagagacagaaacagagagagagagaagtggaagcagggaaatatttgcagaaatagtgcccccagatttccaaatttgatgaaaaggataaactcatagatacttaaaaagcacttgcctaacttaaagg

SEQ ID NO: 13310 - DNA, 409 bp, Homo sapiens
  G09168
  Located on chromosome 7
  Distance between a terminus base of telomere on chromosomal short arm and 5'-terminus of this base sequence : 156874286
  Distance between 3'-terminus of neighbour sequence of sequence listing upward to telomere on chrosomal short arm and 5'-terminus of this base sequence : 358340
tcatagaaactgccctcaggtccttctggcttttagataaatagattatagacagatagatagatagatagatagatagataatagataatagacagatatagataaaaaagatgatagagatagatagataatagacagaaagatatagataaaaaagatgatagagatagatagatacatgatagaaagagaaaggggatcagatagatgacagatagatagataatagataatagaaagatatagataaaaaagatgatagagatagatagatacatgatagaaagaaagagaaagggaatcagatagatgacagatagatagatagatatagacgatagatatatgatagaattactttatatagatatatgaattgttcagtgcagtgtgcaatgtaacagtct

SEQ ID NO: 13311 - DNA, 394 bp, Homo sapiens
  AF109076.1_107329
  Located on chromosome 7
  Distance between a terminus base of telomere on chromosomal short arm and 5'-terminus of this base sequence : 156947917
  Distance between 3'-terminus of neighbour sequence of sequence listing upward to telomere on chrosomal short arm and 5'-terminus of this base sequence : 73222
ggccttggcttctaaatattctccaccagaagaagtcgggattccttgcacatgtgacagagtccaggtttcagcagaaaagtttaagatgatgtattagtcagggttcttttagagggacagaactataggatatatatgtatatatcatatatatcctatatatgtatgtatatctcctatatataatatatatatatatatatatatatatatatatatatatatataaaataggcagaaaatgtgaaaaggagagatgggatatatatatataagtttattaagtattaacttacactaccacaaggtcccacaataggctgcctgcaagctgaagagcaaggagagtcagtccaaatcccaaaactgaagaacttggagtccaatgttc

SEQ ID NO: 13312 - DNA, 208 bp, Homo sapiens
  D7S798
  Located on chromosome 7
  Distance between a terminus base of telomere on chromosomal short arm and 5'-terminus of this base sequence : 157183276
  Distance between 3'-terminus of neighbour sequence of sequence listing upward to telomere on chrosomal short arm and 5'-terminus of this base sequence : 234965
catcaattcacataatgaccgtgtgtgtgtgtgtgtgtgtgtgtgtgtgtgtgtgtgtagtgagaacacaagttctactcttagcaaattttatttatacagtacagtgttattaaatatagttggaaagcattttcatatcacacaaatatagatagtggggtgggggaaaataggaccttttctacttccactattttgagcagct

SEQ ID NO: 13313 - DNA, 270 bp, Homo sapiens
  AF104455.1_27915
  Located on chromosome 7
  Distance between a terminus base of telomere on chromosomal short arm and 5'-terminus of this base sequence : 157219152
  Distance between 3'-terminus of neighbour sequence of sequence listing upward to telomere on chrosomal short arm and 5'-terminus of this base sequence : 35668
gagactccgtctcaaatacatacatacatacatacatacatacatacatacatacatacatacatacataaaatgttttaaagttagttaactatcttaacatggaaaaaaaagatttcgtccctttctgaagccatgctaagctttcgtacttgccttaccaatgagtcactggctctggctgaccccaaggggatgtaaaccctcagacacctctggtctctacaaggccaggcagcaggcagcccctagtcaaagaaccatcctcat

SEQ ID NO: 13314 - DNA, 358 bp, Homo sapiens
  D7S1828
  Located on chromosome 7
  Distance between a terminus base of telomere on chromosomal short arm and 5'-terminus of this base sequence : 157323097
  Distance between 3'-terminus of neighbour sequence of sequence listing upward to telomere on chrosomal short arm and 5'-terminus of this base sequence : 103675
agaatcttgacattatctgacttcaagtcctaaaaataggaatctataacatttctagtatgatcaaattaaaatctggttagtaactgttttctttctatctatctatctatctatctatctatctatctatctatctagagaatgagagaaagagagagacaacatacattttactcctggtatctggcacttctctttcgatgcccaagcttctactgataatcacattaaatccatattttaaaagttctttatgaagttctgggtttgtatggttaaaatctgtacctgcaagaaaatgtaattagaatcatataagtaaaggcttactagcagtgatgcaggaaaggaaaga

SEQ ID NO: 13315 - DNA, 355 bp, Homo sapiens
  G08637
  Located on chromosome 7
  Distance between a terminus base of telomere on chromosomal short arm and 5'-terminus of this base sequence : 157381300
  Distance between 3'-terminus of neighbour sequence of sequence listing upward to telomere on chrosomal short arm and 5'-terminus of this base sequence : 57845
tgtgggggaaagaagatacaggtggaatatagaaatggttaagtaaaaaccttgttttttctcaatctgaatataaaaatctgctattaactcaagatatacagattgagatatcacatctatctatctatcatctatctatctatcttctacctgcctatttatctatctatctatctatctatctatctatctctagatcctattaggtctgtctctcaagaggaccctggtggatacaggcatactgatttttattaacctaattaattccactttattaatttagaggggtgggtaaaggcatctataaagcaccatcagtgctgggcttcaccccatcttgggatgactt

SEQ ID NO: 13316 - DNA, 374 bp, Homo sapiens
  chr7.fa.O7frz.158687353
  Located on chromosome 7
  Distance between a terminus base of telomere on chromosomal short arm and 5'-terminus of this base sequence : 157384262
  Distance between 3'-terminus of neighbour sequence of sequence listing upward to telomere on chrosomal short arm and 5'-terminus of this base sequence : 2607
tacgaaagctgtttaatgacagcagccagtgttaccttctcaaccacagtattatataaaaaaatatacgatttatttatttatttatttatttatttatttatttagagacagggtctcactccgacatccaggctggagtgcagtggcacagtgtcagctcactgcagcctccgcctctcaggttcaagcaattctcttgtctcagcctcccaagtagttgggattacagacgtgtgccaccatgcccggctaatttttgtgtttttattagagacagggttttgccatggtggccaggctggtctcaaactcctgacctcaagtgatttgcctacctcggcttcccaaggtacaaggattacagacgtgag

SEQ ID NO: 13317 - DNA, 365 bp, Homo sapiens
  DISO7_00037300
  Located on chromosome 7
  Distance between a terminus base of telomere on chromosomal short arm and 5'-terminus of this base sequence : 157424063
  Distance between 3'-terminus of neighbour sequence of sequence listing upward to telomere on chrosomal short arm and 5'-terminus of this base sequence : 39427
ggtactattaatagcttccctggtgtaatactgttccatttcttctgcccccatgagttattcctctgtctgcctgcctgcctgcctgcctgcctgcctgcctgcctgcctgcctatctatctatctatctatctatctatctatctatctatctatcatctgcaccttttcagctgtcattgagaagagatatccttgacttttgactattcaacaaaggcaattcaacatttggcttccaaataaagatgaatgcccaaaccagcctgtagccagagctgcctgtgtgggccagcccgttaggccacgctgcaagctttcttgactcagcccttcagtggcttcatgcatcttagatgccctg

SEQ ID NO: 13318 - DNA, 291 bp, Homo sapiens
  chr7.fa.O7frz.160946303
  Located on chromosome 7
  Distance between a terminus base of telomere on chromosomal short arm and 5'-terminus of this base sequence : 157750965
  Distance between 3'-terminus of neighbour sequence of sequence listing upward to telomere on chrosomal short arm and 5'-terminus of this base sequence : 326537
tggtctccagctacatcagaggttgaggacaggagaactacctgagctcaggagtgcaaggctgcagtgacccatgattgtgccactgcatgccaacctgggtgacatagtgagacccctagatagatagatagatagatagatagatagatagatagatagatagacagacagatacataaatagataaaaactgaggtgcactgtcacttgagaatttcaaattatatgataagtagctaaggcagtcaaagaaaggctttggagatgaccagaaagtaccttatgtaa

SEQ ID NO: 13319 - DNA, 219 bp, Homo sapiens
  Z67350
  Located on chromosome 7
  Distance between a terminus base of telomere on chromosomal short arm and 5'-terminus of this base sequence : 157880654
  Distance between 3'-terminus of neighbour sequence of sequence listing upward to telomere on chrosomal short arm and 5'-terminus of this base sequence : 129398
ataagcccacagatccaagcacaacaaaatctgaaacagacagacacacacacacacacacacacacacacacacacacgtaccagtaaggtactttatagtcaaattgctgaaaaagattaataaagagaaaatattaaaagcagcaaaagaaaatacacattgcttaaagggggaataaagtaaaaatgactgcaggcttcttgtctgaaactatgt

SEQ ID NO: 13320 - DNA, 319 bp, Homo sapiens
  chr7.fa.O7frz.160644198
  Located on chromosome 7
  Distance between a terminus base of telomere on chromosomal short arm and 5'-terminus of this base sequence : 157942710
  Distance between 3'-terminus of neighbour sequence of sequence listing upward to telomere on chrosomal short arm and 5'-terminus of this base sequence : 61837
tggaaacagtaccaaatacaacagaaaaatattagaatgtgtactttctaataagtatacatgttaaatatgggattttaaatttaggtagatgtgtactaacctgttaaccaatcatctgcaaaggggtgaattacaagggacttttactgtctaaaatatttgaatatttcaaagcacatgtagtaatcatctaatcatatatatatatatatatatgtagtttttaatggggagggaatgagcattgttatctttgacaaagaaaaaccaacatctcagaaaaatataggcaaggaagattctcaaagcatctagc

SEQ ID NO: 13321 - DNA, 408 bp, Homo sapiens
  AC003109.1_74761
  Located on chromosome 7
  Distance between a terminus base of telomere on chromosomal short arm and 5'-terminus of this base sequence : 158085838
  Distance between 3'-terminus of neighbour sequence of sequence listing upward to telomere on chrosomal short arm and 5'-terminus of this base sequence : 142809
aatcgtaagaatcaactagccaggtgcagtggctcacatccgtaatcccagcactttgggaggcctagcgggctgaccacttgagcctaggagtttgagaccagcctgggcaacacagttagacactgtctacacacacacacacacacacacacacaaaattaactgggtgtggtgacgtatgcctgtagtcccagctactcgggaggttgaggtgggaggatcacttgagcccaggaggtcaaggctgcagtgagccttgatcatgccactgcactccagcctggatgacagaagaaaagaaaacagaataattcaactaaaaacggaaaattgttcatataaaaagagcacaacaggataaccagttatgagtaaaacacgaatatattaatagcattggcaggc

SEQ ID NO: 13322 - DNA, 401 bp, Homo sapiens
  AC003109.1_68057
  Located on chromosome 7
  Distance between a terminus base of telomere on chromosomal short arm and 5'-terminus of this base sequence : 158092542
  Distance between 3'-terminus of neighbour sequence of sequence listing upward to telomere on chrosomal short arm and 5'-terminus of this base sequence : 6296
cacttgaacgtaggagaatcacttgaacccaggaggcagaggtcgaattgagctgagatggcaccattgtactccagcctgggcgacagtgcaagattccgtctcaaaatacgtgtgtgtgtgtgtgtgtgtgtgtgtgtgtgtgtgtgtgtgtgtgtataaacacaataaattattgtttagtgtagtcacctgttgtgctagatcttattctatctaactatatttttgcccccattaaccatcctcactccacccccacacctaccactacccttcccagcctctggtaaccatcattctattctctatccccatgagtttgttttaaattttagttctcacatatgagtgagacatgtgcaattggtctttctgtgcctgatttcacttaatgtaat

SEQ ID NO: 13323 - DNA, 299 bp, Homo sapiens
  AC003109.1_34074
  Located on chromosome 7
  Distance between a terminus base of telomere on chromosomal short arm and 5'-terminus of this base sequence : 158126486
  Distance between 3'-terminus of neighbour sequence of sequence listing upward to telomere on chrosomal short arm and 5'-terminus of this base sequence : 33543
ttctatccttgagtggttaagaaatcaaaaggtgcagaccctttatcaatgtctaatgttgatacttttccccttctcccggacaatgcaaggaccttagcacactaattcttctgctcctaatgtcaaattatatgcttttcttgccacgtattctaagtctgtgagagggtgtgtgtgtgtgtgtgtgtgtgtgttgttcccttctttgtatccaggagttctcatcatttagctcccacttataagtgaaaacatgcagtatctggttttctgttcctatgttagtttgctaagga

SEQ ID NO: 13324 - DNA, 148 bp, Homo sapiens
  chr7.fa.O7frz.159328941
  Located on chromosome 7
  Distance between a terminus base of telomere on chromosomal short arm and 5'-terminus of this base sequence : 158386541
  Distance between 3'-terminus of neighbour sequence of sequence listing upward to telomere on chrosomal short arm and 5'-terminus of this base sequence : 259756
ctactttcctggtgtctagctttcagatggcatagtgtgggacttctcggtctccataatttcgtgagctaattcccgtagcaaatcctctatctatctatctatctatctatctatcttctatctgatctacctatcagctgttatc

SEQ ID NO: 13325 - DNA, 454 bp, Homo sapiens
  chr7.fa.O7frz.159457922
  Located on chromosome 7
  Distance between a terminus base of telomere on chromosomal short arm and 5'-terminus of this base sequence : 158515467
  Distance between 3'-terminus of neighbour sequence of sequence listing upward to telomere on chrosomal short arm and 5'-terminus of this base sequence : 128778
tttcagtacaatctaacaaggaaggaatgcaaacatgaagctcgtaggaagaacagtagattttatcagtctgtctttctattagtaggattactatgtataagatataacctatctacaagagacagcttgataaattttgcgtgtgtgtgtgtgtgtgtgtgtgtgtgtgtgtgttcaccacccaggtcaacattcaaaaatacttccaaagcttcaaaaggccccttcgtgctttttccctgggtaatgtcttcccataaaattaaccatcattctgaattctactcccatagagtagtcttatctgttcttgaacttcaaataagtggagtcttatagtgtatagtcttttgtctggcttctttgtcccatcattgtctttgagattcatgcaggtggttgtgtacagcggtagttcatttttacactatcaccattgtaaccatctatt

SEQ ID NO: 13326 - DNA, 332 bp, Homo sapiens
  chr7.fa.O7frz.161602412
  Located on chromosome 7
  Distance between a terminus base of telomere on chromosomal short arm and 5'-terminus of this base sequence : 158640068
  Distance between 3'-terminus of neighbour sequence of sequence listing upward to telomere on chrosomal short arm and 5'-terminus of this base sequence : 124147
agtttacctagaagcaacaagatattttaagatatggtatatatatatatatatatatatatatatacacacacacgcacgcacacacacacacacacacacacccttacatatatatgtagtacttcctggaatagcctgagaaagaaacatttaggaagactcaatataattattaatacaatttctggctctgattttgatgagccagatattttgatgttcattttgatgcagtctgccatgcctggaacaccaggtcatatggtacatatgacttggttaaagaagagattaaccaataagagaactttggcaggtaagaactattt

SEQ ID NO: 13327 - DNA, 244 bp, Homo sapiens
  D7S2546
  Located on chromosome 7
  Distance between a terminus base of telomere on chromosomal short arm and 5'-terminus of this base sequence : 158837186
  Distance between 3'-terminus of neighbour sequence of sequence listing upward to telomere on chrosomal short arm and 5'-terminus of this base sequence : 196786
ggaggttgaacaactctgaatacactaaaaaccactaaattatatacctaactgggtgaatttatttgtatgtgaattatatcttgataaagcatgtgcttgctcttgctctcactctcgtgctctctctctctctctctatgactctcttacacatacacacacacatgcacacacacacacacacacacacacacacacacacagagagagagagagcaaggaaaagatagaccctggcgtg

SEQ ID NO: 13328 - DNA, 230 bp, Homo sapiens
  D7S637
  Located on chromosome 7
  Distance between a terminus base of telomere on chromosomal short arm and 5'-terminus of this base sequence : 158918822
  Distance between 3'-terminus of neighbour sequence of sequence listing upward to telomere on chrosomal short arm and 5'-terminus of this base sequence : 81392
atatcaaaaccaagatgttgacatcaactaatcttatttagatttctccattttgctttcatatatgtgtgtgtgtgtgtgtgtgtgtggtgtatgggtgtatttagttctgtgcaatcttattatatgtgtaggtttgtgtaatagcacctgctgtggtttgaatgtgttcttacaaaaacatgtgttggaaatttaatctccactgcaatagtgctgggaggtacagc

SEQ ID NO: 13329 - DNA, 258 bp, Homo sapiens
  Z23607.1_192
  Located on chromosome 7
  Distance between a terminus base of telomere on chromosomal short arm and 5'-terminus of this base sequence : 158918828
  Distance between 3'-terminus of neighbour sequence of sequence listing upward to telomere on chrosomal short arm and 5'-terminus of this base sequence : -224
aaaccaagatgttgacatcaactaatcttatttagatttctccattttgctttcatatatgtgtgtgtgtgtgtgtgtgtgtggtgtatgggtgtatttagttctgtgcaatcttattatatgtgtaggtttgtgtaatagcacctgctgtggtttgaatgtgttcttacaaaaacatgtgttggaaatttaatctccactgcaatagtgctgggaggtacagcccaatgaaaggtgtttaggccatggattgatact

SEQ ID NO: 13330 - DNA, 174 bp, Homo sapiens
  D7S2447
  Located on chromosome 7
  Distance between a terminus base of telomere on chromosomal short arm and 5'-terminus of this base sequence : 158976541
  Distance between 3'-terminus of neighbour sequence of sequence listing upward to telomere on chrosomal short arm and 5'-terminus of this base sequence : 57455
tctcactgtactcagcctgtacatggtgttgtgtgtgtgtgtgtgtgtgtgtgtgtgtaaattaaaatctggagaggtacaccagggtgtctgaatatgtaaaagggtcatttctttttagatagcaaattctcctaaaattggaacagcatgtgcttggttcctacatctgac

SEQ ID NO: 13331 - DNA, 230 bp, Homo sapiens
  chr7.fa.O7frz.161990769
  Located on chromosome 7
  Distance between a terminus base of telomere on chromosomal short arm and 5'-terminus of this base sequence : 159083154
  Distance between 3'-terminus of neighbour sequence of sequence listing upward to telomere on chrosomal short arm and 5'-terminus of this base sequence : 106439
gacatctagtggcttctatttctctccaagtaaaggccagacttcctacagtggcctcagaagcccccatgatagatgatagatagatagatagatagatagatagatagataaacagatacatagatagatagatagatgattgatagacagatagatagataggccatgcaccctttctatcccccctcacatcggctgggtcactcccatacgaggatctgcacaga

SEQ ID NO: 13332 - DNA, 146 bp, Homo sapiens
  Z67544
  Located on chromosome 7
  Distance between a terminus base of telomere on chromosomal short arm and 5'-terminus of this base sequence : 159282498
  Distance between 3'-terminus of neighbour sequence of sequence listing upward to telomere on chrosomal short arm and 5'-terminus of this base sequence : 199114
caacttaaaatacgctgttaccctttttcaatgaccctgaaatatacatatatacacatacacacacacacacacacacacacacacacacaagtaaacaggttctcacacaaatactgcttgtaagttatttggtctgaaaaagc

SEQ ID NO: 13333 - DNA, 332 bp, Homo sapiens
  chr7.fa.O7frz.162414401
  Located on chromosome 7
  Distance between a terminus base of telomere on chromosomal short arm and 5'-terminus of this base sequence : 159357491
  Distance between 3'-terminus of neighbour sequence of sequence listing upward to telomere on chrosomal short arm and 5'-terminus of this base sequence : 74847
tctggagacattgaatctaaatactccacaattcaatttctcaagcattttatgtatatttgcatggagtacacacacacacacacacacacacacacacacacacacacgatggtaccaccaagcccctacactagccctaggtctcctgtccccaggcttcttgttatgtgagattatcttgttttggagtcactgctcacccgctattcttgcagccaacagcattcgtggttaaaaatgactgcaaaataatacatagagcagcagatggttgatgcatacatacattcagagcatatacagcactcacttagttatgccattacatt

SEQ ID NO: 13334 - DNA, 213 bp, Homo sapiens
  DISO7_10002379
  Located on chromosome 7
  Distance between a terminus base of telomere on chromosomal short arm and 5'-terminus of this base sequence : 159437679
  Distance between 3'-terminus of neighbour sequence of sequence listing upward to telomere on chrosomal short arm and 5'-terminus of this base sequence : 79856
ctagacaaccagatgcaacacacacacacacacacaagtgcgtgcacacacgtgtacccatgcgtgagcactcacacacacacacgcacatacacacacacacctgtgcatgagcactcacatacacatgcacgcacacatgtacccatgcatgagcacgcacacatgcacacacacatatgcacacccacacatgtacctgtgcatgaacgc

SEQ ID NO: 13335 - DNA, 449 bp, Homo sapiens
  chr7.fa.O7frz.162847736
  Located on chromosome 7
  Distance between a terminus base of telomere on chromosomal short arm and 5'-terminus of this base sequence : 159739895
  Distance between 3'-terminus of neighbour sequence of sequence listing upward to telomere on chrosomal short arm and 5'-terminus of this base sequence : 302003
agatatttggctaaacatggtctgggtgtttctatgagggtgtttcagatgagattagcatttgaatctatggactcagaaaagcagatggcctccccagtgtggtgggcctcatccaatccatttgggcctgaatagaacaaaagactgggcaacagagaattcactctctgcctgactgcttgagctgggacatctatcttctcctgccttcaggtggggacatatgccatcagcgctcctggttctctgccttcagtcttggactgacccacaccatagcttcctgggtctccagtgtgcagacagcagaatgtggaccttctaggcccctgaaatagatgagccaattccttataataaaccacacacactcacacatacacacacactcacatacacacacacactcacacacacacattctattgcttctgtatctctgaaga

SEQ ID NO: 13336 - DNA, 429 bp, Homo sapiens
  chr7.fa.O7frz.162933289
  Located on chromosome 7
  Distance between a terminus base of telomere on chromosomal short arm and 5'-terminus of this base sequence : 159825569
  Distance between 3'-terminus of neighbour sequence of sequence listing upward to telomere on chrosomal short arm and 5'-terminus of this base sequence : 85225
gtattaaacaagcatccaagttaggggactagaaggtctacgtacagccaacagagcggagagtcagtgaccatcgctttcaactttgtatattataaataaaattctgctcattttttccagcttctgagtgtgtgtatatgcttaagaattaactattattttccaccctctgagccagaaaaaaattttttttaagaagtagatacaggaatggaacctggaaaaaaatccagcatccccccaaacaaacaaacaaacaaacaaacaaaaaaactttagaaagttcttacaaaataaaaatcgcaccttctgctgctgtagcagatactcaagccatgaagtgagggtctccttccctggtccaggatggaaaaatcctctctctcaaagtttttaaaaagaaagtgctttggagtcttctaattc

SEQ ID NO: 13337 - DNA, 193 bp, Homo sapiens
  D7S550
  Located on chromosome 7
  Distance between a terminus base of telomere on chromosomal short arm and 5'-terminus of this base sequence : 160044184
  Distance between 3'-terminus of neighbour sequence of sequence listing upward to telomere on chrosomal short arm and 5'-terminus of this base sequence : 218186
gcagttgggttatttcaagtcttcggatgttgtgattagagttgctgtaaacatttgtgtacaggtttgtgtgtgtgtgtgtgtgtgtgtgtgtgtgtgtgtgtgtgtgtgtgtacagattttttttgtgaacataagttgtcagtaaatgcctaggagtggattgtggatgatagtgcattcacagatgaga

SEQ ID NO: 13338 - DNA, 253 bp, Homo sapiens
  AC002484.1_46503
  Located on chromosome 7
  Distance between a terminus base of telomere on chromosomal short arm and 5'-terminus of this base sequence : 160159497
  Distance between 3'-terminus of neighbour sequence of sequence listing upward to telomere on chrosomal short arm and 5'-terminus of this base sequence : 115120
cagtgcatttactagtgagtctgttagctctccgaggcttcaaaacaaagtgtgagatgtgccagcgagcaggcacacacacacacacacacacacacacctagcaaggaaagaacaccgatttttctttatccaatacacttgaccacacacatccccatgagcgctttttccttcaaagtcctcacctcaggaagccgagctcttctgtagtttgaccgtgctggacagctcattgtagtcactgcatttg

SEQ ID NO: 13339 - DNA, 479 bp, Homo sapiens
  chr7.fa.O7frz.163394416
  Located on chromosome 7
  Distance between a terminus base of telomere on chromosomal short arm and 5'-terminus of this base sequence : 160248528
  Distance between 3'-terminus of neighbour sequence of sequence listing upward to telomere on chrosomal short arm and 5'-terminus of this base sequence : 88778
atgcaaacattgactcatttagaaaagggctttttcttctgaaaaagtgaaacattttctatcaagttaataagataggatattaggcagaataaaggttttcattttcatgaaacattccagcttggttaaaaaaattactaggatctttgttcttgggaatattcttgaatttcttccactttgttttgttttgttttgttttgttttgttttttgttgcccaggctggagtgtagctgtgtgatcatggctcactacagccttgacctcctgggctcaagcaatcctcctgcctcaacctcctgagtggctgggaccacaggcacacgctgtcaactttccacatctgatgtggtttgaatctgtgttccttccgcaagtgtcatgtcaaattgtaatctccagtgttggaggtgggcctagtggggtgagggtcatgggggtggatttccttctccgtgcagttcttgcgatagt

SEQ ID NO: 13340 - DNA, 267 bp, Homo sapiens
  AF093117.1_57685
  Located on chromosome 7
  Distance between a terminus base of telomere on chromosomal short arm and 5'-terminus of this base sequence : 160457268
  Distance between 3'-terminus of neighbour sequence of sequence listing upward to telomere on chrosomal short arm and 5'-terminus of this base sequence : 208261
tgctgacgatatggttatttacctaaaaccctaaagactcttccagaaagctcctagaactgataaaataatttagcaaagtttctgtttccaaaattgatgtacacaaatcagtagctcttctatataccaacagcagcgaccaagatgagaatcaaatcaataactcaatcccttttacaatagctgcaaaaaaataaaataaaataaaataaaataaaataaaataaaataaaataaaatatttaggaatatacctaaccaagg

SEQ ID NO: 13341 - DNA, 461 bp, Homo sapiens
  chr7.fa.O7frz.163764148
  Located on chromosome 7
  Distance between a terminus base of telomere on chromosomal short arm and 5'-terminus of this base sequence : 160654877
  Distance between 3'-terminus of neighbour sequence of sequence listing upward to telomere on chrosomal short arm and 5'-terminus of this base sequence : 197342
ctcagttgacttccaagtatctattgtaagaaatccaaatttgtggcagggcgtggtggctcatgcctgtaatcccagcactttgggaggccgaggcgggcagatcatgaggtcaggagatcaggaccatcctggctaatatggtgaaaccctgtctctactaaaaatacaaaaaattagccaggtgtggtggcatgtgcctatattcccatctactcgggaggctgaggaaggagaatcacttgagcccaggaggggaggttgcagtgagcccaggtcgtgccactgcactccagtctgggcaacaagagtgaaactccatcaaaaaaaaaaaagaatgaaagaaagaaagaaaaagaaggaaagaaagaaagaaagaaagaaagaaagaaagaaagaaagaaagaaagaaagaaagaaagaaagaaaaaagaaagaaatccaaatttgtaaatcctttc

SEQ ID NO: 13342 - DNA, 176 bp, Homo sapiens
  D7S2465
  Located on chromosome 7
  Distance between a terminus base of telomere on chromosomal short arm and 5'-terminus of this base sequence : 160726654
  Distance between 3'-terminus of neighbour sequence of sequence listing upward to telomere on chrosomal short arm and 5'-terminus of this base sequence : 71316
cttcaaagagtttatgcttatgtgggtgatgtaggtcaagatttactgtattagaaatcaaaacaatttggagtatatatatatgtgtgtgtgtgtgtgtgtgtgtgtgtgtgtgtgtgtgtgtgtgtgtataatttttttttctttgagatggagtctcactctgttgcccaggt

SEQ ID NO: 13343 - DNA, 181 bp, Homo sapiens
  AC005534.2_128577
  Located on chromosome 7
  Distance between a terminus base of telomere on chromosomal short arm and 5'-terminus of this base sequence : 160992782
  Distance between 3'-terminus of neighbour sequence of sequence listing upward to telomere on chrosomal short arm and 5'-terminus of this base sequence : 265952
ttcacttgttaccatacaaatgactgataagctgtcactagatcaaatgtcaagtaaacgtgaaagcttgtgtggccattcattgagccagtattgccactataaatacacacacacacacacacacacacatacatacacatctatacacacatatatgtaatgctttggaaacactgtc

SEQ ID NO: 13344 - DNA, 291 bp, Homo sapiens
  AC005534.2_36494
  Located on chromosome 7
  Distance between a terminus base of telomere on chromosomal short arm and 5'-terminus of this base sequence : 161084815
  Distance between 3'-terminus of neighbour sequence of sequence listing upward to telomere on chrosomal short arm and 5'-terminus of this base sequence : 91852
aaactgaagtctgccatctattaggaggccacaaagtaacttagtgtctgtgtctagtatttttaaaaataataaaacagaagatgccagcatgcacacttaggaaaaacaagtactgtcttgttaaatttttgcttatacgtatctgagagacagagagagagagagagagagagagagagtgtgtgtgtgtgtgtgtgtgtaatgggttatttcttactgtggtcaaaaagttgaaagccactgtaagtaggcttctgtctgccagtaaattaaccagatgctaacagc

SEQ ID NO: 13345 - DNA, 233 bp, Homo sapiens
  AC004975.2_55735
  Located on chromosome 7
  Distance between a terminus base of telomere on chromosomal short arm and 5'-terminus of this base sequence : 161668759
  Distance between 3'-terminus of neighbour sequence of sequence listing upward to telomere on chrosomal short arm and 5'-terminus of this base sequence : 583653
acatgttcggcctgttaagcacagagacacacacctggtattacaggggtgcgccaacatgctcggcctgttacacacacacacacacacacctggtactacaggtgtaagccaacatgcttggcctgttacacacacacacacacacacacctggtattacaggtgtgagccaacatgctcggcctgttacacacacacacctggtactacaggtgtgagtcaacatgctcg

SEQ ID NO: 13346 - DNA, 346 bp, Homo sapiens
  chr7.fa.O7frz.165047450
  Located on chromosome 7
  Distance between a terminus base of telomere on chromosomal short arm and 5'-terminus of this base sequence : 161972364
  Distance between 3'-terminus of neighbour sequence of sequence listing upward to telomere on chrosomal short arm and 5'-terminus of this base sequence : 303372
cacatcctttatacctacattcaggatcacacacatacatcatacacatgcatacacacagaacactcacagctcacactgcacacaaacattccacacccatatcacacactcatacaccacacacatgcacacacctatgtgcatgcacacacaggtacacacggcatgcataggcccacacaacacccacacccatcacacacactcccacacacacacacacacacactctcctgggccttcagtgctgagtttttacttcacacctttcctggatgatcttaactaaagacttatgaaaattataagcaggtttttttttgctgaccttctagataaatta

SEQ ID NO: 13347 - DNA, 245 bp, Homo sapiens
  D7S2423
  Located on chromosome 7
  Distance between a terminus base of telomere on chromosomal short arm and 5'-terminus of this base sequence : 162219816
  Distance between 3'-terminus of neighbour sequence of sequence listing upward to telomere on chrosomal short arm and 5'-terminus of this base sequence : 247106
gctctcagacacattttccatgaaaagaagaaaatagcaaattccagtaagcattaaggaaactccttctctgggagtctctgttcctctcccccacagtgcttcttatactgtgcatttgaaaggtgttttaaaaggacttgttgtttctttaagaagcatagaaaaaatatatatactcctgtgtgtgtgtgtgtgtgtgtgtgtgtgcgtgtgcaaatacatcatcaactgaaggtctgaag

SEQ ID NO: 13348 - DNA, 114 bp, Homo sapiens
  DISD22_0005539
  Located on chromosome 7
  Distance between a terminus base of telomere on chromosomal short arm and 5'-terminus of this base sequence : 162624020
  Distance between 3'-terminus of neighbour sequence of sequence listing upward to telomere on chrosomal short arm and 5'-terminus of this base sequence : 403959
cttggagtcaaagaggccgcaatccggaaacaccagcgtgtacacacacacacacacacacacacacacacacacaactaaagcagcctctctctaatcaaggagtcaggaaag

SEQ ID NO: 13349 - DNA, 125 bp, Homo sapiens
  DISD22_0005544
  Located on chromosome 7
  Distance between a terminus base of telomere on chromosomal short arm and 5'-terminus of this base sequence : 163066251
  Distance between 3'-terminus of neighbour sequence of sequence listing upward to telomere on chrosomal short arm and 5'-terminus of this base sequence : 442117
cttagcctggactctgggtgagagagagagagagagagagagagagagagagagtaaacacacacacttagtgtgaatgaggtttttgtggggtgcgaatttgagaaagcgtcattaattcactc

SEQ ID NO: 13350 - DNA, 447 bp, Homo sapiens
  chr4.fa.O7frz.189436942
  Located on chromosome 7
  Distance between a terminus base of telomere on chromosomal short arm and 5'-terminus of this base sequence : 163148948
  Distance between 3'-terminus of neighbour sequence of sequence listing upward to telomere on chrosomal short arm and 5'-terminus of this base sequence : 82572
gaggtcaggagtttgagactagcctgaccaacacggtgaaacctcgtctctaccaaaaccacaaaaattatctgggcatggtagcacacaccctgtaatcccagctactcaggaggctgagtgaggtggggagaattgcttgaacccgggaggtggaggttgcagtgagctgagattgcaccactgcactccagcctgggtgacagtgcaagactctgtctaaaatatatatatatatatatatatatatatatatatatatatatatatatatatatatatatatatttgcagacctacaatctatggtacatggcatgtgttttgtgactgggagttgggggacagttggagatgaggctgaaaagtaggcatgatcccatttgtaaagggccttgaatgttgtgatacaaagattaaaatttaaagtgtaagtcactgaaatgg

SEQ ID NO: 13351 - DNA, 243 bp, Homo sapiens
  DISD22_0005550
  Located on chromosome 7
  Distance between a terminus base of telomere on chromosomal short arm and 5'-terminus of this base sequence : 163548581
  Distance between 3'-terminus of neighbour sequence of sequence listing upward to telomere on chrosomal short arm and 5'-terminus of this base sequence : 399186
tcaatttccatagaggagaggaaaagagaagtattctgtccttccatgcatccatgcatctatccatccatccatccatccatctatccatcaatttatgcatgcatccatctatgcatccttccatccatccatccatccatgtacctatgcatcatccatctatccatgcatgcatgcatgcatccatccatccacatgttcatccatccatcattccattcattcatccattatccatgc

SEQ ID NO: 13352 - DNA, 263 bp, Homo sapiens
  AF027390.1_156
  Located on chromosome 7
  Distance between a terminus base of telomere on chromosomal short arm and 5'-terminus of this base sequence : 163672390
  Distance between 3'-terminus of neighbour sequence of sequence listing upward to telomere on chrosomal short arm and 5'-terminus of this base sequence : 123566
tcctacttgtccatggtatttatactatatttgagacctctaaaattttaccttttacttaaacctcagtatcagaaaagcaatgtgctagccttggtcggtaaaaacaaacaaacaaacaaacaaacaaacaaacaatcagttttcctttcagcacatgccacccagacctgtgcaataattgcaggaatacatccatagagaacacacagctttggtgtgaacaaaggagtgttttactttcaagaatacagaaatgtctc

SEQ ID NO: 13353 - DNA, 389 bp, Homo sapiens
  chr8.fa.O7frz.564366
  Located on chromosome 8
  Distance between a terminus base of telomere on chromosomal short arm and 5'-terminus of this base sequence : 264534
  Distance between 3'-terminus of neighbour sequence of sequence listing upward to telomere on chrosomal short arm and 5'-terminus of this base sequence : 0
cttcactagcaaattctatcagacatttaaaaaggcagggcacagtggctcacacctgtaatcccagaactttgggaggctgaggtgggaggatcacttgagcccaggagtttcagaccagccttggcaacatagtgagaccgtgtctctataaaaaaatttttttaaaaaatagccaggtgtagtggtgcacacctgtggtcccagcagctcaggatgctgaggtggaaggattgcttgagcccaggaattcaaggctgcagtgagccatgattgtaccactgtactccaacctgggcaacagaggagatccgctctcaataaataaataaataaataaataaataaaacatcaatactaatcaataccaatactgtcaataccaatc

SEQ ID NO: 13354 - DNA, 116 bp, Homo sapiens
  Z66711
  Located on chromosome 8
  Distance between a terminus base of telomere on chromosomal short arm and 5'-terminus of this base sequence : 389772
  Distance between 3'-terminus of neighbour sequence of sequence listing upward to telomere on chrosomal short arm and 5'-terminus of this base sequence : 124849
agctaatttcttactttgagattgctatccactatttttatatatacctgtgtgtgtgtgtgtgtgtgtgtgtgtgtgtgtgtgtgtgtgtgtaatccaaatcagttgttctacct

SEQ ID NO: 13355 - DNA, 445 bp, Homo sapiens
  AC026950.3_58799
  Located on chromosome 8
  Distance between a terminus base of telomere on chromosomal short arm and 5'-terminus of this base sequence : 657567
  Distance between 3'-terminus of neighbour sequence of sequence listing upward to telomere on chrosomal short arm and 5'-terminus of this base sequence : 267679
gacgctgtccagtaacaacaataacaaaagagaatcagtctgggtgcagtagctcgcacctgtaattccagcactttgggaggccaaggcaggagcacagcttgagcccaggagttcgagagcagcctggggattatagggagacttcacctctataaaaattcaaaaattagctgggtgtggtggcgcacacctgtagtctcagctacttgaggggctgaggtggaaagattgtttgtgcctgagaagtggaggttctagtgaactgtggttgcaccactgcactccagcctgggtgatggagtgagactgtcaggaagaaaggaaggaaggaaggaaggaagggagggagggagggatggagggagggagggaacaatactgatgtccaaaccttagtgggtaaaataggcaaaaggggtgactcaacagtcgctttactatc

SEQ ID NO: 13356 - DNA, 199 bp, Homo sapiens
  D8S504
  Located on chromosome 8
  Distance between a terminus base of telomere on chromosomal short arm and 5'-terminus of this base sequence : 707291
  Distance between 3'-terminus of neighbour sequence of sequence listing upward to telomere on chrosomal short arm and 5'-terminus of this base sequence : 49279
catgcccattttccagatgggaaaaccaagactcaggtggttgagtgacgtgtgtgtgtgtgtgtgtgtgtgtgtgtgtgtgtgtgtgtgtgacttaatatttttagcacagttttaggtacccagcaaaattaagtggaaagtgcagacagttcccatatggcccctgccccacccacgccctccctcgtgacccagt

SEQ ID NO: 13357 - DNA, 112 bp, Homo sapiens
  DISD22_0005557
  Located on chromosome 8
  Distance between a terminus base of telomere on chromosomal short arm and 5'-terminus of this base sequence : 825344
  Distance between 3'-terminus of neighbour sequence of sequence listing upward to telomere on chrosomal short arm and 5'-terminus of this base sequence : 117854
agtggaagaacaatgtaaactagctgtaaacacacacactcacactcacacacacacacacactcacactcacacacacacactcacacacattcaggagatccagtcagca

SEQ ID NO: 13358 - DNA, 458 bp, Homo sapiens
  chr8.fa.O7frz.1416891
  Located on chromosome 8
  Distance between a terminus base of telomere on chromosomal short arm and 5'-terminus of this base sequence : 1089484
  Distance between 3'-terminus of neighbour sequence of sequence listing upward to telomere on chrosomal short arm and 5'-terminus of this base sequence : 264028
tactcaaggagtacgacatgatgatttgatgtctgtgcaccttgtgcagtgatgaccacaactgggtaaattaacacacctgtcctcatccaggctggacggtgcagccccagaccttgcccatcctgtgacttgaatttatatcctttggttagcatctccccgttccgctttccctgggccctggcgcccactcttctactctgtgcttctgggaatctgggtttttctagttccacaagtaagtgaggccactcagtgtttgcctttctgtgcctggcctatttcactcagcatcatgtcctccagctccatcgcgttgccgtgaatgctgggattttcttccttagtaaatctgagggttattctagtgtgtgtgtgtgtgtgtgtgtgtgtgtgtgtgtgtgtgtgtttgtatcacattttcaaagtgagcgtagccattcagataggaattc

SEQ ID NO: 13359 - DNA, 221 bp, Homo sapiens
  DISO7_10002525
  Located on chromosome 8
  Distance between a terminus base of telomere on chromosomal short arm and 5'-terminus of this base sequence : 1409591
  Distance between 3'-terminus of neighbour sequence of sequence listing upward to telomere on chrosomal short arm and 5'-terminus of this base sequence : 319649
acatctgcagcagagctgcccgtcccactgcccaggtgcagcgggagtcggcgggcatcgatgtgaagactgtgtgcttcatacccagtaaaattagaatcagctcaaaactaatttcctccctccgcgttctctctctctctctctctctctgtctctctctctctctctttcctttttttggtctaagtcagggaggggaaggtaggtaggagctgcta

SEQ ID NO: 13360 - DNA, 270 bp, Homo sapiens
  Z66890
  Located on chromosome 8
  Distance between a terminus base of telomere on chromosomal short arm and 5'-terminus of this base sequence : 1564910
  Distance between 3'-terminus of neighbour sequence of sequence listing upward to telomere on chrosomal short arm and 5'-terminus of this base sequence : 155098
ctgatgatgagtcccaaggtacattgttctactgttttatacccaggtagaagttacacagcaatttagcaatgttgttaacagacatacagaattgtgtgtgtgtgtgtgtgtgtgtgtgtgagtgttttgatataaacgtgcaattaaaattcaaagtttattttttatcacaagcacctttgaaatgtacgtggaaaacgtcggctgctcgtgagaatcatgtgtgacttacgttccttatgttttatggaactctcggaacagtgt

SEQ ID NO: 13361 - DNA, 188 bp, Homo sapiens
  DISO7_00037451
  Located on chromosome 8
  Distance between a terminus base of telomere on chromosomal short arm and 5'-terminus of this base sequence : 1579777
  Distance between 3'-terminus of neighbour sequence of sequence listing upward to telomere on chrosomal short arm and 5'-terminus of this base sequence : 14597
actcctaggtcccagatccccagatctggaggaaaggggccccttctgccaggcttcctccctgggtcacaaactcacatctgcctggactcccactgctgtctctctctttctctctctctcccctctttttaactgtccactaggttttatggataactcctgagagaatgtcccagtctgcttac

SEQ ID NO: 13362 - DNA, 211 bp, Homo sapiens
  chr8.fa.O7frz.2065337
  Located on chromosome 8
  Distance between a terminus base of telomere on chromosomal short arm and 5'-terminus of this base sequence : 1796430
  Distance between 3'-terminus of neighbour sequence of sequence listing upward to telomere on chrosomal short arm and 5'-terminus of this base sequence : 216465
ccgacttgatcttcacttaaagaaaacaaaccataaagtcagaatatccaggcacagcccaagtcactaggatgccaactgccctgcagagtgtgtgtgtgtgtgtgtgtgtgtgtcaaaatatatatatatatgttactatacaggaaatcacatattttcccagctattattataggacatcccaagttcaagctttcactcataactc

SEQ ID NO: 13363 - DNA, 434 bp, Homo sapiens
  chr8.fa.O7frz.2358221
  Located on chromosome 8
  Distance between a terminus base of telomere on chromosomal short arm and 5'-terminus of this base sequence : 1953366
  Distance between 3'-terminus of neighbour sequence of sequence listing upward to telomere on chrosomal short arm and 5'-terminus of this base sequence : 156725
gttagcaaatcagctgctaagaagccagatgaataagccaattagaaaattccttccttccttctttccttccttccttcctttctttccttccttccttctttccttccttccttctttccttccttccttccttctttccttcctttcttctttccttccttccttccttctttctttccttccttccttctttccttccttccttccttccttccttccttccttccttcattccttccttccttccttccctccctgcctcccgccttctttcctgccttcctacctttctttttttaatgaaattaaattttggaccttagaaaaccaacagaagaaaaaagtcattctagtttcccgagcctcttttgagggttgataggagatggcctctcaaggctcaaggccacagtgagactagctgaagatgg

SEQ ID NO: 13364 - DNA, 131 bp, Homo sapiens
  D8S264
  Located on chromosome 8
  Distance between a terminus base of telomere on chromosomal short arm and 5'-terminus of this base sequence : 2035561
  Distance between 3'-terminus of neighbour sequence of sequence listing upward to telomere on chrosomal short arm and 5'-terminus of this base sequence : 81761
acatctgcgtcgtcttcatactccattccagaggagttgccatcttgctgggtcatgacacacacacacacacacacacacacacacgcacacacacacactctcttactttatgctgactcaggtgttgg

SEQ ID NO: 13365 - DNA, 350 bp, Homo sapiens
  AC023200.2_17983
  Located on chromosome 8
  Distance between a terminus base of telomere on chromosomal short arm and 5'-terminus of this base sequence : 2234079
  Distance between 3'-terminus of neighbour sequence of sequence listing upward to telomere on chrosomal short arm and 5'-terminus of this base sequence : 198387
cggaagctgtattaacgacaaaagattacatgggaatattatttatttatttgtttatttatttatttatttatttatttatttatttatttttgcagtccaggagattaaagatacaattcagatgaactgttacaaggtaactccatgtcaacagctgaactctgatcgggtcaagggatacattggcaatgaagggtatgtaaacatcacgtttcctctgcaggcagagatggatgcattttaaggaggaaaattaattcatacaaagtagaaatacataggaatcataaaatccagaagtaggtacacaggaagaggagacgctttgctatttctaaacataacca

SEQ ID NO: 13366 - DNA, 301 bp, Homo sapiens
  chr8.fa.O7frz.2756054
  Located on chromosome 8
  Distance between a terminus base of telomere on chromosomal short arm and 5'-terminus of this base sequence : 2430783
  Distance between 3'-terminus of neighbour sequence of sequence listing upward to telomere on chrosomal short arm and 5'-terminus of this base sequence : 196354
tacatatttggtaagccactctatgaaaaagtcattataaagtttgtctaaaactcatatatatatatatatatgtgtatatatatgtatatatatgtatatatgtatatatgtgtatatatgtatatatatgtatatatgtatatatatttgcatatatttacatagacatatagagagagagagagagagaggagagattgatatttattatattttgagaaaatggctcagtttactgggcaggccagtgggctggctatttatttaggtgacagttgaggtgacagtctttagtatg

SEQ ID NO: 13367 - DNA, 411 bp, Homo sapiens
  AC055749.9_110132
  Located on chromosome 8
  Distance between a terminus base of telomere on chromosomal short arm and 5'-terminus of this base sequence : 2622202
  Distance between 3'-terminus of neighbour sequence of sequence listing upward to telomere on chrosomal short arm and 5'-terminus of this base sequence : 191118
ttatgtcacaggtttacaacctgaagcattctcataaacgaaacaggcctgcatcttcagcccccaggcagaagggatgtttgcaccatcccacagaaaccttctctcttgctccttgtgagcctgtagcccccaacggcacacacacacacacacacacagacacacacacacaacaaagggcgtcgatgtctctccttccacccgctgtcctccaaggcgactgcacgcagatgctgcaggcattgttaaggctcctcctgcacagaactgctgtacctcctgatctccctcctgtggctgtgtccaccactgtggagggccgtgccaggcagggaattcagccaggcgaccaagcaagtgacggggcactgtgtccacccagcaaaggcatgtaggtgactgagctgg

SEQ ID NO: 13368 - DNA, 291 bp, Homo sapiens
  chr8.fa.O7frz.3520202
  Located on chromosome 8
  Distance between a terminus base of telomere on chromosomal short arm and 5'-terminus of this base sequence : 2894565
  Distance between 3'-terminus of neighbour sequence of sequence listing upward to telomere on chrosomal short arm and 5'-terminus of this base sequence : 271952
caggcaagcagatctgtatccattttgttgtgggaagttgcttcctctctgatgttctctctctctctctctctctgtctctctctctctgtttttctctctcgtgcttcaagtagggaatgattagtgagtgatactgtttgctaagtagtaagaaaataaagaaggggaacacagaaagagtgtttcatagaaaaatgctggcaatgtctagagacatattgctcactggtttagtctccagtttcctctcttttttgctcctacctagatttccagtttaacagacct

SEQ ID NO: 13369 - DNA, 323 bp, Homo sapiens
  chr8.fa.O7frz.3303834
  Located on chromosome 8
  Distance between a terminus base of telomere on chromosomal short arm and 5'-terminus of this base sequence : 2922835
  Distance between 3'-terminus of neighbour sequence of sequence listing upward to telomere on chrosomal short arm and 5'-terminus of this base sequence : 27979
caaatgccatgattatagacagctataaatgtggacctctgcacccagacttctatgtcacagtgtgtaaggagtcagtaagtcttcatcacacacacacacacacacacaaatatatatatatatggaaaacgccattaataacatagtaccttatgaaaagaaaagaaactgttttatttatcatctgggaaatttagattgtagaggtaaaaagattttgtctcatctgtaaactgttggcaggtttgacacatatcttaaatgctatttctattatttccacttgttacatcctgcagtctcttcaaagcataaaggag

SEQ ID NO: 13370 - DNA, 458 bp, Homo sapiens
  chr8.fa.O7frz.3430058
  Located on chromosome 8
  Distance between a terminus base of telomere on chromosomal short arm and 5'-terminus of this base sequence : 3049258
  Distance between 3'-terminus of neighbour sequence of sequence listing upward to telomere on chrosomal short arm and 5'-terminus of this base sequence : 126100
cttgtatcactttcaatttgcttttattttatttatttattttattttatttgagatggagtcttgctttgttgcccaggttggagtgcagtggtgtgatcttggctcactggaagctctgccacccgggttcatgccattctcctgcctcagcctcccgagtagctgggactacaggtgcccaccaccacacatggctaatttttttgtattttttagtagacacggggtttcactgtgttagccaggaaggtctcgatctcctgaccttgtgatccacccgcctcggcctcccaaagtgctgggattagaggtgtgagccactgagcccagcctcaatttgcttttgtactattatgggagagaccgttatactgaaaaaaaggtagaactttgttaatttactttaaaactgtaagtgttttattttcgtagttccttactaaaggtcagtttgt

SEQ ID NO: 13371 - DNA, 128 bp, Homo sapiens
  D8S1806
  Located on chromosome 8
  Distance between a terminus base of telomere on chromosomal short arm and 5'-terminus of this base sequence : 3193626
  Distance between 3'-terminus of neighbour sequence of sequence listing upward to telomere on chrosomal short arm and 5'-terminus of this base sequence : 143910
cctaactctgtgactctgtgtgtgtatctgtgtgtgtgtgtctgtgtgtgtgtgtgtaattgtagagtcttaagagttctttatgagttcttatcagatacgtggtttgaaaatgttatcttccagtc

SEQ ID NO: 13372 - DNA, 425 bp, Homo sapiens
  AC026292.7_23949
  Located on chromosome 8
  Distance between a terminus base of telomere on chromosomal short arm and 5'-terminus of this base sequence : 3239856
  Distance between 3'-terminus of neighbour sequence of sequence listing upward to telomere on chrosomal short arm and 5'-terminus of this base sequence : 46102
ggtattagaaattacctgtcttgactgtggcggatacaggaacttaaacaggtagtgaaattgtatagaacttcataacaatacacacacacacagagagagagagagagagagagagagggagagagagaaacacaaatgaatacaaataaaacaggaaattaaatgagctgggtgtggtggcgcatgctggttatcccagctactcctgagactgaggcatgagaatcccttgaacttgagaggcagcagttgcagtgagttgagattgtgccactgcactacagcctgggtgacagagcgagactcagcctcaaaaaaataaaataaaataaaataaaataaaataaaataaaataaaataaaataaaataaaataaaacaggaaatctgaataagatcagtggatcatatcaaggtgaata

SEQ ID NO: 13373 - DNA, 385 bp, Homo sapiens
  AC022910.2_30286
  Located on chromosome 8
  Distance between a terminus base of telomere on chromosomal short arm and 5'-terminus of this base sequence : 3319923
  Distance between 3'-terminus of neighbour sequence of sequence listing upward to telomere on chrosomal short arm and 5'-terminus of this base sequence : 79642
gaaacggagtaaatcctgtaaacttttctcccaggatgttttttgaatgttttgtcgtcctcagtgtccataaataactcctacacaaacctagacattcattcactcacacctgctaaatagttgcaagtctattgtctacagctgtgctgttattctttacctctgtaacactttacgttgtacactgataagggattagtcttcttagaaatgctggctccacagtatatttgtgtgtgtgtgtgtgtgtgtgtgtgtgtgtgtataatacatgtttgcaagcaaatcaaaagcatggcccttgttctccattttatttctcagctccaagaggaggcagtaaaaataaatctatttagttctgaaagttaagaactgaggt

SEQ ID NO: 13374 - DNA, 199 bp, Homo sapiens
  Z67618
  Located on chromosome 8
  Distance between a terminus base of telomere on chromosomal short arm and 5'-terminus of this base sequence : 3354734
  Distance between 3'-terminus of neighbour sequence of sequence listing upward to telomere on chrosomal short arm and 5'-terminus of this base sequence : 34426
aaagctgacattggattgcaattgcttactgctgtgtgtgtgtgtgtgtgtgtgtgtctgtgtgtgtgtctgtgtgtgtgtgtgtgtgagatgagggatactgtatatatttaaaggtcctaaatgataaacaaagtgaaatgattactgcagtcaagcaaatgaatgtatccacctcctcatgtggctacgtgtgtat

SEQ ID NO: 13375 - DNA, 232 bp, Homo sapiens
  D8S1824
  Located on chromosome 8
  Distance between a terminus base of telomere on chromosomal short arm and 5'-terminus of this base sequence : 3450638
  Distance between 3'-terminus of neighbour sequence of sequence listing upward to telomere on chrosomal short arm and 5'-terminus of this base sequence : 95705
tgaaaattgtatcctacctgagtttttaaagatgattaggacattagacgaagacatgaaagggaatttggaagagaaaaagtcacgtggaagaaagaacatcacaaaagaattggaggccctgcgtgtgtgtgtgtgtgtgtgtgtgtgtgtgtggttattgaagaagtgtagtacaaggatattgcaggagcacagggggacatatttccaaggacctcgaagacactgt

SEQ ID NO: 13376 - DNA, 363 bp, Homo sapiens
  AC022846.2_119168
  Located on chromosome 8
  Distance between a terminus base of telomere on chromosomal short arm and 5'-terminus of this base sequence : 3459072
  Distance between 3'-terminus of neighbour sequence of sequence listing upward to telomere on chrosomal short arm and 5'-terminus of this base sequence : 8202
gattaggaggcataaatgaaagaatctatagggcttttgttccaaagcacagagagattcctttctcccttttcattcattcattcattcattcattcattcattcattcattcatcagtagatactggttgtgtactggtagcttgggctgtcaggggatgaggaggtatggtgtgtgatctgtgggtcatggatgggaaaaccccaaactttcaaggggctcatcttgaactaaaggtacaatcaaggtaggtctggtagaaaaatttcactggcctagcaggaagaagcagaggaagagatgagcctgcaggatgtgcacgacttccaaacacaggcactttcatctttcaagtgaaaga

SEQ ID NO: 13377 - DNA, 211 bp, Homo sapiens
  D8S1788
  Located on chromosome 8
  Distance between a terminus base of telomere on chromosomal short arm and 5'-terminus of this base sequence : 3534753
  Distance between 3'-terminus of neighbour sequence of sequence listing upward to telomere on chrosomal short arm and 5'-terminus of this base sequence : 75318
aagactcctaatgtctatttttcagataaataaaatattttcactatgcgtgcatacttgtgtgtgtgtgtgtgtgtgtgtgtgtgtgtgtgtgtatgtgcagtatttgagagggtgaataagacagaactcactgtgtgccttctagaaggtgaggactagcaagggtattatctatttgcttgagcttttatgaaactaggcttgaact

SEQ ID NO: 13378 - DNA, 120 bp, Homo sapiens
  D8S262
  Located on chromosome 8
  Distance between a terminus base of telomere on chromosomal short arm and 5'-terminus of this base sequence : 3679876
  Distance between 3'-terminus of neighbour sequence of sequence listing upward to telomere on chrosomal short arm and 5'-terminus of this base sequence : 144912
agctcaaaagcgaaggtgatttctacacacacacacacacacacacacacacacttgtatgtatataaacgccaacatgcgtaacatatatatgctgagacaggatctcactttgttgcc

SEQ ID NO: 13379 - DNA, 395 bp, Homo sapiens
  chr8.fa.O7frz.4702436
  Located on chromosome 8
  Distance between a terminus base of telomere on chromosomal short arm and 5'-terminus of this base sequence : 3907451
  Distance between 3'-terminus of neighbour sequence of sequence listing upward to telomere on chrosomal short arm and 5'-terminus of this base sequence : 227455
aactcatgtgtatttcagtctgactctagtgttcatcaaagtcatctaagtggtaggcacatgtattctggagtgggaggaagggaggaaggagagagacataaagtggaatattctgaaaacaaaatgatcttctacccaaagcccttgggaacggtcctgctcatggaataggaacaatcttggaaactcaggaaatattgcggaaaaaataaattgaaattaaaatggcatttttcccagggaattcttaagaatcattatagctaactcagattagtggtagcgtaaatgcagggaaggcaacattgtgatatgtcattcattcattcattcattcattccacaaatatttatagaatgcaaattatgttgaatatttactgaatgcgtat

SEQ ID NO: 13380 - DNA, 374 bp, Homo sapiens
  chr8.fa.O7frz.5872365
  Located on chromosome 8
  Distance between a terminus base of telomere on chromosomal short arm and 5'-terminus of this base sequence : 4086136
  Distance between 3'-terminus of neighbour sequence of sequence listing upward to telomere on chrosomal short arm and 5'-terminus of this base sequence : 178290
ttgcatgacattcttagatgtaaagtggcacaatatgatcagcctaaatgaaagttttaactgtgcatatatttggattcttctattaagattgtaattaattataattgtctaataatttcttatttggtagaatttatttgaatgtgaatttcatgttgagttatttgatagattcaagttcaagaggtatgttaaaataaattttcccatgaatatttagttttacctactcaagtaagctggaaggttagagctgacaggcggacacacacacacacacacacacacacacacacacacacacgccaacacacatacacacttgctagcatgagagtttcatttttctgttacttggcatcttactctta

SEQ ID NO: 13381 - DNA, 132 bp, Homo sapiens
  chr8.fa.O7frz.5979488
  Located on chromosome 8
  Distance between a terminus base of telomere on chromosomal short arm and 5'-terminus of this base sequence : 4173512
  Distance between 3'-terminus of neighbour sequence of sequence listing upward to telomere on chrosomal short arm and 5'-terminus of this base sequence : 87002
taacacttaactcacaaatggtaatgtaatagtacattacattgcttttgtgtgtgtgtgtgtgtgtgtgtgaaaatgtaatacaaccagtagcataagtaaaagtgattgtggactggagtttagaatcat

SEQ ID NO: 13382 - DNA, 183 bp, Homo sapiens
  chr8.fa.O7frz.3866348
  Located on chromosome 8
  Distance between a terminus base of telomere on chromosomal short arm and 5'-terminus of this base sequence : 4267758
  Distance between 3'-terminus of neighbour sequence of sequence listing upward to telomere on chrosomal short arm and 5'-terminus of this base sequence : 94114
ggtaagaaactccatttcaaataaataaataaatataccttttgtggacacaggaacaaaccacttcatacacacacacacacacacgcacacacacacacgtatatatgatatatatacacacacacaaaactctacaaaaatgacgcgttaagagtgttcttaacagaagtagcgaattca

SEQ ID NO: 13383 - DNA, 470 bp, Homo sapiens
  AC073477.3_18550
  Located on chromosome 8
  Distance between a terminus base of telomere on chromosomal short arm and 5'-terminus of this base sequence : 4324258
  Distance between 3'-terminus of neighbour sequence of sequence listing upward to telomere on chrosomal short arm and 5'-terminus of this base sequence : 56317
acgttcacatacctatccaagtactttatcttttcaccaaaatggaatcacgtggcatatgcattcacatagctatgcaaatacttttatttatatttttaccaaaatggaattatgttgcattttttttcactttaatgtaccatgcacatcttctgaggtcaatacacataggactaaaaggaattatttttaatagtactagaacttacgatttttgatgaaaagtacacagcaacatagctaagggtgtgtgtgtgtgtgtgtgtgtgtgtgtgtgtgtagccagggcaaatgattagctaaatatctcaatgtgcctctgatatagttcagatatttctcaacgtgcaagagtgcgtgcgtgtgtgtgcatgtgtgtttagccagggcaaatgattagctaaatatctcaatgtgcctctgatatagttcggatatctgtcaacgtgcaaacctcatgttaaatt

SEQ ID NO: 13384 - DNA, 108 bp, Homo sapiens
  DISO7_10018160
  Located on chromosome 8
  Distance between a terminus base of telomere on chromosomal short arm and 5'-terminus of this base sequence : 4324484
  Distance between 3'-terminus of neighbour sequence of sequence listing upward to telomere on chrosomal short arm and 5'-terminus of this base sequence : -244
agtacacagcaacatagctaagggtgtgtgtgtgtgtgtgtgtgtgtgtgtgtgtgtagccagggcaaatgattagctaaatatctcaatgtgcctctgatatagttc

SEQ ID NO: 13385 - DNA, 251 bp, Homo sapiens
  D8S518
  Located on chromosome 8
  Distance between a terminus base of telomere on chromosomal short arm and 5'-terminus of this base sequence : 4542426
  Distance between 3'-terminus of neighbour sequence of sequence listing upward to telomere on chrosomal short arm and 5'-terminus of this base sequence : 217834
taccgcaaaacacaccaccacagcatgaggaggtagttgtctgaattcacatgcctgtcaaaacttcctcatagtattgcaaacataattattatctctcttacatgttttcttattttatcacagaatttctaattactagtcattttatcctttttcttaacaaataagcacacagcaaatacacacacacacacacacacacacacacacacacacacactctcacagttgttgtcaactaaggctgc

SEQ ID NO: 13386 - DNA, 195 bp, Homo sapiens
  Z23706.1_187
  Located on chromosome 8
  Distance between a terminus base of telomere on chromosomal short arm and 5'-terminus of this base sequence : 4542486
  Distance between 3'-terminus of neighbour sequence of sequence listing upward to telomere on chrosomal short arm and 5'-terminus of this base sequence : -191
aaacttcctcatagtattgcaaacataattattatctctcttacatgttttcttattttatcacagaatttctaattactagtcattttatcctttttcttaacaaataagcacacagcaaatacacacacacacacacacacacacacacacacacacacactctcacagttgttgtcaactaaggctgcataa

SEQ ID NO: 13387 - DNA, 178 bp, Homo sapiens
  Z66873
  Located on chromosome 8
  Distance between a terminus base of telomere on chromosomal short arm and 5'-terminus of this base sequence : 4726482
  Distance between 3'-terminus of neighbour sequence of sequence listing upward to telomere on chrosomal short arm and 5'-terminus of this base sequence : 183801
tattacggcctcagcctatttcttggaatatataacgaattccgtgaaaactgcaagaaaattaggtttcttccatcttcagaatgattttgtgtgtgtgtgtgtgtgtgtgcgtgtgcgtgtgcgcatgtgcgcgtgtgtgtatgtgtgtggtgggggatggagattcgctcttaat

SEQ ID NO: 13388 - DNA, 476 bp, Homo sapiens
  chr8.fa.O7frz.5390475
  Located on chromosome 8
  Distance between a terminus base of telomere on chromosomal short arm and 5'-terminus of this base sequence : 4806707
  Distance between 3'-terminus of neighbour sequence of sequence listing upward to telomere on chrosomal short arm and 5'-terminus of this base sequence : 80047
actaattcactgcttgtagattcttaaaaacacttagataatttactttcatattctctctttcactctttctctgcccatttcaggttatgtattttgctttaagagctgcttgggaggctgaggcaggagaatcacttgaacccgggaggcagaggttgcagtgagccgagatcgcaccatcgcattccagcctggggacaacagcgagaactcatctcaaaaaagaaaaaaaaaaaaaaaagctacattggcaatattgtgaatgaaataatattctatccacccattatcatttatctgcaaatatctgcaaagggattttaatgtgtttcattcttgatttaagtcaagttatctgaaagactgtgtgtgtgtgtgtgtgtgtgtgtctgaggaggaccgagggggaccaagtgtgtttgtgtgcacatgtataaaatcttctgacttttaattttatttcctcatgaacg

SEQ ID NO: 13389 - DNA, 424 bp, Homo sapiens
  AF202962.2_42988
  Located on chromosome 8
  Distance between a terminus base of telomere on chromosomal short arm and 5'-terminus of this base sequence : 4966422
  Distance between 3'-terminus of neighbour sequence of sequence listing upward to telomere on chrosomal short arm and 5'-terminus of this base sequence : 159239
tctgacggtcctaatttctatcatgagttattttcagtagccagaagaactggaaaataatgttaaaatgctagttgataagacaataaaaagcaaaaaaaaagaaagagagagaaacagagagagaaagaaggaagaaagaaaagaaagaaagagaaaaagaaagagaaagaaaagaagagagaaagaaagaagaaagaaagaaagaaaaaagaaacagaaagaaagaaagaaagaaagaaaaagaaagaaagaaagaaagaaagaaagaaagaaagaaagaaagaaagaaagaaagaaagaaagaaagaaagaaagaaaaagaaattagggtctgaacagaattgtgattctgttcagaggccgaagcatgtgtttgagcaaggaaacacaatgacgagactacatttgtatcctcagctca

SEQ ID NO: 13390 - DNA, 349 bp, Homo sapiens
  chr8.fa.O7frz.5591104
  Located on chromosome 8
  Distance between a terminus base of telomere on chromosomal short arm and 5'-terminus of this base sequence : 5006303
  Distance between 3'-terminus of neighbour sequence of sequence listing upward to telomere on chrosomal short arm and 5'-terminus of this base sequence : 39457
ttggtcttgaactgctgacctcaggtgatccacctgcctcggcttctcaaagtgctgggattacaggcgggagccaccgcgcccgaccccaaatctcaatagacccccattcagttctagttattttgtcagttacctctctgccccaaagacacgcacacacacatacacacgtatacacacacacacacacacacacaccacacatacaaaaagcttttttaaaaccataatttctattacatgaaaataaacttttttactttctttgaaaaaagagttaaacttttcatacgataaaacttaccacacatttttcacaggcgtatttctccattcagaaacttct

SEQ ID NO: 13391 - DNA, 465 bp, Homo sapiens
  chr8.fa.O7frz.5674281
  Located on chromosome 8
  Distance between a terminus base of telomere on chromosomal short arm and 5'-terminus of this base sequence : 5089310
  Distance between 3'-terminus of neighbour sequence of sequence listing upward to telomere on chrosomal short arm and 5'-terminus of this base sequence : 82658
ctcatttatggactaaacagatcttttttatttgactctgcatgattatcttgtgattactggcataaggatgactaaatgataatctcatagaaattaaaaagaaatcaataaacatgggatagaagttccctttattgcttgcttgcttcttttttttttttttttttttttttgtcgcccaggctggagtgcagtggcacaatctcggcttactgcaaggctactcccttccttctttctttctttccttctttctttcttcttgttctcctttctctctttctctctccctccttccttccttccttcgtcttgtctttctgtctttctgtctctgtctctccctctctctctgtctctctcttttttttttttttttttaagaaaagatctcgcagtgttgcccaggctggaatacagtggcttttcagagtcagtgtcctactaatcgtcacctcagga

SEQ ID NO: 13392 - DNA, 437 bp, Homo sapiens
  chr8.fa.O7frz.6190940
  Located on chromosome 8
  Distance between a terminus base of telomere on chromosomal short arm and 5'-terminus of this base sequence : 5286709
  Distance between 3'-terminus of neighbour sequence of sequence listing upward to telomere on chrosomal short arm and 5'-terminus of this base sequence : 196934
atatttctcagatgaatgctgtacttattttgtatttttcataaagtctgataaaataaaacattgtttatatagcagagtcaagatgactaaagtgatagtattttttaaatcataaaatcctaaaatatcagagtaggaaggagctaatttagagatgagcagactgagacttggaaagagaaaagactgtaaattcctcatatcagttagagacatctttaggcatccaatgtaccttccacattttaaattgaaaattagccatatcatttttctttaaaaggtatttcatcatatgcctatttaactctattctccaaatcacaaaaaagagactaaggaaccattctactctgacgtgtgtctgtgtgtgtgtgtgtgtgtgtgtctgtgtgtgtgtgtggtgtatacttctgaatagtttcgtatgaaaa

SEQ ID NO: 13393 - DNA, 405 bp, Homo sapiens
  AC073478.1_31169
  Located on chromosome 8
  Distance between a terminus base of telomere on chromosomal short arm and 5'-terminus of this base sequence : 5354682
  Distance between 3'-terminus of neighbour sequence of sequence listing upward to telomere on chrosomal short arm and 5'-terminus of this base sequence : 67536
  misc_feature (1)...(405): n = A,T,G or C
ctcatgtaacaatctgttatcctcaaatcttcattcaaatatctcaagatggctcaccttctacccagtgatgtctctcaaacttatgccttcaatccatatagtatgctagtagaaaactagcatacaactcctaatgtgtggctgtgaatccatgcatgcgagggtgtacaaagccctaagtgttctagcccagccagctacatccattttctttctttcttttctcttttttttcttttcttttcttttttcttttttctcttcttttccttccttccttccttcctttctctttctttctccctttctttcttccttccttccttccttccttctctttctttcttccttccttctttctttctttttttttttttttggatgaagtttcactcttnnggc

SEQ ID NO: 13394 - DNA, 476 bp, Homo sapiens
  chr8.fa.O7frz.6304865
  Located on chromosome 8
  Distance between a terminus base of telomere on chromosomal short arm and 5'-terminus of this base sequence : 5360050
  Distance between 3'-terminus of neighbour sequence of sequence listing upward to telomere on chrosomal short arm and 5'-terminus of this base sequence : 4963
atggtagactgtgacttagatgactgtttatgcctgttaaatatcaccattttgtttcgtcccctttcttaaaaatgtaaaagttaaaatttattattattattattattattattattattattattattattattatatgacatggagtctcgctctgtctcacccaggctggagtgtagtggtgcgatctcggctcactgtagcttccacctcccgggttcaagcaattctcctacctcagcctcccaaatagctgggattacaggcacacagcaccatactcggctcattttgtatttttagtagagatggggttttgccatgttggcctggctggtctccaactcctgacctcagctaactcatccaccttggcctcccaaagtgctgggattagaggtgtgagacaccgtgcccagtgtaaaaattttatttgtcctgaaaaattcaagttcggactgataatctatggt

SEQ ID NO: 13395 - DNA, 480 bp, Homo sapiens
  chr8.fa.O7frz.6415627
  Located on chromosome 8
  Distance between a terminus base of telomere on chromosomal short arm and 5'-terminus of this base sequence : 5470643
  Distance between 3'-terminus of neighbour sequence of sequence listing upward to telomere on chrosomal short arm and 5'-terminus of this base sequence : 110117
ggtattgaaattatttcatggagatagaaataattctactattgttctattaatatgaaacaaactagacttaaaatataagcagaatgaagaggaatataacgataaaaattaaagggagaaatgcaaaaatctacaaacatagttggaattttaatactttatcttaatatttgatccccaaatgatctatctgtggaagatttgaaaacaatgtcaaccagtgacatgcatataacacacacatatatctctatcattcatatatatatatatatatatatatatatagtcttctgttatagtcttcagttataaggttatacacaagcacacatatgtaactgaagactacacattcttttcaaatgcaaatgaaagagtcactttgatcatgactgacctcatgagtcataaaatacatttacaaatttaaaagactgaaacatcatggtcattgttgctacatgtaaaccagct

SEQ ID NO: 13396 - DNA, 396 bp, Homo sapiens
  D8S1140
  Located on chromosome 8
  Distance between a terminus base of telomere on chromosomal short arm and 5'-terminus of this base sequence : 5545941
  Distance between 3'-terminus of neighbour sequence of sequence listing upward to telomere on chrosomal short arm and 5'-terminus of this base sequence : 74818
gacaacatccgataatgctgttctctttccgcggagatatccatacattccctctagataaaaatttatctcagccaatggagtcgaccaatatgaatattgatgagaaagaaaatgatacaaaaacactacggttctagaaagtgaaaaagcaatctgttttcagaaattggttttgaggccctaaatttgtatgttgaggatctatgtgtgtgtgtaaaataggataggataaagatttagagagaaggaaagatagatgatagatggatagatagatagatagatagatagatagatagatagatagattagacctaatggctacaacattattctcatcaactcacaaaatatttgaattggaagtaatcttccaattatctagatgtcctc

SEQ ID NO: 13397 - DNA, 223 bp, Homo sapiens
  AC053529.4_89462
  Located on chromosome 8
  Distance between a terminus base of telomere on chromosomal short arm and 5'-terminus of this base sequence : 5661261
  Distance between 3'-terminus of neighbour sequence of sequence listing upward to telomere on chrosomal short arm and 5'-terminus of this base sequence : 114924
tgtcaaatgatattgaccagtcaaaattgatgtgaactggagactgaccctgtgctttagaaagcatctgttactgatgatgttaacaggagcgtttgtttgtttgtttgtttgtttgtttgtttcaagtggtagaggtgacagccagatagctataaatttaacagagtctgagaggagagcaattgaagatagatgggtacagatgtctctattgacaagc

SEQ ID NO: 13398 - DNA, 455 bp, Homo sapiens
  chr8.fa.O7frz.6758588
  Located on chromosome 8
  Distance between a terminus base of telomere on chromosomal short arm and 5'-terminus of this base sequence : 5685882
  Distance between 3'-terminus of neighbour sequence of sequence listing upward to telomere on chrosomal short arm and 5'-terminus of this base sequence : 24398
gatatggtaaatgtccttggtaatattaatcaggaatttatgagtatatacacatatatgcatatccatgtactatatacatatatctccatatatatgtctccatatgcgtatatatacataatatatatatgtacattatacttaagtagttgcttttctaatttgcttactaaaaaccacagggagcataatatttaatagtggatttttttaggtatttttattaaaaacaaaaataatgcagggcacatgatgtcactatccctcatcaacactgtatgggagaacctagccaaaagaataatacacatatcctctctctctctctctctctctgtctctcacctgtatgcttggaatgacagatttgaaagcctatttgttctcagtttgattctctacatattaaattgaaaataaatctttataacttacaaaagcatttggtatga

SEQ ID NO: 13399 - DNA, 420 bp, Homo sapiens
  AC078836.2_42722
  Located on chromosome 8
  Distance between a terminus base of telomere on chromosomal short arm and 5'-terminus of this base sequence : 5954297
  Distance between 3'-terminus of neighbour sequence of sequence listing upward to telomere on chrosomal short arm and 5'-terminus of this base sequence : 267960
taattggctttaaatgctagtaaggaagaagctgctactgccagtaaattaaaattgcctgcatttcattcctttccaagccttgtttacccaagccagaattcattttttgttcaacattttaaaaacctttattatgttaggtggtaaagcacagagagaggcatgctcaatgcttgagctttgatttttttgcattccatgatgtgtatgtgtgtgtgtgtgtgtgtgtacacatgtgtgggaggactgggtaccattttggatagctttcaggcctcttgacacgaccataaagggaaagcttggggcttgtaaagaactttaccaacatcttctgaaattaaaccaaccattctgttggtttttctgtttctactgatcagttttcttctattgttactgcacttgtttacttcg

SEQ ID NO: 13400 - DNA, 180 bp, Homo sapiens
  HUMUT7515
  Located on chromosome 8
  Distance between a terminus base of telomere on chromosomal short arm and 5'-terminus of this base sequence : 6081352
  Distance between 3'-terminus of neighbour sequence of sequence listing upward to telomere on chrosomal short arm and 5'-terminus of this base sequence : 126635
acacgcaacagagtgcttcacacgtgcttcccatgttgtcacactgaatgcttaaaagatgtgtgcttgagaatttagttcatcaaaattaaaatgtatctatctatctatctatctatctatctatctatctatctatctatattttttgagacggagtcttgctctgttaccaggctg

SEQ ID NO: 13401 - DNA, 442 bp, Homo sapiens
  chr8.fa.O7frz.9093011
  Located on chromosome 8
  Distance between a terminus base of telomere on chromosomal short arm and 5'-terminus of this base sequence : 6503869
  Distance between 3'-terminus of neighbour sequence of sequence listing upward to telomere on chrosomal short arm and 5'-terminus of this base sequence : 422337
tctagaacacctgaatcaaattactcctcaggctgatagacacatgtaatatgagtgtaaccgggttgggacagtggccacacagttgccttattttaggtaaaagaatgtcagggaagaaatctttacctatgaaaccgtgtgtgtgtctgtgtgtgtgtgtgtgtgtgtgtgtgtgtgtttgtgtgtgtgtgtgtgtgcttgtgctgggatgaacttccaagtatgtacttttggcagctaccatcatcctctcagcgatggaagcacaagaagtctgaagtgcactttctgacctgagaatagtcaatgaagtatagtatttagcacagcgtatatttttccttaataataaaggagagatccgtggaatcaaacagaccttccagcgataacctttccacgttcagactattgattctctatccgagtgaaattacct

SEQ ID NO: 13402 - DNA, 465 bp, Homo sapiens
  AC074340.2_49045
  Located on chromosome 8
  Distance between a terminus base of telomere on chromosomal short arm and 5'-terminus of this base sequence : 6514158
  Distance between 3'-terminus of neighbour sequence of sequence listing upward to telomere on chrosomal short arm and 5'-terminus of this base sequence : 9847
tccatcagtacctagtttattgagagtttttaacatgaagggatggtgaattttatcaaaggcatttttgcatctattgaaataattgtctggtttttgtctttggttctgtttatgtgatcaattacatttattcatttgtgtatgttgaaccagcctttcatcccaaagatgcagccgacttgattgtggtggataagctttttgatgtgctgctggattccgtttgctagtattttattaagaatttttgcattaatgttcatcagggatattggcctggattgaacaggtatgtgtgtgtgtttctaccttggtttgccagtaggttgatgtgtgagtgtgtgtgactgtgtgtgtgtgtgtgtgtgtgtgtgggtgtgaatgtgcgatagagagccaaactagagcagaggaagttccctggcctgccatgacattaaatgttctgaattcaagatacca

SEQ ID NO: 13403 - DNA, 247 bp, Homo sapiens
  chr8.fa.O7frz.8241425
  Located on chromosome 8
  Distance between a terminus base of telomere on chromosomal short arm and 5'-terminus of this base sequence : 6531434
  Distance between 3'-terminus of neighbour sequence of sequence listing upward to telomere on chrosomal short arm and 5'-terminus of this base sequence : 16811
tctagaacacctgaatcaaattactcctcagggtgataggcacatataatatgagtgtaaccgggtttgggcagtggccgcacagttgccttattttaggtaaaagaatgtcagggaagaaatctttacctatgaaaccctgtgtgtgtctgtgtgtgtgtgtgtgtgtgtgtgtgtgtgtgtgtgtttatgtgtgtgtgtgctcgtgctgggatgaacttccaagtatgtacttttggcagctatc

SEQ ID NO: 13404 - DNA, 338 bp, Homo sapiens
  AF228730.3_113316
  Located on chromosome 8
  Distance between a terminus base of telomere on chromosomal short arm and 5'-terminus of this base sequence : 6531434
  Distance between 3'-terminus of neighbour sequence of sequence listing upward to telomere on chrosomal short arm and 5'-terminus of this base sequence : -247
tctagaacacctgaatcaaattactcctcagggtgataggcacatataatatgagtgtaaccgggtttgggcagtggccgcacagttgccttattttaggtaaaagaatgtcagggaagaaatctttacctatgaaaccctgtgtgtgtctgtgtgtgtgtgtgtgtgtgtgtgtgtgtgtgtgtgtttatgtgtgtgtgtgctcgtgctgggatgaacttccaagtatgtacttttggcagctatcatcatcctctcagcgacagaaggacaagaaatcggaagtgtgctttctgacctgagattagtcaatgaagtatggtatttagcacagcgta

SEQ ID NO: 13405 - DNA, 179 bp, Homo sapiens
  DISO7_10018194
  Located on chromosome 8
  Distance between a terminus base of telomere on chromosomal short arm and 5'-terminus of this base sequence : 6531475
  Distance between 3'-terminus of neighbour sequence of sequence listing upward to telomere on chrosomal short arm and 5'-terminus of this base sequence : -297
acatataatatgagtgtaaccgggtttgggcagtggccgcacagttgccttattttaggtaaaagaatgtcagggaagaaatctttacctatgaaaccctgtgtgtgtctgtgtgtgtgtgtgtgtgtgtgtgtgtgtgtgtgtgtttatgtgtgtgtgtgctcgtgctgggatgaact

SEQ ID NO: 13406 - DNA, 458 bp, Homo sapiens
  chr8.fa.O7frz.8363360
  Located on chromosome 8
  Distance between a terminus base of telomere on chromosomal short arm and 5'-terminus of this base sequence : 6556330
  Distance between 3'-terminus of neighbour sequence of sequence listing upward to telomere on chrosomal short arm and 5'-terminus of this base sequence : 24676
gcaatgcagtattcatagctataagcactatgctataaattagacctcctgaacttatttatgtgatatatctaaaactttgtactgtaatcacacctacacacttacctgcaccacagttcttggtcagtctaccctctgcttctgagtttgtttttttgagatttcaaatacaaggggaatcatacagtatttgtcattctgtgtttggtttatttcacatgacttcatgcctttcagatccatcaatgttgtcacaaatgacagggtttcattattatataatactgaataatattccattgtacatatatatatatatatatatatataaaacaataattcagccgtccatgaatgaatgataacatgtatgtcttcttcatagatcttgactattgtgagcagtgctgaaaggagcataggagcgcagataactctttcacatactgatttcg

SEQ ID NO: 13407 - DNA, 269 bp, Homo sapiens
  D8S1706
  Located on chromosome 8
  Distance between a terminus base of telomere on chromosomal short arm and 5'-terminus of this base sequence : 6749449
  Distance between 3'-terminus of neighbour sequence of sequence listing upward to telomere on chrosomal short arm and 5'-terminus of this base sequence : 192661
ggaaaaatcacaatagaaattactaaatatttacaactgaatgaaaacaaaactttatttttatatatatatatatatagtgtgtgtgtgtgtgtgtgtgtgtgtgtgtgtgtgtgtgtgaatcttccaactttgttcttttacaaggttatttgggaaattctgggtctcctgcaattcctcatacagttttatgctgtttgtcaatttccgtggctggggtgaacttgtcgtagttctcatagaccagggtctgcatgtcgctgtct

SEQ ID NO: 13408 - DNA, 221 bp, Homo sapiens
  D8S1819
  Located on chromosome 8
  Distance between a terminus base of telomere on chromosomal short arm and 5'-terminus of this base sequence : 6920703
  Distance between 3'-terminus of neighbour sequence of sequence listing upward to telomere on chrosomal short arm and 5'-terminus of this base sequence : 170985
cgtgctgagaatgagacccatctctgtctcatccgtgtgtgtttgtgtgtgtgtgtgtgtgtgtgtgtgtgtgtgtgtgtgtgtgtgtagtgccaggcacagcattgataaaagtccttccaggcctactgttggatgacagaagaggtggcatgctcactgttttcctgagtccaagccttccctctctgtggctctgacgccgccaagtccctcagtga

SEQ ID NO: 13409 - DNA, 178 bp, Homo sapiens
  D8S561
  Located on chromosome 8
  Distance between a terminus base of telomere on chromosomal short arm and 5'-terminus of this base sequence : 7048541
  Distance between 3'-terminus of neighbour sequence of sequence listing upward to telomere on chrosomal short arm and 5'-terminus of this base sequence : 127617
gctctagtataaggcagaatgcccttatggacgtgtgtgtgtgtgtatgtgtgtgtgtgtgtgtgtgtgtgtaacaaaagttgctaacatttgcgcactcagaatgtgacaggcactaatccaagtgcttcacatagatgatttcgcttaattctcacaagcctgtgaggtaggttcc

SEQ ID NO: 13410 - DNA, 292 bp, Homo sapiens
  AC009632.2_59667
  Located on chromosome 8
  Distance between a terminus base of telomere on chromosomal short arm and 5'-terminus of this base sequence : 7145366
  Distance between 3'-terminus of neighbour sequence of sequence listing upward to telomere on chrosomal short arm and 5'-terminus of this base sequence : 96647
agcctctaattagcagattatgttttcataaaatgttttttatctttgaccatttaaaaatttgggagtttatctctcctctcctttcctttccttccttctctctcttctttctttctttttctttctttctctttctttttttctttctttctctctctctttccctccctccctccctccctcccttcctccctcccttcctcccttcttccttctttccatgagatcttcctatgttgcctaggcgtaccacctatttacttactaccattgcataagtcacttatct

SEQ ID NO: 13411 - DNA, 146 bp, Homo sapiens
  D8S277
  Located on chromosome 8
  Distance between a terminus base of telomere on chromosomal short arm and 5'-terminus of this base sequence : 7153865
  Distance between 3'-terminus of neighbour sequence of sequence listing upward to telomere on chrosomal short arm and 5'-terminus of this base sequence : 8207
ccaggtgagcttatcaattcctgagacgtaaaagacacacacacctactgatttgtcctcatgcagtgtccggactacacacacacacacacacacacacaccactctacttcacatcttaattcggatgtcactcagacctctca

SEQ ID NO: 13412 - DNA, 471 bp, Homo sapiens
  AF287957.2_138754
  Located on chromosome 8
  Distance between a terminus base of telomere on chromosomal short arm and 5'-terminus of this base sequence : 7195112
  Distance between 3'-terminus of neighbour sequence of sequence listing upward to telomere on chrosomal short arm and 5'-terminus of this base sequence : 41101
tttacagcaatgtgctctaaactctaacttcagctgggcaaagtggctaacacctgtaatcccagcactttgggaggctgaggtagttggattgcttaagcccaggagtttgagaccagcctgggcaacataggcagaccccatctagatagatagaaagatagatagatagatagatagatagatagatagatagatagattagatagatagatagatagatggatgatagacagacagacagacagacatagataagcaagcccggcatggtgtcacatgcctatagtttccgctacttgggaggctgaggtgggaggatcacttgagcccaggaagttgaggctgcagtgaactgtgattgtgacccttcactccagcgtgggtgacagagcgagaccctgtctcaaaacaatacaactccccacccccaacaaaaaccaatgattctaatttcattgcaaaccttta

SEQ ID NO: 13413 - DNA, 424 bp, Homo sapiens
  chr8.fa.O7frz.7433403
  Located on chromosome 8
  Distance between a terminus base of telomere on chromosomal short arm and 5'-terminus of this base sequence : 7327087
  Distance between 3'-terminus of neighbour sequence of sequence listing upward to telomere on chrosomal short arm and 5'-terminus of this base sequence : 131504
acatacaaccatctaattctgaagaactgctacaaatctcctttacaagaaatttccagagaataccacacaaaccctgaaataaaaacatgctcagcagtgtttttcttggaggccagtttatactgctagccaaagagaatattttaagaatcccccaactacattggagacagggttagaaggaggaggacgagagagcgagagagcgagagtgccagagagagagagagagagagagagagagagagattccttgtacacaaagtcaatgtatataatatatgatatggatactttaaatcttgaccctaaaagaaattggaactgtgaagtttatatctgaagttatatgcaagacatagataaatattaaagtgggtgctaagctttaaaaattatgtagaatggctttgtaaatggt

SEQ ID NO: 13414 - DNA, 476 bp, Homo sapiens
  AF257499.2_43880
  Located on chromosome 8
  Distance between a terminus base of telomere on chromosomal short arm and 5'-terminus of this base sequence : 7347318
  Distance between 3'-terminus of neighbour sequence of sequence listing upward to telomere on chrosomal short arm and 5'-terminus of this base sequence : 19807
gtgcctctagtaccagctactcaggaggctgaggcaggagaatcacttgaacctgggaagcggaggttgcaatgagcaaagatcgcgcaactgcactccagcctggcgatagagcaagactctgtctcaggaaaaaaaaaaaaaaaaaaaaaaatccaaaaattagccaggtgtagtggcacgggcctgtagtcccagctactcgggaggctgaggcacaagaatcacttgaactggggaggcagaggttgcagtgagccaagatagcgccactgcactccagcctgggcgacagagcgaggctctgtatcggatggatggatggatggatggatgcatggatggatggatggatggatcgatagataaaattgagtaggaaataattattcctcaagagaacagacataaatttttcctgggaaaaccactcacatttaaagtaaattctagccttcaagacaaatacgtacagc

SEQ ID NO: 13415 - DNA, 134 bp, Homo sapiens
  D8S1742
  Located on chromosome 8
  Distance between a terminus base of telomere on chromosomal short arm and 5'-terminus of this base sequence : 7457010
  Distance between 3'-terminus of neighbour sequence of sequence listing upward to telomere on chrosomal short arm and 5'-terminus of this base sequence : 109216
ctcaagggatatgaagggcatcttgaaaatggcctgcttctctctcccctttttctggctacacccagtggctcacattgtgtgtgtgtgtgtgtgtgtgtgtgtgtgtgtgtgtgtgtgtgtcttggtggggg

SEQ ID NO: 13416 - DNA, 250 bp, Homo sapiens
  D8S1099
  Located on chromosome 8
  Distance between a terminus base of telomere on chromosomal short arm and 5'-terminus of this base sequence : 7495023
  Distance between 3'-terminus of neighbour sequence of sequence listing upward to telomere on chrosomal short arm and 5'-terminus of this base sequence : 37879
tatccctgagtggtaagccgtggaaaaatcattgcttttgtgaatgactaaccatttatgatttatagagatatatatatgtcatatatgtgtgtgtgtgtatatatatgtatatatcatatatatatagcttaatagagatgggatctctgttacccaggctggtttcaaactcctgagctcaaaaactttatttatttattattattattattattattattgttactgagacagtcttgctctgttg

SEQ ID NO: 13417 - DNA, 422 bp, Homo sapiens
  chr8.fa.O7frz.13769420
  Located on chromosome 8
  Distance between a terminus base of telomere on chromosomal short arm and 5'-terminus of this base sequence : 7513234
  Distance between 3'-terminus of neighbour sequence of sequence listing upward to telomere on chrosomal short arm and 5'-terminus of this base sequence : 17961
tctagaacacctgaatcaaactactcctcaggctgatagacacatgtaatatgagtgtaaccgggttgggacagtggccacacagttgccttattttaggtaaaacaatgtcagggaagaaatctttacctatgaaaccgtgtgtgtgtgtgtgtgtgtgtgtgtgtgtgtgtgtgtgtgtttgtgccgggatgtacttccaaatatgtgcttttggcagataccatcatcctctcagcgatggaaggacaagaagtcggaagtgcgctttctgacctgagaatagtcaatgaagtatagtaattagcgcagtgtatctttttccttaataagaaaggagagatccgtggaatcaaacagaccttccagcgataacctttccacgttcagcctattgattctctatccgagtgaaattacct

SEQ ID NO: 13418 - DNA, 187 bp, Homo sapiens
  DISO7_10000363
  Located on chromosome 8
  Distance between a terminus base of telomere on chromosomal short arm and 5'-terminus of this base sequence : 7715238
  Distance between 3'-terminus of neighbour sequence of sequence listing upward to telomere on chrosomal short arm and 5'-terminus of this base sequence : 201582
gagcagcattacacaacctctttaccagacacacacacacacacacacacacacacacacacacacacgaacttgaactagttcttttgtaactacaatcaaattaagattttggggactggtttaaaaacttaattgtcatttgcaatttaattcttattggaaaacgctttgagagttcctacaa

SEQ ID NO: 13419 - DNA, 230 bp, Homo sapiens
  DISO7_10000362
  Located on chromosome 8
  Distance between a terminus base of telomere on chromosomal short arm and 5'-terminus of this base sequence : 8018235
  Distance between 3'-terminus of neighbour sequence of sequence listing upward to telomere on chrosomal short arm and 5'-terminus of this base sequence : 302810
aaatacaccgatgtgaaggacggcgccatttctcaactcacagaaataaaagaagagaaaacacctggagaaggaggaggagaagggggaggggaaaggcgagaggagggggaagggaaggggaggggaggagtggaggaggaggaggaggagaaggaggaggaggaggaggaggaggaggcgcactgctgagcctggagctcccgccagcccctgggtgagtccttgag

SEQ ID NO: 13420 - DNA, 102 bp, Homo sapiens
  DISO7_10000029
  Located on chromosome 8
  Distance between a terminus base of telomere on chromosomal short arm and 5'-terminus of this base sequence : 8039428
  Distance between 3'-terminus of neighbour sequence of sequence listing upward to telomere on chrosomal short arm and 5'-terminus of this base sequence : 20963
tcaggcaactggacaatcagttgagacacacacacgcacacacatacacacacacacacacacatatatatatatatacatgtatagggtgttcaatactga

SEQ ID NO: 13421 - DNA, 348 bp, Homo sapiens
  chr8.fa.O7frz.10032742
  Located on chromosome 8
  Distance between a terminus base of telomere on chromosomal short arm and 5'-terminus of this base sequence : 8489886
  Distance between 3'-terminus of neighbour sequence of sequence listing upward to telomere on chrosomal short arm and 5'-terminus of this base sequence : 450356
cttcagcactatgtcaagaaacagcagcccagaaaattcttaacagctgaacttcagtttctaattacttctcacagccacttcaatttttgcctctctgaggcatatgctgaaatcaattatgacatgcgagcggttacaccatggcacagtgaggaagctggtacatttctgaaactccataaactcatcagattatttttactttaaatgctataaacctgaagtatttctttacttgacacacacacacacacagacacacacacactcatacacatttcatacttttgcatcaaagctggtcataaaattggtaccagaagacaaacttggtagagttcacag

SEQ ID NO: 13422 - DNA, 239 bp, Homo sapiens
  DISO7_10002400
  Located on chromosome 8
  Distance between a terminus base of telomere on chromosomal short arm and 5'-terminus of this base sequence : 8576125
  Distance between 3'-terminus of neighbour sequence of sequence listing upward to telomere on chrosomal short arm and 5'-terminus of this base sequence : 85891
gagccttgtgtctagccagttcaaaatgaaatagatagataggtagatagatagatagatagatagatagatagatagatagatagatagatagacagatagatacatagatagatagatagatatagatatatatatacatccccaaagtaggcagaaagaatgtttggaaaatcctcagtaaagtagattgtgtttcctaatgatttttaaaaaagtaataagccactggacatgaa

SEQ ID NO: 13423 - DNA, 172 bp, Homo sapiens
  HUMUT5020
  Located on chromosome 8
  Distance between a terminus base of telomere on chromosomal short arm and 5'-terminus of this base sequence : 8576128
  Distance between 3'-terminus of neighbour sequence of sequence listing upward to telomere on chrosomal short arm and 5'-terminus of this base sequence : -236
ccttgtgtctagccagttcaaaatgaaatagatagataggtagatagatagatagatagatagatagatagatagatagatagatagatagacagatagatacatagatagatagatagatatagatatatatatacatccccaaagtaggcagaaagaatgtttggaaaat

SEQ ID NO: 13424 - DNA, 153 bp, Homo sapiens
  DISO7_10002402
  Located on chromosome 8
  Distance between a terminus base of telomere on chromosomal short arm and 5'-terminus of this base sequence : 8595368
  Distance between 3'-terminus of neighbour sequence of sequence listing upward to telomere on chrosomal short arm and 5'-terminus of this base sequence : 19068
tgttattggaacacattggggtgtgtgtgtgtgtgtgtgtgtgtgtgagagagagagagagagagagacagagagagagagagagagagagagagagagagagagagagagattgtgggccatgcaaataaacataagacaactttccttggc

SEQ ID NO: 13425 - DNA, 257 bp, Homo sapiens
  chr8.fa.O7frz.10246550
  Located on chromosome 8
  Distance between a terminus base of telomere on chromosomal short arm and 5'-terminus of this base sequence : 8732204
  Distance between 3'-terminus of neighbour sequence of sequence listing upward to telomere on chrosomal short arm and 5'-terminus of this base sequence : 136683
tcaaccagagttaaattctaacagagagagagagagagagagagaacgagagagagagagagagattgatctggattcaggcttcctagatgcagtctatccaactcaggcagcagtgaacgaggaatacaggctctttcccacatgtttggaatcctggccctgagccctgagctgtgcattccatttatcctctttgtgggctgaacagatgaaattgctttagctaaaggaagtggcacgaatttacttattta

SEQ ID NO: 13426 - DNA, 263 bp, Homo sapiens
  DISO7_00001532
  Located on chromosome 8
  Distance between a terminus base of telomere on chromosomal short arm and 5'-terminus of this base sequence : 9063431
  Distance between 3'-terminus of neighbour sequence of sequence listing upward to telomere on chrosomal short arm and 5'-terminus of this base sequence : 330970
tatttgctcctggttgcttttctctcagccgtgtgtgtgtgtgtgtgggtgtgtgtgtgtgtgtgtgtgtgtgtgcgtgtgcgtgcgtgcatgcatgtgtgtgtgtagctatccaccgtgcacagaatctctgttgaagacccctgttcttccaggcgtcccttgaccagagtttaaacaagctccaagccatcctcctctccctcatggtccacacttgaattttttgtcctgacatactttgggagtgcaagctgacctca

SEQ ID NO: 13427 - DNA, 133 bp, Homo sapiens
  D8S1825
  Located on chromosome 8
  Distance between a terminus base of telomere on chromosomal short arm and 5'-terminus of this base sequence : 9150473
  Distance between 3'-terminus of neighbour sequence of sequence listing upward to telomere on chrosomal short arm and 5'-terminus of this base sequence : 86779
tgggatttcatttttaacctgtgtgcatgtgtgtgtgtgtgtgtgtgtgtgtgtgtgtgtgtgtgcaatatcaatagtagaagggaaaaaagaaaggtgacctagcctgggcaacatagagaaaccccatctc

SEQ ID NO: 13428 - DNA, 448 bp, Homo sapiens
  AC022784.3_178317
  Located on chromosome 8
  Distance between a terminus base of telomere on chromosomal short arm and 5'-terminus of this base sequence : 9244852
  Distance between 3'-terminus of neighbour sequence of sequence listing upward to telomere on chrosomal short arm and 5'-terminus of this base sequence : 94246
agtcagtgaatttccaacaataagcagaggcacaccttcaacatagcacctcagagccattgaaaactcaaggtattcattctagaaaagtccaaggatacagaagacatgctttagccagtttttcaaagttcttagaaattttgactttgggcaggggcacagtaactcacccctgtaatcccacctactcaggaggttgaggagttcaagaccagcctgggatgtatagtgagaccctgtctcaaaacaaacaaacaaacaaaaagaaagaaagaaagaaagaaagaaagaaagaaagaaagaaaagtttgacttttaagggttctagtaacaaaaacttcctttctaagcaagcagacttggctcatgacacctgacatcctttcatcaaacactggtccaaattcaaggggcaaaatcatctcctgcatttgtagatttctta

SEQ ID NO: 13429 - DNA, 225 bp, Homo sapiens
  G08702
  Located on chromosome 8
  Distance between a terminus base of telomere on chromosomal short arm and 5'-terminus of this base sequence : 9315348
  Distance between 3'-terminus of neighbour sequence of sequence listing upward to telomere on chrosomal short arm and 5'-terminus of this base sequence : 70048
gagggggttaaaggtgtcatggttacatttcctggctaactcttaatttactagaaaatgcctgttaatgtcatccttcctatgtatatatttacgtaatatatattttatgtatacaactctatctgtatatctgtatctatctatctatctatctatctatctatctatctatctatctatcatctacctatctacctacctactacctccgccttctaaagc

SEQ ID NO: 13430 - DNA, 475 bp, Homo sapiens
  AC021736.3_138044
  Located on chromosome 8
  Distance between a terminus base of telomere on chromosomal short arm and 5'-terminus of this base sequence : 9413360
  Distance between 3'-terminus of neighbour sequence of sequence listing upward to telomere on chrosomal short arm and 5'-terminus of this base sequence : 97787
gaatggcaaacatagtgaaaccccatctctactaaaaatacaaaaattagccaggtgtgctggtgtctgtaatcccagctacatgggaggctgaggcagaagacacacttgaacccaagaagcagaggctgcagtgagccgagatcgcgccactgtactccaacctgggtgacagagcaagattctgtctcaaataaataaataaataaataaataaataaataaataaataaataaatcaaagcaggactttggagagcccttcatatactgagaattcaatggtcactgagaattcaaagaaggttatttgaatccagcatttctcaaggttgatttgacaaccaaatctcctgtttccgggtccacattgcctggaggccctccaagatactcaagaaatagtagagtctgtgtcctatatttcaaaaggaaaatgttcatttctgggggaagctgtaggtaacctgtaatg

SEQ ID NO: 13431 - DNA, 212 bp, Homo sapiens
  D8S503
  Located on chromosome 8
  Distance between a terminus base of telomere on chromosomal short arm and 5'-terminus of this base sequence : 9458797
  Distance between 3'-terminus of neighbour sequence of sequence listing upward to telomere on chrosomal short arm and 5'-terminus of this base sequence : 44962
  misc_feature (1)...(212): n = A,T,G or C
tcgctcagaaacaaaccaatgtangagtgtgtgtgtgtgtgtgtgtgtgtgtgtgtgtgttgaaaaataaagggtaatgacaatttccaaacgtggttcttcttttatcaaaggacaaaactcgtaaccttaatagcatttgtgataaacccaggactctgggaaataggaagatttttgttttgtgttatttgttttgcttaatcatggtc

SEQ ID NO: 13432 - DNA, 418 bp, Homo sapiens
  AC021242.3_11726
  Located on chromosome 8
  Distance between a terminus base of telomere on chromosomal short arm and 5'-terminus of this base sequence : 9461512
  Distance between 3'-terminus of neighbour sequence of sequence listing upward to telomere on chrosomal short arm and 5'-terminus of this base sequence : 2503
caataagcaataaagtcaagaaagaaagaaaaagtagaaagaaaagaaggaaggcaggcaggcaggaaggcaggaaggcaggcaggtaagaaggcaggaagttaggaaggaaggcaggaaggcaggcaggaaggcagaaggaaggaagcaaggaaggaaggaaggaaggaaggaaggaaggaaggaaggaatctaagaaaggaagtctttggaaatatttttaagggctaagaataggaattccaaacataaggaatcaggaatagagaaagactctatgaattatatacaaatctacatgtgtgcatgaggagtgtgtatgagcaatagaatagaaatcaagatagtaagaaatatttctagtcataatgctttgaaaataaaattgtacttttaggtattgcagcttctacgactt

SEQ ID NO: 13433 - DNA, 303 bp, Homo sapiens
  chr8.fa.O7frz.11155780
  Located on chromosome 8
  Distance between a terminus base of telomere on chromosomal short arm and 5'-terminus of this base sequence : 9560090
  Distance between 3'-terminus of neighbour sequence of sequence listing upward to telomere on chrosomal short arm and 5'-terminus of this base sequence : 98160
gtcttcctaatctgaggttcagaaaaacagcctctctgcctttttctttaaacagggaattcttattccctgactcttctcaaacatcagtatttgcatttcctgagtggcagatcaggatcactgtgctttgaacaattgatcgtggtcctctgggtgtttgcagtgctgagtgcattggggtttgtgtgtgtgtgtgtgtgtgtgtgtgtgtgtgtgagagagagagagacagagagagggagagaggagcacagtagcttgtgcaaagacctcctttgctatagaagcctgattccaaac

SEQ ID NO: 13434 - DNA, 146 bp, Homo sapiens
  D8S516
  Located on chromosome 8
  Distance between a terminus base of telomere on chromosomal short arm and 5'-terminus of this base sequence : 9608462
  Distance between 3'-terminus of neighbour sequence of sequence listing upward to telomere on chrosomal short arm and 5'-terminus of this base sequence : 48069
gagaatgcttgatcccaaaaaatcaagatcaaagatcagcctgggcaacaaagtgagaccctgtctacacacacacacacacacacacacacacacaaagtatacccaagtactacaaaaatgggagcacatagcactctcttagg

SEQ ID NO: 13435 - DNA, 248 bp, Homo sapiens
  AC068973.2_33022
  Located on chromosome 8
  Distance between a terminus base of telomere on chromosomal short arm and 5'-terminus of this base sequence : 9700999
  Distance between 3'-terminus of neighbour sequence of sequence listing upward to telomere on chrosomal short arm and 5'-terminus of this base sequence : 92391
ctttaactttcaaagatcctcatattcaaatctctcttgtcaccactccaattcacatctcaaccgaggcctttcccagtggggtatgccctctaaacaagactaacaacaacaacaacaacaacaacaactataatcaacttctatttccttctactctccttcccccagccccttgaaaatatctatactctcaatgctcaagaggtattaggataaagacagtgaggttaaagcatttcatacta

SEQ ID NO: 13436 - DNA, 418 bp, Homo sapiens
  chr8.fa.O7frz.11540425
  Located on chromosome 8
  Distance between a terminus base of telomere on chromosomal short arm and 5'-terminus of this base sequence : 10003706
  Distance between 3'-terminus of neighbour sequence of sequence listing upward to telomere on chrosomal short arm and 5'-terminus of this base sequence : 302459
aatggaatactagccttaagaaagaagatcttgccatttgccacagcacggacggatctaaaggacgttatgctaagtgaaatgtgcagacacagagagagaaatattacataatctcacttatatgaaatatttttaaaaagatctcaaatattaatacacacgtagagaataaagcagtggtttccatgggttgcgggtggggagaggaattggggagatgtagatcaaaggataaataaaaacagatatattggacaaatgagagatctaatgtacatcatgactaaagttaataaaattgtattagggatttttgttaaataagtaaattttagctgcttttgtcccacacacacacacacacacacacagtaactctgaggtgatggatatgttagtctgcttcactgcagta

SEQ ID NO: 13437 - DNA, 174 bp, Homo sapiens
  D8S1721
  Located on chromosome 8
  Distance between a terminus base of telomere on chromosomal short arm and 5'-terminus of this base sequence : 10196948
  Distance between 3'-terminus of neighbour sequence of sequence listing upward to telomere on chrosomal short arm and 5'-terminus of this base sequence : 192824
gactttcctaaaagcccagccagttcagatgataggtgcagacacatcatattgcatatattcacattacacacacacacacacacacacacacacacacacactctcacccttctttttgctggggaaaggtttgttgcagaagttaccattccaatacaccatgcaagatgc

SEQ ID NO: 13438 - DNA, 245 bp, Homo sapiens
  D8S542
  Located on chromosome 8
  Distance between a terminus base of telomere on chromosomal short arm and 5'-terminus of this base sequence : 10212836
  Distance between 3'-terminus of neighbour sequence of sequence listing upward to telomere on chrosomal short arm and 5'-terminus of this base sequence : 15714
atctgatggggagttatgtattcattataaatggtgttttctaaaagttttagtgacatggggaagtattcccaatatagtggtaagagagaaaagcatgctgtaatgaatgcagtggaagaaatttgtgtgtgtgtgtgtgtgtgtgtgtgtgtgcacccgtgcatgcacacatctggtaggcacccaggaaaagattgataaaatttattgatagtgcttatgtggcagtagtataggtgatt

SEQ ID NO: 13439 - DNA, 357 bp, Homo sapiens
  chr8.fa.O7frz.11914327
  Located on chromosome 8
  Distance between a terminus base of telomere on chromosomal short arm and 5'-terminus of this base sequence : 10340218
  Distance between 3'-terminus of neighbour sequence of sequence listing upward to telomere on chrosomal short arm and 5'-terminus of this base sequence : 127137
ggcttactaaacctacatggagtgtgcgtatgtgtgtgtgtgtgtgtgtgtgtgtgtgtgtgtgtgtgtgtcttctgacgaagggatgagtgcttctcttcaacaccaaagaggaccccggagcaacaggagctccaggctctgggacaatggaattgcccctgtgagtcatcaatcactgctggcacatgcaaggaggacaaacccaggccaccacagtgtgacaatgacaaggagcgcgttcaaaggggctgaagcctttacaagcccccatcggagctcactgaccctcccagctttgtgaactcattgggagggaaaggagagaaagaggtgacacaattagatctaacttgg

SEQ ID NO: 13440 - DNA, 404 bp, Homo sapiens
  M8_10496641
  Located on chromosome 8
  Distance between a terminus base of telomere on chromosomal short arm and 5'-terminus of this base sequence : 10496450
  Distance between 3'-terminus of neighbour sequence of sequence listing upward to telomere on chrosomal short arm and 5'-terminus of this base sequence : 155875
gttaagcctctttggtgaatttttgaattcccttaagtatttttcagctcctgaatttaattcttttttaaatatataatttctatctccctgtttatattctaattttgtttatatatatagtatatatatatattctctctatatatagtatgtatatattctctatatatatagtgtgtgtgtgtatgtatatatatatatatatatatattctctctctctctctctatatatatatatatatatctctctctctctctatatatatatatatatactaccttgcctggcaagtattgtgctttttaatttttattttcaccactatatatatattactatatatataactatatatggctatatatatagttttcctgatttcctttagttttttgccc

SEQ ID NO: 13441 - DNA, 101 bp, Homo sapiens
  DISO7_10002410
  Located on chromosome 8
  Distance between a terminus base of telomere on chromosomal short arm and 5'-terminus of this base sequence : 10624835
  Distance between 3'-terminus of neighbour sequence of sequence listing upward to telomere on chrosomal short arm and 5'-terminus of this base sequence : 127981
ctgtccaccagacatttcacacactggaacatatatacagtacacacacacacacacacacacacacacacacacacatgctagcatgaaacatctgaagt

SEQ ID NO: 13442 - DNA, 257 bp, Homo sapiens
  D8S550
  Located on chromosome 8
  Distance between a terminus base of telomere on chromosomal short arm and 5'-terminus of this base sequence : 10697240
  Distance between 3'-terminus of neighbour sequence of sequence listing upward to telomere on chrosomal short arm and 5'-terminus of this base sequence : 72304
tggcacatcccgaagtcttcctcaaaggtaaatgacaatcaatttccaatttccattatttgctccagagaggtggttcaggaattccctcgccctcaagtttaaatgagatattaatgaattatttttgccttgttgcagacaacatacctgttaggaggtgtgtgtgtgtgtgtgtgtgtgtgtgtgtgtgtgtgattctccatccaagtgtttacttcctttctcatttcatgactttgggttattgactcctg

SEQ ID NO: 13443 - DNA, 422 bp, Homo sapiens
  AF131215.1_1457
  Located on chromosome 8
  Distance between a terminus base of telomere on chromosomal short arm and 5'-terminus of this base sequence : 10697252
  Distance between 3'-terminus of neighbour sequence of sequence listing upward to telomere on chrosomal short arm and 5'-terminus of this base sequence : -245
aagtcttcctcaaaggtaaatgacaatcaatttccaatttccattatttgctccagagaggtggttcaggaattccctcgccctcaagtttaaatgagatattaatgaattatttttgccttgttgcagacaacatacctgttaggaggtgtgtgtgtgtgtgtgtgtgtgtgtgtgtgtgtgtgattctccatccaagtgtttacttcctttctcatttcatgactttgggttattgactcctgtccctccccaacctctgccctccccagttgggtgacctgggaccaactccccaacctccacatctgtctccttattagtgaaatggagctatgacagaacccatgatgtagggatgctctaagatttaaataaagtaatccaggtaaaatgcctagtcaattgtctggcacctaata

SEQ ID NO: 13444 - DNA, 219 bp, Homo sapiens
  Z24258.1_151
  Located on chromosome 8
  Distance between a terminus base of telomere on chromosomal short arm and 5'-terminus of this base sequence : 10697257
  Distance between 3'-terminus of neighbour sequence of sequence listing upward to telomere on chrosomal short arm and 5'-terminus of this base sequence : -417
ttcctcaaaggtaaatgacaatcaatttccaatttccattatttgctccagagaggtggttcaggaattccctcgccctcaagtttaaatgagatattaatgaattatttttgccttgttgcagacaacatacctgttaggaggtgtgtgtgtgtgtgtgtgtgtgtgtgtgtgtgtgtgattctccatccaagtgtttacttcctttctcatttcatg

SEQ ID NO: 13445 - DNA, 125 bp, Homo sapiens
  HUMUT904
  Located on chromosome 8
  Distance between a terminus base of telomere on chromosomal short arm and 5'-terminus of this base sequence : 10766160
  Distance between 3'-terminus of neighbour sequence of sequence listing upward to telomere on chrosomal short arm and 5'-terminus of this base sequence : 68684
caaccctgctccccagcttgcttgcttttctttctcttttcttttttcttttctctttctttctctttctttttcttttctttctttcttttagacggagtttcactcttgtcaatcaggctgga

SEQ ID NO: 13446 - DNA, 243 bp, Homo sapiens
  D8S1755
  Located on chromosome 8
  Distance between a terminus base of telomere on chromosomal short arm and 5'-terminus of this base sequence : 10805827
  Distance between 3'-terminus of neighbour sequence of sequence listing upward to telomere on chrosomal short arm and 5'-terminus of this base sequence : 39542
accgcgtctggtcaactttgttacttaaagttctatgtcatacctggcaatggcctaatcttcaacttttactttcttcatactggctctgtcccttcattcatacacacacacgcacgcacacacacacacacacacgcacattttttttcttggaagactttttttattacttacatttcttttcacctgtaatgctttgtatgatgtgtgaaaaaaaaaaaaatcttccaatggagatgc

SEQ ID NO: 13447 - DNA, 285 bp, Homo sapiens
  AF131215.1_121459
  Located on chromosome 8
  Distance between a terminus base of telomere on chromosomal short arm and 5'-terminus of this base sequence : 10817345
  Distance between 3'-terminus of neighbour sequence of sequence listing upward to telomere on chrosomal short arm and 5'-terminus of this base sequence : 11275
attcagtccataaacgctgtatatatttatttgatgtagttttgttttaaataaaaagtgtgtgtgtgtgtgtgtgtgtgtgtgtgtgtatctaaagtaggcttcacaggtcttctcggctccctcctgaaactctcatgaaataaaggaagaagcgggtataaccccagaaggaaagacagaagtgagaagtgatgatactagatgagagatggtcacatttgagaaagtggaaaggagacagaggggtctgctggagcaaagtcgagaagcaggaagtagact

SEQ ID NO: 13448 - DNA, 217 bp, Homo sapiens
  D8S265
  Located on chromosome 8
  Distance between a terminus base of telomere on chromosomal short arm and 5'-terminus of this base sequence : 11095487
  Distance between 3'-terminus of neighbour sequence of sequence listing upward to telomere on chrosomal short arm and 5'-terminus of this base sequence : 277857
ccaatggtttcggttactgtaatgactgatttccaaaaagaaagaaaaacctaatttggcattttttcagaatatgggatgggctttcctgcatgggttcaaggatgtttatggcatgttctctgtcgtgtgtgtgtgtgtgggggtgtgtgtgtgtgtgtgtgtgtgtgtgtgtgtaggtcagcccgagacctcaagggcttatctggaaagaggt

SEQ ID NO: 13449 - DNA, 469 bp, Homo sapiens
  AF131216.1_260840
  Located on chromosome 8
  Distance between a terminus base of telomere on chromosomal short arm and 5'-terminus of this base sequence : 11142811
  Distance between 3'-terminus of neighbour sequence of sequence listing upward to telomere on chrosomal short arm and 5'-terminus of this base sequence : 47107
gctgtgaaatagatgagtcaagaaaaatgcccaaccaggcatggtagctcacacctgtaatcccagcaatttgggaggccgaggcagggggattgcttgagcccaggaattggagaccagcctgggcaacatggtgagaccccacttctacaaaaaaaaaatgaagaagaagaaagaaaactcagctgggcatggtggtacacacctgaagtcccagctacttgggaggctgaggtgggactgctggaacccaggagttgaaggttgcagtcagccatgattgcaccaccgcactccagcctgggcaacagagcaagaccctgtctcaaaaataaataaataaataaataaataaataaataaataaataaaagatttaaacttaaaatattctttcagaatttctcccaattcgtttattcatctgttcaataaatacgtattagtaccactaaataccagacattgt

SEQ ID NO: 13450 - DNA, 273 bp, Homo sapiens
  D8S1695
  Located on chromosome 8
  Distance between a terminus base of telomere on chromosomal short arm and 5'-terminus of this base sequence : 11165470
  Distance between 3'-terminus of neighbour sequence of sequence listing upward to telomere on chrosomal short arm and 5'-terminus of this base sequence : 22190
catctggaacccatgagcaaagtcatttccttgttttctttctgagtggctgctggaatcgtgtgtgtgtgtgtgtgtgtgtgtgtgtgtgtgtgtgtgtgtgtgtgtctggtattgttattttccaacctctgtctgttggggtgggcataaaggtgatgtcttatcacagatcacataagggccagcacacctccctgcaaactctcacatcccctcccactctaaccttgggtagacagaccatgtattttctttgtaggatgctgggtt

SEQ ID NO: 13451 - DNA, 365 bp, Homo sapiens
  AC022239.3_98973
  Located on chromosome 8
  Distance between a terminus base of telomere on chromosomal short arm and 5'-terminus of this base sequence : 11183808
  Distance between 3'-terminus of neighbour sequence of sequence listing upward to telomere on chrosomal short arm and 5'-terminus of this base sequence : 18065
tagttccatcaggttctcaacgggggctgtggccccaaaaatgttttttaaaaaacccagctttctctctctgtctctttccccctttctgggaatccgagattgaaatgaaagaaatcgaaagatctttgcctacatacagaggtccagtaatgggatagggaatatattatccccgggatagcgccactgtactccagccaggatgacagagactccatctcaaataaataaataaataaataaataaataaataaataaataaatacataaataaagtgcctctttgttaaggcagttgcttctatttctacttttttaaccaaagctaattgctaatgtgttaaagtacgagattctgcct

SEQ ID NO: 13452 - DNA, 129 bp, Homo sapiens
  D8S1759
  Located on chromosome 8
  Distance between a terminus base of telomere on chromosomal short arm and 5'-terminus of this base sequence : 11293578
  Distance between 3'-terminus of neighbour sequence of sequence listing upward to telomere on chrosomal short arm and 5'-terminus of this base sequence : 109405
ctattgcctagcttagcacatttgaaactgtcttagtgtgtgtgtgtgtgtgtgtgtgtgtgtgtgtgtgtatttaacttaatgaatttggagggagaacgtggataagacgaggagattgtcagtctc

SEQ ID NO: 13453 - DNA, 161 bp, Homo sapiens
  DISO7_10002413
  Located on chromosome 8
  Distance between a terminus base of telomere on chromosomal short arm and 5'-terminus of this base sequence : 11405299
  Distance between 3'-terminus of neighbour sequence of sequence listing upward to telomere on chrosomal short arm and 5'-terminus of this base sequence : 111592
gatattccagccatcaagaactttttaaacctactgaggtgacaaaataaagcacacatgcatgcatgcgcgtgcgcgcatgcacacacacacacacacacacacacacacttgaatctcaaccctataaatctttgtgtggggacgttatatgatgccca

SEQ ID NO: 13454 - DNA, 112 bp, Homo sapiens
  DISO7_10005005
  Located on chromosome 8
  Distance between a terminus base of telomere on chromosomal short arm and 5'-terminus of this base sequence : 11480123
  Distance between 3'-terminus of neighbour sequence of sequence listing upward to telomere on chrosomal short arm and 5'-terminus of this base sequence : 74663
gctgctgttatttgcctgataaacttctttccctctccctccctctgacacagaaacacacacacacacacacacagacacacacacacacacacagcccgctggatctata

SEQ ID NO: 13455 - DNA, 102 bp, Homo sapiens
  DISD22_0005596
  Located on chromosome 8
  Distance between a terminus base of telomere on chromosomal short arm and 5'-terminus of this base sequence : 11989312
  Distance between 3'-terminus of neighbour sequence of sequence listing upward to telomere on chrosomal short arm and 5'-terminus of this base sequence : 509077
cattcgcagaaagttgtacccatctttggaaactaccacacacacacacacacacacacacctttacatgcaaccctcccttgaggtgcatctacttccagg

SEQ ID NO: 13456 - DNA, 187 bp, Homo sapiens
  DISD22_0005605
  Located on chromosome 8
  Distance between a terminus base of telomere on chromosomal short arm and 5'-terminus of this base sequence : 12527800
  Distance between 3'-terminus of neighbour sequence of sequence listing upward to telomere on chrosomal short arm and 5'-terminus of this base sequence : 538386
cgtacgggtaacttaggttctagacaaaaggtcagagaaatactctgcaaaagtgatcatatatacatacacatatatatgtgcatgtatatatatatagagagagagagagagcgagagagaaagagagagagagagagagagagagagagagagaagagtttaagaatcatttaattccaggcaa

SEQ ID NO: 13457 - DNA, 168 bp, Homo sapiens
  D8S552
  Located on chromosome 8
  Distance between a terminus base of telomere on chromosomal short arm and 5'-terminus of this base sequence : 12635951
  Distance between 3'-terminus of neighbour sequence of sequence listing upward to telomere on chrosomal short arm and 5'-terminus of this base sequence : 107964
aggattgtaatttccttgcaaatgtctctttcttccccctgtaccatacccctgtatctcttaagacaacacacacacacacacacacacacacacacacattctctccctctctcactccctacttttttccttcccactgagagattcaaaccttcaaaaagtccc

SEQ ID NO: 13458 - DNA, 359 bp, Homo sapiens
  AC068920.2_82728
  Located on chromosome 8
  Distance between a terminus base of telomere on chromosomal short arm and 5'-terminus of this base sequence : 12703109
  Distance between 3'-terminus of neighbour sequence of sequence listing upward to telomere on chrosomal short arm and 5'-terminus of this base sequence : 66990
ggcacatggatacatatgtaacaaacctgcacgttgcgcacatgtaccctagaacttaaaagtataatttaaaaataaataaataaataaataaataaaggacgagccaaggaaacttcccacccgtctggccctgagcagtgacttcaacctctgtgctatttcacctgcaatcttctcctgcgaatggcattttctcccgttttgttgtttttgtttcctgatggtaatttatttttcttttagacaaactacaagaaaaaaataacttctctgacctttagtgcctgttttgactgctcagttggatttttaaaatgcttctagtcatctttctactgataattgttatttgtggc

SEQ ID NO: 13459 - DNA, 256 bp, Homo sapiens
  D8S1109
  Located on chromosome 8
  Distance between a terminus base of telomere on chromosomal short arm and 5'-terminus of this base sequence : 12739999
  Distance between 3'-terminus of neighbour sequence of sequence listing upward to telomere on chrosomal short arm and 5'-terminus of this base sequence : 36531
tcagctcctcttctgctgattgtgcccattgcaacctggcaacatattttccaactttctctaataaatctgcttttctttacctacaactgtcttggtacatttgtttacccctgcatcactggcccagacagttgctgctaacccgcgacagagagatagacagatgatagatagatgatagatagatagatagatagatagatagatagatagatagatagatagattcttgcactatgagcaattctgagaa

SEQ ID NO: 13460 - DNA, 310 bp, Homo sapiens
  HUMUT5412
  Located on chromosome 8
  Distance between a terminus base of telomere on chromosomal short arm and 5'-terminus of this base sequence : 12740081
  Distance between 3'-terminus of neighbour sequence of sequence listing upward to telomere on chrosomal short arm and 5'-terminus of this base sequence : -174
cctacaactgtcttggtacatttgtttacccctgcatcactggcccagacagttgctgctaacccgcgacagagagatagacagatgatagatagatgatagatagatagatagatagatagatagatagatagatagatagatagattcttgcactatgagcaattctgagaagttcatttatatgactcttctccagattgtttctgtgtcactaaccagccaatatagtagccactgcagggcatgaaacaggcctacttgctacaccttagttatctttaaccaagacatacacagcgtctcaact

SEQ ID NO: 13461 - DNA, 153 bp, Homo sapiens
  D8S1106
  Located on chromosome 8
  Distance between a terminus base of telomere on chromosomal short arm and 5'-terminus of this base sequence : 12740102
  Distance between 3'-terminus of neighbour sequence of sequence listing upward to telomere on chrosomal short arm and 5'-terminus of this base sequence : -289
ttgtttacccctgcatcactggcccagacagttgctgctaacccgcgacagagagatagacagatgatagatagatgatagatagatagatagatagatagatagatagatagatagatagatagattcttgcactatgagcaattctgagaa

SEQ ID NO: 13462 - DNA, 440 bp, Homo sapiens
  AC068920.2_79178
  Located on chromosome 8
  Distance between a terminus base of telomere on chromosomal short arm and 5'-terminus of this base sequence : 12776347
  Distance between 3'-terminus of neighbour sequence of sequence listing upward to telomere on chrosomal short arm and 5'-terminus of this base sequence : 36092
attccacttaactagaaattggagaaaggtcaaagaaatgggccgggcgcggtgactcaggcctgtaatcctagcactttgggaggccaaggtgggtggatcacaaggtcaggagttcaagaccagcctggccaagaaggtgaaaccccgtctctactaaaaatgcaaaaattagccgggcatggtggtgagcacttgtaatcccactacttgggaagctgaggcagggaattgcttgaacccagaaggaagaggttgcattgagccaagatcatgccactgcactccagcctaagcaacagagtgagactccatctgaaataaataaataaataaataaaataaaaagtcaaagaaatctgtggactgcttggtcttcttttgtctacactcattttattttttatttttttaactaaaccttcaaattgttattggat

SEQ ID NO: 13463 - DNA, 289 bp, Homo sapiens
  D8S1107
  Located on chromosome 8
  Distance between a terminus base of telomere on chromosomal short arm and 5'-terminus of this base sequence : 12805977
  Distance between 3'-terminus of neighbour sequence of sequence listing upward to telomere on chrosomal short arm and 5'-terminus of this base sequence : 29190
agtcaagttctgtgctcgcttcagcagcacatacactaaaattggaacgatacagagaagatcagcatggcccctgtgcaagaatgacatgcaaattcatgaagcgttccatatttttttcttaataaagcctcttttctacatatgaaaaaaaaaagagagtcaatgttctatggcacgaagacacaccagtaaatatcagccatttctttcagatatagatagatagatagatagatagatagatagatagatagatttttttttcctgagacagggtctccttctg

SEQ ID NO: 13464 - DNA, 177 bp, Homo sapiens
  D8S1754
  Located on chromosome 8
  Distance between a terminus base of telomere on chromosomal short arm and 5'-terminus of this base sequence : 12892883
  Distance between 3'-terminus of neighbour sequence of sequence listing upward to telomere on chrosomal short arm and 5'-terminus of this base sequence : 86617
tcagggacacgattcagcgacccatctccgggaaaaaaaccaaaactgtgtgtgtgtgtgtgtgtgtgtgtgtgtgtgtgtgtttcctagcaagaagcacgtttgcaagccacggggcttgctaaactaccccaacactctccaggtacctgcggccaccaaaccgagacttccctg

SEQ ID NO: 13465 - DNA, 269 bp, Homo sapiens
  D8S1790
  Located on chromosome 8
  Distance between a terminus base of telomere on chromosomal short arm and 5'-terminus of this base sequence : 12969366
  Distance between 3'-terminus of neighbour sequence of sequence listing upward to telomere on chrosomal short arm and 5'-terminus of this base sequence : 76306
tgactttggaaccgtggcttaaggattaagttataaaattaaaaagataatagacatttcaatgcaggacaagaaacacacaccacacacacacatacacacagacacacacacacacacacacacacacacacttctaataaatgctaagaagtaagatagttttacaagcaattccttaaaacttggaagagctgatgatgtgggaaaaataaaaaatgtttctatcagaagagaaaaatgaatggcctaacatctcttatttgcag

SEQ ID NO: 13466 - DNA, 462 bp, Homo sapiens
  chr8.fa.O7frz.14773250
  Located on chromosome 8
  Distance between a terminus base of telomere on chromosomal short arm and 5'-terminus of this base sequence : 13196196
  Distance between 3'-terminus of neighbour sequence of sequence listing upward to telomere on chrosomal short arm and 5'-terminus of this base sequence : 226561
gcagatagaacatgatcgttaaatacagttttatgaagaaactactagactgacaaatattaataccttttcttccttaattctcacaatagaagtaattttattgtttctgctgtaaaattatgtgatcaaaagcatcaaaactaaattttctccagttggaagggtacaaaagacatacacagcaaaaagtaatgttacactctttaaatgtatgtgcatgtgtgtgtgtgcgtgtgcgtgtgtgtagaagacaactctgagcaaatttctgatgcctggaatgattttggatcagggccatgtcttcttcttcttcttctttttttttttgcatagaaaagacaaactacattttaccctaagaatatgattcattagaatttcaaattggatcaacatcaagtagtcttaaatagcagataatttataaacattgaatgcataatcataagtagcagg

SEQ ID NO: 13467 - DNA, 152 bp, Homo sapiens
  DISO7_10002416
  Located on chromosome 8
  Distance between a terminus base of telomere on chromosomal short arm and 5'-terminus of this base sequence : 13254095
  Distance between 3'-terminus of neighbour sequence of sequence listing upward to telomere on chrosomal short arm and 5'-terminus of this base sequence : 57437
aagaataagatggcccaggatagatatatatatgtgtatatatatatatatatatatatatatatatatatatatatgtatatatatacatatatatatatatttttttttttttcagatagaaatgtttactgagactaagttgagcagcc

SEQ ID NO: 13468 - DNA, 213 bp, Homo sapiens
  DISO7_10002417
  Located on chromosome 8
  Distance between a terminus base of telomere on chromosomal short arm and 5'-terminus of this base sequence : 13265301
  Distance between 3'-terminus of neighbour sequence of sequence listing upward to telomere on chrosomal short arm and 5'-terminus of this base sequence : 11054
tcaatggaataaccctccactaatttttttggttttgttttttattacttgcttttttaaaaaatatagaattttaaattatatatatatatatatatttatatatatatatatatatatatatttatgcttaaataaggttttagttagtgctgttttacagctatataaatgtataatacttggaaactcaccccattactgccagcaaca

SEQ ID NO: 13469 - DNA, 221 bp, Homo sapiens
  DISO7_10002420
  Located on chromosome 8
  Distance between a terminus base of telomere on chromosomal short arm and 5'-terminus of this base sequence : 13307136
  Distance between 3'-terminus of neighbour sequence of sequence listing upward to telomere on chrosomal short arm and 5'-terminus of this base sequence : 41622
cgtgttctccacctactgctttatacacatacacacacatggacacacacacacacacacacacatgtgtgtgtgtgtgtatatatatatatatatatatatatatacacatatatatacacacagagagacacatgcacccaaatatatatgtgtgcatatgtatgtatataaatatacacacacacttacataaaacagctatcgcatagcatgtgctt

SEQ ID NO: 13470 - DNA, 172 bp, Homo sapiens
  DISO7_10002421
  Located on chromosome 8
  Distance between a terminus base of telomere on chromosomal short arm and 5'-terminus of this base sequence : 13344729
  Distance between 3'-terminus of neighbour sequence of sequence listing upward to telomere on chrosomal short arm and 5'-terminus of this base sequence : 37372
ttagcattgcatcccatgtataatatatatagtaaacaatgcacataaaataatttttctctctctctcctctctttgtcattctctcttacacacacacaaacacacacacacacacacacacacacacaaataggaagtaacttactagattggtcacttaactgacaaa

SEQ ID NO: 13471 - DNA, 117 bp, Homo sapiens
  DISO7_10002424
  Located on chromosome 8
  Distance between a terminus base of telomere on chromosomal short arm and 5'-terminus of this base sequence : 13353818
  Distance between 3'-terminus of neighbour sequence of sequence listing upward to telomere on chrosomal short arm and 5'-terminus of this base sequence : 8917
caaatacctgccagctgtcatatatatatatatatatatatatgtatatatatatatatatatatatgtatcacctttcttcttactgttttagatgaactttctgtgctcctatat

SEQ ID NO: 13472 - DNA, 264 bp, Homo sapiens
  DISO7_10002426
  Located on chromosome 8
  Distance between a terminus base of telomere on chromosomal short arm and 5'-terminus of this base sequence : 13387202
  Distance between 3'-terminus of neighbour sequence of sequence listing upward to telomere on chrosomal short arm and 5'-terminus of this base sequence : 33267
agaataatgcagatgcacatgcacacacacacacacacacacacacacacacacacacctgcatgtaaaatgaaacatgtaagaaataatacagagagacccaacggtacccttctctagttttttgaaaggcaacgtctttaaaaactatgtagtacaatatcacaaccagaatgttgacatcaatccagtcaaaatacagaacagttccatcaccacaaggatatatgaagtttgaagtgcctatagatagtattcaagcaa

SEQ ID NO: 13473 - DNA, 183 bp, Homo sapiens
  DISO7_10002427
  Located on chromosome 8
  Distance between a terminus base of telomere on chromosomal short arm and 5'-terminus of this base sequence : 13387585
  Distance between 3'-terminus of neighbour sequence of sequence listing upward to telomere on chrosomal short arm and 5'-terminus of this base sequence : 119
aatacatggacattgaggacctttttaaacttagggttttatgcaatacatgtctagtagagagttagaaatatatgtaggtagtgattccacctataaaacaagctccacttgggaaaatagtttacacacacacacacacacacacacacacattcatgcatgcgcctatccacagatggt

SEQ ID NO: 13474 - DNA, 319 bp, Homo sapiens
  AC022880.2_67948
  Located on chromosome 8
  Distance between a terminus base of telomere on chromosomal short arm and 5'-terminus of this base sequence : 13489399
  Distance between 3'-terminus of neighbour sequence of sequence listing upward to telomere on chrosomal short arm and 5'-terminus of this base sequence : 101631
caagaatcatgtaaggctacatcccacagagatgtcttttgatatatatatatatatatatatatatatatatatatatatatatatatatatatatcacaaagaaaatatatatattttcacaaagagtttggtgtaatctggcagtgtatctggctaggacccaccatcctaaagttccctttaacctgggcagatacatctaggtggacatttgttactcttctcatcccatggacaggtggaagtgcatatccaaccactctattttaaagtgtccttgctcttgcagatagctctatattgctcaggacacgag

SEQ ID NO: 13475 - DNA, 107 bp, Homo sapiens
  DISO7_10002428
  Located on chromosome 8
  Distance between a terminus base of telomere on chromosomal short arm and 5'-terminus of this base sequence : 13503129
  Distance between 3'-terminus of neighbour sequence of sequence listing upward to telomere on chrosomal short arm and 5'-terminus of this base sequence : 13411
ttaccagaagcttacactcctgatgttaattacacacacacacacacacacacacacacagaaacgtatatgcaaatgatagaagggtatgcagagtttctagacga

SEQ ID NO: 13476 - DNA, 173 bp, Homo sapiens
  DISO7_10002429
  Located on chromosome 8
  Distance between a terminus base of telomere on chromosomal short arm and 5'-terminus of this base sequence : 13541893
  Distance between 3'-terminus of neighbour sequence of sequence listing upward to telomere on chrosomal short arm and 5'-terminus of this base sequence : 38657
tgcattagcaataccatgcttgaaatacacacacacacacacacacacacacacacacacacacacacacacacacacaaatatacatcatggaacttttggtttaaccacccagccatggttttcacggtcataaaccatttaagtcaaaagcaatcaccagtaccctagac

SEQ ID NO: 13477 - DNA, 337 bp, Homo sapiens
  chr8.fa.O7frz.15082821
  Located on chromosome 8
  Distance between a terminus base of telomere on chromosomal short arm and 5'-terminus of this base sequence : 13579726
  Distance between 3'-terminus of neighbour sequence of sequence listing upward to telomere on chrosomal short arm and 5'-terminus of this base sequence : 37660
gatctttaatgcactgtcaaacacatgatagggtaggtgaaaagtgaacttgtcttaaaggaatccactgtgtgtgtgtgtgtgtgtgcatgcgcatgcacacgtaaataattattgtactggctttggctttaagcaactcatgaacttccccaccatggcaggtagaggctagcacttcattaatttacatctaaaatcttgcatggctggggatgagacatgtattttctatgattgtaaaagaaacctggggagctacgctagttagggtggcaattttcaggtgctgtgatatcatcactcaatgcccagtagtactggataaagcatcctg

SEQ ID NO: 13478 - DNA, 453 bp, Homo sapiens
  AC022690.3_77189
  Located on chromosome 8
  Distance between a terminus base of telomere on chromosomal short arm and 5'-terminus of this base sequence : 13682477
  Distance between 3'-terminus of neighbour sequence of sequence listing upward to telomere on chrosomal short arm and 5'-terminus of this base sequence : 102414
gatgttagtcctcaagtatgtgagtccaataaatgagatagttgggtgtggaccttggattagttggtttgcatttgaaaagcatgctagtagttgtgctatttactatccctgaaaactgggtcactgtggtagaaacaggtccctctagggtgagcaaagccccagatgtcaaagcattgagtgcagagaataaaatacataattaatacaagagccaaacatccaagtatttgatgggaatggctggttccttcagtgtgtgtgtgtgtgtgtgtgtgtgtgtgtgtgtgtgtgttggatgatgttggcatgcagtggggatatctctgctggcacagtgagttcaggggaattttgctgttaaaatattttaacattgactatctctgctcaagtgtctccactacagatctcagggtagatcttctttctcattaatgactttgatgt

SEQ ID NO: 13479 - DNA, 408 bp, Homo sapiens
  AC023538.3_214065
  Located on chromosome 8
  Distance between a terminus base of telomere on chromosomal short arm and 5'-terminus of this base sequence : 13766154
  Distance between 3'-terminus of neighbour sequence of sequence listing upward to telomere on chrosomal short arm and 5'-terminus of this base sequence : 83224
agccaatctaatggaatgttacaatgggtctctctcttgtttctcatttacattggagcagtgacaataggtgtcaactcctcccaattccagaattagaggctaaagcattataaatgttacagactttctataaataaatttgtgacacttactaattgtattagtaatccttctccagagaaatagaactaataagatctatctatctatctatctatctatctatctatctatctatcttccatcctccctccctcccaaaaccaagtaggagatttatatgtatacaaaatgagatataaaatgaagaattagctcacacaattatgacggctgacaagtcccaggataaggtgtctgcaagctggagacccagaaagccagtggtataattcagtgcaagtg

SEQ ID NO: 13480 - DNA, 357 bp, Homo sapiens
  AC023538.3_125893
  Located on chromosome 8
  Distance between a terminus base of telomere on chromosomal short arm and 5'-terminus of this base sequence : 13917928
  Distance between 3'-terminus of neighbour sequence of sequence listing upward to telomere on chrosomal short arm and 5'-terminus of this base sequence : 151366
tagcaaatatctcaccatgaacagggtaaacagatattcaatattttcaataggtagtgtttttttttttttttgagaaagcttaaattgtgacactgagatgcacacatctgtgtgtgtgtgtgtgtgtgtgtgtgtgtgtgtgaatgcagagtatagcatctcactggggagtacttgacccgtgtgtgtgtgtgtgtatgtgtactgacacatttacaaaataaaattccaatcttgtaaatacctttccagagaattgaaaaaaaagctgatgccctaatatatgaagtttttattatcatactttaagttctggagtacctgtgcagaatgtgcaggtttgttacataggta

SEQ ID NO: 13481 - DNA, 460 bp, Homo sapiens
  AC009898.4_30527
  Located on chromosome 8
  Distance between a terminus base of telomere on chromosomal short arm and 5'-terminus of this base sequence : 14053665
  Distance between 3'-terminus of neighbour sequence of sequence listing upward to telomere on chrosomal short arm and 5'-terminus of this base sequence : 135380
gcataaccaatgaactcattattcatgaaaaataaataaaagaaggctagagtatggaggtaagggttgagaagaagtaaatatagaatatgctgtcattaagaataaaacagtagataacttgaaattagagaacaagatagaacttagaaacatatattatcatatgcttctaaaaatatgcttctaaaaaataagttgtgtgtagggtgtgtgtgtgtgtgtgtgtgtgtgtgtgtatcagtcaggaagaagtgtttgcagatttaatttttgtttatgaattgccagatcttacgtgaaatcataagcaactgtaatatattattataagataaaagcatagtgcttacttgtactatttgtacaagtttcatccagaaaaagagatttcaattacatttccttgaaagactagttgacatgtatatgaaacaagtaatctttatgcctcaaagct

SEQ ID NO: 13482 - DNA, 310 bp, Homo sapiens
  AC021760.3_59353
  Located on chromosome 8
  Distance between a terminus base of telomere on chromosomal short arm and 5'-terminus of this base sequence : 14388985
  Distance between 3'-terminus of neighbour sequence of sequence listing upward to telomere on chrosomal short arm and 5'-terminus of this base sequence : 334860
ttatttcctcatccatgtactaaggctagtagtcattagttatttttcctgaacctctttatcctatattaggcaagttcctttggcaaagagaatttagtgtacacattgcttctacttgaatgagcacattaaggtgtatttcattcattcattcactcattcattcattcactcattcattcgttcattcactcattcattcattcattcattcattcattcattcatttaatgttactgggctgcaaacaggctactgagccaggacttccaaaacaaataataaagaatcagcttttaagtgact

SEQ ID NO: 13483 - DNA, 391 bp, Homo sapiens
  chr8.fa.O7frz.15978143
  Located on chromosome 8
  Distance between a terminus base of telomere on chromosomal short arm and 5'-terminus of this base sequence : 14450139
  Distance between 3'-terminus of neighbour sequence of sequence listing upward to telomere on chrosomal short arm and 5'-terminus of this base sequence : 60844
aaataactgtagcatgtctgaaagtaatataattctgacatgtttggtccaggtctttttctgctccaaattctgggtccactgtcaagcttccttctcagagagttcaaaacattaattactatttcaagtgtctctttgcctcaccactattctgactagaggttttgtcctttattcacagatagaaagattgataggtagagagatagatgatgatgatgatagatagatagacacatagatagatagacacatagacagatgatagatagatagatacattgatagatagacacatagatagatagatagatagatagatagatagatagatagatagatagatagacagacagacagacagatgtttccactatcaagtgacaaa

SEQ ID NO: 13484 - DNA, 379 bp, Homo sapiens
  AC040926.2_115549
  Located on chromosome 8
  Distance between a terminus base of telomere on chromosomal short arm and 5'-terminus of this base sequence : 14520412
  Distance between 3'-terminus of neighbour sequence of sequence listing upward to telomere on chrosomal short arm and 5'-terminus of this base sequence : 69882
ttcaggcaagattaaatacaagtcatttcaaaataacagtatttttttggaaaacatattaaatatttcctcaatgtcaagatgcacccacatctggtaagttaccaaaacaagtgcatatgtatctgtgtctttgtgtttgtactcacatatatataaatgcctaacatgcacaaacacacacacacacacacacacacacacacacacacacacaccatgtactgatgggtggctggaaagagaaaaggaacggattcataggcagaactataacaacacaacatgtcaggcagatagaacagtggactgaagttccgtggctgctgtcagattcctcagaactcctactagcagctggctaaccttgaactaattc

SEQ ID NO: 13485 - DNA, 457 bp, Homo sapiens
  chr8.fa.O7frz.16098299
  Located on chromosome 8
  Distance between a terminus base of telomere on chromosomal short arm and 5'-terminus of this base sequence : 14570321
  Distance between 3'-terminus of neighbour sequence of sequence listing upward to telomere on chrosomal short arm and 5'-terminus of this base sequence : 49530
tgtacctgaaatttcaacttaaactataaaatgaggaatggatctctgaatgatttttaaattactctacaaaatttttggctataaaagggttcacaatgacaacttcttcaattttttgatgaaatatttctttcttattgcgaattataccttatgttctaaaaataatcatgattttttaaatttttaccattattataaaattgaagggaaagttttcctttatttttgtaacacatgctggcgtcctctaaaactttttacacagccaattaaaatatttgcaggtttctttatgaccaattagaaaagtatcattgattatatatatatatttatatgtatatatatatatatatggcacatatatgcaataattatgtttattttaaaaatgctgtatattaggaacaaatagacaaaaataaattcctggtatcctcgaagcttggat

SEQ ID NO: 13486 - DNA, 396 bp, Homo sapiens
  AC040926.2_7154
  Located on chromosome 8
  Distance between a terminus base of telomere on chromosomal short arm and 5'-terminus of this base sequence : 14601347
  Distance between 3'-terminus of neighbour sequence of sequence listing upward to telomere on chrosomal short arm and 5'-terminus of this base sequence : 30569
acctagactacaggctattctgtctctgcactcaaaagtatcatccctgcaatgccagaacttttggaggccaatgcagaaggatctcttaaggccaatgcagaaagatctcttaaggccaggagtttgagaccagcctgaacagcatagagagatcccacctctacaaaaatgaaatagatgtgtgtgtgtgtgtgtgtgtgtatctccagccctgatggcatatgcctgtagttctagctacttgggaggctgagacaggaggatcacttgagtccaggacttcgaggctgtgatgaggtatgattgtgctatggcacttcagcctggagacagagtgagactccatctctatcagagtaaacctcaaaattaatcacaatgatttaactgcct

SEQ ID NO: 13487 - DNA, 478 bp, Homo sapiens
  AC040926.2_47063
  Located on chromosome 8
  Distance between a terminus base of telomere on chromosomal short arm and 5'-terminus of this base sequence : 14627803
  Distance between 3'-terminus of neighbour sequence of sequence listing upward to telomere on chrosomal short arm and 5'-terminus of this base sequence : 26060
aataaaggacaccgctatttactcagttgctcaagtcaaacaccttggggtcactgatgactttctctcaaatgccagttcatatatcagcaaattctgctggcttcaatgatagatagatagatagatagatagatagatagatagatagatagatagacagacagacaggcagacaggtaggtagttaggtagatagatagatagatagatagatagatagatagatagatagatagatagatagatagatagatagataaaaagatagatagacaggcagacaggtaggtagttaggtaggtagatagatagatagatagatagatagatagatagatagatagatagacagacagacagacagatagatttatttgaacaattcttacctcctccattactaccatcctgaagcaagtttccattattttccctctggactgttaacttgtttccaatagtacattgtaagagc

SEQ ID NO: 13488 - DNA, 208 bp, Homo sapiens
  Z23542.1_158
  Located on chromosome 8
  Distance between a terminus base of telomere on chromosomal short arm and 5'-terminus of this base sequence : 14747126
  Distance between 3'-terminus of neighbour sequence of sequence listing upward to telomere on chrosomal short arm and 5'-terminus of this base sequence : 118845
agtactaaaaatcctagccaggacaattaggcaagagaaaaaatattaaggacatccaaattgaaaacaaagaagtcaattgtccctgttggcagatgacttgattttaaatataaaaaaccctaaagattacacacacacacacacacacacacacacacacacacggttagaactaataaataaattcagttaagtttcaggacac

SEQ ID NO: 13489 - DNA, 137 bp, Homo sapiens
  D8S511
  Located on chromosome 8
  Distance between a terminus base of telomere on chromosomal short arm and 5'-terminus of this base sequence : 14747205
  Distance between 3'-terminus of neighbour sequence of sequence listing upward to telomere on chrosomal short arm and 5'-terminus of this base sequence : -129
ttgtccctgttggcagatgacttgattttaaatataaaaaaccctaaagattacacacacacacacacacacacacacacacacacacggttagaactaataaataaattcagttaagtttcaggacacaaaaatca

SEQ ID NO: 13490 - DNA, 263 bp, Homo sapiens
  chr8.fa.O7frz.16352586
  Located on chromosome 8
  Distance between a terminus base of telomere on chromosomal short arm and 5'-terminus of this base sequence : 14811088
  Distance between 3'-terminus of neighbour sequence of sequence listing upward to telomere on chrosomal short arm and 5'-terminus of this base sequence : 63746
ccttaatacctagattgatctgttagaaatttagcatatttctgtacagtctgtcttttttaatcataaaggactttatgttatatatatatatatatatatatatatatatatatatatatatatatataaaattgtatacttagctttttcacttaaggtaatagcacattaatttctgttattacaaagtttgaccacttaatattctatcccatgcatgctcatatatttttaagccagaccgttagtattgaacattg

SEQ ID NO: 13491 - DNA, 336 bp, Homo sapiens
  chr8.fa.O7frz.16653950
  Located on chromosome 8
  Distance between a terminus base of telomere on chromosomal short arm and 5'-terminus of this base sequence : 15102647
  Distance between 3'-terminus of neighbour sequence of sequence listing upward to telomere on chrosomal short arm and 5'-terminus of this base sequence : 291296
gaatgctgatcatgtatgagacaccatttttaagaactatagggtagtcaaagaggtacaggctacaactattatcccctaagacatctaaccctgatgtaaaaagtagaaacatctataggcacacacacacacacacacacacaaacaaacacacacacacacacacacacacacatatacatacatggcataccaggataggcgttatactataattacaactaagtgatatgagacagcattcagcagagcaatcttgtgaaataccattccgtgtcctgtataaatatttcaaatttaaataacgtaactcaggacttactagaccagata

SEQ ID NO: 13492 - DNA, 309 bp, Homo sapiens
  chr8.fa.O7frz.16735620
  Located on chromosome 8
  Distance between a terminus base of telomere on chromosomal short arm and 5'-terminus of this base sequence : 15184278
  Distance between 3'-terminus of neighbour sequence of sequence listing upward to telomere on chrosomal short arm and 5'-terminus of this base sequence : 81295
tacttgacttctaatgcctcagttggctcacaaactgcaagatgctaataatccatatatatacagggatacatatatatccacatatatatggagtagtatcttatataattcctatatatcctaaatatatatatacacatatccctatacatatatatagagagagagagagagagagaattgttcctaatactatctaaaaggatttaacattttttcataaattactgcatttgttatgaaaaaactgagttcttcagagtggtgtggtagaggtcaaaggaatcctagacttggagttctaag

SEQ ID NO: 13493 - DNA, 231 bp, Homo sapiens
  D8S1731
  Located on chromosome 8
  Distance between a terminus base of telomere on chromosomal short arm and 5'-terminus of this base sequence : 15323884
  Distance between 3'-terminus of neighbour sequence of sequence listing upward to telomere on chrosomal short arm and 5'-terminus of this base sequence : 139297
agcaaacttatcccacaagggaaattatgatttcagcagaatctgtggcttttggttatacaagtgaagcaaagtgtgtgtgtgtgtgtgtgtgtgtgtgtgtgtgtgtgtgtgtgtgtacgcatctggtggcatgtggtgttgattgggtggttggttggttgttttatttctattgagtctttagaaaaatactgatatggttagtattgatttccatgatttgcttgt

SEQ ID NO: 13494 - DNA, 471 bp, Homo sapiens
  chr8.fa.O7frz.17025240
  Located on chromosome 8
  Distance between a terminus base of telomere on chromosomal short arm and 5'-terminus of this base sequence : 15456001
  Distance between 3'-terminus of neighbour sequence of sequence listing upward to telomere on chrosomal short arm and 5'-terminus of this base sequence : 131886
cagaacaagactctgtttcagtcaaccaatcaatcaatcaatcaataaatcccattctgtcttggggtgtgtgtgtgtgtgtatatatatttgtgtgtgtgtgtatatatatgtgtgtgtatatatatatatacacacaattctctcggtgtatatatatgtatctatatatataatcatatatatatatatatatatatatatatgattctttttctctggaaaattctcactcatacataagtcaaatttttttcccagattgcatgctgcacgtttaaccccatatattcaagaagttaggaattacaattgtaacgttaccaaaattattactcgaaaaattaatctagccacctaaacagtaaatgaaaataactcacaaatgagtgtgacatcatatacaaaaaattgattatgataaatatctctaaaacataagattaaggctaaccaacttggtagctacaa

SEQ ID NO: 13495 - DNA, 385 bp, Homo sapiens
  chr8.fa.O7frz.17154682
  Located on chromosome 8
  Distance between a terminus base of telomere on chromosomal short arm and 5'-terminus of this base sequence : 15608662
  Distance between 3'-terminus of neighbour sequence of sequence listing upward to telomere on chrosomal short arm and 5'-terminus of this base sequence : 152190
ctcaacttgtagaagcttacaaagctagaatgtgattgaactgagatttgatctcattgatctgattgcaagttctgtattgtttacacaaagctgggcttctttaaatctggacatgtgtcttatatgttggtgattcaacccagtagatacagtgagcccttatgactacaaataaattcatagaagaactttatatgatgtatagatgttaaatacttcagttgatcagttttcttgaaaacctctgctatgttatacagatttattattattattattattattattattattattattattattttgctcttttactgtgaatcttggaaagcgaattaacttggcatggcagaagataaattctaagataccttggcag

SEQ ID NO: 13496 - DNA, 170 bp, Homo sapiens
  D8S549
  Located on chromosome 8
  Distance between a terminus base of telomere on chromosomal short arm and 5'-terminus of this base sequence : 15736669
  Distance between 3'-terminus of neighbour sequence of sequence listing upward to telomere on chrosomal short arm and 5'-terminus of this base sequence : 127622
aaatgaatctctgattagccaacctctaacacacacacacacacacacacacaccctctacccacctttaatggaagtaataatttatttaatattattgaacatcaaatatataccaagcaatgttttaaaacttaacagtgaatgaggtagaaataggttggctctca

SEQ ID NO: 13497 - DNA, 429 bp, Homo sapiens
  chr8.fa.O7frz.17406162
  Located on chromosome 8
  Distance between a terminus base of telomere on chromosomal short arm and 5'-terminus of this base sequence : 15856929
  Distance between 3'-terminus of neighbour sequence of sequence listing upward to telomere on chrosomal short arm and 5'-terminus of this base sequence : 120090
aacatgtcgtgtaggtctgtagcctgggatcaataggctcgaacacacagcttgcatgtgtagcaggctatgccatctaggtttgtgtaagcgcactccgtgatattcacacaatgatgaaatcgcctaacaatgcatttcttcaaatggggacatttctctgaatcgatctcctttgttaagtgatgcatgactctgtgagagagagagagagagacggagagagagagagagaggttatatgtgtgtgtgtgtgtgtgtgtgtgtgtgtgtgtgtgtgtgtgtgtgtatgaggagagagaccgagggctggggagggaggggggtggattttaagaaatttggccatgcgtgaatgtggtggctagcatatccaaaattctaaggacaagccaggaggctgaatattcaggtaggaactgatgtagt

SEQ ID NO: 13498 - DNA, 480 bp, Homo sapiens
  chr8.fa.O7frz.17486165
  Located on chromosome 8
  Distance between a terminus base of telomere on chromosomal short arm and 5'-terminus of this base sequence : 15917751
  Distance between 3'-terminus of neighbour sequence of sequence listing upward to telomere on chrosomal short arm and 5'-terminus of this base sequence : 60393
ctttatcctagaagatagcctgagtcctaaatgttgacccgtgaccttgtgttcctctcacaggaatcttgtttgtaccagcagatgcccttgcggctcttatctgatctatgtccactttattcctgtcattataaccactctctaagagagctgtgaatagaaataaggtgagaagcaggtgtgtgtgtgtgtgtgtgtgtgtgtgtgtcaggtgagacacaacaaggaagggaaaccaaaatgcatgaagtagaagaaatttgttactcaatggtctcagagaggtcaggaactaagggatgccaaagggaggccaatggaaagcccagagttggtggagagtacaaccagtgagtaaggggaggagagggaggaggaagggaagggcagcagggagagagagagagagagagagagagagagagaatgagaacaagcccatgagactatgcctttattaaggtccatgaacattgt

SEQ ID NO: 13499 - DNA, 180 bp, Homo sapiens
  chr8.fa.O7frz.17560432
  Located on chromosome 8
  Distance between a terminus base of telomere on chromosomal short arm and 5'-terminus of this base sequence : 16012176
  Distance between 3'-terminus of neighbour sequence of sequence listing upward to telomere on chrosomal short arm and 5'-terminus of this base sequence : 93945
gtcattagtgatcgaagtcaatctccagccccttccccttccctgaaggttggaaagtgtggctgaaacttccaactctctaattacatgtgtttgttgttgttgttgttcttgttgttgtttttgtgactaccttcatttggaagatatatagggacctaccacgtatcacctcagtag

SEQ ID NO: 13500 - DNA, 392 bp, Homo sapiens
  AC023396.2_145671
  Located on chromosome 8
  Distance between a terminus base of telomere on chromosomal short arm and 5'-terminus of this base sequence : 16095641
  Distance between 3'-terminus of neighbour sequence of sequence listing upward to telomere on chrosomal short arm and 5'-terminus of this base sequence : 83285
agcaatgtaaagtatcaacgagtgttttataaaataaattggtgtcttggctctgaaatatattactttatctatcatggacctgttcttacatatttcattgtaatcccagggtaaataaacataaacataaacacacacacacacacacacacacacacacacacatgcgatacacagatttacttatgagtatgtactatatacttacacaaatccagggtttcatatgcttaaatgaaaactgaaaatggctattttttttacccaatattactatggtgatcataacaactgtatataaaagaaaatgttatattccagtgaaataaaatattttatcctagagttcagtagttcttgataaactattgtaacagtttaggcatctt

SEQ ID NO: 13501 - DNA, 475 bp, Homo sapiens
  chr8.fa.O7frz.17770751
  Located on chromosome 8
  Distance between a terminus base of telomere on chromosomal short arm and 5'-terminus of this base sequence : 16219113
  Distance between 3'-terminus of neighbour sequence of sequence listing upward to telomere on chrosomal short arm and 5'-terminus of this base sequence : 123080
tcacaatctattgattacggacaaacactattcccttccttcttcaaggcttggttagcctgctatgatttaatgtactcttagaagtcaaaatcttctgatttcaagattattttctgtgctatacgtttcaccaatctatattggcactgaaagacaagtatatgattcatcctcaaagtgtctcaacttaaaggtctactttgattggaagaagggccaaggtattaaccaaaaacaaaaaacagcaatttaaatgaattcattagtataacaatatgttattatattaaacattaattgaggaagaattgaatctgataagaaataaaataaaaagctaagagcaaaacattattagtggagaaatagatctttcctctctctcctcactttccgtgtgtgtgtgtgtgtgtgtgtgtgtgtgtgtgtgtgtgtgtgtgagatgtaactacttgatctgctttcatagtct

SEQ ID NO: 13502 - DNA, 428 bp, Homo sapiens
  chr8.fa.O7frz.18080971
  Located on chromosome 8
  Distance between a terminus base of telomere on chromosomal short arm and 5'-terminus of this base sequence : 16429672
  Distance between 3'-terminus of neighbour sequence of sequence listing upward to telomere on chrosomal short arm and 5'-terminus of this base sequence : 210084
tcttctgtttgtcaacttgaaggagaactttataaattcatgttattaattttctgttgatttatcattttcaagtatcttttcccaatttgtggtttgttttctatgtttttaaaaggttccccttaatgaacaaatttcttattaaatttagtgataatgaaattttaagagattttaagaaatattttatagtttatatttaagtatacaagataattttttaatatacataatgaaatagttcctatattcaggcaaattaacatatctgtcatcttacagttatcccttggagtgcatgtgtgtgtgtgtgtgtgtgtgtttgtgtgtgtgtgtgaggtcacctaaaatctactctctcagcacacttccagtatacaaaacaatattattagctattatcctcgtgctgtacattaaatttc

SEQ ID NO: 13503 - DNA, 307 bp, Homo sapiens
  chr8.fa.O7frz.17957894
  Located on chromosome 8
  Distance between a terminus base of telomere on chromosomal short arm and 5'-terminus of this base sequence : 16553062
  Distance between 3'-terminus of neighbour sequence of sequence listing upward to telomere on chrosomal short arm and 5'-terminus of this base sequence : 122962
gctatgaatataagttagctgcagaattgtgaaagaattgttaaggactatataggaaatggttttacttccactttctcctgaaacagctctctctgtatctgtctctgtcacacacacacacacacacacacacacacacacacacacgaaacattgaatgggattgcagcagacttctgagagttggaaagtagatgaacaagaggttttaataaagcaagtaagagagccaagaaacaagctaatttgcaccagcagataaagaggcactagaattagaattcaccaggtacttctgtaagta

SEQ ID NO: 13504 - DNA, 169 bp, Homo sapiens
  DISO7_10002436
  Located on chromosome 8
  Distance between a terminus base of telomere on chromosomal short arm and 5'-terminus of this base sequence : 16680148
  Distance between 3'-terminus of neighbour sequence of sequence listing upward to telomere on chrosomal short arm and 5'-terminus of this base sequence : 126779
aggaaagaattgtgtaacatggtattagaattaattgcatttttaggttagaatatagtcattcacaaaatctgtattgggttgactttattaccaaaagatttctagcacacacatacacacacacacacacacacacacgcacatccacacactgcatgagtgcttt

SEQ ID NO: 13505 - DNA, 102 bp, Homo sapiens
  DISO7_10002434
  Located on chromosome 8
  Distance between a terminus base of telomere on chromosomal short arm and 5'-terminus of this base sequence : 16689625
  Distance between 3'-terminus of neighbour sequence of sequence listing upward to telomere on chrosomal short arm and 5'-terminus of this base sequence : 9308
agaggacctagaacaggcttactttgttaatgtgtgtgtgtgtgtgtgtgtgtgtgtgtgtgtgtgtgtgtgtgtaagggagctgtggatcataactaacca

SEQ ID NO: 13506 - DNA, 171 bp, Homo sapiens
  DISO7_10002431
  Located on chromosome 8
  Distance between a terminus base of telomere on chromosomal short arm and 5'-terminus of this base sequence : 16761484
  Distance between 3'-terminus of neighbour sequence of sequence listing upward to telomere on chrosomal short arm and 5'-terminus of this base sequence : 71757
tggagtcagtgaagacaacctttttcattcactatatggtaattgttttttaaatgatgccacgaatatatatatataatatatatattatatatataatatatattttatatatatatatatatatatatagtgatctcggataaatttgttgtgataattgtctgccaa

SEQ ID NO: 13507 - DNA, 155 bp, Homo sapiens
  DISO7_10002430
  Located on chromosome 8
  Distance between a terminus base of telomere on chromosomal short arm and 5'-terminus of this base sequence : 16835918
  Distance between 3'-terminus of neighbour sequence of sequence listing upward to telomere on chrosomal short arm and 5'-terminus of this base sequence : 74263
ggatcaggtgaaatcatatgagattatatacaggaaactcttttataaaatctatccaacaactatttattgtacaccttctatatgccggacatacattagtgaataacacacacacacacacacacacacacaccctgcttgtggtgtttaca

SEQ ID NO: 13508 - DNA, 240 bp, Homo sapiens
  Z66706
  Located on chromosome 8
  Distance between a terminus base of telomere on chromosomal short arm and 5'-terminus of this base sequence : 16903734
  Distance between 3'-terminus of neighbour sequence of sequence listing upward to telomere on chrosomal short arm and 5'-terminus of this base sequence : 67661
gaaaactgaagaaatgaggatactactttataagtagaagagaatacggttgcaaagaggcagaaaccaagtatacacacacacacacacacacacacacatacacacacacacacactacacacatgttgtttttaggtgccatttcagaggcattgtatctgtgtatgtgtgaatacttggtttgtgttactttgcaactttattgaaataagatcacacatagcatatctgcttgct

SEQ ID NO: 13509 - DNA, 187 bp, Homo sapiens
  DISO7_11505124
  Located on chromosome 8
  Distance between a terminus base of telomere on chromosomal short arm and 5'-terminus of this base sequence : 17131013
  Distance between 3'-terminus of neighbour sequence of sequence listing upward to telomere on chrosomal short arm and 5'-terminus of this base sequence : 227039
tattacagtgttatgcccagcaatgtgtatatatatggatgtatatatgtgtgtgtgtgtgtgtgtgtgtgtgtgtgtgtatatatatatatatacacaccacagtgttttttctttataggattttcaagacagtggcataaaaaatttaagagactttttagttcttgggtgtcaattaatattg

SEQ ID NO: 13510 - DNA, 265 bp, Homo sapiens
  AC072058.1_86060
  Located on chromosome 8
  Distance between a terminus base of telomere on chromosomal short arm and 5'-terminus of this base sequence : 17251602
  Distance between 3'-terminus of neighbour sequence of sequence listing upward to telomere on chrosomal short arm and 5'-terminus of this base sequence : 120402
ttagcaatttatggtttcacacatgaatgaatataattcaggttttcttggctttaaggttagctttccctgttgacctttttttcgttttttgttgttgttcttgttgttgttgttgttgttgttgttgttgagacggagtttcacttttgttgcccaggctggagtgcaatggtgtgttctcagatcactgcagcctctacgtctcaggttcaagtgattctcctgcctcagctccccaagtagctgagattacaggcactcg

SEQ ID NO: 13511 - DNA, 348 bp, Homo sapiens
  AB020858.1_88789
  Located on chromosome 8
  Distance between a terminus base of telomere on chromosomal short arm and 5'-terminus of this base sequence : 17268408
  Distance between 3'-terminus of neighbour sequence of sequence listing upward to telomere on chrosomal short arm and 5'-terminus of this base sequence : 16541
actatagaaatatgcctagctggagaatcagactaaaatgatgttaaaacgtgtgtgtgtgtgtgtgtgtgtgtgtgtgtgtgtgtgtgtgtgtttaacttgccacccctagagacaattaactttagtctaaaacttaagtttgtcatccctggattacaattagtttttattttctgtacttactaatttttctataatatatatctattaactataatttttttaatagtacttatttaagaaaattacgtaactcttttaaaaggcaactataattctaggagactgactttaattcagcaaatatttattttctacctacaatttaattctgacgctaaccac

SEQ ID NO: 13512 - DNA, 451 bp, Homo sapiens
  AB020859.1_33850
  Located on chromosome 8
  Distance between a terminus base of telomere on chromosomal short arm and 5'-terminus of this base sequence : 17313421
  Distance between 3'-terminus of neighbour sequence of sequence listing upward to telomere on chrosomal short arm and 5'-terminus of this base sequence : 44665
tagttagatttctgcaatggagattttattgttggtttaaaaatgcttgcaagtatattcatgtatatgtttcttgctgtttttctcaagcttgaagcatagatagatagatagatagatagatagatagatagatagatagaggtgtttcccaaagtggttcctcagcacatcaatgcatacttaaaaaaaaaagttgcttagtcaagtttaagaaatatcataataaaactggttaaataagtttcttccccatagagtttattagattgtaatatgctactatgcattttgtcttgccaaaaggaaatggcagtattcagcattttacaaattaggtttgagatctagtgttttatggaacccattttgggaaatactcatctaaaatgtttagaggcaagcaggcttacttatttgtctaaggtggtaaccgttgtagctgagttaa

SEQ ID NO: 13513 - DNA, 249 bp, Homo sapiens
  AB020859.1_42490
  Located on chromosome 8
  Distance between a terminus base of telomere on chromosomal short arm and 5'-terminus of this base sequence : 17322054
  Distance between 3'-terminus of neighbour sequence of sequence listing upward to telomere on chrosomal short arm and 5'-terminus of this base sequence : 8182
agcataatcagctttgaaacagcagtgagggagaggacctgaatgggccctcctcttctgagttaaaacttttaagggaatcccaaaagttcctgagatcagtgtacacacacacacacacacacacacacacacacacacaccagaatgaagcagaagaaactatcccaaaagagtcttacatgataatcaagcataaactttaaaagaattcaaccaaatccagataaaggtagccactatgagtga

SEQ ID NO: 13514 - DNA, 313 bp, Homo sapiens
  AB020860.1_92052
  Located on chromosome 8
  Distance between a terminus base of telomere on chromosomal short arm and 5'-terminus of this base sequence : 17471646
  Distance between 3'-terminus of neighbour sequence of sequence listing upward to telomere on chrosomal short arm and 5'-terminus of this base sequence : 149343
ctattgcatttggatagtggatctcttaagttccttttaataatgaaccatttctccccaacttttctcttttatacacacacacacacacacacacacacacacacacacacacagacatatacatatgtgtatttacatatgttcgtatacatgtacacaaatatgggaataaatacatgtccatgtacatacatccatgcgtgtatattagacatagtgtgtgtttattaaattggttatttgtcctataaaattttccatatcctgttttttccttagtgcctccttgtggtaccattgaagatgtttc

SEQ ID NO: 13515 - DNA, 350 bp, Homo sapiens
  AB020862.1_75434
  Located on chromosome 8
  Distance between a terminus base of telomere on chromosomal short arm and 5'-terminus of this base sequence : 17654895
  Distance between 3'-terminus of neighbour sequence of sequence listing upward to telomere on chrosomal short arm and 5'-terminus of this base sequence : 182936
gtctcaacatttctgaaacgacataattatagagatggaaaacaggttaatggttgccagggtttagggatgggaacagacgtgtggatgtggctactaaggggtaataggaaggagcctttggggacagtaaagcatcttgattgtggtattggatatgtgaagctacacacgtgataaatttgcatagagatgtgggtacacacaaacacacacacacacacacacacacacacacacaaagggttacatgtttggtgaaatctaaagctctgtggattgtaccaatgtcaatttcctagcaaaactgtgctatagttatacaagatgttaacatctggtgaggttag

SEQ ID NO: 13516 - DNA, 365 bp, Homo sapiens
  AB020863.1_14703
  Located on chromosome 8
  Distance between a terminus base of telomere on chromosomal short arm and 5'-terminus of this base sequence : 17694116
  Distance between 3'-terminus of neighbour sequence of sequence listing upward to telomere on chrosomal short arm and 5'-terminus of this base sequence : 38871
accatggcacatgtatacctatgtaacaaacctgtgtgttctgcccatgtatcccagaacttaaagtaaaataaaagataaaaatacagaaattagccaggtttggtggcaggtgcctgtaatcccagctgcttgggaagctgatgcaggagaattgcttgaatctgggaggtggaggtttcggtgagccgagatcgtgccactgcactccagcctgagtgactgagcgagactctgtctcaacacacacatacagacacacacacacacacacacacacacacacacacacacacagaatcccagccaagtaggagttcatttccatcaagcttcaattagttaaggtaatcacagcatgaatc

SEQ ID NO: 13517 - DNA, 391 bp, Homo sapiens
  AB020863_24126
  Located on chromosome 8
  Distance between a terminus base of telomere on chromosomal short arm and 5'-terminus of this base sequence : 17703591
  Distance between 3'-terminus of neighbour sequence of sequence listing upward to telomere on chrosomal short arm and 5'-terminus of this base sequence : 9110
cctgaacaacatgatgaaaccacgtctctactaaacgtacgaaaattagccgggcgtgatagcaggcgactgtaatcccagctacttggggggccaaggcaggagcatcgcttgaacctgggaggcagaggttgcagtgagccaagatagcaccgctgcactccagcctgggtgacagagcaagactctgtctcaaaataaacaaataataataataataataataataataataaaagagtgagctggcctttttttgtgtacgaaagtatctgcagaaaagtcaaaattgcctaactgataacataaatgacaatacttatgtatttaaaaacagtaaaatgttgagaatatctataactaggaaaaaaagctgtagaattggcacact

SEQ ID NO: 13518 - DNA, 163 bp, Homo sapiens
  AB020865.1_26814
  Located on chromosome 8
  Distance between a terminus base of telomere on chromosomal short arm and 5'-terminus of this base sequence : 17963331
  Distance between 3'-terminus of neighbour sequence of sequence listing upward to telomere on chrosomal short arm and 5'-terminus of this base sequence : 259349
ataagcactcaagcagtttcagttttcttctctctctgacccactgccacactctttgcttacacacacacacacacacacacacacacacacgggggggttgggggggaagcactacagtcagaatcacaatgcaaaagtgagaaataagcaaggttctaga

SEQ ID NO: 13519 - DNA, 166 bp, Homo sapiens
  chr8.fa.O7frz.19101720
  Located on chromosome 8
  Distance between a terminus base of telomere on chromosomal short arm and 5'-terminus of this base sequence : 18305071
  Distance between 3'-terminus of neighbour sequence of sequence listing upward to telomere on chrosomal short arm and 5'-terminus of this base sequence : 341577
acagtttcatattgcctacactaccctcctctagacccaggcagtacagcatgaaaagagagagagagagagagagaagtgccacaaagtgccaccccatcacagtggaacacagcattctgtagaattttaccagtgcccacaaagcaagaaattagaccagttc

SEQ ID NO: 13520 - DNA, 459 bp, Homo sapiens
  chr8.fa.O7frz.22667831
  Located on chromosome 8
  Distance between a terminus base of telomere on chromosomal short arm and 5'-terminus of this base sequence : 18450621
  Distance between 3'-terminus of neighbour sequence of sequence listing upward to telomere on chrosomal short arm and 5'-terminus of this base sequence : 145384
attggctaactctcctactcacttagattgacatgtaaccccccaaaccaacacacactgagctaccacgacatttcacagacatgtccagctctcacacagacctggccacaggaggggatgggaggaggaagggcagggtggtcagaggagcctcagctctgggacccctggacagggtttgaatcccaactctggcacctgctagtggagaggccttgggcaagtcacttaacacttctgaacttctttttctcttttataaagaaaacacgatgtaccacgatgtttaagatttaagattataattgtgtgtgtgtgtgtgtgtgtgtgtgtgtgtgtgtttccctgggagcaatgattcagtattcactaattcagtgtttgcagcgactttatagagcataactataactacagaactatgaataatgagaagtgattgtattggattaacaa

SEQ ID NO: 13521 - DNA, 460 bp, Homo sapiens
  chr8.fa.O7frz.22766122
  Located on chromosome 8
  Distance between a terminus base of telomere on chromosomal short arm and 5'-terminus of this base sequence : 18711253
  Distance between 3'-terminus of neighbour sequence of sequence listing upward to telomere on chrosomal short arm and 5'-terminus of this base sequence : 260173
aagcttttactaagcacctagaagctgcctaacatgtgccagcagtagaaaaatacaggaaagttcaaggggttcacaacatgctaagcagatcaaatatctgcacagataataagaatatagtaatgaagaaagtctttcaatgtctcacttctttccctttttgacccacagtggccagacttcattcatctgttcatttattcattgatccattcatttgtccatccaccatccatccatccatccatccatccatccatccatccatccattcatccatccacccacccttcctttcttccttccatccatttggtcaaccagtcattattggagtacaagatattaaacactggagaagcaaagaggatacaacacagaacctgccctgggaaggagggaggtgatgatacagtcaaggcagcaaaatgcagtacaatatcaagctatggcttaa

SEQ ID NO: 13522 - DNA, 466 bp, Homo sapiens
  chr8.fa.O7frz.22862062
  Located on chromosome 8
  Distance between a terminus base of telomere on chromosomal short arm and 5'-terminus of this base sequence : 18743540
  Distance between 3'-terminus of neighbour sequence of sequence listing upward to telomere on chrosomal short arm and 5'-terminus of this base sequence : 31827
gcctgagcagactaatataatcttctataaacaagcaaatcccaaaggaacagtggggatggtaccaatgtgtgtgtgtgtgtttgtgtgtgtgtataggcaggagtacaggtgttcttttttagagagtgaattttccattgtgtttcatgtttcatctaagtgggttgaaattttttcctatatatgttttattgtgtgatagaagaatggaatgtgtagatttggtggcggtggtgggagggggtgtttaggagataagaagggagaatgaagaggaactatttttcttttcattttgtatctggtccaagagctgaaagaaaagaattgtaattatttgtatgtgcatataccaatgtatctgttctgcattgtttcccaagttgacttccatagtatactagttctgcaaaacgattaatgaaaggtgttaaaaatatccttggtcaagtgagtttatgaa

SEQ ID NO: 13523 - DNA, 150 bp, Homo sapiens
  D8S258
  Located on chromosome 8
  Distance between a terminus base of telomere on chromosomal short arm and 5'-terminus of this base sequence : 18843150
  Distance between 3'-terminus of neighbour sequence of sequence listing upward to telomere on chrosomal short arm and 5'-terminus of this base sequence : 99144
ctgccaggaatcaactgagagacaaaaaaaaatcactcctgcttgatctctgaacatacacacatgcatgtgcatccacacacacacacacacacacacacacacacacaaacatacacacagaggcaggcacacgtgggtccctgtcaa

SEQ ID NO: 13524 - DNA, 271 bp, Homo sapiens
  chr8.fa.O7frz.23102749
  Located on chromosome 8
  Distance between a terminus base of telomere on chromosomal short arm and 5'-terminus of this base sequence : 18994047
  Distance between 3'-terminus of neighbour sequence of sequence listing upward to telomere on chrosomal short arm and 5'-terminus of this base sequence : 150747
ccttctgtcgtgattgaaagcttcctgaggccttcccagaagaagcagctgctatgcttccatgcttcctgtatagcctgaagaattgcaagcaaattcaacctcttttctttataaattacccagtctcagatacttctttatagcagtgcaaaaatgaactagtacacacacacacacacacacacacacactcgcacacccctcttcaattcacatggtttccaattctttgctgtcagcagaagcgaataggagcctaatcaaactg

SEQ ID NO: 13525 - DNA, 353 bp, Homo sapiens
  chr8.fa.O7frz.23242656
  Located on chromosome 8
  Distance between a terminus base of telomere on chromosomal short arm and 5'-terminus of this base sequence : 19120127
  Distance between 3'-terminus of neighbour sequence of sequence listing upward to telomere on chrosomal short arm and 5'-terminus of this base sequence : 125809
ttcaaccgtcataagtctaactagatgctggtttggtttatcattggattagtttattctctatgtagaccaggctaagtctgcagattgaaaataatcagccactgctatcagggttaggaggaaggcagggtcagccctgccatcaccagtggtctgctggttctccaatcaattggaagccatagatataaactgtgtgtgtgtgtgtgtgtgtgtgtgtgtgtgtgaaagagagagacagaggcagagagagagagacacttataaaggctgaaaagtctaagatctgcagccagcaaactgaacacacaggattgctgatggtataaatttgagtctgagtttaaagg

SEQ ID NO: 13526 - DNA, 274 bp, Homo sapiens
  chr8.fa.O7frz.23437552
  Located on chromosome 8
  Distance between a terminus base of telomere on chromosomal short arm and 5'-terminus of this base sequence : 19291695
  Distance between 3'-terminus of neighbour sequence of sequence listing upward to telomere on chrosomal short arm and 5'-terminus of this base sequence : 171215
tagctgaatcatgattaaccactggaagaagaaggaagccaaagtatctgatgcactggagaatgaaaacccgttcaaaatcaggttcttacaggaaggacaagggacacttggctatatgtagaccacagacagtatttgatatagtgtgtctgcattctactatatatatatatatatatatattttacatatataaatggaggatcttacattattttgttttaacagaagtatagagaagttttctgtaaaatggaaatgagtatcatga

SEQ ID NO: 13527 - DNA, 381 bp, Homo sapiens
  AC069005.3_39499
  Located on chromosome 8
  Distance between a terminus base of telomere on chromosomal short arm and 5'-terminus of this base sequence : 19352908
  Distance between 3'-terminus of neighbour sequence of sequence listing upward to telomere on chrosomal short arm and 5'-terminus of this base sequence : 60939
atatcctgtcttgaagcctaagttgtttcctctgcctaaaatattctttccctagatatctgcttggttaactcccttactgtctttaactctttgtttacgtctcaatttctcaatgaaatctatactgactatcctggttaatactgccacctgcactacacacacacacacacacacacacacacacacttcaaatccctcttatttcattttttttctacagtgtttcattttttccacagtaagttttaccttcttgtatgttacataatttacttgtttattccaggcattgtctgtcttatattcctctctgtcctgattgtaaattccattaagggtaaaaatttaaatgttttgttgattgccgtaagagtg

SEQ ID NO: 13528 - DNA, 306 bp, Homo sapiens
  chr8.fa.O7frz.23713094
  Located on chromosome 8
  Distance between a terminus base of telomere on chromosomal short arm and 5'-terminus of this base sequence : 19666250
  Distance between 3'-terminus of neighbour sequence of sequence listing upward to telomere on chrosomal short arm and 5'-terminus of this base sequence : 312961
aacagtatcacagtggtccttaagacttggtcttgttcattttaaaacttcaatctcaaactcagatcaaagctcccctcctgtggctatagcagcctggtgtgtgtgtgtgtgtgtgtgtgtgtgtgtgtgtgtgtgtgtgtgtgtgtgtgtgtgtgtgtgttagggatgaagaggattgtgttgctagattttgcaaataaaaatatagggtgcctggtgaaatttgaatttctgatgaatattgaatattgaatgaaaatatccaaatgcatttttagggtatttcctaggcaatatttagga

SEQ ID NO: 13529 - DNA, 373 bp, Homo sapiens
  HUMUT5398
  Located on chromosome 8
  Distance between a terminus base of telomere on chromosomal short arm and 5'-terminus of this base sequence : 19773681
  Distance between 3'-terminus of neighbour sequence of sequence listing upward to telomere on chrosomal short arm and 5'-terminus of this base sequence : 107125
gtggaggttgcaatgagtgatatcacatcactgtactccagcctgggtgacagagcaagacccagtttcaatataaataaataaataaataaataaataaataaataaataaataaagagaaaacaagattcaagaccttgtcaggttagaataatgggttgagcccaacatgataaaattaagtcattctttaggttcagaagataaattacacaagagtgacatgttataatatgatttaatacatagtggctccttctactggtttaatgaattactcgaaaaaatgatactaggagaagtattactcagaagtgtgggaatcctcagttcttagtcttacttgggagaaagaattcggccaagaaacta

SEQ ID NO: 13530 - DNA, 138 bp, Homo sapiens
  Z67562
  Located on chromosome 8
  Distance between a terminus base of telomere on chromosomal short arm and 5'-terminus of this base sequence : 19811010
  Distance between 3'-terminus of neighbour sequence of sequence listing upward to telomere on chrosomal short arm and 5'-terminus of this base sequence : 36956
accaaaaaatcactggaaactatctctctctttctctctctctctctctctctctctctctgtgtgtgtgtgtgtgtgtgtgtgtatgattcatattaggggaggaggacttattattggctttcctgtagggtgatc

SEQ ID NO: 13531 - DNA, 422 bp, Homo sapiens
  AC022716.3_15526
  Located on chromosome 8
  Distance between a terminus base of telomere on chromosomal short arm and 5'-terminus of this base sequence : 19839371
  Distance between 3'-terminus of neighbour sequence of sequence listing upward to telomere on chrosomal short arm and 5'-terminus of this base sequence : 28223
attgaaatttaatctctaatgcaacagtatttggaagtgtttttttttgttttgttttgttttgttttgtttgaaaaagagtttcactcttgttgcccaggctggagtgcaatggtgtgatctcagctcaccacaacctctgactcccgggttcaagtgattctcctgcctcagcctcccaagtagctgggattacaagcatgtgccaccacgcctggcaaattttgtatttttggtagagacagggttttccatgttggtcaggctggcctcgaactcccaacctcaggtgatccacccacctcggcctcccaaagtgctgtgattacaggcatgagtcaccatgcccggcctggaggtgtgatcttttgggatgtatttaggtcctgagagctccacccttatgaatggactaatgcatc

SEQ ID NO: 13532 - DNA, 145 bp, Homo sapiens
  D8S1116
  Located on chromosome 8
  Distance between a terminus base of telomere on chromosomal short arm and 5'-terminus of this base sequence : 19914791
  Distance between 3'-terminus of neighbour sequence of sequence listing upward to telomere on chrosomal short arm and 5'-terminus of this base sequence : 74998
ccaccagcagtgtgtaagtgatccagtttctttattattattattattattattattattattattattattctttaagttttagggtacatgtgcacaatgtgcaggttagtaaaatttcatataaccatacacacagatgggc

SEQ ID NO: 13533 - DNA, 266 bp, Homo sapiens
  D8S282
  Located on chromosome 8
  Distance between a terminus base of telomere on chromosomal short arm and 5'-terminus of this base sequence : 19959262
  Distance between 3'-terminus of neighbour sequence of sequence listing upward to telomere on chrosomal short arm and 5'-terminus of this base sequence : 44326
gggcacaggcatgtgtttttgcagacacatacaacacaccacacacacacacacacacacacacacacacacacacacaatgtgtaatacaggtccctgtcctattccacagccacaactctcaacaatgtctgtccacacacaggacaatgtgtaccctgctgaccagccctaatttctagatattccatcctgattattttaggaattttggtttccctatgaactttatgcccaatataagagtaccctttcagaatgcagcc

SEQ ID NO: 13534 - DNA, 227 bp, Homo sapiens
  AC022270.3_83624
  Located on chromosome 8
  Distance between a terminus base of telomere on chromosomal short arm and 5'-terminus of this base sequence : 20186903
  Distance between 3'-terminus of neighbour sequence of sequence listing upward to telomere on chrosomal short arm and 5'-terminus of this base sequence : 227375
gaaattctgagctagataggagacccctggggaagtctggaccaagatggggaaaacttgacccacagtgacttcgatgtgttcacccaaagcccagataaatttaaagactccttataggtaattcttatgtacaaatgtacttcctgcttgaatgaatgaatgaatgaatgaatgaatcagtatttactcctgtcttagttagctcaggctgtcataacagaata

SEQ ID NO: 13535 - DNA, 156 bp, Homo sapiens
  D8S298
  Located on chromosome 8
  Distance between a terminus base of telomere on chromosomal short arm and 5'-terminus of this base sequence : 20217983
  Distance between 3'-terminus of neighbour sequence of sequence listing upward to telomere on chrosomal short arm and 5'-terminus of this base sequence : 30853
caggcttacaccatggaccacaggccaacacacacacacacacacacacacacacacacacacaccccacttctctgctttggaaaaagaaaatccaaggggaggcaagagaagcagagcagaaaaggaacgggaaaaatgatgttgtgtgctgcg

SEQ ID NO: 13536 - DNA, 383 bp, Homo sapiens
  chr8.fa.O7frz.24646064
  Located on chromosome 8
  Distance between a terminus base of telomere on chromosomal short arm and 5'-terminus of this base sequence : 20425373
  Distance between 3'-terminus of neighbour sequence of sequence listing upward to telomere on chrosomal short arm and 5'-terminus of this base sequence : 207234
tgattactaggccaagcatagtggctcacacctataatctcagcactttgggaagccaaggtgggaggattgcttgagcccaggagttcaagaccagcctgggtaccatagtgaggcctggtttctacaaaaaataaaaataaataaataaataaataaatatatatatatatatatatatattagctgggtttgatggcgcatgcccctagtcccagctactgaggaggctgagatggggagaatcacttgagcctgggaggttgaggctacagaaagctataatcacaccactgcacttcagcctggatgacacacggagaccccatctcaaaaataaataaataaacaaacaaacaaatatgaatactagctgagcaggt

SEQ ID NO: 13537 - DNA, 440 bp, Homo sapiens
  chr8.fa.O7frz.20733588
  Located on chromosome 8
  Distance between a terminus base of telomere on chromosomal short arm and 5'-terminus of this base sequence : 20532283
  Distance between 3'-terminus of neighbour sequence of sequence listing upward to telomere on chrosomal short arm and 5'-terminus of this base sequence : 106527
aggcatttaccaacttgatatcacttaatcttataaaggaaaaaatcaagattcagagaaacaaggtaaattatctaaggctacatatttaaataaatgatagaacaaaaatccaacctgggtctaacgtctgtggttttctgctccatcacacggcttcctacactatattggaatgaaaatataatggtggaatatctaatgacagataaagatgaaaatgttatagacgaagagatccctaaaacgatgccatgatggtggtgatctagtttgcatctaggtaatacagccttacacacacacacacacacacacacacacacacacacacatctccttttttgtccctccaagtcttggtgattcctctaccttttcaactgcaataggaattcggtattactgtttattaggagctaggataggcagttacatat

SEQ ID NO: 13538 - DNA, 326 bp, Homo sapiens
  chr8.fa.O7frz.20861962
  Located on chromosome 8
  Distance between a terminus base of telomere on chromosomal short arm and 5'-terminus of this base sequence : 20713158
  Distance between 3'-terminus of neighbour sequence of sequence listing upward to telomere on chrosomal short arm and 5'-terminus of this base sequence : 180435
tctgcaaactgttcagttaattgggtgacctatcatttgtttgatgatgctaagcttggttcttctttccctctatagtagatatcattacaataaaagtatttatatttcaacagcagatttttacttattttattttattttattttattttattttattttattttattttattttattttattttattttattttgtgatggagtctcactctgtcaccaggctggagtgcagtggcacaatctcggctcactgcaaactttgcctcctgagttcaagcgattctcgtgcttcagcctcccaagtagctggtatcacaggca

SEQ ID NO: 13539 - DNA, 258 bp, Homo sapiens
  D8S1145
  Located on chromosome 8
  Distance between a terminus base of telomere on chromosomal short arm and 5'-terminus of this base sequence : 20742034
  Distance between 3'-terminus of neighbour sequence of sequence listing upward to telomere on chrosomal short arm and 5'-terminus of this base sequence : 28550
acaatccagtaatctataacttcatttaaaagaattaaatacagatatatatatacatacatataatatagatagatagatagatagatatagataaagtgaaaaggtttattatgagaaataacgtaacaaaagagaatgtgcctgttgtttcttttcctcctctcttagtgttttttttccctgggagaccaagtaacaacatgggagtgagctgatagatgctgatctgaagaagtggtgaccgtgccagttagc

SEQ ID NO: 13540 - DNA, 477 bp, Homo sapiens
  AC024037.3_35838
  Located on chromosome 8
  Distance between a terminus base of telomere on chromosomal short arm and 5'-terminus of this base sequence : 21110383
  Distance between 3'-terminus of neighbour sequence of sequence listing upward to telomere on chrosomal short arm and 5'-terminus of this base sequence : 368091
accagtttctatggaaatgaacaatattccagctaattcaaacactgctgcagataatattaaatagcaatgtcattttaattccaaaattttgacccccacaacacacacacacacacacacacacacacacacacacacacacacacacaccccaataccaaagctccaattccaggtggctcttaaacttctatacccatggcttcaaataataattttgattttgagtcataatttagcctctcacttcaagtgttttattttgagaagggaatgcccacacacacatgcacacacaccacacacacacacacacacacacacacacacacacacacaaatggttgcttagaggacaacctccatcctaagaaaaaataagactggcaagtaatcgagttctttaacttctaagcccccgactgcagagtcacaatgcaccttagtacccttagcaaagacaataaagacgta

SEQ ID NO: 13541 - DNA, 357 bp, Homo sapiens
  chr8.fa.O7frz.21076400
  Located on chromosome 8
  Distance between a terminus base of telomere on chromosomal short arm and 5'-terminus of this base sequence : 21167631
  Distance between 3'-terminus of neighbour sequence of sequence listing upward to telomere on chrosomal short arm and 5'-terminus of this base sequence : 56771
taatgttactcacgccttaaagcttccaaaggcaataatgtttaacccatcatgaagtgttttaagaaaattgaccatagtgactgctgaagctgtatttataaactgcaccaaaacatataacagtgaaatccattcaacaaagggaagaaaagttaaacttagacacttgggagcccgctttgctttaacagtttcaactgccctctggaaaaaacaaacaaacaaacacacacacacaaacacacacacacacacacacacacacacacacacacgcacacacaactgaacactggccccaagagaagtgaccaaaagatatcaaggggcctcagagaattctgataattcctt

SEQ ID NO: 13542 - DNA, 394 bp, Homo sapiens
  AC009884.4_80219
  Located on chromosome 8
  Distance between a terminus base of telomere on chromosomal short arm and 5'-terminus of this base sequence : 21201617
  Distance between 3'-terminus of neighbour sequence of sequence listing upward to telomere on chrosomal short arm and 5'-terminus of this base sequence : 33629
atgatggccactgtattaaatatctacccactattcccaaaaaacattttcatgcaacaggaaatacaccctaaattttagcttgagagaaacagttaccatgctgtcacaatgacaaaagccccaagtgggctgctgagtggcaaggcacccaggggatgtagagtacactcctagagctacttaagaaacggccaccatctaccctgagtaatttcaataattgtgtgatcattaaaaaaaaaatctggtttaatctaaacaactttataaacacacacacacacacaaacacacacacacacacacacacacacacacacacacactctccttctcctatttcaatgcattcaattacctcctaattgctagatgcttcagtctttattgg

SEQ ID NO: 13543 - DNA, 352 bp, Homo sapiens
  AC009884.4_69249
  Located on chromosome 8
  Distance between a terminus base of telomere on chromosomal short arm and 5'-terminus of this base sequence : 21280021
  Distance between 3'-terminus of neighbour sequence of sequence listing upward to telomere on chrosomal short arm and 5'-terminus of this base sequence : 78010
atgcagtattgaactaagtcagactgaatttcagtggtaaaaatacacaaacaaaaaattactacagaagtgaacttggctacagagtcataaggtgatgtgtttactctctcggacaataatcttgggcaacagaaaacacacacacacacatacacacacacacacacacatacacacacacacacacacacacacacactcctgaaactccctggggaggtttcacagtacaccacttccctgggtgtcctgtggctagggtcaactgtgacctacaggcagggccttctctgactgcttttattgatagctgaaccaccagaattggtccaaaattggtaatacctgt

SEQ ID NO: 13544 - DNA, 206 bp, Homo sapiens
  chr8.fa.O7frz.21716219
  Located on chromosome 8
  Distance between a terminus base of telomere on chromosomal short arm and 5'-terminus of this base sequence : 21520701
  Distance between 3'-terminus of neighbour sequence of sequence listing upward to telomere on chrosomal short arm and 5'-terminus of this base sequence : 240328
tagtacttctgttggatgcaacatatatatgtatatatgtatatgtatatatgtatatatgtatatgtatatatgtgtatatatgtatatgtatatatgtatatgtatatatgtgtatatatatgtatatgtatatatgtgtatatatatgtatatgtatatatgtatatatgtatatatatatatggagtttcattctttgttac

SEQ ID NO: 13545 - DNA, 475 bp, Homo sapiens
  chr8.fa.O7frz.21821398
  Located on chromosome 8
  Distance between a terminus base of telomere on chromosomal short arm and 5'-terminus of this base sequence : 21652704
  Distance between 3'-terminus of neighbour sequence of sequence listing upward to telomere on chrosomal short arm and 5'-terminus of this base sequence : 131797
ttagctgaggtcattgaattagatctggaaatgtgtataattccctctccctcccattctctctctccccccacccccacacacacatgtgtatatatatatatatgtatatatatttgcatgtataaagcacctctggtgtctacagacatgcatgtatatatatgcatgtatatgtatgtgtgtgtgtatatatatatatatatatatgacttttgagggcattattttcaaattagttaaatctaacttgaaaaacttttataaataacagaaatcagggagtggtgaggacactgtccagctctgcccaagaggacatcatccggtggtttaaagaggagcagctaccacttcgagcgggctaccagaaaacctcagacaccatagccccctggttccatggtgagtgcagagatttcctcaatggtgtttcgtcttagggcggatgaagctgtgctaatctaccaggaag

SEQ ID NO: 13546 - DNA, 107 bp, Homo sapiens
  Z67318
  Located on chromosome 8
  Distance between a terminus base of telomere on chromosomal short arm and 5'-terminus of this base sequence : 21809371
  Distance between 3'-terminus of neighbour sequence of sequence listing upward to telomere on chrosomal short arm and 5'-terminus of this base sequence : 156192
atggttggttgaatccattcaatatccatgaatgtgtacacatacacacacacacacacacacacacacacgcacacaagtactgactgtacatgagtgtgtatgtg

SEQ ID NO: 13547 - DNA, 236 bp, Homo sapiens
  AF127414.2_21154
  Located on chromosome 8
  Distance between a terminus base of telomere on chromosomal short arm and 5'-terminus of this base sequence : 21833121
  Distance between 3'-terminus of neighbour sequence of sequence listing upward to telomere on chrosomal short arm and 5'-terminus of this base sequence : 23643
gaaataagaggtttctgaaatgtaattattgttctcagagagctgagaaaacattgcattgacaaaataagtacagaatgtcatgaggaaaataatcaccgaacaagaaagaactcgtagaacacacacacacacacacacacacccagaatcaataaaagcttggaagataaacctgaagatatctttcagaatagagaaaaataagaaaagataaccatctaatttccagtttg

SEQ ID NO: 13548 - DNA, 343 bp, Homo sapiens
  AF127414.2_66723
  Located on chromosome 8
  Distance between a terminus base of telomere on chromosomal short arm and 5'-terminus of this base sequence : 21878642
  Distance between 3'-terminus of neighbour sequence of sequence listing upward to telomere on chrosomal short arm and 5'-terminus of this base sequence : 45285
tgagcagtgacaagatacaaggtggccgtaaaaattgtgagcagaggccaagcatggtggctcacacctgtaatcccagcactttgggaggccaaggaaaaaggaaagaaaggaaggaaggaaggaaaggaagaaagaaaaagaaaaagaaaagaaagaaagaaagaaaaagaaagaaagaaagaaagaaagaaagaaagaaagaaagaaagaaagaaagaaaagaaagaaaaagaaggaaagaaagaaggaaagggaaagaaagaaagagagagaaaggaaaggaggaaggaaagaaggaaagaaagaataaataaataagtagtccaaagctgattaaggt

SEQ ID NO: 13549 - DNA, 479 bp, Homo sapiens
  chr8.fa.O7frz.22108111
  Located on chromosome 8
  Distance between a terminus base of telomere on chromosomal short arm and 5'-terminus of this base sequence : 22005423
  Distance between 3'-terminus of neighbour sequence of sequence listing upward to telomere on chrosomal short arm and 5'-terminus of this base sequence : 126438
aaccttaggaacatcctcatacagagttactagtcaaggtgccacttccaggaatgaataaactccagcacttttattcccctcaaaattcaaatccctgggaagaagcttgctattggtccagcctgggtcacacatccattcctggggctgagggaaggcacccgacctgcttttcaatcacaccagactttccttatcgggaagagatgtgattccccaaaaggaaatcagagggcttatggaaaggagtggatgatgagcagcatgaaggagaaaaaaaatgtccagtggaattaggagtgacttctccctttaactattttctttagttgacaggctgcacctagtaattacaaaattgtgttttgttttgtttgatttggtttggtttggtttggtttggtttggtttggttttagacagggtctggctctatcactcaggctggagtgcagtggtatgatcacggctttcac

SEQ ID NO: 13550 - DNA, 120 bp, Homo sapiens
  DISO7_10003444
  Located on chromosome 8
  Distance between a terminus base of telomere on chromosomal short arm and 5'-terminus of this base sequence : 22231348
  Distance between 3'-terminus of neighbour sequence of sequence listing upward to telomere on chrosomal short arm and 5'-terminus of this base sequence : 225446
ccaactcatcaccatttggaaaaatctgcaacctgggacaaaacaaacaaacaaacaaacaaacaaacaaaaaaacacctaacttttaaggaaatgacttgcttctatatttcctgagga

SEQ ID NO: 13551 - DNA, 467 bp, Homo sapiens
  AC074252.2_92333
  Located on chromosome 8
  Distance between a terminus base of telomere on chromosomal short arm and 5'-terminus of this base sequence : 22274701
  Distance between 3'-terminus of neighbour sequence of sequence listing upward to telomere on chrosomal short arm and 5'-terminus of this base sequence : 43233
atgtgataatctggtaagtttcagttccctgatactatctgggagtcctgatggttagtttcctgagaaaggaactcagataagtgtaactttctcaagttttaagactgggagggtcaatttctatgtttattcaaaagaaaccataagcatcagttctatgggataattgaagtggtttcctttccacattaacgtgtgtgtatgcatgtatgtgtgaacatctcacagtaacagctcactgtagcctcagcctcctgggctcaaggcagtgattgcttgaggctaagagtttgagaccagcttgggcaacacagtgaaaccccatatctttaaaacaaaacaaaacaaaacaaaacattagccggaggctggtgtggtggtgtgctcctgtagtcgcagctactcaggaagctgaggaaggaggatcacttgagcccacggacttaagtttgcagtatgctagg

SEQ ID NO: 13552 - DNA, 121 bp, Homo sapiens
  D8S1715
  Located on chromosome 8
  Distance between a terminus base of telomere on chromosomal short arm and 5'-terminus of this base sequence : 22394360
  Distance between 3'-terminus of neighbour sequence of sequence listing upward to telomere on chrosomal short arm and 5'-terminus of this base sequence : 119192
caggtgatgtcccagaggaactggggaaccaagggcgagcacctcacacacacacacacacacacacacacacacaaagaatatcccacaaataacccactggatttctaattcatgttcg

SEQ ID NO: 13553 - DNA, 352 bp, Homo sapiens
  AF238376.2_90276
  Located on chromosome 8
  Distance between a terminus base of telomere on chromosomal short arm and 5'-terminus of this base sequence : 22692897
  Distance between 3'-terminus of neighbour sequence of sequence listing upward to telomere on chrosomal short arm and 5'-terminus of this base sequence : 298416
atgtcaggactcctttgtaaacttttctgaaatgccattttgaaaatgatgcttcacatggaccaggtttctcacttttagtgacatacatatcacaggacatttaaatcgatcagatgattatttcttttacaaatttgaaaactcatctaatgtaagttcaaaacatatatcctttttttatttccgtgttctgaatgtttagagcaaaagcaaaacaataagccaagggggtgtgtgtgtgtgtgtgtgtgtgtgtgtgtgtgtgtgtgtttctttaatagaatgataaaacaaaaatagcctccgttttccttaaactctcaaggtgacactttggttacaagtagag

SEQ ID NO: 13554 - DNA, 210 bp, Homo sapiens
  D8S1786
  Located on chromosome 8
  Distance between a terminus base of telomere on chromosomal short arm and 5'-terminus of this base sequence : 22725393
  Distance between 3'-terminus of neighbour sequence of sequence listing upward to telomere on chrosomal short arm and 5'-terminus of this base sequence : 32144
gtttccacaccgaagcccttgtgtgtgtgtgtgtgtgtgtgtgtgtgtgtttattctcctctttgggctcaggcttttgagcaatcctttgcgggaagctgggagtggtcaagcacagccagccaaaactcctcttgaacaagggtgttttgtttgtttgtttgttttttgttgttttttttctgtgtgagatggggtctcattctttcg

SEQ ID NO: 13555 - DNA, 223 bp, Homo sapiens
  chr8.fa.O7frz.25474865
  Located on chromosome 8
  Distance between a terminus base of telomere on chromosomal short arm and 5'-terminus of this base sequence : 22935680
  Distance between 3'-terminus of neighbour sequence of sequence listing upward to telomere on chrosomal short arm and 5'-terminus of this base sequence : 210077
gtcctgatattacctgcaattatcccagaacacctttcatcctggttctaattaatttttccacttacccccaggagcttctgggagacacatgagatacacacacatacacacacacacacacacacacacacacacacacacacacacacacgaatgcccatattttccttctgagactctccatttgaaagacctgaaaagtatggttagtgaaaggagc

SEQ ID NO: 13556 - DNA, 242 bp, Homo sapiens
  AC055854.3_66370
  Located on chromosome 8
  Distance between a terminus base of telomere on chromosomal short arm and 5'-terminus of this base sequence : 22993484
  Distance between 3'-terminus of neighbour sequence of sequence listing upward to telomere on chrosomal short arm and 5'-terminus of this base sequence : 57581
ctcctaaatcggtggtagatagagaggccccaaatcattgctgggctgctgaaacaggaggctttgacttggataaggaggagtgtgtctgtgtgtgtgtgtgtgtgtgtctgtgtgtgtgtgtgtgtctctgtgtgtgtgtgtgtgtgtgtgtgtgttgtgcgtctatatatttgtatttacagaacattttgggttgctcttgactgaaaccacaagaagcataaatcactgttcctaaa

SEQ ID NO: 13557 - DNA, 152 bp, Homo sapiens
  D8S1752
  Located on chromosome 8
  Distance between a terminus base of telomere on chromosomal short arm and 5'-terminus of this base sequence : 23052630
  Distance between 3'-terminus of neighbour sequence of sequence listing upward to telomere on chrosomal short arm and 5'-terminus of this base sequence : 58904
tcagagttgggtgagcgagactgtgctgttccctttggggtgtctcatggaggggtgtgtgtgtgtgtgtgtgtgtgtgtgtgtgtgtgtgtgtgtgtgagagagagagagagaaagagaaagaaagagtgagttttctgcctgatccagga

SEQ ID NO: 13558 - DNA, 261 bp, Homo sapiens
  AC007868_33242
  Located on chromosome 8
  Distance between a terminus base of telomere on chromosomal short arm and 5'-terminus of this base sequence : 23206155
  Distance between 3'-terminus of neighbour sequence of sequence listing upward to telomere on chrosomal short arm and 5'-terminus of this base sequence : 153373
aatgagagaggttgtgcagggacactcttattttatttatttatttatattattattattattattttaagacagagttttgctcttgttgcccaggctggagtgcaatgatgtgatcttggctcaccacaaccaccatcccccagtttcaagcaattctcctgcctcagcctcccgagtagctgggattacgggcatgcgccaccatgcccagctaattttgtatttttagtagagatggggtttctccatgttggtcag

SEQ ID NO: 13559 - DNA, 364 bp, Homo sapiens
  chr8.fa.O7frz.26204181
  Located on chromosome 8
  Distance between a terminus base of telomere on chromosomal short arm and 5'-terminus of this base sequence : 23502449
  Distance between 3'-terminus of neighbour sequence of sequence listing upward to telomere on chrosomal short arm and 5'-terminus of this base sequence : 296033
ttcatacatcctattggttgatagcacacacacacacacacacacacacacacacacacaaaaatacacattcatacaacctactggttttgtttctctagagaacttgaccaatacccacctccatcctccagatgaaaaaaatgaggacttgagaagggatggggcttgtaatcagtggcagatttggtacaaatgtcagtcccaggcctatttcaagaccccagctgaggcccaggtgtcttaggaatgagctgactgggaagaaaaatatctggttgaagactcccttgaaatgtggcaccgtttttccactctccttggagatttagagagtgccctggcttgtcataaacaatattag

SEQ ID NO: 13560 - DNA, 418 bp, Homo sapiens
  AC051642.2_165673
  Located on chromosome 8
  Distance between a terminus base of telomere on chromosomal short arm and 5'-terminus of this base sequence : 23875878
  Distance between 3'-terminus of neighbour sequence of sequence listing upward to telomere on chrosomal short arm and 5'-terminus of this base sequence : 373065
ctcagcacagatttgtttactatccctggacctttagggctctggacagtggagctgaccatcgtggaaacagcacactggaaacatcaatcagatactggtcttttgacttcatgaccaatcatggtcctttctctttttcttttctttctttctctttctttctttctttctttctttctttctttctttctttctttctttctctttctttcttcctttctttttccttcctccttccttccttccttccttcctttctttctttctttctttctttctttctttctttctttctttctttctttctctctttctttgtttctttctgtgggtgactttgggtaatttacttgacctctatgtccataaaatttaaattaaactgtctattttaaattaaccaagtaggatgttg

SEQ ID NO: 13561 - DNA, 356 bp, Homo sapiens
  chr8.fa.O7frz.26456022
  Located on chromosome 8
  Distance between a terminus base of telomere on chromosomal short arm and 5'-terminus of this base sequence : 24078007
  Distance between 3'-terminus of neighbour sequence of sequence listing upward to telomere on chrosomal short arm and 5'-terminus of this base sequence : 201711
aacaatcactaccaaccttctaaaatataaccttctagccttttatatatgcatgtatatgggtacatatatatatatatatatatatatacccttatacacattttaaaaaacttttaagttcaggggtacatgtgcaggatgtgcagttttgttacataggtaaatgtgtgtcgtgggggttgtcgtacagattatttcatcacccaagtattaagcctaatattcattaagtatttttctgatccaccctccacccccaggtaggccccagtgtgtgttgttcctgtctatgtgtccatgtgttctcagtatttagctcccacttacaagttagaacatgtggtatttggttt

SEQ ID NO: 13562 - DNA, 101 bp, Homo sapiens
  DISO7_10002450
  Located on chromosome 8
  Distance between a terminus base of telomere on chromosomal short arm and 5'-terminus of this base sequence : 24155968
  Distance between 3'-terminus of neighbour sequence of sequence listing upward to telomere on chrosomal short arm and 5'-terminus of this base sequence : 77605
aacagaggctacagatagcttgaacatattttgtgtgtgtgtgtgtgtgtgtgtgtgtgcgtgtgtgtgtgtgattctaagttgactctacatagcagagg

SEQ ID NO: 13563 - DNA, 117 bp, Homo sapiens
  DISO7_10002449
  Located on chromosome 8
  Distance between a terminus base of telomere on chromosomal short arm and 5'-terminus of this base sequence : 24216608
  Distance between 3'-terminus of neighbour sequence of sequence listing upward to telomere on chrosomal short arm and 5'-terminus of this base sequence : 60539
caattccatttcttgagcttctttcttgccctctaagttaaaacaagaagtggcagcacatttgtgtgtgtgtgtgtgtgtgtgtgtgtgtgtgtgcatttcaccacttcttgttcc

SEQ ID NO: 13564 - DNA, 97 bp, Homo sapiens
  DISO7_10002447
  Located on chromosome 8
  Distance between a terminus base of telomere on chromosomal short arm and 5'-terminus of this base sequence : 24254202
  Distance between 3'-terminus of neighbour sequence of sequence listing upward to telomere on chrosomal short arm and 5'-terminus of this base sequence : 37477
tgttcgtctcacaggtgcctgtgcagcgtgtgtgtgtgtgtgtgtgtgtgtgtgtgtgtgtgtgagagacagagagagaatgatggaaacacaggag

SEQ ID NO: 13565 - DNA, 200 bp, Homo sapiens
  chr8.fa.O7frz.27061948
  Located on chromosome 8
  Distance between a terminus base of telomere on chromosomal short arm and 5'-terminus of this base sequence : 24574918
  Distance between 3'-terminus of neighbour sequence of sequence listing upward to telomere on chrosomal short arm and 5'-terminus of this base sequence : 320619
atttccttcattataggaacctactcaaagaggaaagggcagaccatatatgctgtgatgggcattcagttccatttagtactctctctctcttgctctgtgtgtgtgtgtgtgtgtgtttgtgtgtgtgtgtgtgtgagagagagagagagagagagagagagagatggcaagtagagtgatgtataatttcattcgaa

SEQ ID NO: 13566 - DNA, 401 bp, Homo sapiens
  chr8.fa.O7frz.27176062
  Located on chromosome 8
  Distance between a terminus base of telomere on chromosomal short arm and 5'-terminus of this base sequence : 24704600
  Distance between 3'-terminus of neighbour sequence of sequence listing upward to telomere on chrosomal short arm and 5'-terminus of this base sequence : 129482
cactgaattaagcaaggtacagatcatttgaacgtcgccttgttgagcaaagggtaaaaagtctaacaggactaatctcaagaacaaataaggagaaaggaactggaaacaaactgtagactttttatttttttagaaattttactgttagaatccaagaatgggtggtagctgtttgaaaggagaatgatgtaaaagaagaaatatttttcaaaggatagaaaaaatgattatatatatatatatatatatatatatatatagagagagagagagagagagagagagagagatgatagtagagatggggaagaattgctggagtgatgacattgaggggacaggaaggaataaaatcctgcatattaattggggaatagacactagaagcatgaacagtg

SEQ ID NO: 13567 - DNA, 467 bp, Homo sapiens
  chr8.fa.O7frz.27297849
  Located on chromosome 8
  Distance between a terminus base of telomere on chromosomal short arm and 5'-terminus of this base sequence : 24845466
  Distance between 3'-terminus of neighbour sequence of sequence listing upward to telomere on chrosomal short arm and 5'-terminus of this base sequence : 140465
cactttggcagactgaagtgggcggatcacgaggtcaggagattgagaccatcctggccaacgtggtgaaaccccgtctctactaaaaatacaaaaaattagctgggggtggtggcaggcacctgtagtctcagctactcaggaggctgaggcaggagaatggcgtgaacccgggaggtggagcttgcagtgtgagccaagatcgcgccattgcactccagcccgggcgacagagcgagactccatcttaaaacaaacaaacaaacaaacaaacaaacaaacaaataaatgggagttgaacaatgagaacgtatgggcacagggaagggaacatcacacaccgggacctatcagtgggtgggggtgaaggggaggaatagcattaggagaaatatctaatgtacatgacgggttgatgggtgcagcaaaccaccatggcacatgtatacctatgtaacaaacctgca

SEQ ID NO: 13568 - DNA, 285 bp, Homo sapiens
  AF106564.1_125010
  Located on chromosome 8
  Distance between a terminus base of telomere on chromosomal short arm and 5'-terminus of this base sequence : 25084093
  Distance between 3'-terminus of neighbour sequence of sequence listing upward to telomere on chrosomal short arm and 5'-terminus of this base sequence : 238160
tcatcctaagtccttgatcaaaacaacacaaccagaggaacccacagctgaaaggaaatatataggggagagtttattgctgtctctcatcagctgaggctgccatagaaaatgacttagattgacagtttattcatatggtgagtgtgtgagtgtatgtaaatacgtgtgtgtgtgtgtgtgtgtgtgtgtgtgtgtgtgtcacatttaaacactaaatgttggggaatatagagaaatagtatatttgtgtatgtgaaagtgcgtattgcataatgtaactaa

SEQ ID NO: 13569 - DNA, 207 bp, Homo sapiens
  AF106564.1_108831
  Located on chromosome 8
  Distance between a terminus base of telomere on chromosomal short arm and 5'-terminus of this base sequence : 25100318
  Distance between 3'-terminus of neighbour sequence of sequence listing upward to telomere on chrosomal short arm and 5'-terminus of this base sequence : 15940
cttcaggctcagactgaactatatagcactgggtttcctgggtctcctgcttggagatagatgatcatgggccttctcagcctcataataatgtgagccaagtctttataataaatctgtgtgggtgtgtgtgtgtgtgtgtgtgtgtgtgtgtgtaccttggattctgtttctctggtgaactctgactaatatctttcactgcga

SEQ ID NO: 13570 - DNA, 424 bp, Homo sapiens
  AC021000.3_122859
  Located on chromosome 8
  Distance between a terminus base of telomere on chromosomal short arm and 5'-terminus of this base sequence : 25204070
  Distance between 3'-terminus of neighbour sequence of sequence listing upward to telomere on chrosomal short arm and 5'-terminus of this base sequence : 103545
aactatttcatggagtggctaccaaattatcagtaataaagcctaaaattcaagaaagaaataaagaaacacagaaagataggatagaaagaaaggaagaaaaagaaagaaggaaagaaagagagagagagaggaaaggaaggaggaagggacaaaggaaggaaggaaggacaaaaagaaagaaagagaaggaaagaaagaaagaaagaaagaaagaaagaaagaaagaaagaaagaaagaaaaagaaagaaagaaagaaatggagggagggagggaaaggaaaagagagagaaagagatagagggaagggaaagagagagagagatagggaaggagggcagaagggagggagggaaagttccatgttaaatggtacagaccacccattgttataccaatgtcattgtaactgaacaagactat

SEQ ID NO: 13571 - DNA, 380 bp, Homo sapiens
  AF260013.2_35342
  Located on chromosome 8
  Distance between a terminus base of telomere on chromosomal short arm and 5'-terminus of this base sequence : 25204070
  Distance between 3'-terminus of neighbour sequence of sequence listing upward to telomere on chrosomal short arm and 5'-terminus of this base sequence : -424
aactatttcatggagtggctaccaaattatcagtaataaagcctaaaattcaagaaagaaataaagaaacacagaaagataggatagaaagaaaggaagaaaaagaaagaaggaaagaaagagagagagagaggaaaggaaggaggaagggacaaaggaaggaaggaaggacaaaaagaaagaaagagaaggaaagaaagaaagaaagaaagaaagaaagaaagaaagaaagaaagaaagaaaaagaaagaaagaaagaaatggagggagggagggaaaggaaaagagagagaaagagatagagggaagggaaagagagagagagatagggaaggagggcagaagggagggagggaaagttccatgttaaatggtacaga

SEQ ID NO: 13572 - DNA, 414 bp, Homo sapiens
  chr8.fa.O7frz.27905487
  Located on chromosome 8
  Distance between a terminus base of telomere on chromosomal short arm and 5'-terminus of this base sequence : 25408459
  Distance between 3'-terminus of neighbour sequence of sequence listing upward to telomere on chrosomal short arm and 5'-terminus of this base sequence : 204009
gaatctatgtctggtgaaataagtgttcagaattatatcctggagcagtttccctaacacctaggccctggaaatgcaatccaaatattttacacacacacacacacacacacacacacacacaatttccacccatatttccatatacatatatatatacacacacacacatatacgcatatatacatatatatgtatatacatatatacatatatgtgtgtgtatacgtgtgtgtgtgtgtgtatatatatatatacgtatatatatgtatatatagttttttttttgagatcgggtctcacagtatcacccaggctggagtgcagtgtcgtgatgggggctcggtgcaccctcaacctcccaggctcaagctatcctcccacctcagcctcctcagtagctagaaccacagg

SEQ ID NO: 13573 - DNA, 409 bp, Homo sapiens
  AF176680.2_97310
  Located on chromosome 8
  Distance between a terminus base of telomere on chromosomal short arm and 5'-terminus of this base sequence : 25565613
  Distance between 3'-terminus of neighbour sequence of sequence listing upward to telomere on chrosomal short arm and 5'-terminus of this base sequence : 156740
cctattgcaatactattgtctcagtgaattcggtttatctgtgcagtgggcaagaagaacatatcaggcaattacaggaggattgcttgagcccaggaatttgaagttcaaatctggccagggcaacataatgagaccctgtctctaaatatgtgtgtgtgtgtgtgtgtgtgtgtgtgtgtgtatacatacatatatatgtgtgtgtgtatacatacatatatatgtgtgtgtgtatacatacatatatatgtgtgtgtatacatacatatttgtgtgtgtgtgtatatatatatacacacacacacaatgctaggctaatggtttcggcatggactctgtccatggttctggatcatgggattaattaacaaataatttgttttcactagaagctgaagtatttagc

SEQ ID NO: 13574 - DNA, 172 bp, Homo sapiens
  Z66964
  Located on chromosome 8
  Distance between a terminus base of telomere on chromosomal short arm and 5'-terminus of this base sequence : 25600730
  Distance between 3'-terminus of neighbour sequence of sequence listing upward to telomere on chrosomal short arm and 5'-terminus of this base sequence : 34708
agctcatttgaaaatagcaacttctagatgttaaacagcaaagcaaaagtaatacaaaataacattagattcactgtgtgtgtgtgtgtgtgtgtgtgtgtgtgtgtgtgtgtaagaggtaaagagagagaggtaagtaaccgcagagatgtatcttatctcagcatgacgc

SEQ ID NO: 13575 - DNA, 366 bp, Homo sapiens
  AC079783.2_181092
  Located on chromosome 8
  Distance between a terminus base of telomere on chromosomal short arm and 5'-terminus of this base sequence : 25692237
  Distance between 3'-terminus of neighbour sequence of sequence listing upward to telomere on chrosomal short arm and 5'-terminus of this base sequence : 91335
ataaaggacagtcattctggagtgacctcagatgggtttccttcagtcatttaacaaatgacttttaagtgcctcctgtctatacgccaggaacccaagtgttggggatatggcagcgagagagagagagaaaatgtgtgtgtgtgtgtgtgtgtgtgtgtgtgtgtgcgcgcgcgcgcacgcacgcacgcacgcacgcgtgtgtctgattagctcatgggaaacaaggaggataagtcagtgtagttttccatttcactttgcaaagcctgtgtagataaactcagatcaattagaagctaaagcagaatatgagaaataggaggagaaggcagaattgggaagaaagctaagacctgcttctaa

SEQ ID NO: 13576 - DNA, 226 bp, Homo sapiens
  D8S1771
  Located on chromosome 8
  Distance between a terminus base of telomere on chromosomal short arm and 5'-terminus of this base sequence : 25868152
  Distance between 3'-terminus of neighbour sequence of sequence listing upward to telomere on chrosomal short arm and 5'-terminus of this base sequence : 175549
gatataaaacatgactttgctacccaagtaggatatcttggcttgaactatgcttaaataacaagacgggtagctgtgtgtgtgtgtgtgtgtgtgtgtgtgtgtgtgtactggtatgcagctgtgtgtgtgtgtgtgtgtgtgtgtgtagtggtatgttaacctataaaaatatgaagagaggttaagggagaaggctgtcattctggcaggtggttcttgtaaa

SEQ ID NO: 13577 - DNA, 346 bp, Homo sapiens
  AC009623.4_67071
  Located on chromosome 8
  Distance between a terminus base of telomere on chromosomal short arm and 5'-terminus of this base sequence : 25917052
  Distance between 3'-terminus of neighbour sequence of sequence listing upward to telomere on chrosomal short arm and 5'-terminus of this base sequence : 48674
tacagatttgcataggttcttaaggaaggggtacctgtcccaggctgaggaagatggagaaggcagggtatggaaaatctgcctagaggatggggttcctgaaggagaattaggagtgagttagctggttttccttccacaataaaaggtgtgagatttaagtactctgggacccactgaaattgtctgcaaattggtgtgttatgttatgttatgttatgttatgttacgttatgtacatctgcctttctccggaggggacacataacttatcagattcttagaggcctaagaccttttctatccctaattaatgatttatgttaactgtgcaatacttctgaat

SEQ ID NO: 13578 - DNA, 421 bp, Homo sapiens
  AC023566.4_46472
  Located on chromosome 8
  Distance between a terminus base of telomere on chromosomal short arm and 5'-terminus of this base sequence : 26280626
  Distance between 3'-terminus of neighbour sequence of sequence listing upward to telomere on chrosomal short arm and 5'-terminus of this base sequence : 363228
cacgcagtaggtatacaaagacatcttactgaaactccagttttacacagccagtcatgttacataaaaaaatgtccttatacatctgcatgtatataatacagagctatgggttatacacacacacacacacacacacacacacacacataaaatcaatagacacatttctacaccagcacatccttcctctgagtttaaaataccctatttatatgtggattgttatattacataataataagaaaggtctgttaagtcaaaactttacaagatcatatgtaacgttgttttaaacagaaagcttaaaatgagcaatgttcagtataatccaagaaccctcctcaatgtcaatctgggatgaaaaattaaaagccagatttagccagcttggggccaagcactcatgttcagattctac

SEQ ID NO: 13579 - DNA, 320 bp, Homo sapiens
  HUMUT5185
  Located on chromosome 8
  Distance between a terminus base of telomere on chromosomal short arm and 5'-terminus of this base sequence : 26385488
  Distance between 3'-terminus of neighbour sequence of sequence listing upward to telomere on chrosomal short arm and 5'-terminus of this base sequence : 104441
aaggtaaggcaatcagtaacctaagttattgccctcgttcttaaaccagaaagccaagatggccttgggccctttctagatggatatatagatagatagataggtagatagatagatagatagatagatagatagatagatagatagatagatggaaggaaggaaggaaggaaagaagggagggagggagggagggaagaaagaaagaaaaagaaagaaagaaagagaaagaaagaaagaaagagaaaaggaaggaaggaaagaaggaagggagggagggaaggaagggtgatagaacaaatcaaacattactgggtata

SEQ ID NO: 13580 - DNA, 352 bp, Homo sapiens
  AF172273.4_87221
  Located on chromosome 8
  Distance between a terminus base of telomere on chromosomal short arm and 5'-terminus of this base sequence : 26557518
  Distance between 3'-terminus of neighbour sequence of sequence listing upward to telomere on chrosomal short arm and 5'-terminus of this base sequence : 171710
tagtctgcaagcttgatttataaggttcagattcccttgaaatataaatctcctgggaaaggctggaggacgctctagtccttccttccttccctccctccctccctccctccctccctccctccctccctccctccttccttccttccttccttccttccttccttccttccttccttccttccttcctcttttcttccctctctctctcttcttctgtcagaatttactgatgacagctaatgtgctagacattgttccaggaactgggatacaaagactggtcagaattcatctctggcagtgggaacctgtggtccaggtggtggagacgaaactacaaatgttattg

SEQ ID NO: 13581 - DNA, 396 bp, Homo sapiens
  chr8.fa.O7frz.29029688
  Located on chromosome 8
  Distance between a terminus base of telomere on chromosomal short arm and 5'-terminus of this base sequence : 26675315
  Distance between 3'-terminus of neighbour sequence of sequence listing upward to telomere on chrosomal short arm and 5'-terminus of this base sequence : 117445
gttattcctaaggagctgaaacttgggataagtcatttaatttccgtagaccctcatttcctcatctgcaaaaagaaggcattaaacacgatgagctcttccacttctgaatcctgtagctgcattgcaaactcaaatcagtttaccatgaccccactttttccttttcttccatgactttgccaatgagatgatgagggagaaatagctgaggctggctgttagatcaagccagactctttaaaataactagtctgtgggaatcaggcattgcaagtgtgtgtgtgtgtgtgtgtgtgtgtgtgtgtgtgtgtacacgtttccattaggtggggcaaggaagcggtttctgcagtgtagagggggaagcattcagtcagctctaaatgtttcagc

SEQ ID NO: 13582 - DNA, 135 bp, Homo sapiens
  DISD22_0005625
  Located on chromosome 8
  Distance between a terminus base of telomere on chromosomal short arm and 5'-terminus of this base sequence : 26836646
  Distance between 3'-terminus of neighbour sequence of sequence listing upward to telomere on chrosomal short arm and 5'-terminus of this base sequence : 160935
tgaccttgacatgatttatacctagtaagataaacatcatagttaaaagccacgtgtgtgtgtgtgtgtgtgtgtgtgtgtgtgtgcacacataagaaggagggagagaggagaaacgagggagactgtgcaggt

SEQ ID NO: 13583 - DNA, 275 bp, Homo sapiens
  AC067904.2_30420
  Located on chromosome 8
  Distance between a terminus base of telomere on chromosomal short arm and 5'-terminus of this base sequence : 27112435
  Distance between 3'-terminus of neighbour sequence of sequence listing upward to telomere on chrosomal short arm and 5'-terminus of this base sequence : 275654
cgattaaatgactcattcaattacaggttgttcagtggcttggtcaagactcttaacatatacaacctgactataacatgagtattgtaatagaatgttcatgggtggttttcagggaacctgtgaaacctctagaattgcactaaaaatctgtgtgtgtgtgtgtgtgtgtgtctttttttggaggaaagagtccatggtttttgtcagattcccacatgggttgcaggttgggaatgagttaagcattcctgttctagaagttcaagtcttca

SEQ ID NO: 13584 - DNA, 127 bp, Homo sapiens
  DISO7_10002452
  Located on chromosome 8
  Distance between a terminus base of telomere on chromosomal short arm and 5'-terminus of this base sequence : 27462972
  Distance between 3'-terminus of neighbour sequence of sequence listing upward to telomere on chrosomal short arm and 5'-terminus of this base sequence : 350262
gttaggcgtgtgcacatgagcgtgtgcacacaatgtggatgcacacacacacacacacacacacacacacacacacatacaccatgagcacctctcttgttgtttttgcccttctcccagccataga

SEQ ID NO: 13585 - DNA, 352 bp, Homo sapiens
  chr8.fa.O7frz.30050399
  Located on chromosome 8
  Distance between a terminus base of telomere on chromosomal short arm and 5'-terminus of this base sequence : 27619758
  Distance between 3'-terminus of neighbour sequence of sequence listing upward to telomere on chrosomal short arm and 5'-terminus of this base sequence : 156659
tcatttgaaatctagattcacatattcataaaattttggcaataacatccattattcttatcacaaagaagtaactttagtgtcagattgatgcagtgaggaaaacaggaaggaaggaaggaaggaaggaaggaaggaaggaaggaaggaagggagggaggcagggagagagggaaaggaaggaaaaaggaaaaaagtaattctagaaaatacttttaaacaaaaatattagaaaatacttagaaaatatcttagaaaaatagttagaaaatacttagaaaaaatcttagaaaatacttttaaacaaattatttatctgatgcccacatacaattccataaagtatggaaat

SEQ ID NO: 13586 - DNA, 189 bp, Homo sapiens
  chr8.fa.O7frz.29945454
  Located on chromosome 8
  Distance between a terminus base of telomere on chromosomal short arm and 5'-terminus of this base sequence : 27668220
  Distance between 3'-terminus of neighbour sequence of sequence listing upward to telomere on chrosomal short arm and 5'-terminus of this base sequence : 48110
ggctctatttctaggattacctagtttccatttggtactaggttgtgatggttacacacacacacacacacacacactcagtacatctcacaactgccctgtgagaaagggattacccaccccatttataaaagaaacagactccaataggaaaggtaacctcaaacagcctacctgttatgcagcgag

SEQ ID NO: 13587 - DNA, 410 bp, Homo sapiens
  chr8.fa.O7frz.30281614
  Located on chromosome 8
  Distance between a terminus base of telomere on chromosomal short arm and 5'-terminus of this base sequence : 27915805
  Distance between 3'-terminus of neighbour sequence of sequence listing upward to telomere on chrosomal short arm and 5'-terminus of this base sequence : 247396
ggaaagtgctatccttacagttttatcatataaatgagagccagccaaatgaagaaacatagaggacaggtctgagggaccccaaacaggaaggtttcatatcctcacaaggctttgccctccagacacaccaacaagatgtgcatcaccaaccaggaagttcacctgagctttggtgcccaggaatttattaggccttattatacaggcatcgttgattgattgattgattgatggaatcactggccacataattggactcaatctccagctccccttccctccctggaggtcaggctgataccatgtggctcaaagcttcaactctctgattacccggttggtctttccagcattgcagcccccatcctgaggctagcagggacccaccatgaatcacctcattagta

SEQ ID NO: 13588 - DNA, 318 bp, Homo sapiens
  AC010856.3_73384
  Located on chromosome 8
  Distance between a terminus base of telomere on chromosomal short arm and 5'-terminus of this base sequence : 27994465
  Distance between 3'-terminus of neighbour sequence of sequence listing upward to telomere on chrosomal short arm and 5'-terminus of this base sequence : 78250
cgttctgaatctagaaaagtcactggatatgcccctcccccgccccccaacacggtcttatgttctgaatgtagaagtcactggatgtgctgacacacacacacacacacacacacacacacacacacacacacacacacacacacagagtctgtggcctctttcccaggcattccaagtccagcaagttcgcagggagctgtcagtccgtccaggaaggcccgggcctgggtttgcctcttcaagcagctactgcaggggcgtggggagggggcataagagactttggactttcctttgagacagtagaaagcgtta

SEQ ID NO: 13589 - DNA, 181 bp, Homo sapiens
  D8S1839
  Located on chromosome 8
  Distance between a terminus base of telomere on chromosomal short arm and 5'-terminus of this base sequence : 28028901
  Distance between 3'-terminus of neighbour sequence of sequence listing upward to telomere on chrosomal short arm and 5'-terminus of this base sequence : 34118
tccagggttgctacagtatgtgtactgtgtgtgtgtgtgtgtgtgtgtgtgtgtgtgtgtgtgtgcgcgcgcgcgcgcgcacctatgtgtctaaggcaagttggtgagaaatactgcagtttagtaggaaaaaaaccaatggactaggaatcgaaaatcctgagttctgatcccattctcc

SEQ ID NO: 13590 - DNA, 411 bp, Homo sapiens
  chr8.fa.O7frz.30481571
  Located on chromosome 8
  Distance between a terminus base of telomere on chromosomal short arm and 5'-terminus of this base sequence : 28157092
  Distance between 3'-terminus of neighbour sequence of sequence listing upward to telomere on chrosomal short arm and 5'-terminus of this base sequence : 128010
gaggatgacagaatgtgagacgctgtcatgtgcataacatccatgagtcagcctggcaggctggagcgggaggctggccccattcctcacgggagggtacagacctgggaaggggacaggatttgcaccaagatccagagtgaatggacagaggatcagaacaacctgggtgaggagtgtgtgtttgtgaaccacgggagacctttgggtttccttttttgtttttgcctccagcttgggtatcccaagtccctagaacagtgttggcaccatcttggcctaaatggcaggtgcccaataatatttgttgaaagaatgattatagatttgtaaagcgtgtgtgtgtgtgtgtgtgtgtgtgtgtgtatggtgtatgtgtgagtctgtggatagactggtcaatgctttaca

SEQ ID NO: 13591 - DNA, 434 bp, Homo sapiens
  chr8.fa.O7frz.30566671
  Located on chromosome 8
  Distance between a terminus base of telomere on chromosomal short arm and 5'-terminus of this base sequence : 28242281
  Distance between 3'-terminus of neighbour sequence of sequence listing upward to telomere on chrosomal short arm and 5'-terminus of this base sequence : 84778
tgaacttgattcatacttggagctcaggaacaggggttgcaagcaacagagggagagttagggtagaaagattagcaatcttttgggctacaaattcaatttcctagtctcgggacttttaacatctgtcactgatcagatggtgtttgtatatgtatgtatgtaggtcggtaggtaggtgtgtgtgtgtgtgtgtgtgtgtatttgtttatttctcaactctagaattatatacaagctttaaaaatccaaaatgatgagaataaaatgactaaggtcatgaaataatatgggggctagatttctggtggaaagtgcctctaaaacacagaaaacttcaataagcaaaataaccacaacaatggcatctgagttgtggtatgttgaagactactgtttagtgttaaactgttccaatagtttcaagaaatcta

SEQ ID NO: 13592 - DNA, 267 bp, Homo sapiens
  DISO7_11525117
  Located on chromosome 8
  Distance between a terminus base of telomere on chromosomal short arm and 5'-terminus of this base sequence : 28563471
  Distance between 3'-terminus of neighbour sequence of sequence listing upward to telomere on chrosomal short arm and 5'-terminus of this base sequence : 320756
atgagtgtggcccttctccaaagagagaatcactaaggaggttttaaatgttttcctcctctaactgtacttagttaagctaaatcataacccaaagctggacagagacagatattttagaaataacctctccccacatatatcccaccactggcacatgcacacgcacagacatgcacacacacacacatgcacacacacacacatgcacacacacacatgcacacacacacatgcacacacacgaagccatggagaggagctgtc

SEQ ID NO: 13593 - DNA, 111 bp, Homo sapiens
  D8S1820
  Located on chromosome 8
  Distance between a terminus base of telomere on chromosomal short arm and 5'-terminus of this base sequence : 28711388
  Distance between 3'-terminus of neighbour sequence of sequence listing upward to telomere on chrosomal short arm and 5'-terminus of this base sequence : 147650
tggataccgagggacaactgtacatattttgtgtgtgtgtgtgtgtgtgtgtgtgtgtgtgtgtgtgtgttttatagcaatcagtgtacttagtttccagtgagcacagct

SEQ ID NO: 13594 - DNA, 415 bp, Homo sapiens
  chr8.fa.O7frz.31107660
  Located on chromosome 8
  Distance between a terminus base of telomere on chromosomal short arm and 5'-terminus of this base sequence : 28765469
  Distance between 3'-terminus of neighbour sequence of sequence listing upward to telomere on chrosomal short arm and 5'-terminus of this base sequence : 53970
agcttatgttagatgctaacagaccgggcctgtgccttcagatgtggatttcaccctcatggcagcctgtgagagaagccctattatcagcatcccagcagttacaagtggtgggagaggaagtggatgatttcctcaagagagaatgcaaagtacagaaagagcctgctcttttcatttaaatgaaaatagcgcttgggggctctgaaaattatatatgctcattataacaaatggaaatgagacagaaaagcacaaaataacctgaaatcccaccgtcagtgccagccgtggttaacattgtgatgaatgtccttccagccacctctctctatacacacacacacacacacacacacacacacagacacacaatcagctttacatagaagagtcatattgtacacgttgcttc

SEQ ID NO: 13595 - DNA, 160 bp, Homo sapiens
  D8S1809
  Located on chromosome 8
  Distance between a terminus base of telomere on chromosomal short arm and 5'-terminus of this base sequence : 28905352
  Distance between 3'-terminus of neighbour sequence of sequence listing upward to telomere on chrosomal short arm and 5'-terminus of this base sequence : 139468
atgggcacttttgactggggaattatttgttgtgggggttgtcctgggcactttaggatgtttactggcatccctggcctctaggtgccagtaacacacacacacacacacacacacacaccagttctgacaaccaacaatgtctccagagattgccaaa

SEQ ID NO: 13596 - DNA, 453 bp, Homo sapiens
  chr8.fa.O7frz.31446053
  Located on chromosome 8
  Distance between a terminus base of telomere on chromosomal short arm and 5'-terminus of this base sequence : 29181570
  Distance between 3'-terminus of neighbour sequence of sequence listing upward to telomere on chrosomal short arm and 5'-terminus of this base sequence : 276058
ttactccagactgagcgacagagcgagactccatctcaaaaatatgtatatgtgtgtgtgtgtgtgtgtgtgtttgtgtatgcatgtgaaacaattccagagttagtcgagagtcctaggaaaagagatcagggctgaaaatatagatatggggaatcctggggcaatttcctcatctctttgttaacagattgttagtcaggtccagttcagtgtcttgcatgctggacagccactgtaacacacccagggatctgtttcattccccacctgacctagtcctggcaaatacactacctgtggttgtcatttggaccagaggaaaaagggatgaactgggatcccagagcccaggcactgaggaccggctctgattccaggaaccaaaacaaagaaaaataacagttatcgggcgctttcatgtgtcagccctacatagtgcttcatggaatc

SEQ ID NO: 13597 - DNA, 223 bp, Homo sapiens
  AC012411.3_86809
  Located on chromosome 8
  Distance between a terminus base of telomere on chromosomal short arm and 5'-terminus of this base sequence : 29245410
  Distance between 3'-terminus of neighbour sequence of sequence listing upward to telomere on chrosomal short arm and 5'-terminus of this base sequence : 63387
tgctaatagtccataacgtgagctgtttgtagagatacacagaatactgtgttggatactcctaatcaaccaactatagaatcaatgagctcagtaatgttatatatgataccttttgtttgtttgtttgtttgttttctgaggtagagtcttactctgtcaccccagctggagtgcagtagcacaatcatggctcactgcagccttgactgcttaggctcaa

SEQ ID NO: 13598 - DNA, 271 bp, Homo sapiens
  DISO7_00040181
  Located on chromosome 8
  Distance between a terminus base of telomere on chromosomal short arm and 5'-terminus of this base sequence : 29325511
  Distance between 3'-terminus of neighbour sequence of sequence listing upward to telomere on chrosomal short arm and 5'-terminus of this base sequence : 79878
gttccagggcaagtcattttgacaaaacaggaacttaggggctgttgaggtgctttaagcaggatgtggaagggcatgtggcccatatatgcaaagttaattttttcatgggaatttaaaatgcgtgtgtgtgtgtgtgtgtgtgtgtgtgtagtggttgtggggagctgtgtgtgcctgcgatcccaggacaggtgaggcctcactgtgaatggctcgattcggtccataggtcatgcccctgacctataggtcactaaggcacctgtac

SEQ ID NO: 13599 - DNA, 222 bp, Homo sapiens
  DISO7_10000318
  Located on chromosome 8
  Distance between a terminus base of telomere on chromosomal short arm and 5'-terminus of this base sequence : 29491343
  Distance between 3'-terminus of neighbour sequence of sequence listing upward to telomere on chrosomal short arm and 5'-terminus of this base sequence : 165561
taagcaagaacaagcaaagctaaaacaataaaatcctattttaaattcttttgtaaaatgaatactcaagagatcagtgttatagcttaattttaaaatgaaagccatagtcaaaagtgtatttcaaatgctaaatattataaagaacaagtgaagttttgtgtgtgtgtgtgtgtgtgtgtgtgtgtgtttttcaatagctagacctagagatgtattgca

SEQ ID NO: 13600 - DNA, 457 bp, Homo sapiens
  chr8.fa.O7frz.32004147
  Located on chromosome 8
  Distance between a terminus base of telomere on chromosomal short arm and 5'-terminus of this base sequence : 29707741
  Distance between 3'-terminus of neighbour sequence of sequence listing upward to telomere on chrosomal short arm and 5'-terminus of this base sequence : 216176
tgccaagcagaattaatactatacctttctggtttattttttcccactctcctgtaagattatttcacactttcttctctctgtgcaaactccccatcctcattctcttatgatgaccttgctcatcatgaacggaaatgaggaaaatcaagcaatcagaggagactgtccacaaactacctacttgctaccatgtacacacacacacacacacacacacacacacacagttttcctgcctcttaacatacccagagcacttcaatgatatgtatatttcctagcgtgtgtcttggtgcatcattcatatatatgtgcattttctccttctctgacctcattccactgtgtattccacatatttgacttctaaaatatccaattccaaaaacatttattgtcacaaaggacaatattgtgtgattccatttatatgaagtatctggagtaggcaaac

SEQ ID NO: 13601 - DNA, 385 bp, Homo sapiens
  M8_29908285
  Located on chromosome 8
  Distance between a terminus base of telomere on chromosomal short arm and 5'-terminus of this base sequence : 29908144
  Distance between 3'-terminus of neighbour sequence of sequence listing upward to telomere on chrosomal short arm and 5'-terminus of this base sequence : 199946
ccatgagaaacagaaaactccaggctgggcacggtggctcacgcctgtaatccaacactttgggaggctgaggcgaggattgtttgagcccaggagttcaagaccagcctaggcagccatagtgcaaccccatatctacagataataataataataataataataataataataataaattagctgggcatggtggcatgtgcttgtggtcccagttacttaggaggctgaagagggagccttgagcccaggaagttgaggctgcagtgagccacaatcgcactactactccagcctgggtgacagagtgagaccctgcctcaaaacaaacaaacaaacaacaaaaaatggaaataagggaactccacaaagaaatttaccaaag

SEQ ID NO: 13602 - DNA, 417 bp, Homo sapiens
  M8_29986402
  Located on chromosome 8
  Distance between a terminus base of telomere on chromosomal short arm and 5'-terminus of this base sequence : 29986096
  Distance between 3'-terminus of neighbour sequence of sequence listing upward to telomere on chrosomal short arm and 5'-terminus of this base sequence : 77567
aaataaaaatgaccaggatctgttgggtgtggtggctcatgccaggaatcccagcattttgggagactgaggcaggtccatcacctgaggtcaggagtttgagaccagcctggccaatatggtgaaaccctgtctgtactaaaaatacaaaataatgagctgggcatggtggcacatgcattaatcccagctacttgggaggctgaggcaggagaattgcttgaacccaggaggcggaggttgcaatgagctgagatggtgccattgcactccagcctgggtggcagagtgagactccgtctcaaaaacaacaacaacaacaacaacaacaacaacaacaaacaaacaacaacaacaaaaaacccaccaggatttccacttggaatttctcaagtttgaagaataccaaactgcaga

SEQ ID NO: 13603 - DNA, 223 bp, Homo sapiens
  DISO7_10000322
  Located on chromosome 8
  Distance between a terminus base of telomere on chromosomal short arm and 5'-terminus of this base sequence : 30044371
  Distance between 3'-terminus of neighbour sequence of sequence listing upward to telomere on chrosomal short arm and 5'-terminus of this base sequence : 57858
tgagcaccagctatgtacaagcagaagggccctgttgatttaatgctctgttggtgccttcttgaaattctcaatgttttttaacaagagggtctgcattttcatttagcactggccctgcaaatgctgtagcccgtcttgaggagcaaaacatacacacacacacacacacacacacacacacacacacacacacatctctggccttatgtagtatatgtgc

SEQ ID NO: 13604 - DNA, 152 bp, Homo sapiens
  DISD22_0005657
  Located on chromosome 8
  Distance between a terminus base of telomere on chromosomal short arm and 5'-terminus of this base sequence : 30211753
  Distance between 3'-terminus of neighbour sequence of sequence listing upward to telomere on chrosomal short arm and 5'-terminus of this base sequence : 167159
tcaatgcttggtataaagcaggagatagatagatagatagatagatagatagatatagtgtgtgtgtgtgtgtgtgtgtgtgtgtgtgtgtgtgtgtgtgtgtttgtgtgtgctgagtacagtctatggcccccagattctattccttgaca

SEQ ID NO: 13605 - DNA, 101 bp, Homo sapiens
  DISD22_0005662
  Located on chromosome 8
  Distance between a terminus base of telomere on chromosomal short arm and 5'-terminus of this base sequence : 30370539
  Distance between 3'-terminus of neighbour sequence of sequence listing upward to telomere on chrosomal short arm and 5'-terminus of this base sequence : 158634
tggacctgcacagtgaagaagagacacaaatgaacagagggtatgtgtgtgtgtgtgtgtgtgtgtgtgtgtgtgtgttacctccatgtgcatcaggttat

SEQ ID NO: 13606 - DNA, 187 bp, Homo sapiens
  DISO7_10005007
  Located on chromosome 8
  Distance between a terminus base of telomere on chromosomal short arm and 5'-terminus of this base sequence : 30463145
  Distance between 3'-terminus of neighbour sequence of sequence listing upward to telomere on chrosomal short arm and 5'-terminus of this base sequence : 92505
agattctggtggcaatgggaggcaggggagggatgaaggagcatttttatttttatttttatttatttatttatttatttatttatttatttatttatttatttttgagacggagtctcactctgtcacccaggctggagtgcagtgtaattaccagtgtaattaccattcgtgtaattcacatcca

SEQ ID NO: 13607 - DNA, 120 bp, Homo sapiens
  G10203
  Located on chromosome 8
  Distance between a terminus base of telomere on chromosomal short arm and 5'-terminus of this base sequence : 30554190
  Distance between 3'-terminus of neighbour sequence of sequence listing upward to telomere on chrosomal short arm and 5'-terminus of this base sequence : 90858
tttgaggtctagcaggcttgggtttctttcattcattcattcattcattcattcattcattcattcaatgaatatatgttgaatacctaatacgcaccaggcactgttttaggcatggat

SEQ ID NO: 13608 - DNA, 270 bp, Homo sapiens
  AC044849.2_117273
  Located on chromosome 8
  Distance between a terminus base of telomere on chromosomal short arm and 5'-terminus of this base sequence : 30561524
  Distance between 3'-terminus of neighbour sequence of sequence listing upward to telomere on chrosomal short arm and 5'-terminus of this base sequence : 7214
tggtagatctttctgcactaacttgaacagaaaaaaattctactctcctacaaaacacccatagactcatttggtgcattaagactcaagaagtgacctgtttgttgttgttgttgttgttgtttaaattgtaattcaactctagaaatagtagagagaagcgaagtgggtaatgcctcaagcttcccatttgctctcattttaaagcatattggaaatatctcttctaaacattcactccacagtcttacatgccactttatgttagtc

SEQ ID NO: 13609 - DNA, 472 bp, Homo sapiens
  chr8.fa.O7frz.33604564
  Located on chromosome 8
  Distance between a terminus base of telomere on chromosomal short arm and 5'-terminus of this base sequence : 30660874
  Distance between 3'-terminus of neighbour sequence of sequence listing upward to telomere on chrosomal short arm and 5'-terminus of this base sequence : 99080
cagattctgactgcgtagttaggatggccgggtgcagtagctcacacctgtaatcccagcgctttgggaggctgaggtgggtggattgcttcagcccaggagtttgagaccagccagacctcatctttattaaaaaaagaagaagaagaagaagaagaagaagaatcagaatttctgcagtatagttccaggagctgccaaacagtggtataaggaaatgaattgcctgggcctcaacatatcctcagtgtcagtgacacatgtatactttcaaatgaataacctctttttatgaagattatactttggcatcccttatctgtaggctagctgtgcttgattttagtagaatagatttttaggacttaatcatcattaatgtatctgtattagtccgttttcacactgctgatgaagacataccggagaatgggcaatttacaaaagaaagaggttgactggacttacagtt

SEQ ID NO: 13610 - DNA, 482 bp, Homo sapiens
  chr8.fa.O7frz.33849047
  Located on chromosome 8
  Distance between a terminus base of telomere on chromosomal short arm and 5'-terminus of this base sequence : 30857558
  Distance between 3'-terminus of neighbour sequence of sequence listing upward to telomere on chrosomal short arm and 5'-terminus of this base sequence : 196212
atgtttgctaaactcaagtgagaaaattagaacaggaactcaccataatttcctgcacagaactgttaatgtttgaccagtttgatctccttgaccttctgagggctatttaattaaaagacagaaagacacccctccaccttcagccactaattaaactattttgtttaagtagagatactgctgctcctccactgtatctcagtatagctagggtcctagtggctacacgaagcacagaatgaaaagaaggataagggacctgagtttgcacagattacattatacttacccagagatttaactctctaagcgaccatcatttctgccaatgttttccaaaatgaaaagagctttggttacatggtatttcacacacacacacacacacacacacacacacacacacacacacacacacggggtcttggcctatatatctattgataaacaaaaaaaataaggtctagagctgagaatga

SEQ ID NO: 13611 - DNA, 368 bp, Homo sapiens
  AF252825.2_84258
  Located on chromosome 8
  Distance between a terminus base of telomere on chromosomal short arm and 5'-terminus of this base sequence : 30964756
  Distance between 3'-terminus of neighbour sequence of sequence listing upward to telomere on chrosomal short arm and 5'-terminus of this base sequence : 106716
ctggctaacatggtgaaaccccatctctactaaaaatacaaaaaattagccgggcatgttggcacgtgcctgtagtcccagctacttgggaggctgaggcaggagaatcgtttgaacccaggagaggctgaggttgcagggagcggagattgtaccactgcactccagcctgggcaacagagcgagactccgtctcaaaaaaaataataaataaaagagtagcagttaagtgtgtgtgtgtgtgtgtgtgtgtgtgtgtgtgtgtgtgtgtgtgtattttaagtcacccagaatgtaagctttgccaaaatgtttaagtccccatggaggcagggctcttagcttggttcactgatttattccaactg

SEQ ID NO: 13612 - DNA, 434 bp, Homo sapiens
  chr8.fa.O7frz.33951143
  Located on chromosome 8
  Distance between a terminus base of telomere on chromosomal short arm and 5'-terminus of this base sequence : 31077308
  Distance between 3'-terminus of neighbour sequence of sequence listing upward to telomere on chrosomal short arm and 5'-terminus of this base sequence : 112184
cctgtagaaactgacagagtaaagagatgctcccctttatgtctccagaaggaaccaaacctgcctatactctgactttagcccagcaagtctgccttttgaacctccgacttccaaaactggaagataaccaatttctgttgttttaagccactaaagttgtggtaatttacagcagcaataggaaacttatacacacacacaaacacaaacacacacacacacacacacacacaaacacacacacacacgtatacatacacacattcattcctttgagatctataaatctttgctaagggtctttattgctatgacatcaattaaaaccaaggttccaaacaaactaaacctaaaacgagaccttcatcactttgtaagaaaaggttaaatgaagatgtttgacacagcactcattcaatcatactgctttc

SEQ ID NO: 13613 - DNA, 114 bp, Homo sapiens
  D8S540
  Located on chromosome 8
  Distance between a terminus base of telomere on chromosomal short arm and 5'-terminus of this base sequence : 31118397
  Distance between 3'-terminus of neighbour sequence of sequence listing upward to telomere on chrosomal short arm and 5'-terminus of this base sequence : 40655
gagccaaaccccatcactgcacacacacacacacactctctctctctctctcacacacacacacacacacacacacacatatgtagactttccccaggtagttattggccagga

SEQ ID NO: 13614 - DNA, 269 bp, Homo sapiens
  AF181897.1_17430
  Located on chromosome 8
  Distance between a terminus base of telomere on chromosomal short arm and 5'-terminus of this base sequence : 31214562
  Distance between 3'-terminus of neighbour sequence of sequence listing upward to telomere on chrosomal short arm and 5'-terminus of this base sequence : 96051
caaatgcttaatgatttctcactctgaacaaggcctcctctgttaattgcttaagtgtttagttaattttgtaggttgtccactgataagagtaaaaactgcctatgatgaaaaagctgctatacagaacatagcttacggatttgggcattcattcattcattcattcattcattcattcattcgagacagggtattgctctgtcacccaggctggagtgcagtggtgtaatcatggctcactgcagtcctgaattcctagattcaat

SEQ ID NO: 13615 - DNA, 339 bp, Homo sapiens
  HUMUT8076
  Located on chromosome 8
  Distance between a terminus base of telomere on chromosomal short arm and 5'-terminus of this base sequence : 31404884
  Distance between 3'-terminus of neighbour sequence of sequence listing upward to telomere on chrosomal short arm and 5'-terminus of this base sequence : 190053
gggtcttgtgtctgtaacttattttctttctttctctttttctctttctttctttctttctttctttctttcattcattcttttctttctttctttctttctttctttctttctttctttctttctttccttccttccttccttcctttctttctttccttctttctttcttccttctttctttccttctcttccttccttccttctttttttttgacatggagtctcactccgtcacccaggctggagtgcagtggtgtgatctcggctcattgcaacctctgccttctgggttcaagcagttctcctgcctcatcctcccaaatagctgggactaca

SEQ ID NO: 13616 - DNA, 223 bp, Homo sapiens
  Z67414
  Located on chromosome 8
  Distance between a terminus base of telomere on chromosomal short arm and 5'-terminus of this base sequence : 31423834
  Distance between 3'-terminus of neighbour sequence of sequence listing upward to telomere on chrosomal short arm and 5'-terminus of this base sequence : 18611
ctcactctcatgcactacggaaaattactgttaaaagaatgatgtattttcttctagatttcctactaagggcacacacacacacacacacaccacacacacacacacacacacacagggtttgtaactttttaaacaaaaattggatggcactatgtttatgtgtatgtgttttacacctcaaatctatcatgaaaaaaagaggcagataaaatgacaattc

SEQ ID NO: 13617 - DNA, 331 bp, Homo sapiens
  chr8.fa.O7frz.34629786
  Located on chromosome 8
  Distance between a terminus base of telomere on chromosomal short arm and 5'-terminus of this base sequence : 31721331
  Distance between 3'-terminus of neighbour sequence of sequence listing upward to telomere on chrosomal short arm and 5'-terminus of this base sequence : 297274
cagaatgagattctgtctcagtaggaaagaaagaaggaaggaaggaaggaaggaaggaaggaaggaaggaaggaaggaaggaaggaaggaaggaaggaaagaaggaaggaaggaaggaaggtaggtagattggttaagagtcctttgtcttacgcagtaacagaataaatagctgaggcccaagagcaagcctgtttttaggagacatagagttgaaaaacccactaagtggtcagcactgtcatgtctgttcaccacgataagggtattggttggtgatgaaggaggggaagcctgagatagggaagaggtcatctgagcaatcagaaat

SEQ ID NO: 13618 - DNA, 399 bp, Homo sapiens
  chr8.fa.O7frz.34901302
  Located on chromosome 8
  Distance between a terminus base of telomere on chromosomal short arm and 5'-terminus of this base sequence : 31955220
  Distance between 3'-terminus of neighbour sequence of sequence listing upward to telomere on chrosomal short arm and 5'-terminus of this base sequence : 233558
agataagactatttccttcggtagccttgaaatttttccctagaaacttttaggttctcttgtttatctgtgtagttctgagctgcaccaactttttaaaagagagcagtcttgttctttcctaccatttgatacttagtaagcatttaattctgaagatgtgggtctttttttcagttctggaaacttttctgtgtgtatacccaaacacacacacacacacacacacacacacacacacagagatctttctataaacataatacacatatataattctgtgtgtaaatataatacacatcatacacatagatacacacatgaacacacacataaaattttatatctgtgtgtattatatttatttcctctctgctattgtagaacttgtggatctgt

SEQ ID NO: 13619 - DNA, 272 bp, Homo sapiens
  AC068672.2_142011
  Located on chromosome 8
  Distance between a terminus base of telomere on chromosomal short arm and 5'-terminus of this base sequence : 31960796
  Distance between 3'-terminus of neighbour sequence of sequence listing upward to telomere on chrosomal short arm and 5'-terminus of this base sequence : 5177
tattgtaatgaggaatcagtgttcttttggctggcaataaaggcttactggaaattgaggcttgcaggcatagaattctccaaatattttgaatgtaaacacaaacacaaacacacacacacacacacacacacacaccacactagagagcaccagtaaagaaaaaaaggttaattaaattacagtataaatgcatatttgttctcttttgttatcttaactaacttaaaaagcaattgtaaaaaaatgtagataatgtattgctttgccta

SEQ ID NO: 13620 - DNA, 314 bp, Homo sapiens
  AC004040.1_27458
  Located on chromosome 8
  Distance between a terminus base of telomere on chromosomal short arm and 5'-terminus of this base sequence : 32116259
  Distance between 3'-terminus of neighbour sequence of sequence listing upward to telomere on chrosomal short arm and 5'-terminus of this base sequence : 155191
tggtttgaatgtaaattagcacagccattatgaaaaactgtatggagatttttttcaaaaatctaaaaatggaattaccatatgatccaacaatcccactaccaaatatttatccaaaggaaaagaaatcagtatgtcaaagacatacctgcacttggacgtttattgcagcactattcataacagcaaaggtatggggtcaacctaaatgtccatcattgaatggatggataaagaaaatttggtatgtacacacacacacacacacacacacacacacacacacacatacacagtggaatactatctagcca

SEQ ID NO: 13621 - DNA, 186 bp, Homo sapiens
  D8S1810
  Located on chromosome 8
  Distance between a terminus base of telomere on chromosomal short arm and 5'-terminus of this base sequence : 32295487
  Distance between 3'-terminus of neighbour sequence of sequence listing upward to telomere on chrosomal short arm and 5'-terminus of this base sequence : 178914
atgatgctgagtccccatgattaatctgacttggtaatactgttcatctatgtaaagaattggagaaaagtagatctcccttcatgcgtgtgcgcgcacgcgcgcacacacacacacacacacacacgcacaccaatttgtttaaaataaaaaaagattagacgaaagcataaaatcagccctctg

SEQ ID NO: 13622 - DNA, 288 bp, Homo sapiens
  chr8.fa.O7frz.35250670
  Located on chromosome 8
  Distance between a terminus base of telomere on chromosomal short arm and 5'-terminus of this base sequence : 32337235
  Distance between 3'-terminus of neighbour sequence of sequence listing upward to telomere on chrosomal short arm and 5'-terminus of this base sequence : 41562
tgtctcctactcatgatagcagggggcagattcagatctgcaggaggtagaaataggcatcagatcactctgtcctaaaaaacaaacaaacaaacaaacaaacaaacaaacaaacaattggaagaaatgaattgatcacagaagcatctagagctaggaccaattaaaagtcagttagtttatatgacctatttgaagatttctcaacaatcttgacctattgcttaagagcacaacatttgtagtaaaatgagcctaagttaggatatgacttaagatcactgacca

SEQ ID NO: 13623 - DNA, 432 bp, Homo sapiens
  chr8.fa.O7frz.35334525
  Located on chromosome 8
  Distance between a terminus base of telomere on chromosomal short arm and 5'-terminus of this base sequence : 32420899
  Distance between 3'-terminus of neighbour sequence of sequence listing upward to telomere on chrosomal short arm and 5'-terminus of this base sequence : 83376
ttaatctataaagccttatccagagaaattggagattatctttaagcattttgaaatattaagcatagcctgctggccccaaatgacattttttttaatatttacaaattattaataaaactaaaaatttccatcccttccctggaaccccaagcaaccaccgattatttatttatttattatttatttatttatttatttatttatttatttatttatttattatagagatggagtctcactatgctgcccaggccggtcttgaagtcctggccccaagtgatccctccgcctcagcctcccaaaatgctgaggccacaggcacggatgcagagtttgcagatgggcagctaccattttcgagtatgcagtaactgagttttgtgagaagagcaaagtggaaagggagaatgacttaattaggtctgtcct

SEQ ID NO: 13624 - DNA, 124 bp, Homo sapiens
  Z67344
  Located on chromosome 8
  Distance between a terminus base of telomere on chromosomal short arm and 5'-terminus of this base sequence : 32582622
  Distance between 3'-terminus of neighbour sequence of sequence listing upward to telomere on chrosomal short arm and 5'-terminus of this base sequence : 161291
atttgttgccaggcatttcctttgggaatccatgtaggctgatcatttacctgggaaatcgtgtgtgtgtgtgtgtgtgtgtgtgttacctttacctttgtaagggacatcataaaacctcaat

SEQ ID NO: 13625 - DNA, 474 bp, Homo sapiens
  chr8.fa.O7frz.35612890
  Located on chromosome 8
  Distance between a terminus base of telomere on chromosomal short arm and 5'-terminus of this base sequence : 32670624
  Distance between 3'-terminus of neighbour sequence of sequence listing upward to telomere on chrosomal short arm and 5'-terminus of this base sequence : 87878
gacaaggaaaacctaatttcactgtttttctagctttttttattgctataacttttatatcataaatccacccatttgaagtgtatagctccattttactatactgttttcatttataaaagccttttataaatttatacatacctttcagtgttgtttgaattttccatagcaagcattcatagcatagtatatcatgtagcagggtttaaaataagcatagaagagggtttcgccaaaagattatttaagaaaatctactaaaagagggttcttctgaaaaataaaatgtatttgcttttatcaaatgagcaaacttcatccacttggagatcacccacatgtgaatttctttctttctttctctctttcccttccttccttccttccttccttccttccttccttccttccttccttccttccttccttccttcttactttctttctctgatggtaagttacattagagga

SEQ ID NO: 13626 - DNA, 338 bp, Homo sapiens
  AC023948.2_104903
  Located on chromosome 8
  Distance between a terminus base of telomere on chromosomal short arm and 5'-terminus of this base sequence : 32745847
  Distance between 3'-terminus of neighbour sequence of sequence listing upward to telomere on chrosomal short arm and 5'-terminus of this base sequence : 74749
gccttgagtagaaatctcctacccttcatgtctcctcctagtaattttccatccactgaccccacactctgctctttgactctaaatcttcatttgtccttgttgtcttcaatgtcgaggccaatctctttcccctaccataatatctctattgaaatagtcctgaacaaagtcttccttgccattttcacacgtgccagaataatgcttgcctccctgcctgcctgccttccttccttccttccttccttccttccttccttccttccttccttccttctttctttccacagaatctcgctctgtcacccaggctagagtgcagcggtataatcaag

SEQ ID NO: 13627 - DNA, 135 bp, Homo sapiens
  HUMUT1885
  Located on chromosome 8
  Distance between a terminus base of telomere on chromosomal short arm and 5'-terminus of this base sequence : 32746023
  Distance between 3'-terminus of neighbour sequence of sequence listing upward to telomere on chrosomal short arm and 5'-terminus of this base sequence : -162
ccttgccattttcacacgtgccagaataatgcttgcctccctgcctgcctgccttccttccttccttccttccttccttccttccttccttccttccttccttctttctttccacagaatctcgctctgtcaccc

SEQ ID NO: 13628 - DNA, 271 bp, Homo sapiens
  AC023948.2_36276
  Located on chromosome 8
  Distance between a terminus base of telomere on chromosomal short arm and 5'-terminus of this base sequence : 32778303
  Distance between 3'-terminus of neighbour sequence of sequence listing upward to telomere on chrosomal short arm and 5'-terminus of this base sequence : 32145
acttcactcattactgatgcattgcaattaacagatctcctctttcaagacacattagggtatgttctgactatcagctccaaaaaaataaaataaaataaaataaaataaaacacattaggaaatttaaatgaattagtgtaatcagctgagatagtacttgaaagggaccgtgtaggcttgtggtggaataggtactttcagacagaagtctctagaatattcctgaggaagtattttctcctgcccttcaatgaatagagtggtaagg

SEQ ID NO: 13629 - DNA, 422 bp, Homo sapiens
  AC023948.2_170909
  Located on chromosome 8
  Distance between a terminus base of telomere on chromosomal short arm and 5'-terminus of this base sequence : 32815436
  Distance between 3'-terminus of neighbour sequence of sequence listing upward to telomere on chrosomal short arm and 5'-terminus of this base sequence : 36862
ccaggtatctatgtaagtcacaactcatcatatggtatactgtaaatatgtgcaggctgggcgtggtggctcatgcctgtaataccagtactctggaaggccgaggtgggagaattaaggccaggagtttgagacatagcaagatcctgtctctagtaaataaataaataaataaataaataaataaataaataaatgcacttttttgtatattgagttatatctcaatgaagctgcttttttttaaaaaaaaaaaaaacatataacataaaagagattaacagaagagattcaaaagtctagaacaccaaatattaaaggtagcttttcaaatcagtgagaaaataatgatattacagaaaatggcaaatcatctagaattaaatttctacttcatactatcagcaatataaattgcagac

SEQ ID NO: 13630 - DNA, 460 bp, Homo sapiens
  chr8.fa.O7frz.35907987
  Located on chromosome 8
  Distance between a terminus base of telomere on chromosomal short arm and 5'-terminus of this base sequence : 32877027
  Distance between 3'-terminus of neighbour sequence of sequence listing upward to telomere on chrosomal short arm and 5'-terminus of this base sequence : 61169
ggatagttatgtttgcactttaagcctcatgttagttatctggaatagtatataatattacctacctttagtgtcatcataagaattaaatgatttttgtgatataaagtgttaagtgtggtgccagaccctggcaaagttggtaattgtccccttccttccttccccgctttcaccttccttcctccctccctccctcccttccttccttaattccttctgtccttccctcccttcctcctttcacctccttcccttccttccttctttccttctgtctctttcacatgccttctttctctcttcccttccttccttcccctcaccattctatgagggcataactgggagggttaatagaatggatatctaaagcagcgattctcgaatataggcttttaaccagcagaatcagcattacttgacccgaaaacttgttagaaatgcaaacacttaagtc

SEQ ID NO: 13631 - DNA, 226 bp, Homo sapiens
  D8S1125
  Located on chromosome 8
  Distance between a terminus base of telomere on chromosomal short arm and 5'-terminus of this base sequence : 32970675
  Distance between 3'-terminus of neighbour sequence of sequence listing upward to telomere on chrosomal short arm and 5'-terminus of this base sequence : 93188
ccccctaaaatttagctccaaaagagagaagattcttaactagtggaaaaaatgtcttggtcagaaacaggagaaagaacatagctatcctagacaaaaataataataataataataataataataatcataaaagcaagggagggagggagaaagggaaagaaagagagacagaaagaaaaaagaaagaaaagacaggaaaggaaagaaaggagggctaggcata

SEQ ID NO: 13632 - DNA, 236 bp, Homo sapiens
  D8S278
  Located on chromosome 8
  Distance between a terminus base of telomere on chromosomal short arm and 5'-terminus of this base sequence : 33176198
  Distance between 3'-terminus of neighbour sequence of sequence listing upward to telomere on chrosomal short arm and 5'-terminus of this base sequence : 205297
gctgctatctaaggaatctcttctattagttacatggaaacttggagattttattgtttccctctcagtgtgtgtgtgtgtgtgtgtgtgtgtgtgtgtgtgtgtgtgttagccatttattaatcctaactcccccaagaaaagacaatctataaatttcattttcactcacattaaaaggtgagatgcaggctgggtgctgtggatcacacctgtaaacctagcactttgtgttg

SEQ ID NO: 13633 - DNA, 203 bp, Homo sapiens
  Z16888.1_161
  Located on chromosome 8
  Distance between a terminus base of telomere on chromosomal short arm and 5'-terminus of this base sequence : 33176222
  Distance between 3'-terminus of neighbour sequence of sequence listing upward to telomere on chrosomal short arm and 5'-terminus of this base sequence : -212
attagttacatggaaacttggagattttattgtttccctctcagtgtgtgtgtgtgtgtgtgtgtgtgtgtgtgtgtgtgtgtgttagccatttattaatcctaactcccccaagaaaagacaatctataaatttcattttcactcacattaaaaggtgagatgcaggctgggtgctgtggatcacacctgtaaacctagcac

SEQ ID NO: 13634 - DNA, 313 bp, Homo sapiens
  AF128834.2_144413
  Located on chromosome 8
  Distance between a terminus base of telomere on chromosomal short arm and 5'-terminus of this base sequence : 33246520
  Distance between 3'-terminus of neighbour sequence of sequence listing upward to telomere on chrosomal short arm and 5'-terminus of this base sequence : 70095
gtcaaatccatacttatgtggtagttacatgggaggagatgactttgatagagtctttccactcttggactgggaagttacttccaataaaataacacattctgggcttgaaggcctgttgcttacttttgcaagggcctttccttcaaaatgatattttagaactttgtggaatttatgaaatcagaggtaagctattacctgtttgtttgcaagtccgctgaattttattttattttattttattttattttattttattttattttattttattttattgtcatcttagtctaatccttgaccatttact

SEQ ID NO: 13635 - DNA, 336 bp, Homo sapiens
  chr8.fa.O7frz.36194990
  Located on chromosome 8
  Distance between a terminus base of telomere on chromosomal short arm and 5'-terminus of this base sequence : 33340769
  Distance between 3'-terminus of neighbour sequence of sequence listing upward to telomere on chrosomal short arm and 5'-terminus of this base sequence : 93936
aattgctgactcatagcattacttagaaatgaatttgaaccttggaaaactgcagagttcagtttgtaattttccaaacctcttgatctcaaattcaaaatgtaaattttataagattagacttcaaaagacttcactgtaatatagtacttaacaattattgggaggtggaaggggctgtatcatgtcttccataatcacatatttggtccttttcaaatattccaaaaagccatttgaaaatgtagtgtgtgtgtgtgtgtgtgtgtgtgtgtgtgtgtgtgtgtgtgtgtgtagtttgtattagggaagaagttagaatacaccttatgagga

SEQ ID NO: 13636 - DNA, 466 bp, Homo sapiens
  chr8.fa.O7frz.36282338
  Located on chromosome 8
  Distance between a terminus base of telomere on chromosomal short arm and 5'-terminus of this base sequence : 33436496
  Distance between 3'-terminus of neighbour sequence of sequence listing upward to telomere on chrosomal short arm and 5'-terminus of this base sequence : 95391
caactttagcttggtatttaagacctctcacagaataatgtcaacccacctctcctgtgatgccattgctcctttatatgatgctttcattcagacagctggtctacttttcttctctatctttctctctctctatatatatatgtgtgtgtgtatatatatgtatatatatatacaacacaccacagtgtctcctcatagatgtgtgtgtgtgtatatatatatatatatatatatacacacactcatacagtgtctcattaacagagagtgagactctccatgtcaggaaccccatatacttgaaattcctgccttctctccacctacctaatccaatgctatcatccaagctcagttcacctcctcataaagctttctctgactaataaaaacagaagctgtcaagcatcctgagaggcagtggacattgaacaatacctgctgatacctgacctaagaaagc

SEQ ID NO: 13637 - DNA, 200 bp, Homo sapiens
  D8S259
  Located on chromosome 8
  Distance between a terminus base of telomere on chromosomal short arm and 5'-terminus of this base sequence : 33531733
  Distance between 3'-terminus of neighbour sequence of sequence listing upward to telomere on chrosomal short arm and 5'-terminus of this base sequence : 94771
cttgaatcacggggcggatatcagcacacacacacacacacacacacacacacacacacaaatgcaatgtcttagtctgttcagattgtcccaataattcatgttatgacattttgccttatgacatatctccaatagtgtacaggcaaacgtttagtaactggctctcggggagtggggggaaagccctgatctgtggc

SEQ ID NO: 13638 - DNA, 239 bp, Homo sapiens
  D8S1758
  Located on chromosome 8
  Distance between a terminus base of telomere on chromosomal short arm and 5'-terminus of this base sequence : 33632980
  Distance between 3'-terminus of neighbour sequence of sequence listing upward to telomere on chrosomal short arm and 5'-terminus of this base sequence : 101047
gaagccttgggtagcactgaatcattctgagtcttgtttttttcatttataaagtggagaaaacaatgtctacccttcctgggctattggccagagtaattataagaaaccaatgtgtgtgtgtgtgtgtgtgtgtgtgtgtgtgtgtgtgtgtgtacatataaactaaaacatcaaaaaatgtaaagaataataattggatgataaaatatggaatcaacctaagtgtccatcagtgg

SEQ ID NO: 13639 - DNA, 361 bp, Homo sapiens
  AC067838.2_102215
  Located on chromosome 8
  Distance between a terminus base of telomere on chromosomal short arm and 5'-terminus of this base sequence : 33747831
  Distance between 3'-terminus of neighbour sequence of sequence listing upward to telomere on chrosomal short arm and 5'-terminus of this base sequence : 114612
caatatctaaagtggttgtaccacggtcaacgtttaaaacatttaaacatttaaaaaacttttttaaaagttttaaacatttaaaaaactttaacacacatgtatatataactcctatttgtctaaataacatacttagattgttacacaaacacacacacacacacacacacacacacacacacaatcatgattccctctagagtatcagggagggaaatgggatcggtcagggagggactcatacagattttcaattatacatgtaatattttatgccttaagctatgtgataggtacataaatgcccattatattatctatattttttgtgaatgtaatggaaatctttctagaagct

SEQ ID NO: 13640 - DNA, 380 bp, Homo sapiens
  chr8.fa.O7frz.36786226
  Located on chromosome 8
  Distance between a terminus base of telomere on chromosomal short arm and 5'-terminus of this base sequence : 33794150
  Distance between 3'-terminus of neighbour sequence of sequence listing upward to telomere on chrosomal short arm and 5'-terminus of this base sequence : 45958
aatgccttgataagagttaagatctgagcaatggtatgctgatatatgtttagcaaccagctgtccaggaaaaagaaatatatgtgtgtgtgtgtgtgtgtgtgtgtgtgtgtgtgtatcttatacattttactgatataaaagattgcagcacagtaatgaaatgtacaacatattttattataaattctatatagaaattgactcacagaatggctatgcttatttttaccaaactttggtgttgattgctaacccataattgcaattcaatcatgttttgacaaacagactatgaataagtacctaattagcatggaatttggcaatgaagccactcaagtcattgatgacatgaatgtaattctgacatgaatgtt

SEQ ID NO: 13641 - DNA, 441 bp, Homo sapiens
  AC067838.2_9561
  Located on chromosome 8
  Distance between a terminus base of telomere on chromosomal short arm and 5'-terminus of this base sequence : 33830069
  Distance between 3'-terminus of neighbour sequence of sequence listing upward to telomere on chrosomal short arm and 5'-terminus of this base sequence : 35539
ctcctgtacagttcctggtacataataaattcacaataaattagttgttaggtctctatttacttatttatttagagacagggtctccgttgtcttaccttccaggcctctgccaccttcagccactcccacagcaacttttcccagagctaaccctgggcagagtcaggtttcctatgaagtgtacacacacacacacacacacacacacgaaaccctgaagtgtggaaggcagcttgttggaggattaaacctaataaagttgctcatctgtaaagcatgtgtgtttgcttgtatacaatcagaggaataaaccatttaaggagaagaaaaatacatagttttttgttgttgttttagcagaaccacagagctccccaaaaggaagagatgtgcaggaatgaatttagaccctctctctataaatcttgtcaggcactg

SEQ ID NO: 13642 - DNA, 287 bp, Homo sapiens
  chr8.fa.O7frz.37049102
  Located on chromosome 8
  Distance between a terminus base of telomere on chromosomal short arm and 5'-terminus of this base sequence : 33996711
  Distance between 3'-terminus of neighbour sequence of sequence listing upward to telomere on chrosomal short arm and 5'-terminus of this base sequence : 166201
tgctaggtttcagcttcatcaccccacccccactgccagcacgcatacacacacacacacacacacacacacacggcacttgggtggttgtccccactgctggggatcttgccagctggaatctgagtctcatctgcctggggctatcggcagagagcctagggagctgggatggggttgggggtacctttagacccatccaaagagaattagcagggagacaacagcagctgaggccatgacacatgtcaggcctgccatctctgtgccagagttagactttaacc

SEQ ID NO: 13643 - DNA, 101 bp, Homo sapiens
  D8S1845
  Located on chromosome 8
  Distance between a terminus base of telomere on chromosomal short arm and 5'-terminus of this base sequence : 34019614
  Distance between 3'-terminus of neighbour sequence of sequence listing upward to telomere on chrosomal short arm and 5'-terminus of this base sequence : 22616
tcgataccagcccaggcaatttagggagaccctgcctttacacacacacacacacacacacacacacacaaaagtcgtggcgcgtgcctgtaggttcagct

SEQ ID NO: 13644 - DNA, 117 bp, Homo sapiens
  D8S1709
  Located on chromosome 8
  Distance between a terminus base of telomere on chromosomal short arm and 5'-terminus of this base sequence : 34168069
  Distance between 3'-terminus of neighbour sequence of sequence listing upward to telomere on chrosomal short arm and 5'-terminus of this base sequence : 148354
agctgtattaacacatagacctttctttctccttgatagacacacacacacacacacacacacacacattaatgttaaagaaatcctaatttgaacaaaactgactctgtggcaata

SEQ ID NO: 13645 - DNA, 119 bp, Homo sapiens
  D8S283
  Located on chromosome 8
  Distance between a terminus base of telomere on chromosomal short arm and 5'-terminus of this base sequence : 34171053
  Distance between 3'-terminus of neighbour sequence of sequence listing upward to telomere on chrosomal short arm and 5'-terminus of this base sequence : 2867
attcatgtctaggccattgcatgtttcttctttctctgtctctccatacacacacacacacacacacacacacacacacacacacacacacacacacggagagatctacatctgtatct

SEQ ID NO: 13646 - DNA, 475 bp, Homo sapiens
  AF279873.1_93267
  Located on chromosome 8
  Distance between a terminus base of telomere on chromosomal short arm and 5'-terminus of this base sequence : 34230990
  Distance between 3'-terminus of neighbour sequence of sequence listing upward to telomere on chrosomal short arm and 5'-terminus of this base sequence : 59818
tgcttcatactttagaaaacaaagcattttcgagatgagcactgcatgccaggtgcttcagtatgtattggtttgctctagtaaaaagactacatctggcaagtgcagtggttcctacctgtaatcccagcactttgggaggccaaggtggaaggatctcatgaggctaggagttcaagaccagcctgggcaacgtagcaaaactctctccataaataaaaaattagctaagtgtggtggcacatgtctatagtgccagctacttgggaggctggggtaggaggatcacttgaatccagcagtttgagactgcagtgagccataatcacaccactgctccagcctgggtgacagagtgagaccctatctcaaaaataactaactaactaaataaataaataaataaataaatataaaagagactacatctggaataaaagattaattttctgattgagtttgtgataatttacca

SEQ ID NO: 13647 - DNA, 172 bp, Homo sapiens
  D8S535
  Located on chromosome 8
  Distance between a terminus base of telomere on chromosomal short arm and 5'-terminus of this base sequence : 34233753
  Distance between 3'-terminus of neighbour sequence of sequence listing upward to telomere on chrosomal short arm and 5'-terminus of this base sequence : 2288
gaagcatggaacccacctaaatgcccgtaaatcaacaagtggataaagaaactctggtatatatatatatacacatacacacacacacacacacacacacacacacacacacacacacacaccatggaatgctattcagccataaaaaggaatgagttaatggcatttgcag

SEQ ID NO: 13648 - DNA, 160 bp, Homo sapiens
  DISD22_0005665
  Located on chromosome 8
  Distance between a terminus base of telomere on chromosomal short arm and 5'-terminus of this base sequence : 34403398
  Distance between 3'-terminus of neighbour sequence of sequence listing upward to telomere on chrosomal short arm and 5'-terminus of this base sequence : 169473
aggtccaagtgtatctgtactgactcttttagccttctttggccaaagatggctcaaattttttttgtttttggtaatatatatgtatattctctgtaatgggggtgtgtttgtgtgtgtgtgtgtgtgtgtgtaaattatagctgtgaggtatgcatgc

SEQ ID NO: 13649 - DNA, 107 bp, Homo sapiens
  DISO7_10002456
  Located on chromosome 8
  Distance between a terminus base of telomere on chromosomal short arm and 5'-terminus of this base sequence : 34621250
  Distance between 3'-terminus of neighbour sequence of sequence listing upward to telomere on chrosomal short arm and 5'-terminus of this base sequence : 217692
ttgacaactgtctcctttgatcccttcctcagcttgttacacacacacacacacacacacacacacacacacattattctttatctcatagatttcaatcactgcca

SEQ ID NO: 13650 - DNA, 139 bp, Homo sapiens
  DISO7_10002459
  Located on chromosome 8
  Distance between a terminus base of telomere on chromosomal short arm and 5'-terminus of this base sequence : 34736535
  Distance between 3'-terminus of neighbour sequence of sequence listing upward to telomere on chrosomal short arm and 5'-terminus of this base sequence : 115178
attgcttacacagaggagaaagttttgaaggtctttggtatttgttatggcagccctagaaatctaatatggcatcattattattattattattattattattattattattattttcatcagtttgagatactcctgg

SEQ ID NO: 13651 - DNA, 380 bp, Homo sapiens
  chr8.fa.O7frz.38454378
  Located on chromosome 8
  Distance between a terminus base of telomere on chromosomal short arm and 5'-terminus of this base sequence : 34875240
  Distance between 3'-terminus of neighbour sequence of sequence listing upward to telomere on chrosomal short arm and 5'-terminus of this base sequence : 138566
tctaatgacatctggaactcatttccttgaaacccaagcaggtgagataatcaataccagattccatccttgatgatctgtctgcatctagtgtgtgtgtgtgtgtgtgtgtgtgtgtgtgtgtgtgtgtgtaatttgttggattttaattgtaagaaactgaaaccacttaaaattttttaagcagaaggagatttaataaaagaaacaggtgcttatggtatcagtggaggggtgaaggagtggaatctggtcagcaactccagtaatgactcttgagcacaaccactgaattagcccaccaggggtgtagctgcctctgccataatctgttttccatgtttggactcagagtgatgtcgttcaaatgtaatatgagc

SEQ ID NO: 13652 - DNA, 315 bp, Homo sapiens
  chr8.fa.O7frz.38557923
  Located on chromosome 8
  Distance between a terminus base of telomere on chromosomal short arm and 5'-terminus of this base sequence : 34975162
  Distance between 3'-terminus of neighbour sequence of sequence listing upward to telomere on chrosomal short arm and 5'-terminus of this base sequence : 99542
tgcatgctaggtttactaagaagaaaaggctgttcagacatggggcgctgaatgacggtttgtgttctaatgctatgataatagaaggtggtgggtttacatagccgacctgggcacaggagtcaaggagcactgtgggattactcagagattgccagacaagtcacagtgtgaggaactggttagaaacaaaaagaaaccaaggtagggttagaagaagcaactaagaaaggaagagaagggtgtgtgtgtgtgtgtgcgtgtgtgtgcgcacatgtgtgtgtttcctatgtaaatctaagatagtgcctttga

SEQ ID NO: 13653 - DNA, 209 bp, Homo sapiens
  D8S505
  Located on chromosome 8
  Distance between a terminus base of telomere on chromosomal short arm and 5'-terminus of this base sequence : 35009896
  Distance between 3'-terminus of neighbour sequence of sequence listing upward to telomere on chrosomal short arm and 5'-terminus of this base sequence : 34419
agcctgctatttgtagataatgtttgatttgttaaagttagtgagactgttcaattgacaaaatcaaaagtgaacccaaacctaaatatacactattggtctcagtatctctcctctctctgtctctctgacacacacacacacacacacacacacacacacacacacacacacaatgtcccttctcaattggtctgggacttagcact

SEQ ID NO: 13654 - DNA, 410 bp, Homo sapiens
  AC069386.4_131532
  Located on chromosome 8
  Distance between a terminus base of telomere on chromosomal short arm and 5'-terminus of this base sequence : 35132805
  Distance between 3'-terminus of neighbour sequence of sequence listing upward to telomere on chrosomal short arm and 5'-terminus of this base sequence : 122700
ctcaatttaagtgctgtacaaataaacttaaagtttctatgtgtgccctgaaggagaaccttatctcctatagccacagaactgattttattagaaattaaatgcaaaatcaagatcactttctgcagctggctgaattacaaagctatttgaaaacacacacacacacacacacacacacacattttattggttctgtttctctggaaaaacctgaccaaactaatgcagaggtcttaacaaatttattagtattcattttatttcccgaataacaattctgataataatctagttctgatgtttgctgtgtcttttcagacctctttttttttgcttgccttttgccatgtcctgtaattttactttgaaaatggggtcttattgtagcaggtaatagaattgaggta

SEQ ID NO: 13655 - DNA, 458 bp, Homo sapiens
  AC069136.5_31290
  Located on chromosome 8
  Distance between a terminus base of telomere on chromosomal short arm and 5'-terminus of this base sequence : 35204272
  Distance between 3'-terminus of neighbour sequence of sequence listing upward to telomere on chrosomal short arm and 5'-terminus of this base sequence : 71057
ccaagtgcatagtttcagataggggtaaatgttatgaaataaagcagtgagggcaagaaaatatgactgatatggagtcacttgggtcacttttaacaaggagattaaagaaggcccttctgaggaggggccaactgctcaaagacttgaatcatgtaagagcatgagctatgcaaatatttggaagaaagcattccaggaatagggaacagcaaaaggaaaagctgtgagagaagaatgaggtgtatgggtgcatcagagtgctatgagaaacagagcaatattataaataggttttatgtataataatatatataaaacctatgtataatagtgttctatttacatattgcacgtgctctctctctctctctctctctctctatatatatatatatatacaatggtgcaagccaattccttgaaagaaatcaattgctctatcattcacatttaat

SEQ ID NO: 13656 - DNA, 465 bp, Homo sapiens
  chr8.fa.O7frz.38845863
  Located on chromosome 8
  Distance between a terminus base of telomere on chromosomal short arm and 5'-terminus of this base sequence : 35207256
  Distance between 3'-terminus of neighbour sequence of sequence listing upward to telomere on chrosomal short arm and 5'-terminus of this base sequence : 2526
cactatgtccattgcctattacttttccctagcttgtctcctccctgcctaaaacctctattcttctttaaacactataaaaataataaataaaattcagttgggtgccgtggctcatgcctgtaatcccagcactttgagaggccactggaggattgcttaagcctaggagtttgagattagtttgggtaacatagagagacccccatctctacaaaaaattttaaaaattagccaggtgtggtggtgtgtacctgtagtcctaggtatgattgaggtgggaggatcacttgagcccaggaaatcaaggctgcagtgagctatgattgtaccattgcacttcagcctgatatatagatagatgatagatagagagagagagagagagagagagagagagagagagagatctacaagcggaaaatccctttaagccctataaggaaatcaggcatctactcaatt

SEQ ID NO: 13657 - DNA, 457 bp, Homo sapiens
  AC074199.2_75360
  Located on chromosome 8
  Distance between a terminus base of telomere on chromosomal short arm and 5'-terminus of this base sequence : 35419318
  Distance between 3'-terminus of neighbour sequence of sequence listing upward to telomere on chrosomal short arm and 5'-terminus of this base sequence : 211597
tttacctatgtaacaaacctgaacttctaccctgaacttaaaaggaatacatacatacatacatacatacatacatacatacatacaaatgaaaacctgtatttctgtagtgcaacttccgggactcctctgagaaagtgatcagatccagtgtagtggtgtctgtctgtctgcttttgcaaaatatatgaccagaaaatcaaaaatagttaatcctcaaaaatattactatcaagtgttttttttttacttatactaatatgtatatacagtcatgtgtcacttaacaacagggatatgttctgagaaatgcatcgttaggcaagttcaacattgtgcaaacatcatagagtacacttacacaaacttagatattgttgtctacttcacacctaggctgcatggtatagcctattgcactaggttacaaacctgtatagcatgttcctgtactgaa

SEQ ID NO: 13658 - DNA, 478 bp, Homo sapiens
  AF282855.2_23694
  Located on chromosome 8
  Distance between a terminus base of telomere on chromosomal short arm and 5'-terminus of this base sequence : 35560840
  Distance between 3'-terminus of neighbour sequence of sequence listing upward to telomere on chrosomal short arm and 5'-terminus of this base sequence : 141065
gtggtcaacttactaaattgaaagatgattttaaagattttgaagaaaaaaataagaggtttgccctaatgttctggaggcttatttttactattgaaaagttaaacacatacagtcagaaatatgtaatatactatcatgtacccatcaccttacttcaacaattatcaatacatagcccatctgttctcatttatatctctaccctctctccctaacatttctaacacattttgatgctaatcccagatatattattattattattattattattattatgagacgagtctcgctctgtcgctcaggctggaatgcagtggcgcgatcttggctcactgcaagctctgcctcctgggttcacgccattctcctgcctcagcctctggagtagttgggactacaggcgcctgccaccatgcccggctaattttttgtatttttagtagagaagaggtttcaccatgttagctaggat

SEQ ID NO: 13659 - DNA, 457 bp, Homo sapiens
  AC074199.2_31304
  Located on chromosome 8
  Distance between a terminus base of telomere on chromosomal short arm and 5'-terminus of this base sequence : 35577328
  Distance between 3'-terminus of neighbour sequence of sequence listing upward to telomere on chrosomal short arm and 5'-terminus of this base sequence : 16010
agaaactcagaactgcatgagaagaagcaaccgaagtttttatttatttattttattattattattattattattattattattttgagacagagtttccctccattgcccagactggagtgcagtggtgcaatctcggttcactgcaacctccacctcccaggttcaagcgattctcctgcctcagcctcccgagtagccgggattacaggcacctgccaccacacctggttaatttttgtattttcagtagagatggggtttcgccatgttagccactctgatctcgaactcttgacctcaggtgatccatctgccttggcttcccaaagtgctgggattacaggcgtgagccaccacgcctggccaccaaagcttttaaaagtatatccagtcactctttttggatgtaaatttatggctttttgaggatatcatggacatattactgccaaca

SEQ ID NO: 13660 - DNA, 217 bp, Homo sapiens
  AC018704.6_89112
  Located on chromosome 8
  Distance between a terminus base of telomere on chromosomal short arm and 5'-terminus of this base sequence : 35627249
  Distance between 3'-terminus of neighbour sequence of sequence listing upward to telomere on chrosomal short arm and 5'-terminus of this base sequence : 49464
ttactttattctgatctaggcaaccttaccaacataagcagatacataaaaatgtatgtatgaacagatatgtgtgtgtgaatgtgtgtgtatatatatatatatatatatataatacacatctgtatttgtatttccttcctccttagataggtgatagtacttttgagaatgtttttctcattgatatttagtacaatacctaggaagacaacct

SEQ ID NO: 13661 - DNA, 391 bp, Homo sapiens
  AC018704.6_131287
  Located on chromosome 8
  Distance between a terminus base of telomere on chromosomal short arm and 5'-terminus of this base sequence : 35680409
  Distance between 3'-terminus of neighbour sequence of sequence listing upward to telomere on chrosomal short arm and 5'-terminus of this base sequence : 52943
catgacatatgtaaatattaggcacagaatgtgatttgaagcaagattgaaaaaaaattaaattttcttcatacttcctaaagataacttggtgcccaatgttgatttgagacatccttaggaataaataaatcaaatactatcttccttccttccttccttctttccttccttctttccttcctttctctctgcagcactttttctcttttatatcaagggtgtaaggttaagtttgttggagcatttaaaaaaaacaattctgcctggatgtcactaaagatattttaattatgaatcacttactgagaatttgccattactgctggtaggtaaatttacatattgacattttacttggacaagccaaggattggtaagaaactgagtt

SEQ ID NO: 13662 - DNA, 205 bp, Homo sapiens
  DISD22_0005675
  Located on chromosome 8
  Distance between a terminus base of telomere on chromosomal short arm and 5'-terminus of this base sequence : 35819057
  Distance between 3'-terminus of neighbour sequence of sequence listing upward to telomere on chrosomal short arm and 5'-terminus of this base sequence : 138257
ggtgactacattctctttcgcaaagacaaatttcatttatgtatgtagaaataaataagtgagccaaacccctgggggatgatttgcctgctgaaaaggagtgctacaaaacaatactctgtgtgtgtgtgtgtgtgtgtgtgtgtgtgtgtgtgtgtgtgtggttgcatacagatttaagatatcttaaagtgcctcataatga

SEQ ID NO: 13663 - DNA, 478 bp, Homo sapiens
  chr8.fa.O7frz.42716806
  Located on chromosome 8
  Distance between a terminus base of telomere on chromosomal short arm and 5'-terminus of this base sequence : 35902571
  Distance between 3'-terminus of neighbour sequence of sequence listing upward to telomere on chrosomal short arm and 5'-terminus of this base sequence : 83309
cataatgctaagaacttctcaaacccaacaagcttttccatcctcggtccttcttgcatttttctctctccccttgaacatccatccatccatccatccatccatccatccatccatccaaggagtacctactaaacctcaggtggacgttggactcaattcaggggctatcgggaaacctcttcgacactcttactcctctccaacgcccttccccaccacccacctccgcgcccccagctctaaatttagctcccaggacgccgctggttggttcactcctcctcccacaccctctctaaaggccgggaacggaattgttagcccctccacccccacccccatcaaggtcaagaaattgaagcggggcggggggcggtgagcataactactcaatccccattttctcatctgaggaactaaggcacgaaacagggagtgcgaaggtacaccaggcctgatgtcctaatgcagaaac

SEQ ID NO: 13664 - DNA, 314 bp, Homo sapiens
  AP000501.1_40900
  Located on chromosome 8
  Distance between a terminus base of telomere on chromosomal short arm and 5'-terminus of this base sequence : 36026158
  Distance between 3'-terminus of neighbour sequence of sequence listing upward to telomere on chrosomal short arm and 5'-terminus of this base sequence : 123109
ggatctcaatgaccttccttccttccttccttccttccttccttccttccttccttccttccttccttccttccttccttccttcctttcttccttccttccttcgtgccacttgcaaaagttcaatgattattcagaaactggaagaaggatttctcttcctacctcaggagagaaagaagcatttcttggtcccttcttccatttatgaccaggagctaaaagagaaggcactgctagaacacactccctgtccacccctgtctccccaggcataaggctttcattccaggccagtccttaggcaccagaat

SEQ ID NO: 13665 - DNA, 226 bp, Homo sapiens
  D8S1722
  Located on chromosome 8
  Distance between a terminus base of telomere on chromosomal short arm and 5'-terminus of this base sequence : 36151860
  Distance between 3'-terminus of neighbour sequence of sequence listing upward to telomere on chrosomal short arm and 5'-terminus of this base sequence : 125388
agctgcctggctaagagccgtgtgtgtgtgtgtgtgtgtgtgtgtgtgtgtgtgtgtgtgtgtgtgtgtgtgtgtgtgtgtgtctcaccgtgggcaggctggcccctccctgggggtagactggagaccccacatcttatctttgatggtctttcccatcctggatgctgagtctcctgaagcctgaagtcatagtttctgccttgatacacaattcccagcaagg

SEQ ID NO: 13666 - DNA, 156 bp, Homo sapiens
  Z67542
  Located on chromosome 8
  Distance between a terminus base of telomere on chromosomal short arm and 5'-terminus of this base sequence : 36159755
  Distance between 3'-terminus of neighbour sequence of sequence listing upward to telomere on chrosomal short arm and 5'-terminus of this base sequence : 7669
gactgggcctcctacattttccacaacgctgtgtgtgtgtgtgtgtgtgtgtgtgtgtgtttcggggacagtgagtgggacaagggaaaagtagatgagaaggagcagggctttgcagcagggtgtggaaagagcactgcgcagtgagtctggaga

SEQ ID NO: 13667 - DNA, 359 bp, Homo sapiens
  AF178650.1_36763
  Located on chromosome 8
  Distance between a terminus base of telomere on chromosomal short arm and 5'-terminus of this base sequence : 36283694
  Distance between 3'-terminus of neighbour sequence of sequence listing upward to telomere on chrosomal short arm and 5'-terminus of this base sequence : 123783
attaggcaataaagaattccaccggggcaataagagaacattactttaattaaggaaatggttgtggtcagagttttaattctcattttctttttaaatgcactgcttcgttagatgcaaagctaaatatgaagtaaacttcctttctcagaaacttttgtgtcagttataatgtatttatctaaatctaccatctctatctatctatctatctatctatctatctatctatatctctacctccctacctatttatttggtactaagcaatctttcacagtcttaagaacttagagataataaaggctaaacaacactagaacatggaataatttaatatgattagtaattgcctcagc

SEQ ID NO: 13668 - DNA, 272 bp, Homo sapiens
  D8S515
  Located on chromosome 8
  Distance between a terminus base of telomere on chromosomal short arm and 5'-terminus of this base sequence : 36290579
  Distance between 3'-terminus of neighbour sequence of sequence listing upward to telomere on chrosomal short arm and 5'-terminus of this base sequence : 6526
catgcctgggcaaaagcaactaatttttgggtgttgatttggtatcctgctactgcactgaatttattagttatagcatggtgtgtgtgtgtgtgtgtgtgtgtgtgtggatgtgtgtgcatttgtgtgtagtgttctctatagataagattctaccactgagaacagagattttactttgtctttccagtttggatgctttttgtcttgcttaattgctctaagtagatcttccagtactgtgttgaatagaagcagtgaaagtggacatc

SEQ ID NO: 13669 - DNA, 459 bp, Homo sapiens
  AF301239.1_17940
  Located on chromosome 8
  Distance between a terminus base of telomere on chromosomal short arm and 5'-terminus of this base sequence : 36498852
  Distance between 3'-terminus of neighbour sequence of sequence listing upward to telomere on chrosomal short arm and 5'-terminus of this base sequence : 208001
aaatgtccggtctttgtataacttgttgatagaatagtttgtttagtagtttgaataatatttccagccaatccaaggaattcaagcacaacaaaattcaccaatgaaaatccatacgaaaaatctgttttatgttaattaataaaagctctcttcccgagcagagataagacagctgaagtgtttgttgtagctattataatgcttagattatatgagagcaaacccaattcagacaagtaattaccttgggttggttgtaaattaaaactctatttcttacaccatctctctctctctctctctctctctgtttctctctctctctctctctcacacacacacacacacacacacacacacacaacacacacacaccactgtgcttaagtatttgacagtaaattacagacatcaaaataccataatataggtgaggaccattaggatcaggtagct

SEQ ID NO: 13670 - DNA, 203 bp, Homo sapiens
  D8S1777
  Located on chromosome 8
  Distance between a terminus base of telomere on chromosomal short arm and 5'-terminus of this base sequence : 36543783
  Distance between 3'-terminus of neighbour sequence of sequence listing upward to telomere on chrosomal short arm and 5'-terminus of this base sequence : 44472
agcccttcacaagtacatgagccaattccttaaaatcaatctctctgtctctctctctctctgtacacacacacacacacacacacacacaccccacagactgttagttttagttctctggagaatcctgctcatacagattttagtactaacaagtgcaatgctgctataacaaatacctaaaaatgcggagtggctttgga

SEQ ID NO: 13671 - DNA, 269 bp, Homo sapiens
  D8S1719
  Located on chromosome 8
  Distance between a terminus base of telomere on chromosomal short arm and 5'-terminus of this base sequence : 36596656
  Distance between 3'-terminus of neighbour sequence of sequence listing upward to telomere on chrosomal short arm and 5'-terminus of this base sequence : 52670
gctaaaattgccatagtttatgaagccctttatattctttcacaaagcagaggggtgtgtgtgtgtgtgtgtgtgtgtgtgtgtgtgtgtgtgtttcctggttatgtgtttattctagaaacctaaaaatagagaaaaagcaaaaaacttaatacaaacttaaattactaacattgtgtgacccagagaaaaatacctggactaaatttgacatcttacttcaaagtctctttgaataaactgttatgggaacaggtgtctcaggttaa

SEQ ID NO: 13672 - DNA, 221 bp, Homo sapiens
  D8S1750
  Located on chromosome 8
  Distance between a terminus base of telomere on chromosomal short arm and 5'-terminus of this base sequence : 36612044
  Distance between 3'-terminus of neighbour sequence of sequence listing upward to telomere on chrosomal short arm and 5'-terminus of this base sequence : 15119
gatcgcaccactgtactccagcctgccaacagagcaagactccacctcaaaaaaatacaaaaaaaaaaagaataattataaagatctataaaaaaacagcacacacacacacacacacacacacacacacacacacacacacaacagaaaaagaaacctgaggttagcctaatggttaagaacatgggttttggtgtagaggaagcaatgtttgaaatcag

SEQ ID NO: 13673 - DNA, 144 bp, Homo sapiens
  DISO7_10002464
  Located on chromosome 8
  Distance between a terminus base of telomere on chromosomal short arm and 5'-terminus of this base sequence : 36775386
  Distance between 3'-terminus of neighbour sequence of sequence listing upward to telomere on chrosomal short arm and 5'-terminus of this base sequence : 163121
actgcttacatgcacatgtgcttatacacacacacacacacacacacacacacacacacacacacacacacgactttctcccttctctcatgaagtcagggtaaaaaaatctagaactaaaccttggggccagtactgaacaca

SEQ ID NO: 13674 - DNA, 101 bp, Homo sapiens
  DISO7_10002462
  Located on chromosome 8
  Distance between a terminus base of telomere on chromosomal short arm and 5'-terminus of this base sequence : 36793503
  Distance between 3'-terminus of neighbour sequence of sequence listing upward to telomere on chrosomal short arm and 5'-terminus of this base sequence : 17973
aacttggcaagatctgctctgtgtgtgtgtgtgtgtgtgtgtgtgtgtgtgtgtgtgtgtgtgtgtgttaatgtgtgatgaaggaattgaagataattccc

SEQ ID NO: 13675 - DNA, 101 bp, Homo sapiens
  DISO7_10002466
  Located on chromosome 8
  Distance between a terminus base of telomere on chromosomal short arm and 5'-terminus of this base sequence : 36846123
  Distance between 3'-terminus of neighbour sequence of sequence listing upward to telomere on chrosomal short arm and 5'-terminus of this base sequence : 52519
aactaatgaaatagagcatgtcaaggggatagtcaagaacaaaacacacacacacacacacacacacacacacacacacagagttcaaggaaagtgaggac

SEQ ID NO: 13676 - DNA, 104 bp, Homo sapiens
  DISO7_10002468
  Located on chromosome 8
  Distance between a terminus base of telomere on chromosomal short arm and 5'-terminus of this base sequence : 36917717
  Distance between 3'-terminus of neighbour sequence of sequence listing upward to telomere on chrosomal short arm and 5'-terminus of this base sequence : 71493
accacaggtgaatagcaatgatcacacacacacacacacacacacacacacacacacacactcttccatgaacatgcaaacatatctctgtacacagagatgca

SEQ ID NO: 13677 - DNA, 243 bp, Homo sapiens
  DISO7_10002469
  Located on chromosome 8
  Distance between a terminus base of telomere on chromosomal short arm and 5'-terminus of this base sequence : 36920818
  Distance between 3'-terminus of neighbour sequence of sequence listing upward to telomere on chrosomal short arm and 5'-terminus of this base sequence : 2997
gccttgaatttattcactctagctaaggggttgggggccaaatttctaagcactgttatcaaactatatatatatatatatatatatatatatatatatatatacatacacacacacacacgtatatatatgcatatatatgtacatatatggtttgtatatatgtggtgtgtatatacacacacatacacatataaatatgtataataaaccttttgtgtaaattgattagatgaggatgca

SEQ ID NO: 13678 - DNA, 133 bp, Homo sapiens
  DISO7_10002470
  Located on chromosome 8
  Distance between a terminus base of telomere on chromosomal short arm and 5'-terminus of this base sequence : 36946717
  Distance between 3'-terminus of neighbour sequence of sequence listing upward to telomere on chrosomal short arm and 5'-terminus of this base sequence : 25656
tgccaagttcaaaccttaagaaatctttggcaggattccccctgcaaacagctaaatttgtgtgtgtgtgtgtgtgtgtgtgtgtgtgtgtgtgtatccattttagacagctttagtgtctcaggatggcgta

SEQ ID NO: 13679 - DNA, 120 bp, Homo sapiens
  D8S1121
  Located on chromosome 8
  Distance between a terminus base of telomere on chromosomal short arm and 5'-terminus of this base sequence : 36999546
  Distance between 3'-terminus of neighbour sequence of sequence listing upward to telomere on chrosomal short arm and 5'-terminus of this base sequence : 52696
tcactccatcagtgggtctttatgggctccgtgtacattattattattattattattattattattattattattattattattatttgaaatgcaaggttggttcctgaagcaaaaaag

SEQ ID NO: 13680 - DNA, 132 bp, Homo sapiens
  D8S1700
  Located on chromosome 8
  Distance between a terminus base of telomere on chromosomal short arm and 5'-terminus of this base sequence : 37000133
  Distance between 3'-terminus of neighbour sequence of sequence listing upward to telomere on chrosomal short arm and 5'-terminus of this base sequence : 467
tctgtcaaggatgtttatgcaagtgtgtgtgtgtgtgtgtgtgtgtgtgtgtgtgtgtgtgtgtgtgtgattatgcacataggaacatgagtgcactggggatgtctgtatgtgtgcaggtgaccccgaatg

SEQ ID NO: 13681 - DNA, 346 bp, Homo sapiens
  AC079009.2_22824
  Located on chromosome 8
  Distance between a terminus base of telomere on chromosomal short arm and 5'-terminus of this base sequence : 37140258
  Distance between 3'-terminus of neighbour sequence of sequence listing upward to telomere on chrosomal short arm and 5'-terminus of this base sequence : 139993
gctttcaagtttaacagtcttagagaagatgggccagtgaggctggcactattttagatgtaccagagcaggaccaggaatgtgaagagaactgagacttagtcaaaagatgagattatttgtgggtggcaaaatcacatttttctttttaacatagtatcttgagtttctgaccttttatttgttgttgttgttgttgttgttgttgttgttgttgttgttaaaggtctcacacaaaatctggcccaatcatattacagtcaagagggatttgtagtcttgaaagggccaccagccacatgtatcttaaaggaaacacatgatcttataagcaacctgtcctagg

SEQ ID NO: 13682 - DNA, 269 bp, Homo sapiens
  AP000080.1_45628
  Located on chromosome 8
  Distance between a terminus base of telomere on chromosomal short arm and 5'-terminus of this base sequence : 37357250
  Distance between 3'-terminus of neighbour sequence of sequence listing upward to telomere on chrosomal short arm and 5'-terminus of this base sequence : 216646
tcaggtacattttcttactgctagtccagctcccaacctctaaattgtttacttttaactgcaagccacatcatttgtcttagagagaaaatctctgataagttatctatctatctatctatctatctgtctatctatctatatatttatctatcacctatctatctatcgatcgatcatctatttatccatctatctattgggatatgtgcattaattcatcccacaaataatggtgttttgtgctcaattgttccttagtagcataa

SEQ ID NO: 13683 - DNA, 436 bp, Homo sapiens
  AP000079.1_97981
  Located on chromosome 8
  Distance between a terminus base of telomere on chromosomal short arm and 5'-terminus of this base sequence : 37404857
  Distance between 3'-terminus of neighbour sequence of sequence listing upward to telomere on chrosomal short arm and 5'-terminus of this base sequence : 47338
actttcagacttggactgagtcagcattcctggatttccagcttgcagactgtctatcatgggacctctctgtttctgtaatcacatgaggcaattcacctaataaatcccttctaatctatctgtctgtctgtctgtctgtctgtctgtctgtctgtctgtctgtctacctgtctgtctatcttactggttctgtctttctggagaaccctaactaatacaattatatactttaaaatggctaaagtggtacgttttatgttatggaaatgttatctctatttaaaaaaagcagaagaaaaaacaaaactctggcctcctctgagtgttttggttaaggagaaataagaatcttgaagggtcatgtagtattttcaatgttgttacaaagactaaaattaagttacttggaagatgatttaggcaacttagaaca

SEQ ID NO: 13684 - DNA, 344 bp, Homo sapiens
  AP000079.1_69048
  Located on chromosome 8
  Distance between a terminus base of telomere on chromosomal short arm and 5'-terminus of this base sequence : 37433741
  Distance between 3'-terminus of neighbour sequence of sequence listing upward to telomere on chrosomal short arm and 5'-terminus of this base sequence : 28448
cacttttctatggaacataggagacccaaacctcacaaacaaacaaaatagagatgtattaatgccccttatagttgtgaaccaaagataggcacatattcagagtaaacagaagaaagacatgaacaaaccattttcttttcttttcttttctttctctttctttctttctttctttctttctttctttctttctttctttctttctttctttcttctttctttctttcctttctttctttctctctttctctttctctctttctctctctctttctctctttctttctttctgacagaaccttgctctgtcccccaagccagagtacagtgactcgatcttg

SEQ ID NO: 13685 - DNA, 405 bp, Homo sapiens
  AP000078.1_46521
  Located on chromosome 8
  Distance between a terminus base of telomere on chromosomal short arm and 5'-terminus of this base sequence : 37556276
  Distance between 3'-terminus of neighbour sequence of sequence listing upward to telomere on chrosomal short arm and 5'-terminus of this base sequence : 122191
tacctacagtgaaaggcaagactctttctcccattattttgggattttctacaaacaaggttttcttattctgggagtggggaaagaaagccaaatgtgtatgagagctgtgcagtgtgtatcgaactatgaagtgtgtagagtttaaacaaatagctggattgaagggcagagaatgtgtgtgtgtgtgtgtgtgtgtgtgtgtgtgtatttggccaagcaagaggtgttaaggatatctaggaagaaaggaaggaagggattctaggcattttacagagcatgatgatgacataagtgaagcaagaatcaaagatgtatctgagattttgagctggaaaaaatactgtcattaaaagaagtgtcctgagttttattgctctcaggatgtctaagtgcctatac

SEQ ID NO: 13686 - DNA, 363 bp, Homo sapiens
  AP000078.1_42639
  Located on chromosome 8
  Distance between a terminus base of telomere on chromosomal short arm and 5'-terminus of this base sequence : 37560064
  Distance between 3'-terminus of neighbour sequence of sequence listing upward to telomere on chrosomal short arm and 5'-terminus of this base sequence : 3383
actcctgtgcattctacaaactggagattaaaccagaactggtagtggatttaataaattccagtcccagagttccataatggaaacctccagggcacaactgcccctcagctcccgatgacagccactgaccagtgcatgcagcttacctgtgacaaattatatggtgaaaccacatggcattgtgtctgtatctggactttctggcaggagagatctgagtttcagtccacaaacttagatttccagaattttatgtatgcatatacaaatatatatatatatatatatatatatatatatgttttacactgcagtctttctattcagattatgggctctggtcttgttatggactaaata

SEQ ID NO: 13687 - DNA, 294 bp, Homo sapiens
  AP000077.1_48613
  Located on chromosome 8
  Distance between a terminus base of telomere on chromosomal short arm and 5'-terminus of this base sequence : 37654172
  Distance between 3'-terminus of neighbour sequence of sequence listing upward to telomere on chrosomal short arm and 5'-terminus of this base sequence : 93745
tttccatgcaataaagattaattccttttactgtgttggtgaaataataatagagtcataaaacataacagaaaaagaggaagttgacaaagtgtgtgtttgattaattgccttaatagattataggcgctgactgaagtgtttttatttcccaaggctcatttttcaatgtttcaagatataatacaaatatatatatatatatatatatatatatatatttgccaacccctactccatgaacaaaaactaaaacacaaaaggcatgggtcagaattactcaaagcatgagga

SEQ ID NO: 13688 - DNA, 236 bp, Homo sapiens
  AP000076_6971
  Located on chromosome 8
  Distance between a terminus base of telomere on chromosomal short arm and 5'-terminus of this base sequence : 37795821
  Distance between 3'-terminus of neighbour sequence of sequence listing upward to telomere on chrosomal short arm and 5'-terminus of this base sequence : 141355
catgatgaatattactaaagtgtcctcttctctgagcctccaatgtggccctgtgcagcaccattattgatcttgcctatatgtaacatttagaatttgccctcctttagcaaagaaaacaacaaccaatggcttaaacaaaagggcatggttttttgttttttggtttttgtttgtttgtttgttgttgttgttgttgttgttgttgttgttgcagagaggaagtcctgaatcag

SEQ ID NO: 13689 - DNA, 187 bp, Homo sapiens
  chr8.fa.O7frz.41068275
  Located on chromosome 8
  Distance between a terminus base of telomere on chromosomal short arm and 5'-terminus of this base sequence : 38044709
  Distance between 3'-terminus of neighbour sequence of sequence listing upward to telomere on chrosomal short arm and 5'-terminus of this base sequence : 248652
ttgttactgctttgaccagtaggtgctctttcagcgggctcctgtgttcctttgaaaatcttcatccgtctgtgtgtgtgtgtgtgtgtgtgtgtgtgtgtgcgcgcacgcgcgcgcttccttactttctggtatacaaaatgctccaggcccacattatattttatctgtcctagcactagaatca

SEQ ID NO: 13690 - DNA, 423 bp, Homo sapiens
  chr8.fa.O7frz.41176345
  Located on chromosome 8
  Distance between a terminus base of telomere on chromosomal short arm and 5'-terminus of this base sequence : 38152633
  Distance between 3'-terminus of neighbour sequence of sequence listing upward to telomere on chrosomal short arm and 5'-terminus of this base sequence : 107737
tgtagattagctgtggcactaggaatctcggcaaaagatttgggatggtacccagcacctgctctcaaaagctcatccctccatgatgcgctggggaggagactctttcccaagacccagctgggtatgcaatgctacaaacgtctctgctgcatttcttttctgggttggtactttttctaagagagagagagagagagagagtgcatgtaaaacagagagagagagaaaggagagagagagaatcagtgtgcctttgtgtttgtatatgtgactgcgtgtggatgtatgcgtgcctcggcctgtgtgcctctgtgtgtgactctatgggtgtgacagtatgcaactgtgtcataacactgtgtatttacatctgtgagtacatgtgtctgtgagtgtgtgatagaatctgtgactatggat

SEQ ID NO: 13691 - DNA, 261 bp, Homo sapiens
  AP000069.1_45267
  Located on chromosome 8
  Distance between a terminus base of telomere on chromosomal short arm and 5'-terminus of this base sequence : 38457504
  Distance between 3'-terminus of neighbour sequence of sequence listing upward to telomere on chrosomal short arm and 5'-terminus of this base sequence : 304448
ttgaatccattctgttccttagtaatcatatggttcatctttaagctctttaactagtctcatataaaacaattttgggctgggtacagtggctcatgcctgtaatcccagcactttgggaagccgaggcagaaagatcacttgaaaccagaagtttaagaccagcatgggcagcatagcaagatcctatttttacacacacacacacacacacacacacacacacacacacacaatgttaattagctgagcatcatagca

SEQ ID NO: 13692 - DNA, 187 bp, Homo sapiens
  AP000068_90609
  Located on chromosome 8
  Distance between a terminus base of telomere on chromosomal short arm and 5'-terminus of this base sequence : 38512344
  Distance between 3'-terminus of neighbour sequence of sequence listing upward to telomere on chrosomal short arm and 5'-terminus of this base sequence : 54579
ccggattctgttatatttcacagaagagtgttgagttgttgttgttgttgttggtgttgttatagtgggtaattagctttgttagactcagattgcaaactgtctcttgggtgtcaactcaaatcttagttcaattcttctatctttagctgagcttcttggattgtactccatacatgcttgattc

SEQ ID NO: 13693 - DNA, 398 bp, Homo sapiens
  AC084847.1_31737
  Located on chromosome 8
  Distance between a terminus base of telomere on chromosomal short arm and 5'-terminus of this base sequence : 38614327
  Distance between 3'-terminus of neighbour sequence of sequence listing upward to telomere on chrosomal short arm and 5'-terminus of this base sequence : 101796
gagttgtctgtgaggactcactttgactccattctgtccttcttcttcttcttatactaacccccttgatcttcctttccctagaagaggggcatgccaagcgtcttccttttgcatgcacacacacacacacacacacacacacacacacacagagcatgttaccaacagctttttatttaactttctccctgcccagagcttctcttcactgactgtctgggacaagccagcgccgtggagctgtctctttttcatttctcagcctcactggccattccaggtatctgctgatggggctcttggcccttatagccaagctgcccaagacttgacttgctctttttaccaaaaaaaaaaaaaaaaactatttccactaaaccactgagcatttcata

SEQ ID NO: 13694 - DNA, 226 bp, Homo sapiens
  chr8.fa.O7frz.41790072
  Located on chromosome 8
  Distance between a terminus base of telomere on chromosomal short arm and 5'-terminus of this base sequence : 38766484
  Distance between 3'-terminus of neighbour sequence of sequence listing upward to telomere on chrosomal short arm and 5'-terminus of this base sequence : 151759
aaatgatcttagacagaatccttcttggcaacccttgcccctcaccataatcttccccttcctgccccttccccagtgccattcttcccccaacacacacacacacacacacacacacacacacacgttccctctcactctcacctcccttccctcccccaccccttcccctccatttgtttcaatgaacagccccttttatctattctgtaggtacaaatgaagc

SEQ ID NO: 13695 - DNA, 287 bp, Homo sapiens
  AB022785.1_15879
  Located on chromosome 8
  Distance between a terminus base of telomere on chromosomal short arm and 5'-terminus of this base sequence : 38849036
  Distance between 3'-terminus of neighbour sequence of sequence listing upward to telomere on chrosomal short arm and 5'-terminus of this base sequence : 82326
cctacatgatcgaggtatgtaaagtattggagatcatatggatgcagggttactttgaactgccatcattagccttgtcagtctagaattaggtgtacatctcagtctgttgccactgcctcacccccatctctgtctagattcatccagaatgtgcaagaaattctgttccttcctataagctccagccgttttatttatttatatatatatatatatatatatatatatatggttttttaaaactttctattttgaactaattttaaacttgcagtaaagttgcc

SEQ ID NO: 13696 - DNA, 352 bp, Homo sapiens
  AP000065.1_16445
  Located on chromosome 8
  Distance between a terminus base of telomere on chromosomal short arm and 5'-terminus of this base sequence : 38886376
  Distance between 3'-terminus of neighbour sequence of sequence listing upward to telomere on chrosomal short arm and 5'-terminus of this base sequence : 37053
atattcaatgtaaggactgatcactactaattatcctactcctggccgctcagtggtcgcaactgtcttcaccttttggggtcgtactggtctctgaagcatattggtaagccagcctgaacttacttcatgctttcatccatccatccatccatccatccatccatccatccatccatccatccttcaacaaatacatactgagacttaatgcacattaggcatcattctagatgctggggatacaagagtgaacaagacagatagaaatccatccttaagggtttacattctagtgagggaggggagcagacagtaaacaggtaaaatatatgtcagatggcaatacttg

SEQ ID NO: 13697 - DNA, 90 bp, Homo sapiens
  D8S536
  Located on chromosome 8
  Distance between a terminus base of telomere on chromosomal short arm and 5'-terminus of this base sequence : 38988771
  Distance between 3'-terminus of neighbour sequence of sequence listing upward to telomere on chrosomal short arm and 5'-terminus of this base sequence : 102043
agcaagaccccaccactacaaaaaaaagtacacgcgcacacacacacacacacacacacacacaaatacaaatgcaaactgtattatgct

SEQ ID NO: 13698 - DNA, 381 bp, Homo sapiens
  AC011237.4_133993
  Located on chromosome 8
  Distance between a terminus base of telomere on chromosomal short arm and 5'-terminus of this base sequence : 39223882
  Distance between 3'-terminus of neighbour sequence of sequence listing upward to telomere on chrosomal short arm and 5'-terminus of this base sequence : 235021
attaaatcaactttccaaggacagccagaaactccaggccctccccaatccctcaggagcacttgcagactgaggggcgttggtactgcgctcagtggggaggggctcccgacagacacacagacacacagacacacacacacacacacacacacacacacacacacacacacacacacacacacacttaaaatcacagcaaggccttttaaatggggaaaactcagtgtgaacagggttttaggtggtttgctctcaccttttggacaaagcccttaatacatagattataatgtgtttcttcttttttttaaagacagggtctccttctgacacccaggctggagtgcagtggcttgattatagctcactgtagcctca

SEQ ID NO: 13699 - DNA, 144 bp, Homo sapiens
  D8S1821
  Located on chromosome 8
  Distance between a terminus base of telomere on chromosomal short arm and 5'-terminus of this base sequence : 39287225
  Distance between 3'-terminus of neighbour sequence of sequence listing upward to telomere on chrosomal short arm and 5'-terminus of this base sequence : 62962
gcatgtacatatttatgtgtagatatcatgtgtgtgtgtgtgtgcgtgtgtgtgtgtgtgtgtgtgttctaccccccttcctttttcgacaaatagtagcatttctgcaggccccttttaaacaacactaacctcagataacca

SEQ ID NO: 13700 - DNA, 439 bp, Homo sapiens
  AC016813.3_111110
  Located on chromosome 8
  Distance between a terminus base of telomere on chromosomal short arm and 5'-terminus of this base sequence : 39534757
  Distance between 3'-terminus of neighbour sequence of sequence listing upward to telomere on chrosomal short arm and 5'-terminus of this base sequence : 247388
atactgtattgtttccgtccttccttccttccttccctctttctttctctctctttctttccttctctttctttttctttcttttccttccttccttcttctttctctttctttctttttctttctttccctccctcccttctttcttttctttctttcttcctttctttctttctctccttctttctttttctttcatctttctttcccttcctccctccctcccttcttctcctttctttcttttttccttttttctttctttctttctctccttctttctttctttctttctttttctttcatctttctttctttctttcccttcctccctccctcccttccttcctctctctctctctctctctctctttccttcttttttttttcctgtctcactctgtcacccaggctggagtacagtgatgcaatcatagct

SEQ ID NO: 13701 - DNA, 288 bp, Homo sapiens
  G10158
  Located on chromosome 8
  Distance between a terminus base of telomere on chromosomal short arm and 5'-terminus of this base sequence : 39622061
  Distance between 3'-terminus of neighbour sequence of sequence listing upward to telomere on chrosomal short arm and 5'-terminus of this base sequence : 86865
cttttgcactcaacaactgcttctttaatatgtttacatcacagagtagagaactaaagtgaactttcttataaagtcaataaacatatagtcatgaatatttgatgggaatgagagaatctcacagaactggctcttcaatgacactagtgtagtgtaaatatctatctatctatctatctatctatctatctatctatctatatatatatatatatatatatatatgtccccccagcttctctgaaagctgacacagtgtaactcttctgtgtggcagttctgcta

SEQ ID NO: 13702 - DNA, 441 bp, Homo sapiens
  AC067817.2_92863
  Located on chromosome 8
  Distance between a terminus base of telomere on chromosomal short arm and 5'-terminus of this base sequence : 39710311
  Distance between 3'-terminus of neighbour sequence of sequence listing upward to telomere on chrosomal short arm and 5'-terminus of this base sequence : 87962
ataaatgtactgttcctgaatgaggcactgtcctcctccctactcccacccaatcacccttgtgactctttcagagcagagcagagcagccccgagccaaggattagtgtgatcacaaggtcaacaatagataccctgtccataaatactcctggagagctttagtcattgactaggagccaggagtgggggaataagaagaggggaagggagagagctggaagcctgtagggctagcttgaaacatctacagttgtttgtttgtttgtttgtttgtttgtttgtttaaaaaagcccaactttcctcctgaatgtgaaagtctctggatggcgtggagaagggaggggacacgggcttcaggagggggatactgggagggatggatgaaccccagagaaggactcttgtttttagggtggttagctttatcctcagagcac

SEQ ID NO: 13703 - DNA, 402 bp, Homo sapiens
  AF302687.1_4812
  Located on chromosome 8
  Distance between a terminus base of telomere on chromosomal short arm and 5'-terminus of this base sequence : 39945923
  Distance between 3'-terminus of neighbour sequence of sequence listing upward to telomere on chrosomal short arm and 5'-terminus of this base sequence : 235171
ctggaacaatgtaagtcttgactttgtcttggtttggtttggtttgacattggtttgtttttcatctttgtctcatgcttaaaatgtgaagggcaaatatgatccttagagttaaggttttaggttttgtagatgttttactccatttaaatgacagcagatcatttagaaatgattcctctgtaacagccttccagatcccattcgattgtacagcattgagatagatagatagatagatagatagatagatagatagatagatagacggaatttggccctgtgttcccacccatatctcatgtcaaattgtaacccccacatgtcaggagagggatccagtgggaggtgacaggatcatggggttggatttccccaatgctattctcatgatagtgagtt

SEQ ID NO: 13704 - DNA, 123 bp, Homo sapiens
  D8S255
  Located on chromosome 8
  Distance between a terminus base of telomere on chromosomal short arm and 5'-terminus of this base sequence : 39987369
  Distance between 3'-terminus of neighbour sequence of sequence listing upward to telomere on chrosomal short arm and 5'-terminus of this base sequence : 41044
tgaaacccacagatattggggggtccaactctgtgtgtgtgtgtgtgtgtgtgtgtgtgtatgcatgtgtgtgtagatagagagagagagtgagagagagaatggaggctagaaattccaaaa

SEQ ID NO: 13705 - DNA, 332 bp, Homo sapiens
  AF165142.1_37831
  Located on chromosome 8
  Distance between a terminus base of telomere on chromosomal short arm and 5'-terminus of this base sequence : 40302240
  Distance between 3'-terminus of neighbour sequence of sequence listing upward to telomere on chrosomal short arm and 5'-terminus of this base sequence : 314748
tagtttagacattttccttgtcactgagaattttgaggttggtttaaaacaaacaaacaaacaaacaaacaaacaaaaactaggggagcaggagtgacggtagctggaactccattggaagaaagttgggtgagagaagagcccagtagaagacttgcttttcatccgtgactggggacttgggctgtattcaggtggacctcattttaactgcgggatgctggagagtcaggtcacctcttcaggccataactttttcagtgacagaacgaggagctcaggccaagccatcactaagatcttttcagctcttgtgagataaaccagataaa

SEQ ID NO: 13706 - DNA, 398 bp, Homo sapiens
  AF165142.1_60716
  Located on chromosome 8
  Distance between a terminus base of telomere on chromosomal short arm and 5'-terminus of this base sequence : 40325006
  Distance between 3'-terminus of neighbour sequence of sequence listing upward to telomere on chrosomal short arm and 5'-terminus of this base sequence : 22434
tgtcagaggattcaattacttaagcaaagctagaggctggctgcagtggctcacacctgtaatcccagcactttgggaggccaaggcaggtgggtcccttgagcccaggagttcaagatcagccttggtgtcagagcaagaccccctctcgaaagaagaaagaaggaaggaaagaaagaaagaaagagagaaagaaagaaagaaagaaagaaagaaagaaagaaagaaagaaagaaagaaagagggaaggaaggaaggaaggaaagaaagaaagagagaaagagagagagagaaagaaagagagagagacgaactagaaattttattttcactgtaatttcaaatattaagtaatttaaaaacctttaacactgtacttacaccaaacaagacatagc

SEQ ID NO: 13707 - DNA, 168 bp, Homo sapiens
  D8S1817
  Located on chromosome 8
  Distance between a terminus base of telomere on chromosomal short arm and 5'-terminus of this base sequence : 40555736
  Distance between 3'-terminus of neighbour sequence of sequence listing upward to telomere on chrosomal short arm and 5'-terminus of this base sequence : 230332
actgagggccaagtccctactatggtctcatcagtgcaaagtagagaaggacagtcacagatcttgtgcactattacttctatcaatacttttaaagctttcagtataagtgtgtgtgtgtgtgtgtgtgagtcttgagacacgaatcaacagtcatattgaacctgc

SEQ ID NO: 13708 - DNA, 443 bp, Homo sapiens
  chr8.fa.O7frz.45120511
  Located on chromosome 8
  Distance between a terminus base of telomere on chromosomal short arm and 5'-terminus of this base sequence : 40623698
  Distance between 3'-terminus of neighbour sequence of sequence listing upward to telomere on chrosomal short arm and 5'-terminus of this base sequence : 67794
ccattggtacattgtttagttatcaaggacaggtttaggcagcgttagacacatacacacacacacacacacacacacacacacacacacacacacacaaacacaaaactctgattttcccctttcttgaatttttggctttactttccagtgctatggttccccagagctctctcctttggtcttcaagccagtaagactgtgggtttttacctatattccagccagccagcttgctgctgactggatcagccctgaggaaaatagccacaaaaactggaaaactcactcaatgttctttccttattccaaatgttcacctccctccagtttctgcctggttttgattgctccccattgtcttcaagtagatgatttttatattttctccagagtttacaaatattatcagtagaagggttggtctgattactctagcatta

SEQ ID NO: 13709 - DNA, 458 bp, Homo sapiens
  AC048387.2_60469
  Located on chromosome 8
  Distance between a terminus base of telomere on chromosomal short arm and 5'-terminus of this base sequence : 40729865
  Distance between 3'-terminus of neighbour sequence of sequence listing upward to telomere on chrosomal short arm and 5'-terminus of this base sequence : 105724
attgctatggtacatttgtcacagctaatgaaccagtattaatacattattactattatatagcatatatatatttttattttttaatttaatttaatttaatttaatttaatttaatttaatttaatttaatttttgagatggagttttgctcttgtcgcccaggctggagtgcagtggcacaatctcggctcactgcaaccttcacctcccaggttccaagtgattctcctgcctcagcctcctgagtagccaggattacaggcacctgccaccacgcccagctaattttttgtatttttaatagagacagggtttcactatgttggccaggctggtctcaaactcctgacctcaggtgatccgcccgcctcggcctcccaaagtgctgggattacaggcatgagccaccgcacctgacctatatcctatattttaaagtgtcaagtccaatcttt

SEQ ID NO: 13710 - DNA, 245 bp, Homo sapiens
  D8S532
  Located on chromosome 8
  Distance between a terminus base of telomere on chromosomal short arm and 5'-terminus of this base sequence : 40780576
  Distance between 3'-terminus of neighbour sequence of sequence listing upward to telomere on chrosomal short arm and 5'-terminus of this base sequence : 50253
gctcaaagcctccaatgactgtccatttcccttaaagtaattatgcaaggcccacatgacctgacttgcctgtacacacacacacacacacacacacacacacacacacacacacaatctctctaccctcttctctactttctcctcattccctctactctagacacacagagtgtcctagtccattctggttgctataacagaataccatgtttgggacgctgacgcacgtggatcacgaagtc

SEQ ID NO: 13711 - DNA, 401 bp, Homo sapiens
  AC048387.2_186046
  Located on chromosome 8
  Distance between a terminus base of telomere on chromosomal short arm and 5'-terminus of this base sequence : 40804623
  Distance between 3'-terminus of neighbour sequence of sequence listing upward to telomere on chrosomal short arm and 5'-terminus of this base sequence : 23802
attcaagctgaattacatgactagctttcctggttctccagcttgcaaatgtcagaatgcaggccttcccttggcctccattatcatgtgagctgattcctgaaataaatctcatatatgtatatatactctttctctctcctctctctctcctctctctctgcatgctctctctcattctgtgtgtgtgtgtgtgtgtgtgtgtgtgtgtgtgtgtgtgttctgtttttctggagatccctggctaatacaccttgcattagcaataaactttccagcattccaaagtgatcccacattcatcatattttaaactcacctggggtagtaaaagtgtctttcttacatctggcagatgaagaaactgaggcctcaagaaattaagtgacttgcataatgtc

SEQ ID NO: 13712 - DNA, 321 bp, Homo sapiens
  HUMUT5171B
  Located on chromosome 8
  Distance between a terminus base of telomere on chromosomal short arm and 5'-terminus of this base sequence : 40841517
  Distance between 3'-terminus of neighbour sequence of sequence listing upward to telomere on chrosomal short arm and 5'-terminus of this base sequence : 36493
gggcaacagagcaagactctgtcaaaagaaagaaagagagagagaaagaaaggaagaaaaagaagaaagagagaaagaaagaaagaaagaaagaaagaaagaaagaaagaaagaaagaaagaaagaaagaaagaaagaggaaggaaggaaggggagagagagagacagaaagaaagaaagaaagaaagaaagaaagaaagaaagaaagaaagaaagaaagaaagaaagaaagaaagaaaagaaaagaaaagagagagagaaagaaagaataatatcagttccttgtcaaagcagcaatacttaggagcaactgtatgggga

SEQ ID NO: 13713 - DNA, 478 bp, Homo sapiens
  AC020736.3_115483
  Located on chromosome 8
  Distance between a terminus base of telomere on chromosomal short arm and 5'-terminus of this base sequence : 40974107
  Distance between 3'-terminus of neighbour sequence of sequence listing upward to telomere on chrosomal short arm and 5'-terminus of this base sequence : 132269
ctggctaacatggtgaaacccccgtctctactaaaaatacaaaaattagctggtggtgggtacctgtaatcccagctacttgggaggctgaggcagaagaatcacttgaacctgggaggcagaggttgcagtgagccgagactgcaccattgaactccagcctgggcgacaagagcaagactccatttcaaataaataaataaataaataaataaataaataaagattgcttttcaggatgaagaataaatagagaggacaatatgaacacgggaaggttaatgaacaggcaatgacagtcatccaggtgagggagggtggtctgacttgatttgtgggcagtggagttaaggtgaatgggtttgagaggtgcaggaggtagaagggagaagattccagatggatcagatgtagtgggctgagagcaggaaggagcgaggcgtcagggatgactctcaatgttatccttagtgatgac

SEQ ID NO: 13714 - DNA, 325 bp, Homo sapiens
  chr8.fa.O7frz.45876217
  Located on chromosome 8
  Distance between a terminus base of telomere on chromosomal short arm and 5'-terminus of this base sequence : 41022238
  Distance between 3'-terminus of neighbour sequence of sequence listing upward to telomere on chrosomal short arm and 5'-terminus of this base sequence : 47653
gtgtctcatctgtcaaatgaagggcttggactggctcagtggttcccaaacacagtgggatatcagaatggggaggggagatgccctctctctctctctgtgtctcacacacacacacacacacacacacactctctctctctctctctctctgtctctctctctctcacacacacacatgcactctctctgtgtctctctctaacacacacacacacgtactgtctctctctctctgtctctctctctctcacacacacacccttctgtaagatcccttctcactgattctgtttttgctctctagcagatgacagatttctag

SEQ ID NO: 13715 - DNA, 255 bp, Homo sapiens
  D8S268
  Located on chromosome 8
  Distance between a terminus base of telomere on chromosomal short arm and 5'-terminus of this base sequence : 41219242
  Distance between 3'-terminus of neighbour sequence of sequence listing upward to telomere on chrosomal short arm and 5'-terminus of this base sequence : 196679
acctacaagcaacaacaccatggtagcaatgagcacacctagcacccagatttggtttctaatgccattctccaatagagggaaccagggttccttgggaaaacggtggattctaggactaaggcaggaaatctacaggttgatcctggaacatctttttcatgccggaaaataaagaagtgctcaggaaaacacacacacacacacacacacacacaattaatgagagtatgtcaaagagccatggaagtcaac

SEQ ID NO: 13716 - DNA, 299 bp, Homo sapiens
  chr8.fa.O7frz.46089500
  Located on chromosome 8
  Distance between a terminus base of telomere on chromosomal short arm and 5'-terminus of this base sequence : 41302873
  Distance between 3'-terminus of neighbour sequence of sequence listing upward to telomere on chrosomal short arm and 5'-terminus of this base sequence : 83376
aggttctaatttcagatttaccaccctctgtatgatttggggcaaatgaatataaccctctgagcctctttccccataagcctgcaaggtaagatcagtgaccccttaagtctttgcaatgacctttttattcttattctttaaaaggacaaaatatgagatcttaaaaaaaaaaaaatatatatatatatatatatatatatatatatatatatatatatatacgccttctctggctgagagaaggaaaaggagaacgaggaggatagcagcaagtaataaactttgctctatgcaag

SEQ ID NO: 13717 - DNA, 390 bp, Homo sapiens
  chr8.fa.O7frz.46536687
  Located on chromosome 8
  Distance between a terminus base of telomere on chromosomal short arm and 5'-terminus of this base sequence : 41493549
  Distance between 3'-terminus of neighbour sequence of sequence listing upward to telomere on chrosomal short arm and 5'-terminus of this base sequence : 190377
tcagaagttctagactgtagcaagccatgattgtaacaatgtgcccctacctgggtgacagagcaagaatcagagagagagagagagagagaaagagacaaagagagagagacagagagagagagagagacaaaaagagggacagagagagagaaagaaagaaagaaagagagagagagaaagagctctatgagagagagagaaagaaagagagaaagagctctatgagagagagaaacacacacacacacacgacacacacacacacacacagagagaaagaaagaaacagctctatgggatccttaatattttttactgtaaaagggtcccgagataaaaaagtttgagttccattcaacactattctctaagtttaccggaatgagt

SEQ ID NO: 13718 - DNA, 435 bp, Homo sapiens
  chr8.fa.O7frz.46429060
  Located on chromosome 8
  Distance between a terminus base of telomere on chromosomal short arm and 5'-terminus of this base sequence : 41595245
  Distance between 3'-terminus of neighbour sequence of sequence listing upward to telomere on chrosomal short arm and 5'-terminus of this base sequence : 101306
tggtgatacgtattagctgtagtcccagctaattgggaggctgaagtgggaggatagcctgagtccgggaggtcaaggctgcagtgagctgtgattgcgccactgcagttcagtgtccattttccagttgcccacttgacatccagcctggaagacagagcaagaccttgtctcttaaaaaaaaaaaaaaaatatatatatatatatatatatatatatatatatatatatatacacacacacacacacacacacatatacatatatatatatgcacacacacacatacataccacatatataaatacttgttgaaacccattctaaaatatgtgaaactgttttcagtatggtacaactgaacataattaaatgtcctgggtggttcctgatctttcagggctcaaggttatctttagtgacatcagcaatcat

SEQ ID NO: 13719 - DNA, 348 bp, Homo sapiens
  AC009630.5_183533
  Located on chromosome 8
  Distance between a terminus base of telomere on chromosomal short arm and 5'-terminus of this base sequence : 41695217
  Distance between 3'-terminus of neighbour sequence of sequence listing upward to telomere on chrosomal short arm and 5'-terminus of this base sequence : 99537
tcttattgctatattacaagccaccccaaaactacgtgaatacaccattcattcattcattcattcattcattcattcattctgtgcagctgaggactggaatcctcagaagactcatccctccagtgtggggtggctggtgctggccttcagggcctcactgagctgggagctgggctgcctacacctggttggcttccttacaacatggtagctggggtccaggggcaagcggcctgagagacgggccagatagaagccctactgcattttctaacctaatctcacatatcacagcatcctgcccccccacatcctctgtgtcaggaacagtcactgaggtccata

SEQ ID NO: 13720 - DNA, 462 bp, Homo sapiens
  AC023045.2_166874
  Located on chromosome 8
  Distance between a terminus base of telomere on chromosomal short arm and 5'-terminus of this base sequence : 41828916
  Distance between 3'-terminus of neighbour sequence of sequence listing upward to telomere on chrosomal short arm and 5'-terminus of this base sequence : 133351
aatctcctacaagcctacactaacaagagagtgtggtcccagcataaagacagacatatagactgatggaacagaagaaagagatcagaaataaaccctcatgtgaagacgggcaactgattctcaacaaggatgccaaggtcattcagcagggaaaggacagtcttttcaacaaataatgctgagaaaactggatatccacatgcagaatgaagccacatcttgtttcacaccacacacacacacacacacacgcacacgcgaaactcaaaatggatcacaaaacaaaatgtgaaagcgaactctacaaagcccttattggggaaaagtttcatgacactgaatttggcagtgatttcccagacatgacaccaaaagctcacacaacaaaagagaaaatagacaaattgaacttcatcaagattaaaaacgttttgtgcatcaaaggacactatcaacaga

SEQ ID NO: 13721 - DNA, 405 bp, Homo sapiens
  AC023045.2_49651
  Located on chromosome 8
  Distance between a terminus base of telomere on chromosomal short arm and 5'-terminus of this base sequence : 41852947
  Distance between 3'-terminus of neighbour sequence of sequence listing upward to telomere on chrosomal short arm and 5'-terminus of this base sequence : 23569
tttaaatgaaaggatttctatcacttatttaaaaggaatatctcacagagatctgtttaatagtaaatcttgatgatgatgatgatgatgatgatgatgtgtgacctctgctctgtgattctctattgctgttagtagcgctcttgatcctcagttctgtggttttcgtgccaagtattaattgagtacttgcttatgtgccgttacttactgtaacagtaaaatttcagattgtcaggatcccctcagtctctcacttttcttggtcctccctaagactcttttaagtgatcagtagaggagttctttaccttgggagaagctggggtaggtgtggtatatactgtttgaagagaatattaaactacctgggttgttgaggagttctgttagtatcgcagacag

SEQ ID NO: 13722 - DNA, 102 bp, Homo sapiens
  DISO7_10002493
  Located on chromosome 8
  Distance between a terminus base of telomere on chromosomal short arm and 5'-terminus of this base sequence : 41852978
  Distance between 3'-terminus of neighbour sequence of sequence listing upward to telomere on chrosomal short arm and 5'-terminus of this base sequence : -374
aaaggaatatctcacagagatctgtttaatagtaaatcttgatgatgatgatgatgatgatgatgatgtgtgacctctgctctgtgattctctattgctgtt

SEQ ID NO: 13723 - DNA, 162 bp, Homo sapiens
  DISO7_10002492
  Located on chromosome 8
  Distance between a terminus base of telomere on chromosomal short arm and 5'-terminus of this base sequence : 41855332
  Distance between 3'-terminus of neighbour sequence of sequence listing upward to telomere on chrosomal short arm and 5'-terminus of this base sequence : 2252
atggcaggtttctcatcgatttcagtaaggattatattaatttctcattggtcttttccagtggaccttctctgtgtgtgtgtgtatgtgtgtgtgtgtgtgtgtgtgtgtgtgtgtgtgtgtatatatatatttaaagatttgtaggtgctttgttggctg

SEQ ID NO: 13724 - DNA, 136 bp, Homo sapiens
  DISO7_10002491
  Located on chromosome 8
  Distance between a terminus base of telomere on chromosomal short arm and 5'-terminus of this base sequence : 41871294
  Distance between 3'-terminus of neighbour sequence of sequence listing upward to telomere on chrosomal short arm and 5'-terminus of this base sequence : 15800
ttacttgctccagggataggtaaaaaaaaaaaaaaaaaaaaaaaaatatatatatatatatatatatacacacacacacacacacacacacacatatatatatatatatattccatcattagaagatggaaactat

SEQ ID NO: 13725 - DNA, 211 bp, Homo sapiens
  DISO7_10002494
  Located on chromosome 8
  Distance between a terminus base of telomere on chromosomal short arm and 5'-terminus of this base sequence : 42121329
  Distance between 3'-terminus of neighbour sequence of sequence listing upward to telomere on chrosomal short arm and 5'-terminus of this base sequence : 249899
aaccctctgtatgccgtcgccgccaccaccattctcattctctctgtttctctctcattctctctctcattctctctcctctctctctctctctcattctctctctctctctctctctctctcattctctctctctctctctctctctctctctccctctcggcaagccggggaggggaagacccctgaggcccaggcagcgatcctatct

SEQ ID NO: 13726 - DNA, 359 bp, Homo sapiens
  AF271407.2_71230
  Located on chromosome 8
  Distance between a terminus base of telomere on chromosomal short arm and 5'-terminus of this base sequence : 42244244
  Distance between 3'-terminus of neighbour sequence of sequence listing upward to telomere on chrosomal short arm and 5'-terminus of this base sequence : 122704
ctataaacctcgtcctagtcaagcagctcacaaaaccatatggtgggtctcacatcaaaccaggtaaaagagtgaggatgatttagactcaaagaaaattagagctagaaataaatttaaagctcatccaccctgctccaaccctaagtcaagccacatggtcttccgatagtggctcagttttctacttacataaaaagacagcacattctcttagcaatatgtgtttgtatgtgtgtgtgtgtgtgtgtgtgtgtgtgtatatatatatatatatatatataatttagagacaaggtctgactccatcacccaggctggagtgcagcagtgtgatcgtaggtcactgaaccttcaaa

SEQ ID NO: 13727 - DNA, 330 bp, Homo sapiens
  chr8.fa.O7frz.47463529
  Located on chromosome 8
  Distance between a terminus base of telomere on chromosomal short arm and 5'-terminus of this base sequence : 42586098
  Distance between 3'-terminus of neighbour sequence of sequence listing upward to telomere on chrosomal short arm and 5'-terminus of this base sequence : 341495
atgcaacatgatagaatgctactagaatttccataaaggaaaatagaaactatcctgcaaatacatagctggatgcacaggcaattgtaaattccctgaaggtacagaaacatcatcctattaattgttttgtccttagagctttttgcactgtgtctttcctgaacacagtagaaaatcagaatggatggatggataaatggatggatggatggatggatggatggatggatggatggatggatggataaatggatggataaatgaatggatggatgggtggataaatggatggattggatgaatgtatggataaatggaaggatagat

SEQ ID NO: 13728 - DNA, 139 bp, Homo sapiens
  D8S1115
  Located on chromosome 8
  Distance between a terminus base of telomere on chromosomal short arm and 5'-terminus of this base sequence : 42593164
  Distance between 3'-terminus of neighbour sequence of sequence listing upward to telomere on chrosomal short arm and 5'-terminus of this base sequence : 6736
ggcctaggaaggctactgtcaaaataataataataataataataataatgtgttggtgaggatgtggagaaactggaactcttgtgggcctctggtggatatgtgaaatggtgcggccgctgtggaaaacattatggtg

SEQ ID NO: 13729 - DNA, 286 bp, Homo sapiens
  chr8.fa.O7frz.47815947
  Located on chromosome 8
  Distance between a terminus base of telomere on chromosomal short arm and 5'-terminus of this base sequence : 42673884
  Distance between 3'-terminus of neighbour sequence of sequence listing upward to telomere on chrosomal short arm and 5'-terminus of this base sequence : 80581
actcaggcaaacttaaagaaacagccctgtgaggaaagcgctattatcattcttgttttacagatgaaggttctcttcatctgcaaaattccatgaggtgggagtggggaaggattcaccctactttactcgggcacccccagtcattgtggcagccaaaacacccctttatacatttccaaacaccaatgggaaattgtatgagagtgtgtgtgcgtgtgtgtgtgtgtgtgtgtgtgtgtgtagaatgggtgcgatggcatctccagttgagaataactggtat

SEQ ID NO: 13730 - DNA, 288 bp, Homo sapiens
  AC009634.3_7080
  Located on chromosome 8
  Distance between a terminus base of telomere on chromosomal short arm and 5'-terminus of this base sequence : 42812993
  Distance between 3'-terminus of neighbour sequence of sequence listing upward to telomere on chrosomal short arm and 5'-terminus of this base sequence : 138823
tttacaaactgaaggttgtgacaactttgtgttgagcaagactattggcaccatttttccaacagcatgcacttgcttcatgtttctgtgtcgtcttttggttatacttgcaatcaatcaatcaatcaatcaatcaatcaatcaacgttgtgtatgctgtgactgctctattgaccagccattccccagtctctctccctctcctcagaccttcctattccctgaggcattgacaatattgaaattaggccaactaataaataactctatagtggcctctaggtgttc

SEQ ID NO: 13731 - DNA, 114 bp, Homo sapiens
  DISO7_10002495
  Located on chromosome 8
  Distance between a terminus base of telomere on chromosomal short arm and 5'-terminus of this base sequence : 42897278
  Distance between 3'-terminus of neighbour sequence of sequence listing upward to telomere on chrosomal short arm and 5'-terminus of this base sequence : 83997
tctttgcaacataaggattagggcgtgtgtgtgtgtgtgtgtgtgtgtgtgtgtgtgtgtgtgtgttatcattaaacattagccagtaattttcgctaatactgatgttgtcca

SEQ ID NO: 13732 - DNA, 201 bp, Homo sapiens
  DISO7_10002496
  Located on chromosome 8
  Distance between a terminus base of telomere on chromosomal short arm and 5'-terminus of this base sequence : 42906311
  Distance between 3'-terminus of neighbour sequence of sequence listing upward to telomere on chrosomal short arm and 5'-terminus of this base sequence : 8919
aagcacatcttcgggaagggccagatgacatgaaaagttacaggcagggatttttaaaagacagatgcatttatagacttatagaaatctatatacgtgtgtgtgtgtgtatgtgtgtgtttatagagatagacttatttaaaggggtgagctgatttaaaaggacaggcgagatttaaaggaacaatcttccagacatct

SEQ ID NO: 13733 - DNA, 360 bp, Homo sapiens
  HUMUT629
  Located on chromosome 8
  Distance between a terminus base of telomere on chromosomal short arm and 5'-terminus of this base sequence : 43237747
  Distance between 3'-terminus of neighbour sequence of sequence listing upward to telomere on chrosomal short arm and 5'-terminus of this base sequence : 331235
cataacctagcatagctcccacttataaatgagaacatgtggtatttgtcgttccattcctgagttacttcacttagaataatggcctctagctccatccaatttgctggaaaaaacattatttcattcttctttatggctgagtagtattctgtggtgtgtgtgtgtgtgtgtgtgtatatatacgtatctatacatgtatgtatatgtagatgtatgtatataagtatatatatacacacatagatatatggactcacacacatatatgtgtatatatatcacattttctttatgccattcatcagtcaatggacactggttgattccatatattttcatgttgtaattgtgctgcag

SEQ ID NO: 13734 - DNA, 474 bp, Homo sapiens
  AC069389.3_129415
  Located on chromosome 8
  Distance between a terminus base of telomere on chromosomal short arm and 5'-terminus of this base sequence : 46459263
  Distance between 3'-terminus of neighbour sequence of sequence listing upward to telomere on chrosomal short arm and 5'-terminus of this base sequence : 3221156
acatttgacctataagtggcttttgttgacccagaattgacctctagaaacccaggttaaaagataaaaataaaaccctagtgctcatacagatgggccctgagctcaccagggccctatgtacttcctgtagctctctgacatgaatggaccactcaaaggagaggacttgcatcttctctatctatctctctctctctctctctctctcagaaagatcaaatgctacacactgcagagggaacagacctcttagaattggttcagccaaatctccaggcaaatgagcaagcaatgaagcaaaaacaatgccacacccttgggggatgtagactccatattcagagttgttatactatattatctaaaatgtccaattttgaacagcaaaacatgagagacatgtcaagaaaaaagaaagtgtgacttatacacatgaaaataagcaagtgatagaaattgcctttaaaggac

SEQ ID NO: 13735 - DNA, 284 bp, Homo sapiens
  DISO7_10002498
  Located on chromosome 8
  Distance between a terminus base of telomere on chromosomal short arm and 5'-terminus of this base sequence : 46633084
  Distance between 3'-terminus of neighbour sequence of sequence listing upward to telomere on chrosomal short arm and 5'-terminus of this base sequence : 173347
tggtattgtaaatctcacctatggaattttctgacagaaagaaagaaagagaaagagaaagaaagaaagaaagaaagagaaagaaagaaagaaagaaagaaagaaagagaaaagaaagagaaaaagaaagaaagaaaggagaaagaaggaatgaaagaaaaaagaaagaaagaaaaagaaagaaagaaagaaagaaagaaagaaagaaagaaagaaagaaagaaagaaaaaaaaaagaaaattatgtcttctatctagttctgtcatgtaagtgatatgagtcc

SEQ ID NO: 13736 - DNA, 114 bp, Homo sapiens
  DISO7_10002500
  Located on chromosome 8
  Distance between a terminus base of telomere on chromosomal short arm and 5'-terminus of this base sequence : 46649872
  Distance between 3'-terminus of neighbour sequence of sequence listing upward to telomere on chrosomal short arm and 5'-terminus of this base sequence : 16504
gaagaccagtgatttagcctgcacacacacacacacacacacacacacacacacacacacacacacaaaagaaaacactggttaggctggggcaggggttggaggaagagatct

SEQ ID NO: 13737 - DNA, 193 bp, Homo sapiens
  DISO7_10002499
  Located on chromosome 8
  Distance between a terminus base of telomere on chromosomal short arm and 5'-terminus of this base sequence : 46685313
  Distance between 3'-terminus of neighbour sequence of sequence listing upward to telomere on chrosomal short arm and 5'-terminus of this base sequence : 35327
gaactccgggttcaagtgattttgcttgaatccgggaggtggaggttgcagtgagctgagactgtaccactgcactccagcctgggaaacaagagcaaaactccatctaaataaataaataaataaacaagtaaataaaatttaaacaatattttttaaaaaaagtaaaggtgagataaactattcactccag

SEQ ID NO: 13738 - DNA, 295 bp, Homo sapiens
  DISO7_10002501
  Located on chromosome 8
  Distance between a terminus base of telomere on chromosomal short arm and 5'-terminus of this base sequence : 46720875
  Distance between 3'-terminus of neighbour sequence of sequence listing upward to telomere on chrosomal short arm and 5'-terminus of this base sequence : 35369
tgcttgctaattcctcagttcagttttttactggacattagttttttctcattgctatgtggggattttttgtatgtttaagttattaacccctgcaattatgtttctagtttcatatttgtatcttattttgcattttttgtcatacagaatttaacattttataagtatttttattttattttatcttattttatttatcttagtttttggcatgtatgttttctttaaagtttctaattttagattagaaaatcatttaggcatcatttagaaagaggtagaagcaaggatg

SEQ ID NO: 13739 - DNA, 225 bp, Homo sapiens
  chr8.fa.O7frz.52631034
  Located on chromosome 8
  Distance between a terminus base of telomere on chromosomal short arm and 5'-terminus of this base sequence : 46793580
  Distance between 3'-terminus of neighbour sequence of sequence listing upward to telomere on chrosomal short arm and 5'-terminus of this base sequence : 72410
tagagctacctgcattcataacagaataagaggtcatgtcagtttataaaatcaaagatttcctttttatttatttatttatttatttatttatttatttatttatttttattattatactttaagttttagggtacatgtgcacattgtgcaggttagttacatatgtatacatgtgccatgctggtgcactgcacccactatctcgtcatctagcattaggta

SEQ ID NO: 13740 - DNA, 288 bp, Homo sapiens
  M8_46803696
  Located on chromosome 8
  Distance between a terminus base of telomere on chromosomal short arm and 5'-terminus of this base sequence : 46803665
  Distance between 3'-terminus of neighbour sequence of sequence listing upward to telomere on chrosomal short arm and 5'-terminus of this base sequence : 9860
ctggatgacagagtgagaccttgtgaaaaaaaaagaaagaagaaagaaagaaagaaagagagagagagagagagaaagaaagaaagaaagaaagaaagaaagaaagaaagaaagaaagaaagaaaagaaaaggcgtaagtcaggtgcagtggcacacacctatagtcccagatacttgggaggctgtagtgggaggtctgagctcaggagttcaagtccagcctggcaacatagcaagaccccatcttgaaaaattcaaaaaagaggtttttcatgtgtttatttgtt

SEQ ID NO: 13741 - DNA, 436 bp, Homo sapiens
  AC073224.4_126323
  Located on chromosome 8
  Distance between a terminus base of telomere on chromosomal short arm and 5'-terminus of this base sequence : 47532724
  Distance between 3'-terminus of neighbour sequence of sequence listing upward to telomere on chrosomal short arm and 5'-terminus of this base sequence : 728771
tcaacatccacctgagtctctgccacccgtccacttctgccttgggccctgtttttgcttgtgggggcctgtggcaagagacacaagcacattgctccaaagcctggggctttacagcttaccagggacagacctgggggctttgggttgggagaggactccttggcaggtccctagcattcctttcagtctcgccacttctcctctctccctgctgcaatgtttccctgagtttctgtggcctgccagcagaaatttaaaataataataataataataataataataataataataactgtatttattcactccaaaaaagtaaaacctatggccaagaatgtggcaaggcaagggttaaaaagaaaagaaccaatgttcctctgcctagcagctcacttcaaggacagttagaagataatgctgtctgaatagc

SEQ ID NO: 13742 - DNA, 464 bp, Homo sapiens
  AC024649.3_161887
  Located on chromosome 8
  Distance between a terminus base of telomere on chromosomal short arm and 5'-terminus of this base sequence : 47681536
  Distance between 3'-terminus of neighbour sequence of sequence listing upward to telomere on chrosomal short arm and 5'-terminus of this base sequence : 148376
agatgttaaacgattaagaaacaggaacagaaagattcaatgaagaagatacaccaagagatctagtaatttctatccatgcatatgcctagcagatgaaacataattcttagttaaaaatggacagtattcaacttcaagaataacaacatttgctgaataactgcatgaattcgttatttaatcagctaactgctctttgaaaagtcttttgttttaaacaaccaagaggccacacacacacacacacacacacacacagatctgagcaaatgactgagcatggtggctcacacctgtaaccccggcactttgggaagccagggcgggaggacagcttgaggccaggagctcgaggccaggagttcaagaccagcctgagcagcacagtgagaccccccagctttacaaaaataaaaatataaaaatgagtcaggcacagtggagtatactgtagtttcagc

SEQ ID NO: 13743 - DNA, 362 bp, Homo sapiens
  chr8.fa.O7frz.51605599
  Located on chromosome 8
  Distance between a terminus base of telomere on chromosomal short arm and 5'-terminus of this base sequence : 48001928
  Distance between 3'-terminus of neighbour sequence of sequence listing upward to telomere on chrosomal short arm and 5'-terminus of this base sequence : 319928
gtcaggagtttgagaccaacctggctaacatgatgaaaccccgcctctactaaaaagacaaaaattagttgggcatggtggcatgcgcctgtaatcccagctactcaggaggctgatgcaggagaattgcttgaacccaggaggcagaggttacagtgagctgagatcgcgccactgcattccagcctgggcaacaagagcgaaactctgtctccaaaacaacaacaacaacaacaacaacaacaacaacaaaacacatagccaggtcagagaactgtccactctatcattttcttgatcatatgtacttggcattattaaattatttccaacctatagttctttacaggaatcttagagct

SEQ ID NO: 13744 - DNA, 276 bp, Homo sapiens
  Z67566
  Located on chromosome 8
  Distance between a terminus base of telomere on chromosomal short arm and 5'-terminus of this base sequence : 48102914
  Distance between 3'-terminus of neighbour sequence of sequence listing upward to telomere on chrosomal short arm and 5'-terminus of this base sequence : 100624
gtttctatgccacggtgatttaccaaaaaccacaggtaataatctctctcaatctctcaatctctcagcctttctctctctctctctctctctctctctctctctctctctctctctcacacacacacacacacacacacacacacacacacacggtgttagaggtttattaaagggtaatctcctttggaaattaatgcattgccaaaacagagaagtgtttttaaagtccagttaagcatgccccatatactgaagtggcagtaaatccattcc

SEQ ID NO: 13745 - DNA, 176 bp, Homo sapiens
  DID22N_0031512
  Located on chromosome 8
  Distance between a terminus base of telomere on chromosomal short arm and 5'-terminus of this base sequence : 48216493
  Distance between 3'-terminus of neighbour sequence of sequence listing upward to telomere on chrosomal short arm and 5'-terminus of this base sequence : 113303
ttacgcttccattccagggatcaatttaaagcaagaaaagcacctatcaaaatatgaagaacacacacacacacacacacacacacacacacacacacacacacgtaaattagaaaccaataaaaaacggagctaatgtataaagaaatttatactgacagtttctcgttccatca

SEQ ID NO: 13746 - DNA, 105 bp, Homo sapiens
  DISO7_11545114
  Located on chromosome 8
  Distance between a terminus base of telomere on chromosomal short arm and 5'-terminus of this base sequence : 48508035
  Distance between 3'-terminus of neighbour sequence of sequence listing upward to telomere on chrosomal short arm and 5'-terminus of this base sequence : 291366
cacaatactgttaacaatgttacccccgcctccccaacacacacacacacacacacacacacacacacacacacacacatttccctctcaacttctagatgtgtt

SEQ ID NO: 13747 - DNA, 123 bp, Homo sapiens
  DISD22_0005691
  Located on chromosome 8
  Distance between a terminus base of telomere on chromosomal short arm and 5'-terminus of this base sequence : 48866712
  Distance between 3'-terminus of neighbour sequence of sequence listing upward to telomere on chrosomal short arm and 5'-terminus of this base sequence : 358572
tgcaattactgctcaaacaagttcatacatatatatatacacacataaacatgtatataaaacatatatacatacatatatatatatgtatatatatatattccctgatattccagtaagcat

SEQ ID NO: 13748 - DNA, 379 bp, Homo sapiens
  AC022915.3_144521
  Located on chromosome 8
  Distance between a terminus base of telomere on chromosomal short arm and 5'-terminus of this base sequence : 48945738
  Distance between 3'-terminus of neighbour sequence of sequence listing upward to telomere on chrosomal short arm and 5'-terminus of this base sequence : 78903
tagttattccttcacgagtttaaggcctagagcccatcagccatgttcccttaaagttaaaaaaataataaaaagatgtaggggcaatatcacagattgttgaaattaaaatatgccgggccaaaactccttaacctgttgagcaaactttgtaagtcacctcctcctcttccacttcttttatcctccagttctttcttccatgcagttcttttagccaaaaaaatcaaccaatctatctatctatctatctatctatctatctatctatctatcatctatctatctatctttctatctatctatgcaaatgcattgttttgtgaatctcacttatctaagagagtgatttgcagagttgaccttacaataaggtctt

SEQ ID NO: 13749 - DNA, 216 bp, Homo sapiens
  DISD22_0005697
  Located on chromosome 8
  Distance between a terminus base of telomere on chromosomal short arm and 5'-terminus of this base sequence : 49218273
  Distance between 3'-terminus of neighbour sequence of sequence listing upward to telomere on chrosomal short arm and 5'-terminus of this base sequence : 272156
catctcattatagcagggtgtgtgtgtgtgtgtgagagagagagagagagggagagagagagagagaaaatgagagagagagagagaaagagagagaaaatgacagagagagagagagagagacagatatagagaaagaaacagagacagaggaacagagacaaagaaaagcagttagagactctgattttcaatgtcctcagcatataatatttg

SEQ ID NO: 13750 - DNA, 412 bp, Homo sapiens
  AC044893.2_62766
  Located on chromosome 8
  Distance between a terminus base of telomere on chromosomal short arm and 5'-terminus of this base sequence : 49316273
  Distance between 3'-terminus of neighbour sequence of sequence listing upward to telomere on chrosomal short arm and 5'-terminus of this base sequence : 97784
accatgaagacattgtcactattgcttgcaaatgtggtgcggtggctcatgcctgtaatccctgcactttgggaggctaaggcaggtggatcacctgaggtcaggagttcaggaccagcctggccaacatggtgaaacgttgtctgtactaaaaatacaaaaattagccggccatggaatctcagctactggggaggctgaggcaagagaattgctggaacccaggaggcggaggttgcagtgagccaagattgcatcattgcactccagcccgggcaacaacagggagactctgtctcaaaacaaaaacaaaaacaaaaacaaacaaacaaacaaacaaaaagaatgaccctggcttgactcacaaaagcagaaaaaaaattgtgtgagaatgctcatttctagctaataa

SEQ ID NO: 13751 - DNA, 129 bp, Homo sapiens
  D8S1745
  Located on chromosome 8
  Distance between a terminus base of telomere on chromosomal short arm and 5'-terminus of this base sequence : 49513961
  Distance between 3'-terminus of neighbour sequence of sequence listing upward to telomere on chrosomal short arm and 5'-terminus of this base sequence : 197276
gaacccactaattgcggacatagtacggtttgaaagtgaatgagtgtgtgtgtgtgtgtgtgtgtgtgtgtgtatagtatttggttaaatatctttatgtaaagaatgtggcatttggtgtgaactttt

SEQ ID NO: 13752 - DNA, 479 bp, Homo sapiens
  AC021184.4_90191
  Located on chromosome 8
  Distance between a terminus base of telomere on chromosomal short arm and 5'-terminus of this base sequence : 49642396
  Distance between 3'-terminus of neighbour sequence of sequence listing upward to telomere on chrosomal short arm and 5'-terminus of this base sequence : 128306
ggtagctattcaaacactctgagaatgttccctgatttgtaaattacatataacattgacaccatagtattgtgttaataacaagtattaagtgagatggtttatcacacacacacacacacacacacacacacacataatttaccatgcccctgcagaagtgtagagtgtatgtgtgtatacatctgtgtgtgtgtttgtatactgcatgatgcctgggatgcaacagttgttgcagttaatgttagtctcttatacctcatacacatattgttacaaaaaagtgttcactgtaaatttggattttggggggattgttgaccagacaactaggaacatatccaagagtcttccaaggaggtgacagaaattggaacattccttcccaggcattgatgcagtgggacataagagtcattgtggactagtaagtagacattggtatgatattgaatttaagacaccaagctagaattaga

SEQ ID NO: 13753 - DNA, 451 bp, Homo sapiens
  AC025746.2_117472
  Located on chromosome 8
  Distance between a terminus base of telomere on chromosomal short arm and 5'-terminus of this base sequence : 49851311
  Distance between 3'-terminus of neighbour sequence of sequence listing upward to telomere on chrosomal short arm and 5'-terminus of this base sequence : 208436
gcaatgactaagttctttattcacattcaacagcaggaaactcaagttcagctttctctgaaataattttgttttcctatagagagaaccagggaagggcatatgcctgtgtcacagtcacagtctgccagctcttactggggctctttgtctggatttccctttcatcagctctatctctgcctgctacctctctatgctgatgataccttatccttagcccctaaatgcccatgcactcaccctttatttcacaactacatgcatatttggcaatggataactgttttaaaaagctttgttaaagtattggtgtggtgaagggacacatataaaaattcttacatgaaaaatgtgtaatggttccttccttccttccttccttccttccttccttccttccttccttccttccttcctttcttccgttagtcatttattgagtgcctac

SEQ ID NO: 13754 - DNA, 360 bp, Homo sapiens
  AC025746.2_8061
  Located on chromosome 8
  Distance between a terminus base of telomere on chromosomal short arm and 5'-terminus of this base sequence : 49891920
  Distance between 3'-terminus of neighbour sequence of sequence listing upward to telomere on chrosomal short arm and 5'-terminus of this base sequence : 40158
agaggaagacagctccaaggaagggcagttggagggatcagtcctcagctacgtgccctttgtttttattttattttattttattttattttattttattttattttattttattttattttattatttttaatttcaattggtttttgggaaacaggtggtgtttggttacatgaatgcgttctttagtggtgatttctgagattttggtgcacccatcaccctagcagcatacactgtaactaatgtgtggtcttttatccctcaccaacctcccaccctttcctgtgggtccccaaagtccactgtattattcttatgcctttgcattctcatagcttagcttccacttatgagtga

SEQ ID NO: 13755 - DNA, 132 bp, Homo sapiens
  D8S1098
  Located on chromosome 8
  Distance between a terminus base of telomere on chromosomal short arm and 5'-terminus of this base sequence : 49922423
  Distance between 3'-terminus of neighbour sequence of sequence listing upward to telomere on chrosomal short arm and 5'-terminus of this base sequence : 30143
atctgggactatgggtccatttcaccatgcccagttattattattattattattattattattattagagatggagtctcactatgtgcctagtctggtctcaaactcctgggctgaagtgatccttccaca

SEQ ID NO: 13756 - DNA, 378 bp, Homo sapiens
  AC025746.2_67956
  Located on chromosome 8
  Distance between a terminus base of telomere on chromosomal short arm and 5'-terminus of this base sequence : 49925942
  Distance between 3'-terminus of neighbour sequence of sequence listing upward to telomere on chrosomal short arm and 5'-terminus of this base sequence : 3387
taggattcattgtcaatttaagactatacccaagactatattgaaatagaggttacagccaaagtagaagaaagttttagtaagaaacaacatctctggagcagttttctttctttctttctttctttctttctttttttcctgattgaaatatctccttattatgtaggttggttttaacagtggtcaattctgtagaaagaaagaccaattaaatgagaacaaaaagagtctatttgctgagagcttgctgtaagaagggagtaaaccttttcacttgcatttgaaagtcacttaaggcaggtggggcaagaaggctttctagtgagcaaaagggaaggccacaggcatgctgtgattgctgatgtatgaaagatg

SEQ ID NO: 13757 - DNA, 429 bp, Homo sapiens
  AC023405.2_36724
  Located on chromosome 8
  Distance between a terminus base of telomere on chromosomal short arm and 5'-terminus of this base sequence : 50135615
  Distance between 3'-terminus of neighbour sequence of sequence listing upward to telomere on chrosomal short arm and 5'-terminus of this base sequence : 209295
gcatgccttagctaatttaatccacataataatcctagaaggtagataataattataatccccactattttgtagacaaaggagcatgtgcatgtttattaaattggatactcaggatgaaaatcatcactacatagacaggattcaaattaattgcagggctatactattcttccagtgccaaaaggtgcatttgtggaatttctctttgtccctccctatcttaccatgccttcttttcttttgttttcttttcttttcttttcttttcttttcttttcttttcttttcttttctttctttctttctttctttctttctttctttctttccttcctctctctctctcttccttccttccttccttccctccttctttctttttcttcctttctcccattgtttcttggacttcataacaagagttta

SEQ ID NO: 13758 - DNA, 144 bp, Homo sapiens
  D8S589
  Located on chromosome 8
  Distance between a terminus base of telomere on chromosomal short arm and 5'-terminus of this base sequence : 50210747
  Distance between 3'-terminus of neighbour sequence of sequence listing upward to telomere on chrosomal short arm and 5'-terminus of this base sequence : 74703
aacctccagaatggggatagagagatagatagatagatagatagatagatagatagatagatagagatatatatgtatgtgcacatatatacatatatatatacatatatatggctctctgtgacagtaactatctggaaaagt

SEQ ID NO: 13759 - DNA, 139 bp, Homo sapiens
  DISD22_0005714
  Located on chromosome 8
  Distance between a terminus base of telomere on chromosomal short arm and 5'-terminus of this base sequence : 50523604
  Distance between 3'-terminus of neighbour sequence of sequence listing upward to telomere on chrosomal short arm and 5'-terminus of this base sequence : 312713
cgtcatcagcattcaacttaggttttagcacacatatatgtgcaagtaaattttatatatatatatatatatatatatatataaatcatatattaactaactaaacaaaaaaatacaggttcttgtactttaatcttcc

SEQ ID NO: 13760 - DNA, 414 bp, Homo sapiens
  AC023145.4_5746
  Located on chromosome 8
  Distance between a terminus base of telomere on chromosomal short arm and 5'-terminus of this base sequence : 50850081
  Distance between 3'-terminus of neighbour sequence of sequence listing upward to telomere on chrosomal short arm and 5'-terminus of this base sequence : 326338
ctgagtcttggtaagaacagtaagctttgtggcattataactggacctggtcccaacccctctcttttctctggcaatatgttggcttacataataatgatgcataccctaaaatttataatctaatcagttgtatatttaattcatgaaattttagctttattgaagatgtgtgtgtgtgtgtgtgtgtgtgtgtgtgtgtgtgtatttagacaaaatattctattaatgaaactgacaattggtctttatttttggggaatgtcaaaaatctatttttttcaatttgagaaagaaactctcctagttctttatacattcaatttattaatgttaaaaacacattatagagtcacacaatctgaagataatgagcctgtttttgttctggtctatttcataacacttggtgat

SEQ ID NO: 13761 - DNA, 441 bp, Homo sapiens
  AC023145.4_62378
  Located on chromosome 8
  Distance between a terminus base of telomere on chromosomal short arm and 5'-terminus of this base sequence : 50887221
  Distance between 3'-terminus of neighbour sequence of sequence listing upward to telomere on chrosomal short arm and 5'-terminus of this base sequence : 36726
tgactatgttaagcgatttgtcattaggaaatacttcaaaatgaggtcacttgaaataactactgtgctgtttaggaaacacatttttaagcactagttaactttcacaaacataggatatggcagtcactaaagggcaaaacaggtcaaaatacagaagtgtcaagtacattatatttatatttatagttacattctagccttaaaggatgggtaaaagcttaggaattggggtaatatatgataaaatgataaatatcatggcatgtattttattttaatagtctttttaattttatttatttatttatttatttatttatttatttatttatttgagagagggtctcactctgttgtccaggttggagtgcagtgttgcaatctcggctcactgcaacctctgcctcctgggtttaaatgaaccgtatgtctcagaat

SEQ ID NO: 13762 - DNA, 434 bp, Homo sapiens
  AC034174.3_83059
  Located on chromosome 8
  Distance between a terminus base of telomere on chromosomal short arm and 5'-terminus of this base sequence : 50946125
  Distance between 3'-terminus of neighbour sequence of sequence listing upward to telomere on chrosomal short arm and 5'-terminus of this base sequence : 58463
atctttcaagtgccaagtattaattaattaattctcatgtttcaaaatttgtttcattgacctatatttgctcttaaaagttcaaagacatcattgtttcatactcttttcttgttttgtttttttttccaaggagaggtttctgattcttttagctagatcttgtctagagatacctatgttcttcatctttcgcacattattattattattattattattattattattattattattttgctttaagttctgggatacatgtgcaaaatgtgcaggtttcttacctaggtatacgtgtaccatggtgatttcctgcacctatcgacctgtcctctaaggtacctcccctgacccttaaaccctcaacaggccctgatgtgtgttgtttcccaccctgtgtccatgtgttctcatagttcaacttccatttg

SEQ ID NO: 13763 - DNA, 477 bp, Homo sapiens
  AC023272.5_107165
  Located on chromosome 8
  Distance between a terminus base of telomere on chromosomal short arm and 5'-terminus of this base sequence : 51147588
  Distance between 3'-terminus of neighbour sequence of sequence listing upward to telomere on chrosomal short arm and 5'-terminus of this base sequence : 201029
atcagttgaaatgtattagctgagtgtcttcacagtttcagttgtattagctgagtgtcctcacagtttcagttcatttgctccctcttaactagtaggtcttgcctattctctgctgctgttgctttctgggtgttttttgtttgtttgtttgtttgtttacacagtctgactctgtcacccaggctgtagtgcagtggtgtgatcttggctcactgcaacctccgcctccctggttcaagcgattctcctgcctcagtctcacgagtagctgggactagatgcacctgccaccatgcctggctaatttttgtatttttagtagagacggggtttcaccatattgaccaggctagtctcgatctcctgaccttgttatgcacctgccttggacttctaaagtgcttggactacaggtgtgagccaccacgcccaggcgctttctgggtcttttctaagaacatcaaggtaatcaac

SEQ ID NO: 13764 - DNA, 267 bp, Homo sapiens
  D8S1831
  Located on chromosome 8
  Distance between a terminus base of telomere on chromosomal short arm and 5'-terminus of this base sequence : 51171572
  Distance between 3'-terminus of neighbour sequence of sequence listing upward to telomere on chrosomal short arm and 5'-terminus of this base sequence : 23507
agtccaggctgcggttgtgtgtgtgtgtgtgtgtgtgtgtgtgtgtgtgtatttgattatagtaagttttgaaattgggacatatgagttttccttattaaaaataaatttggagcattgatcttaattcagaaatcttgctattttttatttcaaataatataatcaatagatgtattttttaacatatacagtgaaacaatctgaaaatgttaattaggtgtgtttatgtttttgttttcacttatttgctgatctttcagtgca

SEQ ID NO: 13765 - DNA, 464 bp, Homo sapiens
  AC023272.5_88552
  Located on chromosome 8
  Distance between a terminus base of telomere on chromosomal short arm and 5'-terminus of this base sequence : 51251196
  Distance between 3'-terminus of neighbour sequence of sequence listing upward to telomere on chrosomal short arm and 5'-terminus of this base sequence : 79357
gtaactttaaagctcttcggagctgggagaggtggctcgtgcctgtaattccagcactttgggaggcagaggcagacacatcacctgaggtcaggcgttcgagaccagcttgaccaatatggtgaagccctgtctctactaaaaatataaaacctagctgggtgtggtggtacactcctgtaatcccagctactcagagacaggagaatcgcttgaacctgggaggcggagattgcagtgagccaagatcacgctactgtactccagcctgggcgacagagactctgtctcaaaagaataaaataaaataaaataaaataaaataaaataaaataaaataaaataaaataaagctctgggggaatttcttaaggttgataaacttaacattattataaccaagggttttgcaaatagttctacaaaataatacaatatggctttaattaggcactgtaacattc

SEQ ID NO: 13766 - DNA, 181 bp, Homo sapiens
  D8S538
  Located on chromosome 8
  Distance between a terminus base of telomere on chromosomal short arm and 5'-terminus of this base sequence : 51327680
  Distance between 3'-terminus of neighbour sequence of sequence listing upward to telomere on chrosomal short arm and 5'-terminus of this base sequence : 76020
tactatttgtggcaattgtaataccagtaagtacaaatatttaactaaaatttacaagtgttcagacatagtatttaacgtgtgtgtgtgtgtgtgtgtgtgtgtgtgtgtgtacacatatatataatgttttaagttaaaatgccatgttaatccattttaaagtcaatcacaagcagct

SEQ ID NO: 13767 - DNA, 235 bp, Homo sapiens
  AC012413.4_91011
  Located on chromosome 8
  Distance between a terminus base of telomere on chromosomal short arm and 5'-terminus of this base sequence : 51571826
  Distance between 3'-terminus of neighbour sequence of sequence listing upward to telomere on chrosomal short arm and 5'-terminus of this base sequence : 243965
cattgtaaatgatccaattgatttgctttctacagacctggattttgatctccccttttattttagtttaataactttcgactattttaatgattttctttagcagtaagatggatggatggatagatagatagatagatagatagatagatagatagatagatatgtgaactttacccatgatatgatttagatctgtgtctccacccaaatctcatgtcaaattgtaatcacc

SEQ ID NO: 13768 - DNA, 174 bp, Homo sapiens
  D8S587
  Located on chromosome 8
  Distance between a terminus base of telomere on chromosomal short arm and 5'-terminus of this base sequence : 51571863
  Distance between 3'-terminus of neighbour sequence of sequence listing upward to telomere on chrosomal short arm and 5'-terminus of this base sequence : -198
ctggattttgatctccccttttattttagtttaataactttcgactattttaatgattttctttagcagtaagatggatggatggatagatagatagatagatagatagatagatagatagatagatatgtgaactttacccatgatatgatttagatctgtgtctccacccaa

SEQ ID NO: 13769 - DNA, 474 bp, Homo sapiens
  AC012413.4_25594
  Located on chromosome 8
  Distance between a terminus base of telomere on chromosomal short arm and 5'-terminus of this base sequence : 51611260
  Distance between 3'-terminus of neighbour sequence of sequence listing upward to telomere on chrosomal short arm and 5'-terminus of this base sequence : 39223
atcctagatttagtggttccaccctaattatcttgactgagtaagggatgactatctattgcatgaagaaaggtaaatggggccacctggcagaaaccgctagtacacacacacacacacacacacacacacacacacacacacacacacgttctttctttctgaagagcagaattatagcttgtggttacaatatagaccacatggagactgcatttatcagtccctttactgctagctgtggccacatgactgttcaaaaccaatggatggtgagtgaatgcagcacaggtgtgtcctggaaagtctttagcatgcaccttgccatgccatttctcccttcttgctggctggagtaagcagaaagaccttgaaagttccatgatccagagagaagaaccattgtcagttgatgtctgtgaatgatttttcaagacaaagacgctatggagctgctcagtgaagtataggaca

SEQ ID NO: 13770 - DNA, 160 bp, Homo sapiens
  D8S1773
  Located on chromosome 8
  Distance between a terminus base of telomere on chromosomal short arm and 5'-terminus of this base sequence : 51671401
  Distance between 3'-terminus of neighbour sequence of sequence listing upward to telomere on chrosomal short arm and 5'-terminus of this base sequence : 59667
ttttgtaatatctgtgaagacctcattaacatttttattataattaaaagtgtaaattcttatatctcatctcattgttcattatataccctacacacacacacacacacacacacacacacacacacacatccatgccctctccacagtcaggtaaact

SEQ ID NO: 13771 - DNA, 467 bp, Homo sapiens
  AF235105.2_47566
  Located on chromosome 8
  Distance between a terminus base of telomere on chromosomal short arm and 5'-terminus of this base sequence : 51889298
  Distance between 3'-terminus of neighbour sequence of sequence listing upward to telomere on chrosomal short arm and 5'-terminus of this base sequence : 217737
ataccaaactacggactctgtaagtaagtgtataaaatatgctttttaaagatgttcttcatcagttagttcaatgccttgctgtgagaagtttatatatgcgcattgaaaacatgaaatgagtgtgttacttcaaagatgcattgtgagctcctttattacagtgaattgaaccgcttcccaaacaatgaactctatcaacaaatgtacaaatacacatttaaaagatgttccttatcatttagtttattgccttattgtgagggattttatatatatatatatatatatatatatatatacacacactgaaaatataaatctcggcatgttacttcaaagatgcattgtgaagcactttattaaaatgaattgaactgtttaacacagtgaactttttaaccacatgtttaagacatgctctttaaagatgtcccttgcccttgtgttctaagccataatgtgag

SEQ ID NO: 13772 - DNA, 296 bp, Homo sapiens
  DISO7_00040448
  Located on chromosome 8
  Distance between a terminus base of telomere on chromosomal short arm and 5'-terminus of this base sequence : 52073871
  Distance between 3'-terminus of neighbour sequence of sequence listing upward to telomere on chrosomal short arm and 5'-terminus of this base sequence : 184106
acctcgtaggttactcaccccgcacaccatgtctcaccttcctcctgtttcccactctctttgatgaaccagcagcactgcctggctctgggtctctctctctctctctctgtctctgtctctctctttctctctctctctatatacacacacacacacacacacacacacatatacagctgctccgatgggtcacacctccttgcatgccccactctctcttttctggctggatacctgtgctttctggggaaatcgtgtggtgtcagagaaccttgtggactttcaggatccaa

SEQ ID NO: 13773 - DNA, 437 bp, Homo sapiens
  AC067932.2_42422
  Located on chromosome 8
  Distance between a terminus base of telomere on chromosomal short arm and 5'-terminus of this base sequence : 52241018
  Distance between 3'-terminus of neighbour sequence of sequence listing upward to telomere on chrosomal short arm and 5'-terminus of this base sequence : 166851
aacatattactcgaaacactgaacataaaatgcaaaataaacaaaccccacactcatgtttattaatgtgcttgtgtgctgattgttttgtttagtaaaccttgttgtgacagaaaccacaaattttattaataacctcaatattccaagcactagaacatgttttatacacacacacacacacacacacacactcacacacacatacactgaacttctttaacagattaaactcagcatctgaatgcaaatgtaagtgcaatttgagaaaactaaaaaaatttcaaaacataatactgaatatacaatttaagctttattcaactatagctagtaagttaatgtatcaattcctgaattaataaatcagtagaggagaaagtgtgaaatgaaatacccatggccagtaacaagagttatgacagttaactctggca

SEQ ID NO: 13774 - DNA, 166 bp, Homo sapiens
  DISO7_10002502
  Located on chromosome 8
  Distance between a terminus base of telomere on chromosomal short arm and 5'-terminus of this base sequence : 52268660
  Distance between 3'-terminus of neighbour sequence of sequence listing upward to telomere on chrosomal short arm and 5'-terminus of this base sequence : 27205
agctgtgcaccacaaatggccatatgtaaggatatacgtgtgtgtgtgtgtgtgtgtgtgtacacacaaaaatatatattagtgtgaagtgaattaattttattgtgctgcctagatacaataaaaccagtgataactaaacagtgataactgaacaagtccttaa

SEQ ID NO: 13775 - DNA, 298 bp, Homo sapiens
  AC067932.2_68933
  Located on chromosome 8
  Distance between a terminus base of telomere on chromosomal short arm and 5'-terminus of this base sequence : 52329932
  Distance between 3'-terminus of neighbour sequence of sequence listing upward to telomere on chrosomal short arm and 5'-terminus of this base sequence : 61106
gaactacaatactggtttctgtctgaacttgcagccgcagagcatgagagaaataaccattgaactctaaataactgctttccaaattttgtgctggctgtctaattcaaactattatctatctatctatcatctatcatctatctatctatctatctatctatctatctatcttttatctcatagcactgtggaatttaatttaattaatttaatttaattaatagttaactattgcagcctatagaatgttaaaataattctgacattattaatgttcctaaacctaccagtaagc

SEQ ID NO: 13776 - DNA, 298 bp, Homo sapiens; identical to SEQ ID NO: 13775
  AC064807.3_43643
  Located on chromosome 8
  Distance between a terminus base of telomere on chromosomal short arm and 5'-terminus of this base sequence : 52329932
  Distance between 3'-terminus of neighbour sequence of sequence listing upward to telomere on chrosomal short arm and 5'-terminus of this base sequence : -298

SEQ ID NO: 13777 - DNA, 268 bp, Homo sapiens
  D8S524
  Located on chromosome 8
  Distance between a terminus base of telomere on chromosomal short arm and 5'-terminus of this base sequence : 52336021
  Distance between 3'-terminus of neighbour sequence of sequence listing upward to telomere on chrosomal short arm and 5'-terminus of this base sequence : 5791
attctagtaccagatgctgtgagaaaagatttaagagtgtgtgtgtgtgtgtgtgtgtgtgtgtgtgtgtgtgtgtgtgatgttacttggagaaagatcaaattaaaatggagaatggaggaggtctttttatagtctcctcatttgcactccaagttaggaaatggctgtataaagagatgatctccaagaacctttataggactgatgtggcttgaccaagacaaatacaaataaagagtggacagtggagtcatggcttagggtg

SEQ ID NO: 13778 - DNA, 249 bp, Homo sapiens
  D8S1815
  Located on chromosome 8
  Distance between a terminus base of telomere on chromosomal short arm and 5'-terminus of this base sequence : 52464798
  Distance between 3'-terminus of neighbour sequence of sequence listing upward to telomere on chrosomal short arm and 5'-terminus of this base sequence : 128509
tctatgccagtatctatgtaatcatgactctctttctgtgtgtgtgtgtgtgtgtgtgtgtgtgtgtgtgtgtgtgtgtgtgtgtgtgtagtattttggggtacaattttttgaagtattttgttctcagaaagtatttaaatttgaaagaaagtctagaacaatttcctccggactatgtgaccttgattcttgaaggaaactcagaatatgaaataatataaacatggcttactaaagaatttaatt

SEQ ID NO: 13779 - DNA, 271 bp, Homo sapiens
  D8S1833
  Located on chromosome 8
  Distance between a terminus base of telomere on chromosomal short arm and 5'-terminus of this base sequence : 52576629
  Distance between 3'-terminus of neighbour sequence of sequence listing upward to telomere on chrosomal short arm and 5'-terminus of this base sequence : 111582
  misc_feature (1)...(271): n = A,T,G or C
accctcagagaaacagcctagagggcagacacgagaatagaagatagagacccacagagggaaaacagcaaaacaaaatgagcacacacacacacacacacacacaaatacagaacttcttncagtaatatgagcaatatagtaattttctggctttttaagttactaagacaaaaggcgttttaaagaccatgtggctgttttatttgtttgtttgtttgtttttgagacggagtcttgctctgtcacccaggctggagtgcaatgtgca

SEQ ID NO: 13780 - DNA, 115 bp, Homo sapiens
  DISO7_10002503
  Located on chromosome 8
  Distance between a terminus base of telomere on chromosomal short arm and 5'-terminus of this base sequence : 52692317
  Distance between 3'-terminus of neighbour sequence of sequence listing upward to telomere on chrosomal short arm and 5'-terminus of this base sequence : 115417
tagcagtcaattacaggttgatagatgatggatggatggatggatggatggatggatggatggatggataaatggatgaatagacatatagagagaatgaccagatagaggtctc

SEQ ID NO: 13781 - DNA, 385 bp, Homo sapiens
  AC013650.3_78942
  Located on chromosome 8
  Distance between a terminus base of telomere on chromosomal short arm and 5'-terminus of this base sequence : 52899180
  Distance between 3'-terminus of neighbour sequence of sequence listing upward to telomere on chrosomal short arm and 5'-terminus of this base sequence : 206748
gaccttgtgatcatgtaagttaatacttaataaattcatatatatatatatatatatatatggaataggatgtgtatatatatatagggaataggatatacacacacacacacacacacacacacacacacacacacacacacacatcctattagttctgtccctctaagagaacactaatacatctggcttgatgcagataggtaaatagagcagtgtatttatctcaaaccatctcttctcttctctctctctctctctctctccccctctatctcactcactccctctctatacttctctcccttcatcaacctccccacctatgattggcacacactgaagaggcaaagactcacctttgtcaaggatcaagaagtagctc

SEQ ID NO: 13782 - DNA, 236 bp, Homo sapiens
  D8S601
  Located on chromosome 8
  Distance between a terminus base of telomere on chromosomal short arm and 5'-terminus of this base sequence : 53090435
  Distance between 3'-terminus of neighbour sequence of sequence listing upward to telomere on chrosomal short arm and 5'-terminus of this base sequence : 190870
gcacagttggatcttgtgtcattttgacaaactcccactgctttttgtgtgtgtgtgtgtgtgtgtgtgtgtgtgtgtgtgtgtgtgtgtgaagcactttctggcattacaaggtaatcctgcctttttttttttttggataatccttttttatcttttttaaaaaaagttctgtcctattgatataatttggatgtttgttgcctccaaatctcatgctgaaatgtgattgccaa

SEQ ID NO: 13783 - DNA, 101 bp, Homo sapiens
  DISO7_10018408
  Located on chromosome 8
  Distance between a terminus base of telomere on chromosomal short arm and 5'-terminus of this base sequence : 53136212
  Distance between 3'-terminus of neighbour sequence of sequence listing upward to telomere on chrosomal short arm and 5'-terminus of this base sequence : 45541
aactaggaagtggtgcaacagggaacagcacttgttatttgcaggacagtggctggggcgtgtgtgtgtgtgtgtgtgtgtgtcaggagctaacaggcatg

SEQ ID NO: 13784 - DNA, 420 bp, Homo sapiens
  AC009800.6_93264
  Located on chromosome 8
  Distance between a terminus base of telomere on chromosomal short arm and 5'-terminus of this base sequence : 53224502
  Distance between 3'-terminus of neighbour sequence of sequence listing upward to telomere on chrosomal short arm and 5'-terminus of this base sequence : 88189
tacttcataaagcttggttgaggccaggcacggtggctcacacctgtaatctcaacactttgggaggctgagacaggcggatcaccagaggtcaggagttggagaccagcctgaccaacatggtgaaaccccatctctacaaaagtacaaaaaaatttagccaggcatgaaggcaggtgcctataatcccagcttctcgggaggttgtggtggaagaatcacttgaacctgggaggaggaggttgcagtgagccgagatcgtgccattgcactccagcctgggcaagagagcgagactctgtctcaaaataaataaataaataaataaataaatataagtaaataaagcttggttgaagattaaataaggtaatacacgtaaagcccaataactactaccaatcattagtgtcattactg

SEQ ID NO: 13785 - DNA, 161 bp, Homo sapiens
  DISO7_10018465
  Located on chromosome 8
  Distance between a terminus base of telomere on chromosomal short arm and 5'-terminus of this base sequence : 53237167
  Distance between 3'-terminus of neighbour sequence of sequence listing upward to telomere on chrosomal short arm and 5'-terminus of this base sequence : 12245
cctggaagctatctgtctttctatctatctatctatctatcaatcatctacctatctatcatctatcactttcagatcaaaccatattataaatactcacatttagctttatttgggttattacctaaaattttgttagttggagaactacaatgaaacag

SEQ ID NO: 13786 - DNA, 101 bp, Homo sapiens
  DISO7_10000355
  Located on chromosome 8
  Distance between a terminus base of telomere on chromosomal short arm and 5'-terminus of this base sequence : 53329295
  Distance between 3'-terminus of neighbour sequence of sequence listing upward to telomere on chrosomal short arm and 5'-terminus of this base sequence : 91967
aagccattctaagaactgcctgcacattctgcaaacttgcaacaaacaaacaaacaaacaaacataaaaaaccaggaatttgccttgtacccttgaattgg

SEQ ID NO: 13787 - DNA, 379 bp, Homo sapiens
  chr8.fa.O7frz.61773995
  Located on chromosome 8
  Distance between a terminus base of telomere on chromosomal short arm and 5'-terminus of this base sequence : 53337450
  Distance between 3'-terminus of neighbour sequence of sequence listing upward to telomere on chrosomal short arm and 5'-terminus of this base sequence : 8054
ctaccaggatcaggagtttaacactttatttaaccaatagccaattttcttatcttgactctctaccacttacaatcttttttcttttctctttctcctcccttcctcccttctttctttctttctttctttctttctttctttctttctttctttctttctttcttttctttctttcttttctttctttctttccttctttctttcttttctttctttctttctttttctttctttctttctttctttctctctctttctttctttcttttctttcttttctttctttctttctttttcttttctttctttctttcgatggagatctcactctgtcacccaggctggagcacagtggaacaatcatagttcactgcag

SEQ ID NO: 13788 - DNA, 151 bp, Homo sapiens
  DISO7_10000353
  Located on chromosome 8
  Distance between a terminus base of telomere on chromosomal short arm and 5'-terminus of this base sequence : 53394150
  Distance between 3'-terminus of neighbour sequence of sequence listing upward to telomere on chrosomal short arm and 5'-terminus of this base sequence : 56321
aagcatgcatgaatgtgcctctctttctctctctctctctctctgtgtgtgtgtgtgtgtgtgtgtgagagagagagagagagagcaagagataaaggcagagagacagaaagacataagaaggaggaggggaagcagaggaaatatgtgt

SEQ ID NO: 13789 - DNA, 474 bp, Homo sapiens
  chr8.fa.O7frz.61665349
  Located on chromosome 8
  Distance between a terminus base of telomere on chromosomal short arm and 5'-terminus of this base sequence : 53447948
  Distance between 3'-terminus of neighbour sequence of sequence listing upward to telomere on chrosomal short arm and 5'-terminus of this base sequence : 53647
ctctgaacctgtatctgttatgacatagaaatgatatttcaggggggtgtgtgtgtgtgtgtgtgtgtgtgtgtggtagggagaagggttggttagattaatgacaatcatcttgtctcttgtaagtatctaatcatgcaatttatattttcctgttatcatttctttctttgtgctgttcagaatatattctgtgctgctaaatattcctttacttctattattcatcttatgatctttaaacaatatagatggactgcaattttttttaaatgaaattagcatattttcatcacctcccacgtttccttcctctacttcttcaaaatattgatttgggacatttatatttacctgatagtctctaatccttgcatttgttttagtctggtgtattcaattaattcgattcagggcttatttttccatttgtaggtgggctgatattcatgctatgctctttcaagatgaatg

SEQ ID NO: 13790 - DNA, 228 bp, Homo sapiens
  DISO7_10000352
  Located on chromosome 8
  Distance between a terminus base of telomere on chromosomal short arm and 5'-terminus of this base sequence : 53491388
  Distance between 3'-terminus of neighbour sequence of sequence listing upward to telomere on chrosomal short arm and 5'-terminus of this base sequence : 42966
ggagcaatcattgtccaagattttgtattttttcagacatagtctttggttaaacaagaacttatgactatagtgattcactatatatatatatacacacacacacacacacacacacacacatatatatatatagtgtgtgtgtgcctgtataatttattatcttcaattaacaattattactatattttatactcctgaaattttcctttgcatacatggttacag

SEQ ID NO: 13791 - DNA, 219 bp, Homo sapiens
  DISO7_10000350
  Located on chromosome 8
  Distance between a terminus base of telomere on chromosomal short arm and 5'-terminus of this base sequence : 53529062
  Distance between 3'-terminus of neighbour sequence of sequence listing upward to telomere on chrosomal short arm and 5'-terminus of this base sequence : 37446
cctcaccaacagagcagagaggagcccaggaggtagtgtgtgtttgtgtgtgtgtgtgtgtgtgtgtgtgtgtgtgtgtgtgtgtgtgtgtgtgcatgtgagaaaaagaggaggaagccggaggagtgcgcggacatgggagggaagacatcaggggagagcaaaagaaaggggaccccagaggtgggagatggggcaccctggtctgcactggaaact

SEQ ID NO: 13792 - DNA, 166 bp, Homo sapiens
  DISO7_10000351
  Located on chromosome 8
  Distance between a terminus base of telomere on chromosomal short arm and 5'-terminus of this base sequence : 53592118
  Distance between 3'-terminus of neighbour sequence of sequence listing upward to telomere on chrosomal short arm and 5'-terminus of this base sequence : 62837
tgaccagcaagtcagaggtattttggcctgttttctctcttttcttttctcttcttttccttttttctttctttctttctctttctttctttctctttctttctttctttctttctttctctttccttctttcttttttttaacagatgaaaccaacattagttga

SEQ ID NO: 13793 - DNA, 142 bp, Homo sapiens
  DISO7_10000328
  Located on chromosome 8
  Distance between a terminus base of telomere on chromosomal short arm and 5'-terminus of this base sequence : 53723278
  Distance between 3'-terminus of neighbour sequence of sequence listing upward to telomere on chrosomal short arm and 5'-terminus of this base sequence : 130994
aagcatttgattagaactcacgaattgaaaatgacaacagtacatctaagtgttgatataatgaaggttttgtcaatacacacacacacacacacacacacacacacaagttgagctcttttgatgctctaatttcgatcca

SEQ ID NO: 13794 - DNA, 260 bp, Homo sapiens
  DISO7_10000329
  Located on chromosome 8
  Distance between a terminus base of telomere on chromosomal short arm and 5'-terminus of this base sequence : 53727166
  Distance between 3'-terminus of neighbour sequence of sequence listing upward to telomere on chrosomal short arm and 5'-terminus of this base sequence : 3746
aggccttcctatggatacacacctctctctctctctctctctctcacacacacacacacacacacacacacacacacacagagttctttaaaaatatttttgtatatttttatttttatagatttagggggtacaattgcagttttgttacatgggtatattgtgtagtggtgaagtctgggcttttagtgtaagtatcatccaaatagtgtatgtatgcattaggtaatttctaatggatgtatacactattgggatga

SEQ ID NO: 13795 - DNA, 320 bp, Homo sapiens
  chr8.fa.O7frz.61033215
  Located on chromosome 8
  Distance between a terminus base of telomere on chromosomal short arm and 5'-terminus of this base sequence : 53741317
  Distance between 3'-terminus of neighbour sequence of sequence listing upward to telomere on chrosomal short arm and 5'-terminus of this base sequence : 13891
gtagagtctgcttgaagtcattactccatttgtccatgcattcatctatccatccatgatccatcatccatccatccatccatccatccatccatccatgcatcaacccatccatccatgcatccattcatgagccaccatccatccatccaaccatccatccatgcatccatccatgcatttatccttctagccatcttttaactcatcacataaattaagcacgaattacatgcaagtatttgtgctatacaggcactctggagcttataaaaataaattacacaatatgcctcctattatcaagtttgcaatctagc

SEQ ID NO: 13796 - DNA, 103 bp, Homo sapiens
  DISO7_10000330
  Located on chromosome 8
  Distance between a terminus base of telomere on chromosomal short arm and 5'-terminus of this base sequence : 53823818
  Distance between 3'-terminus of neighbour sequence of sequence listing upward to telomere on chrosomal short arm and 5'-terminus of this base sequence : 82181
atattctcagggcatcgggaattgatcaaaagtgggcatgcagacacacacacacacacacacacacacacacacacacttacactcacagaagcacgaataa

SEQ ID NO: 13797 - DNA, 159 bp, Homo sapiens
  DISO7_10000327
  Located on chromosome 8
  Distance between a terminus base of telomere on chromosomal short arm and 5'-terminus of this base sequence : 53841270
  Distance between 3'-terminus of neighbour sequence of sequence listing upward to telomere on chrosomal short arm and 5'-terminus of this base sequence : 17349
tctaggatgtgttgacatgagtcttgttaatgtgtgtgtgtgtgtgtgtgtgcatgcttttaaaaaattaattttcttggttttcacattgcaaaaatgaacttttaattttcccttccattccctctcccatccccttcggatgtacttaatgccaca

SEQ ID NO: 13798 - DNA, 453 bp, Homo sapiens
  AC023132.4_185070
  Located on chromosome 8
  Distance between a terminus base of telomere on chromosomal short arm and 5'-terminus of this base sequence : 53945072
  Distance between 3'-terminus of neighbour sequence of sequence listing upward to telomere on chrosomal short arm and 5'-terminus of this base sequence : 103643
ttggaaatgcagaagtcacccaccttctgcattgatctcattgggagctacagaccggagctgttcctattcagccagtttgccagccacaggttgtttgttgttgttgttgttgttgttgttgttgttgttgttgttttggagttttgctcttgttgcccaggctggactgcaatggcattatcttggctcactgcaacctctgcctctcagtttcaaacaattttcctgcctcagcctcctgagtagctgggattacaggtgcccaccaccacgcccagctaatttttgtatttttagtagagatggggtttcaccatgttggccaagctggtcgcaaactcctgacctcatgatctgcccaccttggcctctcaaagtgctgggattacaggcgtgagccactgcacctggccttaattagtcttgcatgtaagtttcaggaccacaaga

SEQ ID NO: 13799 - DNA, 194 bp, Homo sapiens
  D8S1737
  Located on chromosome 8
  Distance between a terminus base of telomere on chromosomal short arm and 5'-terminus of this base sequence : 53957541
  Distance between 3'-terminus of neighbour sequence of sequence listing upward to telomere on chrosomal short arm and 5'-terminus of this base sequence : 12016
tgtaacacacagatgcacgcaagcacacgcgcgcgcacacacacacacacacacacacacacacacacaccccttattgcttctgattctctggggaaccttgactaatgcacacctttcactgatctttctccttccgtttgccatatttcctgtcatagtctcatctcaacaccgaagccaaagttatcctt

SEQ ID NO: 13800 - DNA, 398 bp, Homo sapiens
  M8_53964232
  Located on chromosome 8
  Distance between a terminus base of telomere on chromosomal short arm and 5'-terminus of this base sequence : 53963945
  Distance between 3'-terminus of neighbour sequence of sequence listing upward to telomere on chrosomal short arm and 5'-terminus of this base sequence : 6210
aataaaaagaatgacccagctttggcaaggcctataatctcagcactttgggaggctgaggtgggcagatcttttgagcagaggcatttgagaccagcctgggcaatgtggcaaaaccccggctctacaaaaaatacaaaaaaattagacaggtgtggtggcgtgtgcctgtagtcccagctacccgggagactgagataggagaatcacctgagcctaggaggtttaggctgcagttagctgggatcacaccactgcactggtgatcggagaccctgtcttggggaaaagaaagaaggaaagaaagaaagaaggaaagaaacaaagaaaggaaggaaggaaggaaggaaggaaggaaggaaggaaggaaggaagactacttccgtaatggttggatt

SEQ ID NO: 13801 - DNA, 322 bp, Homo sapiens
  AC060764.2_101306
  Located on chromosome 8
  Distance between a terminus base of telomere on chromosomal short arm and 5'-terminus of this base sequence : 54414206
  Distance between 3'-terminus of neighbour sequence of sequence listing upward to telomere on chrosomal short arm and 5'-terminus of this base sequence : 449863
aaagttttagaaagactcaaacaattattttaaaagtccaggtaaatattgaagaatgagatcacattacttgtattgtagattgtgatgcagctgcaataaaactaagtaaattaagttgaaaaacttttgctttaatctatggacatgatgtgtgtgtgtgtgtgtgtgtgtatactttatttcaggaagtacgctcactaaagaaatgtgaaaaatataacaacaaggatggcgtcatgttataatgacataaataaacgatgttgaatttttaacccattaaacatgatcatcaaagacatctagtcaaggtcatggt

SEQ ID NO: 13802 - DNA, 150 bp, Homo sapiens
  D8S1080
  Located on chromosome 8
  Distance between a terminus base of telomere on chromosomal short arm and 5'-terminus of this base sequence : 54485119
  Distance between 3'-terminus of neighbour sequence of sequence listing upward to telomere on chrosomal short arm and 5'-terminus of this base sequence : 70591
tgccatagtcactggcgaaaggtaactgctttgttgtgtagatttgggcagtccttggcaagcctggtaagactcacacacacacacacacacacacacacacacacacacacacggacacaagcagccaaggtgtccttctggaaagcc

SEQ ID NO: 13803 - DNA, 277 bp, Homo sapiens
  AC017038.6_63587
  Located on chromosome 8
  Distance between a terminus base of telomere on chromosomal short arm and 5'-terminus of this base sequence : 54568624
  Distance between 3'-terminus of neighbour sequence of sequence listing upward to telomere on chrosomal short arm and 5'-terminus of this base sequence : 83355
tagtggtttcttaccaaactaaacatatctttaccgtataaaccagcagctgtactctttggtgtttacccaaaggagtcgaaaacttatgtccacacaaaaacctgcacatggtttcttatagcagctttgttcatgatcaccaaaacttggaagcaagatgtcttggaagcaagaataaataaataaataaataaataaacaaataaataaacaaacatgttgagaatggaatattattcagtgctaacaagaaatgaactatcaagctatgaaa

SEQ ID NO: 13804 - DNA, 450 bp, Homo sapiens
  AC017038.6_29016
  Located on chromosome 8
  Distance between a terminus base of telomere on chromosomal short arm and 5'-terminus of this base sequence : 54588097
  Distance between 3'-terminus of neighbour sequence of sequence listing upward to telomere on chrosomal short arm and 5'-terminus of this base sequence : 19196
ctccttgactagactggatttcaaaatcagggcccttgttctagccatggttttattctctcttctaacacaagatctggcacaaagcaaccactgagcaactgaagggaaagtgtgagtgtgtgtgtgtgtgtgtgtgtgtgaggcatgtgggtggagaggaggctgttgctaactcttgtcttcaagaagagactgtggaccatgtgcaaccagggttacttgtcagacatgtgcagaggagacaaagccttgggagggatttgtcacctcattagcacaggctcatctcccaagttttttctagcaaaacttcgccacagatatctcaccccagttctggagctcttttaaggtggagagagcactgagctaccagatgctcctcccctgccagcgtggaccagcagcaccatattctgtgcacccttgatggagtctaaactgttg

SEQ ID NO: 13805 - DNA, 411 bp, Homo sapiens
  AF215846.2_133222
  Located on chromosome 8
  Distance between a terminus base of telomere on chromosomal short arm and 5'-terminus of this base sequence : 54728012
  Distance between 3'-terminus of neighbour sequence of sequence listing upward to telomere on chrosomal short arm and 5'-terminus of this base sequence : 139465
tcagtcttgctagaagtttgtaacttttatagagtttttcaaggacccagtttttgcttcattggttttctctattatttttctggtttcaattttattgatttcttgtttttccctgcccccaccacctttccttccttccttccttccttccttccttccttccttcctcccttcctcccttccttccttctttccttttttccttcctttttcttgctctgtcacccaggctggagtgcagtggcacaatcatggctcattgcaaccttgatctcctgggctcaagggattctcccacctcagcctcccaagtagctaggactacaggcaaatacctaaaaaaaaaaatcattctaccataaagactcacgcacacaaatgttcattatgcactattcacaatagcaa

SEQ ID NO: 13806 - DNA, 403 bp, Homo sapiens
  AF215846.2_68551
  Located on chromosome 8
  Distance between a terminus base of telomere on chromosomal short arm and 5'-terminus of this base sequence : 54801108
  Distance between 3'-terminus of neighbour sequence of sequence listing upward to telomere on chrosomal short arm and 5'-terminus of this base sequence : 72685
aaacagaactagcaagcctattacacagcatatacccaaaggaattgaaattagggtcttgaagaaatatctgtactctcatgttcatagcaacattattcacaatagccaggaagtgaaaacaacctaagtgtccataaatggacgaatggataaagaaaatgtgatctgtctatctgtctatctatctatctatctatctatctatctatctatctatctatctataaaatacatgactactattcagcctttaaaaagaaggaaatcatgctcttgcaataacatggatgaacctggagaacattacattaagcgaaataaaccagacacagagggaagaatactgcatgattccacttatgtgagggcttctaaagtagtcaaactcatagaagctgag

SEQ ID NO: 13807 - DNA, 440 bp, Homo sapiens
  AF198095.1_48034
  Located on chromosome 8
  Distance between a terminus base of telomere on chromosomal short arm and 5'-terminus of this base sequence : 54899847
  Distance between 3'-terminus of neighbour sequence of sequence listing upward to telomere on chrosomal short arm and 5'-terminus of this base sequence : 98336
gtatgaaatctgaccttatgctaatatttataaaatcactttaaaccaaaagttaatttctaagaagttgaaacagggaaataatatatttctaaaaatgtaaacatctctttctaaacaggaaaatattaatgacataagatttgggaagaaattgccatgtttgacataaacatttcaaaatagaaacactagaaatagaaaatttatctgggtgcagtggcacgtgtctgtagtcccagctactcaggaggctgaggtgggaggatcacttcagcctaggagttggcaaccagcctgggcaacatagcaagactttgtctcaaataaataaataaataaataaatagaaataggaagatttttagatagaggaaagaaatgccattgtacctgagatggcagtaaaagaagaaattagcactgtcaaattatcaaca

SEQ ID NO: 13808 - DNA, 440 bp, Homo sapiens; identical to SEQ ID NO: 13807
  AF128525.1_72486
  Located on chromosome 8
  Distance between a terminus base of telomere on chromosomal short arm and 5'-terminus of this base sequence : 54899847
  Distance between 3'-terminus of neighbour sequence of sequence listing upward to telomere on chrosomal short arm and 5'-terminus of this base sequence : -440

SEQ ID NO: 13809 - DNA, 163 bp, Homo sapiens
  AF128525.1_87306
  Located on chromosome 8
  Distance between a terminus base of telomere on chromosomal short arm and 5'-terminus of this base sequence : 54914942
  Distance between 3'-terminus of neighbour sequence of sequence listing upward to telomere on chrosomal short arm and 5'-terminus of this base sequence : 14655
atactctgatgttaggtgcacatatatttatgaataatatatatgtttttatatatatatatatatatatatatatatatatataaaacattaagtcctggtgaattaaccatattatcattatatagtacatttttttgtctcgtgacagttttggaattaa

SEQ ID NO: 13810 - DNA, 358 bp, Homo sapiens
  AF198095.1_33202
  Located on chromosome 8
  Distance between a terminus base of telomere on chromosomal short arm and 5'-terminus of this base sequence : 54914942
  Distance between 3'-terminus of neighbour sequence of sequence listing upward to telomere on chrosomal short arm and 5'-terminus of this base sequence : -163
atactctgatgttaggtgcacatatatttatgaataatatatatgtttttatatatatatatatatatatatatatatatatataaaacattaagtcctggtgaattaaccatattatcattatatagtacatttttttgtctcgtgacagttttggaattaaactctattttgtctgatataaatatggccactgtctccctctttaggttcccatttacatagaatttctatcttttcactttcaacctatgtatatactgagatgtatgtattgttcttggcttaccgcaagcctctggatcctgggctcaaacttcatattttcatatgacttcatgttgctatctagtgtcct

SEQ ID NO: 13811 - DNA, 277 bp, Homo sapiens
  D8S509
  Located on chromosome 8
  Distance between a terminus base of telomere on chromosomal short arm and 5'-terminus of this base sequence : 54925696
  Distance between 3'-terminus of neighbour sequence of sequence listing upward to telomere on chrosomal short arm and 5'-terminus of this base sequence : 10396
tgtgaggtcccaatggtaccagcacacgtagtcaggtacattaaaagagagaaatttgcaaattaggaaactatgatcttatattttctatttttattttttgatttgtgtgtgtgtgtgtgtgtgtgtgtgtgtgtgtgtgtgtgtatgtatatatgtatattatttaatcaacttttaagttccagggtaaatgtgcaggtttgttacacaggtaaacgtgtgccatggtggtttgctgtacagatcaacccttcacctaggcattaagcccagc

SEQ ID NO: 13812 - DNA, 239 bp, Homo sapiens
  Z67248
  Located on chromosome 8
  Distance between a terminus base of telomere on chromosomal short arm and 5'-terminus of this base sequence : 54979090
  Distance between 3'-terminus of neighbour sequence of sequence listing upward to telomere on chrosomal short arm and 5'-terminus of this base sequence : 53117
cctgtgaacatttcaaagacatttctgtaatgtagaagtgtgtgtgtgtgtgtgtgtgtgtctcctatataaaatgaacctctggtcttttagaatgcctgtaagttaataatgcttattgtaacaatcaaaggaaatatttttgctcacatatcttattcaagcaaggaaagttgtagaaaaatttgctttctttaaagacagtttattttaggccatgggtttgaaactggccctat

SEQ ID NO: 13813 - DNA, 158 bp, Homo sapiens
  D8S566
  Located on chromosome 8
  Distance between a terminus base of telomere on chromosomal short arm and 5'-terminus of this base sequence : 55051903
  Distance between 3'-terminus of neighbour sequence of sequence listing upward to telomere on chrosomal short arm and 5'-terminus of this base sequence : 72574
atgcagaaccaccagaatgtgtgtgcatctctatctacctgtctgtctgtctatctatctatctatctatctatctatctatctatctatctatctatttatctatctctatctatctatcatgagagatttattttaaggaattggctcacaattcc

SEQ ID NO: 13814 - DNA, 404 bp, Homo sapiens
  HUMUT7463B
  Located on chromosome 8
  Distance between a terminus base of telomere on chromosomal short arm and 5'-terminus of this base sequence : 55056987
  Distance between 3'-terminus of neighbour sequence of sequence listing upward to telomere on chrosomal short arm and 5'-terminus of this base sequence : 4926
attctactggttctcaggcataacagcagattctcattcacatgattccagatatctctctctcttctatgtatctatgtatccatgtatctatctatcatctatctatctatctatctatctatctatctatctatctatctatctctccgtcttctatcatttatctattgaattaaaaagtaaaggaagcaggaatgatattcttgagactcctctgaagattccagcagctcgctgctatagttatttcaggttcttaaatgcctgtggtaactcattcttactaatccatctggccaacagattttattggtattaacacttctgtgccacaagtcaaaatttagtttctgctctcattttctgtaagaatcttattgtggataatggtgaggaggtgt

SEQ ID NO: 13815 - DNA, 195 bp, Homo sapiens
  D8S593
  Located on chromosome 8
  Distance between a terminus base of telomere on chromosomal short arm and 5'-terminus of this base sequence : 55057010
  Distance between 3'-terminus of neighbour sequence of sequence listing upward to telomere on chrosomal short arm and 5'-terminus of this base sequence : -381
cagcagattctcattcacatgattccagatatctctctctcttctatgtatctatgtatccatgtatctatctatcatctatctatctatctatctatctatctatctatctatctatctatctctccgtcttctatcatttatctattgaattaaaaagtaaaggaagcaggaatgatattcttgagactcctc

SEQ ID NO: 13816 - DNA, 474 bp, Homo sapiens
  AC022679.3_20183
  Located on chromosome 8
  Distance between a terminus base of telomere on chromosomal short arm and 5'-terminus of this base sequence : 55375430
  Distance between 3'-terminus of neighbour sequence of sequence listing upward to telomere on chrosomal short arm and 5'-terminus of this base sequence : 318225
gaacataatctattgacctttcacggccttgctactccaagtttgacctcaccttcttgttagaaatgcagactcttgcggtggctcacgtctgtaatcccagcactttgggaggccaaggtgggcggatcacctgaggtcgggagtttgagaccagcttgaccgacgtggagaaaccccatctctactaaaaacacaaaattagccaggcatgatggtgcacgccggtaatcccagctactcaggaggctgaggcaggagaatcacttgaacccgggaggcggaggttgaggtgagctgagatcacaccattgcactccagcctgggcaacaagagcgaaatggctgtctcaaaaacaacaacaacaacaacaacaaatgcagactcttgagccacgcctcaaatccattacatcacaatcagattttgcattttaatgtgttcctcaggtgattcatatgcactttaaactt

SEQ ID NO: 13817 - DNA, 453 bp, Homo sapiens
  chr8.fa.O7frz.62220691
  Located on chromosome 8
  Distance between a terminus base of telomere on chromosomal short arm and 5'-terminus of this base sequence : 55559445
  Distance between 3'-terminus of neighbour sequence of sequence listing upward to telomere on chrosomal short arm and 5'-terminus of this base sequence : 183541
ctggtcacggacatatgacaacatgctccagtcagggacagcagctccctttgcaaaggagtatttttgttgttgttgttttgttttgttttgtttgtttgtttttcaagttctttagaaaaacatcagttgaatggaagggaaccccgtgatcagagtttttcagaggcttttcttttaataaattccctaatccagaatcatattttagagatagaaatagaagagagaatgtgtgtgtgtgtgtgtgtgtgtgtgtacatacacacatatacatacatttcaacacatatttaatgaaccatgcaaaaggaaaacaaagtaattacaactgtggtgagctatgaagaatatagacatggcgctactacataaagaagaacagaaggaggccagcagtagattgcctcctcattttgtagaagcgggtgaaggtcttattaaattccttaa

SEQ ID NO: 13818 - DNA, 424 bp, Homo sapiens
  AF235101.2_9933
  Located on chromosome 8
  Distance between a terminus base of telomere on chromosomal short arm and 5'-terminus of this base sequence : 55579156
  Distance between 3'-terminus of neighbour sequence of sequence listing upward to telomere on chrosomal short arm and 5'-terminus of this base sequence : 19258
tctaagtgacgagcagattaattgatttatctctgtgctgagtctcctcgtctgcaaaatgggaacgaggacagcaagtgtgggagcccatgtgtaaagcactgagctcagtgcatgcctctagcaagtgggggccgagcaggtgagagaagaataacacacacacacacacacacacacacacataaacacactgctctccctctttggggccacgttcattgtgtggaattgagtgaggtcagagctggaatttactggcttgggatggctttctgcagctactcagccagttattcagcgcaaacctggttgcctatgagccacaggagatcttttgggaagatattaatttgaaacatgagagaaaaaatgaccaagaaaaccaatgacagtgttgaattacagtttatcaaataaggca

SEQ ID NO: 13819 - DNA, 387 bp, Homo sapiens
  chr8.fa.O7frz.62330829
  Located on chromosome 8
  Distance between a terminus base of telomere on chromosomal short arm and 5'-terminus of this base sequence : 55675416
  Distance between 3'-terminus of neighbour sequence of sequence listing upward to telomere on chrosomal short arm and 5'-terminus of this base sequence : 95836
agacatcaacttcaatccattaaatgtgaaaactaatcttttttctcacaagctcatctgtatcatatgtgtggagatatttcctacagttctgggaaagtataggattcctaaaactggtggccatattttaatgatgttagaggcagtctgcactgagtgcatatcattaattctaataaatgagtcatcaaaagtcattatatttctttctattttctcatctctcaccctctctctctctctctctgtctctctgtctctacctctctctccatacccctctccatacacacacacaaacacacactcacacacacacacacacacacacacacagagagagagagagagacggacccacaaatatacctggtgtaacaggca

SEQ ID NO: 13820 - DNA, 406 bp, Homo sapiens
  AF254980.2_18816
  Located on chromosome 8
  Distance between a terminus base of telomere on chromosomal short arm and 5'-terminus of this base sequence : 55828421
  Distance between 3'-terminus of neighbour sequence of sequence listing upward to telomere on chrosomal short arm and 5'-terminus of this base sequence : 152618
gctccactatgtattcaattaagtgataaatataaattaacctgatgccatgtctcttgtattttatatgtgtatgctgttttcatccaattaagcagactgaaaaaaaactaaaccccattacttactttggcattttgacaagatagagagagaggaaaagaaagagggagggagagagggagggaaggaagaaggaaggaaggaaggaaggaaggaaggaaggaaggaaggaaggaaggaaggaaggaaggaaggagatttaacaagtctttgaagtgatattttcaaattataaggtaattctgtttcactgccataatttttccctaaattttatttaatatcttgcaggtcacaaactttaatatttaagaggattattaaaccactagcttgaacaatc

SEQ ID NO: 13821 - DNA, 271 bp, Homo sapiens
  chr8.fa.O7frz.62681686
  Located on chromosome 8
  Distance between a terminus base of telomere on chromosomal short arm and 5'-terminus of this base sequence : 55999137
  Distance between 3'-terminus of neighbour sequence of sequence listing upward to telomere on chrosomal short arm and 5'-terminus of this base sequence : 170310
attgtcctaatcttgtcctttatcacgttttttttttccttccagtataggatcatgtatcattgcgtttatttttcaagttctttagttgcctttaatgtggaatgtttccttagccttttttgtctttcatgactgacatttttcaaaggatcaatggccatttattttataggatgcccttcaatttgggggggtgtgtgtgtgtgtgtgtgtatttttaaaatttcagacttgggtttaatctgtatttgtagcacgttaggataga

SEQ ID NO: 13822 - DNA, 242 bp, Homo sapiens
  DID22N_0031612
  Located on chromosome 8
  Distance between a terminus base of telomere on chromosomal short arm and 5'-terminus of this base sequence : 56090269
  Distance between 3'-terminus of neighbour sequence of sequence listing upward to telomere on chrosomal short arm and 5'-terminus of this base sequence : 90861
tctgacacttagtagctatcaatggatcataacttttaactaataattaaattcatatcttctctctctctctctctctctcaccagttctaatgtttttcaaaagtctggatatattttatcccagatttgtattgctgaaaaagacctcaaggtcatgctctcattgtatagataggaacactgaggcaaacaggaatgagtaccttgctcagttttcttcacagcaatggcagctctaa

SEQ ID NO: 13823 - DNA, 198 bp, Homo sapiens
  D8S1828
  Located on chromosome 8
  Distance between a terminus base of telomere on chromosomal short arm and 5'-terminus of this base sequence : 56136925
  Distance between 3'-terminus of neighbour sequence of sequence listing upward to telomere on chrosomal short arm and 5'-terminus of this base sequence : 46414
agtgctgtttttacttctgtacgtctttatatttaaaagaatgagcatcccatatatacataaatatatatataaatcccacatataaatatatacataaatcccatataaaaatataaatatatatatatatacacacacacacacacacacacacacatatatatatattttttttttcctgagacagagtcttgc

SEQ ID NO: 13824 - DNA, 191 bp, Homo sapiens
  DID22N_0031615
  Located on chromosome 8
  Distance between a terminus base of telomere on chromosomal short arm and 5'-terminus of this base sequence : 56188868
  Distance between 3'-terminus of neighbour sequence of sequence listing upward to telomere on chrosomal short arm and 5'-terminus of this base sequence : 51745
tcctgtcttggatgtcaccaccccacccacatccacctgctttttgtttccgtccttccttttcccaagagaagagagagagagagagagagagagaacgctggagcgagcagcgagggcaggggaactgcaggaacgcagtgggggggggacaggggattccctgtgccctggttgtggcacagctcagt

SEQ ID NO: 13825 - DNA, 352 bp, Homo sapiens
  AF191070.1_14437
  Located on chromosome 8
  Distance between a terminus base of telomere on chromosomal short arm and 5'-terminus of this base sequence : 56389397
  Distance between 3'-terminus of neighbour sequence of sequence listing upward to telomere on chrosomal short arm and 5'-terminus of this base sequence : 200338
gccttactagagaaggtaaatgaggataataaaatatgctctgtcttttataaggctgaaagaagataatggctgggagagttttgtaaatcataaagaactacacatgtaacaaatattgttcattctgccactgggtctgtggacatgcctaagttgttgttctctgacttcaattatacatttctgggcagatcagatctattatctattaattatctatctatcaatcaatcatcaatctatccattatctatctatccattatctatctatctatctatctatctatctatctatctatctatctatcatctagattatgattctaaccaatttagtcattagcagt

SEQ ID NO: 13826 - DNA, 223 bp, Homo sapiens
  G10152
  Located on chromosome 8
  Distance between a terminus base of telomere on chromosomal short arm and 5'-terminus of this base sequence : 56389533
  Distance between 3'-terminus of neighbour sequence of sequence listing upward to telomere on chrosomal short arm and 5'-terminus of this base sequence : -216
ggtctgtggacatgcctaagttgttgttctctgacttcaattatacatttctgggcagatcagatctattatctattaattatctatctatcaatcaatcatcaatctatccattatctatctatccattatctatctatctatctatctatctatctatctatctatctatctatcatctagattatgattctaaccaatttagtcattagcagtgggctgt

SEQ ID NO: 13827 - DNA, 215 bp, Homo sapiens
  AF191070.1_31413
  Located on chromosome 8
  Distance between a terminus base of telomere on chromosomal short arm and 5'-terminus of this base sequence : 56406551
  Distance between 3'-terminus of neighbour sequence of sequence listing upward to telomere on chrosomal short arm and 5'-terminus of this base sequence : 16795
gaagacaggatgaaagtttgttataaagttaatcatagacttatatgacctaggcatcacacagaatctttgctacctacaaagattacacacacacacacacacacacacacacacacacacacacacacaaaatccttcattcctattgtatgtaaaggccataaacccataaaaactgggaactttttctgagaattaacagattccatacg

SEQ ID NO: 13828 - DNA, 120 bp, Homo sapiens
  D8S285
  Located on chromosome 8
  Distance between a terminus base of telomere on chromosomal short arm and 5'-terminus of this base sequence : 56406604
  Distance between 3'-terminus of neighbour sequence of sequence listing upward to telomere on chrosomal short arm and 5'-terminus of this base sequence : -162
gcatcacacagaatctttgctacctacaaagattacacacacacacacacacacacacacacacacacacacacacacaaaatccttcattcctattgtatgtaaaggccataaacccat

SEQ ID NO: 13829 - DNA, 227 bp, Homo sapiens
  chr8.fa.O7frz.63906034
  Located on chromosome 8
  Distance between a terminus base of telomere on chromosomal short arm and 5'-terminus of this base sequence : 56497704
  Distance between 3'-terminus of neighbour sequence of sequence listing upward to telomere on chrosomal short arm and 5'-terminus of this base sequence : 90980
tctaactcatgttaaactttggacttttatggggtatgagtctcctttgcaaataagtctttattttgtgtcaacatatattttaactcaaagaaatgttatagttgcttccttctgatgattcctaagacacacacacgtgcatgcacacacacacacacacacacacacaaagaaactgacaccattttctttcctcacccttctttactggttcctccaaatac

SEQ ID NO: 13830 - DNA, 413 bp, Homo sapiens
  AC032027.3_148794
  Located on chromosome 8
  Distance between a terminus base of telomere on chromosomal short arm and 5'-terminus of this base sequence : 56573641
  Distance between 3'-terminus of neighbour sequence of sequence listing upward to telomere on chrosomal short arm and 5'-terminus of this base sequence : 75710
ttctagtttatgaagtcagaagcttagattattaatgttagtcttttttctaacagtaatttaaagctttacattttgctttatgctctgctctacttatgtctcacatgttttgatatattgtgctttcttatcattcagtttgaaatttttttaatgtttcttgtgattatttgacccatgtgttattaaggtgtgtgtgtgtgtgtgtgtgtgtgtgtgtaacgttctagtgtttggatatattccatgtatcttttggttattgatttttaacttgaatctggtatagtcagaaaacattgcctgtttaatttcaatcttcttaaatttagtgaaaattttatttctttcttcattattttaatgtttcctttagactgctaattctgtcacctatgtcattcttagtc

SEQ ID NO: 13831 - DNA, 295 bp, Homo sapiens
  chr8.fa.O7frz.63802725
  Located on chromosome 8
  Distance between a terminus base of telomere on chromosomal short arm and 5'-terminus of this base sequence : 56583936
  Distance between 3'-terminus of neighbour sequence of sequence listing upward to telomere on chrosomal short arm and 5'-terminus of this base sequence : 9882
cagcttcaaaatggactatctatctatctatcaagatatattctagatccataacccatgagcttatcccttctgtgtacacacacacacaggtgcacacacacacacacacacaaacacacatatatatatagatatatgtagatatctgtatcccagttccatctgagattttcattagaatggcctttactgaccatatttctatctgcattttggtatgaccacttaaccaatctctaaggaattccaaactttccctagtcttcttgccttctaaggatctttccagaac

SEQ ID NO: 13832 - DNA, 147 bp, Homo sapiens
  D8S1816
  Located on chromosome 8
  Distance between a terminus base of telomere on chromosomal short arm and 5'-terminus of this base sequence : 56684602
  Distance between 3'-terminus of neighbour sequence of sequence listing upward to telomere on chrosomal short arm and 5'-terminus of this base sequence : 100371
acttgcgaacctgggatcacctaagaactttaaacgcataatcaggagcgggaggctgaggtaggtgtgtgtgtgtgtgtgtgtgtgtttgtgtgtgtgtgtgtgtgtttggaatgaccacatcacgcgatgctttttaagggtgca

SEQ ID NO: 13833 - DNA, 195 bp, Homo sapiens
  D8S1102
  Located on chromosome 8
  Distance between a terminus base of telomere on chromosomal short arm and 5'-terminus of this base sequence : 56734235
  Distance between 3'-terminus of neighbour sequence of sequence listing upward to telomere on chrosomal short arm and 5'-terminus of this base sequence : 49486
aggcaagagaaaaaagtgaggcacatctgttccatcccctgctgtctatctctaccctctattctataggttgaaataagagaggctagaaataagatgttgatcttcaattatatttttcattcattcattcattcattcattcattcatttcccatgggaaagattgaggccaagcaggtgaaacaaggtgaa

SEQ ID NO: 13834 - DNA, 398 bp, Homo sapiens
  chr8.fa.O7frz.63508936
  Located on chromosome 8
  Distance between a terminus base of telomere on chromosomal short arm and 5'-terminus of this base sequence : 56953898
  Distance between 3'-terminus of neighbour sequence of sequence listing upward to telomere on chrosomal short arm and 5'-terminus of this base sequence : 219468
tgagtttctacagtgagcaaacaaaataatgcatagttcaaagcactttgtaaactatgaaggattatacaaatgtcaggtattattattacagagcaattttgtctttttctttgaaatgttttttaaatccctgataatgtaaagatgtgggtccatcatgtcataatgtaagaactctgttcatttctctgtaacttaattttgtaaattttctttctttttgaataccccaaactgccccctcccctaaatacacacacacacacacacacacacacacacacacagcccaaagggctactaaatactaaaaatttaaaaagtaattctgctactaaatactaaaaatcaaaaatgattatattaaaacaacctaacattgcatagctaccaaa

SEQ ID NO: 13835 - DNA, 328 bp, Homo sapiens
  chr8.fa.O7frz.63615180
  Located on chromosome 8
  Distance between a terminus base of telomere on chromosomal short arm and 5'-terminus of this base sequence : 57053529
  Distance between 3'-terminus of neighbour sequence of sequence listing upward to telomere on chrosomal short arm and 5'-terminus of this base sequence : 99233
gagtagaaagtaactgcctcaacctgataaaaacacctaccaaaaaaatttattacatctaccaacatacttaatgatgatggaaagagtgctatctctccatgatcattaacaaaagaaagatatctattctttgcacttatattcaacattgtggtggaggttccagccagttcaattaggcaaaaggagaaaggaaggaaagaaggaaggaaggaaggaaggaaggaaggaaggaaggaaggaaggaaggaaggaaggaaggaagggcaggcatccatattgaagagaaagaaacaaaattgtctttatttgcaaatgacataat

SEQ ID NO: 13836 - DNA, 190 bp, Homo sapiens
  DISD22_0005730
  Located on chromosome 8
  Distance between a terminus base of telomere on chromosomal short arm and 5'-terminus of this base sequence : 57157035
  Distance between 3'-terminus of neighbour sequence of sequence listing upward to telomere on chrosomal short arm and 5'-terminus of this base sequence : 103178
gatgcaacatcacttatgctgagagaagacggagaaggaggaaggaaggaagaagagagagaggaagaagaaggagaagaagaggaggaggaagagggagggaggaggagaaggaggaggaggatgagaaggaggcagaaggagaaggagaaggagaaggagaaggaacaactagtagttagccagccaa

SEQ ID NO: 13837 - DNA, 439 bp, Homo sapiens
  chr8.fa.O7frz.64210554
  Located on chromosome 8
  Distance between a terminus base of telomere on chromosomal short arm and 5'-terminus of this base sequence : 57297764
  Distance between 3'-terminus of neighbour sequence of sequence listing upward to telomere on chrosomal short arm and 5'-terminus of this base sequence : 140539
cctttaaggaatcaaatttgacttataaagcccataaaagtcccttgggaaaattggccgaattcattgtctacacagtccctgtatggggtttctcacctgtagtaagtaaagaatgtcactttctgacaagtccaggagcctcaagttatcttgggacatcaaaataagaggaatttatccaattcatacaggtatttgatggcacaaacccatggctgggcttaaggctctagaaagtcttgtctgagattccttatgaaaggatggttcatcaaagccaatttaaaaaggagtatatatatatatatatatatatatatatatatatatatatatatgcagataattattcttgctgttctttttgcaaataatcaggccacatataataagactagagcttattatgtagagaaatcagtcctatcataacttg

SEQ ID NO: 13838 - DNA, 404 bp, Homo sapiens
  chr8.fa.O7frz.64119836
  Located on chromosome 8
  Distance between a terminus base of telomere on chromosomal short arm and 5'-terminus of this base sequence : 57369536
  Distance between 3'-terminus of neighbour sequence of sequence listing upward to telomere on chrosomal short arm and 5'-terminus of this base sequence : 71333
gaaagcagacctgaaataagaccccccaacagctatttctccttcagcgctctccaggctgtataggaccagtcagtcactgcacaaccccacatggccttggggaacaagcttaccctgctggaatatgctttaaagatgtggccatgtaacactcatctgggccagtgggccttcacacacacacacacacacacacacacacacacacacacacacacacacacacacacccctgggaagcaaaaactgctttgttcaggaaaggcaaaaatgcatttataacccaattccaatgtcagctacttggagcataaaatgaggtcacattctctagcatttgggattacatcatctctttcaagggaatctcggggtcctccttctaaataactccaagagcc

SEQ ID NO: 13839 - DNA, 311 bp, Homo sapiens
  chr8.fa.O7frz.64466039
  Located on chromosome 8
  Distance between a terminus base of telomere on chromosomal short arm and 5'-terminus of this base sequence : 57531416
  Distance between 3'-terminus of neighbour sequence of sequence listing upward to telomere on chrosomal short arm and 5'-terminus of this base sequence : 161476
ttcagtccaatttcactgataggagaatgaatatttagagaggtgaggtctttctcctaatacattgcactataatcagaaaacaaagggtagaaaaaaggaaggaaggaaggaaggaaggaaggaaggagggaaggaaggaaggaaggaagggcaggcgggcacgccaagatttcttccactcccaaagataaagaaatttttctttttcacagtatttctaaggtgccaatttaaaatattgtttttagatcacctgtaagttagaggtagctgagattgtgttagatctgtttatagatcaaatgcag

SEQ ID NO: 13840 - DNA, 449 bp, Homo sapiens
  chr8.fa.O7frz.64683106
  Located on chromosome 8
  Distance between a terminus base of telomere on chromosomal short arm and 5'-terminus of this base sequence : 57802800
  Distance between 3'-terminus of neighbour sequence of sequence listing upward to telomere on chrosomal short arm and 5'-terminus of this base sequence : 271073
gtttagcatgtttgcagaatacctacatacaaatatcaattatattttatatactctcaataaataataagaattgaacatttttaaaagcaataaaatgtataataacaccaaagagatacttaagtgtaactaatataacataggcatgatttttctgctgaaaaccacatacaaataataatgaaagaaatcagagacttaaataataaagatataccatgttcatggtttgaatcatggaatattatcaagttgttgtgtcactcagggtacaaacagagaagcaaaatcagaaggagaaagattggaagatcagatagatagatagatagatagatagatagatagatagatagatagatgatagatagatagacagacagatagacagacagatagaaacaaccacaataacaacaattgccttatgcagaagtctgaaatcc

SEQ ID NO: 13841 - DNA, 292 bp, Homo sapiens
  chr8.fa.O7frz.64763607
  Located on chromosome 8
  Distance between a terminus base of telomere on chromosomal short arm and 5'-terminus of this base sequence : 57827694
  Distance between 3'-terminus of neighbour sequence of sequence listing upward to telomere on chrosomal short arm and 5'-terminus of this base sequence : 24445
ttgtatctggatgtctacctctagcaagattcgggaaattttcttgaattattcccacaaatatgtttccaggttgtttacattttctctttctctccaagaatgccaataattcataggtttgattgctttacataatcccatatttctcaagactttattttaaaaaattattattattattattattatttgttgttgttgttggactgggttagtttgaaggtctggtgttccatctctgaaacactttcttttgcttattctagtctactgataaagctttcaattg

SEQ ID NO: 13842 - DNA, 163 bp, Homo sapiens
  D8S507
  Located on chromosome 8
  Distance between a terminus base of telomere on chromosomal short arm and 5'-terminus of this base sequence : 58088087
  Distance between 3'-terminus of neighbour sequence of sequence listing upward to telomere on chrosomal short arm and 5'-terminus of this base sequence : 260101
taatcttgccccagtgagaggggcaagaaacaacaaaaagccctgtcccctattccttctgccttttctgttagatgttactttaaaaatatgtgtgtgtgtgtgtgtgtgtgtgtgtgtgtgtgtgtgtgtgtacatcaatactttgaactgctctgaggaa

SEQ ID NO: 13843 - DNA, 441 bp, Homo sapiens
  chr8.fa.O7frz.65163585
  Located on chromosome 8
  Distance between a terminus base of telomere on chromosomal short arm and 5'-terminus of this base sequence : 58259402
  Distance between 3'-terminus of neighbour sequence of sequence listing upward to telomere on chrosomal short arm and 5'-terminus of this base sequence : 171152
gtaagctcaggagttcaagaacagcctgggaaatgcggagaggtcttgcctctacaaaaagtacaaaggttagccaggtgtggtggcacacacctgtagtcccacctactcaggaggctgaggtgggaggattgcttgagcctgggaggcagagtttgtagtgagccatgatcacaccactgcattctagcctgggcaatagagtgcaaccccatctcaaaataaataaataaataaataaaataataaaaaataaacctgcagacagactccacaaataaaaactgttagaactaataaacaaagttgcacaagaatcagtagcatttctgtataataatgtatactaacaacaaactatctgaaaagaaatgaagagtcaatcccatttacaatagatagcaaaaaaagaaaatgcttaggaataaatttaaccaagga

SEQ ID NO: 13844 - DNA, 234 bp, Homo sapiens
  AC020782.5_143508
  Located on chromosome 8
  Distance between a terminus base of telomere on chromosomal short arm and 5'-terminus of this base sequence : 58299673
  Distance between 3'-terminus of neighbour sequence of sequence listing upward to telomere on chrosomal short arm and 5'-terminus of this base sequence : 39830
ttgtgaccgtctgttagactagtggcctcccaattaactgcacctctacttcacacccttttttaaaatctggtctgggcatgtgacttgtttagtaagtagagggcatactccagctctcttctggtgagacgaaatcatcatcatcatcatcatcatcatcatcatcatcatcatcaatagagggcagtagaagggaagctgcgacaattctggacttaagtcttcagaagg

SEQ ID NO: 13845 - DNA, 239 bp, Homo sapiens
  D8S1723
  Located on chromosome 8
  Distance between a terminus base of telomere on chromosomal short arm and 5'-terminus of this base sequence : 58381522
  Distance between 3'-terminus of neighbour sequence of sequence listing upward to telomere on chrosomal short arm and 5'-terminus of this base sequence : 81615
agctcaatggcacgtcctttgcctgcttttctcttctctttttttcggctggtaaagttttatttattctctttctctatgtctctgtctcaccatctttctctctgtgtgtctctcttgtttctctgtctctctctgtgtctcactctctctgtctctctctgtctgtgtcacacacacacacacacacacacacacatgctgtacctctactacatgccaggctctgagtcagcagt

SEQ ID NO: 13846 - DNA, 240 bp, Homo sapiens
  D8S1113
  Located on chromosome 8
  Distance between a terminus base of telomere on chromosomal short arm and 5'-terminus of this base sequence : 58671661
  Distance between 3'-terminus of neighbour sequence of sequence listing upward to telomere on chrosomal short arm and 5'-terminus of this base sequence : 289900
ccctggactcatggtacttgctgttttcaaatctcttcctttttcatttctcttcctccctcctttttatgtaaaatatctcctgaaactcaaaattatccgtctcctctccctcccttccttcctccctcccttccttccttccttccttccttccttccttccttccttccttccttccgaggaattcagctctttctagctttcaccctaagctcagttcctggttcatctttgcat

SEQ ID NO: 13847 - DNA, 302 bp, Homo sapiens
  chr8.fa.O7frz.65742361
  Located on chromosome 8
  Distance between a terminus base of telomere on chromosomal short arm and 5'-terminus of this base sequence : 58798451
  Distance between 3'-terminus of neighbour sequence of sequence listing upward to telomere on chrosomal short arm and 5'-terminus of this base sequence : 126550
tatgaactgtgacctttcctatagcctttaatttttaaatgactttttaatttattatagataggtgttacacacacacaaacacacacatatatatgtgtatatacatatatataaaaaacaccagatatatatgtgttattcaacaatactaagggcatgccttcttctctcttctagatgtgtggaacacagcaggattaggcagccaagaccaccacctctcacggtgcttctagtctagcagtgggaggtggccaatcaactacttgaataaactagatgatttcaggaagtaacaa

SEQ ID NO: 13848 - DNA, 165 bp, Homo sapiens
  D8S1763
  Located on chromosome 8
  Distance between a terminus base of telomere on chromosomal short arm and 5'-terminus of this base sequence : 58827541
  Distance between 3'-terminus of neighbour sequence of sequence listing upward to telomere on chrosomal short arm and 5'-terminus of this base sequence : 28788
ttccattcacggagtaaaagttgttttcaagagaaaaatgcagaaatagtaaaacttttgaggaggttaagataaactttgtgtgtgtgtgtgtgtgtgtgtgtgtgtgtgtgaagaatttgaagaattatgtaagcacacacctgtagataaaggctttcattg

SEQ ID NO: 13849 - DNA, 439 bp, Homo sapiens
  chr8.fa.O7frz.65863229
  Located on chromosome 8
  Distance between a terminus base of telomere on chromosomal short arm and 5'-terminus of this base sequence : 59038917
  Distance between 3'-terminus of neighbour sequence of sequence listing upward to telomere on chrosomal short arm and 5'-terminus of this base sequence : 211211
ggtagttcaggaagaatcaaatcagaactgcctttagagccccaagctactcactgccttaggagctggtgctgcctctgggcttgggatggccccgcctctctgaccctcccactcccctcactggtcctttcttcctggctcctggctccttggctgaaaacaaaacaaaaaactgtgagcaggacacacccttgcttcaaagcctccattggccctcaggaaccaggtgaggtcaaaataagctttagcatcagttgggacctgtcacaatcctgtgctcccatcactcactggcagggagacctttgaccatcagcaggaggcacttcataaaagggactccgtgtgtgtgtgtgtgtgtgtgtgtgtgtgtgtgtgtgtacatgtgtaaaacattaaaggagctggcatcgggtgctttatttccatttcataa

SEQ ID NO: 13850 - DNA, 425 bp, Homo sapiens
  chr8.fa.O7frz.65938425
  Located on chromosome 8
  Distance between a terminus base of telomere on chromosomal short arm and 5'-terminus of this base sequence : 59106583
  Distance between 3'-terminus of neighbour sequence of sequence listing upward to telomere on chrosomal short arm and 5'-terminus of this base sequence : 67227
acaatgtatgacaaccgtagagactacaaacaatggcactggagccacggacttcatagttcacaactgcgcctgtacatattttattgtaggcattatatatttaaagcatgacaaatgtaccattgtacattatgtgctgcacaaatagaagctcctcccactcattcgccttttgcatttctcttgatgatggaaacatagttgagtttcatttttttctcttctcttaaaacactgaagattcctaaatcataaaggaaacacacacacacacacacacacacacacacatacacacacaaggttatcaaaagagtaacagaaaatagaaggcaataatacaagatgagaaaatgagatcttgttcacttaacattttggcttctctctgaggacacaaaagcaaggattaccttcaatac

SEQ ID NO: 13851 - DNA, 289 bp, Homo sapiens
  AC068394.2_81078
  Located on chromosome 8
  Distance between a terminus base of telomere on chromosomal short arm and 5'-terminus of this base sequence : 59188495
  Distance between 3'-terminus of neighbour sequence of sequence listing upward to telomere on chrosomal short arm and 5'-terminus of this base sequence : 81487
ctgcttttcctaggataaactaacaagtaaaatagcaagtagtagaattttaacaacattatatggaaaatatggcaacactggccaatatcagcagtttcattcacatgaattgcatgggattaaacttttgcaaagaaaaacttggcaggcaaagttgtcaaactctttccagaaatcgactgacagaaaacacacacacacacacacacacacacacacacacacacacccccacagtgaagaaaattctggtatcagtgatgtattcctaaacctcaaattacaa

SEQ ID NO: 13852 - DNA, 366 bp, Homo sapiens
  AC068394.2_129299
  Located on chromosome 8
  Distance between a terminus base of telomere on chromosomal short arm and 5'-terminus of this base sequence : 59297863
  Distance between 3'-terminus of neighbour sequence of sequence listing upward to telomere on chrosomal short arm and 5'-terminus of this base sequence : 109079
agatccttggtgttatcttgagttcactttctctttcctctcatctgggctatcaccagtcttgttgcttcttcctgtgtattgtattgtattgtattgtattgtattgtattgtattgtattgtattgcatttttctcttctaatttccatcttttttaccactgaatctgcattaacaagggatcttatcgcctctctctctattgttagaatttcttgtgtgatctcttggattctggtctttccctccagccccacctctatcctatttcgtgattactttttctaatgatcccccaaaccttaaaatattatgtattgcctgtgatagattggaatattgttcctaatttgtcactccttc

SEQ ID NO: 13853 - DNA, 463 bp, Homo sapiens
  AC068394.2_103520
  Located on chromosome 8
  Distance between a terminus base of telomere on chromosomal short arm and 5'-terminus of this base sequence : 59306602
  Distance between 3'-terminus of neighbour sequence of sequence listing upward to telomere on chrosomal short arm and 5'-terminus of this base sequence : 8373
ccatgtccagcttcatagagcttttaaaaatacattttatttgaaaataattatatacatataaaatttgtgaaaagtaagagtagcacaaaaatgcaaaaatatcaacagtacaaagattgcccatatacctttttctcaaataaaaatataccttttactcaacttacacaagttcaacttttacccaaaatattcttaacaacctatttccattttctttctttctttctttctttctttctttctttctttctttctttctttcttctttcttctttctttctttctttatttttttattgtgtgtgtgtgtgtgtgtgtgtattttctgggtttattttcagaatcatgtgagattaagatgattaaaataagattctttacccttaaagatttcaatgcatatttcttaagagtaggcgtattctattacataattgctataggattatcaatttga

SEQ ID NO: 13854 - DNA, 299 bp, Homo sapiens
  D8S1082
  Located on chromosome 8
  Distance between a terminus base of telomere on chromosomal short arm and 5'-terminus of this base sequence : 59386920
  Distance between 3'-terminus of neighbour sequence of sequence listing upward to telomere on chrosomal short arm and 5'-terminus of this base sequence : 79855
ttttgggagatcgaagaatggactctaaggcctactctgtgtgtgtgtgtgtgtgtgtgtgtgtgtgtgtgtccttagtgtagtggaattcttgtcccaaaatatacactggtagtaaaagaaccataatgggttaatctatactgttagattcaaacctactctatttcaaatcaatgagaatcttttctgtttttaaatgcctctgaaggagagtattttatcatgtcatcctttttaaaaagtattgattatctactaataactggacttgtacccattccctgtttgactataag

SEQ ID NO: 13855 - DNA, 132 bp, Homo sapiens
  DISD22_0005733
  Located on chromosome 8
  Distance between a terminus base of telomere on chromosomal short arm and 5'-terminus of this base sequence : 59603368
  Distance between 3'-terminus of neighbour sequence of sequence listing upward to telomere on chrosomal short arm and 5'-terminus of this base sequence : 216149
gagtgatgcatgtgtttgtagactatatatatatatatatatatatagactatatgtatatatatatatagactatatgtgtgtgtatatatatatatatatacatatatacaatctttcattgctagcctt

SEQ ID NO: 13856 - DNA, 454 bp, Homo sapiens
  chr8.fa.O7frz.66486039
  Located on chromosome 8
  Distance between a terminus base of telomere on chromosomal short arm and 5'-terminus of this base sequence : 59740377
  Distance between 3'-terminus of neighbour sequence of sequence listing upward to telomere on chrosomal short arm and 5'-terminus of this base sequence : 136877
tttctaatccatctgtcaataaagggaaccagggatccttaaagaaattgctgattctaggactaaggcagaaaatatacaagatgagcctggagcattttgaagtgccagaaagtaagaaagtgctcaacatacacacacacacacacacacacacacacacacacacacacacacccccatggggtatgtcaaaaggaggcatgattcaactgaaagagctcccatggccaaaggtggaaaaatttgtgcaacaaataaagtagtatgttttgattctaactcaaaacacaaaataaacgtaaatgagtccatgatgatataaataaataaatggagagaatggactaatctcccatgcaaaagaatttctaataatttatgtaaataccccaccctcaagtgggtggaacataactccccattccttgagtgtggtctatgcatagtgact

SEQ ID NO: 13857 - DNA, 393 bp, Homo sapiens
  chr8.fa.O7frz.66581009
  Located on chromosome 8
  Distance between a terminus base of telomere on chromosomal short arm and 5'-terminus of this base sequence : 59835250
  Distance between 3'-terminus of neighbour sequence of sequence listing upward to telomere on chrosomal short arm and 5'-terminus of this base sequence : 94419
catacttggttagtgcttattgtcaagaggtcaaaagaaattgtcaaaactctccttctctcttgacacattttagactcatcctaaggaatatgaaactggtatttcactagagttacgggaactcatactgtaggcaagtctatgcctgatggtctcatacacattttctttcttattcccaacaatagtctttcaatgtggacatacatcgatttccacagggccaattggaatctatgattcgtcatgaaaatctgattgtctctgacagacagtgcttacccagcagccttctcaaatggtggcagtattttctccctcggacccctagcaaaataaaaaaataaataaataaataaaaactgaatgtgaagtagttgtctggtttga

SEQ ID NO: 13858 - DNA, 337 bp, Homo sapiens
  AC022709.3_47623
  Located on chromosome 8
  Distance between a terminus base of telomere on chromosomal short arm and 5'-terminus of this base sequence : 59864822
  Distance between 3'-terminus of neighbour sequence of sequence listing upward to telomere on chrosomal short arm and 5'-terminus of this base sequence : 29179
tacctatgtatcaaacctgcatgttgtgcacaggtaccctagaacagaaagaaagagagaaagagagacagaaagagagaaagaaagaaagaatgagagagagagagagaagaaagaaagaaagaaagaaagaaagaaagaaagaaagaaagaaagaaagaaagaaagaaagaaagggagaaagagagaaagaaaagaaagaaagaaagaaagaaagaaaagaaagaaaagaaggaaggaaggaagggaagaaggaaggaaggaaggaaaagagaagagaagaccagtacaagacaaggatgccctctctcactgctcctgttcaacatagtattgg

SEQ ID NO: 13859 - DNA, 488 bp, Homo sapiens
  AC068668.2_74858
  Located on chromosome 8
  Distance between a terminus base of telomere on chromosomal short arm and 5'-terminus of this base sequence : 59901139
  Distance between 3'-terminus of neighbour sequence of sequence listing upward to telomere on chrosomal short arm and 5'-terminus of this base sequence : 35980
aacaaatagtgtcatttagcagatatatcacatttacccatgccaagctcaccagcttagccaaaattgctaagcgttttgttttgttttgttttgttttgttttgttttgttttgttttgttttttgacatggtcttgctctgtcgcccaggctatagtgcagtggaacaatcacagctcactgcagcctcgacctcctgggctcaagcaatcctcccacctcagcctcccaagcagctgcgagtacaggggcacaccaccatgctcagctaatttttgtgttttttatagagttgaggtctgtctatgttgcccagtctggtctcgaactcctgggctcaagcaatcttcccacttcagcatcccaaagtgccggaagtacaggcgtgagtcacattcccagccttgctaagcttgttgcaatagtttctgctaaacttattgtctgaatccacagtgatggctttaaggacctagcttagaactt

SEQ ID NO: 13860 - DNA, 354 bp, Homo sapiens
  chr8.fa.O7frz.66692740
  Located on chromosome 8
  Distance between a terminus base of telomere on chromosomal short arm and 5'-terminus of this base sequence : 59934066
  Distance between 3'-terminus of neighbour sequence of sequence listing upward to telomere on chrosomal short arm and 5'-terminus of this base sequence : 32439
gcacttgaactaggacttacatcattggtgcttttggttctcaggcctttggactcagactggaatttacaccagtggctttcctgggtctccagcttgcagacagcagatcctaggacttctcaacctccacaatcccatgagccaactccttataataaatctcacttatatgatatcatatatttgaaatatatcatatataatgaaatttatttctcaccgtgtgtgtgtgtgtgtgtgtgtgtgtgtgtgtgtctgtgtgtgtgcatgtgttgtgtctgtgagtgcatatctcctgttggttctgtttctctggagaaccttgactaacacatagactattaacggaca

SEQ ID NO: 13861 - DNA, 452 bp, Homo sapiens
  chr8.fa.O7frz.66808958
  Located on chromosome 8
  Distance between a terminus base of telomere on chromosomal short arm and 5'-terminus of this base sequence : 60050759
  Distance between 3'-terminus of neighbour sequence of sequence listing upward to telomere on chrosomal short arm and 5'-terminus of this base sequence : 116339
atacttttggacttggaattctaggaacttataatagacatataattatccaatcatacaaagagtctatgtgtaaggatattcactgcaaaaagaaactggaaacaaactaaatggcctccttctgggcaatgtcctttggaaaaaaagaaaaaataataaaacaaaatagcctcctttccttaataaattatattactatgcagtatttcagaattatgcatatatagtatatatgtatctgtggacacacctgcacacacacacactatatatatatatatatatacacacacacatttctacatatgcatacatatataaacatagatacatacaaatatatagaatgtctggaaaaatttattagaaaatatttataatgctgggttatgtatttccaaactatatattttttcctgctcccactctaccaggaccaaactacattt

SEQ ID NO: 13862 - DNA, 365 bp, Homo sapiens
  HUMUT8106B
  Located on chromosome 8
  Distance between a terminus base of telomere on chromosomal short arm and 5'-terminus of this base sequence : 60149541
  Distance between 3'-terminus of neighbour sequence of sequence listing upward to telomere on chrosomal short arm and 5'-terminus of this base sequence : 98330
cactgcactccagcctgagtgacagagtgagattccatctcaaaaaaagaagaaagaaagaaagaaagatagaaagaaagaaagaaagaaagaaagaaggaaggaaggaaggaaggaaggaaggaaggaaggaaggaaggaaggaaggaaggaaaaagaaagaaagagaaggaaagaaagaaagaaagaaggaaggaaggaaggaaggaaggaaggaaggaaggaaggaaagaaaaagaaagaaagaaagagaaggaaagaaagaaagaaagaaagaaggaaggaaggaaggaaaggaaagaaagaaagaaagaaaaagaaaagaaagaaagaagaaagtatgattcagacggtaggtggtggaa

SEQ ID NO: 13863 - DNA, 136 bp, Homo sapiens
  D8S1177
  Located on chromosome 8
  Distance between a terminus base of telomere on chromosomal short arm and 5'-terminus of this base sequence : 60195113
  Distance between 3'-terminus of neighbour sequence of sequence listing upward to telomere on chrosomal short arm and 5'-terminus of this base sequence : 45207
tgaaatcatgtgacccccccagatagtaatttgaaacaacacacacacacacacacacacacacacacacacacacacacaaaaccaggaaaagtaattaaataactataaaaggcaatctaaatgtttacttttt

SEQ ID NO: 13864 - DNA, 201 bp, Homo sapiens
  D8S260
  Located on chromosome 8
  Distance between a terminus base of telomere on chromosomal short arm and 5'-terminus of this base sequence : 60666596
  Distance between 3'-terminus of neighbour sequence of sequence listing upward to telomere on chrosomal short arm and 5'-terminus of this base sequence : 471347
gctgaaggctgttctatggacaaatatgtaaagggtctttgtgtgtgtgtgtgtgtgtgtgtgtgtgtgtgtgtgtgtgtgtaaagccaacagcctcacatttgttctttggtaatttgtcttcaatatgcctccccccgacccccatgatgaaaggtcaattatcagactcaaaaataagcaaccttatctggcaagcct

SEQ ID NO: 13865 - DNA, 408 bp, Homo sapiens
  chr8.fa.O7frz.124187027
  Located on chromosome 8
  Distance between a terminus base of telomere on chromosomal short arm and 5'-terminus of this base sequence : 60693033
  Distance between 3'-terminus of neighbour sequence of sequence listing upward to telomere on chrosomal short arm and 5'-terminus of this base sequence : 26236
agatggctaacttgttactgtaaggatgtaaatgtttttaaattaatccatgatttcaatgccatcataatcatgactatgaagtaaatttttgaggaactcaaattttattaccatgtatagggaagaataaaacacctaaatccatcttgaaaatagtagagtggatctttcacactataaaaaaaagcatagcataaagccatagtaataaaaaaggtgtgatattgatgcaagaacaaagaagctaatagaatattacacacacacacacacacacgaacttaatatgtaataatagtagcactacaaaccaataagggacagaatttttagtagctgataatgggaaaattgtctcactatggagaaaagtaagatcgcatgttgacataacacagatgaagg

SEQ ID NO: 13866 - DNA, 161 bp, Homo sapiens
  chr8.fa.O7frz.69273437
  Located on chromosome 8
  Distance between a terminus base of telomere on chromosomal short arm and 5'-terminus of this base sequence : 60890313
  Distance between 3'-terminus of neighbour sequence of sequence listing upward to telomere on chrosomal short arm and 5'-terminus of this base sequence : 196872
tgcaggtcagttctatttaaacttttcaaaattcatcattgtaagtaaaaaaaaaattgaggctgcaccagtgaacacacacacacacacacacacaatatatatgtagtcaatgattattattctcagaacacatattaccaaattcacctattagctaa

SEQ ID NO: 13867 - DNA, 408 bp, Homo sapiens
  chr8.fa.O7frz.69506975
  Located on chromosome 8
  Distance between a terminus base of telomere on chromosomal short arm and 5'-terminus of this base sequence : 61083482
  Distance between 3'-terminus of neighbour sequence of sequence listing upward to telomere on chrosomal short arm and 5'-terminus of this base sequence : 193008
acattcatctattgatggacacttgggttgctttcatattgtagttattgtgaataatactgctgtgatattattcatagcaatattatttatatatactctctgagatacatacatatatattgtggtgtgtgtgtgtgtgtgtgtgtgtgtgtgtgtgtgtgtgtggatgggtgtgtatttgagaccctgctttcaatattttggatatgtatccagaagtggaattgctggattttatgatactatcatttttaatgttttgatgaaccgcaatactgttttccacagtggctataccatttgcattctcaccagtagtgcataagggttctaatttattcacattctcatgccttcatttttcacacattcttaaaggaagtcaaaataagaactttgcattta

SEQ ID NO: 13868 - DNA, 543 bp, Homo sapiens
  chr8.fa.O7frz.69613039
  Located on chromosome 8
  Distance between a terminus base of telomere on chromosomal short arm and 5'-terminus of this base sequence : 61234893
  Distance between 3'-terminus of neighbour sequence of sequence listing upward to telomere on chrosomal short arm and 5'-terminus of this base sequence : 151003
taagaatattcttgcctgatgtacttgaccaaactcatatctaaccattcttccttttttccttcctttgtcccccaccttcctccctccctccatccatcccttctttccttccttcctccctccctccctccctttctcccacctatcctccctcccttccttctttacttccttccctctttccttttttccttcctccctcccacccatcctcactcccttccttctacccttcctccctcccttccttctttccttccttccctctttccttttttccttcctccctcccacctatcctccctcccttccttctatccttcctccctcccttccttctttccttccttccctctttccttttttccttcctccctcccacccatcctcactcccttctttcctccctcctttcctccctccctctctccctccctccttctgtctttccttccttctttcctttttccttccttcctttcttccttccttccttcttctttcccttcctctccccatcctctttcctttactcacttc

SEQ ID NO: 13869 - DNA, 445 bp, Homo sapiens
  AC022531.4_61404
  Located on chromosome 8
  Distance between a terminus base of telomere on chromosomal short arm and 5'-terminus of this base sequence : 61341534
  Distance between 3'-terminus of neighbour sequence of sequence listing upward to telomere on chrosomal short arm and 5'-terminus of this base sequence : 106098
gctaaacattaaatctgtgcaccttaaaacatccagtaacagtccaaactcattcattcatttattcatacaatattgattgaccatttatcttattccaaatcctggaataaaccctggtagtatagcagagaataaaacaaatttataccttggcgtaaggaaagatagtgtatccagtataaacattgaattactaatgtgagaagttctgtcaagtaaaaattctacttagtataaagagagcacatgcaacaggaaacattaaaaacatctattttcaatctcacacatagacacagacagacagacagacagacacacacacacacacacacacacacacacaaaaccataacgtattctctccccttacagagtctttttatatcaagaataaacactccaaagtctttatctattcttcagatagcatggttatttg

SEQ ID NO: 13870 - DNA, 424 bp, Homo sapiens
  AC022531.4_3754
  Located on chromosome 8
  Distance between a terminus base of telomere on chromosomal short arm and 5'-terminus of this base sequence : 61342752
  Distance between 3'-terminus of neighbour sequence of sequence listing upward to telomere on chrosomal short arm and 5'-terminus of this base sequence : 773
gttcactgtgcctttatgttagaagaacgcattttaaagaatgttcagaaaatcctacttagcccagaattcctatccccttatctgaatttcctcttctttatctctttgaccctggaattcaataaatttgaatattaattttgagattcaatcatcgagtcagatgagtttcccaataaagaaattgacaaagtctcagttggacctgaacgagccctgagaaaaattacatcatatctcagtttcctcagctgtaccaagggaagttcactggcattgggctccttggccaccgcactgaaaataaataaataaataaataaataaataaataaataaataaataaaattgcacatgttaaggaaaggaggtaagagggaaagaagactccttcaccttactgagtgtctttaagttcgg

SEQ ID NO: 13871 - DNA, 432 bp, Homo sapiens
  AC022525.4_103949
  Located on chromosome 8
  Distance between a terminus base of telomere on chromosomal short arm and 5'-terminus of this base sequence : 61451035
  Distance between 3'-terminus of neighbour sequence of sequence listing upward to telomere on chrosomal short arm and 5'-terminus of this base sequence : 107859
tgagcagtaaactatcaaccaccaatattctcaatagctgagagaatgagtacttggtcccgtatggggaatttgagtggcatgccactacacctactacactagccctacctttgcagtattctcattgtttctcctatccattaatgtaacagatatttattaggtacccaacctactggatgccagacatctgctgggtcttggcaacataaatttgaatataaagtgattctgcagtctaagcggaaaaaataccacctcttcaacacacacacacacacacacacacacacacacacacacacaaatagtggtgagtgctctaaaaatgatagacacaacatgctttggaaatgcaaaggagaaaatgtttgacttcctggggaaatttagtcagtcttcatgggagaaacatgagcctaacatatg

SEQ ID NO: 13872 - DNA, 251 bp, Homo sapiens
  chr8.fa.O7frz.70026568
  Located on chromosome 8
  Distance between a terminus base of telomere on chromosomal short arm and 5'-terminus of this base sequence : 61520493
  Distance between 3'-terminus of neighbour sequence of sequence listing upward to telomere on chrosomal short arm and 5'-terminus of this base sequence : 69026
gttatatttgttccagtgattcagtgtgaactggagaagtgaggggaagccggtgatgtttactgcagggtttgagctactccttgaatgtgtgtgtgtgtgtgtgcgtgcacacatatgcacatatgcacataactaactgtgtacacacaaggatatatataactgggaaggtaaaaatggaggccaatatccagaccctggaaatatccatgatcaaatggctggaatgataggaaagtatggaaagt

SEQ ID NO: 13873 - DNA, 267 bp, Homo sapiens
  D8S1696
  Located on chromosome 8
  Distance between a terminus base of telomere on chromosomal short arm and 5'-terminus of this base sequence : 61559892
  Distance between 3'-terminus of neighbour sequence of sequence listing upward to telomere on chrosomal short arm and 5'-terminus of this base sequence : 39148
ctgccctagaaggctaactaccccaagcctcactcaatgaacacacacacacacacacacacacacacacacaccagggaatgagagaattgataccttgtcacatctgtacccactcaggtcacaccacttcagatgctctgctggatgatgtggagcagtgaatggatttaatcttgggaatatgatcaaattcagttttctttgaacagcaattcatagaaagggaaaaggatttataaaagagatctcagtgagcaaatggca

SEQ ID NO: 13874 - DNA, 383 bp, Homo sapiens
  chr8.fa.O7frz.70096920
  Located on chromosome 8
  Distance between a terminus base of telomere on chromosomal short arm and 5'-terminus of this base sequence : 61591342
  Distance between 3'-terminus of neighbour sequence of sequence listing upward to telomere on chrosomal short arm and 5'-terminus of this base sequence : 31183
aaaggcttacagcttaggatagaataagtagagtcattgtcaaaagtgtggagaaaacagtgattggagatggggatctgtatgagtcagggttctccagagaaacagaaccagtagagaaagagagagagagagagagtgtgtgtgtgtgtgtgtgtgtgtgtgtgtgtgtgtgtgtgtgtgcttccccacacatgcgtgcatctgggggctggcagactggagacccaaggaagagatgcagctcaagtccaaagacagtctggaggcagactttcttctaactcaagagacctcagtcctttctcttaaggccttataccgattgcatgaggcccacccacattacagacggcaatctgctttactcaaagtctactgat

SEQ ID NO: 13875 - DNA, 223 bp, Homo sapiens
  DISD22_0005758
  Located on chromosome 8
  Distance between a terminus base of telomere on chromosomal short arm and 5'-terminus of this base sequence : 61748747
  Distance between 3'-terminus of neighbour sequence of sequence listing upward to telomere on chrosomal short arm and 5'-terminus of this base sequence : 157022
atggacatttggactctatccaaatatgaaaataacttcagatgtatacataacacatctatgtgtgcatatatatactatagcgagtataatatatagatagtatgtgttacatattataatcatatgtcatatagctattatacacaatgttatactaaaaaactgtgtgtgtgtgtgtgtgtgtgtgtgtatgtgttactgagagcatttcctagtcctc

SEQ ID NO: 13876 - DNA, 271 bp, Homo sapiens
  chr8.fa.O7frz.70521545
  Located on chromosome 8
  Distance between a terminus base of telomere on chromosomal short arm and 5'-terminus of this base sequence : 61886050
  Distance between 3'-terminus of neighbour sequence of sequence listing upward to telomere on chrosomal short arm and 5'-terminus of this base sequence : 137080
tttacaaagctttccagagttattttatgtatacagaagttaatacacacacacacacacacacacacacacacacacatttctgaaaacctgttggattgcaagtttttggatagttggagcttatattatttttcaagtaaaaataatatattcccaggcaatcaaaaactacagctcgtttgtccaattgttgtatatcaaggatagctgcatgaacaacctaaatattcaacacttagtgaactcatcatgagttcattacgttcat

SEQ ID NO: 13877 - DNA, 207 bp, Homo sapiens
  G09917
  Located on chromosome 8
  Distance between a terminus base of telomere on chromosomal short arm and 5'-terminus of this base sequence : 62089875
  Distance between 3'-terminus of neighbour sequence of sequence listing upward to telomere on chrosomal short arm and 5'-terminus of this base sequence : 203554
aactctcagaatcttggtgttcattaaatagatttctgtatctttcctgtacctatttaaatatgatctcatttccttcagctgcagatactggcaaggaaggaaggaaagaaagaaggaaagaaggaaggaaggaaggaaggaaggaaggaaggaagggaaataagaaaagtctgttgattttttctatcgaatgaccaagaggaa

SEQ ID NO: 13878 - DNA, 374 bp, Homo sapiens
  chr8.fa.O7frz.70899101
  Located on chromosome 8
  Distance between a terminus base of telomere on chromosomal short arm and 5'-terminus of this base sequence : 62245303
  Distance between 3'-terminus of neighbour sequence of sequence listing upward to telomere on chrosomal short arm and 5'-terminus of this base sequence : 155221
gtcacttgaaggaaatgatttaatcctaaaaaagagccacttaacaggcatatattatcaccattcaatagaaattaataaagtgttagtgtttacaacatttctcagtatatgcaaatggaagtgggattcattttaattggaatttgcattgcattagaattttcatccatatctgaaaagtatcatcagtagaaaagtgtgtgtgtatatgtgtgtacatctatctatctatctatctatctatctatctatctatctgtctgtctgtctgtctatctatctatctatctagctatctatagtgagagagagagagagaatatccctggacttcccattcccagtttgagtatcagcaagtgcatattaac

SEQ ID NO: 13879 - DNA, 439 bp, Homo sapiens
  chr8.fa.O7frz.70994349
  Located on chromosome 8
  Distance between a terminus base of telomere on chromosomal short arm and 5'-terminus of this base sequence : 62340409
  Distance between 3'-terminus of neighbour sequence of sequence listing upward to telomere on chrosomal short arm and 5'-terminus of this base sequence : 94732
ttctactggtaccagtttactgtagtaatccatttgcacgctactaataaagacatactcgagactgggcaatttacaaaagaagggtttattggacttatggttctacatggctggggaggcctcacaatcatggcagaagttgaaaggcacatctcacatggcagcagacaagagaagagagattgtgcagggaaactcccctttttaaaaccatcaaatctcgtgagactgactaacaatcatgagaacaacatgggaaaaacctgcccccatgattcaattacctccccccaggtccctcccacaacacgcaggaattcaagatgaaatttgggtgaggacacagccaaaccatatcacacacacacacacacacacacacattaagcattagtattcagagaactattctgggaccaatgtcctaggttacaat

SEQ ID NO: 13880 - DNA, 450 bp, Homo sapiens
  AC027017.2_137982
  Located on chromosome 8
  Distance between a terminus base of telomere on chromosomal short arm and 5'-terminus of this base sequence : 62396095
  Distance between 3'-terminus of neighbour sequence of sequence listing upward to telomere on chrosomal short arm and 5'-terminus of this base sequence : 55247
ttacatattcatcggaaatgagtgaggaccacagctgttatgttttttccttttcatttatattccttctctctttccttctccctccttccttccttccctttcttccttccttcctccctccctccctttctttctttctttctttctttctttctttctttctttctttctttctttctttctttcttttctttctttctttcttttctctttctttctttcattctttctctttccttctttttctttccttctttcttctttcttccctctctgtcactcttttacacttttgaattttttctttgaatcaatgggaatactagtaagtgaaaaatgtcctgaggactctcctttcataaaaaaaggataagcctatcttttgcaataagaagagaaagaaaatacccaacccaacataaaagtctttatagcctcataaaccac

SEQ ID NO: 13881 - DNA, 469 bp, Homo sapiens
  chr8.fa.O7frz.71187734
  Located on chromosome 8
  Distance between a terminus base of telomere on chromosomal short arm and 5'-terminus of this base sequence : 62550822
  Distance between 3'-terminus of neighbour sequence of sequence listing upward to telomere on chrosomal short arm and 5'-terminus of this base sequence : 154277
gaattaaaggcatagctacctatctagcaatcccactactgggtatttgcctaaagaaaaataagtcattatatgaaaaagacacacacacacacacacacacacacacacacacacacacacacacacacacacacatgtttatagcagcaaaattcccaattgcaaagatatagaaccaatctaagggtctatcaacccatgagtggataaaaaatgtagtatatatacactgtggaatactactcagccataaaaatgaatgaaataatgtattttgcagcaacttggatagtgaaataactcagcaatggaaaaccaaataccatatgttctcacttacaagtgagagctaagatatgaggacacaaagacatacagagtgatatgatgaactttggaaactcagaagaaggaaagtgggagaagggtaagggataaaaaaaactccatatttggtacaatgttg

SEQ ID NO: 13882 - DNA, 455 bp, Homo sapiens
  chr8.fa.O7frz.71317014
  Located on chromosome 8
  Distance between a terminus base of telomere on chromosomal short arm and 5'-terminus of this base sequence : 62557334
  Distance between 3'-terminus of neighbour sequence of sequence listing upward to telomere on chrosomal short arm and 5'-terminus of this base sequence : 6043
aatattctgttcctctagaaccactcctggtaccaaagtctgtgttagtcagggttctctagagggaaaaaacctatgggatatatttttttacttaacacttaataaactcatatatacatatacatacagatatatatacacacacacatatatacacacacacacacacacatatatatatacacacacacacacacacacacacacatatggtattaactcacacaatcacaaggtcccacaataggccttctgcaggctgaggagcaaagagagccagtccaaattccaaaactgaagaacttggagtctgatgatggagggcgggaagcatccagcatgagagaaagatgtaggctgtgagtgtaggccaattcatgttttcctgcctgctttatatttgctggcagatgataagatggtgcctacctgggttaaaggtggaattgcct

SEQ ID NO: 13883 - DNA, 284 bp, Homo sapiens
  AC023533.3_189872
  Located on chromosome 8
  Distance between a terminus base of telomere on chromosomal short arm and 5'-terminus of this base sequence : 62601916
  Distance between 3'-terminus of neighbour sequence of sequence listing upward to telomere on chrosomal short arm and 5'-terminus of this base sequence : 44127
ggagataatgttcatacagtacctagcaaaatatcagtattcagtcaatcagtgtgactttccttcctctttagagaagcaggaaaaactataatcagggtaatatgcactgcatatgtaaaccaattacatagagaataatgcaggagctttgctatatatatatatatatatatatatatatatatatatatatatttaatatagtgggtgtcgtctagggggatatgatgttaaaaacatctgggaaggttttataactctcctgaggactaaactctgac

SEQ ID NO: 13884 - DNA, 475 bp, Homo sapiens
  chr8.fa.O7frz.71401511
  Located on chromosome 8
  Distance between a terminus base of telomere on chromosomal short arm and 5'-terminus of this base sequence : 62659067
  Distance between 3'-terminus of neighbour sequence of sequence listing upward to telomere on chrosomal short arm and 5'-terminus of this base sequence : 56867
tgaagtactgatacatgctacaacatagatgaaccctgaatacattatactaaagtaaataaatccagaaacacacacacacacacagaaaaaaacacatattgtatgattccatttatatgaaacatccagaataggcaaatccatacaaacagaaagtagatcagtggtttacaggggcaagatggaaagggaaacaggaatgactctaatgggtattgagtttcttttgggggtgatgaaaatattctaaagttagatcactgtaagggttgagcaactctgtgaatattatgaaaaccaccaaattgtagatttgcaaagggtaaattttatggcatgtgaatgatatccaataaagctatgattaaacacacacacacacacacacacacacacacacacatacacacacagaggaggtgggggaggggctaaattcaagttatttcttaattcagaatttgcttagatg

SEQ ID NO: 13885 - DNA, 130 bp, Homo sapiens
  chr8.fa.O7frz.71577210
  Located on chromosome 8
  Distance between a terminus base of telomere on chromosomal short arm and 5'-terminus of this base sequence : 62799272
  Distance between 3'-terminus of neighbour sequence of sequence listing upward to telomere on chrosomal short arm and 5'-terminus of this base sequence : 139730
cgaccaacaccagtgttaggaggaggcgagaccggtggaaaaaggagagccccagagatttcccgtgtgtgtgtgtgtgtgtgtgtgtgtgtgtgtgtgtgtgtgtgtgtgtaatgcatttagaggacgg

SEQ ID NO: 13886 - DNA, 472 bp, Homo sapiens
  AC018864.4_168349
  Located on chromosome 8
  Distance between a terminus base of telomere on chromosomal short arm and 5'-terminus of this base sequence : 62901155
  Distance between 3'-terminus of neighbour sequence of sequence listing upward to telomere on chrosomal short arm and 5'-terminus of this base sequence : 101753
ctcatctaattcctgagtacaaactgcctgctggatttctcaccaccacattcatcccctcccatggagagtgcaggtcctgactatggtctggcttaaaaatagatatgcgatatctttagcctccacctgaccccttggctacttctttagagccagtcattttcttgttcttttagtatctgttcctttcaggtgtttgtgtgtgtgtgtgtgtgtgtgtgtgtgtgtgtgtgtgtgtgtttgtgtgtgtgtgtatctcctgccaaatcctgcttcagctccatcttcactcttgtggtgttactggaaatgcagtgttacttcttacagctgagtcaccagattatcaaattaaaggttggtgtgtttttcttcggtggcagtactcataactgccccttattgagttactgctatatggcacatgtgttagcatattttgtgttgctgctaaggaatacctgagact

SEQ ID NO: 13887 - DNA, 133 bp, Homo sapiens
  D8S512
  Located on chromosome 8
  Distance between a terminus base of telomere on chromosomal short arm and 5'-terminus of this base sequence : 62911226
  Distance between 3'-terminus of neighbour sequence of sequence listing upward to telomere on chrosomal short arm and 5'-terminus of this base sequence : 9599
aagtgggatgagggcgcatgtgtgtgtgtgtgtgtgtgtgtgtgtgactcacacagcagaaagaaggttttgctgcgtggctttattcctgtggagttcctctattgtaaagtacaaggggagcaaaactgga

SEQ ID NO: 13888 - DNA, 447 bp, Homo sapiens
  chr8.fa.O7frz.71802538
  Located on chromosome 8
  Distance between a terminus base of telomere on chromosomal short arm and 5'-terminus of this base sequence : 63023310
  Distance between 3'-terminus of neighbour sequence of sequence listing upward to telomere on chrosomal short arm and 5'-terminus of this base sequence : 111951
agctatggaacttccactttaggcaacatggcgaactagacgtccaagtacgaaaaggacagagtatgctttgtggtggactaaaggctagggcccagggtgtgtgtgtgtgtgtgtgtgtgtgtgtgtgtgtgtgtgtgtgtgtgtgtgtgtaatccaaggcctttgcataaagccaagaacttgcaaagacaacatactcaataggtgaactagaaagaaactgtgctccacagagcaaaactgtcagtatatttgcctatctcagtcttagctccgggtaaaaataaacaaaaaaatgaacccccaaatgtgtcccctgtctattcctaataaaatggttgcattctacctgatttagggctagaaaccacaatacctatgtagcgttccctccccactcccagataatcaagctgaaattttaaggtgatctgagtttggtag

SEQ ID NO: 13889 - DNA, 134 bp, Homo sapiens
  D8S544
  Located on chromosome 8
  Distance between a terminus base of telomere on chromosomal short arm and 5'-terminus of this base sequence : 63118233
  Distance between 3'-terminus of neighbour sequence of sequence listing upward to telomere on chrosomal short arm and 5'-terminus of this base sequence : 94476
ctcttgtggaatttgagggaattgcttttgttaaacatcaatgctgtgtgtgtgtgtgtgtgtgtgtgtgtgtacaaaaagataagcaaataaattgtggtgccagattctgaaaagcaagacagcataatggc

SEQ ID NO: 13890 - DNA, 353 bp, Homo sapiens
  AF149786.1_44867
  Located on chromosome 8
  Distance between a terminus base of telomere on chromosomal short arm and 5'-terminus of this base sequence : 63139406
  Distance between 3'-terminus of neighbour sequence of sequence listing upward to telomere on chrosomal short arm and 5'-terminus of this base sequence : 21039
gacactaattaaactgcatcaaacaaataccaccgtgttcctcagggggacaacagaaggcagtttaaaataattactggagcttcatgcatgtgtgaagttttcattactcttaggacacaagcaaaaaagatttgatatcattaaaatagccaccttttagtgattgcaacaacaacaacaacaacaaaaagtgactaaaatttccttggagcatattgatgtctaaatagtggtggcttcagttcttcagaatggtaacttttccttaagaattggaagtgtgtgaagcaggaacaggtgttccagtcacattctggtatgattatgtattagcttatgtttgtcagacc

SEQ ID NO: 13891 - DNA, 353 bp, Homo sapiens; identical to SEQ ID NO: 13890
  AF228661.2_123529
  Located on chromosome 8
  Distance between a terminus base of telomere on chromosomal short arm and 5'-terminus of this base sequence : 63139406
  Distance between 3'-terminus of neighbour sequence of sequence listing upward to telomere on chrosomal short arm and 5'-terminus of this base sequence : -353

SEQ ID NO: 13892 - DNA, 184 bp, Homo sapiens
  D8S1748
  Located on chromosome 8
  Distance between a terminus base of telomere on chromosomal short arm and 5'-terminus of this base sequence : 63313577
  Distance between 3'-terminus of neighbour sequence of sequence listing upward to telomere on chrosomal short arm and 5'-terminus of this base sequence : 173818
ttaacctcccaatgccatagtttcttcatctataaaatgattacctatctatctatctatctatctatctatctatctatctatctatctatattgttgtaaagactaaaataagagtacctctattgtgtgtgtgtgtgtgtgtgtgtaagagatggagttttggtttgctgctcagtctgga

SEQ ID NO: 13893 - DNA, 248 bp, Homo sapiens
  chr8.fa.O7frz.72431758
  Located on chromosome 8
  Distance between a terminus base of telomere on chromosomal short arm and 5'-terminus of this base sequence : 63567964
  Distance between 3'-terminus of neighbour sequence of sequence listing upward to telomere on chrosomal short arm and 5'-terminus of this base sequence : 254203
caattagctacaaactggtaagattcctgggtcttctttttgcctcatatatcccaactgagtgctagagaagccagcaagtcacaaaaggtaatgagcagagacaaaaatgaaataaacaagcaataaataagtaaataaataaataaataaataaaggctgatttctagcctttggataaagaaagagacagccaagcaagacagaaaactattagacaataactgttctcctacaatcaaatatc

SEQ ID NO: 13894 - DNA, 294 bp, Homo sapiens
  AC060775.1_65781
  Located on chromosome 8
  Distance between a terminus base of telomere on chromosomal short arm and 5'-terminus of this base sequence : 63584546
  Distance between 3'-terminus of neighbour sequence of sequence listing upward to telomere on chrosomal short arm and 5'-terminus of this base sequence : 16334
caacattgtccaggtagtgtagggtatcacctaatgtgaaaagctcagtgattgagaggcctcctggtgcttgcataagcattccaaaagagctaacactaaaatcactgtgtttcccttttgagggaatatttatataattatatgtatgcatacacgcacgcgcacacacacacacacacacacacacacacacaggcatgcacatatataagagctccatatatacatatatgtgtgtgtgtatatatatatatatatatggttttcctgatcttgagttaaacttagcat

SEQ ID NO: 13895 - DNA, 427 bp, Homo sapiens
  chr8.fa.O7frz.72532008
  Located on chromosome 8
  Distance between a terminus base of telomere on chromosomal short arm and 5'-terminus of this base sequence : 63811104
  Distance between 3'-terminus of neighbour sequence of sequence listing upward to telomere on chrosomal short arm and 5'-terminus of this base sequence : 226264
atccttagaaactctggttcagttgtctgcagtgggaacacagactgctatttattaaaaatatgctggccaggtgtgttggctcatgcttgtaatcccaacagttctggaggccaaggcaggaggattgcttgagcccaggagttcaagaccagcctgggcaatgtagtgagagcctatctacataaaaaatacaaaaattagccaggcatggccatttgcacctgtagttccagtcactcaggaggctaaggcaagaggattgcttgagcctgggaggttggggttgcagtaagccatggttgtgccactgcactccagcctaagcaatagagacagaccctatctcaaaaaaaaaaaaaaaaaagccacacacacacacacacacacacacacaaagcatttaggaaattctaatgtatcaaca

SEQ ID NO: 13896 - DNA, 320 bp, Homo sapiens
  chr8.fa.O7frz.72741583
  Located on chromosome 8
  Distance between a terminus base of telomere on chromosomal short arm and 5'-terminus of this base sequence : 63831234
  Distance between 3'-terminus of neighbour sequence of sequence listing upward to telomere on chrosomal short arm and 5'-terminus of this base sequence : 19703
tatttgtcagaaataagtctgctcattcaaaacaacaacaacaacaacaacaacaacaacaacaacgcctggaccactacatccaactgaatcttgttttttaaaaaaggtatatattaaatacgtcatacacttagaagaattagatcctttatttgtggctaatcttgtagccctcaacaccaacacaggattgcatgcacagctttgggggacagacacagggcaaagaggttaaacatgaagcatgaacctcagatttttgttacgtaaataaatcatcaatgaccagcatagtatgaacgtttatggattagttg

SEQ ID NO: 13897 - DNA, 157 bp, Homo sapiens
  DISD22_0005763
  Located on chromosome 8
  Distance between a terminus base of telomere on chromosomal short arm and 5'-terminus of this base sequence : 63901673
  Distance between 3'-terminus of neighbour sequence of sequence listing upward to telomere on chrosomal short arm and 5'-terminus of this base sequence : 70119
ggcaattaggattgctgtgtgtgtgtattaggatcacactgtatgtatatatgtaaattagaatcactgtgtgtgtgtgtgtgtgtgtgtgtgtgtctgtgtgtgtctgtgtgtgtgtgagacagagagagaatttgagaatctctttgcaaggaca

SEQ ID NO: 13898 - DNA, 245 bp, Homo sapiens
  D8S553
  Located on chromosome 8
  Distance between a terminus base of telomere on chromosomal short arm and 5'-terminus of this base sequence : 64152293
  Distance between 3'-terminus of neighbour sequence of sequence listing upward to telomere on chrosomal short arm and 5'-terminus of this base sequence : 250463
gtcgtctgatgcaatacagatactttttagtatcatatggggttagcgtctagaaaaagtgaagggtatgaaataatgaagaatgaaattccagtgagactctatttctttacagattgctcctccctgtcccttactcaacactagaacctggtatagcgctgtaatcaatactctgtgtgtgtgtgtgtgtgtgtgtgtgtgtgtgtgtgtgtgtgtgtgtgtgtgttttagacaaggtttca

SEQ ID NO: 13899 - DNA, 163 bp, Homo sapiens
  D8S533
  Located on chromosome 8
  Distance between a terminus base of telomere on chromosomal short arm and 5'-terminus of this base sequence : 64222061
  Distance between 3'-terminus of neighbour sequence of sequence listing upward to telomere on chrosomal short arm and 5'-terminus of this base sequence : 69523
agagccttgtttcatgggacaatgtatgtgtatgtagtgtgtgtgcgtgcaggcatgtgtgtgtgtgtgtgtgtgtgtgtgtgtggtagagagagagagagagagaaggtatggaagcaagagcccaaatcggaaccagttacctctgaacaccctggcaaag

SEQ ID NO: 13900 - DNA, 428 bp, Homo sapiens
  AF277371.1_92587
  Located on chromosome 8
  Distance between a terminus base of telomere on chromosomal short arm and 5'-terminus of this base sequence : 64296563
  Distance between 3'-terminus of neighbour sequence of sequence listing upward to telomere on chrosomal short arm and 5'-terminus of this base sequence : 74339
  misc_feature (1)...(428): n = A,T,G or C
acaccttatggctcttcactctcaaatagcagcgatgcagagggcaaggccaatagcctactataggcagatgcagtggagaaaatgtcgccaaggaaaaccagcctgcagtcctcttagtctccaacccaggctctgtgatagttgttttgtaagattataaaggtgatcccagaggaaaataaaaaacattacattacagaaaaaaggcagggaggaaaggaaaatggaagggaaaggaaaaatgggaaggaggaaagaaggaaggaaggaagtnaggaaggaaggaagtagaaggaaggaggggacttatggtttaaatggtttaaaagactggtagcgggtaagggaggaaggggctagcaaagcctcttttcccccttgaaccccagggtttatttcccagtctttcagaaaccaatacacgt

SEQ ID NO: 13901 - DNA, 381 bp, Homo sapiens
  chr8.fa.O7frz.73186220
  Located on chromosome 8
  Distance between a terminus base of telomere on chromosomal short arm and 5'-terminus of this base sequence : 64315323
  Distance between 3'-terminus of neighbour sequence of sequence listing upward to telomere on chrosomal short arm and 5'-terminus of this base sequence : 18332
tctacttctagattgtccgttaattatttttataatcatagttaaatctcccatgcttttatgcttttactataattgattctacacttgatcttagccaaagggccaagaagctctagatagatatagatagacagatgatgatagatagatagatagatagatagatagatagatagatagatagatagatagattctaaaagtaggaagtcaatatagtttttaattattgactatgaaagttgttcactgaagaataagatcatagactctgattacatttcctatcttgtttttttttctacaattttcaattgacacttttatattttttataatcccagtttggttttttcctagaattacgaactgccttaat

SEQ ID NO: 13902 - DNA, 349 bp, Homo sapiens
  chr8.fa.O7frz.73302575
  Located on chromosome 8
  Distance between a terminus base of telomere on chromosomal short arm and 5'-terminus of this base sequence : 64436483
  Distance between 3'-terminus of neighbour sequence of sequence listing upward to telomere on chrosomal short arm and 5'-terminus of this base sequence : 120779
atctggatgtcactatacgctctaaatatactaccaggatatcatgggattgtttatgaaaattaatttataacacacagtgagaaagaaggggaaagagaccacaataagttaacacactcagggatgggtattagagaggataggatgaccttactgcttgaatcctggaggttagcaatgtttgtcttctctgtctctctctctctgtctctctctctgtctctctctctctctctctctctctctctctctctctcacacacacacacacacacacacacacaccacatatacatcattagcctttcctactgatggcatggttacaaggactagaatggagatt

SEQ ID NO: 13903 - DNA, 351 bp, Homo sapiens
  AF277372.1_45285
  Located on chromosome 8
  Distance between a terminus base of telomere on chromosomal short arm and 5'-terminus of this base sequence : 64459580
  Distance between 3'-terminus of neighbour sequence of sequence listing upward to telomere on chrosomal short arm and 5'-terminus of this base sequence : 22748
acctgatcataggaacatcttatcaatatcttgccgggcagcaagccatactgcctagacccctcccgcccataccgataaataccccagcctgtaagcagtggtgggctctggcattaacctggtcccccacttccgcaggtgtctgcaatatacctgtgttattgttgagccaccgtgtgtgtgtgtgtgtgtgtgtgtgtgtgtgtgtgtgtttgtgtgtgtgtgtctttctttaaccctcgccttcccttcaaaacctaatagatgggacaagacctacctacagagacttaaaaagcctttcctaatgtttaaaagattaccacctaagagcatacattaattcac

SEQ ID NO: 13904 - DNA, 225 bp, Homo sapiens
  D8S1797
  Located on chromosome 8
  Distance between a terminus base of telomere on chromosomal short arm and 5'-terminus of this base sequence : 64468160
  Distance between 3'-terminus of neighbour sequence of sequence listing upward to telomere on chrosomal short arm and 5'-terminus of this base sequence : 8229
cccagtaaacccacagaagtctcagaatcaatggggcatgaatacatcttgtgcctcttccctgcatctctttgtaaataactccatagagggtgctacctttctaccctacccctccccaaggcacgtgcatgcacacacacacacacacacacacacacacacacacacacacacaattcagtcttccagctcactctcctatcttgacacttttcatttgga

SEQ ID NO: 13905 - DNA, 438 bp, Homo sapiens
  AC009879.3_178670
  Located on chromosome 8
  Distance between a terminus base of telomere on chromosomal short arm and 5'-terminus of this base sequence : 64548614
  Distance between 3'-terminus of neighbour sequence of sequence listing upward to telomere on chrosomal short arm and 5'-terminus of this base sequence : 80229
gttccttataaggaccatgaaggaaggatttgctccaggcctcattccttgacttatagatggttgtttgtcttctctatgtcttcacatcatcttccttcttaagtgtccacgttcaaagttcctcttctttttttttttattttgtttgggttttaaaaattattattattattattattattattattattattttagagatggggtcttgctctgttgcccaggctggagtgcaatggcaaatgtcaaaaatgttgcaagaaataggacaaacataattttgaattcatagttgagctttcatgaaaggaaaagatagtttcagagaccaaaagcaaagaaagaactagaaactagagagattgttacagcagccctgggagggtggaaaggatgggtgctgatctccaacacctagcgatttggatttaactg

SEQ ID NO: 13906 - DNA, 458 bp, Homo sapiens
  AC009879.3_24496
  Located on chromosome 8
  Distance between a terminus base of telomere on chromosomal short arm and 5'-terminus of this base sequence : 64611776
  Distance between 3'-terminus of neighbour sequence of sequence listing upward to telomere on chrosomal short arm and 5'-terminus of this base sequence : 62724
tagctagacaaggtggcacatgcctgtagtcccagttactcggggagccaaggtgggaggattgcttaagcctgggaggttgaggctgcagtgagacatgactgtgccactactcttcggcctgggtaacagcgcgagaccctgtctcaaataaataaataaataaataaataaataaataaataaataaataaataaataaaaatttacggtccatagtccattgagaatgttgggagggcagcctgggggatccacagaactgaggaacctccttttacaaatcagtgtacagagaacccactagctaaaccaaagaggaacaactttataagaacagacagctatttatccacacaaaagaaaatcttcctaccagtagtaacgctattaacatctcagcagcttttccattataaatctgacgtttcctccttcttcaaagcctagtttgagtg

SEQ ID NO: 13907 - DNA, 117 bp, Homo sapiens
  D8S1785
  Located on chromosome 8
  Distance between a terminus base of telomere on chromosomal short arm and 5'-terminus of this base sequence : 64814882
  Distance between 3'-terminus of neighbour sequence of sequence listing upward to telomere on chrosomal short arm and 5'-terminus of this base sequence : 202648
tgcccaggaaaccgcctgattaggttgtgtgtgtgtgtgtgtgtgtgtgtgtgtgtgtgtgtatgtatgtatgtagaacttgatgctttgaaatgaaccatctgcaaaatagaggcc

SEQ ID NO: 13908 - DNA, 204 bp, Homo sapiens
  DISO7_10018499
  Located on chromosome 8
  Distance between a terminus base of telomere on chromosomal short arm and 5'-terminus of this base sequence : 64993788
  Distance between 3'-terminus of neighbour sequence of sequence listing upward to telomere on chrosomal short arm and 5'-terminus of this base sequence : 178789
tggctcaagtaaattatatgtatggagatatatatatatatatatatatatatatatatatatatatatatatatatatatatatattttcatatgggttatatttgttctgctgggctctagtttttaatctctgaatagtgtttgtttttttcaaatggaaaacatagtccagaaaggccctgtaagataattacatggcag

SEQ ID NO: 13909 - DNA, 356 bp, Homo sapiens
  AC011031.3_23724
  Located on chromosome 8
  Distance between a terminus base of telomere on chromosomal short arm and 5'-terminus of this base sequence : 65011982
  Distance between 3'-terminus of neighbour sequence of sequence listing upward to telomere on chrosomal short arm and 5'-terminus of this base sequence : 17990
agctacttggagaaggctaaggcaggatgatcccttgagcccaggaggtcgaagctgcagtgagctgtgattgtgccactgcattccagcctggactacaggatgagaccctgtctcaaaaaagtgtgtgtgtatgtgtgtgtgtgtgtgtgtgtgtgtgtgtgtgtgtgtgtgtgtaggaaaggtagagtctattagcttgtatcagatttgtaaaggaaagttaaccactgcctttgagcctaagcagccatcatgcttaattttcatatcaggactcggaagccctccagagctaagggtgccctagtcaaatgcttcattgacagtctctgtagcacagtaagagtcatctt

SEQ ID NO: 13910 - DNA, 390 bp, Homo sapiens
  AC011031.3_7741
  Located on chromosome 8
  Distance between a terminus base of telomere on chromosomal short arm and 5'-terminus of this base sequence : 65021730
  Distance between 3'-terminus of neighbour sequence of sequence listing upward to telomere on chrosomal short arm and 5'-terminus of this base sequence : 9392
tggcaggtgtctgtaatctcagctactcaggagggtgaggcaggagaatcacttgaacctgggaggcggaggttgcagtgagccaagatcaagccattgcactctagcctaggagacaagagcaaaactccatctcaaaataataataataataataataataataataataatataaaaacaaaaaataaaaaataaaagctttgtgtttctcaaaactcaaaaactcataagacaatatgtaagagccgttcattttgctacatatgaattatacctcaatgaaaaatattaaaaggcaaaaaagctatatgaaaggcaaaaataaaaataattcataattctaccaccttaatatttgagccattttaccagattgcatgtaatttc

SEQ ID NO: 13911 - DNA, 129 bp, Homo sapiens
  DISD22_0005771
  Located on chromosome 8
  Distance between a terminus base of telomere on chromosomal short arm and 5'-terminus of this base sequence : 65258129
  Distance between 3'-terminus of neighbour sequence of sequence listing upward to telomere on chrosomal short arm and 5'-terminus of this base sequence : 236009
cactacctattgtccagtatctggaaaacaattattttgtgtattttgcgcagttttctaatgtttctgttgttgttgttgttgttgttgtttatttgttttttaaactgtgaggttaagtcttgtgct

SEQ ID NO: 13912 - DNA, 469 bp, Homo sapiens
  AC020714.2_152981
  Located on chromosome 8
  Distance between a terminus base of telomere on chromosomal short arm and 5'-terminus of this base sequence : 65417251
  Distance between 3'-terminus of neighbour sequence of sequence listing upward to telomere on chrosomal short arm and 5'-terminus of this base sequence : 158993
atgagatgtttacattcaccacacagccacttaaaaagcagaaaattttgttaagatccgcagacttttgattatagagttaacaatttcaaacacaaagctaaaagttaaacacactaaatgccttcataaatatatcaggatattcttttcagtttagaaaatttaaaaagcagattttacacacacacacacacacacacacacacacacacaccagtcatcactcagtatcagtgggggattggttccaggaccctgcatggacaccaaaatccatggatgctcaagttccttataaaaaatggcacagtatttgcatataacctacacacgtcctcccatatactctactcccatatctagattacttataataggtaatacaatgtaaataggttttctgtattgcttaggaaataactacaagaaaaaaagttcgtacatgttcagtacagatgcaattacc

SEQ ID NO: 13913 - DNA, 126 bp, Homo sapiens
  Z66847
  Located on chromosome 8
  Distance between a terminus base of telomere on chromosomal short arm and 5'-terminus of this base sequence : 65538821
  Distance between 3'-terminus of neighbour sequence of sequence listing upward to telomere on chrosomal short arm and 5'-terminus of this base sequence : 121101
cagatatcatagtcaggctctttcccagtctgtgtgcatgcacacacacacacacacacacacacacacctcccaggaggccttttgtgtggtaagtggactttaccgacgatttgagagacagac

SEQ ID NO: 13914 - DNA, 177 bp, Homo sapiens
  chr8.fa.O7frz.74409741
  Located on chromosome 8
  Distance between a terminus base of telomere on chromosomal short arm and 5'-terminus of this base sequence : 65594163
  Distance between 3'-terminus of neighbour sequence of sequence listing upward to telomere on chrosomal short arm and 5'-terminus of this base sequence : 55216
ttgtttgcactattggacttaggagtgccgagggtggggagatggagctgcctgactcagtgtgtgagtgtgtgtgcgtgcatgtgtgtgtgtgtgtgtgtgtatgtgtctgtctgcctgtctctctcctcctggacccagggcagccaagggcagggataggtgcagtggtcagat

SEQ ID NO: 13915 - DNA, 433 bp, Homo sapiens
  AC027006.3_82100
  Located on chromosome 8
  Distance between a terminus base of telomere on chromosomal short arm and 5'-terminus of this base sequence : 65702101
  Distance between 3'-terminus of neighbour sequence of sequence listing upward to telomere on chrosomal short arm and 5'-terminus of this base sequence : 107761
tactgctcaatttctgtttgacaaatacacagttaaagattcaacaatcagaccagaaactacacaaaaatagcaatgggaagacagatttccttgggagagcttgtggttctgaggcatccgttaagggcctgggggtttcttgtggcaaaattcatgataaataatgagaacttttgccctaatgttatttttaccatggaccattttcagtatacaattcagtactatacatgtatatgttcacattgttgtgaaacacatctccagacctttttcatttatactcatcaaacaacaattcccttttccccctccactattattattattattattatttttaagagacagggtcttgctgtgttgcccaggctggagtgcagtagtgtgatcatagctctctgcagcctccaactcctaaactcaagtg

SEQ ID NO: 13916 - DNA, 410 bp, Homo sapiens
  AC022861.3_128742
  Located on chromosome 8
  Distance between a terminus base of telomere on chromosomal short arm and 5'-terminus of this base sequence : 65765658
  Distance between 3'-terminus of neighbour sequence of sequence listing upward to telomere on chrosomal short arm and 5'-terminus of this base sequence : 63124
taggaagtttcattaagtaaccacactctaagttctttcctagatgtaactctcaaatctgtcttcttcttcttcctcttcttcttcttcttctttcctcctcctcctcctcctcctcctcctccccctcctcccccccctcctcttcttcttcttcctcttcttcttcttcttcttcttcttcttcttcttcttcttcttcttcttcttcttcttcttcttcttcttcttcttcttcttctcctcctcctcctttcttctttcttcttcttgttattattttgcttcctggcccccatgcctttccacctctcttcaacttaatggaagctactttgagggcatctgaaagagtaggcggggtggaaaggtagaaaagtaactcccttaatctaagctactttgcaaac

SEQ ID NO: 13917 - DNA, 315 bp, Homo sapiens
  chr8.fa.O7frz.74664870
  Located on chromosome 8
  Distance between a terminus base of telomere on chromosomal short arm and 5'-terminus of this base sequence : 65775066
  Distance between 3'-terminus of neighbour sequence of sequence listing upward to telomere on chrosomal short arm and 5'-terminus of this base sequence : 8998
gaactatagaagtggccttaagactgcagaggagaagttaggtaactgtcatcctccatctgggatttggtggcaaattgaatgtgtgtgtgtgtgtgtgtgtgtgtgtgtgtgtgtgtgtgtgtgtgtgtgttgtgggggttgtggggaatagaagatgtggtggattacaaaaatgaccacagactctcttgtacataccttaccattctctcactaagcatgagagtctgtttttccacttcttgaatctgagctgtgactttctttggctaggataatgtggcagaagtgacatttaccgagtactctaag

SEQ ID NO: 13918 - DNA, 283 bp, Homo sapiens
  chr8.fa.O7frz.74527040
  Located on chromosome 8
  Distance between a terminus base of telomere on chromosomal short arm and 5'-terminus of this base sequence : 65775098
  Distance between 3'-terminus of neighbour sequence of sequence listing upward to telomere on chrosomal short arm and 5'-terminus of this base sequence : -283
agaagttaggtaactgtcatcctccatctgggatttggtggcaaattgaatgtgtgtgtgtgtgtgtgtgtgtgtgtgtgtgtgtgtgtgtgtgtgtgtgttgtgggggttgtggggaatagaagatgtggtggattacaaaaatgaccacagactctcttgtacataccttaccattctctcactaagcatgagagtctgtttttccacttcttgaatctgagctgtgactttctttggctaggataatgtggcagaagtgacatttaccgagtactctaag

SEQ ID NO: 13919 - DNA, 366 bp, Homo sapiens
  AC022861.3_37720
  Located on chromosome 8
  Distance between a terminus base of telomere on chromosomal short arm and 5'-terminus of this base sequence : 65788612
  Distance between 3'-terminus of neighbour sequence of sequence listing upward to telomere on chrosomal short arm and 5'-terminus of this base sequence : 13231
tagtggcagacatctatagcaccagctactcgggaggctgaggcaggagaatggcgtgaacctgggaggcggaacttgtagtgagccgagattgcaccaccgcactccagtccgggcgacagagtgagaatctgtctcaattaaaataataataataataataataataataatttgtattcattccttaattcattttccaacccacttattctagttcagggtcaagagtggctggagcttgtccctgcagctcaggacacaaagtggaaactgactctggataggacgccatccattacagggtacactcacacacccatgctcactcagcctgggaccatgtagacatgctgatgaacctaa

SEQ ID NO: 13920 - DNA, 234 bp, Homo sapiens
  D8S1840
  Located on chromosome 8
  Distance between a terminus base of telomere on chromosomal short arm and 5'-terminus of this base sequence : 65790633
  Distance between 3'-terminus of neighbour sequence of sequence listing upward to telomere on chrosomal short arm and 5'-terminus of this base sequence : 1655
tgtaacactcaccgcgagggtccgtggcttcattcttgaagtcagtgagaccaagaacccaccaattctggacacattaatattttatttcagagttttataactgtattcataaggaagcattttttttaaactttttgtaaacctttaaaaaatgatgctgtgtgtgtgtgtgtgtgtgtgtgtgtgtgtgtgttttctcagagacagtctcgctctgtcatgcaggctgga

SEQ ID NO: 13921 - DNA, 149 bp, Homo sapiens
  D8S1767
  Located on chromosome 8
  Distance between a terminus base of telomere on chromosomal short arm and 5'-terminus of this base sequence : 65949767
  Distance between 3'-terminus of neighbour sequence of sequence listing upward to telomere on chrosomal short arm and 5'-terminus of this base sequence : 158900
gcatgaggtttacagttaatgatgttgtatactgaacatttgctaagagagtagattttaggtgttcctgctatacacacacacacacacacacacacacacacacacgttaactgtggaaggggatggacatgtaatttatttgactg

SEQ ID NO: 13922 - DNA, 105 bp, Homo sapiens
  DISO7_10018504
  Located on chromosome 8
  Distance between a terminus base of telomere on chromosomal short arm and 5'-terminus of this base sequence : 66207984
  Distance between 3'-terminus of neighbour sequence of sequence listing upward to telomere on chrosomal short arm and 5'-terminus of this base sequence : 258068
agctgcttgaactgtaacaatacaactctaaggtcacacacacacacacacacacacacacacacacacacacacacatgcatgttcatatacatggatccatac

SEQ ID NO: 13923 - DNA, 430 bp, Homo sapiens
  AC073253.1_69074
  Located on chromosome 8
  Distance between a terminus base of telomere on chromosomal short arm and 5'-terminus of this base sequence : 66419709
  Distance between 3'-terminus of neighbour sequence of sequence listing upward to telomere on chrosomal short arm and 5'-terminus of this base sequence : 211620
gcatttgagtttacagaatgaggctctaaattatcataacttagaattttaaatacttgaatataaaataactttagttactactttcccaagatgttgataaggagcacccctctacacacacacacacacacacacacacacacacacacacacttttcaactaaatgctattctataataataaaagtataagttttgaaatggggcaatctgactcttgcaacagatagattgaatgtggaatgtgactggtatggatctttttggtcataactgaagattttttcagttggtaaagcagtttcataaaatgtgttagcccctgcctttacagaattcacaagctagcaagggagatagatatatataaaatattagaaggcaaaacaacaagtaaatacttgttggaggtaaatgtactatttga

SEQ ID NO: 13924 - DNA, 466 bp, Homo sapiens
  AC067871.2_81346
  Located on chromosome 8
  Distance between a terminus base of telomere on chromosomal short arm and 5'-terminus of this base sequence : 66538356
  Distance between 3'-terminus of neighbour sequence of sequence listing upward to telomere on chrosomal short arm and 5'-terminus of this base sequence : 118217
ttcaatgtttaacaatcctcactcgtggcagcatctgatccccttccctgatttatttctctccataggactcatcatttatcaatatgttctataatttgcatattattttatgtattctcactaccactagaatacaacctttctagaacagagatttttaaaaattctattttgttctcattcatattccaagatcctggaacagaaactggcatatagtagatgctcagcaaacatttattgaataaacatatgaattagtattttattttattaaacatacatttatttatttatttatttatttatttatttatttagagacgaagtctctctcttttgcccaggctggagtgcagtggcacgatctcagctcactgcaacctcctcctaccaggtttgagtgattcttctgcttcagcctctgattagctgggattacaggtagatgtcaccatgcctg

SEQ ID NO: 13925 - DNA, 182 bp, Homo sapiens
  DISO7_10002514
  Located on chromosome 8
  Distance between a terminus base of telomere on chromosomal short arm and 5'-terminus of this base sequence : 66588757
  Distance between 3'-terminus of neighbour sequence of sequence listing upward to telomere on chrosomal short arm and 5'-terminus of this base sequence : 49935
ccattcctttgttgaaggacatttagattactaacagggttttgcggccatgaaatatttgctaaaataaacaaagtcttacactttctgtgaaaataaacaacgttgtacatatatatatatatatatatatatatagatgctttcatttctttatgatgactttaccagacataagattg

SEQ ID NO: 13926 - DNA, 159 bp, Homo sapiens
  DISO7_10002515
  Located on chromosome 8
  Distance between a terminus base of telomere on chromosomal short arm and 5'-terminus of this base sequence : 66601496
  Distance between 3'-terminus of neighbour sequence of sequence listing upward to telomere on chrosomal short arm and 5'-terminus of this base sequence : 12557
tttcttctgtgcatgtatcagagagacacagagaaacagtgagagagagagagagagagagagagagagaaagcaacagagagagagaatatgtgtctgtgtgtacaattaatggtttttagggtattagtggaaaccaagataaagaacttgcagatt

SEQ ID NO: 13927 - DNA, 169 bp, Homo sapiens
  DISO7_10002516
  Located on chromosome 8
  Distance between a terminus base of telomere on chromosomal short arm and 5'-terminus of this base sequence : 66619873
  Distance between 3'-terminus of neighbour sequence of sequence listing upward to telomere on chrosomal short arm and 5'-terminus of this base sequence : 18218
gccaactccatctctattctgaattttaactttaaccccttggagtgtttttgttttttttgtttttggttttgttatgttactacacacacatacacacacacacacatgcacatgcacacacacacactcagatacaaaattagaagatgactttctcagcaatatg

SEQ ID NO: 13928 - DNA, 480 bp, Homo sapiens
  AC073253.1_27739
  Located on chromosome 8
  Distance between a terminus base of telomere on chromosomal short arm and 5'-terminus of this base sequence : 66698790
  Distance between 3'-terminus of neighbour sequence of sequence listing upward to telomere on chrosomal short arm and 5'-terminus of this base sequence : 78748
accttcagagtttggttaagacttttgggacttcatctctgataccacccatcccaaccacaagtttttctccaactataagacagggtggcatttttgcaggggttttaaaagcagaaggcctagattcaaataaaaattttaccacttcattcattcattcattcattcattcattcattcatacgtatttacacctacttattgccaggcactgtcccaggcattgacaatagagcattatagaaacaggccaagtctgtcttcttaaaggtaacatttgaaagaaggaggggacaggcaataaatacatgcagtatatcatatgatttcaggtactgacaaggtaaggggcacacaggtatcacaaggtaaggggcacagagagccatggctggggatagagttgaaaaggagggcttctcctaggtggtcatgtttgagcagacttgagcaaagtgtcatactaaaccacgagaa

SEQ ID NO: 13929 - DNA, 242 bp, Homo sapiens
  DISO7_11565112
  Located on chromosome 8
  Distance between a terminus base of telomere on chromosomal short arm and 5'-terminus of this base sequence : 66748189
  Distance between 3'-terminus of neighbour sequence of sequence listing upward to telomere on chrosomal short arm and 5'-terminus of this base sequence : 48919
atctgccacattgtggtggtgtgtgtctgtgtgtgtgtgtgtgcacggacgaaggaaatttaagtgggttatttccctcattattttggcgaccaaggaagaaccccaaagggactatctttactagaaaattgatactgtaagagcagtttttctcatgtttcagataatacttttaaacccacgttaagccttaaagtaatataactactaggaaagagtaactttattcctgcttcttg

SEQ ID NO: 13930 - DNA, 431 bp, Homo sapiens
  chr8.fa.O7frz.75875384
  Located on chromosome 8
  Distance between a terminus base of telomere on chromosomal short arm and 5'-terminus of this base sequence : 67021746
  Distance between 3'-terminus of neighbour sequence of sequence listing upward to telomere on chrosomal short arm and 5'-terminus of this base sequence : 273315
agtacgtagtcctcatgacctctaatgagaataggtttttctccaagtatcctgcataagattataagatttcctaagagtgtgtgtgtgtgtgtgtgtgtgtgtgtttctctgtgtgtgtgtgtgtgtgtgtgcatgttctataggttttggagttctcatttagtctgcactctcccttgctaaggtgggaggatggggattttaaaccctttctccttgacaggaaaaataatatcttctagatagatatgagctgaaaaacatattctcccacatgcaggccatggactctatgatgctattatatatcccctgcagttataggatctcagaacaatttcgtgtccatgaatatgaggctactttatgaactggatacacaaagataaaaaataaaacactttgtcatctcttaagtatgttccaga

SEQ ID NO: 13931 - DNA, 188 bp, Homo sapiens
  D8S1117
  Located on chromosome 8
  Distance between a terminus base of telomere on chromosomal short arm and 5'-terminus of this base sequence : 67201706
  Distance between 3'-terminus of neighbour sequence of sequence listing upward to telomere on chrosomal short arm and 5'-terminus of this base sequence : 179529
ttattttcctgcagactccgatagattttaattattattattattattattattattattattatttttacaattgcctctctttgctcaacctagtatattaacgctgtattttgccacttctttgggtcttcattttcctatgggagcttccatgtacatgtaaaaatctgcatgcttttctcctg

SEQ ID NO: 13932 - DNA, 480 bp, Homo sapiens
  chr8.fa.O7frz.76029716
  Located on chromosome 8
  Distance between a terminus base of telomere on chromosomal short arm and 5'-terminus of this base sequence : 67279106
  Distance between 3'-terminus of neighbour sequence of sequence listing upward to telomere on chrosomal short arm and 5'-terminus of this base sequence : 77212
cagatctatagtgaaactcctgacctgttgtcctagcagcaatgcatggatgtttgtggatgctagtggatgggttgtgtttctcacaggcactgggacaggagatggagagcatgggggttgatgggctacaaggctatttctctcttatatgctatgaatattgtcccgtattttcactggactcacattatatctatatatctatatctctatctatctatctatctatctatctatctatctatctatctaatttttttttgagatgaattcttgctctgtcgcccaggctggagtgcagtggcatgatcttggctcactgcaacttccacctcccaggtacaggcgattctcctgcctcagcctccaagtagctaggattacaggcgcctgccaccatgaccggctaatttttgtatttttagtagagacaaggtttcaccatgttggccaggctggtctggaattcctgacctc

SEQ ID NO: 13933 - DNA, 282 bp, Homo sapiens
  D9S920
  Located on chromosome 8
  Distance between a terminus base of telomere on chromosomal short arm and 5'-terminus of this base sequence : 67425055
  Distance between 3'-terminus of neighbour sequence of sequence listing upward to telomere on chrosomal short arm and 5'-terminus of this base sequence : 145469
acagctgaaattaattttaatagcctattgtatttaacccaatatattaagaaatatacatatatacgtatatatgtgtgtatgcatatatatgtagatgatagatagatagatagatagatagatagatagatagatagatagatagattttttttggagacagggtccactctgtttcccaggatggagtgcagtggtgtgatcatggctcactgcagccttattgatgtcctgggctcaagcaatcctcctgcctcagctccccaagtagctgagactg

SEQ ID NO: 13934 - DNA, 459 bp, Homo sapiens
  AC013746.4_20031
  Located on chromosome 8
  Distance between a terminus base of telomere on chromosomal short arm and 5'-terminus of this base sequence : 67674771
  Distance between 3'-terminus of neighbour sequence of sequence listing upward to telomere on chrosomal short arm and 5'-terminus of this base sequence : 249434
cctagtgtatcaaatgaccaatacacttgcctgaatcaacttctgctacacactggtcacacattccaagattaatacaattactacttttgatcttatctgtaattttagtagaaaagtttaggaagaaaggccactatttcctagcagcaataatgcccctctaaaaccacccttggtcccatatctccattaagaacctgtcccctctcccactacccttgtactggcaattctccaaagggttgtctacacttggataaggtagttacatttactgtgattgtgtgtgtgtgtgtgtgtgtgtgagagagagagagagagaaagaggaaggaaggaaggaaggaaggaaggaaggaaggaaggaaggaaggaaggaaggaaaaacagttgaggaggaattcggggaagagaccaggtcatgcattcattgggatatgttgaatttaagatgcctc

SEQ ID NO: 13935 - DNA, 250 bp, Homo sapiens
  HUMUT5138
  Located on chromosome 8
  Distance between a terminus base of telomere on chromosomal short arm and 5'-terminus of this base sequence : 67691693
  Distance between 3'-terminus of neighbour sequence of sequence listing upward to telomere on chrosomal short arm and 5'-terminus of this base sequence : 16463
gacctcggttcttactaacactaaatctaggaggtaaggtgggcagagaaggtttttctttcttactttcttcctttctttctttctttctttctttctctttcttctttctttctttcttctttctttctctttatttttacattttttatattaataggctacttttaaaaacagttttaggtttatagaaaaattgagcagatagtatagagttcccctattccactctcccttacacagtctccta

SEQ ID NO: 13936 - DNA, 454 bp, Homo sapiens
  AC013746.4_106760
  Located on chromosome 8
  Distance between a terminus base of telomere on chromosomal short arm and 5'-terminus of this base sequence : 67707440
  Distance between 3'-terminus of neighbour sequence of sequence listing upward to telomere on chrosomal short arm and 5'-terminus of this base sequence : 15497
caacatggtgaaactccatctctgttaaaaatacaaaaattagccagacgtggcggcgcgtgcctgtaatcccagctactcaggaggctgaggtgagaggatagcttgagcctgagagacggaggttgcagtgagccgagattatgcaactgcaatccagcctgggtggcagagcaagataactaactaactaaataaatacatacatacatacatacatacatttagtgaggagcaaatgtaagcactcagaatcctcaaagctgatttatttttatttatctctagggaaaacctaagaacacatgacatgaatttgactattcaccttaagttttacagtgaaagtttcgatttgcctcctatcctattacaaaattcagatactctctttgttttgtctttatttcctaagaaatgatttcttttgttcttaatggaagattccaaagat

SEQ ID NO: 13937 - DNA, 271 bp, Homo sapiens
  AC013746.4_33135
  Located on chromosome 8
  Distance between a terminus base of telomere on chromosomal short arm and 5'-terminus of this base sequence : 67807303
  Distance between 3'-terminus of neighbour sequence of sequence listing upward to telomere on chrosomal short arm and 5'-terminus of this base sequence : 99409
gacttactatgacacgcatgacaaacttctatgagtctgtggttctgtgagatagagatttagcaaccatccaattaatgcttcttattgatcaaatcagactatttgtttttttaattactctaaaaacaccactgtatacattccatacttgcaaatatataaattaagcccctggttttgtttttgttgttgttgttgttgtttatttcttttaaattccagggtacacgtgcaagatatgcaggtttgttacataggtaaacctgtg

SEQ ID NO: 13938 - DNA, 114 bp, Homo sapiens
  DISO7_10002518
  Located on chromosome 8
  Distance between a terminus base of telomere on chromosomal short arm and 5'-terminus of this base sequence : 67999915
  Distance between 3'-terminus of neighbour sequence of sequence listing upward to telomere on chrosomal short arm and 5'-terminus of this base sequence : 192341
gccacatacccggtacacacatcttacacacacacacacacacacacacaccaatgtcttctggtagaaaaataactcccaggacaaaagatggcacagtattctgtaatctaa

SEQ ID NO: 13939 - DNA, 120 bp, Homo sapiens
  DISO7_10002520
  Located on chromosome 8
  Distance between a terminus base of telomere on chromosomal short arm and 5'-terminus of this base sequence : 68109598
  Distance between 3'-terminus of neighbour sequence of sequence listing upward to telomere on chrosomal short arm and 5'-terminus of this base sequence : 109569
gctaccgatctaaggagtgtggtgtgtgtgtgtgtgtgtgtgttttgtgaggaggggaaaaggaaggagtactttttttgctttggttgtgttttgttctttgctaggatgggtgagcat

SEQ ID NO: 13940 - DNA, 391 bp, Homo sapiens
  chr8.fa.O7frz.76845676
  Located on chromosome 8
  Distance between a terminus base of telomere on chromosomal short arm and 5'-terminus of this base sequence : 68115446
  Distance between 3'-terminus of neighbour sequence of sequence listing upward to telomere on chrosomal short arm and 5'-terminus of this base sequence : 5728
ctgctttagaatgctgattaactgctttctaattttccacaattccttgtcttgatgttttcttttcctaaaggcaccacaactaaaagagaggtaaaatatcaacacacacacacacacacacacacacacacacacacacacacaaaattacatcattccctcttcaaggattacagtattcccaattccaataatatggtccaggaaattcccatggttaaattttttaagctgatgggaactaaattaactaaagaaaccatgaaagccctaatatttttgcacccactaaaaataatccactggagcacaccatagtaacttctctaaactattaacagcacagtatattatagatactacagtatctactgagcaacaatgtagc

SEQ ID NO: 13941 - DNA, 222 bp, Homo sapiens
  D8S1795
  Located on chromosome 8
  Distance between a terminus base of telomere on chromosomal short arm and 5'-terminus of this base sequence : 68153640
  Distance between 3'-terminus of neighbour sequence of sequence listing upward to telomere on chrosomal short arm and 5'-terminus of this base sequence : 37803
  misc_feature (1)...(222): n = A,T,G or C
caaaaatntcacaaacctgtggcaaaatcagactggtggtaaagtgcacgtgtgtgtgtgtgtgtgtgtgtgtgtgtgtgtgtgtataaacatgtatacaaatatatatataatttttttagttttctgaattagttacccaagttttaaaattgggagatttcagatgaaaaccccagatttctggatttttgaaatttggcattgtcatattgggctcaa

SEQ ID NO: 13942 - DNA, 148 bp, Homo sapiens
  DISO7_10002521
  Located on chromosome 8
  Distance between a terminus base of telomere on chromosomal short arm and 5'-terminus of this base sequence : 68193568
  Distance between 3'-terminus of neighbour sequence of sequence listing upward to telomere on chrosomal short arm and 5'-terminus of this base sequence : 39706
  misc_feature (1)...(148): n = A,T,G or C
atgttnccataacactttctctgtaaagggccagacagcaactattttttaggctttgcagatcacatatgatctctctttctctctctctctctctctctctctctctctgtctttctctctgtctctcaaatgttcatcttctggn

SEQ ID NO: 13943 - DNA, 113 bp, Homo sapiens
  DISO7_10002523
  Located on chromosome 8
  Distance between a terminus base of telomere on chromosomal short arm and 5'-terminus of this base sequence : 68256616
  Distance between 3'-terminus of neighbour sequence of sequence listing upward to telomere on chrosomal short arm and 5'-terminus of this base sequence : 62900
ttgattgctttctctactacgagggaaaaaagaccaaaatgaatgaatgaatgaatgaatgaatgaatgaatgaatgaaagactgaatgaatctcagagtctataattcctgc

SEQ ID NO: 13944 - DNA, 144 bp, Homo sapiens
  DISO7_10002526
  Located on chromosome 8
  Distance between a terminus base of telomere on chromosomal short arm and 5'-terminus of this base sequence : 68496901
  Distance between 3'-terminus of neighbour sequence of sequence listing upward to telomere on chrosomal short arm and 5'-terminus of this base sequence : 240172
tgaggtaattactgccaagcaaaatcatcatcatcatcatcatcatcatcatcatcacttcttggccttttggctaagaagcaatgattttcacgtactttaaatataggatcgaaaatgatcactcatttgagatcagtatct

SEQ ID NO: 13945 - DNA, 101 bp, Homo sapiens
  DISO7_10002528
  Located on chromosome 8
  Distance between a terminus base of telomere on chromosomal short arm and 5'-terminus of this base sequence : 68539073
  Distance between 3'-terminus of neighbour sequence of sequence listing upward to telomere on chrosomal short arm and 5'-terminus of this base sequence : 42028
acttgtgcaagaccttctttgtggcgcatatatatatatatatatatatatatatatatatttgttttgaaatgtagaagtactacctaaacatgcagtgt

SEQ ID NO: 13946 - DNA, 149 bp, Homo sapiens
  chr8.fa.O7frz.77610407
  Located on chromosome 8
  Distance between a terminus base of telomere on chromosomal short arm and 5'-terminus of this base sequence : 68559832
  Distance between 3'-terminus of neighbour sequence of sequence listing upward to telomere on chrosomal short arm and 5'-terminus of this base sequence : 20658
acctgtctaaagaatacaaaggtctgggattcctttatccccaaacactggggaccatatgatttagaatttacacacacacacacacacacacgtgcgtagatatacatatatatatatttcattctagaaagataatacatgtcggc

SEQ ID NO: 13947 - DNA, 243 bp, Homo sapiens
  AC021558.3_47833
  Located on chromosome 8
  Distance between a terminus base of telomere on chromosomal short arm and 5'-terminus of this base sequence : 68808789
  Distance between 3'-terminus of neighbour sequence of sequence listing upward to telomere on chrosomal short arm and 5'-terminus of this base sequence : 248808
cgagctcatacattattccactgtgttccttatttgaagcaaataagaaaccagatcatcatcatcatcatcatcattatcatcatcatcatcatcatttattgagtgttttataatcttcatatcctgtgtcaaagtcattattcccatcttgtactggaaaaaaaaataggtttagataggttaaataacttaatggaggtaaggcagttggaagtggtaagatggaatatgactcagatg

SEQ ID NO: 13948 - DNA, 412 bp, Homo sapiens
  chr8.fa.O7frz.77731892
  Located on chromosome 8
  Distance between a terminus base of telomere on chromosomal short arm and 5'-terminus of this base sequence : 68812337
  Distance between 3'-terminus of neighbour sequence of sequence listing upward to telomere on chrosomal short arm and 5'-terminus of this base sequence : 3305
ttgagttaccagtatgtctaggagtgaatctgtataatggtcaagtaaactttgctagcttttgagcttgaaatcttcaacactggatcactggaggccgtgaccaatgatctccatgatttgttatatatatatcatgtaagaaattaaaaatttgctatcagttttcctcatgtgaaccccccttgttttatattttatgaaagacatgtcctccaaattactttgttttctgtataattttaggaatcacagctgtgtgtgtgtgtgtgcatgtgtgtgtgtgtgtgtgcacgtgtgtgtgtgtgtgtgtgtgagagagagaaatgcagaaagggtagttttctgtcattttatttgtattaattttattgctgtcactattttgaactaacagtgaaatgcctgtatc

SEQ ID NO: 13949 - DNA, 110 bp, Homo sapiens
  DISD22_0005783
  Located on chromosome 8
  Distance between a terminus base of telomere on chromosomal short arm and 5'-terminus of this base sequence : 68969683
  Distance between 3'-terminus of neighbour sequence of sequence listing upward to telomere on chrosomal short arm and 5'-terminus of this base sequence : 156934
ttctgctgtctgttacccacaaaagaaactcacacacacacacacacacaatacacagttacacacacacaatacacagttacaaacaagccccaagggtgttcacagtg

SEQ ID NO: 13950 - DNA, 248 bp, Homo sapiens
  DISO7_10000359
  Located on chromosome 8
  Distance between a terminus base of telomere on chromosomal short arm and 5'-terminus of this base sequence : 69230967
  Distance between 3'-terminus of neighbour sequence of sequence listing upward to telomere on chrosomal short arm and 5'-terminus of this base sequence : 261174
gtctccagggcaacactactttcatgtgattatttttagtaaagttgagtggtcactacatttcatttagttttgctatctttgtttagattttttatatatatatatagtctaaacaatatatatctatatatacacactatatatatgttttatacacacacacacacacacacacacacacacaatctgttttacacacaaacactccacatccctgtttccagtttgtaatatgaagtcaccac

SEQ ID NO: 13951 - DNA, 476 bp, Homo sapiens
  chr8.fa.O7frz.78374876
  Located on chromosome 8
  Distance between a terminus base of telomere on chromosomal short arm and 5'-terminus of this base sequence : 69618403
  Distance between 3'-terminus of neighbour sequence of sequence listing upward to telomere on chrosomal short arm and 5'-terminus of this base sequence : 387188
taaaggatctccacttcagttcagttctatgaagccacgttccattttaacccaaattgcaagtttccgttccaatcctttaacagaaagtgataatagccaagagaaaaattctctgagactgataaatcaggaagttttggcagaataagagagagagagagagagagagagagagagagagaaagagagagagagagagaacaagcatgtgtatttcatgcatccatctgggaactttcagaaacttgggatcatttcatcagtttgcttttaaaatgggtatggagactcacccctcttccctggtgaagtaaaattactttggatgtattaaaattgccactggtgagaggtgtgtttatctaatttcataatataacaataggtctttcaccttcttccaagtccatattgattttagctaaattatatttagggtgggagacaagacatcttgatttagtgatccttat

SEQ ID NO: 13952 - DNA, 106 bp, Homo sapiens
  DISD22_0005791
  Located on chromosome 8
  Distance between a terminus base of telomere on chromosomal short arm and 5'-terminus of this base sequence : 69845356
  Distance between 3'-terminus of neighbour sequence of sequence listing upward to telomere on chrosomal short arm and 5'-terminus of this base sequence : 226477
aactaaattctggacggccttgtatgccaaagaaatagtgtgtgtgtgtgtgtgtgtgtgtgtgtgtgtgtgtgtgtgtgtgtttttccagtgggatagtctggaa

SEQ ID NO: 13953 - DNA, 336 bp, Homo sapiens
  chr8.fa.O7frz.78760671
  Located on chromosome 8
  Distance between a terminus base of telomere on chromosomal short arm and 5'-terminus of this base sequence : 69995040
  Distance between 3'-terminus of neighbour sequence of sequence listing upward to telomere on chrosomal short arm and 5'-terminus of this base sequence : 149578
gcttcatgtgaaacttcaataattctcaatagagtttggggtgggagtggggataccttcttactcattggttaaaaggaaaagcttacctagttatataactattggccaatatggtgaaactctgtctctactaaaaatacaaaaattagccggatgtgtaatctcagctacttgggtggctgaggcaggagaatcacttgaacttgggaggctgaagtttcagtgagccgagatcatgctattgcgctccagcttgggtgacaagagtgtaactctatctcaaataaataaataaataaataaataaataattgttaacaatcatagtcatgg

SEQ ID NO: 13954 - DNA, 211 bp, Homo sapiens
  D8S530
  Located on chromosome 8
  Distance between a terminus base of telomere on chromosomal short arm and 5'-terminus of this base sequence : 70151107
  Distance between 3'-terminus of neighbour sequence of sequence listing upward to telomere on chrosomal short arm and 5'-terminus of this base sequence : 155731
gcttgggctcagaggcctgacaatatcacattgtgtgtgtgtgtgtgtgtgtgtgtgtgtgtgtgtgtgtaaaatacaaatttaatagcccccataataatctgtctctcttgctctttctatctctctctctctggcagtgactccagccttctggctctcttcctcattacttctttccctctcctctccatacatcacccaaccctgc

SEQ ID NO: 13955 - DNA, 433 bp, Homo sapiens
  AF202963.2_29791
  Located on chromosome 8
  Distance between a terminus base of telomere on chromosomal short arm and 5'-terminus of this base sequence : 70161351
  Distance between 3'-terminus of neighbour sequence of sequence listing upward to telomere on chrosomal short arm and 5'-terminus of this base sequence : 10033
ctgttatgtttaagtccacgttactcttccattttctaatgttctgctttcctttccctctctgttgctgatgattctctccatcctttcttgggttcttttgtgtgtgtgtgtgtgtgtgtgtgtgtgtgtgtgtttgtgtgtgtgtgtgtttcctctgccttgcacgggaatttgtgttttgttctcttgagtcttcatcctctgagaacaatagaagaagttatttgatcatccccttaggccactgtgcttttgggagaaaaagaccagttagcagacaataccgtaaatgccagatgcacagcatctattaagaaactaacagtgagtgtgtgcagcgcttccacagagccctctaagaaactgtcatgagagtctagattgaggatcctgacagcttagattccgatcctagctccactccttacta

SEQ ID NO: 13956 - DNA, 232 bp, Homo sapiens
  D8S1807
  Located on chromosome 8
  Distance between a terminus base of telomere on chromosomal short arm and 5'-terminus of this base sequence : 70178292
  Distance between 3'-terminus of neighbour sequence of sequence listing upward to telomere on chrosomal short arm and 5'-terminus of this base sequence : 16508
acaaaacattgctcccataatgccggatgggagtatcctaatgggcgctgggtcacaggaccctatcagaccatctgtggatacccagaggacacaaaagggaatctgaggaccctacactgctgctaatattatgttatgcagaacacacattcacacacacacacacacacacacacacacacacacacaatcaccaagacactatcttggaaagaactagggacaggcg

SEQ ID NO: 13957 - DNA, 450 bp, Homo sapiens
  AC022867.2_9860
  Located on chromosome 8
  Distance between a terminus base of telomere on chromosomal short arm and 5'-terminus of this base sequence : 70420226
  Distance between 3'-terminus of neighbour sequence of sequence listing upward to telomere on chrosomal short arm and 5'-terminus of this base sequence : 241702
ttctcagtaaactatcacaaggacaaaaaaccaaacactgcatgttctcactcatagatgggaattgaacaatgagaacccatggacacaggaaggggaacatcacactctggggactgttgtggggtggggggaggggggagggatagcattaggagatatacctaatgctaaatgacgtgttaatggttgcagcacaccagcatggcacatgtatacatatgtaactaacctgcacattttgcacatgtaccctaaaacttagagtataataataataataataataataataataataaaaagaaaaatgatacaaaatggtatagccaatttggagaatagtttggcagtttcttaaagttaaacatacactttctctacttcctggcaatcatgtagggctgtgtcaggaaaagtgcacgagaaatcaataacatcttgtagtgc

SEQ ID NO: 13958 - DNA, 286 bp, Homo sapiens
  AC016057.3_140849
  Located on chromosome 8
  Distance between a terminus base of telomere on chromosomal short arm and 5'-terminus of this base sequence : 70444498
  Distance between 3'-terminus of neighbour sequence of sequence listing upward to telomere on chrosomal short arm and 5'-terminus of this base sequence : 23822
ttaatgagtggaacattataggagctcaactgtatttgaaaaatttacttttctaagatgaggagtgaatacatgggcattttccatgttattctttattcattcgatatgtctgggacaatttataatatattaaaaattttaagttcacatcacatgctaacccacacatatttctctctctctctctctctctcacacacacacacacacatacacacacagacacacactatatatattttccttagatcagatgccatcttatttccagatgctagtgcta

SEQ ID NO: 13959 - DNA, 426 bp, Homo sapiens
  AC016057.3_177224
  Located on chromosome 8
  Distance between a terminus base of telomere on chromosomal short arm and 5'-terminus of this base sequence : 70480777
  Distance between 3'-terminus of neighbour sequence of sequence listing upward to telomere on chrosomal short arm and 5'-terminus of this base sequence : 35993
ctgaaatattacgatctttcacacacatacccagccagctggcaggggattccgagcagtgcctcctaggaaaaacagtggttctaaaaggttttcattttaattatattactgggctttaaggtttaattttgtgttttctatgaaaagagaagttttatttgtagttgttactaggcaatcttatttctaagtctactgagttatgatcattttctcaggttaaaatgcatattaggcaaggtggcttttgtgcttgtcaagtgtgtctgtgtgtgtgtgtgtgtgtgtgtgtgtgtgtgtggtctcctatatatttgaggtagaagaaagcccttcaggtagattttggtaaagattttttggttgtttttgagacagggttctgctctgttgcccaggctggagtgcagtgatgcaataaca

SEQ ID NO: 13960 - DNA, 359 bp, Homo sapiens
  chr8.fa.O7frz.79285587
  Located on chromosome 8
  Distance between a terminus base of telomere on chromosomal short arm and 5'-terminus of this base sequence : 70480777
  Distance between 3'-terminus of neighbour sequence of sequence listing upward to telomere on chrosomal short arm and 5'-terminus of this base sequence : -426
ctgaaatattacgatctttcacacacatacccagccagctggcaggggattccgagcagtgcctcctaggaaaaacagtggttctaaaaggttttcattttaattatattactgggctttaaggtttaattttgtgttttctatgaaaagagaagttttatttgtagttgttactaggcaatcttatttctaagtctactgagttatgatcattttctcaggttaaaatgcatattaggcaaggtggcttttgtgcttgtcaagtgtgtctgtgtgtgtgtgtgtgtgtgtgtgtgtgtgtgtggtctcctatatatttgaggtagaagaaagcccttcaggtagattttggtaaagat

SEQ ID NO: 13961 - DNA, 366 bp, Homo sapiens
  AC016057.3_40173
  Located on chromosome 8
  Distance between a terminus base of telomere on chromosomal short arm and 5'-terminus of this base sequence : 70572790
  Distance between 3'-terminus of neighbour sequence of sequence listing upward to telomere on chrosomal short arm and 5'-terminus of this base sequence : 91654
atctgtcttatttcactgcttaactgcttaaaagacattagcgacactatttaataccaaaatacatagcacttaaaactggtgttcagaatcaagcttcaaaataatgagtttatagttctagcatggtgtgtgtgcatgtgtgggaagtggatctgtgtgtgtgtgtgtgtgtgtgtgtgtgtgagagatagagaaagagagagagagagagagagagagagagagagagagaatgaattccaaggcatttgttttgtgttgcttttgcaatgggatgattccacaaggacaaaggacaagctttcagggtaaagatgttgggttgaacacagaagaaaatcctcctgagattgatcatttgta

SEQ ID NO: 13962 - DNA, 243 bp, Homo sapiens
  D8S279
  Located on chromosome 8
  Distance between a terminus base of telomere on chromosomal short arm and 5'-terminus of this base sequence : 70595758
  Distance between 3'-terminus of neighbour sequence of sequence listing upward to telomere on chrosomal short arm and 5'-terminus of this base sequence : 22602
gtgtcaggtcggggtggattgcagagaatttgttataataaactaagaggccccttgccctgccccccaaccttgcatgtgagtgtgtgtgtgtgtgtgtgtgtgtgtgtgtgtgtgtgtgtgtgtgtgttgggtggagggtggggggtgtaaagagagaggaagagggaatgactgggtatattggaaagatttttagttttcaggagttttttctaactaaaatcctacagacctgtgttt

SEQ ID NO: 13963 - DNA, 452 bp, Homo sapiens
  AC022905.2_51152
  Located on chromosome 8
  Distance between a terminus base of telomere on chromosomal short arm and 5'-terminus of this base sequence : 70717659
  Distance between 3'-terminus of neighbour sequence of sequence listing upward to telomere on chrosomal short arm and 5'-terminus of this base sequence : 121658
caaatagtctcctatcttcaggttaactgtgccatataacacaacataacatggcatagcataacataacataacataacataacataacataacataacataacataacataacataacgaaacagtgaaagtgatataagtttcataggttctggggattagagtataatatcttggtgtagggtaggttacctttttatgtttctattttcttctaggggtagggggcctagagcgagtaggacttgctatgggcaaaagtttagagtcaagtggggaagtattcaaatagagttaagaacaaagaaacagacaaattagggaaacagaattattgctgggaagcacaggatgatgccttgaggtaagaggttaggaatttagctattaaaggacacaaaatgcttataattttcaaaattccccgtcttatttgcgtagcatatctag

SEQ ID NO: 13964 - DNA, 479 bp, Homo sapiens
  AC022905.2_161313
  Located on chromosome 8
  Distance between a terminus base of telomere on chromosomal short arm and 5'-terminus of this base sequence : 70809038
  Distance between 3'-terminus of neighbour sequence of sequence listing upward to telomere on chrosomal short arm and 5'-terminus of this base sequence : 90927
gactcacctctacttagtactgctaaatactaatttcctgtaattatccccaaataatttcagttttcaaagtattttagtaccaatactgtaatgttttatattgtaaacatagaactgagtaaatactgagacgatatctttaatttgcctgcaggtgagctgcattttgattccatggctcctttcttgggcaataacagatccatcaattattttctagattagcaatatccaatagaactttctatcatatatctgtgctgttcaatatgatagctactaggatcataaccaaatgtggctattgagcacttgaaatgtgttggtgctactactactactagtatgtagtaccactagtgctactgaggaattaagttttaatttaatttgaattaattcaaatacatagagtcatgtatgatagtagctattgttactggagaacacagtgctagttgatacagatgacttac

SEQ ID NO: 13965 - DNA, 408 bp, Homo sapiens
  chr8.fa.O7frz.79724986
  Located on chromosome 8
  Distance between a terminus base of telomere on chromosomal short arm and 5'-terminus of this base sequence : 70938116
  Distance between 3'-terminus of neighbour sequence of sequence listing upward to telomere on chrosomal short arm and 5'-terminus of this base sequence : 128599
cttatctttgaaggatattgtcactgggtataaactgcttacttgtatagtttatggggataagtctgctttaattcttatcttggtttctctgtgtttcttttttcctctggctgcctacaaagtattttctgtatttttggttttcagcagtttgactcaaattcatgtgcctatgggtgtgtgtatgtgtgtgttttattctgtgtaaccccctcatcttgggtgtgagtgacttcattctaaggaagagaatatggcaaatgtgacaggtcatcacttgggaaattaggttataaaagacagtgatacggtctctctctctctctctctctctctctctctctctctctctctgtctctctctctctctctctctctctctcagtgaggaactgagactttcag

SEQ ID NO: 13966 - DNA, 454 bp, Homo sapiens
  AC073661.1_8501
  Located on chromosome 8
  Distance between a terminus base of telomere on chromosomal short arm and 5'-terminus of this base sequence : 70938264
  Distance between 3'-terminus of neighbour sequence of sequence listing upward to telomere on chrosomal short arm and 5'-terminus of this base sequence : -260
agcagtttgactcaaattcatgtgcctatgggtgtgtgtatgtgtgtgttttattctgtgtaaccccctcatcttgggtgtgagtgacttcattctaaggaagagaatatggcaaatgtgacaggtcatcacttgggaaattaggttataaaagacagtgatacggtctctctctctctctctctctctctctctctctctctctctctgtctctctctctctctctctctctctctcagtgaggaactgagactttcagtccagcaacccaggagaaagtgaatcctaccaaaaaccacgtgggtgagcttgaaacaagatcctgcctgggttgagccttgacattccgggagctccaactgatggcttgactgcagcctgtgagaggctgaatcagagaaattggagaagccatgccccgattcctgactcacagaaacagatactaagcat

SEQ ID NO: 13967 - DNA, 452 bp, Homo sapiens
  AC011003.5_180903
  Located on chromosome 8
  Distance between a terminus base of telomere on chromosomal short arm and 5'-terminus of this base sequence : 70976025
  Distance between 3'-terminus of neighbour sequence of sequence listing upward to telomere on chrosomal short arm and 5'-terminus of this base sequence : 37307
gttgtatgtttccagaattcagctatttcctctagattttctagtttgtgctcatggagacgctcatcataatctctgaggatcttttgtatttttgtgcgattggttatgatgtcacctttgtcatttctgattgtgcttatttggaacttttctccttttttctttgcttctttagctagcggtctatcaatcttgtttattcttccaaacacacacacacacacacacacacacacacacacacacacacacacgcctttttgttttgttgagcctttgtatgtttttttggtcttattttcatttagttgtgctctgattttaattatttcttttctcctacagctttgggtttagtttgttcttgcttttctagttcctttaggtgtaatgttagatttttaacttcagatctttctatcttcttgatgtaggcatttagtgctgta

SEQ ID NO: 13968 - DNA, 457 bp, Homo sapiens
  AC073661.1_113005
  Located on chromosome 8
  Distance between a terminus base of telomere on chromosomal short arm and 5'-terminus of this base sequence : 71011640
  Distance between 3'-terminus of neighbour sequence of sequence listing upward to telomere on chrosomal short arm and 5'-terminus of this base sequence : 35163
gactagaatgatctaaatggtcagaggtgaagaaattacataatagaataaatagtggaaaaggaagataatgtaataatacctgtggcctgaccgaacaaaccacagaagtgcggactattttttttccactaactcttctggcctaggtctttttgtttttttttcttaagagaaattgtaaccaccttgaagagtcagtgacagattggaatcaatgtagaacatgaaaggataaaagaaactgactgatgtgaggtgtggatcgagaggaaggaaggaagggagggagggagggagggagggagggaaggagggaggaggaagggagggaattaagttgtgtccctcaaaaatgtgtgtccaagtcttaacttccagtacctgtgaatgtggccttaattggaaatagggtcttggaagatgtaattaagataaggagtttaggatggaatta

SEQ ID NO: 13969 - DNA, 298 bp, Homo sapiens
  chr8.fa.O7frz.79942918
  Located on chromosome 8
  Distance between a terminus base of telomere on chromosomal short arm and 5'-terminus of this base sequence : 71148539
  Distance between 3'-terminus of neighbour sequence of sequence listing upward to telomere on chrosomal short arm and 5'-terminus of this base sequence : 136442
gcagaactgactttattgtcacttattatgcagatttctcctgttagggggtgtgtgtgtgtgtgtgtgtgtgtgtgtgtgtgtgtgtgtgtgtgagatgcacttaaaggggtagctgataattatttgaagtacttcttttcacagtggtttagcaggttagcagatttttcccaagaaaaaagagctaaccatgcatcaaaataacacttttctggagcatttctagaggatagctccaaggaatgatgcccacttcatcctttattaaggttggtatctcaggagaacttacgct

SEQ ID NO: 13970 - DNA, 387 bp, Homo sapiens
  chr8.fa.O7frz.80026671
  Located on chromosome 8
  Distance between a terminus base of telomere on chromosomal short arm and 5'-terminus of this base sequence : 71224527
  Distance between 3'-terminus of neighbour sequence of sequence listing upward to telomere on chrosomal short arm and 5'-terminus of this base sequence : 75690
agattaggaaagtggagttcagaaaagcaagtaacttgcccaaaatcaactattaagggctattattaccctaaaattttgccaggggtcttccatctgaaaggagttactgaaatggcaaaactattacagctctctcggagatactgtcagagaaagctggtgtgtgtgtgtgtgtgtgtgtgtgtgtgtgtgtgtgtattggtgaaacagccaagtaatcctagacaaagggcacagataagatgagcagtgtgtccccaaaaggacctcagctttcagagggactctcctacctagcaccaaaactatggagtaggcttcaagataaatcaggagttactgtcttgagtgatctctttaaagatgaggaatttagcagtgact

SEQ ID NO: 13971 - DNA, 117 bp, Homo sapiens
  D8S1123
  Located on chromosome 8
  Distance between a terminus base of telomere on chromosomal short arm and 5'-terminus of this base sequence : 71482364
  Distance between 3'-terminus of neighbour sequence of sequence listing upward to telomere on chrosomal short arm and 5'-terminus of this base sequence : 257450
taaatgtcaattaatcgagagtggttacactaagaacaaaaatggatttccatgaagctgttaataataataataataataataataataataaggtagatcagtacctccaagaca

SEQ ID NO: 13972 - DNA, 429 bp, Homo sapiens
  chr8.fa.O7frz.80412438
  Located on chromosome 8
  Distance between a terminus base of telomere on chromosomal short arm and 5'-terminus of this base sequence : 71571826
  Distance between 3'-terminus of neighbour sequence of sequence listing upward to telomere on chrosomal short arm and 5'-terminus of this base sequence : 89345
gcttaatgatcattgtgtcaacagatgtttacagagtccagcccatgtccatctatcacaaagcagggcagagaagggtggatttggagctgagagccattatattgataactggcacataaagtgcttttatttttttcaacttactcccaacacacacacacacacacacacacacacacacacacacacgcacgcacgcacaccccttcatatgtcaaaatgacattaagtttcatttaaatgtatcctatattgaaagagcaaaaaaaaaaagtgacagtttgactcaagaaatgcaatggtttatatgacctacaactctcgaaggaaaagagtaataattttgcaatgttttgatgatatttacaagtcataatttaaagagatacataatttttccctttctacgtaagtcctcaaggaact

SEQ ID NO: 13973 - DNA, 300 bp, Homo sapiens
  chr8.fa.O7frz.100905515
  Located on chromosome 8
  Distance between a terminus base of telomere on chromosomal short arm and 5'-terminus of this base sequence : 71701639
  Distance between 3'-terminus of neighbour sequence of sequence listing upward to telomere on chrosomal short arm and 5'-terminus of this base sequence : 129384
aataggatacaatggctgagtcaaacagaggttgctgcttaaaagctcagtgttggtaatctatcagttatttcaggctgaatgtttcaaattctctttttgttttttacttaatttttgcaggtacataataggtgtgtgtgtgtatatatatatatatatatatatatatatatatagatgggggtacatgagctattttgatacaagcatataatgcatgataatcacatcagggtaaatgcggtatctatctcctccagaattttcctttctttgtgttgcaaacaatctgattat

SEQ ID NO: 13974 - DNA, 301 bp, Homo sapiens
  chr8.fa.O7frz.100810682
  Located on chromosome 8
  Distance between a terminus base of telomere on chromosomal short arm and 5'-terminus of this base sequence : 71746859
  Distance between 3'-terminus of neighbour sequence of sequence listing upward to telomere on chrosomal short arm and 5'-terminus of this base sequence : 44920
caattctcactgcactacaatcaaagaccttctggcagttggagtggggctagaatctgttgcaatttagggaaaatgaaattcagttaaggaaaactatcactgagggtgggtagcatgtcaagcaattttagctggccttcggatttgttactggaaagggtccaaagactatagtttgagaaacattgccgcgtgtgtgtatgtgtgtgtgtgtgtgtgtataatatacataaacattcaatagagtcatatattcaatgcattcaaacatctatatctagctatcaaatttggaaat

SEQ ID NO: 13975 - DNA, 157 bp, Homo sapiens
  Z67484
  Located on chromosome 8
  Distance between a terminus base of telomere on chromosomal short arm and 5'-terminus of this base sequence : 71915266
  Distance between 3'-terminus of neighbour sequence of sequence listing upward to telomere on chrosomal short arm and 5'-terminus of this base sequence : 168106
ctgtgctaatggaccgtataggattctgagtgtcacacatgctcatatgatcttaataaactgtatgaatgtgtgtgtgtatacacatacatacacacacacacacacacacacacacatatatatatatatatacaggaggtatttctgttgaccc

SEQ ID NO: 13976 - DNA, 162 bp, Homo sapiens
  D8S1818
  Located on chromosome 8
  Distance between a terminus base of telomere on chromosomal short arm and 5'-terminus of this base sequence : 72053444
  Distance between 3'-terminus of neighbour sequence of sequence listing upward to telomere on chrosomal short arm and 5'-terminus of this base sequence : 138021
agcattcattcctaaagactgtgtgtttgtacttgatatacatagaatcactatatatgtctgtatatgtacctttacacacacacacacacacacacacacacacacatatacaggttgagtacatcttagcctaaatgcttgagaccagaagtatttcag

SEQ ID NO: 13977 - DNA, 273 bp, Homo sapiens
  chr8.fa.O7frz.101274272
  Located on chromosome 8
  Distance between a terminus base of telomere on chromosomal short arm and 5'-terminus of this base sequence : 72165553
  Distance between 3'-terminus of neighbour sequence of sequence listing upward to telomere on chrosomal short arm and 5'-terminus of this base sequence : 111947
gttatcatgctttctgtaattgtctccccaaaagacgcctattgagagcattgtctgggcttgtgtattagactgacaatcaagctccaggcagagggtagaggggcatatgcagcctgccccaaaatgcttttgtgtgtgggggggggagggctgtgtgtgtgtgagtgtgtgtgtgtgtgtgtgtgtgtgtgtgtgtgtggttgttcagcagagagagctaagattctggaaaaatatgaggacgcactgtgcgtactaacaagatcagtc

SEQ ID NO: 13978 - DNA, 351 bp, Homo sapiens
  AC024738.3_45474
  Located on chromosome 8
  Distance between a terminus base of telomere on chromosomal short arm and 5'-terminus of this base sequence : 72332021
  Distance between 3'-terminus of neighbour sequence of sequence listing upward to telomere on chrosomal short arm and 5'-terminus of this base sequence : 166195
aactcctgacctcgtgatccacccaccttggcctcccaaagtgttgggattacaggcgtgagccaccgcacctggccatatatcagagttttatttatttatttatttatattatactttaagttctagggtacatgtgcacaacatgcaggtttgttacatatgtatacatgtgccatgttggtgtgctgcacccattaacttgtcatttacattaggtatatctcctaatgctgtccctcccgacttcccccatcccacgacaggccctggtgtgtgctgttccccatcctgggtccaagtgttctcgttgtgcaattcccacctatgagtaagaacatgcagtgtttg

SEQ ID NO: 13979 - DNA, 407 bp, Homo sapiens
  AC022182.3_54933
  Located on chromosome 8
  Distance between a terminus base of telomere on chromosomal short arm and 5'-terminus of this base sequence : 72368081
  Distance between 3'-terminus of neighbour sequence of sequence listing upward to telomere on chrosomal short arm and 5'-terminus of this base sequence : 35709
tctgacaatattgcctgtaaactgctgaaataactcctgatatatttcctgctggatggcaccaaattgttgtacaaggttgtgaatgataaccctttgtgagaggtgaagcttctagagggtgtggtctgcccattctacattgtatagagatgttgctgccttgggacactattatttcagtatgatagatgtttgattcaagttgtaataattttatcttccacagaattcttggaaggaagtgatggagacacacatacacacacacacacacacacacacacacacacacacacacacacacacacacacacacacacggaggcatgagtataatttttcaccaagaagcctttagttacccatggagatgttataattttagatgttagaaggatcagaaa

SEQ ID NO: 13980 - DNA, 341 bp, Homo sapiens
  chr8.fa.O7frz.101348432
  Located on chromosome 8
  Distance between a terminus base of telomere on chromosomal short arm and 5'-terminus of this base sequence : 72483991
  Distance between 3'-terminus of neighbour sequence of sequence listing upward to telomere on chrosomal short arm and 5'-terminus of this base sequence : 115503
aatgataactcaatcatagctcactgcagccctgaactcctcagcggaagcaatcctcctgcctctcagcctcctgggtagctggcactacaggctcgcaccactacatccagctaatttgtacgtatgtatgtatgtatgtatgtatgtatgtatgtatgtatgtgtgtatgtatgtatgtatgtatgtagagatggggttttgctttgttgcccaagctggtctcaaactccctccagggaattttttgatatcatcactagcctcagcagcatgctgggcactcattccttccccacattcttctgtcttatctctgtggagaagtaggagtaaagga

SEQ ID NO: 13981 - DNA, 243 bp, Homo sapiens
  AC022182.3_107687
  Located on chromosome 8
  Distance between a terminus base of telomere on chromosomal short arm and 5'-terminus of this base sequence : 72756286
  Distance between 3'-terminus of neighbour sequence of sequence listing upward to telomere on chrosomal short arm and 5'-terminus of this base sequence : 271954
caatgtaggtcataggccattcccagtgcaccagctccgacttcctcgctttccaacattttgagaaatcacatcagtaagagcgacactaaatctttctactttttcctttccttctttctctctctcttccttccttccttccttcctctgttttcccttccttccttttgaaagtaaattatttgcatacttgagtatttatcagcagtcacactttctttggtgcatcttatagcagat

SEQ ID NO: 13982 - DNA, 418 bp, Homo sapiens
  chr8.fa.O7frz.67920876
  Located on chromosome 8
  Distance between a terminus base of telomere on chromosomal short arm and 5'-terminus of this base sequence : 72836994
  Distance between 3'-terminus of neighbour sequence of sequence listing upward to telomere on chrosomal short arm and 5'-terminus of this base sequence : 80465
gctcagaatctgtcactatcacaaggctgaaaatcccacttctgagtagctttgggaaagtcaattttaactttttgtttcagttttctcatttgagaaaggtgtgtgtgtgtgtgtgtgtgtgtgtgtgtgtgtgtgtgtgtgactctcctgcaaggggatggactcgacctggtgcaggccaggaaatcctttgtcagtgagatgagaacccttaaaagacatgatttagtttcccacattccagttttgctcttctccaagcccaggaatgcctcacttctggtccagcaggggaaggcactgagcttgccaaaggaaagctacacagagagccaggggcatggcgcttaggacttcccatggttgaccagacgcttgggcagcttttggtgacttatctattcctttccacatt

SEQ ID NO: 13983 - DNA, 223 bp, Homo sapiens
  D8S510
  Located on chromosome 8
  Distance between a terminus base of telomere on chromosomal short arm and 5'-terminus of this base sequence : 73025893
  Distance between 3'-terminus of neighbour sequence of sequence listing upward to telomere on chrosomal short arm and 5'-terminus of this base sequence : 188481
ggcaacgcatggactaatttacagcccctcccttcctggctctctcaggtcagtaggcttggccaccaaagggaacactgtgtgtgtgtgtgtgtgtgtgtgtgtgtatgcatgtgagtgtgtgcctgtgtgtgtgtgtgtgtgcttcttttgaggaggctgaggatgctttgaggttggagaggggaagatgggagatgactcataaagactggtgggccag

SEQ ID NO: 13984 - DNA, 211 bp, Homo sapiens
  D8S1843
  Located on chromosome 8
  Distance between a terminus base of telomere on chromosomal short arm and 5'-terminus of this base sequence : 73032506
  Distance between 3'-terminus of neighbour sequence of sequence listing upward to telomere on chrosomal short arm and 5'-terminus of this base sequence : 6390
gcagaagcaacaattaaaagtcctggctgagaaagaaactcctaattacatttggatgacttgatgttccctcgaatatggtgcctgctcttttctttcttccttgattggagcctctaggggtgtgtgtgtgtgtgtatgtgtgtgtgtgtgtgtgtgtgtgtgtgtgtgtttggtttgacaacatgtgttgctattactcagttgtttt

SEQ ID NO: 13985 - DNA, 177 bp, Homo sapiens
  DISO7_10002506
  Located on chromosome 8
  Distance between a terminus base of telomere on chromosomal short arm and 5'-terminus of this base sequence : 73103263
  Distance between 3'-terminus of neighbour sequence of sequence listing upward to telomere on chrosomal short arm and 5'-terminus of this base sequence : 70546
cctagaaagcattagttgaacaagatagctagctagctagctagctagatacatacatacatacatacatacatacatacatacatacatacatacatattcccatgcctagaataaatactagaacaataggtggggaaaataatgaattttgtattggttcatcccaagaggatc

SEQ ID NO: 13986 - DNA, 380 bp, Homo sapiens
  chr8.fa.O7frz.68420069
  Located on chromosome 8
  Distance between a terminus base of telomere on chromosomal short arm and 5'-terminus of this base sequence : 73138578
  Distance between 3'-terminus of neighbour sequence of sequence listing upward to telomere on chrosomal short arm and 5'-terminus of this base sequence : 35138
aaggcctatgatcttgagatacatctgctctagcccttaagaaatgctcttccaggagggcggtaggcctcttggggttctgggagacttttgtgtgactgacaacttcccttttgtctgcagttggcggatgtgatcaggcaagaggcaaccaataatgatgtgttgaccatgagaggggtgtgtttgctgattttcccttccctcaccttcccctctgtacaaaacacacacacacacagagagagagagagagagagagagagagagagagaacagagagtagcatggctgggctcattcaagaagacccagaacatctgcacattgcctttatcagacagaaggcctttcatgtgacttgtataggaagtacctga

SEQ ID NO: 13987 - DNA, 148 bp, Homo sapiens
  DISO7_10002507
  Located on chromosome 8
  Distance between a terminus base of telomere on chromosomal short arm and 5'-terminus of this base sequence : 73249721
  Distance between 3'-terminus of neighbour sequence of sequence listing upward to telomere on chrosomal short arm and 5'-terminus of this base sequence : 110763
ttatgtcacatgcttgaaaggcccctgttctatatagcctctctctagaccatacttctgccaaaaaaaaaaaaaaaaaaaggaaagtgtgtctgtgtgtgtgtgtgtgtgtgtgtgtgtgtaacattcacaggaacttaaattcttc

SEQ ID NO: 13988 - DNA, 120 bp, Homo sapiens
  DISO7_10002508
  Located on chromosome 8
  Distance between a terminus base of telomere on chromosomal short arm and 5'-terminus of this base sequence : 73406692
  Distance between 3'-terminus of neighbour sequence of sequence listing upward to telomere on chrosomal short arm and 5'-terminus of this base sequence : 156823
cttcaaggatcgtgtgagagagagagagtgtgtgtgtgtgtgtgtgtgtatgtgtgtgtgtctaagtaaagtaattatttctttgtctttcatgaaaataaccagcctcttccattggat

SEQ ID NO: 13989 - DNA, 392 bp, Homo sapiens
  chr8.fa.O7frz.68815147
  Located on chromosome 8
  Distance between a terminus base of telomere on chromosomal short arm and 5'-terminus of this base sequence : 73551721
  Distance between 3'-terminus of neighbour sequence of sequence listing upward to telomere on chrosomal short arm and 5'-terminus of this base sequence : 144909
ttagcttaagacagtgagtcgtttccagtgtctttattagatctcgttgagtcatttccagtttttttactggatcttattttttgataagcacagtcaccatctcattttatgtgctttaaaaatacagtttaaataaagataaatcatttagaaatcatatgtgtatttttcttcactaaagtttatttcatcaaagttataattacttttctgaaaatttatagtgtagaaacatcatcaaagttttatgcagagaggcattgagagatatataaataatcattatatcaccttatttattgtgtgtgtatatatatatatatatatatatccaggctggagtgtggtgacacgatcatagcttactgtaacttccaactccttagctc

SEQ ID NO: 13990 - DNA, 350 bp, Homo sapiens
  chr8.fa.O7frz.68915356
  Located on chromosome 8
  Distance between a terminus base of telomere on chromosomal short arm and 5'-terminus of this base sequence : 73594962
  Distance between 3'-terminus of neighbour sequence of sequence listing upward to telomere on chrosomal short arm and 5'-terminus of this base sequence : 42849
gtttggctcatttatgtcatactgcaatataagctcatgttctgagtttaaaaaacaacctaccataaatgtttctttctagaattttcattaaggcaaatttgttcagcctcgtgtgttttactaacttggtgcagtgtagtttttagcaagtttaatagctttatcttctcagtgtttctatttcatataataaggcaaaaaaaaatcttcctctatgtgaccattgttttaaaatgtaataatatccatcaattatctatctatctatctatctatctatctatctatctattaaaaacacattttaacatacttcactgctcctgctaatgctttagtttacagtc

SEQ ID NO: 13991 - DNA, 221 bp, Homo sapiens
  DISO7_10002512
  Located on chromosome 8
  Distance between a terminus base of telomere on chromosomal short arm and 5'-terminus of this base sequence : 73599552
  Distance between 3'-terminus of neighbour sequence of sequence listing upward to telomere on chrosomal short arm and 5'-terminus of this base sequence : 4240
acctagaaatatgcagtgttaacacacagggactgaactttgatcagcaagaaactggaaactggaaaaagtgagcagataaattgtttgccctttcttaccctgaaacaacaacaacaacaacaacaacaacaacaacagaaaccacacacccaaaactgtttcatgggctttgtatggcctttttggagatgccctgtgtgaagtagcagttggccact

SEQ ID NO: 13992 - DNA, 375 bp, Homo sapiens
  chr8.fa.O7frz.69024360
  Located on chromosome 8
  Distance between a terminus base of telomere on chromosomal short arm and 5'-terminus of this base sequence : 73691523
  Distance between 3'-terminus of neighbour sequence of sequence listing upward to telomere on chrosomal short arm and 5'-terminus of this base sequence : 91750
attaaatggcagacttaagctctagcatatcaataattaccttaaatataaataatctaaatttacctgtaaaaagacaaagagatttgcaaagtggatgaaaaaacatgaactaactatatactgtttacaagaaggtcacctcaaattcaacaacataggtagcttgaaatgaaatgatgaaaatgatatgccatgcaaacattatatattaataatatagattgtacgtgtgtgtgtgtgtgtgtgtgtgtgtgtgtgttttaaaaacctagtaaaggtctgaatgagagaagatgaggaagccaaatcagtgtacatcactgaatctgggtaggaaggttaccgctaatgttacggaatttaacaagcata

SEQ ID NO: 13993 - DNA, 269 bp, Homo sapiens
  AC067849.2_24452
  Located on chromosome 8
  Distance between a terminus base of telomere on chromosomal short arm and 5'-terminus of this base sequence : 73731668
  Distance between 3'-terminus of neighbour sequence of sequence listing upward to telomere on chrosomal short arm and 5'-terminus of this base sequence : 39770
catgtggatatctaatggttctagcaccgtttgtttgaaagaccattatttcttcattgaattgtctttgcctctgttaataagctgaaaatgtatgtgtgtgtgtgtgtgtgtgtgtgtgtgtatgtttggacccaccaccattcttttccattcatctatgtacttattttgctaatattacactgtcttgattactgtagatttatggtcaattttgaaattggataatttaactcctctaagtttattcatctttctcagaatga

SEQ ID NO: 13994 - DNA, 415 bp, Homo sapiens
  AF286885.1_68342
  Located on chromosome 8
  Distance between a terminus base of telomere on chromosomal short arm and 5'-terminus of this base sequence : 73844267
  Distance between 3'-terminus of neighbour sequence of sequence listing upward to telomere on chrosomal short arm and 5'-terminus of this base sequence : 112330
ggcaatacatttggcatagaaagaatgaccctgttcccccaacccctactgatcttatattttgctggaggcaaaagcaaatttccaagattcaggtcaatgtcaatttagaattatttctgccagttggaaaagaaaacattttcttttaacttgagaaaatttgaaagctacagccttctaaggaaacaggatacctaacacacacacacacacacacacacacacacacacacacaccccagcctggctttacgtagctcaatcctgtcaggctaatctaatcttttgtgacagagcagcagacctggtagatcaagggggaaaacaatagttggaatttatgtttgttggcttcaaaacttttgattcctgggtcccactcaatataattatcattaaattggttgaaagg

SEQ ID NO: 13995 - DNA, 403 bp, Homo sapiens
  AF286885.1_17259
  Located on chromosome 8
  Distance between a terminus base of telomere on chromosomal short arm and 5'-terminus of this base sequence : 73942964
  Distance between 3'-terminus of neighbour sequence of sequence listing upward to telomere on chrosomal short arm and 5'-terminus of this base sequence : 98282
agatttcacctttataaactccacccctccctgcactagtcagccacaagatcatgggatcatggatcatggggtgcgaccctgggcaaggtagatctcttctgccgagggaaatttctcaggagggcctctcctgtggacactctcagcaactgaggagcaagtactgcagctctcaagatgcaatttggatggcacactacagtattcattacacctctccccagagaaaccaaagtatggtattaggtaggaatgaagataagcacccaggagtagaagaagaagaagatggcttgaccatgtattggtagggctcctcttaggaaatggctcaaatgaagagactttatggacagggttaaagaagcagacacgattgtgatgtacctggagactaaca

SEQ ID NO: 13996 - DNA, 207 bp, Homo sapiens
  G12406
  Located on chromosome 8
  Distance between a terminus base of telomere on chromosomal short arm and 5'-terminus of this base sequence : 74064994
  Distance between 3'-terminus of neighbour sequence of sequence listing upward to telomere on chrosomal short arm and 5'-terminus of this base sequence : 121627
tgaaaacatagtacaatgaacatccatttatccaccacccagattcaacagtggcaaactttttgtcacagtggtttatttacttctaactagatctatcggtctgtctatctatctatctatctatctatctatctatctatctatctatctatcatctatctatctacatatagaactatttcaatcattggcagatattatgac

SEQ ID NO: 13997 - DNA, 121 bp, Homo sapiens
  Z67645
  Located on chromosome 8
  Distance between a terminus base of telomere on chromosomal short arm and 5'-terminus of this base sequence : 74308176
  Distance between 3'-terminus of neighbour sequence of sequence listing upward to telomere on chrosomal short arm and 5'-terminus of this base sequence : 242975
tccacaatcacatgggccaattccttaatatatatacacagacagacacacacatacacacacacacacacacacacacacgttgatggttctttttctttggagaaccctgacttataca

SEQ ID NO: 13998 - DNA, 423 bp, Homo sapiens
  AC027018.2_88291
  Located on chromosome 8
  Distance between a terminus base of telomere on chromosomal short arm and 5'-terminus of this base sequence : 74363976
  Distance between 3'-terminus of neighbour sequence of sequence listing upward to telomere on chrosomal short arm and 5'-terminus of this base sequence : 55679
aaactcaactttaatactgctcactaagcttctttctcttacttataaaagtcatattaaaatgtactatgatggacagggcagtttgtatgatattatcatcaatatatcacaacaaaagttccaaacacaacgctttagatgtctttgagaaggttttagatatctttgagagcacactactcaaagatgctcttctatatttaattttttataagttagtatatatgtcttctatataattttatatatatatatatatatatatatatatatatatatatatggtgcaaagatagcacagagttcccacacacccttcatctagctttccctaacattagcaactgacaaaaacacagtaacactggtcaaaactggaaactgaacattgatacaacagtattaagtaaatcgcagatt

SEQ ID NO: 13999 - DNA, 425 bp, Homo sapiens
  chr8.fa.O7frz.81043225
  Located on chromosome 8
  Distance between a terminus base of telomere on chromosomal short arm and 5'-terminus of this base sequence : 74431752
  Distance between 3'-terminus of neighbour sequence of sequence listing upward to telomere on chrosomal short arm and 5'-terminus of this base sequence : 67353
aggttttacatttaagtccagaagccattttgagttagttttcctatacagcgcaaggtatgaatccattttttgtatatcaatatccaattgtttccaactgtggaaaaggctacatttctcccactacattgcctttatgtctttgtcaaaattattagttatctacatataaggagtttatttctggactaccaattctgtttccactgatctatttgtcttttgttgttgttgttgttgttgttgttgttgttgttgttgttttgagacggagtctcgctctgtcgcccaggctggagtgcagtggcgcgatctcagctcactgcaacctccacctcctgggttcaagcgattctgccgcctatttacctatttttacgccaaactattttacagcttttaattcttgaaatcaggtagtg

SEQ ID NO: 14000 - DNA, 298 bp, Homo sapiens
  AC009672.4_157052
  Located on chromosome 8
  Distance between a terminus base of telomere on chromosomal short arm and 5'-terminus of this base sequence : 74672724
  Distance between 3'-terminus of neighbour sequence of sequence listing upward to telomere on chrosomal short arm and 5'-terminus of this base sequence : 240547
gcaacatcgctacagaaaatacaatttaaaaaaaggtgcatgcctgtggttccagctactcaggaggttgaggtgggaggattgcttgagcctaggaaggcttgtgccactacactccagcctgggcaacaagcaagaccctatctcaaaaacaaacaaacaaaaaaccccacaacaacaacaacaacaacaacaacaacaacaaaacaacagacaaaaccagaaagagctgcaagggatcccaaatagcccaaacaatcttgaaacagaaaaacaaagttggaggcctcatactttc

SEQ ID NO: 14001 - DNA, 233 bp, Homo sapiens
  D8S526
  Located on chromosome 8
  Distance between a terminus base of telomere on chromosomal short arm and 5'-terminus of this base sequence : 74769783
  Distance between 3'-terminus of neighbour sequence of sequence listing upward to telomere on chrosomal short arm and 5'-terminus of this base sequence : 96761
tttgggagtcgaatttgcaagtaccatacatatctatgtttaaaataattttccttttggttgttataaaagttatacatctttatgatatgatatttagaaaatatggacaagcaattataaagtaaaagttacccataatctcaccagtttacacacacacacacacacacacacacacacacacatatatctgtttctctcaaaaacacatttatgaatcaatggatgga

SEQ ID NO: 14002 - DNA, 230 bp, Homo sapiens
  D8S286
  Located on chromosome 8
  Distance between a terminus base of telomere on chromosomal short arm and 5'-terminus of this base sequence : 74924476
  Distance between 3'-terminus of neighbour sequence of sequence listing upward to telomere on chrosomal short arm and 5'-terminus of this base sequence : 154460
gctgtttatttgcccatgtcattgattttgtacacacacacacacacacacacacacacacacacataaatatttacttaaggtagatttatataaagatattttcctctttctttcccattccttaactttctttccctctttttttccatctttctcttctgaaaacttccttctgtccattttttttcactccctctttcttttctttctcagtgacagtttcatgc

SEQ ID NO: 14003 - DNA, 253 bp, Homo sapiens
  D8S551
  Located on chromosome 8
  Distance between a terminus base of telomere on chromosomal short arm and 5'-terminus of this base sequence : 75051087
  Distance between 3'-terminus of neighbour sequence of sequence listing upward to telomere on chrosomal short arm and 5'-terminus of this base sequence : 126381
ccacaaaggactttcagttacgaataatcaccatttccacgaaagggaacaacctggtatgtagcaatctcagtaaggacacacacacacacacacacacacacggagtattgggctaatagatgaactatcagaaacccgattaaatcttagcctaatactgcctattctaaatctccaaggaagaatattaactcaaaggagataaatcaaaaccaagtatttggagtgcctataatgtcttggtaactgt

SEQ ID NO: 14004 - DNA, 237 bp, Homo sapiens
  AF303735.1_118472
  Located on chromosome 8
  Distance between a terminus base of telomere on chromosomal short arm and 5'-terminus of this base sequence : 75199352
  Distance between 3'-terminus of neighbour sequence of sequence listing upward to telomere on chrosomal short arm and 5'-terminus of this base sequence : 148012
aaattacctattgcaaatggtccctaaagttgaataagatgaaaacagccaactgtccacggtgactggtgagtgtggtgagaatggtggcaggcaaatgcacacacacacacacacgcgcgcacacacacacacacacacacacacacacacacacacttcccttttccctgctgctgacacatggctatttttacccagaagagaagatacgttaaacatagactatgtggcatt

SEQ ID NO: 14005 - DNA, 184 bp, Homo sapiens
  G09139
  Located on chromosome 8
  Distance between a terminus base of telomere on chromosomal short arm and 5'-terminus of this base sequence : 75339813
  Distance between 3'-terminus of neighbour sequence of sequence listing upward to telomere on chrosomal short arm and 5'-terminus of this base sequence : 140224
aattcaaaatagctagaagaattgcaatattcctgacctaaagaaaacataaatgtttaaggtcatggatttgccaattaccctgatttggcaaattatctatctatctatctatctatctatctatctatctatctatctatctatcttgcttctaaactttaaggtgtccttgctcattcct

SEQ ID NO: 14006 - DNA, 159 bp, Homo sapiens
  D8S1144
  Located on chromosome 8
  Distance between a terminus base of telomere on chromosomal short arm and 5'-terminus of this base sequence : 75339828
  Distance between 3'-terminus of neighbour sequence of sequence listing upward to telomere on chrosomal short arm and 5'-terminus of this base sequence : -169
gaagaattgcaatattcctgacctaaagaaaacataaatgtttaaggtcatggatttgccaattaccctgatttggcaaattatctatctatctatctatctatctatctatctatctatctatctatctatcttgcttctaaactttaaggtgtcctt

SEQ ID NO: 14007 - DNA, 376 bp, Homo sapiens
  AC009629.3_28349
  Located on chromosome 8
  Distance between a terminus base of telomere on chromosomal short arm and 5'-terminus of this base sequence : 75519368
  Distance between 3'-terminus of neighbour sequence of sequence listing upward to telomere on chrosomal short arm and 5'-terminus of this base sequence : 179381
ttctagtgagacagctttacctacacaaagccaacctgctaaacatttgaaaatattttgttgggtatagtgaataaatgaccaagtgaatcttttatctattatctatgtatgtatgtatgtatgtatgtatgtgttatctatgtatgtatatatctgttatgtatgcatgtatgtatgtatctatcatttatgtatgtatgtatgatctatgtatgtatgtatgtatctgttatgtatgtatgtatgtatgtatgtatgtatctatctatctatccatctacctatctatctcatctatcttttatagttttctggcacttgacattcaaggccctcaatcaaccttcttcctacatgtaccgtatttccattt

SEQ ID NO: 14008 - DNA, 232 bp, Homo sapiens
  D8S548
  Located on chromosome 8
  Distance between a terminus base of telomere on chromosomal short arm and 5'-terminus of this base sequence : 75527639
  Distance between 3'-terminus of neighbour sequence of sequence listing upward to telomere on chrosomal short arm and 5'-terminus of this base sequence : 7895
cattgagcacaccctcagtgaaggggacagacacaaataagtaaataactccaagcaaaagcaatatgttataagaaagggagaattaaagtgccatgggaatgcaggctgaaagttgtaaaagtaattgtaagaggagaagaagtgtgtgtgtgtgtgtgtgtgtgtgtgtgtgtcaaagagcgagaagggaggaagagagaatatttacatttggccttgcatgaggtag

SEQ ID NO: 14009 - DNA, 115 bp, Homo sapiens
  D8S1829
  Located on chromosome 8
  Distance between a terminus base of telomere on chromosomal short arm and 5'-terminus of this base sequence : 75664673
  Distance between 3'-terminus of neighbour sequence of sequence listing upward to telomere on chrosomal short arm and 5'-terminus of this base sequence : 136802
cgtcaatcaatcaatcaatcaatcaatcaatcaatcaatcatgtgtgtgtgtgtgtgtgtgtgagagagagagagagtgtgtgcatgtatatgtgttaaaaggttgatcgaagct

SEQ ID NO: 14010 - DNA, 215 bp, Homo sapiens
  chr8.fa.O7frz.82402446
  Located on chromosome 8
  Distance between a terminus base of telomere on chromosomal short arm and 5'-terminus of this base sequence : 75777225
  Distance between 3'-terminus of neighbour sequence of sequence listing upward to telomere on chrosomal short arm and 5'-terminus of this base sequence : 112437
tttactaactcgaagccaagtgtttataaaaatggcaatgggtcattgctttatatatatatatatatatataaatacgcatgtgttttatatatatatacatgcacatacatcatggatgtttatacatatatgcatatgtaatacatgtatatgtgtgatatctagttcacagaaaaatgtgaaaattcaagtggtaatgaattatctggtga

SEQ ID NO: 14011 - DNA, 312 bp, Homo sapiens
  chr8.fa.O7frz.82489590
  Located on chromosome 8
  Distance between a terminus base of telomere on chromosomal short arm and 5'-terminus of this base sequence : 75889958
  Distance between 3'-terminus of neighbour sequence of sequence listing upward to telomere on chrosomal short arm and 5'-terminus of this base sequence : 112518
ataactgcgcaatgttactaagaagtttctgagctaactcacgagttgggactacttggaattggaagggttctgtccaatcagtgctcagtaagcaggtcccgaatgggtgggagaagggagtagtatacccccagcatggaagtcttatgtaagcaactttaaaacactgggtttttatgcataaccatcttcaattagacacagttgctgttttccaagcagacccatcagaagatcacacacacacacacacacacacacacacacacttctcatgaaaatggagtatgacaaatcctgtactaggaa

SEQ ID NO: 14012 - DNA, 131 bp, Homo sapiens
  DISO7_10002529
  Located on chromosome 8
  Distance between a terminus base of telomere on chromosomal short arm and 5'-terminus of this base sequence : 75922245
  Distance between 3'-terminus of neighbour sequence of sequence listing upward to telomere on chrosomal short arm and 5'-terminus of this base sequence : 31975
tcactttgagagcaagatgaacatttttcatttttacactttcccttctctttccatagacatggccagtttagtgtgtgtgtgtgtgtgtgtgtgtgtgtgtgttcctgagctagttcatctattattcc

SEQ ID NO: 14013 - DNA, 173 bp, Homo sapiens
  DISO7_10002530
  Located on chromosome 8
  Distance between a terminus base of telomere on chromosomal short arm and 5'-terminus of this base sequence : 75964543
  Distance between 3'-terminus of neighbour sequence of sequence listing upward to telomere on chrosomal short arm and 5'-terminus of this base sequence : 42167
tcctcccagttcttggtcaaatagaaaaagttggatagaataaaaagcctttacctgaataaataagaaaaaaactcatgaaaatattggataaaatatataaatctatatttatatttatgcatacacacacacacacacacacacacatccaagtaggagtcattgtgaaa

SEQ ID NO: 14014 - DNA, 211 bp, Homo sapiens
  chr8.fa.O7frz.82855882
  Located on chromosome 8
  Distance between a terminus base of telomere on chromosomal short arm and 5'-terminus of this base sequence : 76109102
  Distance between 3'-terminus of neighbour sequence of sequence listing upward to telomere on chrosomal short arm and 5'-terminus of this base sequence : 144386
cttagctcatgtacctaattcaactaaatatatatacgtgtgtgtgtgtgtatatatatatgtgtgtgtgtgtgtatatatacacacacacacacatatatgtgtatatgtacgtgtgtgtgtgtatgtgtgtgtgtgtgtgtgtatatatatatatatatatatcctaagcttgacttttcagaccttctgtactgaggcttcaatgtag

SEQ ID NO: 14015 - DNA, 101 bp, Homo sapiens
  DISO7_10002536
  Located on chromosome 8
  Distance between a terminus base of telomere on chromosomal short arm and 5'-terminus of this base sequence : 76120622
  Distance between 3'-terminus of neighbour sequence of sequence listing upward to telomere on chrosomal short arm and 5'-terminus of this base sequence : 11309
tgtgtcacaggaagctaatatgtatgtgtacacacacacacacacacacacacacacacatatatactactgacttagtagaaggcaactggtttctcaca

SEQ ID NO: 14016 - DNA, 145 bp, Homo sapiens
  DISO7_10002539
  Located on chromosome 8
  Distance between a terminus base of telomere on chromosomal short arm and 5'-terminus of this base sequence : 76143828
  Distance between 3'-terminus of neighbour sequence of sequence listing upward to telomere on chrosomal short arm and 5'-terminus of this base sequence : 23105
tgcatgttacagatatctagattggtaaatttgtgtgtgtgtgtgtgtgtgtgtgtgtgtgtgtgtgtttttggtcaaaactttcactctattctcttcttagttgtgtggtttttgagaagttggatataattcttgtctttgc

SEQ ID NO: 14017 - DNA, 144 bp, Homo sapiens
  DISO7_10002538
  Located on chromosome 8
  Distance between a terminus base of telomere on chromosomal short arm and 5'-terminus of this base sequence : 76150098
  Distance between 3'-terminus of neighbour sequence of sequence listing upward to telomere on chrosomal short arm and 5'-terminus of this base sequence : 6125
gcctgtagcttgctagggtaaaatattcctcaaaaaaaaaaaaaaaagagagagagagagagagagacagagagagagagagaaatagccatcagtgtttttcaaaatattacattacaattaaatgcatgggaatctaatgca

SEQ ID NO: 14018 - DNA, 134 bp, Homo sapiens
  DISO7_10002534
  Located on chromosome 8
  Distance between a terminus base of telomere on chromosomal short arm and 5'-terminus of this base sequence : 76213981
  Distance between 3'-terminus of neighbour sequence of sequence listing upward to telomere on chrosomal short arm and 5'-terminus of this base sequence : 63739
aaggtgccagtcctctaccttagaaaagaaagaaagagagaaggagagagagagagagagagaggagagagagagagagagttgtatttgtttgggtgcagagaaagctttggtggctgtagcgggtcatgtga

SEQ ID NO: 14019 - DNA, 425 bp, Homo sapiens
  chr8.fa.O7frz.82731011
  Located on chromosome 8
  Distance between a terminus base of telomere on chromosomal short arm and 5'-terminus of this base sequence : 76302427
  Distance between 3'-terminus of neighbour sequence of sequence listing upward to telomere on chrosomal short arm and 5'-terminus of this base sequence : 88312
aacataactggttgtcatgaaggagctcctataatatttggtttttattccatgaaaattaataagactataaccagacaagtggagaaaaagacatagaaaacatagaagcatatatagaaattataacgaagcagcatcaaatacattattactatatatatatatatatggcattaaaatatgtaaagataggttgtgctatgtctctgatgactgtctaaagttttgtgactatgagaaatgcagtttttggaaaaatgaagagcagcagtgtctactagatttagaaacattatcttaacaacaaaatgcaaattttgttgcagaaaagatatttcctcagttccaatgccctatgattcagaaaaacctagttgagtaggggctacagcccttggcttgtttctcactagctttgatgg

SEQ ID NO: 14020 - DNA, 473 bp, Homo sapiens
  AC021500.3_68479
  Located on chromosome 8
  Distance between a terminus base of telomere on chromosomal short arm and 5'-terminus of this base sequence : 76309711
  Distance between 3'-terminus of neighbour sequence of sequence listing upward to telomere on chrosomal short arm and 5'-terminus of this base sequence : 6859
gtctaagttgtctccataatcctaaaagctaataaaattctgggtgtattgggaggccgaggcaggtggatcatttgaggtcaggagttccagaccagcctggccaacatggtgaaaccctgtctctactaaaaacacaaaaattagccaggtgtggtggcatacatctgtggtcccagctactcaggaggctgaggcaggagaatcccttggaccaggaggcacaggttgcagtgagctgagattgtgccactgcactccaggctaggtgacagagtaagactttgtccaaagcacacagacacacacacacacacacacacacacacacacacacacacacaccaaaaacaacaacaaaaaaaatctggatatgatcagggaagaaaacaaaacatatttttaccttttatattaacaagtgtttctccctttaaaatatcaaagatagttctggttactaaatctcaaga

SEQ ID NO: 14021 - DNA, 103 bp, Homo sapiens
  DISO7_10002540
  Located on chromosome 8
  Distance between a terminus base of telomere on chromosomal short arm and 5'-terminus of this base sequence : 76346562
  Distance between 3'-terminus of neighbour sequence of sequence listing upward to telomere on chrosomal short arm and 5'-terminus of this base sequence : 36378
aactgttagaactcctaagatcgagtaattatgtatactttggaaaatgtgtatgtgtgtgtgtgtgtgtgtgtgtgtgtgtgtgtttaatgcaagattgaga

SEQ ID NO: 14022 - DNA, 128 bp, Homo sapiens
  DISO7_10002531
  Located on chromosome 8
  Distance between a terminus base of telomere on chromosomal short arm and 5'-terminus of this base sequence : 76382574
  Distance between 3'-terminus of neighbour sequence of sequence listing upward to telomere on chrosomal short arm and 5'-terminus of this base sequence : 35909
ccttatcactacctgcagtttcttttacccaataaagtatgtctccctttcaatgaaaaattacaagacatagtagaaaaacacacacacacacacacacacatacacagacaatttgagaagacaga

SEQ ID NO: 14023 - DNA, 141 bp, Homo sapiens
  DISO7_10002547
  Located on chromosome 8
  Distance between a terminus base of telomere on chromosomal short arm and 5'-terminus of this base sequence : 76460778
  Distance between 3'-terminus of neighbour sequence of sequence listing upward to telomere on chrosomal short arm and 5'-terminus of this base sequence : 78076
tgaagttgaaggtgtcactctctctctatctagccctatacctctatctattatctatctatctatctatctatctatctatctatctatctatctatctatctatctatctatcatctatgtcagtcagtctgtcttctg

SEQ ID NO: 14024 - DNA, 263 bp, Homo sapiens
  DISO7_10002546
  Located on chromosome 8
  Distance between a terminus base of telomere on chromosomal short arm and 5'-terminus of this base sequence : 76475657
  Distance between 3'-terminus of neighbour sequence of sequence listing upward to telomere on chrosomal short arm and 5'-terminus of this base sequence : 14738
ggcaggagtagtatcaagaatgatatactatatatacatatatacatatatatatatatatatatatatatatataaaaaacacacacagacacacacatatatacatacacacacatacatacatatatatatttaactcaggcaatttataaatgctattttactttataatatattttaatatcattgctgttttcctatcacaaatttctataaaagccaggcaacatataaaaaccatactccttcaatttcttagtg

SEQ ID NO: 14025 - DNA, 360 bp, Homo sapiens
  chr8.fa.O7frz.83212777
  Located on chromosome 8
  Distance between a terminus base of telomere on chromosomal short arm and 5'-terminus of this base sequence : 76508120
  Distance between 3'-terminus of neighbour sequence of sequence listing upward to telomere on chrosomal short arm and 5'-terminus of this base sequence : 32200
ttaattgactcgttgattcaaccatacatggctttatttacttattatttatttatttatttatttatttatttatttttatcttttaactttgcctattcactgtatcagttttgtcttaatgcttgtgatacagtgctaatatttacatatagacacaaagatcttcatcagaagaaaagaatgatttctgcctgtgcacctctttttaagaacaagaaaacctttcccagaatcactctagagtgattttcttcctgactcattgagcaagatttcatcaaattcttacaacatcactattctctggtaaggtgaatggaataatcacaattaacttagaatccaatcatgattaac

SEQ ID NO: 14026 - DNA, 116 bp, Homo sapiens
  DISO7_10002545
  Located on chromosome 8
  Distance between a terminus base of telomere on chromosomal short arm and 5'-terminus of this base sequence : 76517594
  Distance between 3'-terminus of neighbour sequence of sequence listing upward to telomere on chrosomal short arm and 5'-terminus of this base sequence : 9114
ggtcttgctgagtctgtcagagaaaaaaaaatgccgaagtgtatgtgtgtgtgtgtgtgtgtgtgtgtgtgtaactctcagtctttgacaaaaggttacattgctatgctacatga

SEQ ID NO: 14027 - DNA, 246 bp, Homo sapiens
  DISO7_10002543
  Located on chromosome 8
  Distance between a terminus base of telomere on chromosomal short arm and 5'-terminus of this base sequence : 76576757
  Distance between 3'-terminus of neighbour sequence of sequence listing upward to telomere on chrosomal short arm and 5'-terminus of this base sequence : 59047
gaatatgccagaattccttagagaattatatagttaagaaaatccattagtgctctaaacttaaaaacaaaagatgaaaatataatgtatgctggccatatatccacatatatatatatatatatatatatacacacacacacacacacatatatatatacacacacatatatatatgtttcaccttatctgtgatttttattatttttgccttaataaaagacattggcataatatcaattaatt

SEQ ID NO: 14028 - DNA, 275 bp, Homo sapiens
  HUMUT5297
  Located on chromosome 8
  Distance between a terminus base of telomere on chromosomal short arm and 5'-terminus of this base sequence : 76601672
  Distance between 3'-terminus of neighbour sequence of sequence listing upward to telomere on chrosomal short arm and 5'-terminus of this base sequence : 24669
ctgaagaatgaagacactgtcctttagggaatgagatgttttgacatttacacatggccataaaatactttgaaatcagtctttcttttctcttttcttttcttctttcttcttcttttttctttctttctttcttcttttctttcctttctttctatctctctctctctctctctctcacacgccacatgccctagcaaattgtgttgactttaccttgaagatacacccagaagctgactccattttgacactatcactgtcaacccctgtgc

SEQ ID NO: 14029 - DNA, 223 bp, Homo sapiens
  DISO7_10002541
  Located on chromosome 8
  Distance between a terminus base of telomere on chromosomal short arm and 5'-terminus of this base sequence : 76601677
  Distance between 3'-terminus of neighbour sequence of sequence listing upward to telomere on chrosomal short arm and 5'-terminus of this base sequence : -270
gaatgaagacactgtcctttagggaatgagatgttttgacatttacacatggccataaaatactttgaaatcagtctttcttttctcttttcttttcttctttcttcttcttttttctttctttctttcttcttttctttcctttctttctatctctctctctctctctctctcacacgccacatgccctagcaaattgtgttgactttaccttgaagataca

SEQ ID NO: 14030 - DNA, 289 bp, Homo sapiens
  DISO7_10002550
  Located on chromosome 8
  Distance between a terminus base of telomere on chromosomal short arm and 5'-terminus of this base sequence : 76719882
  Distance between 3'-terminus of neighbour sequence of sequence listing upward to telomere on chrosomal short arm and 5'-terminus of this base sequence : 117982
gatctatgctggcccttccaagggcgtcatttcatgaaacactatcagctttagcttgtttttgttttgttttgttttgttttgttttgagacagtgtttcgctctgttgccgtcaccgaggctggagttcagtggtgccctcttggctcactgcaacctctgcctcccaagttcaagtgattcccctaactcagcctcctgagtagctggaattacatgcgagagccaccgcacctggcccagctttagtttttgatattgctgccctttcaagtacttcaactgcct

SEQ ID NO: 14031 - DNA, 171 bp, Homo sapiens
  DISO7_10002551
  Located on chromosome 8
  Distance between a terminus base of telomere on chromosomal short arm and 5'-terminus of this base sequence : 76738467
  Distance between 3'-terminus of neighbour sequence of sequence listing upward to telomere on chrosomal short arm and 5'-terminus of this base sequence : 18296
ataccatctttgaacagtcctgagaagatacacacacacacacacacacacacacacacacacacaaacacatagagttatatatctaagaaagaattagtgagaatataaagaaatattgcatatcagtcataaaagacaagcaaaaccaatgagaatatgagcaaagga

SEQ ID NO: 14032 - DNA, 438 bp, Homo sapiens
  AC021842.3_125488
  Located on chromosome 8
  Distance between a terminus base of telomere on chromosomal short arm and 5'-terminus of this base sequence : 76789395
  Distance between 3'-terminus of neighbour sequence of sequence listing upward to telomere on chrosomal short arm and 5'-terminus of this base sequence : 50757
aaggaaccaagattaaatcataagaaaacaaaccatgtatctcatcagagacaccactgacaaataaacattgcaaaagaaaaaagagtttggctttttccctttgctgttgtgacaaaaaacaataattctgccccaaattgctcatgtttcaaaccaggaggctaaggaatcagtctgcagctgcctggatttcagaaaatctagaaaagtgacagatatttgttttacaccatacttttagattttaagtcttgtacttcctgaccctataggttagggaatatctgtatctatatttcaatagatgtgtagttatagagatatagaagtagatgtaaatacacacacacacacacacacacaaacttaagtgtcataataccctagagtttttacttgtgaaaatatgtgcccttgaccgtaacattcactaag

SEQ ID NO: 14033 - DNA, 220 bp, Homo sapiens
  chr8.fa.O7frz.83542777
  Located on chromosome 8
  Distance between a terminus base of telomere on chromosomal short arm and 5'-terminus of this base sequence : 76909439
  Distance between 3'-terminus of neighbour sequence of sequence listing upward to telomere on chrosomal short arm and 5'-terminus of this base sequence : 119606
ccactgttgaatgattctgtattagggttctttagagggacaggactaacaggagatagatagatagatagatagatagatagatagatagatagataaaggggagtttattaagtattaactcacatgatcacaaggtcccacagtaggctgtctgtaagctgaggagcaaggagagccagtccgagtttcaaaactgtagaacttggactccaatgtt

SEQ ID NO: 14034 - DNA, 324 bp, Homo sapiens
  chr8.fa.O7frz.83648053
  Located on chromosome 8
  Distance between a terminus base of telomere on chromosomal short arm and 5'-terminus of this base sequence : 77015569
  Distance between 3'-terminus of neighbour sequence of sequence listing upward to telomere on chrosomal short arm and 5'-terminus of this base sequence : 105910
gctggtcgttaatttaaatctcactgtcatttatttaaatctcgaactcttgactcaaaatcttcatagtatctcagatcttgcagctttttatctcagaacattgcagaacctgccaatgttctggctactcacttggttccagctacttttcacacacacacacacacacacacacacacacacacacacacacacgcaaatagaatgacagctaaaaaattggtatgaataattacatggcattcatgagtcttaagtactagatatgagcctctgtaaagacataaaacaacttaaataatcaaaccttagcttattgtg

SEQ ID NO: 14035 - DNA, 402 bp, Homo sapiens
  chr8.fa.O7frz.83814031
  Located on chromosome 8
  Distance between a terminus base of telomere on chromosomal short arm and 5'-terminus of this base sequence : 77153186
  Distance between 3'-terminus of neighbour sequence of sequence listing upward to telomere on chrosomal short arm and 5'-terminus of this base sequence : 137293
tgaatcagataccatagctgaccttaaggcttccaacgtttagcagaggagacaaacatgtaagttggcatttcaaaacagaatactatggatgctacaaaatcacagaatgccgtgtaagctggacagaagaaaggttttccccagaatgcaacataaaatctgaatcttagcagttctttttttttcccccttctttccattgtcagtttgtagaaagaagagagtctaatatgtatttttgtttgtttgtttgtttgtttgtttgttttgagacggagtttcactcttgttgcccaggctgtagtgcaatggcgcaatctcggctcgctgcaacctctgactcctgggttcaagagattctcctgcctcagcctgtgcagtagctacgtttacaggcat

SEQ ID NO: 14036 - DNA, 478 bp, Homo sapiens
  chr8.fa.O7frz.84730386
  Located on chromosome 8
  Distance between a terminus base of telomere on chromosomal short arm and 5'-terminus of this base sequence : 77317397
  Distance between 3'-terminus of neighbour sequence of sequence listing upward to telomere on chrosomal short arm and 5'-terminus of this base sequence : 163809
attgagtgaatgcatttaaagtactaaagtattgttattgtcattctgcaatcatacttccagaaaacttagcttaagaagtaattagaaaaagatgtatgcacaagtatattcaacacagtgatttgtataatagattttttaaaagaaacaatcataatatatgacagtgattggttaaataaatgatgacagtaaatgtaatcatatatatttctaataaatatgtttatgtttttatggaaatatgttcaaagtagatggttatattaaaaagttacaaactacatctataaaattaaataactgtaaataaatagtgtacgtatatactcatgtaactatacttagaaaaatacttgaagtaactgtgtatatataatatgttatatatatatatatatatatatatatatacagagagagaaaaaatattgaaagagagatttccaatttgtcacaatttatgcaatcattt

SEQ ID NO: 14037 - DNA, 480 bp, Homo sapiens
  chr8.fa.O7frz.84641747
  Located on chromosome 8
  Distance between a terminus base of telomere on chromosomal short arm and 5'-terminus of this base sequence : 77402193
  Distance between 3'-terminus of neighbour sequence of sequence listing upward to telomere on chrosomal short arm and 5'-terminus of this base sequence : 84318
ctcataagatgtgaagctgaatatctttttttagattaggtaaccttttcatagctttgggggaaaacatggatagtactcatgtgtgtgtgtgtgtgtgtgtgtgcgcgcgcgcgtgtgcgtgcacatgtgtgagcttgtgtgcattgacagataattattttatattgagaataagcaaaactttgtgttgatcattccaagaaaatcctagaagatcttgttttgttttcttttaaatctatagctctgcactctgtgtgtgtgtgtgtgtgtgtgtgtgtgtgtgtgtgtatcaactcaactcacatataactcagaggaattagtatagaatactgattaagaaggctgaaatttttactctgctctgacattttcttagtttgcctcaattttctcatctgtattacagaaatgaaaatcgcaccttcttcatgaaatatttaacaagaaaagacgtatcaaagtgacatactc

SEQ ID NO: 14038 - DNA, 145 bp, Homo sapiens
  D8S1134
  Located on chromosome 8
  Distance between a terminus base of telomere on chromosomal short arm and 5'-terminus of this base sequence : 77519030
  Distance between 3'-terminus of neighbour sequence of sequence listing upward to telomere on chrosomal short arm and 5'-terminus of this base sequence : 116357
cataccagaaaagaaaagtgacgaaaaatctgtcaatcaaaggatagagagatagatagaaagatagatagatagatagatagatagatagatagatgatagacagatagatagatatcaatccctaggaagattgactaagacc

SEQ ID NO: 14039 - DNA, 310 bp, Homo sapiens
  AC079993.2_27056
  Located on chromosome 8
  Distance between a terminus base of telomere on chromosomal short arm and 5'-terminus of this base sequence : 77572726
  Distance between 3'-terminus of neighbour sequence of sequence listing upward to telomere on chrosomal short arm and 5'-terminus of this base sequence : 53551
agacagtctgcaacattctattagccagcacagtttttggccaatgtcagttgtttaattaatgtagtttttttccctaacactcagttactcaatcaaaacctgaggaaacacagcctcttaagagaatcagaatttgtttcttcctttgtctgtctcataaaggggtgtgtgtgtgtgtgtgtgtgtgtgtgtgtatgtgtgcatgtgtgtatgtgagacaacgtgacactgcgtgacatgaacatacaaattagaatggcctaagcttgcattccagctttattactaaataagtggcagaaatgtg

SEQ ID NO: 14040 - DNA, 299 bp, Homo sapiens
  chr8.fa.O7frz.84454414
  Located on chromosome 8
  Distance between a terminus base of telomere on chromosomal short arm and 5'-terminus of this base sequence : 77589948
  Distance between 3'-terminus of neighbour sequence of sequence listing upward to telomere on chrosomal short arm and 5'-terminus of this base sequence : 16912
ttcttgttggacaaataagattagattgccaagtcacagctgtgtatgccagttgatatataattgtagaattgataattcataaaagctcagtgctatttgggggttaaagttttattttattttattttattttattttattttatgtttttagatgtgagaaaataaggctgcctgctaaatatatttttcatttcttatctaagttttaccaggtttagactagttattgactcagtaaatgtaaaaaaaaagttgatatgctgtcaatattaatgtagatgtcagaccaacact

SEQ ID NO: 14041 - DNA, 339 bp, Homo sapiens
  AC079993.2_154045
  Located on chromosome 8
  Distance between a terminus base of telomere on chromosomal short arm and 5'-terminus of this base sequence : 77600650
  Distance between 3'-terminus of neighbour sequence of sequence listing upward to telomere on chrosomal short arm and 5'-terminus of this base sequence : 10403
ctagcaaagtatcctatcaaacatttttaaatctagttaaaatggatagagatggagaaggcggctggcctgtcattgtgtgtgtgtgtgtgtgtgtgtgtgtgtgtgtgtgtggacaaatcaagcctcttctcagttgaagtccatctcagtagacactttcacaatcaagttgtctctgggccagctgtcagcctgcaagtagagagtcaagtacaaagtagtggcttcctccaggagaattcatataagcagccttttcaagtcccagggaaaatggaagacaagatgcaatccccactgtttcattccttcttcattgtaattacatctggtaac

SEQ ID NO: 14042 - DNA, 125 bp, Homo sapiens
  DID22N_0031877
  Located on chromosome 8
  Distance between a terminus base of telomere on chromosomal short arm and 5'-terminus of this base sequence : 77679835
  Distance between 3'-terminus of neighbour sequence of sequence listing upward to telomere on chrosomal short arm and 5'-terminus of this base sequence : 78846
atctgcgttctagccctgtgcttgtttctccctctccttcaccccttctctctctctctctctctctctctctcttccttgctctctctttttgtctctctttccaaacttaatggtggctacct

SEQ ID NO: 14043 - DNA, 116 bp, Homo sapiens
  DID22N_0031880
  Located on chromosome 8
  Distance between a terminus base of telomere on chromosomal short arm and 5'-terminus of this base sequence : 77728746
  Distance between 3'-terminus of neighbour sequence of sequence listing upward to telomere on chrosomal short arm and 5'-terminus of this base sequence : 48786
cacttattggtttatccagagtgttcattcattcattcattcattcattcattcattcattcattcatccatccatccgcccatccattcatttgatgcgtatgtactggtttctt

SEQ ID NO: 14044 - DNA, 127 bp, Homo sapiens
  DID22N_0031881
  Located on chromosome 8
  Distance between a terminus base of telomere on chromosomal short arm and 5'-terminus of this base sequence : 77832613
  Distance between 3'-terminus of neighbour sequence of sequence listing upward to telomere on chrosomal short arm and 5'-terminus of this base sequence : 103751
  misc_feature (1)...(127): n = A,T,G or C
gcttaacattgatggtgggggcagagagaaagcgagagntgagagcgagagagagagagagagagagagagagagagagagagagagagagagagagagaggacaaatgatggaggagaaagaggct

SEQ ID NO: 14045 - DNA, 149 bp, Homo sapiens
  DID22N_0031884
  Located on chromosome 8
  Distance between a terminus base of telomere on chromosomal short arm and 5'-terminus of this base sequence : 77890428
  Distance between 3'-terminus of neighbour sequence of sequence listing upward to telomere on chrosomal short arm and 5'-terminus of this base sequence : 57688
ttaggaatatggcctgggccaaatgtgtatacatcatattctatctatctatctatctatctatctatctatctatctatctatctatcatctatctatctatccacttatcacttactccatttggcatctatttgtaatatctccat

SEQ ID NO: 14046 - DNA, 197 bp, Homo sapiens
  D8S1805
  Located on chromosome 8
  Distance between a terminus base of telomere on chromosomal short arm and 5'-terminus of this base sequence : 77988300
  Distance between 3'-terminus of neighbour sequence of sequence listing upward to telomere on chrosomal short arm and 5'-terminus of this base sequence : 97723
acctctactcttgtattggggtttttcagagaaagaaaaccaatgaacacacacacacacacacacacacacacacacacacatcccacacatatcccatttttatttatttattacaagatattaactcacacaattatggaggttgagaagttcctaggatctgcagacagtaaactggagacctgtgagagcca

SEQ ID NO: 14047 - DNA, 210 bp, Homo sapiens
  D8S594
  Located on chromosome 8
  Distance between a terminus base of telomere on chromosomal short arm and 5'-terminus of this base sequence : 78245393
  Distance between 3'-terminus of neighbour sequence of sequence listing upward to telomere on chrosomal short arm and 5'-terminus of this base sequence : 256896
tagaaatatatatgcgttagggtttatattttatacctatatctatatctatctatctatctatctatctatctatctatctatctatccatccatctatctacctatctctcctattggttcaggttctgtggaaaaccctaactaataaacaaggcattaaggtaaaagatatagtatccttgactgctcccaatttttgagagtgga

SEQ ID NO: 14048 - DNA, 404 bp, Homo sapiens
  AC037492.3_126739
  Located on chromosome 8
  Distance between a terminus base of telomere on chromosomal short arm and 5'-terminus of this base sequence : 78398664
  Distance between 3'-terminus of neighbour sequence of sequence listing upward to telomere on chrosomal short arm and 5'-terminus of this base sequence : 153061
acaactagaaggaacgaaagagccaagtttgacaaaatgcttttttagtgacactttggaggaacaggtgctcccacaagttgctgatgagatacataaatttagatgcatcttaaatacattatgttaagcaacagcagccaatcataaaagattacatatgtgtgtgtgtgtgtgtgtgtgtgtgtgtgtgtgtaattccatttatatggcatacttaaaaagataaaactttaacaagagagaacagatgaatggctgccaggggtttgggatggagagagggcataatcacagagaagtaccatgggagatttggggaatgatggaactcatctttcttccgagtgtggaggtagttctacaaatctatactctgttagaactcatagaactgtaccaca

SEQ ID NO: 14049 - DNA, 240 bp, Homo sapiens
  chr8.fa.O7frz.85475413
  Located on chromosome 8
  Distance between a terminus base of telomere on chromosomal short arm and 5'-terminus of this base sequence : 78550933
  Distance between 3'-terminus of neighbour sequence of sequence listing upward to telomere on chrosomal short arm and 5'-terminus of this base sequence : 151865
gcaagtttcataggtattaatgagaaaacacactcaggcatttagtgctaaaatgctttaactccaaaatcaaggaaataaaatgtcacaagctttcaaattaaaataaaaatgacttattcaaaaaaaaagtagatcaatttagatgttacatctgcaacgtgttttcttgtttgtttgtttgtttgttttgagacgaagtctcgctctcgtgtgctatcctagttcactacaacctcc

SEQ ID NO: 14050 - DNA, 412 bp, Homo sapiens
  chr8.fa.O7frz.85397946
  Located on chromosome 8
  Distance between a terminus base of telomere on chromosomal short arm and 5'-terminus of this base sequence : 78583334
  Distance between 3'-terminus of neighbour sequence of sequence listing upward to telomere on chrosomal short arm and 5'-terminus of this base sequence : 32161
tggtttgatttaatctgaatctatctaactttctctcaggccagacaattcaaatcaatagacaatttaaaatatatttatatgcatttcccttaaaattttccacctgctgaaaagacgaaatgcatgttatttcatattatataaagctcagaattcatatttgtgatcttataattatgtgattagagtctatgaagctatttgtatcagtaaacacacacacacacacacacacacacactctctctctctcacacacacacaccatataaaaaatacatacatattctccacccaaagaagcaagaactacataccatgatttcctgctgatttgtgtttttggtagattatcatcattacagaaatgaaacttaattaaaagataagtatcaggaatttatgcaag

SEQ ID NO: 14051 - DNA, 244 bp, Homo sapiens
  D8S1105
  Located on chromosome 8
  Distance between a terminus base of telomere on chromosomal short arm and 5'-terminus of this base sequence : 78718317
  Distance between 3'-terminus of neighbour sequence of sequence listing upward to telomere on chrosomal short arm and 5'-terminus of this base sequence : 134571
tcaaacctggtgagtgtcaaaactcatatttgttcttgttgctttcactgaaagattttacatatatctatctatctatctatctatctatacatatatttagatgttactactaagacagtcatggcgtccttgtctttactagtctacctcaagttctatataaccaaatttatctgtgaatctttttatctgattgtaaagtggaaatattcccttgtttgcactcactcgagttcactgt

SEQ ID NO: 14052 - DNA, 459 bp, Homo sapiens
  AC022828.2_8276
  Located on chromosome 8
  Distance between a terminus base of telomere on chromosomal short arm and 5'-terminus of this base sequence : 78913825
  Distance between 3'-terminus of neighbour sequence of sequence listing upward to telomere on chrosomal short arm and 5'-terminus of this base sequence : 195264
tgcaaaatcctattgtaaacagcaatatatgtttacatgttagttatctttgcctacaattttatacatgagaaacattgagatgcagaaagataagatgattgtcacatgaatactaatgagtaggactaagactagaaatacacacacacacacacacacacacacacacacaaaggttcccttattctccttcaaaaggcaaagttgagcagagtgtgttttctattaacaggacattcattctaactttaattaaacagacatgtattgatctcataggtaatcattattataataatatcacattcacatttgtggtattttagattttccaatgtagagaaatacccagggaacatttgtcttttccacttttcatattagataagcaagaagtattcttgattttctatagattaaaatactaaggatctgagcatacaataggttaagttc

SEQ ID NO: 14053 - DNA, 408 bp, Homo sapiens
  chr8.fa.O7frz.85875998
  Located on chromosome 8
  Distance between a terminus base of telomere on chromosomal short arm and 5'-terminus of this base sequence : 78942745
  Distance between 3'-terminus of neighbour sequence of sequence listing upward to telomere on chrosomal short arm and 5'-terminus of this base sequence : 28461
tcgtgatcctgtgagttaatacttaataaactcatatatatatatatatatatatagagagagagagagagaggagtttttggtacaggagtggttctagaggaacagaatattaagaatggagttctttcgttggttctggggttttaggagttggctgcttaatatgattagaccccaaaatgttaaggcctctacttctaatagtatggagaacactgatagtcattggcaggcattaactgtttagagagttatgcaaaataaatgcatttgacactcgtgattcactgctcatgagtggcaaggagtttaatgactccatacataataactttgaccatatgtgaagaaccaaggaacataatgaagctggttggttgctcctaagttcagtggacaaagtga

SEQ ID NO: 14054 - DNA, 454 bp, Homo sapiens
  AC011002.2_37073
  Located on chromosome 8
  Distance between a terminus base of telomere on chromosomal short arm and 5'-terminus of this base sequence : 79091548
  Distance between 3'-terminus of neighbour sequence of sequence listing upward to telomere on chrosomal short arm and 5'-terminus of this base sequence : 148395
aatcttgatcaactagttgaacagatgcttgtagatattttctgaaccaacaactcccatcatgtaccatctctatagcttactgacattgcaagaagagtctgattgactctacaaatataccttgaaatgcgccatcctctaaaaccatggttttcaaaatattatcctcagatcagcagtgtcagaattatttgagaacttagaaatgcagattatcaagcaccctatcccccacaccaggtccgactgaattaaaaattttgagagttgagtccagcaatgtgtgtgtgtgtgtgtgtgtgtgtgtgtgtgtgtgtgtgtgtgtgtgtagagggagtgaaggggcaatgtaattttaaatcctggaattatacttgttacaaaacaaacctaacatttgttaaaaataaacacacctgagacttacttctttcaattccaatagaaatcc

SEQ ID NO: 14055 - DNA, 389 bp, Homo sapiens
  AC068873.2_134240
  Located on chromosome 8
  Distance between a terminus base of telomere on chromosomal short arm and 5'-terminus of this base sequence : 79113629
  Distance between 3'-terminus of neighbour sequence of sequence listing upward to telomere on chrosomal short arm and 5'-terminus of this base sequence : 21627
ctgactgtacaaaggaatctttctgaagcatcacacaaccagaagggtgccatcttagtcacctcagtcagccacatgagttccgtcaccatctgattctttttcctccttcctcaagtttttcaaacaatgtctggggatcaaaggtaatataaatccacacaaaaattaccatatatatattatatatatatatatatatatatatatatatatatatatagtgagaaatgtgctattcccaactctgcaaggattcctaaaagacagagtataaccaggttaccatctctataaaacttcccctgcagaggggagctttctttctacttttcacaccacaatgaaagaggaagaaacaaagtatctgaggacatgatttctagtca

SEQ ID NO: 14056 - DNA, 421 bp, Homo sapiens
  chr8.fa.O7frz.86196566
  Located on chromosome 8
  Distance between a terminus base of telomere on chromosomal short arm and 5'-terminus of this base sequence : 79136883
  Distance between 3'-terminus of neighbour sequence of sequence listing upward to telomere on chrosomal short arm and 5'-terminus of this base sequence : 22865
tttgacagaggtagacctcagctaaaaccctgacattcaccagcctggtgaccatggtcaacttacttaagcatatatatatatatatatatatatatatatatatatgcttttataggtctatatatatatagctgactatatacagtctgactatatataaatctcctatggagattatatggagatatatatatatatatatatatatatctcctatggtaagtggtcaagcaattattattatcattaatatcagtacattctaggtattttcataatggatattggcgtcgcagttctggatgagcagcaaagtacaatttaatttccatcagaaattctcatcccagctttatttctaaagttaaagttctgaaggttaacttgtatctctaaggtatgtaattaaattgacagc

SEQ ID NO: 14057 - DNA, 447 bp, Homo sapiens
  chr8.fa.O7frz.86307998
  Located on chromosome 8
  Distance between a terminus base of telomere on chromosomal short arm and 5'-terminus of this base sequence : 79323811
  Distance between 3'-terminus of neighbour sequence of sequence listing upward to telomere on chrosomal short arm and 5'-terminus of this base sequence : 186507
tactattaactagcctgaggacaaggtggcaactgcatttcattctgaaatggaaaaatccaaggaaggtagaagaaacaattgcatgagaattattactcaattatttttcctcaaaaagctgtgtatcttcttttttgaactttgggaaagcatatataagagtttctttgaccccgaatagtccatgtatttacccagaaatatttgtgtatcttgctactgcagcaggattacaaaatagattacaactctactgtagaaagaaaatatgtttttatataatctgtaacttatctgggtagctagaaaacatacacacacacacacacacacacacacacacacacacacacacacacacactacattttaatcctggcatctcagtcaactcccatatctgagtggttctttcaaataatgcttctgagtctacaactttac

SEQ ID NO: 14058 - DNA, 160 bp, Homo sapiens
  chr8.fa.O7frz.86422561
  Located on chromosome 8
  Distance between a terminus base of telomere on chromosomal short arm and 5'-terminus of this base sequence : 79411306
  Distance between 3'-terminus of neighbour sequence of sequence listing upward to telomere on chrosomal short arm and 5'-terminus of this base sequence : 87048
ttagaactgtccagatacattgtccatttttctacagtaccattagtcttttactttagtcttttgagaagatagatagatagatagatagatagatagatagatagatagatagataatatacaggtagatagatattctgttagtgatctaagttgga

SEQ ID NO: 14059 - DNA, 448 bp, Homo sapiens
  chr8.fa.O7frz.86520698
  Located on chromosome 8
  Distance between a terminus base of telomere on chromosomal short arm and 5'-terminus of this base sequence : 79504100
  Distance between 3'-terminus of neighbour sequence of sequence listing upward to telomere on chrosomal short arm and 5'-terminus of this base sequence : 92634
aggcactttaaagatagcaatcaaacatataaaaatgtcaaccacaaaaaaactgtaaaaataataaccataaaaaataggggggaatacatgcattctttctagatagtctttcattttccaaaggaaagccttctataaaaatatagaagtacaaatatatatatatatatatatatttagaagccatcatcaaagttcaaatctctgtaaagagaatgtttttcctcaagttagtaaagtttggattcatacattttctagagaagcaattacaatcttcatgctatatataggaagaaaaatagcttttaattatgtttgtcgactcttttattcaataaacatttagtgactattgtgtgacactgttttaggtgctagggatatagaaataaatcagaaacaatcattagccctagagaactaaacctaatggaactggatc

SEQ ID NO: 14060 - DNA, 339 bp, Homo sapiens
  AC036144.2_28723
  Located on chromosome 8
  Distance between a terminus base of telomere on chromosomal short arm and 5'-terminus of this base sequence : 79771982
  Distance between 3'-terminus of neighbour sequence of sequence listing upward to telomere on chrosomal short arm and 5'-terminus of this base sequence : 267434
gctaatatcattcttaatggtgagaggcaatacattttctccccaagatcaggaacagggcaaggacatagactctcaccagttctatctgacattgtactgccaggttctagctaatgcaataaaacataaacagtaaataagatgtgtgtgtactggaaaggaagtaataaaactgtattcacagatggatttacacacacacacacacacacacacacacacacacacacacacacacactcctggagctaatagtcaagcataacaaggttagaggatacaaaaccaatatgcaaaagttaattttttcttacatactagcaatgaacaattgga

SEQ ID NO: 14061 - DNA, 215 bp, Homo sapiens
  D8S501
  Located on chromosome 8
  Distance between a terminus base of telomere on chromosomal short arm and 5'-terminus of this base sequence : 79922986
  Distance between 3'-terminus of neighbour sequence of sequence listing upward to telomere on chrosomal short arm and 5'-terminus of this base sequence : 150665
aaaggtaattgagtccacgcttctctagtaacctctgctgattttctgacaatctttggtgttctatggtttgtagacatatcactccaatgtctgccttatattcacacgtgtgtgtgtgtgtgtgtgtgtgtgtgtgtgtgcccaaatttcaacattgtgtaagaacagcagccgtgttggagcagggttcactctgctccaggatgacctca

SEQ ID NO: 14062 - DNA, 278 bp, Homo sapiens
  G10075
  Located on chromosome 8
  Distance between a terminus base of telomere on chromosomal short arm and 5'-terminus of this base sequence : 80061890
  Distance between 3'-terminus of neighbour sequence of sequence listing upward to telomere on chrosomal short arm and 5'-terminus of this base sequence : 138689
cctggatacttactgtgtgccagtcattaatctcagtttagatagatagatagatagaggatagatagatagatagataatagatagatagatagatagatagatatagaaatgatagctatctagagagaaagatagccactactttacttacccatcatatccctattaagtagatattattattttaaatcagatgaggaaattgaagcatagatgtttcaagtgatttgccaaggtcaatgcaactagaaagggatgagtgaagccaggattca

SEQ ID NO: 14063 - DNA, 198 bp, Homo sapiens
  D8S1705
  Located on chromosome 8
  Distance between a terminus base of telomere on chromosomal short arm and 5'-terminus of this base sequence : 80193651
  Distance between 3'-terminus of neighbour sequence of sequence listing upward to telomere on chrosomal short arm and 5'-terminus of this base sequence : 131483
agctacagtgctctagtatcacttctggaaacaacagaacacaaaaatatccaactgaaatagcatatgagaattatgtgaatatcagactctgacccaggcctaaatagtacctgttttgctgtttctcagacactttctcacacacacacacacacacacacacacacacacacacacacaggcaaggactcgttg

SEQ ID NO: 14064 - DNA, 174 bp, Homo sapiens
  D8S569
  Located on chromosome 8
  Distance between a terminus base of telomere on chromosomal short arm and 5'-terminus of this base sequence : 80292840
  Distance between 3'-terminus of neighbour sequence of sequence listing upward to telomere on chrosomal short arm and 5'-terminus of this base sequence : 98991
atttgattatatcctacaggtttgcagaattagatagatagatagatagatagatagatagatagatagatagaagacatatatccaatatatcttatgtcttttactattgttgtattttcagtattcatctttgttaattttatcctgaatgcacacacaaggtgttatcct

SEQ ID NO: 14065 - DNA, 153 bp, Homo sapiens
  D8S1760
  Located on chromosome 8
  Distance between a terminus base of telomere on chromosomal short arm and 5'-terminus of this base sequence : 80383582
  Distance between 3'-terminus of neighbour sequence of sequence listing upward to telomere on chrosomal short arm and 5'-terminus of this base sequence : 90568
cctctcacacactcgggcacacatgcacgcacacacacacacacacacacacacacacacacacacacacacatacagagagcaatgacagctgaacctgtgccatgccaacatgtataggttttcagtagacacagagccaggctagttggg

SEQ ID NO: 14066 - DNA, 281 bp, Homo sapiens
  D8S1764
  Located on chromosome 8
  Distance between a terminus base of telomere on chromosomal short arm and 5'-terminus of this base sequence : 80418257
  Distance between 3'-terminus of neighbour sequence of sequence listing upward to telomere on chrosomal short arm and 5'-terminus of this base sequence : 34522
acacatatttgcctgcaatgagaacctgtgtgtgtgtgtgtgtgtgtgtgtgtgtgtgtgtatggccattttgggaacatagtaaggtataaataaacatatttattctcacaatttttgtggccacaaagagcaaacatattagtcacatacctttactttgctgaacgaatatatcacccaacaaaacgtaagaatcagttacaacctcaaactgttgtcaacaactttctatatgtaattcatttacttactcactaacaagcactcactcggaaaca

SEQ ID NO: 14067 - DNA, 391 bp, Homo sapiens
  chr8.fa.O7frz.87778487
  Located on chromosome 8
  Distance between a terminus base of telomere on chromosomal short arm and 5'-terminus of this base sequence : 80607780
  Distance between 3'-terminus of neighbour sequence of sequence listing upward to telomere on chrosomal short arm and 5'-terminus of this base sequence : 189242
aaacttgttatttgcacatgacatgattgtgttgtctagattcccaaggactctataaaaatgttataaaataaataataaaagagctgataactgagtatagtaagataatatattaaaatcaattgcatatttttatacactagcaaaaaaaattggcataatccttgaaataataaattgataaggctggacacaggggcttatgcctgtagtcccaacactaggagtccaaggcaggaggatcatttgagaatttgagaccagcccagaaaacataatgagaccccatctggatgactagatgattgatagatagatagatagatagatagatagatagatagatagacagatagatagatagatagataaagctggacttcattaa

SEQ ID NO: 14068 - DNA, 185 bp, Homo sapiens
  G08717
  Located on chromosome 8
  Distance between a terminus base of telomere on chromosomal short arm and 5'-terminus of this base sequence : 80607995
  Distance between 3'-terminus of neighbour sequence of sequence listing upward to telomere on chrosomal short arm and 5'-terminus of this base sequence : -176
tcccaacactaggagtccaaggcaggaggatcatttgagaatttgagaccagcccagaaaacataatgagaccccatctggatgactagatgattgatagatagatagatagatagatagatagatagatagatagacagatagatagatagatagataaagctggacttcattaaaattaaaag

SEQ ID NO: 14069 - DNA, 291 bp, Homo sapiens
  D8S1757
  Located on chromosome 8
  Distance between a terminus base of telomere on chromosomal short arm and 5'-terminus of this base sequence : 80936605
  Distance between 3'-terminus of neighbour sequence of sequence listing upward to telomere on chrosomal short arm and 5'-terminus of this base sequence : 328425
atggagcactgccaagaagaaaaacccaaataaagacactgcaaatcagaccagcaagtgttcaaattttattatgcaaagaaacagaaactttgagatttttacaggaattatcctataatctagaacctgacaaatacaggtcccacttgtgatttctaaataaacacacacacacacacacacacacacacacacacacacacacacacacacagagatacataataaaaaatataaaggtaaatactaaaacattatagtggttctctctcaaaaataggactcaaa

SEQ ID NO: 14070 - DNA, 395 bp, Homo sapiens
  AC021510.2_136617
  Located on chromosome 8
  Distance between a terminus base of telomere on chromosomal short arm and 5'-terminus of this base sequence : 81148850
  Distance between 3'-terminus of neighbour sequence of sequence listing upward to telomere on chrosomal short arm and 5'-terminus of this base sequence : 211954
ctgtcataagcatgcaaatatctctctatagtttgtagcttgtcttctaacatttttcttggtgttatttcttgttaagttgtataattatttattgctttaaaagctttaaaaaggcaagtaaagcacaacattagaattaattaattctttctttctttctttctttttctttttgagacagagtctcactctgtcccccaggctggaatgtagtggcgcgatctcagatcactgcaacctccacctcccaggttcaagcgattctcctgcctcagcctcccaagtagttgggattacagctgtgtgccaccacatccagctaatgcttttgtattttcagtagagacagggtttcaccatgttggccaggctagtcttgaactcctgacctc

SEQ ID NO: 14071 - DNA, 353 bp, Homo sapiens
  chr8.fa.O7frz.88380643
  Located on chromosome 8
  Distance between a terminus base of telomere on chromosomal short arm and 5'-terminus of this base sequence : 81263707
  Distance between 3'-terminus of neighbour sequence of sequence listing upward to telomere on chrosomal short arm and 5'-terminus of this base sequence : 114462
gtctaagtgtccagattggttaaactcattttggagccagtagaatagaatgatggtctccatggagcaatgattctgggctgaaacagacatgacaaaatataattatacatagaacacataagatacaaaagaaaagttcatattagggaaaaacaaacccaatagtgtttaattcaatagtttcctttaaaactcagttgaaagagagagagaaagagagagagagaaaattgtgtgtgtgtgtgtgtgtgtgtgtgtgcgcgcgcgcgtgcatatgtgtggttgtctagccattagcagtagcaagcaaattagcataaattacagttgtagaactcaaggtcacatag

SEQ ID NO: 14072 - DNA, 212 bp, Homo sapiens
  DISO7_10002555
  Located on chromosome 8
  Distance between a terminus base of telomere on chromosomal short arm and 5'-terminus of this base sequence : 81282092
  Distance between 3'-terminus of neighbour sequence of sequence listing upward to telomere on chrosomal short arm and 5'-terminus of this base sequence : 18032
ccaaaggcagtcagttccattttggggcttcaattattgtttgtttgtttgtttgtttgtttgtttgtttgtttcagagacagagtctcgctctgtcatccaggtcggagttcagtgacgcaatcataactcattgcagccttgaactcctaggctcaagcaatcttcctgcctcagcctcccaaggcatgcaccatcatgcctggctaaca

SEQ ID NO: 14073 - DNA, 126 bp, Homo sapiens
  DISO7_10002556
  Located on chromosome 8
  Distance between a terminus base of telomere on chromosomal short arm and 5'-terminus of this base sequence : 81367050
  Distance between 3'-terminus of neighbour sequence of sequence listing upward to telomere on chrosomal short arm and 5'-terminus of this base sequence : 84746
ttcagggctcagaggaagaaaactgaatacatatacatacacacacacacacacacacacacacacacacacacacacacatatataatgataaatatataaatacacaagcatgcatactcaatc

SEQ ID NO: 14074 - DNA, 354 bp, Homo sapiens
  chr8.fa.O7frz.88676949
  Located on chromosome 8
  Distance between a terminus base of telomere on chromosomal short arm and 5'-terminus of this base sequence : 81482816
  Distance between 3'-terminus of neighbour sequence of sequence listing upward to telomere on chrosomal short arm and 5'-terminus of this base sequence : 115640
atactcaaattgcctcagactcggccactgagggccccttcaaactggctcctgtgtccctttgacatgccttatcagtctttgagcatttccttgatttctggatcaacaagatcttccaggtcatcctataattttcctgcctccgccttggaaatagccatttctccaagaagcctgggttgacttttggagagaatgatatttaagaacaagatctgcatgctggatgtgctcattgcaattgggctgtgctcactgctcctaggccctttcactagacagagccagggaacacacacacacacacacacacacacacacacacacatttgtttctgtatctaagcatct

SEQ ID NO: 14075 - DNA, 101 bp, Homo sapiens
  DISO7_10002557
  Located on chromosome 8
  Distance between a terminus base of telomere on chromosomal short arm and 5'-terminus of this base sequence : 81504089
  Distance between 3'-terminus of neighbour sequence of sequence listing upward to telomere on chrosomal short arm and 5'-terminus of this base sequence : 20919
cttagttctgggttccttatcctccctgccacacacacacacacacacacacacacacacacacacacacacacacacactgcctcactgtccaaattcca

SEQ ID NO: 14076 - DNA, 446 bp, Homo sapiens
  chr8.fa.O7frz.88874457
  Located on chromosome 8
  Distance between a terminus base of telomere on chromosomal short arm and 5'-terminus of this base sequence : 81680621
  Distance between 3'-terminus of neighbour sequence of sequence listing upward to telomere on chrosomal short arm and 5'-terminus of this base sequence : 176431
caagatacaatggcaggacaggcatagagtggacattcccatttgaaaaggaagaagactgggtgtggtggctcatgcttgtaatcccagcacactggaaggccaaggcaaaaggatagcctgagcccaggagtttgagatcagcctggatgaacactgtgaaagaaaagaaagaaaagaaaagaaaaaagaaagaaaagagaaatgaaagagagaaagagagagggaaatggaaagggaaagagaaagggaaagggaaagagaaagggaagggaaaaggaaaagaagggagggagggagagaaggaaagggagggagggagggagggagggaggaaggaaggaagcaagcaagcaagcaaaggagggaatagcccaaaagatagtggtaacaggccccaagctagtctgaagcccaagagggtaaacattaaatcataaagctgg

SEQ ID NO: 14077 - DNA, 319 bp, Homo sapiens
  AC012533.5_155579
  Located on chromosome 8
  Distance between a terminus base of telomere on chromosomal short arm and 5'-terminus of this base sequence : 81762134
  Distance between 3'-terminus of neighbour sequence of sequence listing upward to telomere on chrosomal short arm and 5'-terminus of this base sequence : 81067
agtgattcttaaacctttgagttctgagccctaaagataactaaaacattttttttacatgtatcagaaagaaagagaaagaaaggaaggaaggaaggaaggaaggaaggaaggaaggaaggaaggaaggaaggaaggaagaaaatcaggctcaatttgacattatgttcagtgtttttttaaaatttaagattcagcaaaataatcatgtttccaaaatcaagaggtgtaaccatagccagaacaaaacatataacaaatttgtacccactggtggtagttcttttttgtccctgtgaaactttaatagttggatttg

SEQ ID NO: 14078 - DNA, 167 bp, Homo sapiens
  G09332
  Located on chromosome 8
  Distance between a terminus base of telomere on chromosomal short arm and 5'-terminus of this base sequence : 81784970
  Distance between 3'-terminus of neighbour sequence of sequence listing upward to telomere on chrosomal short arm and 5'-terminus of this base sequence : 22517
ggagattgaggctgcagtaagctgaagtcatgccactacaccccaacctgggtgacagagtgagactctgtctaataaacgaatgaatgaatgaatgaatgaatgaataaataaataaaaagatagaaattttatttttaagataaccaaatagacattctggcact

SEQ ID NO: 14079 - DNA, 350 bp, Homo sapiens
  AC022778.3_122932
  Located on chromosome 8
  Distance between a terminus base of telomere on chromosomal short arm and 5'-terminus of this base sequence : 81905333
  Distance between 3'-terminus of neighbour sequence of sequence listing upward to telomere on chrosomal short arm and 5'-terminus of this base sequence : 120196
attaatggaccaatatcggtacattattattattatttggatttccttagtttgcaccctatgtccttttatttttggttccaggatcccatctaggatgctgcattacatttagtctgctcatttttcattacttcaagtgtgtgtgtgtgtgcatgtgtgtgtgtgtgtgtgtgtgcctctgtgtttgtgtgtgtgtgtgatagagagagagaaagagggagaatacaagtatttcttttctatgtagcaaattaagggcaaaatcctacaaattacaattctcacgttctctaatgtaaaagaaaagggcagatgttaatgaagtaatctgtggtttcaattatgag

SEQ ID NO: 14080 - DNA, 473 bp, Homo sapiens
  AF181449.1_4133
  Located on chromosome 8
  Distance between a terminus base of telomere on chromosomal short arm and 5'-terminus of this base sequence : 82165933
  Distance between 3'-terminus of neighbour sequence of sequence listing upward to telomere on chrosomal short arm and 5'-terminus of this base sequence : 260250
ctggtgaaataactaccgtgaccctctattgatacctggtcgccgtggcacttcggaatcactccttcagtaccctttatccaagaccatgtggtgttaaggctggtttatggtgaatcatgagtgtatttttgatactatcagtaaagaaggcagtatttttctttttccttgtaaacctacatcaagatgactctggaaaaagcgatttactgcacctgtccaataaataacagtgtgtgtgtgtgtgtgtgtgtgtgtgtgtgtacaagtttaaggcccaaagaacacttttctctgcctgtagaaagcaaattgtgtgtaggtttggagggcttgtttccaggattctggagtcttgaaggttgtcaagactcagttcattagggagcagtcacaatgtgaaaagagcagagcccatttatttgtccaaagtgagagtacataatgactcaattaacagcataaggcac

SEQ ID NO: 14081 - DNA, 441 bp, Homo sapiens
  AC018616.3_150821
  Located on chromosome 8
  Distance between a terminus base of telomere on chromosomal short arm and 5'-terminus of this base sequence : 82240255
  Distance between 3'-terminus of neighbour sequence of sequence listing upward to telomere on chrosomal short arm and 5'-terminus of this base sequence : 73849
cgccaacctaatatttaagtttacttttgcaccaacttaaaaaaggctcatgcccataatcccagcactttgggaagccaaggaagtgggctgatcgcttgagcctaggagtttgagaccagcctgggcaacatggtgaaatcctgtctctacgaaatatacaaaaatgagctgggcatggtggtgcgcacctgtaatcccagctattcaggaggatgagatgggaggatcgcttgaacccgggaggtggagcttgcagaaagccaagattgtgctgctgcactccaacctgggtgacagagccagactttgtcaaataaataaataaataaataaataaataaataaagatgtctgtctgttaaacacataggaaaaaaataggcaaagaatatgaacagagagtacagcacaggcaatacaaatggcctttagatttat

SEQ ID NO: 14082 - DNA, 393 bp, Homo sapiens
  AC018616.3_65842
  Located on chromosome 8
  Distance between a terminus base of telomere on chromosomal short arm and 5'-terminus of this base sequence : 82325472
  Distance between 3'-terminus of neighbour sequence of sequence listing upward to telomere on chrosomal short arm and 5'-terminus of this base sequence : 84776
actccttccactcacatttaacactggtccatgacgttctattgcaaaagagaaaccttctcatttctctatctatctatctatctatctatctatctatctatctatctatatatctatctatcatctgtcagtcatctacctatctatcgattatctatcattatatcagtatggattcatggatttctattttttcccaatggaattgggaatttattttatttttttctcaattatcttgttatttatttttctcaattattttgctctcagattggctcaagtttggccagtgggagccccttcaagctggctctatgttttggcaatatacctctatttttttttttaacattactttctggcataacaagatatttcaagctcatc

SEQ ID NO: 14083 - DNA, 244 bp, Homo sapiens
  Z67599
  Located on chromosome 8
  Distance between a terminus base of telomere on chromosomal short arm and 5'-terminus of this base sequence : 82497274
  Distance between 3'-terminus of neighbour sequence of sequence listing upward to telomere on chrosomal short arm and 5'-terminus of this base sequence : 171409
gatctactgacaaaactgacaagactgaatatggatggtagattagacaaaaagtatatttttgaagtcaattgtactgtggttacagaaaaaaacacagtattatatactctaaaataatgagggagaaaaaaatgtgtgtgtacacacacacacacacacacacacacatacagagagagagagaagatgagaaagaataattaaatgataaagcaaatggagtaaaatattcacaacaggc

SEQ ID NO: 14084 - DNA, 242 bp, Homo sapiens
  AF165141.1_33823
  Located on chromosome 8
  Distance between a terminus base of telomere on chromosomal short arm and 5'-terminus of this base sequence : 82532015
  Distance between 3'-terminus of neighbour sequence of sequence listing upward to telomere on chrosomal short arm and 5'-terminus of this base sequence : 34497
aaagtcattcactggtcaataaacgcaatagttttctaattcacatgcatgacttcctctcatctacttaaatgacacatacatacacaacaatacacacacacacacacacacacacacacacacggccttctccaggtttgcaaagggtgcttactctgcaccagttgccaagaataccttgttctctacagaagctgagtgtaataactatttttctatttgtctggctatctacttgc

SEQ ID NO: 14085 - DNA, 153 bp, Homo sapiens
  D8S525
  Located on chromosome 8
  Distance between a terminus base of telomere on chromosomal short arm and 5'-terminus of this base sequence : 82532022
  Distance between 3'-terminus of neighbour sequence of sequence listing upward to telomere on chrosomal short arm and 5'-terminus of this base sequence : -235
ttcactggtcaataaacgcaatagttttctaattcacatgcatgacttcctctcatctacttaaatgacacatacatacacaacaatacacacacacacacacacacacacacacacacggccttctccaggtttgcaaagggtgcttactct

SEQ ID NO: 14086 - DNA, 362 bp, Homo sapiens
  chr8.fa.O7frz.89652369
  Located on chromosome 8
  Distance between a terminus base of telomere on chromosomal short arm and 5'-terminus of this base sequence : 82833716
  Distance between 3'-terminus of neighbour sequence of sequence listing upward to telomere on chrosomal short arm and 5'-terminus of this base sequence : 301541
aaagcatttacagtgtagcaatagcttatagataacttgggcctgtaactgtcttgggcagtttttcacatgaggatggaaaacaaattaagaaaaccattctatctaattttttctacctctttttctcaacctttgcatgtatcaatttttttcctgcatgacacacgtgcgatatatatatatagatatatacacacatatgtgtatatatatacatatacatatatatatatatatatatgtatatgtatatatatatacacatcttgcttttcagtgtgtgccacataagcctgatggcttctcaaggtctctgcccatcctcccttatttttctcttaatgaaggaactacaagcc

SEQ ID NO: 14087 - DNA, 437 bp, Homo sapiens
  chr8.fa.O7frz.90154378
  Located on chromosome 8
  Distance between a terminus base of telomere on chromosomal short arm and 5'-terminus of this base sequence : 82965040
  Distance between 3'-terminus of neighbour sequence of sequence listing upward to telomere on chrosomal short arm and 5'-terminus of this base sequence : 130962
gacttggaacaagttatttacaactgagacactgaatgtagaacatcagaaataataaatggcacaggatgatagctcaataactcagtaatgctattgtcaatggaaatcaaacaagaacattttttctgtcattgttataataaagggactattttgacataacggagcaaagttcaaaatagtgatttctttttgtatttcagaaaatgtggagctctatcagtttgtattattagagaggggtgtgtgtgtgtgtgtgtgtgtgtgtgtgtgtgtgttaaggagagagagaaagaactggcagagtgggtagtgatgtattccatctcgggtattcttaaatggactatttaaacattatttagtggcagtgtaatgcaaagagcaatgaacttggaacaagaaaacttaggtttctatctcagcactgtcaa

SEQ ID NO: 14088 - DNA, 421 bp, Homo sapiens
  AC019252.3_82250
  Located on chromosome 8
  Distance between a terminus base of telomere on chromosomal short arm and 5'-terminus of this base sequence : 83250657
  Distance between 3'-terminus of neighbour sequence of sequence listing upward to telomere on chrosomal short arm and 5'-terminus of this base sequence : 285180
atactttgtgcactcatgagacaatgagaatttacaaataatattgtgtcttagtattattatgaatatagttttgaattgcagtacccctgagagaatctggtagttcgccagaagtctttggatcactctttgaaaaccctcacttaataaaatatgctaatatagtggagtgtaataggtgtgtgtgtgtgtgtgtgtgtgtgtgtgtgttgtttatgtagagtagtcagaagaagcttctctgaggaagtaaattttggaccaaggggtaatgataaagaagagccagccacatggccaccatggagaacattttctgcaaaaggagcagatgctctgagcagagaggggctgaggagtttacattattgaattactcagataattagataatctcttcattgaaagatacatgttt

SEQ ID NO: 14089 - DNA, 479 bp, Homo sapiens
  chr8.fa.O7frz.90408988
  Located on chromosome 8
  Distance between a terminus base of telomere on chromosomal short arm and 5'-terminus of this base sequence : 83270556
  Distance between 3'-terminus of neighbour sequence of sequence listing upward to telomere on chrosomal short arm and 5'-terminus of this base sequence : 19478
ggttatgagatagtatttgcaaacttcttggtaatctcaaacccaaaaacatacaatggatacacaaagaataaagagcaagatgctgaatcatatcaccggagaaaatcttcactcgaggaagacaggagtgaaagaaggaagagaaaaccacaaaacaaccagaaagcaaataacaaaatgacaggagtaagtttttacttatctataatgacactgaatagtgagtcccaatatatattatatatatatattaaattgttggctgggcacggtggcgcatatatatatatatatatatatatatatatatatatatatatatatatatgcacacacacatacacacacacccagcactggagcaccaggatatttaaagaaaatattattacagctagaaagagataggcccccctacagtaagagctggagactttaattctccactttcagcactgaacagatctaccagacag

SEQ ID NO: 14090 - DNA, 211 bp, Homo sapiens
  D8S1697
  Located on chromosome 8
  Distance between a terminus base of telomere on chromosomal short arm and 5'-terminus of this base sequence : 83351258
  Distance between 3'-terminus of neighbour sequence of sequence listing upward to telomere on chrosomal short arm and 5'-terminus of this base sequence : 80223
tatcctgagtcctggcctacctccagtttcccaattagtatcagatttagaaaagacagcaacacacacacacacacacacacacacacacacacacacaaacacaggagtttcttacaaattggggcaaagagtcaaatgcccaatgcctccatacttcaatattttaaattaactcttaaaaattatagtggctgggtaaactgtattc

SEQ ID NO: 14091 - DNA, 477 bp, Homo sapiens
  chr8.fa.O7frz.90595259
  Located on chromosome 8
  Distance between a terminus base of telomere on chromosomal short arm and 5'-terminus of this base sequence : 83536247
  Distance between 3'-terminus of neighbour sequence of sequence listing upward to telomere on chrosomal short arm and 5'-terminus of this base sequence : 184778
ctcatggtatctaggcttgaattttaatcattcagttctcaaacagtttcttctctctctcctcacaacaaacttactccaagagaacaattttctctcagtcatgtattctttaatatatgttttcttctttttcctctctctctctctctctctctctctctgtctttcctagaaagtaatttacatgcaatatctcaactgttttttgttggttgaatataaacctagtgggccaacagttctttaaaattaagctgctctgtgagcaacttactcttagttaaaacttttaaaactgtctctcagcaagctgtaccccaaagtgtctggaaatacccagatgtgtaggcacattttcctgggttctcagtaccaagtgctatggtggtatgtgggtgtgtgtgtctgtgtgtgtgcatgtgtatgcaaatctttgtatactcatgtgaattagacttagactggcagctttca

SEQ ID NO: 14092 - DNA, 364 bp, Homo sapiens
  AC060765.2_119499
  Located on chromosome 8
  Distance between a terminus base of telomere on chromosomal short arm and 5'-terminus of this base sequence : 83567665
  Distance between 3'-terminus of neighbour sequence of sequence listing upward to telomere on chrosomal short arm and 5'-terminus of this base sequence : 30941
atgagtacaatgatgctatggtacagtatatgtgttataattaagtagttccaaaatgtgatatcagcacttagagagtagcaattatgtgtgtgtgtatgtgtgtgtgtgtgtgtgtgtatggtgggtttggtagaggaagtttgagtcgaagaagttggctattggcaaaatttcttccagcaagaattctaggctgaggtactggcatgggttgcaatacctggaagaatcagtgtgtttcacaaaggtgagtacccacacccatacttctttctctactgctcccttttttggcaacttagaagtattaaagtagcaaaagtaaaacctcactttccttccagaatgttacattatcttc

SEQ ID NO: 14093 - DNA, 209 bp, Homo sapiens
  G10092
  Located on chromosome 8
  Distance between a terminus base of telomere on chromosomal short arm and 5'-terminus of this base sequence : 83746029
  Distance between 3'-terminus of neighbour sequence of sequence listing upward to telomere on chrosomal short arm and 5'-terminus of this base sequence : 178000
agaattagaaatgcagacagagctttagagagactgcttaactgctctctcaaaattgtgtaaggtaagattctgccctcgtcttgctcactttgatagatagatgatagatagatgatagatagatagatagatagatagatagatagatagatagatagatagatgatagatagagtgatatgcatttacacaactgtaactggtac

SEQ ID NO: 14094 - DNA, 457 bp, Homo sapiens
  AC073282.3_75079
  Located on chromosome 8
  Distance between a terminus base of telomere on chromosomal short arm and 5'-terminus of this base sequence : 83809436
  Distance between 3'-terminus of neighbour sequence of sequence listing upward to telomere on chrosomal short arm and 5'-terminus of this base sequence : 63198
cagtcctgagaaatatgtaatcaaaatgtatttttggtattgtgtccatttaaacagtataaggtgtattgaaagtaaatttggcacttcctttccttccttcctatttcttttctttctttctttctttctttctttctttctttctttctttctttctttcttccttcctttcttctttctcttctttctttcttttttcctttccttctttccttttagtttttctttttctttctttctgcctttctttctttcttttttttctttctctcttgctgcatttcgtttccttccttcctttcttccttccttactttcttcctttcttcattccttttttccttcctttcttttcctctggaggggaggaatactgtgccctctaatggtggaagttggaaggcaagctttaaaacctgtttgaagcctcttttataaggaccttaccgtcatt

SEQ ID NO: 14095 - DNA, 302 bp, Homo sapiens
  D8S1702
  Located on chromosome 8
  Distance between a terminus base of telomere on chromosomal short arm and 5'-terminus of this base sequence : 83822587
  Distance between 3'-terminus of neighbour sequence of sequence listing upward to telomere on chrosomal short arm and 5'-terminus of this base sequence : 12694
tgactctcagttattcatattagcctgtttggtttctgagtacgaaagataatttacaaaccttacacttacaatgtattataacatcattagcattattgtctttgaaagaaaattcatcaaattaaaaataattagccttatttctgataatattttcaaaatgacctcattaataattttcagtagatgacaatcaagagtttataaagcctttccaaacacacacacacacacacacacacacacaaacatgtatgttccaacacactatttttttccctaagaacactttcaagagc

SEQ ID NO: 14096 - DNA, 447 bp, Homo sapiens
  AC073282.3_124827
  Located on chromosome 8
  Distance between a terminus base of telomere on chromosomal short arm and 5'-terminus of this base sequence : 83829238
  Distance between 3'-terminus of neighbour sequence of sequence listing upward to telomere on chrosomal short arm and 5'-terminus of this base sequence : 6349
gagcttcatttcaaataaggtcatcacaaaatatatgtctagatgatttaataacttaactcattgtataacattatttatttatttatttatttatttatttatttatttatttatttatttatttatgtagagacggagtcttgctctgtcgccaggctggagtgcagtggcgcgatcgccgctcaccgcaagctccgcctcccgggttcacgccattctcctgcctcagcctcccgagtagctgggaatacaggcgcctgccaccatgcccggcaatttttttgtatttttagtagagacaaggtttcaccatgttagccaggatggtctcaatctcctgatttcgtgaaccgcccgcctcagcctcccgaagtgctgggattacaggcgtgaggcaccgtgcccggccctattcattatttcttaaagctaggtaacgtcctt

SEQ ID NO: 14097 - DNA, 339 bp, Homo sapiens
  chr8.fa.O7frz.91256824
  Located on chromosome 8
  Distance between a terminus base of telomere on chromosomal short arm and 5'-terminus of this base sequence : 83960601
  Distance between 3'-terminus of neighbour sequence of sequence listing upward to telomere on chrosomal short arm and 5'-terminus of this base sequence : 130916
tcaacatagtaccgaaagttctagctggagcaattaggcaagaacaaaaagacaactaaattggaaaaaatgaagtaaaattattggtttccagatgacatgatattacatttagaaaaccctagagagttcacacatacacacacacacacacacacacacacacacacacacgccattagaactaataggtctagttacagaatataaaatcaacacacagaattcagctgtgcttctatatatcaagtcactatccaaaaagaaaattaagagaataatcccacttatagtagcatcagaatgaataaaatatttagaataaacttaactgcggag

SEQ ID NO: 14098 - DNA, 102 bp, Homo sapiens
  Z67110
  Located on chromosome 8
  Distance between a terminus base of telomere on chromosomal short arm and 5'-terminus of this base sequence : 84246829
  Distance between 3'-terminus of neighbour sequence of sequence listing upward to telomere on chrosomal short arm and 5'-terminus of this base sequence : 285889
ttcttgttgtagagaactttcacatacttggttaaatgtattcctaggtatctcattgtgtgtgtgtgtgtgtgtgtgtgtgttgtgagtggggtggcattc

SEQ ID NO: 14099 - DNA, 256 bp, Homo sapiens
  AC069139.5_26208
  Located on chromosome 8
  Distance between a terminus base of telomere on chromosomal short arm and 5'-terminus of this base sequence : 84329374
  Distance between 3'-terminus of neighbour sequence of sequence listing upward to telomere on chrosomal short arm and 5'-terminus of this base sequence : 82443
attacaattgtgtttctgagctagggctgggatgtctggagaatgtttttaaaagcagatttctgggtataattttcccaaatttgtatttattgtgtctgagtttgtactcgggtatttttatacctctatctatctatctatctatctatctatctatctatctatatcaattaatagatcaatagctatgtattattttgtaaagctcccagtgaatcagagtttatagtcttgtcttagtgatacgaacagg

SEQ ID NO: 14100 - DNA, 459 bp, Homo sapiens
  AC022821.3_46086
  Located on chromosome 8
  Distance between a terminus base of telomere on chromosomal short arm and 5'-terminus of this base sequence : 84357675
  Distance between 3'-terminus of neighbour sequence of sequence listing upward to telomere on chrosomal short arm and 5'-terminus of this base sequence : 28045
agtgtctaatgtatgctaggacacattcctatgtgtctttatatgtatattaaaataaataataagtaatatgcaaaagagaagcagtcaccgattattccctagttgagcttacatttttttttagtggagacaaaaatgaaaattaaatgtaataaatatgtaaaatccatttattataataatttttatataaataaaattatacaaatactaatttattatataaataaaaattattattatataaataaaatttattaatagtttattataatttggtaaatgctgtgaaaatagaaaaagagaaagtacaaaagagagttaggagtacctgcttagtgtgtgtgtgtgtgtgtgtgtgtgtgtgtgcatgtgcacatactttcatctgtgtatttaaggtaatcaggatagacctgattgagaattttgtcctttgagtatactttaaatggt

SEQ ID NO: 14101 - DNA, 259 bp, Homo sapiens
  chr8.fa.O7frz.91564278
  Located on chromosome 8
  Distance between a terminus base of telomere on chromosomal short arm and 5'-terminus of this base sequence : 84366415
  Distance between 3'-terminus of neighbour sequence of sequence listing upward to telomere on chrosomal short arm and 5'-terminus of this base sequence : 8281
gatacaagcagttaccagttctatatctttcacaattatacatacagttccttgaatagactatatatatataaaatgtgtgtgtgtgtgtgtatatatatatgtgtgtgtgtgtatgtttgtgctacatttattgatgtaagagttgttgagtataaggctaagggaatgagtgtgcaactaaagtcagtcagtctaacacttactaagtttaacatttactaaataagtttaactcttgctacgtttaacacttact

SEQ ID NO: 14102 - DNA, 280 bp, Homo sapiens
  chr8.fa.O7frz.91671546
  Located on chromosome 8
  Distance between a terminus base of telomere on chromosomal short arm and 5'-terminus of this base sequence : 84473066
  Distance between 3'-terminus of neighbour sequence of sequence listing upward to telomere on chrosomal short arm and 5'-terminus of this base sequence : 106392
taaatgtttgccgtagtatcacaattcctttatttcataaaatttgctgagcacttttaaatttgatggattttatatatatatatatatatatatatatacacacacactcacacacacaataattttacctactttatcttccctaatgattatgtttttttaaaaaaaataagaatagaggattaaaattcgaatatttaagaaaaagaagtatatgaattaactagttttctaaacttcttgcttgagggtaaactacgtagttccattaaatgca

SEQ ID NO: 14103 - DNA, 365 bp, Homo sapiens
  chr8.fa.O7frz.91881866
  Located on chromosome 8
  Distance between a terminus base of telomere on chromosomal short arm and 5'-terminus of this base sequence : 84475221
  Distance between 3'-terminus of neighbour sequence of sequence listing upward to telomere on chrosomal short arm and 5'-terminus of this base sequence : 1875
attctcaaattggagtctgttcctaaggcaatggaaggatagatagcgaatgattttgtatagaaacttcccattcacaagagttttactttaaagagatcagaggagtgggaaagtacctgaaacagaagatggtgtgtgtgcgtgcatgcgtgcatgtgtatgtgtgtgtgtgtgtgtgtgtgtgtgtgtgtgttaggttaggcaatattaaagcttcctgtttatatcctggtagagatgactcagcaaaaacaaagataaaaataaatcatgatgcagaagacactgggcaattttaaatgcaaagtcagtgaatgggaagaaaaaagtgggatctagtgcacctatgatattgttcttac

SEQ ID NO: 14104 - DNA, 419 bp, Homo sapiens
  AC022821.3_37112
  Located on chromosome 8
  Distance between a terminus base of telomere on chromosomal short arm and 5'-terminus of this base sequence : 84475839
  Distance between 3'-terminus of neighbour sequence of sequence listing upward to telomere on chrosomal short arm and 5'-terminus of this base sequence : 253
agtattagaatgttcagaaagcactgagggcacatttgaggtattgtggcatgaatttaaaataacaccagttaacatggctgtttctctatggctaaattctgctacttgaaagctgcctcaacaatataaatcatgatggatgaatagatagatagatagatagatagatagatagatagatagatcagctatgcatagataaaaatgatgtggcctgctaaccaaatacagattaataatttgctctttttttaaggtcacattcaactcagccccagattaatagcttttcccaactcctctattttatggatatttttaaagaaatttccagctcagaattttcttttactctcaaagagtttttatatagcattaccaaagtttttgcagactaaatccttcaattctggaat

SEQ ID NO: 14105 - DNA, 476 bp, Homo sapiens
  AC016879.4_110363
  Located on chromosome 8
  Distance between a terminus base of telomere on chromosomal short arm and 5'-terminus of this base sequence : 84488624
  Distance between 3'-terminus of neighbour sequence of sequence listing upward to telomere on chrosomal short arm and 5'-terminus of this base sequence : 12366
ctaagattaaggtgctgtttaaacaaccagagaaatagattgaagagattcttgggtatgcaaatctagatatcaaggagcagatatggctaacagtaacatctgaagctgtcaacatataaatggaatttaatacataaaactcaataggcttaccaagagagttgtagtgagtatagctttaaaagtttaaggattaagctctagagttttcaaacatttagaggatgggatatgaagaagaataaagaataagcagaaacagtcagtgtagaagaagaaaacatacacacacacacacacacacacacacacacacaccccacagacagagagagagaaagagagagacagagaagatgaatgagatcctgaatgttaagtaagggtttcaagagaaagaatgttcagatcaattttgacaaatgctgctgatgactgaactagaaacatgcttatcatgaataaccagtgga

SEQ ID NO: 14106 - DNA, 216 bp, Homo sapiens
  chr8.fa.O7frz.91797458
  Located on chromosome 8
  Distance between a terminus base of telomere on chromosomal short arm and 5'-terminus of this base sequence : 84559698
  Distance between 3'-terminus of neighbour sequence of sequence listing upward to telomere on chrosomal short arm and 5'-terminus of this base sequence : 70598
gatcacagagtgaatgtaaggtagaggtagaactgagattcaaacctttatttatcagatttcatacccctactcccacatatatggctgtacacacacacacacacacacacacacacacacacacacatctatctatctatctatctatctatacacatatacatatatatatatacacatatacatatacataatgctacctcttggaataga

SEQ ID NO: 14107 - DNA, 412 bp, Homo sapiens
  AC024254.4_116883
  Located on chromosome 8
  Distance between a terminus base of telomere on chromosomal short arm and 5'-terminus of this base sequence : 84617707
  Distance between 3'-terminus of neighbour sequence of sequence listing upward to telomere on chrosomal short arm and 5'-terminus of this base sequence : 57793
cagctaattctaggacatggtagaagatcctgaggcattttatagtgttagaaataaggagtgctcaacacacacacacacacacacacacacacacgcacacttatgagatcaaaggcccataggaggcaactggagaagctcccatttgccaaaactgtaacaaggtgagcaacagagtagtattggattataatccaaattatatagtaatactcagtagtattggattataatccaaattatatagtaatagtagtattggattataatccaaattatatagtaaataaatatccatgaatctatactgatataaatatatgattggataactaaatgtagagaatagacaaatctgtcacacagtagaatttcaaataattatgtaaataagctttgtgatggttaa

SEQ ID NO: 14108 - DNA, 325 bp, Homo sapiens
  AC015522.4_153329
  Located on chromosome 8
  Distance between a terminus base of telomere on chromosomal short arm and 5'-terminus of this base sequence : 84822760
  Distance between 3'-terminus of neighbour sequence of sequence listing upward to telomere on chrosomal short arm and 5'-terminus of this base sequence : 204641
agttgcagtgagctatgactatgccacagtaccccagcctgggcaatagagcaagaccttgtcaccaaaaaaaaaaaaaaaaaaaaaagtagagagagtccaaatgtccaactggtgaatgaattaacacaatgggacacacacacacacacacacacaagcacacacataatggagggttgactatgcttagtggcttactttcaaagagtagagtattcaaaataaaattgtggagaaacatgaaaactgctacattggccaggcgatcaaagtgaatattataattgataagtcaagtaaataacatgtacttccactatgc

SEQ ID NO: 14109 - DNA, 442 bp, Homo sapiens
  AC073192.4_174121
  Located on chromosome 8
  Distance between a terminus base of telomere on chromosomal short arm and 5'-terminus of this base sequence : 84987189
  Distance between 3'-terminus of neighbour sequence of sequence listing upward to telomere on chrosomal short arm and 5'-terminus of this base sequence : 164104
taatgataactaggtccagcatagagcttgctttgaggtccttgccattattatcacttccatcatcaaaataatgaaactgagatacaacaaaagattttgagaaacatcccccaaagtcattaaggtagatagtagcatagcaggaacttaaaaataaattttcagatgtatacaatgtgccaggccttgactcagtttcagtttttaattctcacatcagtcttcagaaccaatatgttagatagataaatagatagatagatagatagataataggtagataggtagattagatagatagatgagagtagatttattagggaaattggctcacatgattatagaggctaagaagtcttgcggtaggttgtctgcaagctggagaaccagggaggctgatagggtggctcagtccaagtcttaaggcttcagaactagg

SEQ ID NO: 14110 - DNA, 252 bp, Homo sapiens
  chr8.fa.O7frz.93088185
  Located on chromosome 8
  Distance between a terminus base of telomere on chromosomal short arm and 5'-terminus of this base sequence : 85050592
  Distance between 3'-terminus of neighbour sequence of sequence listing upward to telomere on chrosomal short arm and 5'-terminus of this base sequence : 62961
cgatcgtagcgattgtaagtcttccacaaggccaagatggctgagtcaccattttgaatttatgttcaaagcagccataaggacacacacacacacacacacacagacacacacacactcctttagtcaagatatattgattaaaactcttcttatttgttgcatgaactgtacagtcttcagttcctttgtgtccagactattttaactataactatatttaagagtgttagtgtctaatttaggctgatg

SEQ ID NO: 14111 - DNA, 305 bp, Homo sapiens
  AC024698.4_197176
  Located on chromosome 8
  Distance between a terminus base of telomere on chromosomal short arm and 5'-terminus of this base sequence : 85165867
  Distance between 3'-terminus of neighbour sequence of sequence listing upward to telomere on chrosomal short arm and 5'-terminus of this base sequence : 115023
actatctacagccttcatttgtacattagatctctacactcttgcatcctacatatttgctactttgtatccactgatctacatctccccattcctcctgcctcctgccccttgtaactactcttttgcgttctctctctctctctgtgtgtgtgtgtgtgtgtgtgtgtgtgtgtgtgtgggtttagatttcacatataagtgagatcatgcaatactttcctttctatgtctgacttagttcaataagcataatgtactccaggcctatccatgttgtagcaaatgacaagatcttgtccttt

SEQ ID NO: 14112 - DNA, 254 bp, Homo sapiens
  chr8.fa.O7frz.92528496
  Located on chromosome 8
  Distance between a terminus base of telomere on chromosomal short arm and 5'-terminus of this base sequence : 85177875
  Distance between 3'-terminus of neighbour sequence of sequence listing upward to telomere on chrosomal short arm and 5'-terminus of this base sequence : 11703
tttgaggatgtatccataaattacttcccaaggctgatgtccaggattgtgttttctaggttttcttctaggattattttacttatttatttatttatttatttagagacagggtctcactctgttgctcgtgctggagggcagtggcacaatctctgctcactgcaacctccacctcctgggctcaagccatcctcctgcctcagcctcataattagatgggactacaggcataggccatctcaataagctat

SEQ ID NO: 14113 - DNA, 351 bp, Homo sapiens
  AC023116.4_35370
  Located on chromosome 8
  Distance between a terminus base of telomere on chromosomal short arm and 5'-terminus of this base sequence : 85229956
  Distance between 3'-terminus of neighbour sequence of sequence listing upward to telomere on chrosomal short arm and 5'-terminus of this base sequence : 51827
agtggtttggaataactagaattcatatttttgttttaaagtgtcaagaaacaggccgaattagggagaaggaaccaaatcatgaaagaccatatccagaaataaaagtttttctaaagataaagaatgaagttgaattttaatgacagtaacacaatcagatttacttttgtaagaattacattcagagaatagtggaagtcagagtgcttgcgtgcatgtgtgtgtgtgtgtgtgtgtgtgtgtgtgtgtgtgtgtgttgagtggggagggaataattttcatactccaataagaaatgttgaagacttgagctttggcaaaatttattaatttatgaggattttgagc

SEQ ID NO: 14114 - DNA, 146 bp, Homo sapiens
  chr8.fa.O7frz.92630413
  Located on chromosome 8
  Distance between a terminus base of telomere on chromosomal short arm and 5'-terminus of this base sequence : 85280338
  Distance between 3'-terminus of neighbour sequence of sequence listing upward to telomere on chrosomal short arm and 5'-terminus of this base sequence : 50031
tagctttgtctcattacgtgagaaacctgttaatattttgttattattgtttatcataggatttgtgtgtgtgtgtgtgtgtgtgtgtatgtgtaaactttctattaaattaaggaagttatcttctatttctagttggctaacaa

SEQ ID NO: 14115 - DNA, 474 bp, Homo sapiens
  AC024197.3_132206
  Located on chromosome 8
  Distance between a terminus base of telomere on chromosomal short arm and 5'-terminus of this base sequence : 85439105
  Distance between 3'-terminus of neighbour sequence of sequence listing upward to telomere on chrosomal short arm and 5'-terminus of this base sequence : 158621
tgactaagatagaatcagccaggaaaagaggaaggcagaactctgagaagtcagcagtgtgtacaataggatacttgctactttatgtctctgccttcctctacttcacgtgccacgtgccacttgctggtccccaccattgtcctgagtcttctgtgcttggttaagaattttctctagctacaatctggccactgaggaaggacgcatcctgcaaacacctcagaaccgtgttttgctaggaagctttaccactcacaaccctgtggcttttaagataggtaggtacatagatagatagatagatagatagatagatagatagatagatagatagataggataaatagataacagatgaatagatagatagtagatagataagtgtatacatcctattctgtaaactctttcatagtaaaattctatgcataattttcatgatcacagaaactaatatgacttcaaggatgt

SEQ ID NO: 14116 - DNA, 446 bp, Homo sapiens
  chr8.fa.O7frz.92916189
  Located on chromosome 8
  Distance between a terminus base of telomere on chromosomal short arm and 5'-terminus of this base sequence : 85557827
  Distance between 3'-terminus of neighbour sequence of sequence listing upward to telomere on chrosomal short arm and 5'-terminus of this base sequence : 118248
atcctattctgtcacttcctagacagatggctttagcaatttgtttaactttcctgagtctccatttgctcacttaaggtagtaactaatcttttattattattattattattattattattattaatttcttttgagacagggtcttactccatctcccaggttggagtgcagtggtgcaatcacagtcactgcagcctcaacctcccaggcccaagtgatcctccctcctcagcttcccaagtagctggaactataggcatgagccaccacacctggctaattcttatcttttctagaaacggggggtctcactgtgttggacaggctggtcttaaactcctgatttctagcaatcttcccacctcatcctccaaaagtgctgggattacaagcatgagccatcatactgggtcataactaactcttaacagctgttatgaatg

SEQ ID NO: 14117 - DNA, 347 bp, Homo sapiens
  AC009901.4_97337
  Located on chromosome 8
  Distance between a terminus base of telomere on chromosomal short arm and 5'-terminus of this base sequence : 85647531
  Distance between 3'-terminus of neighbour sequence of sequence listing upward to telomere on chrosomal short arm and 5'-terminus of this base sequence : 89258
gtaaaccttcctagcctgtagtctactggaaataatacctacccctgctatttaaagctgtgtgaattgaacaagttctggaatcactttgggccttagttgtttcaaaaatgtggaaaacagcttatctttaaaaaggcagaaatctgagaaaataagatatagcgtcacacacacacacacacacacacacacacacacacacacacagtgaaaaactgagaggatttttattttattccaagtcaggaagaaacggaaagaaaacaatactgtttccattttcactaccttccaggaacaatgctgagttttttatatatgtcttgtcattactgcctaaaata

SEQ ID NO: 14118 - DNA, 266 bp, Homo sapiens
  AC024698.4_140662
  Located on chromosome 8
  Distance between a terminus base of telomere on chromosomal short arm and 5'-terminus of this base sequence : 85744799
  Distance between 3'-terminus of neighbour sequence of sequence listing upward to telomere on chrosomal short arm and 5'-terminus of this base sequence : 96921
gagaatgctatgttgataattgaggagcagatatctaagcaagaattaaaaagaaaacgtgtgtacatatatatgtgtgtatatatatgtatctatatatgtgtatgcgtgtgtgtgtgtgtgtgtgtgtatacatatatataatttagatctataaaatcagttgagtatatatgtataggtcacccagtctttttgggctagaccaaaccaaatgttggaacttgacaaaatagaagagcgcgttcaactaagtggattgtctg

SEQ ID NO: 14119 - DNA, 374 bp, Homo sapiens
  AC012400.4_136218
  Located on chromosome 8
  Distance between a terminus base of telomere on chromosomal short arm and 5'-terminus of this base sequence : 85830265
  Distance between 3'-terminus of neighbour sequence of sequence listing upward to telomere on chrosomal short arm and 5'-terminus of this base sequence : 85200
actattgctaatagaactctgcagctaaagatcttccctcctaataaccccctaacaagttaaatgcatttctaacttcttcaaagagcgaactgcaatttctactttgatgaaacttttttccctaatttccctttgatgaaactttttttccctaatcgaggtatgacacataaaaattgtatacatgtatagtgtacaatgcaatgtttctatatatatatatatatatacacacacacacacacacacacattatgaaatgattatcacagtcaaggtaattaaaatacccattacctcacacagtttcctggggggtgggggttggtgaatatatttaagacctgctgtcttagcaaatttcaagtatc

SEQ ID NO: 14120 - DNA, 475 bp, Homo sapiens
  AC012400.4_98948
  Located on chromosome 8
  Distance between a terminus base of telomere on chromosomal short arm and 5'-terminus of this base sequence : 85931309
  Distance between 3'-terminus of neighbour sequence of sequence listing upward to telomere on chrosomal short arm and 5'-terminus of this base sequence : 100670
aaggtctatagtcctgagcaaggttattcaattttgacttttcttgacttttctttcttgtattgtagcaaagtactgaacctggtcatgtgatgacccagtttcatgtaaaacaatctattacatagatagatagatagatagatagatagatagatagatagatagatatagatagatagtgaatgttaatcaattcctgggtgacattttattttctatctgtcctaaggtctccctaaaacttttaattgtttttatctttaaaataaagccaaagatagtgatgttgattgaccacaatctgataagattaatactagatgattaacggacattccaaaaagtccagtttccccctttcctaatttttcatttatgaattcaatatgctctttatttttatagaacttttcgcacttgagagatggataacagaatagaggcccaatagcacatactatgtaaatcatgc

SEQ ID NO: 14121 - DNA, 473 bp, Homo sapiens
  chr8.fa.O7frz.93621837
  Located on chromosome 8
  Distance between a terminus base of telomere on chromosomal short arm and 5'-terminus of this base sequence : 86390721
  Distance between 3'-terminus of neighbour sequence of sequence listing upward to telomere on chrosomal short arm and 5'-terminus of this base sequence : 458937
gatcttaaatcatgtagaccagagcagcctgagaaagggtagtataaagctttccagctccctcctcattaaaggaagcaagaaatgggtaatgctaaaacaagtttttatttcttcatttgtatgcttttatttatgtatttggttagttagctttaaaataaaatttaagatgacataaagcattgcaattaagagctggaactctgagttccagagacctgagactaagactaactctgccacttacttagggccagcaatttccctgagcttcagcttcctcatgaacagaatagagttttaaggattaattaagataatacatgtgaggagcgacatcaggaagatggcagagtagaagatcctagccttcacacacacacacacacacacacacacacacacacacacaattagctatccaagaataaaaatagctctaggagagctcagaagtgtaggtaagatac

SEQ ID NO: 14122 - DNA, 196 bp, Homo sapiens
  Z66802
  Located on chromosome 8
  Distance between a terminus base of telomere on chromosomal short arm and 5'-terminus of this base sequence : 86487114
  Distance between 3'-terminus of neighbour sequence of sequence listing upward to telomere on chrosomal short arm and 5'-terminus of this base sequence : 95920
aatcagactttctaggggtaaggctaggaaacgtgtgtgtgtgtctgtgtgtgtgtgtgtgtgtgtgtgtgtgttttaactctcaagttattattatgatcagccactttgaggaactattagaggtaatgctttgagatttatgggtagttgtttttagaggtcaataaccataattccgaagcatgaagtgcag

SEQ ID NO: 14123 - DNA, 478 bp, Homo sapiens
  AF206725.3_20838
  Located on chromosome 8
  Distance between a terminus base of telomere on chromosomal short arm and 5'-terminus of this base sequence : 86730447
  Distance between 3'-terminus of neighbour sequence of sequence listing upward to telomere on chrosomal short arm and 5'-terminus of this base sequence : 243137
cgaaatacgttcttggactaggttatgtattggtggaaattgctctaagaaatattatttgaactaggggatgaaagtagaatatggaatatagataagataaatgtatcaatgtcaaattctctaaatgtaagtattgtattgaagttatgaattttaattgttctgggaaatatgtaaagactgaaatattaagaagtaaggggcaataatgtatgcaatctactgtcaaatagttttaaagaaccgtgtgtgtgtgtgtgtgtgtgtgtgtgtgtgtgcgcctggagagacagagagaatgacaaagcaaatgtgacaaaatgtgtaaacattggtgagtctaggtaaagcatgtatagatgttctcatttcaaattttcaaaattaaaaattagatttcagaattttttaattctgaagaaattgtgtggggtaaatggatgaaaacaatctgtaagtctaattctatccatgg

SEQ ID NO: 14124 - DNA, 397 bp, Homo sapiens
  AC009801.4_207220
  Located on chromosome 8
  Distance between a terminus base of telomere on chromosomal short arm and 5'-terminus of this base sequence : 86793882
  Distance between 3'-terminus of neighbour sequence of sequence listing upward to telomere on chrosomal short arm and 5'-terminus of this base sequence : 62957
ttgatgttatggtaaaggtgagtattttcttgatatacagaaaatttggaatcatccaggattacaggtactggcatcctaaggaagttagtttttcaaaaggtacttatcatcatcatcatcatcatcatcatcatcattataattcctaacatttattgagtagtcaccgtgtaccaggcactttctctgcacacattatctagacactatagtattagtattatctagataaatatagagtatcgtattagtagagagatagacactatgagtgttcccattttacagataaggaaactgagataaacaaaatgtaagtaacctgcccaaaggcacactcctgctaaatgacacagtctttatgttgaacacagcaatttcactaccaagtcta

SEQ ID NO: 14125 - DNA, 109 bp, Homo sapiens
  HUMUT6932
  Located on chromosome 8
  Distance between a terminus base of telomere on chromosomal short arm and 5'-terminus of this base sequence : 86980706
  Distance between 3'-terminus of neighbour sequence of sequence listing upward to telomere on chrosomal short arm and 5'-terminus of this base sequence : 186427
gaaagaaggaaagaaggaaggaaggaaggaaggaaggaaagaaaagaaaagaaaagaaaagaaaagaaaagaaaagaaaagacgaggtatctctatgttgtccaagcct

SEQ ID NO: 14126 - DNA, 464 bp, Homo sapiens
  AF165424.2_103468
  Located on chromosome 8
  Distance between a terminus base of telomere on chromosomal short arm and 5'-terminus of this base sequence : 87134345
  Distance between 3'-terminus of neighbour sequence of sequence listing upward to telomere on chrosomal short arm and 5'-terminus of this base sequence : 153530
tagtctgtgactgttcatgctattactccttgctggaatcttttcccacctaagcccctcttttacttgtctaaatcactcatctttcggccaggttcggtggctcatggctgtaatcccagcactttgggaggctgagagggacagatcacttgaggccaggagttcaagaccagcctggccaacatggcaaaaccctgtctctaccaaaaatacaaaaattagccgggcatggttgtggacacctgtagtcccagctacttgcgaagctgaggcacaagagtcactcaaacccaggaggcggaggttgcagtgatctgagattgtgccactgcactccagcctgggtgacagagtgagactctgtctcaaaaataaataaataaataaataaataaataaataaataaataaataaataaataaaattaatcactcatctttcaaatttgtgagtcatagac

SEQ ID NO: 14127 - DNA, 286 bp, Homo sapiens
  DISO7_10002561
  Located on chromosome 8
  Distance between a terminus base of telomere on chromosomal short arm and 5'-terminus of this base sequence : 87321472
  Distance between 3'-terminus of neighbour sequence of sequence listing upward to telomere on chrosomal short arm and 5'-terminus of this base sequence : 186663
gagtgccaatacataataacacaacaatttagtatatagcatggattataataattcttttatctatcttatctatctatctatctatctatctatctatctatctatctatctatcttttttagagacagagtctcactatgttgcctaggctggtctggaactcctgggctcaagcaatcctcccatctcatactcccaaagtgttgggattgcaggtgtgagcccctgagcccagctttttgtacttaattctataatctagtcaatattcttcattgtttgc

SEQ ID NO: 14128 - DNA, 173 bp, Homo sapiens
  DISO7_10002559
  Located on chromosome 8
  Distance between a terminus base of telomere on chromosomal short arm and 5'-terminus of this base sequence : 87326404
  Distance between 3'-terminus of neighbour sequence of sequence listing upward to telomere on chrosomal short arm and 5'-terminus of this base sequence : 4646
cctagattcaccaaatgaacacacactcccacatacttgtgctctctgtctttctctatctctgtccctctctgtctctctctctctctctctctcacacacacacacacacacacttatgcacacatgtattttccttttgcaaaatcatcctaatggagctacagatataa

SEQ ID NO: 14129 - DNA, 316 bp, Homo sapiens
  chr8.fa.O7frz.94824502
  Located on chromosome 8
  Distance between a terminus base of telomere on chromosomal short arm and 5'-terminus of this base sequence : 87424117
  Distance between 3'-terminus of neighbour sequence of sequence listing upward to telomere on chrosomal short arm and 5'-terminus of this base sequence : 97540
atcttacacctagacatgcataaccaaaggtaagatttgtaatttaattagatgacctcttatggatttcctaagattagcttaattagtcaagtgtgtccatctctaatatctacatcccagtcagatagatcttttcaaagagattctatctggctggattaacacatgaagtatctaattattagctatacaatgcatcaactgtataacacatgatatatatatatatatatatatatatatatatatatatatatacacatacacatatacttaggcatacttaaagcagtaaggcaggatttgacataaa

SEQ ID NO: 14130 - DNA, 377 bp, Homo sapiens
  AC021132.5_125477
  Located on chromosome 8
  Distance between a terminus base of telomere on chromosomal short arm and 5'-terminus of this base sequence : 87500237
  Distance between 3'-terminus of neighbour sequence of sequence listing upward to telomere on chrosomal short arm and 5'-terminus of this base sequence : 75804
tgcttcatcttggtacatctagtttttggcagcattattaatgacttttaaggatacaaagcacagatggaggctctagcaggtagtttaccactctctctctctctctctctatatatatatatatatgacatataatacatagtatataaatattatgtataataaatacttatatatgtactatgagtaattactttttttgaagtaaggccagactttcagattgcactgttttgagtaccaggatcactgttttacttctgggattacctgatatattggttactttaggctatcaattaaagtacactgtgcttctggtattgaattttgaaaaagagaaaatgaaattgtggtagtaacggatgaaagat

SEQ ID NO: 14131 - DNA, 375 bp, Homo sapiens
  AC021132.5_2073
  Located on chromosome 8
  Distance between a terminus base of telomere on chromosomal short arm and 5'-terminus of this base sequence : 87587406
  Distance between 3'-terminus of neighbour sequence of sequence listing upward to telomere on chrosomal short arm and 5'-terminus of this base sequence : 86792
taggcttagtactcaacataggaaaactggaactaactaacagtatatatcattaaaaagaaatcagaaaagaaggttttacacacagatgtaaggtcacgaacactgagactaaacaaaaatgattttttaaggaaaatgtatattacttatatttgacattagaaaaaagagaaaagcctaagtaaattaattgccttgaaaaaaatggggaataatctcaaagcagttttcctccaccacaaacacacacacacacacacacacacacacaaacacacacacacaggtatcaaacaaggcattatcacagtggattccatcaaatcttcatggaagagacaatacatatgcttgttaaatattgaaacatag

SEQ ID NO: 14132 - DNA, 216 bp, Homo sapiens
  DISO7_10002563
  Located on chromosome 8
  Distance between a terminus base of telomere on chromosomal short arm and 5'-terminus of this base sequence : 87787293
  Distance between 3'-terminus of neighbour sequence of sequence listing upward to telomere on chrosomal short arm and 5'-terminus of this base sequence : 199512
gatagagcaaagcacaaggacattaaagggaatatactattattgctggggtagcaaaactggggcatatttggacagcagtgtgtgtatgggtggtgtgtgtgtgtgtgtgtgtgagagagagagagagacagagagtcaaaaacacaatggaatgataaaaatgaaactggtcaggctggcgttctgaaaaccatacaaagacattggacttaa

SEQ ID NO: 14133 - DNA, 112 bp, Homo sapiens
  DISO7_10002562
  Located on chromosome 8
  Distance between a terminus base of telomere on chromosomal short arm and 5'-terminus of this base sequence : 87819696
  Distance between 3'-terminus of neighbour sequence of sequence listing upward to telomere on chrosomal short arm and 5'-terminus of this base sequence : 32187
catcccagtgtctggtacccacaaaagacattcacttccctggacacacacacacacacaacacacaacacacaattacaagcatgtccccaagtgtatccatactgaaaca

SEQ ID NO: 14134 - DNA, 402 bp, Homo sapiens
  chr8.fa.O7frz.95467184
  Located on chromosome 8
  Distance between a terminus base of telomere on chromosomal short arm and 5'-terminus of this base sequence : 88062234
  Distance between 3'-terminus of neighbour sequence of sequence listing upward to telomere on chrosomal short arm and 5'-terminus of this base sequence : 242426
tcaccaacttaatgcttctaagtagctttaaaatctttcattaattttatttttccaattagtcttacaacttttaaaattataataataaattcaaatttcttagagacatctcagcataaatatagtatggtctgtgccaaaacacacacacacacacacacacacacacacacacacacagacacaaacatgcacttctatatttcatatttatatacttctatattcaacatatattactatctgcagttaaacatattttactaaaatctatttttgctatgattaaatttagcaaaattataaaagcaaattattaagttgaagattctcaataattattaaaagaactttctagtttgttaaagtagttttctttgaaatacatttggaattatg

SEQ ID NO: 14135 - DNA, 249 bp, Homo sapiens
  DISO7_10002565
  Located on chromosome 8
  Distance between a terminus base of telomere on chromosomal short arm and 5'-terminus of this base sequence : 88103715
  Distance between 3'-terminus of neighbour sequence of sequence listing upward to telomere on chrosomal short arm and 5'-terminus of this base sequence : 41079
tcctctgaattgacgctggcatttaaacaactacatacacatatggattactgtttttctaactgttcattttttaaaaaacgatttttaatatactatctactatttgtttttttcatcagaattcttctaggctaagatatatatatatatatatatatatatatatatatatatatatatatatatatatatatataactaatttttaccagtatattaaaacttagacttggttgaattccttaa

SEQ ID NO: 14136 - DNA, 426 bp, Homo sapiens
  AC003016.1_74845
  Located on chromosome 8
  Distance between a terminus base of telomere on chromosomal short arm and 5'-terminus of this base sequence : 88257970
  Distance between 3'-terminus of neighbour sequence of sequence listing upward to telomere on chrosomal short arm and 5'-terminus of this base sequence : 154006
gttgcagataaatggtctgaagccagactgattttatttcttgtattttatttgtctattttctgttttttctgtcctttattcctgaggtaattagtttcacacacacacacacacacacacacacacacacaaaatatatgtatatatatatagagagagatggagtttcgctcttgttgcctaggctggagcagcatggcgcgatctctgctcactgcaacctccacctcccgggttcaagcagttctcctgcctcagcctcctgagtagctaggattacaggcatgcaccaccacgccccgctaattgtttgtatttttagtggagacggggtttctccatgttggtcaggcattgtgggttctttgatgataaaagttgaactgtttttcctcgtctctaagaaatgttccaaatccatag

SEQ ID NO: 14137 - DNA, 281 bp, Homo sapiens
  AF188025.1_96981
  Located on chromosome 8
  Distance between a terminus base of telomere on chromosomal short arm and 5'-terminus of this base sequence : 88311236
  Distance between 3'-terminus of neighbour sequence of sequence listing upward to telomere on chrosomal short arm and 5'-terminus of this base sequence : 52840
ctttgattgcagatgaatttagacttctttgacttttgaagactgaacttgatgttgcattgtataaaagttgtgaattccagcttatttctctgcttcctgtctgtaataattatgcacaaaatgaaacagctaaacaaacttgcttatgagtgttactcatggaatgacccaggacagagagagagtgagtgtgtgtgtgtgtgtgtgtgtgtgtgtgtgtgtgtgtgtatgtgtgtgtctttacacatagcctccaatctaggtcctattccttggtc

SEQ ID NO: 14138 - DNA, 261 bp, Homo sapiens
  D8S271
  Located on chromosome 8
  Distance between a terminus base of telomere on chromosomal short arm and 5'-terminus of this base sequence : 88311371
  Distance between 3'-terminus of neighbour sequence of sequence listing upward to telomere on chrosomal short arm and 5'-terminus of this base sequence : -146
aacaaacttgcttatgagtgttactcatggaatgacccaggacagagagagagtgagtgtgtgtgtgtgtgtgtgtgtgtgtgtgtgtgtgtgtgtatgtgtgtgtctttacacatagcctccaatctaggtcctattccttggtctttctccataattaaaatagaaaagggtaggaaaaactgatagaaaatcagtctgatgcaatgactggttggtcaatccattggcatctatcttccactctcatccaggtcatct

SEQ ID NO: 14139 - DNA, 201 bp, Homo sapiens
  Z16751.1_256
  Located on chromosome 8
  Distance between a terminus base of telomere on chromosomal short arm and 5'-terminus of this base sequence : 88311382
  Distance between 3'-terminus of neighbour sequence of sequence listing upward to telomere on chrosomal short arm and 5'-terminus of this base sequence : -250
ttatgagtgttactcatggaatgacccaggacagagagagagtgagtgtgtgtgtgtgtgtgtgtgtgtgtgtgtgtgtgtgtgtatgtgtgtgtctttacacatagcctccaatctaggtcctattccttggtctttctccataattaaaatagaaaagggtaggaaaaactgatagaaaatcagtctgatgcaatgact

SEQ ID NO: 14140 - DNA, 221 bp, Homo sapiens
  AF121898_56057
  Located on chromosome 8
  Distance between a terminus base of telomere on chromosomal short arm and 5'-terminus of this base sequence : 88393451
  Distance between 3'-terminus of neighbour sequence of sequence listing upward to telomere on chrosomal short arm and 5'-terminus of this base sequence : 81868
ccagatggaaattccttgtgggcaaattgtgagggaggttatgtaactcttttacctttttagctgtcttatttaggaattaaaatggaaggcaggctcccagctcgacttttcccatggcttagtgattttggggtacacacactactgctactactactactactactactactactactaccaccaccaccaagagatatacaattatatgcatcagg

SEQ ID NO: 14141 - DNA, 415 bp, Homo sapiens
  AF121898.1_39354
  Located on chromosome 8
  Distance between a terminus base of telomere on chromosomal short arm and 5'-terminus of this base sequence : 88409990
  Distance between 3'-terminus of neighbour sequence of sequence listing upward to telomere on chrosomal short arm and 5'-terminus of this base sequence : 16318
atcattagctaatactcttgcaacagaaagttttctttcattatacatgaaaatcagtacagtgatactgtttataaagttataatgaattaatattaacctcacctgtgtcctgcacatcaattattaataatgacaccagcaataatcttatgtgtagctcataacatactagtgaaactggcaaaagcaggcttttatattgagtgcctccacaccaacctttctatacagtggtaccctgacaatgatgtagccatgtctgcagttaaactcccattatatactgatgagagcacatctttattatttatttatttatttatttatttatttatttatttattttgagatggagtcccgttctgtcaccaggctggagtgcagtggtgcgatctcagctcactgtaacctc

SEQ ID NO: 14142 - DNA, 207 bp, Homo sapiens
  AF121898.1_13472
  Located on chromosome 8
  Distance between a terminus base of telomere on chromosomal short arm and 5'-terminus of this base sequence : 88436071
  Distance between 3'-terminus of neighbour sequence of sequence listing upward to telomere on chrosomal short arm and 5'-terminus of this base sequence : 25666
acctaatgctagatgacgagttagtggttgcagcacaccagcatggcgcatgtatacatatgtaactaacctgcacaatgtgcacatgtaccctaaaccttggaaagtatattaaaatatatatatatatatatatatatatatatataaagaaaattaagcaatacaacaacataggggaaagtatttgccacttaataggcacta

SEQ ID NO: 14143 - DNA, 381 bp, Homo sapiens
  AC005066.1_217693
  Located on chromosome 8
  Distance between a terminus base of telomere on chromosomal short arm and 5'-terminus of this base sequence : 88529545
  Distance between 3'-terminus of neighbour sequence of sequence listing upward to telomere on chrosomal short arm and 5'-terminus of this base sequence : 93267
attaggatttacaggcatgtttacaaataataatttcatatcttaagtcaataaaaaacaaagttcaaccaaataaatttaattagtctagtgactctcaaatttaaaaagaatagctagccccaagggatttttcaaactaccctctaataaaaagtaagcttggttggtgcttcaaaaatgtataactaaattccctccaccacacacacacacacacacacacacacacacacacacaatgggattgctgtagttgagcaatttctttgcagaggtctatatttttacatttttaagcatattaatttctcttgcagcagagaattggcaatacatcttctcactattctttgcctttctgcagtacaatgattagtg

SEQ ID NO: 14144 - DNA, 270 bp, Homo sapiens
  AC005066_90051
  Located on chromosome 8
  Distance between a terminus base of telomere on chromosomal short arm and 5'-terminus of this base sequence : 88657185
  Distance between 3'-terminus of neighbour sequence of sequence listing upward to telomere on chrosomal short arm and 5'-terminus of this base sequence : 127259
ttcctgagtagctggaactacaggtgcatgccaccacgcctggctagtttttgtattttttgtagagatggggtttcaccatatcaccgaggctagtcttgaactcctggactcaagttatcctcccacctcggcctcccaaagtgatggaatcataggcatgagccaccatgcctggcctcatttctttcttcctttctctttttttttttttctggttttgttgttgttgttgttgttgtttttgagacaggtcttgctctgtcatcc

SEQ ID NO: 14145 - DNA, 131 bp, Homo sapiens
  D8S273
  Located on chromosome 8
  Distance between a terminus base of telomere on chromosomal short arm and 5'-terminus of this base sequence : 88664432
  Distance between 3'-terminus of neighbour sequence of sequence listing upward to telomere on chrosomal short arm and 5'-terminus of this base sequence : 6977
attgccagtgtcaataaagtttacctgtgtttcatgtagcctcagtgtgtgtgtgtgtgtgtgtgtgtgtgtgtgtgtgtatatatatatatatgttacattatcattcatgggtgcatctaataccttga

SEQ ID NO: 14146 - DNA, 445 bp, Homo sapiens
  AC037450.2_5743
  Located on chromosome 8
  Distance between a terminus base of telomere on chromosomal short arm and 5'-terminus of this base sequence : 88722475
  Distance between 3'-terminus of neighbour sequence of sequence listing upward to telomere on chrosomal short arm and 5'-terminus of this base sequence : 57912
ctaagaaatctcaggattcgagtcagtggaggaagccatagtccatcctgtcactaactcttattttttcatttatttatttatttatttatttatttatttatttatttatttatttatttttagacagacttttgctcttgtcgcccaggttggagtgcaattggcatgatctcggctcactgcaacctctgccttctgggttcaagcgattctcctgcctcagcctcctgagtagctgggattacaggcatgcaccaccatgctcagctaatttttgtatttttagtagagacggggtttctccatgttggtcaggccggtcttgaactcccaactcaggtgatccgcccgtatcagcctcccaaagtgctgggattacaggtgtgagccatggtgcatccagcctatttttttttcatcttttaagaccaagtgaaatgcc

SEQ ID NO: 14147 - DNA, 436 bp, Homo sapiens
  AC021991.3_198967
  Located on chromosome 8
  Distance between a terminus base of telomere on chromosomal short arm and 5'-terminus of this base sequence : 88794693
  Distance between 3'-terminus of neighbour sequence of sequence listing upward to telomere on chrosomal short arm and 5'-terminus of this base sequence : 71773
tcaaatcaatttgtctagcaagtgggtggaaattgtgaatctgagtttcacagcacatcatagtcataaagctaaagccatggctgtgaacgagggtccaggaaagagtgtagaaataaaggaagttaagaacgtggtggtggtggtggggtcatgtaaactcacaagaattagtttaaaaagttaacacggtgaggggaaaatcctaaactctaatgtctagaagtcaacattttattgaagactatgagctaggtactctaccagcataggaaaaaatgaatagtcctaccaccaaggagttgcctagaacaaatattaatggcagagtaattattagtattaaatactatgaggaagtccagtaagataggaaataaagactcaatttagtgatgactatataatttacctttcatgaaataggtctagtgaa

SEQ ID NO: 14148 - DNA, 430 bp, Homo sapiens
  chr8.fa.O7frz.96300982
  Located on chromosome 8
  Distance between a terminus base of telomere on chromosomal short arm and 5'-terminus of this base sequence : 88896376
  Distance between 3'-terminus of neighbour sequence of sequence listing upward to telomere on chrosomal short arm and 5'-terminus of this base sequence : 101247
  misc_feature (1)...(430): n = A,T,G or C
caggtctgtttgaatacaaagtctttcttccctatgctgnagtatgactatctatagtattatacacacacacacacacacacacacacaatcttccataaatttcatcacctaaactaacgtaaaagatataaatgtaatcttatgacacaaatgaacaagaaaagaatcaatgttgataccaaaaaggactatcatttcctttgatgtttgctcatggactgctagattccatgaattttaataacatacagcaagaatatattgtccactgtatgcccaaccagaaacacacactattcataggagatacaagagtctccaaggaatttactgtgctctgctagacaacatctaccatcctataccatattaatggagtgttaacaaaacatcattattatcacagtactttattggtcgaaatcct

SEQ ID NO: 14149 - DNA, 371 bp, Homo sapiens
  AC068611.5_119435
  Located on chromosome 8
  Distance between a terminus base of telomere on chromosomal short arm and 5'-terminus of this base sequence : 88931707
  Distance between 3'-terminus of neighbour sequence of sequence listing upward to telomere on chrosomal short arm and 5'-terminus of this base sequence : 34901
aaactgatggatagttaggatagagttgcaaaaaatgatctttggtaaaaattaagatgtaatgaaaatataataaattatatagtcccatcagattgggagaccaatgaaatggatgagagacaaaagagaaggagcaaaaaattacatatatatatatatatatatatatatattcttaattttaattttttttaaacagagggagtttgtttaaaaaacagacccaggctggtattgaactcctgagctcaagggatcccgtcttggcctctcacagtgttgggattacaggtgtgagccactgcgcccagcctgcaaaaattatagactggaaagttaataatagaatagaaactaggctgaatgtg

SEQ ID NO: 14150 - DNA, 381 bp, Homo sapiens
  AC068611.5_64303
  Located on chromosome 8
  Distance between a terminus base of telomere on chromosomal short arm and 5'-terminus of this base sequence : 89021665
  Distance between 3'-terminus of neighbour sequence of sequence listing upward to telomere on chrosomal short arm and 5'-terminus of this base sequence : 89587
caagacattcagaattcaataaacttatttttgaatcaaaccgactttttctgagaagaaagacaaactactgaaggatgcatatttattttgtcaccatcttgctatcttcccttctcccttctcactatatccttccataatcaccccatctctctctctctctctctctcacacacacacacacacaccccacacacaccatccatcaggggaactacagtacacacttataactcagagggtccctggtttataaccctcctagcagcaatacaaatgtccacattttatgatcaggttttccttgctagaagcttttgtgaggtcatcatagccaaatgttattttatttcttttatttcagagcctatttaagca

SEQ ID NO: 14151 - DNA, 416 bp, Homo sapiens
  AC024063.3_43064
  Located on chromosome 8
  Distance between a terminus base of telomere on chromosomal short arm and 5'-terminus of this base sequence : 89270173
  Distance between 3'-terminus of neighbour sequence of sequence listing upward to telomere on chrosomal short arm and 5'-terminus of this base sequence : 248127
cattcttacaatgacactccacactattctcttgttaattgtagaaaaaaatagaagacacatttgagtctttaagtaacataaagtgaataaacaacagggcaaaaaagtgccatatctttgaaattgttcttaaaatttagttttattttaaaattcagaaacaattttctgtatccaaaggcaaatggtgtaggtgtccattaaacaaaacaaaacaaaacaaaacaaaacaaaacaggccaggggcagtgactcaggtctataatcccagcactttgggaggccaaggcaggatgattgcttgaagccaggagtttgagatcagcttgggcaacatagtgagaccctatctctataaaaactttaaaaaatattatccaggtgtgttggcacatgtttgtagtccaagctac

SEQ ID NO: 14152 - DNA, 436 bp, Homo sapiens
  AC022485.4_35887
  Located on chromosome 8
  Distance between a terminus base of telomere on chromosomal short arm and 5'-terminus of this base sequence : 89484996
  Distance between 3'-terminus of neighbour sequence of sequence listing upward to telomere on chrosomal short arm and 5'-terminus of this base sequence : 214407
cttaaatatttctgcggtgagaacatttgaaatgtactcatgagttcgaagtgtacaatttttatttattgtcttcaccatgctatgcaatatatctcaaggtaaaaaacaaacaaacaaacaaacaaacaaacagaaactcattcctcctgtctaactaaagctgtaccctttgaccatcgtgtcaaagccacattacatttatgattttacttgtggcaccagggaacattggcttctacattttcaaatgcttctttttaaaatgaccaaatttttacatttactttattaaatattataaatcaataggagtgataataataaagagttccatctatccccaccccaatcatgcttctaaaagctatcaccttttagcacttctgggttaagttcctcggtaggttatcttcatactgctaaataagtgctt

SEQ ID NO: 14153 - DNA, 408 bp, Homo sapiens
  chr8.fa.O7frz.97501332
  Located on chromosome 8
  Distance between a terminus base of telomere on chromosomal short arm and 5'-terminus of this base sequence : 89485024
  Distance between 3'-terminus of neighbour sequence of sequence listing upward to telomere on chrosomal short arm and 5'-terminus of this base sequence : -408
gaaatgtactcatgagttcgaagtgtacaatttttatttattgtcttcaccatgctatgcaatatatctcaaggtaaaaaacaaacaaacaaacaaacaaacaaacagaaactcattcctcctgtctaactaaagctgtaccctttgaccatcgtgtcaaagccacattacatttatgattttacttgtggcaccagggaacattggcttctacattttcaaatgcttctttttaaaatgaccaaatttttacatttactttattaaatattataaatcaataggagtgataataataaagagttccatctatccccaccccaatcatgcttctaaaagctatcaccttttagcacttctgggttaagttcctcggtaggttatcttcatactgctaaataagtgctt

SEQ ID NO: 14154 - DNA, 466 bp, Homo sapiens
  AC026089.5_121980
  Located on chromosome 8
  Distance between a terminus base of telomere on chromosomal short arm and 5'-terminus of this base sequence : 89621764
  Distance between 3'-terminus of neighbour sequence of sequence listing upward to telomere on chrosomal short arm and 5'-terminus of this base sequence : 136332
tattcttggcactgtgttaaagatcagttgactgtaaatgcttggacttatttttgggttatgtattcttttccatttgtctatacatctggtgtgtgtgtgtgtgtgtgtgtgtgtgtgtgtgccagcactatactgtttgattactgtggctgtgtaatacatttccaaatcagtaagtgtcatgccacaagctttgctatttttgctcacaattgctttggcatcatctgtggtttcatgttaatttaaaattgtttaatcaatttctgtaaacagtgtcactgggattttgatagagcttgcattgaattgctagattgctttgcgtagtaatatgatttggctttgtgttcacaccgaagtctcatctcaaagtgtaatcaccacacgttgaggaagagacctggtgggaaatgattggatcatgggggtggttcccccgtgctgttcttatgctagtgag

SEQ ID NO: 14155 - DNA, 381 bp, Homo sapiens
  AC026089.5_141712
  Located on chromosome 8
  Distance between a terminus base of telomere on chromosomal short arm and 5'-terminus of this base sequence : 89641326
  Distance between 3'-terminus of neighbour sequence of sequence listing upward to telomere on chrosomal short arm and 5'-terminus of this base sequence : 19096
atgtcggaatgcctacttcccagagtcctttttgtttgtttgtttgtttgtttgtttgtttgtttgtttctttctttctttctttctttctttctttccttctcttctttctttccttctttctttctttcctttctctttctttctttgtttgtttctttcttttctcttttttctttctttctctttcttttctttctctctcttctttctttctttctttctttctttctttctttctttctttctttctttctttctttcttttctttctctctttcctcagggttgtttttgccattgccagctatatccttttaaatttgaattaaatttaccctaaatatttattgatccctaccttatggtagattctaggct

SEQ ID NO: 14156 - DNA, 402 bp, Homo sapiens
  chr8.fa.O7frz.97197357
  Located on chromosome 8
  Distance between a terminus base of telomere on chromosomal short arm and 5'-terminus of this base sequence : 89824154
  Distance between 3'-terminus of neighbour sequence of sequence listing upward to telomere on chrosomal short arm and 5'-terminus of this base sequence : 182447
tactaagcagtaatcaaggcagaaatacaaaccaagatacaaggttaaaacttctatttaggaaataattagaattccagatgtcttggatggttggatggatgggtgttcatctccctaccacaacattttctctttggtaagagtaaatcagaaaatatctgtgctgggggccataaggagagctgagagcaaatgaaagtaattaggtttacattagtcagagttctccagggaaacagaaccaatagtattgtttgtttgtgtgtgtgtgtgtgtgtgtgtgtgtgtgtgtgtgtgttgatggtggacgatgggttgaggggagaaaataagagagggaaggagagagagagtgagacattgattcattataagatattggcttacacagttatgaag

SEQ ID NO: 14157 - DNA, 190 bp, Homo sapiens
  Z66957
  Located on chromosome 8
  Distance between a terminus base of telomere on chromosomal short arm and 5'-terminus of this base sequence : 89914962
  Distance between 3'-terminus of neighbour sequence of sequence listing upward to telomere on chrosomal short arm and 5'-terminus of this base sequence : 90406
ttctcattgcaaaactcagtgtaaaactactttagaaaagtagaaatttcagaaaggttaagtcacttgtccaaagtcacactactagtaattccaaaatgaggcttctcagttctaaaggggtgtgtgtgtgtgtgtgtgtgtatgtgtgtgtgtgtgtgttttctttttactccaagggatttcttca

SEQ ID NO: 14158 - DNA, 373 bp, Homo sapiens
  AC022485.4_68136
  Located on chromosome 8
  Distance between a terminus base of telomere on chromosomal short arm and 5'-terminus of this base sequence : 90144893
  Distance between 3'-terminus of neighbour sequence of sequence listing upward to telomere on chrosomal short arm and 5'-terminus of this base sequence : 229741
gagttgtatgcattctcacaagaggcattctttccctaccagttgaatgttcctagaaggtcacatgccagttaaactccactattttgtcttttagtgaccatgcttgagcccacttgttcaactcctgagatcttattaggaagctgctgaaaacatttcaggtgttattatctatcaggagactgcctttccctggcactggctgagacgtattgtattttattgtattgtattgtattgtattgtattgtattgtattgtattgtattgtattgtattgtattgtattgtattgtattgtatcgcatttttggcagagctagctgaggctttatttggaagaaaaaattgtttcatagatggaggcatg

SEQ ID NO: 14159 - DNA, 443 bp, Homo sapiens
  chr8.fa.O7frz.97622669
  Located on chromosome 8
  Distance between a terminus base of telomere on chromosomal short arm and 5'-terminus of this base sequence : 90158426
  Distance between 3'-terminus of neighbour sequence of sequence listing upward to telomere on chrosomal short arm and 5'-terminus of this base sequence : 13160
tttgattccacatctaagtgagatcatatagtatttgcctttctgtatttggcttattacactcagcataatatcttccaggtttattcccatagtcacagatggcaggatttccttttttttatggccaaataatattctaccgtgtgtgtgtgtgtgtgtgtgtgtgtgtgtgtgtgtgtgtgtgtgtaccccatattttctttatccatttatccatcaatgggcacgtattatttttgtatcttggctattatgagtaatgctgcaatgagcatgagcagatatctcttcgagatactcattttattttctttggatatatacccagaggagatatgtttttctaaactaaatttattattttgatatttcccaatgaatagtaaatgggataaacttataattgtctatatgtctttgtcctaagtaatctgcactgc

SEQ ID NO: 14160 - DNA, 217 bp, Homo sapiens
  DISO7_10002567
  Located on chromosome 8
  Distance between a terminus base of telomere on chromosomal short arm and 5'-terminus of this base sequence : 90201191
  Distance between 3'-terminus of neighbour sequence of sequence listing upward to telomere on chrosomal short arm and 5'-terminus of this base sequence : 42322
tgccctacctactccagagaaagagagagacagagtgtgtgtgtgtgtgtgtgtgtgtgtgtttgtgtgtgtgtggtgtgtgtgcgagagagagagagagagagacggagggagggaagaagacagaaatatcaaatgaaattaacatgaaagtgcttaaatagtagaatttttcaagagtgagattataattttacattctggaactatttgcacc

SEQ ID NO: 14161 - DNA, 101 bp, Homo sapiens
  DISO7_10002568
  Located on chromosome 8
  Distance between a terminus base of telomere on chromosomal short arm and 5'-terminus of this base sequence : 90229415
  Distance between 3'-terminus of neighbour sequence of sequence listing upward to telomere on chrosomal short arm and 5'-terminus of this base sequence : 28007
atgcttctgaaattatatgttcatgaaaacacacaccacacacacacacacacacacacacacacacacacacacaggcacacaagtgctcattcctggat

SEQ ID NO: 14162 - DNA, 106 bp, Homo sapiens
  DISO7_10002569
  Located on chromosome 8
  Distance between a terminus base of telomere on chromosomal short arm and 5'-terminus of this base sequence : 90511429
  Distance between 3'-terminus of neighbour sequence of sequence listing upward to telomere on chrosomal short arm and 5'-terminus of this base sequence : 281913
tggcctataaacatatccagctttgtatctaatagtacagtgtgagtgtgtgtgtgtgtgtgtgtgtttaatttatcacatttcttacaaagtactgttgtctgcc

SEQ ID NO: 14163 - DNA, 101 bp, Homo sapiens
  DISO7_10002572
  Located on chromosome 8
  Distance between a terminus base of telomere on chromosomal short arm and 5'-terminus of this base sequence : 90547167
  Distance between 3'-terminus of neighbour sequence of sequence listing upward to telomere on chrosomal short arm and 5'-terminus of this base sequence : 35632
aatgttgataatgctgtgtaaggcaattgtgtgtgtgtgtgtgtgtgtgtgtgtgtgtgtgtgtgtgtgtgtctctcttagcagagtgtgccgaggatttc

SEQ ID NO: 14164 - DNA, 101 bp, Homo sapiens
  DISO7_10002573
  Located on chromosome 8
  Distance between a terminus base of telomere on chromosomal short arm and 5'-terminus of this base sequence : 90570470
  Distance between 3'-terminus of neighbour sequence of sequence listing upward to telomere on chrosomal short arm and 5'-terminus of this base sequence : 23202
ttattggcaaagagaactcatcagatagggtgtgtgtgtgtgtgtgtgtgtgtgtgtgtgtgtgtgtgtgtgtgtgataaccctttctctgctggagttgg

SEQ ID NO: 14165 - DNA, 249 bp, Homo sapiens
  AF049895.1_279743
  Located on chromosome 8
  Distance between a terminus base of telomere on chromosomal short arm and 5'-terminus of this base sequence : 90944226
  Distance between 3'-terminus of neighbour sequence of sequence listing upward to telomere on chrosomal short arm and 5'-terminus of this base sequence : 373655
tatacctatgtagcaaaccttcatgttctgcacatgtatcccagaacttaaagtataataaataaataaataaataaataaataaataaataaataaatgttaacctaagagtacacaactattggtattaggactatagagcacaatgggcatgttatatacctaaataatgcaatgatagcagtgcaagtatattttgggaggttagagaaagtgtgagagtgctaaagccttcatgttatgatatc

SEQ ID NO: 14166 - DNA, 84 bp, Homo sapiens
  D8S1811
  Located on chromosome 8
  Distance between a terminus base of telomere on chromosomal short arm and 5'-terminus of this base sequence : 90954390
  Distance between 3'-terminus of neighbour sequence of sequence listing upward to telomere on chrosomal short arm and 5'-terminus of this base sequence : 9915
cccacccccaaaatgcatgcaagtgcctacacacacacacacacacacacacactgccaccaccttctccacttccctaaaccc

SEQ ID NO: 14167 - DNA, 411 bp, Homo sapiens
  AF117830.1_2770
  Located on chromosome 8
  Distance between a terminus base of telomere on chromosomal short arm and 5'-terminus of this base sequence : 90996986
  Distance between 3'-terminus of neighbour sequence of sequence listing upward to telomere on chrosomal short arm and 5'-terminus of this base sequence : 42512
acatacacctacttaagcacaaattaaaaaattcccataagttctagattacattttgtgtaatatgtgtgggccattcatagctcaagctatttttctctatctcacaccaagtttaaatagaattcacagagatgataggcacattttaaaaataacatcactaatgaaagaaaaaatgcatggaatattttaaagctgtcttttctattatgaaagtatcacaatgagaatctagaaaaaccagaaatgctatatatctacatatctctatctccttaggtctatctatttatctatctatctatctatctatctatctatctatctatctattatctatctttccatcatctatctaatctatcaccacacatatccctactactcagaaataaggtgctattaaca

SEQ ID NO: 14168 - DNA, 305 bp, Homo sapiens
  AC004083.1_167979
  Located on chromosome 8
  Distance between a terminus base of telomere on chromosomal short arm and 5'-terminus of this base sequence : 91060660
  Distance between 3'-terminus of neighbour sequence of sequence listing upward to telomere on chrosomal short arm and 5'-terminus of this base sequence : 63263
ttaccagcaccttgatcttagactccccagactctggaactgtaagaaatgcatttctgttgttatgtctatggtattttgttatagcagcttaaatggaccaagacacacctgtaggctttaaatgtttatatttgaaaataaacgagaggaaaataaataaataaataaataaataaataaataaataaataaaagactccacagcctagtggataggctctgttcccggacttgcttctcttcctgtattctgagtcttagttaatgacatcatttctgacttgtaattcacaatcagcaat

SEQ ID NO: 14169 - DNA, 142 bp, Homo sapiens
  D8S1724
  Located on chromosome 8
  Distance between a terminus base of telomere on chromosomal short arm and 5'-terminus of this base sequence : 91142682
  Distance between 3'-terminus of neighbour sequence of sequence listing upward to telomere on chrosomal short arm and 5'-terminus of this base sequence : 81717
aacttcaaaagtaatggcaaaattttaataagcaaataacagatacagggtgttgattttatttttctgcacacacacacacacacacacacacacacacacacacacagcaccagccttcaatatctatgggttccacacc

SEQ ID NO: 14170 - DNA, 113 bp, Homo sapiens
  DISO7_10002576
  Located on chromosome 8
  Distance between a terminus base of telomere on chromosomal short arm and 5'-terminus of this base sequence : 91206809
  Distance between 3'-terminus of neighbour sequence of sequence listing upward to telomere on chrosomal short arm and 5'-terminus of this base sequence : 63985
cttctcttcccaggatgtgtgtatggtgctcctgtgcgcatacacacacacacacacacacacatcaaatgtgaggtgcaaagagtagagatttggggagcaggtgagaagag

SEQ ID NO: 14171 - DNA, 150 bp, Homo sapiens
  DISO7_10002578
  Located on chromosome 8
  Distance between a terminus base of telomere on chromosomal short arm and 5'-terminus of this base sequence : 91217158
  Distance between 3'-terminus of neighbour sequence of sequence listing upward to telomere on chrosomal short arm and 5'-terminus of this base sequence : 10236
taacatcctgcccatacgctcaagaaagaatatatatatatatatatatataatattttaattttctgattcaagacaaagtgttctaacttccctacactagtaatacaaatattatgcaaaatccttgtcacttaaagctactgttaa

SEQ ID NO: 14172 - DNA, 126 bp, Homo sapiens
  DISO7_10002580
  Located on chromosome 8
  Distance between a terminus base of telomere on chromosomal short arm and 5'-terminus of this base sequence : 91297714
  Distance between 3'-terminus of neighbour sequence of sequence listing upward to telomere on chrosomal short arm and 5'-terminus of this base sequence : 80406
tgcaatacccagtgtatgtgtggatatgtatgggtgtgtgtgtatatatatatatatatatatatatatatatatatgttcggtatatgcatacacacatatatgtgtaactgtttccaggagttg

SEQ ID NO: 14173 - DNA, 101 bp, Homo sapiens
  DISO7_10002583
  Located on chromosome 8
  Distance between a terminus base of telomere on chromosomal short arm and 5'-terminus of this base sequence : 91480932
  Distance between 3'-terminus of neighbour sequence of sequence listing upward to telomere on chrosomal short arm and 5'-terminus of this base sequence : 183092
aatattgcgtacagtctataagcccatgagtgtgtgtgtgtgtgtgtatgtgtgtgtgcacgcacatgtgtaggggattcagatgcttcactatcttcctc

SEQ ID NO: 14174 - DNA, 413 bp, Homo sapiens
  chr8.fa.O7frz.99104266
  Located on chromosome 8
  Distance between a terminus base of telomere on chromosomal short arm and 5'-terminus of this base sequence : 91600645
  Distance between 3'-terminus of neighbour sequence of sequence listing upward to telomere on chrosomal short arm and 5'-terminus of this base sequence : 119612
atcacgaggtcaggagtttgagaccatcctggctaacacggtgaaaccccgtctctactaaaaatacaaaaaattagccaggcgcggtggcgggtgcctgtagttccagctactcgggaggctgaggcaggagaatggcgggaacccgggaggcggagctttcagtgagctgagatcgtgccactgcactccaacctgggcgaaagagcgagactccgtctcaaaataataaataaattaaataaataaatatatatatatgtatatatacacacacacacacacacacacacacacacacacacacttgtataagcagtgacacatgaaacgaatttcatttctccaaataatctgtaaaatacatggagccagggtagaatgtctagagttaagaaactgaatctgttgag

SEQ ID NO: 14175 - DNA, 329 bp, Homo sapiens
  AC023841.2_2343
  Located on chromosome 8
  Distance between a terminus base of telomere on chromosomal short arm and 5'-terminus of this base sequence : 91790090
  Distance between 3'-terminus of neighbour sequence of sequence listing upward to telomere on chrosomal short arm and 5'-terminus of this base sequence : 189032
catttaatggcatctaaatgacataggaacataagagaaaacccggataaagtgcggtcaagttccaactttggaaaatagcaaaatttaacaacttggaagagaaagtaaagccaacaaagaagagttgtgagaagtaggagaaacccaggagaaagcagtatctggaaaccaagaaaacaaactttaaggaaaagaaaccattgtattagtcagggttctccagaaagccagaaccaacaggagatagatagatagatagatagatagatagatagatagatagatagatagatagatagatagatgaaatagataagaggcaattt

SEQ ID NO: 14176 - DNA, 242 bp, Homo sapiens
  G08712
  Located on chromosome 8
  Distance between a terminus base of telomere on chromosomal short arm and 5'-terminus of this base sequence : 91797287
  Distance between 3'-terminus of neighbour sequence of sequence listing upward to telomere on chrosomal short arm and 5'-terminus of this base sequence : 6868
atggataaattgagtttccccaagatatattttgcaactaatcttagaagatttgtaaaaaaaaaaaaaaaagctatattgcttaaaactaataatttaattttatagtatcttactgagatagatagatagatagatagatagatagatagatagatagatagacagatagatacaataggcaactggtaacactttgaaatatgttcaagttaaaactattatccctctctgctatggca

SEQ ID NO: 14177 - DNA, 240 bp, Homo sapiens
  D8S1146
  Located on chromosome 8
  Distance between a terminus base of telomere on chromosomal short arm and 5'-terminus of this base sequence : 91797289
  Distance between 3'-terminus of neighbour sequence of sequence listing upward to telomere on chrosomal short arm and 5'-terminus of this base sequence : -240
ggataaattgagtttccccaagatatattttgcaactaatcttagaagatttgtaaaaaaaaaaaaaaaagctatattgcttaaaactaataatttaattttatagtatcttactgagatagatagatagatagatagatagatagatagatagatagatagacagatagatacaataggcaactggtaacactttgaaatatgttcaagttaaaactattatccctctctgctatggca

SEQ ID NO: 14178 - DNA, 344 bp, Homo sapiens
  chr4.fa.O7frz.40769277
  Located on chromosome 8
  Distance between a terminus base of telomere on chromosomal short arm and 5'-terminus of this base sequence : 91981366
  Distance between 3'-terminus of neighbour sequence of sequence listing upward to telomere on chrosomal short arm and 5'-terminus of this base sequence : 183837
agtgtaaacatatgtctttgagatcttgctttcaatgtttatttgcatgtataccccaaaatggaattgttggaccatatggtaattctatttttaatattttgaggaaacatcacactgctttttgtagtggctataccattttacattcccagcaacagagcacaagtgttgcaattcctacatatgcttgccaaaacttattttctgtgtgtgtatgtaggtgtgtctgtgtgtgtgtgtgtgtgtgtgtgtgtttgatagtagtcatcctaacggatgtgaggtgctctctcattgtagttttgatttgcattttcttaatgataagtgatgttgaacat

SEQ ID NO: 14179 - DNA, 322 bp, Homo sapiens
  AC017061.5_104602
  Located on chromosome 8
  Distance between a terminus base of telomere on chromosomal short arm and 5'-terminus of this base sequence : 92063570
  Distance between 3'-terminus of neighbour sequence of sequence listing upward to telomere on chrosomal short arm and 5'-terminus of this base sequence : 81860
cagtgattactgtcttccttgttcatcattgtacttagattttctaggacagtgcttagagtaggcactcaatacatctatattagctgactgctgggaggaaggaaggaaggaaggaaggaaggaaggaaagaaggaaagaaatgttcaataatatgtgcacgtgttttccaaaggcaatgctgtggtttgtcttcaatatttatcttcttattttcttgagaaattcaagatataaatctgcttttcaatagttaattgatatcaacagaaaatactttcttttaaaaaattatgagttactcacagactgtcaagaatc

SEQ ID NO: 14180 - DNA, 394 bp, Homo sapiens
  AC020783.6_141009
  Located on chromosome 8
  Distance between a terminus base of telomere on chromosomal short arm and 5'-terminus of this base sequence : 92271536
  Distance between 3'-terminus of neighbour sequence of sequence listing upward to telomere on chrosomal short arm and 5'-terminus of this base sequence : 207644
gacctatggttagcagaacatatagaagctaaccttaaccttttcatcctctagaaacagtaacatctatttcaattgaattctgttaaaaacactaaccactcttccttgtactgtgacattcctttctgtatccgtcaatgccatttttgaatcttcatattttattctgccaatttgcaaaagttctccatcttctttcattctttctattttctttctcacttcactcacttttcaaagtaatgaggaaggaatatttatgacaagaaaacacacacacacacacacacacacacacacacacacacacacacacacacatccccaaatgcttttccaaatagcaaaaatgacttgctttaccttttccttggataagcatgttatttga

SEQ ID NO: 14181 - DNA, 243 bp, Homo sapiens
  DISO7_10002585
  Located on chromosome 8
  Distance between a terminus base of telomere on chromosomal short arm and 5'-terminus of this base sequence : 92528004
  Distance between 3'-terminus of neighbour sequence of sequence listing upward to telomere on chrosomal short arm and 5'-terminus of this base sequence : 256074
ctatgaagatggctatgatgaacaaaataagtgagctttatttgagggactagattatttaagtattacaatgtttatgctattgttaatgtttagtaaggtgtcatctttttatatatagaaataaaaccacatacatatacatataaacacacacaaacatatatacacacacatacacacacacacacacacacacacatacatacatatatattttctctgtaatggccttattcacct

SEQ ID NO: 14182 - DNA, 164 bp, Homo sapiens
  DISO7_10002586
  Located on chromosome 8
  Distance between a terminus base of telomere on chromosomal short arm and 5'-terminus of this base sequence : 92622756
  Distance between 3'-terminus of neighbour sequence of sequence listing upward to telomere on chrosomal short arm and 5'-terminus of this base sequence : 94509
ctgcaggctgagtctcttacttctgtgtgtgtgtgtgtgtgtgtgtgtgtgtgtgtatatgtgcgtgtgtgtgtgtgtgtgtgtgtgtatatatatatatatatatatatggagccttttgtattatggcatttttttttcttgctgctgtattcatacatccc

SEQ ID NO: 14183 - DNA, 127 bp, Homo sapiens
  DISO7_10002587
  Located on chromosome 8
  Distance between a terminus base of telomere on chromosomal short arm and 5'-terminus of this base sequence : 92633355
  Distance between 3'-terminus of neighbour sequence of sequence listing upward to telomere on chrosomal short arm and 5'-terminus of this base sequence : 10435
ttgagccatttaggctagctgtgtgtgtgtgtgtgtgtgtgtgtgtgtgttgtgtgtgtgtgtgtgtgtgtgtgagaattattatactggaacaataatatatgtaacattacctctagcagcaatg

SEQ ID NO: 14184 - DNA, 140 bp, Homo sapiens
  DISO7_10002589
  Located on chromosome 8
  Distance between a terminus base of telomere on chromosomal short arm and 5'-terminus of this base sequence : 92723556
  Distance between 3'-terminus of neighbour sequence of sequence listing upward to telomere on chrosomal short arm and 5'-terminus of this base sequence : 90074
caggaattagttctgatacttcaactaccaaatatatatatatatatatatatatatatatatgtgtgtgtgtgtgtgtgtgtgtgtgtgtgtgtatgttgatatatagtcatttaagcagtagatgatatcagagtgca

SEQ ID NO: 14185 - DNA, 132 bp, Homo sapiens
  Z67229
  Located on chromosome 8
  Distance between a terminus base of telomere on chromosomal short arm and 5'-terminus of this base sequence : 92888499
  Distance between 3'-terminus of neighbour sequence of sequence listing upward to telomere on chrosomal short arm and 5'-terminus of this base sequence : 164803
aaacatgactggttagcaaatgataattttgctttttagatcacacaatgttgccttctcatccttctacctaaagatatgtacacacacacacacacacacacacacacatgcagcctacctttactaaag

SEQ ID NO: 14186 - DNA, 107 bp, Homo sapiens
  Z67114
  Located on chromosome 8
  Distance between a terminus base of telomere on chromosomal short arm and 5'-terminus of this base sequence : 92954831
  Distance between 3'-terminus of neighbour sequence of sequence listing upward to telomere on chrosomal short arm and 5'-terminus of this base sequence : 66200
ggaacaggtgggacaattgttagagtaggatgataaataacacacacacacacacacacacacatacacacacaagcatacaattgtataggattcttacgccccac

SEQ ID NO: 14187 - DNA, 268 bp, Homo sapiens
  HUMUT5319
  Located on chromosome 8
  Distance between a terminus base of telomere on chromosomal short arm and 5'-terminus of this base sequence : 93089508
  Distance between 3'-terminus of neighbour sequence of sequence listing upward to telomere on chrosomal short arm and 5'-terminus of this base sequence : 134570
caccagtttcagcccccaatctatgaaaaatcaggcacacccttccttccttccttccttccctccttccttccttccctccttccctccttccctccttccttccttcttttttctctttcttttcttctttctttctttctttctttctttctttctttctttctttctttctttctttcttctttctttctttctttctcccttccctttcctttcctttccttttctttctctctttctttcttctttttgacagggtctcact

SEQ ID NO: 14188 - DNA, 295 bp, Homo sapiens
  G08687
  Located on chromosome 8
  Distance between a terminus base of telomere on chromosomal short arm and 5'-terminus of this base sequence : 93320011
  Distance between 3'-terminus of neighbour sequence of sequence listing upward to telomere on chrosomal short arm and 5'-terminus of this base sequence : 230235
  misc_feature (1)...(295): n = A,T,G or C
cctttggactncagnanccagananctacatcanctgactctcctgggtctccagatctcaatctctctctctctctctcatctgcctatctatcatctatctatctatctatctatctatctatctatctatctatctatctatttatcatctatctctatctatcgatctgtttgtttatctatcttatctatctagctagctagctagctagctatcatctatctatcgccctaaccttccatttatttatctaatctcccgttggttctgtttctctgaggactctgacta

SEQ ID NO: 14189 - DNA, 170 bp, Homo sapiens
  DISO7_10002591
  Located on chromosome 8
  Distance between a terminus base of telomere on chromosomal short arm and 5'-terminus of this base sequence : 93396226
  Distance between 3'-terminus of neighbour sequence of sequence listing upward to telomere on chrosomal short arm and 5'-terminus of this base sequence : 75920
tcgagacataacctcaggggcatgtgtgtatatatatatatatatatatatatatatatatatatatatatacacataggtagaaaatatcgcaagttgaaaatggatttaataccctggtaaacccatgataaagttgaaaacttgtaagctgaatcattgttaagctg

SEQ ID NO: 14190 - DNA, 157 bp, Homo sapiens
  DISD22_0005816
  Located on chromosome 8
  Distance between a terminus base of telomere on chromosomal short arm and 5'-terminus of this base sequence : 93522421
  Distance between 3'-terminus of neighbour sequence of sequence listing upward to telomere on chrosomal short arm and 5'-terminus of this base sequence : 126025
aagacttcctatttgtgcacacaccccaggaagcgcatgcgtgcactgaagctggggtgtgcgcatacacacacacacacacacacacacgcatgcacagacacgtgcacacacacacatacacagaagttttcatattagtttcctgagttcatgg

SEQ ID NO: 14191 - DNA, 277 bp, Homo sapiens
  AC023376.3_34582
  Located on chromosome 8
  Distance between a terminus base of telomere on chromosomal short arm and 5'-terminus of this base sequence : 94051606
  Distance between 3'-terminus of neighbour sequence of sequence listing upward to telomere on chrosomal short arm and 5'-terminus of this base sequence : 529028
cgagtgctaagttcacactaagctccggcttttgaaagaaattcaaggctgatgaaagaaagaaagagagaaagacagacagagagacaggggtggaaggggaagggagggagggacggaggaaggaaggaaggaaggaaggaaggaagggaaggaaggaaggaaggaaggataatggttatttaatggttatttaaaagtggacaaaattatagacatgacatgtatttcaaattagaagactgtactaattaggttaaacagctaaaggcaaagt

SEQ ID NO: 14192 - DNA, 329 bp, Homo sapiens
  chr8.fa.O7frz.109792772
  Located on chromosome 8
  Distance between a terminus base of telomere on chromosomal short arm and 5'-terminus of this base sequence : 94094723
  Distance between 3'-terminus of neighbour sequence of sequence listing upward to telomere on chrosomal short arm and 5'-terminus of this base sequence : 42840
atgtcatagttggaattgtgaggctctttctcactttttaatgtagagggatttgatttttagccattattattatataaagcaagctcacactcagaaaaggatatttaagggttttactggccaaagtggcattcctgtgcagtgtgatcttgtagtaaggcagaattaggaaacagtgctggcattaataaattctcctttctctctccctccctgcttctgtgtgtgtgtgtgtgtgtgtgtgtctgtgtgtgtgtgtgtgtgttcatgtgtacagttgattaattggttggttgtttagtgtagaaagtgagttactggttctg

SEQ ID NO: 14193 - DNA, 472 bp, Homo sapiens
  chr8.fa.O7frz.109894720
  Located on chromosome 8
  Distance between a terminus base of telomere on chromosomal short arm and 5'-terminus of this base sequence : 94199855
  Distance between 3'-terminus of neighbour sequence of sequence listing upward to telomere on chrosomal short arm and 5'-terminus of this base sequence : 104803
gaatagagcctaatgtcttcctctggaaccttccaaatttcccctgggtcatctttttcttcttcccaacgagagagagagagagagagagagagagagagagagagtgtgtgtgtgtgtgtgtgtgtgtgtgtgtgtgtgtgtgtgtttattgaggagtgggtaagagcaaggtcctatacttctgaaatcctgtcctcacaatgctgatctataatcttcatatgcttaaacacattggctttcaaaccccaaagccaaggaatgggttttgttttctctgctctctgctcagtcacatttctccagaagcagagagcccagaatagtccagccgtttgggaagtactagtaacctaagatactaggcctgtaaaattactgataattaaaaaggagttaagcatagagggaaaaatccactacaaataaacttgctaaaatgttagtaatggctatggtttctggataa

SEQ ID NO: 14194 - DNA, 147 bp, Homo sapiens
  D8S1772
  Located on chromosome 8
  Distance between a terminus base of telomere on chromosomal short arm and 5'-terminus of this base sequence : 94362902
  Distance between 3'-terminus of neighbour sequence of sequence listing upward to telomere on chrosomal short arm and 5'-terminus of this base sequence : 162575
gatctgagccttcctactgtctcctgtttccactctatttctgccctaccatcctttcttctcctcccgggcacatacacgcgcgcacgcgcgcgcacacacacacacacacacacacacacacacaccaccattcaccaaaaggca

SEQ ID NO: 14195 - DNA, 432 bp, Homo sapiens
  AC068091.3_100690
  Located on chromosome 8
  Distance between a terminus base of telomere on chromosomal short arm and 5'-terminus of this base sequence : 94388502
  Distance between 3'-terminus of neighbour sequence of sequence listing upward to telomere on chrosomal short arm and 5'-terminus of this base sequence : 25453
gtgatactgaggcttaggtttagtaatttgcctaaggacacacagctagcaagcagctgagtctgaatttgcaccaggatgtctgctttccttgttgttgttgttgttgtttttgaggcatagtctcactctgtcgcctaggctggagtgcagtggcacaatcttggctcactgcaacctctgtctcccaggttcaagtgattctcctgcctcagcctcccaaatagctgggactgcaggcacccgccaccacacctggctaatttttgtatttttagtagagacagggtttcaccatgttggccaggctgatctcaaactcctgacctcaagtgatctgccggcctcagcctcccaaagtgctgggattagaggcatgagccaccatgcctggcctcaggatgtctgctttcttgaacactgctacagtat

SEQ ID NO: 14196 - DNA, 248 bp, Homo sapiens
  AC068091.3_10718
  Located on chromosome 8
  Distance between a terminus base of telomere on chromosomal short arm and 5'-terminus of this base sequence : 94424851
  Distance between 3'-terminus of neighbour sequence of sequence listing upward to telomere on chrosomal short arm and 5'-terminus of this base sequence : 35917
catgtcttactcctatcagcagaccacagccccatagatcctcactggcctcagagctggcaaatggatggcaaggagctggttccctggtgaccgccacacctttgctcctcctcctcctccttggaaggagactcagatctcaggtgcttgcttgattagagatggccacacctccaagccactcttcaggtggctccaggggtggttggctggttgcgtgctctgtggacagaataactggtgtt

SEQ ID NO: 14197 - DNA, 214 bp, Homo sapiens
  DISD22_0005839
  Located on chromosome 8
  Distance between a terminus base of telomere on chromosomal short arm and 5'-terminus of this base sequence : 94642022
  Distance between 3'-terminus of neighbour sequence of sequence listing upward to telomere on chrosomal short arm and 5'-terminus of this base sequence : 216923
agttcgtttggaatgaattattagaatatcacacacacacacacacacacatacacacacacacacacacattcaaatgtgattatctactggaaagtcagtagataaatcagttgactagaaagtttatggtttggattatttttgtaatgttatttcatatttcccacccttatattcccctctttgggaatgataatttgagaagttagct

SEQ ID NO: 14198 - DNA, 206 bp, Homo sapiens
  Z66740
  Located on chromosome 8
  Distance between a terminus base of telomere on chromosomal short arm and 5'-terminus of this base sequence : 94948212
  Distance between 3'-terminus of neighbour sequence of sequence listing upward to telomere on chrosomal short arm and 5'-terminus of this base sequence : 305976
catacgggaccatgcctaggttgcttaacctttctaaatctcagattactcatctttaatatggggacaataatattgatttttgcatttgtgtgtgtgtgtgtgtgtgtgtgtgtgtgtgtgtgtctgggagagagagaaaggagagagagaggagagaaagactggttataatctatgtaaaccttctggtgctcaataaatgg

SEQ ID NO: 14199 - DNA, 314 bp, Homo sapiens
  chr4.fa.O7frz.40586996
  Located on chromosome 8
  Distance between a terminus base of telomere on chromosomal short arm and 5'-terminus of this base sequence : 95050031
  Distance between 3'-terminus of neighbour sequence of sequence listing upward to telomere on chrosomal short arm and 5'-terminus of this base sequence : 101613
gctatggagtgtcctattgataaatacaacacagtttattcattctattgtcagcagacatttcatgagttttctttctttttttttttttagaagggttaggcctattatgaatactctgttatgaacattccagtacatcttttttggttaaagtatacacacacacacacacacacacacacacacacacacacacacacatcctgttggatatataacgaggagtagcattgctgggtcatagttttgtgtatgttcagatttaatagataagccagtttttccaggtggttgaatgtacttacactagc

SEQ ID NO: 14200 - DNA, 474 bp, Homo sapiens
  chr8.fa.O7frz.110904594
  Located on chromosome 8
  Distance between a terminus base of telomere on chromosomal short arm and 5'-terminus of this base sequence : 95358017
  Distance between 3'-terminus of neighbour sequence of sequence listing upward to telomere on chrosomal short arm and 5'-terminus of this base sequence : 307672
atgatatgcctcaatacaattaactaccataacatgtgaggcacatatgtgtcaaaagaatacaagttaagatgttgtgaggggttaaattgctcctgccctcacaccaaattcatatgtggaagtcataatccctaatacttcataatgtagctgaatttagagacagggtctttaaagggtaattaaagttaaatgaggtcattagaggggccccaattcaagatgactagtatccttataagagattaggatatatatacacacagagacacacacacacacacacacacacacacacacacacacacacacacacacagagaccatgtaaagacagagagagaagaaagctatctataagctgagtgaggccctcagaagaaaccaaccctgctgataccttgatcttgaatttctagcctccagaactgagaaaataaatttgttgtttaagctactcagtctgtggta

SEQ ID NO: 14201 - DNA, 362 bp, Homo sapiens
  AC068351.2_109057
  Located on chromosome 8
  Distance between a terminus base of telomere on chromosomal short arm and 5'-terminus of this base sequence : 95476479
  Distance between 3'-terminus of neighbour sequence of sequence listing upward to telomere on chrosomal short arm and 5'-terminus of this base sequence : 117988
gaatcagtcctctcaaccttactctaaatcactcatgaaaacaaggatgttgccaacatccaaacaggaccaaggtctgcataacagagggcttacatggccatacatgtaactatcaacttgaagttgcaatttatgttttaaattttatttatttatttatttatttattggagagaggatcttggtctgttgtccaggctagaatgcagtggtgcgatcatggctctctgtggcctaaacctcctgggctcaagcaatcattccacctcagcttcctaaagtgctgggattacaggtgtgagccatcatgcccagccaaaattacaattcaattgtccttgttcttaagtcatgtcagc

SEQ ID NO: 14202 - DNA, 403 bp, Homo sapiens
  AC022256.3_131744
  Located on chromosome 8
  Distance between a terminus base of telomere on chromosomal short arm and 5'-terminus of this base sequence : 95602352
  Distance between 3'-terminus of neighbour sequence of sequence listing upward to telomere on chrosomal short arm and 5'-terminus of this base sequence : 125511
attgtcagtaaactattgcaagaacaaaaaaccaaacaccgcatattctcactcataggtgggaattgaacaatgagatcacatggacacaggaaggggaatatcacactctggggactgtggtggggttgggggaggggggagggatagcattgggagatatacctaatgctagatgacacgttagtgggtgcagcgcaccagcatggcacatgtatacatatgtaactaacctgcacaatgtgcacatgtaccctaaaacttaaagtataattaaaaaaaaataataaaataaataaataaataaataaataaataaaatagtttgcccttcactccttcagatcctgggggattttgcatgcagtttgaagtctctgaataaattactaaaccaagcctc

SEQ ID NO: 14203 - DNA, 269 bp, Homo sapiens
  chr8.fa.O7frz.111321377
  Located on chromosome 8
  Distance between a terminus base of telomere on chromosomal short arm and 5'-terminus of this base sequence : 95908366
  Distance between 3'-terminus of neighbour sequence of sequence listing upward to telomere on chrosomal short arm and 5'-terminus of this base sequence : 305611
aggttagtctgaccaagctaactctgccattaccagaaactcgaagctaggacctcacaattatctttaaaaagactttttaaatcttttaaacattttcacttgtacttatttgaaatgcccacatcacattttgagtcagaggacctagggttagcttctgtcagtatgacttctattttatttatttatttatttatttatttatttatttatttattaaggcacaaccatgttcatcattactagtcatatggtctaaattagca

SEQ ID NO: 14204 - DNA, 206 bp, Homo sapiens
  D8S1778
  Located on chromosome 8
  Distance between a terminus base of telomere on chromosomal short arm and 5'-terminus of this base sequence : 96241876
  Distance between 3'-terminus of neighbour sequence of sequence listing upward to telomere on chrosomal short arm and 5'-terminus of this base sequence : 333241
ccactgagcccagcctattattctttatcatatgtttcttggaaagcttttgtgtgtgtgtgtgtgtgtgtgtgtgtgtgtgtgtgtgtgtgtgtgttttaaaatagagatgcattataatggttataattattttagttttccaatcctaaattgttcaacattggttctcctgtatgtttttctttagacgccctcctgcaaaa

SEQ ID NO: 14205 - DNA, 123 bp, Homo sapiens
  D8S506
  Located on chromosome 8
  Distance between a terminus base of telomere on chromosomal short arm and 5'-terminus of this base sequence : 96319334
  Distance between 3'-terminus of neighbour sequence of sequence listing upward to telomere on chrosomal short arm and 5'-terminus of this base sequence : 77252
attttgttagtttgttttcttgatgtgtgtgtgtgtgtgtgtgtgtgtgttttccccttccttatattacatttttagtattacctcttaggaatctctcagcaatgaaggtggtaatagaaa

SEQ ID NO: 14206 - DNA, 101 bp, Homo sapiens
  DISD22_0005853
  Located on chromosome 8
  Distance between a terminus base of telomere on chromosomal short arm and 5'-terminus of this base sequence : 96423397
  Distance between 3'-terminus of neighbour sequence of sequence listing upward to telomere on chrosomal short arm and 5'-terminus of this base sequence : 103940
tgatctctgatctgcagtatcccctcaccacacacacacacacacacacacacacacacacacacacacacacacatttctgggcccatgtaacaggtgct

SEQ ID NO: 14207 - DNA, 101 bp, Homo sapiens
  DISD22_0005856
  Located on chromosome 8
  Distance between a terminus base of telomere on chromosomal short arm and 5'-terminus of this base sequence : 96493703
  Distance between 3'-terminus of neighbour sequence of sequence listing upward to telomere on chrosomal short arm and 5'-terminus of this base sequence : 70205
caccttctagcccactcagatgagtgcatgtgtgtgtgtgtgtgtgtgtgtgtgtgtgtgtgtgtgtgtgtgcgcgcgcgcgcgcatgcatggtatgacta

SEQ ID NO: 14208 - DNA, 211 bp, Homo sapiens
  DISD22_0005862
  Located on chromosome 8
  Distance between a terminus base of telomere on chromosomal short arm and 5'-terminus of this base sequence : 96577130
  Distance between 3'-terminus of neighbour sequence of sequence listing upward to telomere on chrosomal short arm and 5'-terminus of this base sequence : 83326
gtagtggcatccttccatccctcttttcttgcttacacaaaataaacacgagagagagagagagagagagagagagagagagagagacagagagagagagagaagtactctttctgtttttattaaaacaatcagacacttattttgtaatttggtagtatttaaaaaaatgttatttcaaataaatgatgatgaaaccaatatctgttct

SEQ ID NO: 14209 - DNA, 425 bp, Homo sapiens
  AC016877.3_61191
  Located on chromosome 8
  Distance between a terminus base of telomere on chromosomal short arm and 5'-terminus of this base sequence : 96881696
  Distance between 3'-terminus of neighbour sequence of sequence listing upward to telomere on chrosomal short arm and 5'-terminus of this base sequence : 304355
tacttgagtaacgtttcaggatacaaaatgaacaaaaaccagtagcatttctatacaccagtaacgttccagctgagagccaagtcaagaacacgatcccatttacaatggccacaaaatacaatacaatacaatacaatacaatacaatacaatacaatacaatacaatacaatacaatacaatacctaggaatacatctaaccaaggggatgaaggatctctacaaggagaactataaaacactgctgaaagaaatcagagatgacacaaacaaatggaaaaacatttcatgttcatgaagtggaaaaatcaatatcattaaaaataaaaaacatttcatgttcatgaagtggaaaaatcaacatcattaaaatggccacacagcccaaaggaatacacagattcaacactattcctatcaag

SEQ ID NO: 14210 - DNA, 136 bp, Homo sapiens
  D8S1749
  Located on chromosome 8
  Distance between a terminus base of telomere on chromosomal short arm and 5'-terminus of this base sequence : 97000302
  Distance between 3'-terminus of neighbour sequence of sequence listing upward to telomere on chrosomal short arm and 5'-terminus of this base sequence : 118181
acacttgtgtgcaagcacatgcctacacacacacacacacacacacacacacacacactctctctctctctcttcactcttaaaatacggggcttgaaattatttcagttgtttgttcacacaggcccaaattgct

SEQ ID NO: 14211 - DNA, 217 bp, Homo sapiens
  HUMUT5034
  Located on chromosome 8
  Distance between a terminus base of telomere on chromosomal short arm and 5'-terminus of this base sequence : 97222427
  Distance between 3'-terminus of neighbour sequence of sequence listing upward to telomere on chrosomal short arm and 5'-terminus of this base sequence : 221989
gcataggcctcagttcatggaagtcacttaacaaatgttaactttaattccctctttgttcataatatttttgatgagttggataaattattctgtcccagatttgagatagatagatagatagatagatagatagatagatagatgatagatagatagatagataaacaatttttcttccctgtgactacccagctctctgctcatgggcatatcc

SEQ ID NO: 14212 - DNA, 169 bp, Homo sapiens
  D8S1822
  Located on chromosome 8
  Distance between a terminus base of telomere on chromosomal short arm and 5'-terminus of this base sequence : 97291047
  Distance between 3'-terminus of neighbour sequence of sequence listing upward to telomere on chrosomal short arm and 5'-terminus of this base sequence : 68403
agctatacactcattcttgagaggaaaggcctgaaagaacaataggggtgtgtgtgtgtgtgtgtgtgtgtgtgtgtgtgtgtgtgtgtgtgtgtctatatgtatatctgagacatgaagagtaggtgaggtttctcaaaggattggaataaaatcagggtgtagatta

SEQ ID NO: 14213 - DNA, 266 bp, Homo sapiens
  D8S1756
  Located on chromosome 8
  Distance between a terminus base of telomere on chromosomal short arm and 5'-terminus of this base sequence : 97318253
  Distance between 3'-terminus of neighbour sequence of sequence listing upward to telomere on chrosomal short arm and 5'-terminus of this base sequence : 27037
gatcaaagtttgttctgaagttaacatatagtacacacacacacacacacacacacacagagagagagagagagagagagagagagagagagagaaagcattaattctgactgccaattgtcttttaatatcaattttccccttctcactcagaaaactcttaggttttagctgggcatagaagccatggagaataaagacaacatttccaaggtttctttgtagttaggtatggccaggtgattaagttctaacccacgggatgt

SEQ ID NO: 14214 - DNA, 357 bp, Homo sapiens
  AC026561.2_107076
  Located on chromosome 8
  Distance between a terminus base of telomere on chromosomal short arm and 5'-terminus of this base sequence : 97547044
  Distance between 3'-terminus of neighbour sequence of sequence listing upward to telomere on chrosomal short arm and 5'-terminus of this base sequence : 228525
tcaccttgtttctagaattctaaatgtctatttctaatcctgttccctaaaggtaaaagcaatgcatatatcccattattttatcaatgtgtgcatgggcccttgcagaacatagcatcagcacggtaacttccagatgggtggggtgtgtgtgtgtgtgtgtgtgtgtgtgtgtgtacaggccaccaaggtggagagagaaacaaacaaaatatgaagtgacaaggaaggtgcacaagtgacgagcggagatctgccgttccaagtttggctggtcacagcctggggagtttttatggcctattcaaggctgtggtgcagactaaacaaggttttctttactttcaccatgacatc

SEQ ID NO: 14215 - DNA, 412 bp, Homo sapiens
  chr8.fa.O7frz.109200354
  Located on chromosome 8
  Distance between a terminus base of telomere on chromosomal short arm and 5'-terminus of this base sequence : 97595472
  Distance between 3'-terminus of neighbour sequence of sequence listing upward to telomere on chrosomal short arm and 5'-terminus of this base sequence : 48071
tcctgagaagcagaaggtaatgttttttgtttgtttgtttgtttgtttgtttgtttttgagacggagtctcactctgtcacccaggctggagtgcagtggcgcaatctcggctcactgcaacatccgcctcctgggttcaagtgattcttctgcctcagcctcccgagtagatgggactacaggcatgcaccaccacacccagctaatttttttatttttagtagagacggggtttcaccatgttagccaggatggtcttgatctcttgaccttgtgatcctcctgcctcggcctcccaaagtgctgggattacaggtgtgagccactgcgcctggctggaaatgctcttaatgtacttggaacatcacagacaaaaggaatgccttaaagtagacatgtaatttgacaggc

SEQ ID NO: 14216 - DNA, 372 bp, Homo sapiens
  AC024995.2_72496
  Located on chromosome 8
  Distance between a terminus base of telomere on chromosomal short arm and 5'-terminus of this base sequence : 97764421
  Distance between 3'-terminus of neighbour sequence of sequence listing upward to telomere on chrosomal short arm and 5'-terminus of this base sequence : 168537
atcaattttatggccactagacataacctgggcaacatggtgaaaccccacttctacaaaaaatataaaaattagctgagcatggtggtgtgtgcctgtagtccacactactgggaggctgaagtgggaggatggcttgagcccaggaggtagaagttgcggtaaggcatgatcatgccactgtaccccagcgtggacaacagagtgaaaccctgtctcaaaaaaagaaagagaaagaaagggaggaaagaaaaagaaagaaggaaggaaggaaggaaggtggtggggagggaggtagggaggcagggaggaagggaggcagggaggcagggagggagggagagaggaaggagtcttatccagaatgaccat

SEQ ID NO: 14217 - DNA, 404 bp, Homo sapiens
  chr8.fa.O7frz.104710540
  Located on chromosome 8
  Distance between a terminus base of telomere on chromosomal short arm and 5'-terminus of this base sequence : 97848544
  Distance between 3'-terminus of neighbour sequence of sequence listing upward to telomere on chrosomal short arm and 5'-terminus of this base sequence : 83751
ttaccatttaaactctacatcacacagatgcaaacccatctgtcaccgaggacagaggcatcattaaattaatcactagcccttcccgggtgtgacaaaattcctctggcattgttttttgggtgtgcctgctagtgggaattctgcagagacaggttttcagcttctaaaagtcaggtggtggttttgttgtgagataatatcaccctctccatactacacacacacacacacacacacacacacacacactcactcactcatacacacttcctggaggccagggggagggaagcaggaactggagcccacccctcatcccccaggacatctgcacaaagcatggcttcatggaaatctttttggcttgctcaagagaagccatttcaacctgacttcagatc

SEQ ID NO: 14218 - DNA, 211 bp, Homo sapiens
  D8S1735
  Located on chromosome 8
  Distance between a terminus base of telomere on chromosomal short arm and 5'-terminus of this base sequence : 97951543
  Distance between 3'-terminus of neighbour sequence of sequence listing upward to telomere on chrosomal short arm and 5'-terminus of this base sequence : 102595
aggttgcagtgagccgagatggcgccactgcactccagtctgggtgacaaagtgagacgctgtctcaaaaaaaataataaaataaaataaaataaaaacaagaaaacaaaaagaaaacacacacacacacacacacacacacacacacacaaaaccccaaaaaagtgacttggctgaaattaacctaaaattgacttctgaagccaaagcc

SEQ ID NO: 14219 - DNA, 381 bp, Homo sapiens
  AC068189.2_57737
  Located on chromosome 8
  Distance between a terminus base of telomere on chromosomal short arm and 5'-terminus of this base sequence : 98027481
  Distance between 3'-terminus of neighbour sequence of sequence listing upward to telomere on chrosomal short arm and 5'-terminus of this base sequence : 75727
ccagtaaccatctatggagttacatagtttttattacccattaaaaggggtttttgctgttttttttgagacagagtcttactctgtcacccaggctggaatgcagtggcgcgatcataacttattgcagcctctacctctcatgctcaagcgatcttcccacctcccaagtagctgggaccacaggcatgtgccaccatacctggctaatttttatttgtttatttatttatttatttatttatttatttattttagagacagagtcttgctgttgcccaggctggtctcaaacttctgtcctcaagagagccacctgcctaggcctcccaaagtgctgggattacaggcatgagccactgtaaccagcctaaaggtact

SEQ ID NO: 14220 - DNA, 221 bp, Homo sapiens
  D8S1699
  Located on chromosome 8
  Distance between a terminus base of telomere on chromosomal short arm and 5'-terminus of this base sequence : 98042925
  Distance between 3'-terminus of neighbour sequence of sequence listing upward to telomere on chrosomal short arm and 5'-terminus of this base sequence : 15063
catgatgttctaagcatatctgctagtggaagaaaaaatcatttttcctttttacattaaatactcaaaatctgtctcttacattctctctgtctctctctctctctctctctctctctgtgtgtgtgtgtgtgtgtgtgtgtgtgtgtgtgtgtgtgtgtgtgtgtgtgtgtctttcttcttgcttaagtgcctactgaaatcctggcagggtcaggttg

SEQ ID NO: 14221 - DNA, 323 bp, Homo sapiens
  chr8.fa.O7frz.104434323
  Located on chromosome 8
  Distance between a terminus base of telomere on chromosomal short arm and 5'-terminus of this base sequence : 98108618
  Distance between 3'-terminus of neighbour sequence of sequence listing upward to telomere on chrosomal short arm and 5'-terminus of this base sequence : 65472
tgaactctattaaggtgatccacctgcctcagcctcccaaagtgttgggattacaagagcgagccacagcgcctggcctaaaaataattttctttatattaacttttttctattagtttcttattgtggcctcttaaaattctactgtaaaaaaattttatatatatatatgtgtgtgtgtgtgtgtgtaataaatatgtgtgtttcctcaagtgattttaggcagaatgtgtcactgcccttcctgtgtaaaataactcttaaaaatcatacagctcttcatgttacgtgttgacatagtttacagcaatcctacttgatta

SEQ ID NO: 14222 - DNA, 258 bp, Homo sapiens
  D8S1794
  Located on chromosome 8
  Distance between a terminus base of telomere on chromosomal short arm and 5'-terminus of this base sequence : 98461174
  Distance between 3'-terminus of neighbour sequence of sequence listing upward to telomere on chrosomal short arm and 5'-terminus of this base sequence : 352233
ggattacagtcacggcgcccggccaaaaaaatttttttaaagaaagaataatccagccaggtgtagtggctcatgcctgtaatcccaaagttttgggaggctgcggtgggaggatcgcttaagcccaggagttcaagaccagcctggggaacataatgagacccctgtctttacacacacacacacacacacacacacacacacactagccagatgtggtggtatgtgcctgtagtcctagttattagggaggctgag

SEQ ID NO: 14223 - DNA, 113 bp, Homo sapiens
  chr8.fa.O7frz.102351658
  Located on chromosome 8
  Distance between a terminus base of telomere on chromosomal short arm and 5'-terminus of this base sequence : 98608170
  Distance between 3'-terminus of neighbour sequence of sequence listing upward to telomere on chrosomal short arm and 5'-terminus of this base sequence : 146738
taatttgctatgttccagaataaccacccctaacaattatatatatatatatatatatataattttttgtggtgaggaggctttctagaaaattctgaaactggatttagaat

SEQ ID NO: 14224 - DNA, 399 bp, Homo sapiens
  AC024035.3_54960
  Located on chromosome 8
  Distance between a terminus base of telomere on chromosomal short arm and 5'-terminus of this base sequence : 98624673
  Distance between 3'-terminus of neighbour sequence of sequence listing upward to telomere on chrosomal short arm and 5'-terminus of this base sequence : 16390
tgcttattcagagatctgagtaagaatcatggttttgccactgaactaactggttctttgacctcttgggggtagtcactaaccttcctaatgttttgcctactcatgtgtaaaacgtgggtcctaataaccaccgtagagatttagagtgtctagtatatactctttccaggaaatacttgttgagtgagtgaatgaaacattttattgtggcatttatgtgttgtgtgtatgtgatgtaaatgtatatatatgtgtacatgtgaattttatatatatgtgtgtgtgtgtgtgtgtgtgtgtaaaagcacttcaggtaaatagtaaatggttaattattcttatgtatttatcttagccaaggatagaattaggttgtagactttaatgcctcagaca

SEQ ID NO: 14225 - DNA, 98 bp, Homo sapiens
  Z66605
  Located on chromosome 8
  Distance between a terminus base of telomere on chromosomal short arm and 5'-terminus of this base sequence : 98793008
  Distance between 3'-terminus of neighbour sequence of sequence listing upward to telomere on chrosomal short arm and 5'-terminus of this base sequence : 167936
gttaccacatttggctaggggcctgcaggtgggagtgtgtgtgtgtgtgtgtgtgtgtgtgtgtgtgtgtgtatgtgtatgtgttgaggatgaggcag

SEQ ID NO: 14226 - DNA, 292 bp, Homo sapiens
  D8S1083
  Located on chromosome 8
  Distance between a terminus base of telomere on chromosomal short arm and 5'-terminus of this base sequence : 98845447
  Distance between 3'-terminus of neighbour sequence of sequence listing upward to telomere on chrosomal short arm and 5'-terminus of this base sequence : 52341
agctttacaacggacaaacatccagacctagaaactgttcagtaggatcattccagagtctctggggatcctagccagtaaaagtcatgccttgggctgctccacttttctttttttgttttgttttagtttttctgttagtcatgctgcaaagttatcccttcttagcaggaaatgatagcctggttatcatggttgaatgtttcttctttacaggggtgtgtgtgtgtgtgtgtgtgtgtgtgtgtgtgtgtgtattggggtagggtgtggggttgggatgacagagtag

SEQ ID NO: 14227 - DNA, 175 bp, Homo sapiens
  chr8.fa.O7frz.102012276
  Located on chromosome 8
  Distance between a terminus base of telomere on chromosomal short arm and 5'-terminus of this base sequence : 98926714
  Distance between 3'-terminus of neighbour sequence of sequence listing upward to telomere on chrosomal short arm and 5'-terminus of this base sequence : 80975
agccaaagtcttaaagtaaatctctttctacagatctatatatatgtaaatatatatacgtgtgtgtgtgtgtgtgtgtgtgtgtgtgtgtgtgtgtatgtctgtgtatatcttattggttctgactctctggagaaccctaacgtaacaaaagaataaagatactggaaatggt

SEQ ID NO: 14228 - DNA, 343 bp, Homo sapiens
  chr8.fa.O7frz.101934059
  Located on chromosome 8
  Distance between a terminus base of telomere on chromosomal short arm and 5'-terminus of this base sequence : 98990569
  Distance between 3'-terminus of neighbour sequence of sequence listing upward to telomere on chrosomal short arm and 5'-terminus of this base sequence : 63680
gctatgataatggcactgtactccagcctgggtgacagagggagaccctgtcctaaataaataaataaataaataaacaaacaaacaagagaaatcacccttcacttgttttctttcctcctctgggaatgtccctatatgactaattcttaccccaaggctgctgtgagattggagtggagcagagtgagaagcaagaaatgatagtggctaagagctcaaattctgagtcaaaaaccacctgcaatcccagctgatcttctgctcccagatctccattttctcatctttatatggggtgagaacagcatctccctcatatcatgattatgacaattcaatc

SEQ ID NO: 14229 - DNA, 247 bp, Homo sapiens
  Z67343
  Located on chromosome 8
  Distance between a terminus base of telomere on chromosomal short arm and 5'-terminus of this base sequence : 99138093
  Distance between 3'-terminus of neighbour sequence of sequence listing upward to telomere on chrosomal short arm and 5'-terminus of this base sequence : 147181
cattggtgagttgttgtcagaaagttcatgaggggatacgtgtgtgtgtgtgtgtgtgtgtgtgtgtgtgtgtgtgtgtctgaaatgggggcaacaaaaagcgaaagaagatgaagtctcgaatacaacaatgtatgatgtataacatttattgatatgtgtttatacatactctatcttgtagagacaagattggatgacttaaatggatgcatgtaatataactagaaagcatcactttaagggt

SEQ ID NO: 14230 - DNA, 460 bp, Homo sapiens
  chr8.fa.O7frz.101608795
  Located on chromosome 8
  Distance between a terminus base of telomere on chromosomal short arm and 5'-terminus of this base sequence : 99349396
  Distance between 3'-terminus of neighbour sequence of sequence listing upward to telomere on chrosomal short arm and 5'-terminus of this base sequence : 211056
tggtgccatcatagtttactacagccttgacttcccaggctcaatcggttctctcatctcagcctcccgagtgactgggactacaggcacttgccactatgctcagctaatttttgtatacatgtattttttttggagggatgtggttttgccgtgtgtgtgtgtgtgtgtgtgtgtgtgtgtgtgtgtgtgtgtgtatgtgtgtatgtgtctgtctatcatctatttttctatctatctatctatctatctatctatctatctatctatctatctacctatctatttttagagatggggtctcactatattgccaggctgttcttgaactcctgggctcaagtgatcctctgcttcccaaagttctgggattatgggtgtgagccaccttgcttggcccactctctcatattttaattcacatttcttcgaatagtagtgaagttgaacatcttttaaa

SEQ ID NO: 14231 - DNA, 361 bp, Homo sapiens
  chr8.fa.O7frz.103186163
  Located on chromosome 8
  Distance between a terminus base of telomere on chromosomal short arm and 5'-terminus of this base sequence : 99728498
  Distance between 3'-terminus of neighbour sequence of sequence listing upward to telomere on chrosomal short arm and 5'-terminus of this base sequence : 378642
  misc_feature (1)...(361): n = A,T,G or C
actgtactgcttatgtgaccatgggcaactttctttgcttttctaaaacccagtttcttcattggtaaaatggggatggtttattttgaggattaaatatnncacacacacacacacacacacacacacacacaccacacacacttaatatatgtgcccagtgacaattctctttttgcatttgtattgctgctgtttttctgaagccagaccgctgctcctctgcgtccatccctcatgtctgtctgactgattaaaagcatcttgaggaagttttgactgcagcagttggtttggtgccttcagaagatgaattgtgaggaaactccatgtttttctaagagtccattacattcagaag

SEQ ID NO: 14232 - DNA, 477 bp, Homo sapiens
  AC026827.2_155839
  Located on chromosome 8
  Distance between a terminus base of telomere on chromosomal short arm and 5'-terminus of this base sequence : 99885662
  Distance between 3'-terminus of neighbour sequence of sequence listing upward to telomere on chrosomal short arm and 5'-terminus of this base sequence : 156803
tacttaccaatggtttattgaaacaagttatgtttcactgatatgtttgtgacaaaaagattacaaatcaggctatttaagaaagaagaggaaaaaaaagaacaactttattttctgtggggcttttttagtttgtttatatgtttttgttttgggcttattgtgttataaacattaatactacatatcacacagttttattgtttcccattgagttgcttcaactaggaaaatccctcaactaattgtaattgcagaaatatttccagacttctgccatcttatttttaaagctgctgctgctgctgctgctgctgctgctgcttctgcttcctcctcctcctcctcctcctcctcctgctgctgctgctgctgctttttcttctttttttggtggtggctgtggtgggtttttaacatataatttcagaattcaggtgcctaggtacttcctaaggtcaccttgaataagagtat

SEQ ID NO: 14233 - DNA, 346 bp, Homo sapiens
  AC018442.4_1885
  Located on chromosome 8
  Distance between a terminus base of telomere on chromosomal short arm and 5'-terminus of this base sequence : 100010434
  Distance between 3'-terminus of neighbour sequence of sequence listing upward to telomere on chrosomal short arm and 5'-terminus of this base sequence : 124295
gcctgtaatcctagctcctccgaaggctgaaatgggaggcttccttgagccaccactgaggggttgtaggctgcagtgagctatgatcacaccactgcactccaacctgggcaacagaacaagactctctctttaaaaatagtaataataataataataataataataataataataataataagaagaagaagaagaagaagaagagaaaagaaaagaaaagaaaagaaaagaaaagaaaagaaaagaaaagaaaagaaaagaaaagaagaagaagcaatacccagttacccagtactttgggagacattttttatcgctgatagtaatgtaacttagtgcagcc

SEQ ID NO: 14234 - DNA, 242 bp, Homo sapiens
  D8S1789
  Located on chromosome 8
  Distance between a terminus base of telomere on chromosomal short arm and 5'-terminus of this base sequence : 100027903
  Distance between 3'-terminus of neighbour sequence of sequence listing upward to telomere on chrosomal short arm and 5'-terminus of this base sequence : 17123
gggcatcaaatacccactaagtgttttttctttttccctttaatttttataaatgcttggtaaatagtgctattttgtctttaagtcctgaataacttataagtcagcatatgtttaggatcatcctagaggtgatcattcagcagtactttaaaaattgtgtgtgtgtgtgtgtgtgtgtgtatgcagatagattttttacatttgaatttactgaatctgtgtcctatttcattgtttta

SEQ ID NO: 14235 - DNA, 227 bp, Homo sapiens
  HUMUT5392
  Located on chromosome 8
  Distance between a terminus base of telomere on chromosomal short arm and 5'-terminus of this base sequence : 100032871
  Distance between 3'-terminus of neighbour sequence of sequence listing upward to telomere on chrosomal short arm and 5'-terminus of this base sequence : 4726
cctcttctgttatttctccctcacttccgtatagtcttagctatttatttaacaaaaattattacatttcactttttgttttgttattttgtagttacagtgcttcagagtgttacccatggaatgagtattagtttcttccttaagaattttatttaattttatttatttatttatttattttttgagaccatcttgctctgttacccaagccaaagtacagtcgt

SEQ ID NO: 14236 - DNA, 169 bp, Homo sapiens
  DISD22_0005879
  Located on chromosome 8
  Distance between a terminus base of telomere on chromosomal short arm and 5'-terminus of this base sequence : 100191584
  Distance between 3'-terminus of neighbour sequence of sequence listing upward to telomere on chrosomal short arm and 5'-terminus of this base sequence : 158486
gtaaatacgaattccattgtgagtaaaaaaaaaaaaaatacattgggagccaaaatagaatgtacgttgtcattacaaaacacacacacacacacacacacacacacacacacacacacacacacacacacacacaccatggagggatatttggttaccttagtagacc

SEQ ID NO: 14237 - DNA, 134 bp, Homo sapiens
  DISD22_0005882
  Located on chromosome 8
  Distance between a terminus base of telomere on chromosomal short arm and 5'-terminus of this base sequence : 100385854
  Distance between 3'-terminus of neighbour sequence of sequence listing upward to telomere on chrosomal short arm and 5'-terminus of this base sequence : 194101
cgttagggtctcctccaccgcctccctcccctgttaaaagtgtgtgtgtgtgtgtgtgtgtgtgtgtgtgtgtgtgtgtgtgtgtgtgtgtgtgtaaaatttaaaattttagatatgctgacataggcacttaa

SEQ ID NO: 14238 - DNA, 194 bp, Homo sapiens
  chr8.fa.O7frz.103719482
  Located on chromosome 8
  Distance between a terminus base of telomere on chromosomal short arm and 5'-terminus of this base sequence : 100641510
  Distance between 3'-terminus of neighbour sequence of sequence listing upward to telomere on chrosomal short arm and 5'-terminus of this base sequence : 255522
gaggttgcagtgagttgagattgtcccactttattccagcctgagcgacagagcgagactctgtctctagatagatagacagacagatagatagatagatagatagatagatagatagatagatagatatagatagatagatagacagatagacagacagataaatgaaagtcataatgtaagacgatttaacc

SEQ ID NO: 14239 - DNA, 462 bp, Homo sapiens
  chr8.fa.O7frz.103821147
  Located on chromosome 8
  Distance between a terminus base of telomere on chromosomal short arm and 5'-terminus of this base sequence : 100755691
  Distance between 3'-terminus of neighbour sequence of sequence listing upward to telomere on chrosomal short arm and 5'-terminus of this base sequence : 113987
ggaactaagagtaaattcaggaaggcctggagcagcttaaagaaatttcccattaaaagcagagctctgggcctggaacagtggctcgggcctgtaatcccagcactttgggaggccgaggtgggtggattgcttgagcccaggaattcgagactggcctgggcaacatggtgaaactctgtctctacaaaaaatataaaaattagccaggcgtgctggcacgtgcctatagggccagtgactcagatggctgagacaggaagatcacctaagcccagggaagtcagggctgcagtgagttgtgatggggccactacactccagcctgggtgacagagagagaccctgtctcaaaatatgtgcgtgtgtgtgtgtgtgtgtgtgtgtgtgtatttttttttttcttaaagcagagctctgtcaacatggccagaagatggaaggaatttctgacttgttctg

SEQ ID NO: 14240 - DNA, 226 bp, Homo sapiens
  D8S559
  Located on chromosome 8
  Distance between a terminus base of telomere on chromosomal short arm and 5'-terminus of this base sequence : 101048812
  Distance between 3'-terminus of neighbour sequence of sequence listing upward to telomere on chrosomal short arm and 5'-terminus of this base sequence : 292659
aattgaagtgaggtaggaggttgatcaaattttctgtataacaggaatatggaggctaagaacctcttctagaatgttcagtgaagagtctaggttttggagcctgagatctctagagtaaaaactctatattgattatggcatgataaccacacacacacacacacacacacacacacacacacacacacacattctttgtttccctactgtaagagcaatagct

SEQ ID NO: 14241 - DNA, 170 bp, Homo sapiens
  D8S1808
  Located on chromosome 8
  Distance between a terminus base of telomere on chromosomal short arm and 5'-terminus of this base sequence : 101062926
  Distance between 3'-terminus of neighbour sequence of sequence listing upward to telomere on chrosomal short arm and 5'-terminus of this base sequence : 13888
tctttgggcagccttccccagagtatgacccaactgtagtgcaggtgtgcatgtgaagaggatggtgtgtgtgtgtgtgtgtgtgtgtgtgtgtgttgcatagggtttcctgtataagaaaggaacaacagtagatgtttcattcacaaatatccactaccactgcctgg

SEQ ID NO: 14242 - DNA, 165 bp, Homo sapiens
  D8S546
  Located on chromosome 8
  Distance between a terminus base of telomere on chromosomal short arm and 5'-terminus of this base sequence : 101076288
  Distance between 3'-terminus of neighbour sequence of sequence listing upward to telomere on chrosomal short arm and 5'-terminus of this base sequence : 13192
aggtgatccacatgcctcagcctcccaaagtgctaaggttataggcgtgagccaccacgcccggcctcgattttgtgtgtgtgtgtgtgtgtgtgtgtgtgtgtatgtgtgtgtgttttaatgaagaaactactttgtctccctggtcagtgcttttggcaatca

SEQ ID NO: 14243 - DNA, 230 bp, Homo sapiens
  D8S1762
  Located on chromosome 8
  Distance between a terminus base of telomere on chromosomal short arm and 5'-terminus of this base sequence : 101100647
  Distance between 3'-terminus of neighbour sequence of sequence listing upward to telomere on chrosomal short arm and 5'-terminus of this base sequence : 24194
ttgctgtaaacctttggctgttttccagagttctgacaaagttggttctgacaatttctgcttttgtgtgtgtgtgtgtgtgtgtgtgtgtgtgtgtgtgtctttgtagggagatgagagcttggagctacccactccgccatttgctgacatcattccccagctatacttttaacagtgaccttattttttacctgtatactactgtggcctggggaactggattacac

SEQ ID NO: 14244 - DNA, 345 bp, Homo sapiens
  chr8.fa.O7frz.105068564
  Located on chromosome 8
  Distance between a terminus base of telomere on chromosomal short arm and 5'-terminus of this base sequence : 101174355
  Distance between 3'-terminus of neighbour sequence of sequence listing upward to telomere on chrosomal short arm and 5'-terminus of this base sequence : 73478
cgaagatcaacagcaatactctccagaagcccagatcctccacaaactcctgccacgtggttcggaagctggagaggactccttcaccttgctgcaggttgggattgaggagtgaatggctttccatggcactgtggaagaagaaagagcaaaaagggcattaaaaaaacacagcaattccaaaaacataaaaccacagggctactatttagaaaagaccaaatacacacacacacacacacacacacacacacacacacacacatatatatatatacacactcttacatgcttacgtatctgaacaatatatactaaactgtaaattgctaaatggtaatgagt

SEQ ID NO: 14245 - DNA, 403 bp, Homo sapiens
  HUMUT6245B
  Located on chromosome 8
  Distance between a terminus base of telomere on chromosomal short arm and 5'-terminus of this base sequence : 101404619
  Distance between 3'-terminus of neighbour sequence of sequence listing upward to telomere on chrosomal short arm and 5'-terminus of this base sequence : 229919
agggcaattgagggaagagctcaaggttgtctctgaactgactgagtgcccaactctatcccaactcccagctgatcctttccttccttccttcctttcctccctccctccttccctccctcacatctatctttctttctttctttctttctttctttctttctttctttctttctttccttccttccttccttccttctttctttctttctttctttctttctttctttctttctttctttcctttttctttcttccttccttccttccttcctttctctctcccttcctttctctctcccttccttccttccttcctttctctctcccttccttccttccttcctttctctctttctctctctttctttctgtctttctttctcagtctcactctgttgcc

SEQ ID NO: 14246 - DNA, 344 bp, Homo sapiens
  AC027373.2_2331
  Located on chromosome 8
  Distance between a terminus base of telomere on chromosomal short arm and 5'-terminus of this base sequence : 101461994
  Distance between 3'-terminus of neighbour sequence of sequence listing upward to telomere on chrosomal short arm and 5'-terminus of this base sequence : 56972
cttgagattaggagttcgagaccagcctggccaacatggtaaaaccctatctctactaaaaataaaagaattcgccgggcatagtgatgcacgcctgtaatcccagctattccggaggctgaggcaggagaatcacttgaacccaggagaggttgcagtgagccgagatcgtgccactgcactccagcctgggtgaaaaagccagaccttgtctcaaaacaacagcagcagcagcagcagcagcagcagcagcaacaacaaagccacaacaatactgatggaggttttctccccagcttcctgtctctggtctgcactgcccaataggaagtcactagccacat

SEQ ID NO: 14247 - DNA, 366 bp, Homo sapiens
  AC027373.2_36983
  Located on chromosome 8
  Distance between a terminus base of telomere on chromosomal short arm and 5'-terminus of this base sequence : 101486340
  Distance between 3'-terminus of neighbour sequence of sequence listing upward to telomere on chrosomal short arm and 5'-terminus of this base sequence : 24002
agatcacttgaagtcaggagttcaaaaccagcctggccaatatagtgaaatctcgtctctactaaaatcacaaaaattagccgggtgtggtggtggacgcctgtaatcccagctacttgggaggctgaggcaggagaatcacttgaaccgggaggcggagtttgcagtgagccgagattgcaccactgcactccagcctgggctactgagcgagactccatctcaaaaataaataaataaataaataaataaataaaacaaataaataaaaataaaggttaccactgaagaaagctttaaactgtctcggcctggagatgaagccagaggaatgcatatgaacaagctttactaaccagcctttat

SEQ ID NO: 14248 - DNA, 356 bp, Homo sapiens
  AC018781.3_8025
  Located on chromosome 8
  Distance between a terminus base of telomere on chromosomal short arm and 5'-terminus of this base sequence : 101647313
  Distance between 3'-terminus of neighbour sequence of sequence listing upward to telomere on chrosomal short arm and 5'-terminus of this base sequence : 160607
agcaagtctcctagcacttaactgtctaaattagcatgtcctcttccaagtaacttgggagacagtgataggataccaccatgcatttattttaacgtagctgactttgcttttaatgttttggaattcttcttttggtacattactttctgagtctatggcactttgtttctgtgtgtgtgtgtgtgtgtgtgtatgtgtatgtgtatgtgtgtgtgtgtgtgtgtgtgatgggagtcttgctgtgttaaccaggctggagtgcagtggcatgatcttggctcactgcaaccttcacctctggagttgaagtgattctcctgcctcagcctctcgagtagctagaattacaagtg

SEQ ID NO: 14249 - DNA, 178 bp, Homo sapiens
  D8S1714
  Located on chromosome 8
  Distance between a terminus base of telomere on chromosomal short arm and 5'-terminus of this base sequence : 101748695
  Distance between 3'-terminus of neighbour sequence of sequence listing upward to telomere on chrosomal short arm and 5'-terminus of this base sequence : 101026
ccactgacgccctgattataaagtagagtgtgtgtgtgtgtgtgtgtgtgtgtgtgtgtgtgtgtgtgtgtgtgtggcagtggaatgtggcagaatgacaggctcccacccatggtctctgggtaggcagaaaatgtgcagaaaacacgatgtccatcggccatggctctggcaaggg

SEQ ID NO: 14250 - DNA, 347 bp, Homo sapiens
  chr8.fa.O7frz.106766281
  Located on chromosome 8
  Distance between a terminus base of telomere on chromosomal short arm and 5'-terminus of this base sequence : 101871758
  Distance between 3'-terminus of neighbour sequence of sequence listing upward to telomere on chrosomal short arm and 5'-terminus of this base sequence : 122885
gatgaatgtccagaatacacagggaactcaaacaactcaatagcaaatgatgatgatgatgatgatgatgatgatgatgataattcaatcaaatagtgggcaaatgagctgaagagacatctcttaaagggaggcgtacaaatggccaacaagaatatttaaaaatgctcaatatcactaatcatcagggaaatacaaatcaaaaccacagtgagatatcttctcaccccagtgagaatggctggggtgagattatcaaaaagacaaaaaaaaatgctgatgaagatgaaacaaaaagtggagtgatctcttatacactgttggttgaattgtaaattagtacagcc

SEQ ID NO: 14251 - DNA, 126 bp, Homo sapiens
  D8S521
  Located on chromosome 8
  Distance between a terminus base of telomere on chromosomal short arm and 5'-terminus of this base sequence : 101945361
  Distance between 3'-terminus of neighbour sequence of sequence listing upward to telomere on chrosomal short arm and 5'-terminus of this base sequence : 73256
tttgaaatcctacagagttcctgaagacacacacacacacacacacacacacacacacacacacacactagatgtgatatgtggttaatggaaaaatagcatcagagacaccgcattcattaacag

SEQ ID NO: 14252 - DNA, 420 bp, Homo sapiens
  AC011028.5_58170
  Located on chromosome 8
  Distance between a terminus base of telomere on chromosomal short arm and 5'-terminus of this base sequence : 101983019
  Distance between 3'-terminus of neighbour sequence of sequence listing upward to telomere on chrosomal short arm and 5'-terminus of this base sequence : 37532
aagaaataatttcaggcttgaggattgcctgagcatggaaggtcaaggttgcagtgagtcgtgaacatgcattgtgctctagcctgggtgagagagtgagaccctggaaggaaggaaggaaggaaggaaggaaggaaggaaggaaagaaaggaagggagggaaagaaagagaaagaaaggaaagaaaagaagaaagaaaaagaaaagaaagaaagaaagaaaaagaaagaaagggaaagaaaggaaggagaaaagaaatattctgtaccccttcctcccccattttactaggctgaaacaaaattaatgaataataacctaactatatgcctaatttcaaaaaatcaacacaatgccttagagaagaaataaaaagatagtaacttaccgtaaaataatacgtatttcagtagacagagg

SEQ ID NO: 14253 - DNA, 332 bp, Homo sapiens
  AP001208.3_68256
  Located on chromosome 8
  Distance between a terminus base of telomere on chromosomal short arm and 5'-terminus of this base sequence : 102022293
  Distance between 3'-terminus of neighbour sequence of sequence listing upward to telomere on chrosomal short arm and 5'-terminus of this base sequence : 38854
gttcatttgcatactctttcaggaatgatcaatgttcaaagaggtataggggccttaaagaagtatgggagggccaggagtggtggctcacacctgtgatcccaacactttcagaggccgaggcaaacaaatcatgagatcaggagttcgagaccagcctagccagcatggtgaaaccccgtctctactaaaacaaaacaaaacaaaacaaaacaaaacaaaacaaaacaaaacagcatagggataggcttagagatttctttctaggtcgtgtgtataggaaaaacaacttccaagatgctagggaagtaattctgtttgtagtcagcaac

SEQ ID NO: 14254 - DNA, 361 bp, Homo sapiens
  AC022200.2_20082
  Located on chromosome 8
  Distance between a terminus base of telomere on chromosomal short arm and 5'-terminus of this base sequence : 102134879
  Distance between 3'-terminus of neighbour sequence of sequence listing upward to telomere on chrosomal short arm and 5'-terminus of this base sequence : 112254
atttcctagatcctgtctttaaacattccattaaagactctatttcagctttcctatttttaatgttcagaagctcttttgactctctgatatttgtttttgttgcatttatttatttatttatttatttatttatttattttgagaccgtgttttgctcttgttgcctaggctggagtatgatggcgtgatttcggctcaccacaatctccgcctcccgggttcaagcgattctcctgcttcagcctcccaagtagctgggattacaggcatgcgccaccacgcctggctaattttttgtgtttttagtaaagacggggtttctccatgttggtcaggctggtctagaactcctgacttc

SEQ ID NO: 14255 - DNA, 361 bp, Homo sapiens; identical to SEQ ID NO: 14254
  AP001207.3_94971
  Located on chromosome 8
  Distance between a terminus base of telomere on chromosomal short arm and 5'-terminus of this base sequence : 102134879
  Distance between 3'-terminus of neighbour sequence of sequence listing upward to telomere on chrosomal short arm and 5'-terminus of this base sequence : -361

SEQ ID NO: 14256 - DNA, 432 bp, Homo sapiens
  AP001207.3_69379
  Located on chromosome 8
  Distance between a terminus base of telomere on chromosomal short arm and 5'-terminus of this base sequence : 102160299
  Distance between 3'-terminus of neighbour sequence of sequence listing upward to telomere on chrosomal short arm and 5'-terminus of this base sequence : 25059
gttaggtcaaggtttaagattgtaattagaaaaaacataatttaggaaaaaaaagcaattgcacatttaccttccattcttcagataattagttgtgggaaatgtggaggcaggtccagaatgaggcaagacagtgtgagtcttcaaattttgtacttttatttcgatttcaaaggtctgccactatttttcatttctcaggcttggtcaggctttcatcccttccctgtttgtttgttttcctttctttctttctttctctccttccttccttccttccttccttccttccttccttccttccttccttcctttctttctttctttttctttctttcttttctctctttctttctttcttcttgtgtgtgtgtgtgtgtgtgtgtgtgtgtgtgtgtgttttggcctattagtggttaagaaacactttgg

SEQ ID NO: 14257 - DNA, 316 bp, Homo sapiens
  AP001207.3_63329
  Located on chromosome 8
  Distance between a terminus base of telomere on chromosomal short arm and 5'-terminus of this base sequence : 102166558
  Distance between 3'-terminus of neighbour sequence of sequence listing upward to telomere on chrosomal short arm and 5'-terminus of this base sequence : 5827
aatgaggtcttgaagtaggaaagagagaatagactcaactccctctctctttctctctctctgtctctctgcacacacacacacacacacacacacacacacacattaatattatatatgaggttggggtgtggccatcacttttcctacttcatcagcttttcttacaaatttaaaaaatgtcttatgatgcttacattccacagttcaacatcctcttcccctctcccagcctgagaatgtctttcttcccagagtcctgtctcattgttgacaagttcaggaactacaggtttacttaagtcacggattctgt

SEQ ID NO: 14258 - DNA, 308 bp, Homo sapiens
  AP000426.3_164797
  Located on chromosome 8
  Distance between a terminus base of telomere on chromosomal short arm and 5'-terminus of this base sequence : 102263800
  Distance between 3'-terminus of neighbour sequence of sequence listing upward to telomere on chrosomal short arm and 5'-terminus of this base sequence : 96926
cgtaccttctacaacagtgaatactgttggacccccaccatttccttgagggcagggccctgccatagatagacttctgtatttcccatggcctctatatatagcatcttcagagtgtggatggatggatggattagatagatagatagatagatagatagatagatagatagatacatacatacatacatacatacatacatacatagatattgatgaagatattcatgctgaatatatagttgatgctcaatttatgattgttgattgatagataacatccagtcagagcagttaactccactata

SEQ ID NO: 14259 - DNA, 283 bp, Homo sapiens
  AP000426.3_120414
  Located on chromosome 8
  Distance between a terminus base of telomere on chromosomal short arm and 5'-terminus of this base sequence : 102308219
  Distance between 3'-terminus of neighbour sequence of sequence listing upward to telomere on chrosomal short arm and 5'-terminus of this base sequence : 44111
atacatggtgcttaaagtaacacacagaaattataaattaatatatactgggtgtgtgttcatgtgtctgtctgtgtgtctgttagtgtattttatgtgtctaacagacacacacacacacacacacacacacacacacaggcaatgaccgtgagtgctatgaggtggagaggcagactgtgtttcccctaaggtgaagaggctagagaaagggatagggatgttctctctcaatgaagctagctgatgtctacaaagaaaaaggtcgctcatggccttagta

SEQ ID NO: 14260 - DNA, 120 bp, Homo sapiens
  Z66713
  Located on chromosome 8
  Distance between a terminus base of telomere on chromosomal short arm and 5'-terminus of this base sequence : 102415370
  Distance between 3'-terminus of neighbour sequence of sequence listing upward to telomere on chrosomal short arm and 5'-terminus of this base sequence : 106868
ccacaatcagatgagccaattctttatgacaaatttctctctctctctccacacacacacacacacacacacacacacacacacacacacacacacaccccctattggtctgtctctcaa

SEQ ID NO: 14261 - DNA, 259 bp, Homo sapiens
  AP001329.3_33396
  Located on chromosome 8
  Distance between a terminus base of telomere on chromosomal short arm and 5'-terminus of this base sequence : 102470581
  Distance between 3'-terminus of neighbour sequence of sequence listing upward to telomere on chrosomal short arm and 5'-terminus of this base sequence : 55091
tgttgacagaatttctcttcagacttttaaatgaactgtaattgttactgacactaacaagaattgaatataccattttcccacaggcttgtcagcactacatcacatatatttgtttacttataaatacataactttatttatttatttatttatttatttatttatttatttattgttcttagtttaataaatgccaaatagtagcttaacatcatttgggtttttatttcttgagttactggaaaggttgaacatt

SEQ ID NO: 14262 - DNA, 293 bp, Homo sapiens
  AP001206.3_90769
  Located on chromosome 8
  Distance between a terminus base of telomere on chromosomal short arm and 5'-terminus of this base sequence : 102570134
  Distance between 3'-terminus of neighbour sequence of sequence listing upward to telomere on chrosomal short arm and 5'-terminus of this base sequence : 99294
tacactaacaatgttcaagctgagggccaaatcaagaacacaatcccatttacaatagccacacacacacacacacacacacacacacacacagatacctaggaaaacatctaaccaaggaagtgaaagatctctacaaggaaaactacaagacattgccaaaagatatcagaggtgacacaaacaaatgttaaaacattccatgctcatgaattaggaggatcaatgttgttacattggccatattacccgaagcaatctagagattcgatgctattcctatcaaactacca

SEQ ID NO: 14263 - DNA, 142 bp, Homo sapiens
  Z67095
  Located on chromosome 8
  Distance between a terminus base of telomere on chromosomal short arm and 5'-terminus of this base sequence : 102570168
  Distance between 3'-terminus of neighbour sequence of sequence listing upward to telomere on chrosomal short arm and 5'-terminus of this base sequence : -259
agaacacaatcccatttacaatagccacacacacacacacacacacacacacacacacagatacctaggaaaacatctaaccaaggaagtgaaagatctctacaaggaaaactacaagacattgccaaaagatatcagaggt

SEQ ID NO: 14264 - DNA, 353 bp, Homo sapiens
  HUMUT6744
  Located on chromosome 8
  Distance between a terminus base of telomere on chromosomal short arm and 5'-terminus of this base sequence : 102706046
  Distance between 3'-terminus of neighbour sequence of sequence listing upward to telomere on chrosomal short arm and 5'-terminus of this base sequence : 135736
tgctggtctgccctacagatcgcagacttgctaggctccatctgatatgtctctctctttctcttccgatagatagatagatagatagatagatagatagatagatagatagatagatagatagatatcctatagatagatagatagatctataggatgatagatatatattgatagatgatagatgatagataagctctatctttttctctatatttctatctctatatttcttcctctgtctctatatctctgtctctatatccacacacacgtcttattgattctgtttctctgaagaacactgactaatacaagtcccctcagaaccatcagatagggtgtgggggtgg

SEQ ID NO: 14265 - DNA, 331 bp, Homo sapiens
  AP001328.3_66492
  Located on chromosome 8
  Distance between a terminus base of telomere on chromosomal short arm and 5'-terminus of this base sequence : 102794884
  Distance between 3'-terminus of neighbour sequence of sequence listing upward to telomere on chrosomal short arm and 5'-terminus of this base sequence : 88485
aagaaacttaagatgtgccatcgtgtagttttcctcaggtttcttgtatgtgaggtttatttagttttttcaatctgtaagtttttcatcaaatttgaaaaacttttagtcattagtttttcaatatcgtactcaaccacacacacacacctctactttgaggactcaaaatacacatgtattaggctacttaaagttgtcccacagttcactgatggctctgtttatttatttatttatttatttatttatttatttatttattttggtcagtgttttttctgtgttttgctttattttctattgctatgtcttcaggttcagtaatctt

SEQ ID NO: 14266 - DNA, 306 bp, Homo sapiens
  AP001328.3_46811
  Located on chromosome 8
  Distance between a terminus base of telomere on chromosomal short arm and 5'-terminus of this base sequence : 102814634
  Distance between 3'-terminus of neighbour sequence of sequence listing upward to telomere on chrosomal short arm and 5'-terminus of this base sequence : 19419
ttgaatgcattgtttaagtgtattagttttctattgctgctataaaaaaattaccataaacacaatgacttaaaacaatacaaatttatcattttttagttctgtaggtcagaagtccagcatgggtcccactgagttaaaatcagggtgttagcagggctgcgtttttgtttgtttgtttgtttgtttgtttgttttctggaggctctaggggagaatctatttccttgtcttttccaaactcgaaaggctacccacattccttggttcatggccctctcctccatcttcaaagctagtaatatt

SEQ ID NO: 14267 - DNA, 413 bp, Homo sapiens
  chr8.fa.O7frz.107034360
  Located on chromosome 8
  Distance between a terminus base of telomere on chromosomal short arm and 5'-terminus of this base sequence : 102960195
  Distance between 3'-terminus of neighbour sequence of sequence listing upward to telomere on chrosomal short arm and 5'-terminus of this base sequence : 145255
ccttcaggaggtattacagaagaaggcattgtaaattgcacattttttaaaaaggcagtaaaaaattttaaatatagaaaaagtgcttaatacctgggtgatgaaacaatctgtacaaaaaaccctgtacatgagtttaccctgcagtaaaatctcacatgtactcccaagcctaaaagttttttttttaaaaaaaaaaaaaagaaagaaagaaagaaatgaaaactctgcccctcccccccaaaaaacccttaaggatataggaaagaaagttattttttagatagctacacaatgtgtgtgtgtgtgtgtgtgtgtgtgtgtgtgtaagacagagtctcactctgtcgcccaggctggagtgcagtggcatgatctcagctcactgcaacctccaccttcacctactaggt

SEQ ID NO: 14268 - DNA, 193 bp, Homo sapiens
  D8S545
  Located on chromosome 8
  Distance between a terminus base of telomere on chromosomal short arm and 5'-terminus of this base sequence : 103084602
  Distance between 3'-terminus of neighbour sequence of sequence listing upward to telomere on chrosomal short arm and 5'-terminus of this base sequence : 123994
acagaaacagtccctgtctcaaaaaaataaaataaaataaacacacacacacacacacacacacacacacacacacacacacacacaaaccaaaaataaccaaccaaacaaaaactctggacaaaatgtatttataattaagcatgaatcaggctgcactaatactgagcatttgcatcctgattgttcctat

SEQ ID NO: 14269 - DNA, 395 bp, Homo sapiens
  AP002851.1_106710
  Located on chromosome 8
  Distance between a terminus base of telomere on chromosomal short arm and 5'-terminus of this base sequence : 103257381
  Distance between 3'-terminus of neighbour sequence of sequence listing upward to telomere on chrosomal short arm and 5'-terminus of this base sequence : 172586
ggacatttcctattaatggaatcatacagcatgtggccctttgtgactggcttattttgcttaacataatgctctccaggtccattcatgttgcagtaatctcattctaaagaatccgtccattccataacaataaaggcaccagtgcctctggacatatgcaggatgtttattgcagaatcttccataacagtaaaagaaaataagggaaagaaagaagaaaaagaaagaaagaaagaaagaaagaaagaaagaaagaaagaaagaaagaaagaaagaaaggaaagaaggaaggaaggaaggaaaaagaaaagaaagagagagaaaaagagaaagagagagaaaaagaaaaaaaggaaaatgggaaacgccatgaatgcctgctaataggaaca

SEQ ID NO: 14270 - DNA, 188 bp, Homo sapiens
  D8S1834
  Located on chromosome 8
  Distance between a terminus base of telomere on chromosomal short arm and 5'-terminus of this base sequence : 103352324
  Distance between 3'-terminus of neighbour sequence of sequence listing upward to telomere on chrosomal short arm and 5'-terminus of this base sequence : 94548
atggatgccccattctaccagccaggctcctcctccccagcctcccagggcccagcccctgcctatctacccactgccccttcaagaaagtgtaccaggctgggcagggtgtgtgtgtgtgtgtgtgtgtgtgtgtgtgtgtgtgttaaaagccctgtcaacaccccattgcctgaaattagtccagc

SEQ ID NO: 14271 - DNA, 457 bp, Homo sapiens
  AP002851.1_161262
  Located on chromosome 8
  Distance between a terminus base of telomere on chromosomal short arm and 5'-terminus of this base sequence : 103355884
  Distance between 3'-terminus of neighbour sequence of sequence listing upward to telomere on chrosomal short arm and 5'-terminus of this base sequence : 3372
ggtttatttgaatagaatccaaacaagctccacacattgcatctttctttctttcactttctttctttctttctttctttctttccttctttcctcccttctttctttcatttctttttccttcttgcttttttttttttgcatttcttaaatgtttgttaaatctgtaacagcttcccctccccaacccacctctgttttcatgccatgtatttgttgaaaagcaaaggcatttgtcctatagtttccctcactctaggtttggctaaatgcatctttatgatagttaacatgttccatttccccatgtgtttaccataaaatgaagggactcaattgagtcaggtttggttatttatttatttgcaagaattctccataggcagttctgggttgtctccatcatgtcacctcagaaggcacatggtgtctggtagactcagtctttgaaattcag

SEQ ID NO: 14272 - DNA, 272 bp, Homo sapiens
  AP002851.1_159943
  Located on chromosome 8
  Distance between a terminus base of telomere on chromosomal short arm and 5'-terminus of this base sequence : 103357115
  Distance between 3'-terminus of neighbour sequence of sequence listing upward to telomere on chrosomal short arm and 5'-terminus of this base sequence : 774
cttggttacaggaacctaattcagaggtcataagggctgcggagacagtgaggagtcagacaggcgcacagcacttaagctcttaataataaaaatgtgttgaatgaatgaactcagttgttctgatccttaatttgtatttatttatttatttatttatttatttatttattgagacagagtctcactctgtcgcccagcctggagtgcggtggcgtgatctcggctcactgcaacctccgcctcccgggtttgagttattctcttgcctc

SEQ ID NO: 14273 - DNA, 320 bp, Homo sapiens
  chr8.fa.O7frz.107517076
  Located on chromosome 8
  Distance between a terminus base of telomere on chromosomal short arm and 5'-terminus of this base sequence : 103445255
  Distance between 3'-terminus of neighbour sequence of sequence listing upward to telomere on chrosomal short arm and 5'-terminus of this base sequence : 87868
aggcttggctgaaagatacatcagcacggaccatttcaaatctgttccatgccatttttaggtctctctctctctctctctctctctctatatatatatatatatgtgtgtgtgtgtgtgtgtatatgtgtgtatgtgtgtgtacatgtatgcatatctattttatgcttggcagggtcacactgaggaggtgcttcgtggcagggagcacttctgagttctgaagagaaggaatcctgttgcctgtggtcacacagtggctctcgtgacatgcttcccagccagaagaagggtctgcacaacgtacttggctaatctaa

SEQ ID NO: 14274 - DNA, 442 bp, Homo sapiens
  AC011771.4_2891
  Located on chromosome 8
  Distance between a terminus base of telomere on chromosomal short arm and 5'-terminus of this base sequence : 103528222
  Distance between 3'-terminus of neighbour sequence of sequence listing upward to telomere on chrosomal short arm and 5'-terminus of this base sequence : 82647
cactttggcagatggatagcttgagctcaggagttcaagaccagcctgggaaatatgacgaaaccctgtctctaccaaaaatacaaaaattagctgggcgtggtgcagtacgcctgtggtcccagctacttgggaggctgagatgggaggatcgcttgagcccaggagatcaaggctgcaatgagctataatcatgccactgcactccagcctgggagacatagtgagaccctgtctcaaaaataaataaataaataaataaataaataaataaataaataaataaataaaataaaaatttttaaaaaagcctgtgcctaatttgaaagaaatttataaattttaagtttttagtcagggaagtggaaatgaactgtcgtaaaatgggaggttttatatttatttttgttcctagttactaagacaagaatgctattcaaag

SEQ ID NO: 14275 - DNA, 328 bp, Homo sapiens
  AC051654.2_42944
  Located on chromosome 8
  Distance between a terminus base of telomere on chromosomal short arm and 5'-terminus of this base sequence : 103698692
  Distance between 3'-terminus of neighbour sequence of sequence listing upward to telomere on chrosomal short arm and 5'-terminus of this base sequence : 170028
gctcttgtttaaactgttaacaagccaggcttgtggctcacacctgtaatccctcctgcttgaggggccaaggcaagaggatcgcttgagcccagatgttcaaagctgcaatgcactgtgattgcaccactgcattccaacatgggcagtagagtgagactctctcttaaaaaaaaaaaaaaaatgcgcgcgcacacacacacacacacacacacacacacacacattttttttttaaggaaaaaaaaccattacaggaatttcttaatttgtcttccagtttcccctcctagctgttgagcatgtagtcatcagaatacttgtcctg

SEQ ID NO: 14276 - DNA, 380 bp, Homo sapiens
  chr8.fa.O7frz.107854610
  Located on chromosome 8
  Distance between a terminus base of telomere on chromosomal short arm and 5'-terminus of this base sequence : 103769589
  Distance between 3'-terminus of neighbour sequence of sequence listing upward to telomere on chrosomal short arm and 5'-terminus of this base sequence : 70569
cctattggaaggttttaatgacatctggggacaggagagggaaagaaaaagaaagaaagaagaaaaaagagagggagggaaggagggagggagggaaggagggaggaaggaaggaaggaaggaaggaaggaaggaaggaaggaaaatagtgaaaacatggaacagacacccagaagggaaagggtttggaggaggtcgaggtgccagaggcaagcattcatttgtgtaagattcattcattcattcattcattcattcatcgtcattcaaacattgtgttgaatgtccactgtatgctgtgccctgcgtggaatgctaatgatggatctaccctctagcaaaaggtaagtcctaccctagttcattcgtacaaatagagg

SEQ ID NO: 14277 - DNA, 459 bp, Homo sapiens
  AC025370.2_86517
  Located on chromosome 8
  Distance between a terminus base of telomere on chromosomal short arm and 5'-terminus of this base sequence : 103900925
  Distance between 3'-terminus of neighbour sequence of sequence listing upward to telomere on chrosomal short arm and 5'-terminus of this base sequence : 130956
aacaaattaggagctagcctagcacagggaatgactcgttgtattgctttctttcctcacctcccctctccttttttaaaaaatggggacagggtcttgctttgttgcccaggctggtcttgaacttctgggctcagttgatccttctgcctcagcctcccaaagtgctgggagtacaggcatgagccactacaccctgccttttccctctttttaaggatgtagatattagatactaatttttttaaattaaatagctagaagggaacctgggtcatttcatctagactgtcttcagcagagcaatgctcaacttataaataaatctccaattcatacacacacacacacacacacacacacacacacacacacacacacgatggggtaaaatttccttataaaagttaaaatataaatatattttatgtcatatagtattgactaagagctttggct

SEQ ID NO: 14278 - DNA, 163 bp, Homo sapiens
  HUMUT1208
  Located on chromosome 8
  Distance between a terminus base of telomere on chromosomal short arm and 5'-terminus of this base sequence : 103998698
  Distance between 3'-terminus of neighbour sequence of sequence listing upward to telomere on chrosomal short arm and 5'-terminus of this base sequence : 97314
agcctgggtgacagagagagactctgtctccagatagatagatagatagatagatagatagatagatagatagatagatagatagacagacagacagacagacagacagacagacagacagacaggcagacagacaaatgaatgtagcagggaaagtaacaga

SEQ ID NO: 14279 - DNA, 416 bp, Homo sapiens
  chr8.fa.O7frz.108218827
  Located on chromosome 8
  Distance between a terminus base of telomere on chromosomal short arm and 5'-terminus of this base sequence : 104098761
  Distance between 3'-terminus of neighbour sequence of sequence listing upward to telomere on chrosomal short arm and 5'-terminus of this base sequence : 99900
gattaatggatcagaaagcacaaaatatagatctagggggtcttagggaagaggaaaaaaagggcaagtattaggtaaaaatgaaggtgggtgtgagaaatggaggcacggagccagagctgagtgtgttgcaaatcctgtggatggatgggcccatggcaagatcagccagcagcgacagaagtaggcttacagcaggtgcacacacatgcccgtgcatacttaaaggaacagagggcaagccagcagcaaaatatatacaatacacacacacacacaatcttctgctctttaccctccataattcatccacccaaggagaaaatcagttttatctgtagggccagctttaaaaataggcctggatgattttatgattctgtcttctgccttcagtgaataaaacatctttgctg

SEQ ID NO: 14280 - DNA, 417 bp, Homo sapiens
  chr8.fa.O7frz.108322492
  Located on chromosome 8
  Distance between a terminus base of telomere on chromosomal short arm and 5'-terminus of this base sequence : 104231264
  Distance between 3'-terminus of neighbour sequence of sequence listing upward to telomere on chrosomal short arm and 5'-terminus of this base sequence : 132087
ttataaccttgaatgtaaatggacttaattctccaactaaaaggcagagagtgactgaatagctaaagaaacaacaaccaactctatgtttcttaccaaaaacccacctcacctgtaaagatacacatagactaagcttgaaggggtggaaaaagatatttcattgcaattagaaaccaaaatcaagcagaagtagctatacttagataaaatagactacaaatcaaagactgtaaaaacaaagactatatgtgtgcatgtgtgtgtgtgtgtgtgtgtgtgtaaaatgataaaggggatcaattcaacaagatgacataacaattatgaatttctgtgtacataacactggagctccctagtacataaagcaaacattaataaatctaatgggagagatagactgcaatgcagtaa

SEQ ID NO: 14281 - DNA, 250 bp, Homo sapiens
  chr8.fa.O7frz.108498151
  Located on chromosome 8
  Distance between a terminus base of telomere on chromosomal short arm and 5'-terminus of this base sequence : 104433371
  Distance between 3'-terminus of neighbour sequence of sequence listing upward to telomere on chrosomal short arm and 5'-terminus of this base sequence : 201690
ttctttaccagtgcatagtgagtgttcttcttcataattttagtgtatgtgtcatatttgtttagtctgtaatgatgaacagttagattattacaacatttttttgctattacaaatgctatcatgatacataaatcccgtgtgtgtgtgtgtgtgtgtgtgtgtgtgtgtgtacttacagttttgcaaaatagtaaatctgtaagataaaggaaaattcctagaagtacaatcacttggttaaagaatg

SEQ ID NO: 14282 - DNA, 371 bp, Homo sapiens
  AP001572.2_111902
  Located on chromosome 8
  Distance between a terminus base of telomere on chromosomal short arm and 5'-terminus of this base sequence : 104502606
  Distance between 3'-terminus of neighbour sequence of sequence listing upward to telomere on chrosomal short arm and 5'-terminus of this base sequence : 68985
cttccttgtctttatgtactgaaaatagtttgattttagtattcttatagttgctagctgcagaccaattgtgtatgtatagatgtgtatgcctgtgtctataggaatgctatgtacacacacacacacacacacacacacacacacacacacacacacacacaggcaactcaaaagtttaagattcaaagaatgacacttttggactgaaataaattaaaccaaacaaattatgtgcactgataagcaaaatgggactttattcatattatgatttcatttgctgcattatttttgattgcattgcaaggacatgtagaatatgaaaatgaattgcacttttagaaaaatcattaattgtatggttcagc

SEQ ID NO: 14283 - DNA, 112 bp, Homo sapiens
  D8S267
  Located on chromosome 8
  Distance between a terminus base of telomere on chromosomal short arm and 5'-terminus of this base sequence : 104502681
  Distance between 3'-terminus of neighbour sequence of sequence listing upward to telomere on chrosomal short arm and 5'-terminus of this base sequence : -296
tgtatagatgtgtatgcctgtgtctataggaatgctatgtacacacacacacacacacacacacacacacacacacacacacacacacaggcaactcaaaagtttaagattc

SEQ ID NO: 14284 - DNA, 453 bp, Homo sapiens
  AC016832.3_152371
  Located on chromosome 8
  Distance between a terminus base of telomere on chromosomal short arm and 5'-terminus of this base sequence : 104745490
  Distance between 3'-terminus of neighbour sequence of sequence listing upward to telomere on chrosomal short arm and 5'-terminus of this base sequence : 242697
ccaaagtatttcataaatcaagactcccaaaactttaaacactttttcaaaaatcaagagtcccaaaactttaaaaattttggtagcttgtggctgagcgtggtggctcacacctgtaatcccagctctttgggagaccaaggcgggagcatcacctgaggtcaggagttcaagaccagcctgaccaacatggagaaaccccgtctctactaaaaatacaataaataaataaataaataaataaataaataaataaataaataaataaattcgccggacatggtggtgcatgcctgcaatcccagctacttgtgaggctgcgacaggagaatcacttgaacccgggaggagagattgcggtgagctagatcgcgccattgcactccagcctgggcaacaagagcgaaactccatctcaaaaaaaaagaaaaatggtagcttatttgcttacaa

SEQ ID NO: 14285 - DNA, 355 bp, Homo sapiens
  HUMUT5342
  Located on chromosome 8
  Distance between a terminus base of telomere on chromosomal short arm and 5'-terminus of this base sequence : 104937585
  Distance between 3'-terminus of neighbour sequence of sequence listing upward to telomere on chrosomal short arm and 5'-terminus of this base sequence : 191642
ccattctctgagttctctaggagtgcaggaaagaaatcttgcagcaccagctgaatctcatctgcctatatcacagcccctccaccttaagttgcaccaatttgtaggggtctctgagttttaaacccaattggcctctccctttctttctttctttttctctttctccctttctctctctctctttctctctctctctttctttctctttctttctttctctttctttccttctttctttctttctttctttttctttctttctttcttctttctttctttcttctttctttctttcttctttctttttctttctttctttcgtgtatcaagtttactacctacctcctggcca

SEQ ID NO: 14286 - DNA, 211 bp, Homo sapiens
  D8S1738
  Located on chromosome 8
  Distance between a terminus base of telomere on chromosomal short arm and 5'-terminus of this base sequence : 104981881
  Distance between 3'-terminus of neighbour sequence of sequence listing upward to telomere on chrosomal short arm and 5'-terminus of this base sequence : 43941
ctgtcagtgcttgagcagagttttgaaatcacacacacacacacacacacacacacacacatacacacagacaaataacaaattattgtgggtctcattttgaccacccaaactaatacattgtagtgatcaacagtgtgacctttgaagtgagacagatctaagttagaattctccatttgccatttactacgcataggaaactgacaag

SEQ ID NO: 14287 - DNA, 336 bp, Homo sapiens
  AC055117.3_50180
  Located on chromosome 8
  Distance between a terminus base of telomere on chromosomal short arm and 5'-terminus of this base sequence : 105050060
  Distance between 3'-terminus of neighbour sequence of sequence listing upward to telomere on chrosomal short arm and 5'-terminus of this base sequence : 67968
tttaccaggtgactctttgtatactaaagtgtgagaagcactgataaggacaaacaccatcacctttgctccatcttataaaataggagaataggaaaatgaagagaaggaaggaagggagggagggaagagaagaaaagaaagaaggaagggaggaagggagggagggagggaaaagaagaagagaagggaggggagggaagggaagaaaaggagggacgatcctaaaagcataagagttcagatgcatcactaaaaatggcatttttggagaaaaactaacgttagctgtggactataaaccttgctattatgtttgctgaactacctgttaaa

SEQ ID NO: 14288 - DNA, 214 bp, Homo sapiens
  D8S1814
  Located on chromosome 8
  Distance between a terminus base of telomere on chromosomal short arm and 5'-terminus of this base sequence : 105321684
  Distance between 3'-terminus of neighbour sequence of sequence listing upward to telomere on chrosomal short arm and 5'-terminus of this base sequence : 271288
tgcactcctatgaggcaaagtagtgcatggggtattctgcatcaggttttagatttcatttgtttcattgtaatctcactattttcaatccctcaataaagtttcttcacatacaaaacacacacacacacacacacacacacacacccccttgtgttcatggtagggttgggaatatacagaggggtggctctaagtattttctggttgagtc

SEQ ID NO: 14289 - DNA, 311 bp, Homo sapiens
  AC012564.3_151999
  Located on chromosome 8
  Distance between a terminus base of telomere on chromosomal short arm and 5'-terminus of this base sequence : 105369975
  Distance between 3'-terminus of neighbour sequence of sequence listing upward to telomere on chrosomal short arm and 5'-terminus of this base sequence : 48077
taaatgtactagctaagtgccatcatgctcttattaattatgggtttattgaggaaggaaaatggaagagaagtgcttttgtcctctaaagggaagattttagctgtggttacagttaacaaacacataccattggaaactcccagaagatggggggtggggttggagacaggaagagaggacacacacacacacacacacacacacacacacacacacacacagagttggattttgaaagagaactgacagagccctatgggagaagaactacttctgtgtaagtggttaaagtacttggtagtgtgcac

SEQ ID NO: 14290 - DNA, 190 bp, Homo sapiens
  D8S1844
  Located on chromosome 8
  Distance between a terminus base of telomere on chromosomal short arm and 5'-terminus of this base sequence : 105458794
  Distance between 3'-terminus of neighbour sequence of sequence listing upward to telomere on chrosomal short arm and 5'-terminus of this base sequence : 88508
gctgctgagtgcatgaacgatatcttggtgccttttattactttcttaataataatcgccttctcaatggcaagggagtcacctcccaatggtaggggaattacttaggtctctctctgtgctcgtgtgtgtgtgtgtgtgtgtgtattttatgcagtcaagttggatttttgacgtgtactttgagcca

SEQ ID NO: 14291 - DNA, 469 bp, Homo sapiens
  chr8.fa.O7frz.113048911
  Located on chromosome 8
  Distance between a terminus base of telomere on chromosomal short arm and 5'-terminus of this base sequence : 105633465
  Distance between 3'-terminus of neighbour sequence of sequence listing upward to telomere on chrosomal short arm and 5'-terminus of this base sequence : 174481
agaactccaagcaggagattcacactcaaaaaacaggctcttactctatatcaaaggaatgggggaaaatgtacatttagattgtttaacacacacacacacacacacacacacacacacttaaatctacccactacactaggtggatcacattaattaaggaatttctactatgtgttcagaggaaaaacatcaagatggagcagatctgtataggacattttgtgttatgctaactgatgaagtccacagagagagctatgcaaccctgtttttgttccatctcttctgtcaggaagagtgctctttatattagaaataacagagccattctagttaagagggaattaacaaacaacgcaggtgaaaaaagtgccaagatgttttaaaagtttagttcttcaggctttagtaaattcattctacaggtttcaagaggagatatagttgaactctaaagaatggtaaa

SEQ ID NO: 14292 - DNA, 163 bp, Homo sapiens
  D8S1784
  Located on chromosome 8
  Distance between a terminus base of telomere on chromosomal short arm and 5'-terminus of this base sequence : 105747707
  Distance between 3'-terminus of neighbour sequence of sequence listing upward to telomere on chrosomal short arm and 5'-terminus of this base sequence : 113773
ccatttattcatttgtgtagtgcttacacacacacacacacacacacacacacacacacacagacacactgtttagcaaaaaaggaacccagggagaaataatgactcaagcaaaataatatttaagaattaagagaagatatagtgaaagttgaagccagcc

SEQ ID NO: 14293 - DNA, 173 bp, Homo sapiens
  D8S556
  Located on chromosome 8
  Distance between a terminus base of telomere on chromosomal short arm and 5'-terminus of this base sequence : 105754876
  Distance between 3'-terminus of neighbour sequence of sequence listing upward to telomere on chrosomal short arm and 5'-terminus of this base sequence : 7006
ctggtgacttcctgccatatacatcctctcttatcaccactatcttccatacacatgcacgcgcgcgcacacacacacacacacacacacacacacacacacacacacacagtgtatctaactcctacgcattcttagttttagtcacctctttcgtcttacctcacagcaag

SEQ ID NO: 14294 - DNA, 394 bp, Homo sapiens
  AC021546.3_175683
  Located on chromosome 8
  Distance between a terminus base of telomere on chromosomal short arm and 5'-terminus of this base sequence : 105804135
  Distance between 3'-terminus of neighbour sequence of sequence listing upward to telomere on chrosomal short arm and 5'-terminus of this base sequence : 49086
cattgtcatgaagttagtatccttatgtgttgacatttggtcattattttataagagacctactactggaagaaaagaaggggctgaaaaaaatatgtgtgtgtgtgtgtgtgtgtgtgtgtgtgtttgtattctgtcttacatatattaggtatttctattcaaacacttggtagaaataaaatttaatttttttttgtttttttcaggtacttaaataaccagtgtaatcttctaaaatagtctctctatatttaatgcaaatctcataaaatatttaaaaattagagaagaaataataatttgttgacactactgctttcatataaaacgacttattgtcatcagaacttctggttcttaatttgtaacctctatagcagtaggctggaat

SEQ ID NO: 14295 - DNA, 152 bp, Homo sapiens
  D8S1703
  Located on chromosome 8
  Distance between a terminus base of telomere on chromosomal short arm and 5'-terminus of this base sequence : 105993360
  Distance between 3'-terminus of neighbour sequence of sequence listing upward to telomere on chrosomal short arm and 5'-terminus of this base sequence : 188831
ttcactgggaaacgctttataagatagattgatattaaaatgtaatatactccacacacacacacacacacacacacacacacacacacacacagacatatacatgcagacatacacactatatatatgacacacacattatagatgtagat

SEQ ID NO: 14296 - DNA, 452 bp, Homo sapiens
  AC022721.3_81252
  Located on chromosome 8
  Distance between a terminus base of telomere on chromosomal short arm and 5'-terminus of this base sequence : 106028685
  Distance between 3'-terminus of neighbour sequence of sequence listing upward to telomere on chrosomal short arm and 5'-terminus of this base sequence : 35173
aacttacatttcaaatggttcacaaaatgataaaaatagtgaaattattattattattattattattattattattattattattattttattttttttgagacggagtcttgctctgtcacccaggctggagtgcagtggcgtgatctcggctcactgcaagctctgcctgctgggttcacgccattctcctgcctcagcctcccaggtagctgggactacaggcacctgccaacaggcctggctaattttttgtatttttagtagagacagggtttcaccgtgttagccaggatggtcttgatctgctgacttcgtgatccacctgcctcggcctcccaaagtgctgggattacaggcgtgagccaccgcgcccggcctattatttttagtactgagaaagaagcatacagaaaatgtggcaaaatgttagcaatttgtaattctaagca

SEQ ID NO: 14297 - DNA, 380 bp, Homo sapiens
  AC022721.3_154519
  Located on chromosome 8
  Distance between a terminus base of telomere on chromosomal short arm and 5'-terminus of this base sequence : 106098034
  Distance between 3'-terminus of neighbour sequence of sequence listing upward to telomere on chrosomal short arm and 5'-terminus of this base sequence : 68897
ccttaaacatagtagatgctcaataaatattttatggagggaatttcattggtattcattctgataatccgaacaggcaaaaggagtgaaaactctgtctcaacaaaaaaaaagaaagaaagaaagagagagagagagagagagaaagaaagaaagaaagaaagaaagaaagaaagaaagaaagaaagaaatcaaagcccaggggcgccccggtgttggagtctataggagttcaggatcccttggtcacaaagcagggccaagaaggaagagagcggattggggccagcaagaagggacaagcagagaatgtccaggagacattagggttctccaccacagctaacattgtgattccagttatgccagtttgctaatta

SEQ ID NO: 14298 - DNA, 334 bp, Homo sapiens
  chr8.fa.O7frz.113737291
  Located on chromosome 8
  Distance between a terminus base of telomere on chromosomal short arm and 5'-terminus of this base sequence : 106267671
  Distance between 3'-terminus of neighbour sequence of sequence listing upward to telomere on chrosomal short arm and 5'-terminus of this base sequence : 169257
ctcacctactttcgcatttacttttaaaataacatggtttaatgtctaatttggggcaaatatatatatatatatttatatatatacacacgcatataatgataatgtatatataatgataatgttgctacattacaataagtattgttttcctttgtctctattttaagctgaaagtgtgcatgtgtgtgtgtgtgtgtgtgtgtgtgtgtaaataaagattactttgtaaaaatctggttgaatccatcattgtatttatatttagatccatcagcttaggatagacttttttgataaatgtgacagggtcagtaacgataatcctcttatg

SEQ ID NO: 14299 - DNA, 479 bp, Homo sapiens
  AC015561.10_184878
  Located on chromosome 8
  Distance between a terminus base of telomere on chromosomal short arm and 5'-terminus of this base sequence : 106352925
  Distance between 3'-terminus of neighbour sequence of sequence listing upward to telomere on chrosomal short arm and 5'-terminus of this base sequence : 84920
cggttctcagttggatctaatttctcaaaaagaatataagaaatgtgaattgtaagagaaaagtagtagcaacctttttttttttttctattgatggaggtaaagcttgtgattttttccccctttttaacacagatatgtctgagggaaaacagagaacaaaaccaggacattatttgtaagcccaaacatgacggttgcaaaattggcccaagctgtagaagatttaagcagctattgttaggaggttttttgtagtgggagaacaagtctgccatagatatgaccttaaatgtgtctgctttcccacattttgtgacggtctggagaaatttaatatgtgtgtgtgtgtgtgtgtgtgtgtgtgtgtgtgtgtgcacgtgcgcatgtgcgcatgcgtgtgtgttgcaggaatagttgtagcagcatgaagtgcagggaaggttaaccctgttttcaggaagttatttagttgaatg

SEQ ID NO: 14300 - DNA, 451 bp, Homo sapiens
  chr8.fa.O7frz.113846254
  Located on chromosome 8
  Distance between a terminus base of telomere on chromosomal short arm and 5'-terminus of this base sequence : 106376503
  Distance between 3'-terminus of neighbour sequence of sequence listing upward to telomere on chrosomal short arm and 5'-terminus of this base sequence : 23099
attaagcaatgtggttacgtatagatatatgtcctgtgttcatgcctagaccctgagatctaggcattaccacatgcgatgttgaaatgggacagttatttagcttttaaggaatttttctgaccaatcacttctcagttatgaaaaaaacagatttcagagggaggtatcatgtgagattttttctaattatttatttagtaaaaatgaaagaagttaatgaccaaacaagtaagtattccgcttttctccacctccagaaacatgatactctgtgtatgtctgcatgtgtctgagtgcatgcgtgtgtgtgtgtgtgtgtgcgtgtgtgtgtttgtttgctaaatggcctattcccccagagaatggctttaattttacttgaatgtgcctacaagagatcatgatttacttcacaggccaatgtgtaatcgtcattaactaagtgctt

SEQ ID NO: 14301 - DNA, 370 bp, Homo sapiens
  chr8.fa.O7frz.114073770
  Located on chromosome 8
  Distance between a terminus base of telomere on chromosomal short arm and 5'-terminus of this base sequence : 106601359
  Distance between 3'-terminus of neighbour sequence of sequence listing upward to telomere on chrosomal short arm and 5'-terminus of this base sequence : 224405
taccatagtgaagcaaatgaacatatctatctgtctacctatctatctatctatctatctatctatctatctatctatctatctatcatctaacatagcctttcttttcatttaaatctactcatttagcatgaatctccaatacaatttcgttacctgtagttctcatgttgtacattaggatctctagacttgttcatcacacatacctgctcatttgtatcctttgagctacatctcttcgtttcttcccacccccatttctagtaagcactattttttctatctctgtatatctgaattttttgtgtgtttgacatataagtgagattgtgcaattttttttctgtgccttactgatttcacttaa

SEQ ID NO: 14302 - DNA, 428 bp, Homo sapiens
  chr8.fa.O7frz.114286696
  Located on chromosome 8
  Distance between a terminus base of telomere on chromosomal short arm and 5'-terminus of this base sequence : 106790456
  Distance between 3'-terminus of neighbour sequence of sequence listing upward to telomere on chrosomal short arm and 5'-terminus of this base sequence : 188727
attgaaagaggactgaacaattcaggagcaggcacagaaagaattcagtagtagagaccaatgaagcagcccagcgctatcaactgctgccacagtgtgtgtgtggggtgtgtgtgtgtgtgtgtgtgtgtgtgtgtgtgtgtgtgtgttttcagacagcaggagtgatataggaagtggtgatagttggtagcagagaaaaccaaaatggagataaggaagtggaggctgcataaggcaaatgtgcagagtcatcccacaaagctgaagatttcagatgtgtcaggtaacttgaaaggcctgtgattctgactaatcctctggatcccagatgcattattagctcataagtggaaccccttttaaatgagagttggggatgccaacttcattggggtacttcctactttagaaaggatggacctaga

SEQ ID NO: 14303 - DNA, 142 bp, Homo sapiens
  D8S1132
  Located on chromosome 8
  Distance between a terminus base of telomere on chromosomal short arm and 5'-terminus of this base sequence : 106936553
  Distance between 3'-terminus of neighbour sequence of sequence listing upward to telomere on chrosomal short arm and 5'-terminus of this base sequence : 145669
ggctaggaaaggttagtggcttaatgtatttgtttttctctctttttttctatctatctatctatctatctatcatctatctatctatctatctatctatctatctatctatctatctatctattgctcgaaagagagaggg

SEQ ID NO: 14304 - DNA, 149 bp, Homo sapiens
  D8S1131
  Located on chromosome 8
  Distance between a terminus base of telomere on chromosomal short arm and 5'-terminus of this base sequence : 106936553
  Distance between 3'-terminus of neighbour sequence of sequence listing upward to telomere on chrosomal short arm and 5'-terminus of this base sequence : -142
ggctaggaaaggttagtggcttaatgtatttgtttttctctctttttttctatctatctatctatctatctatcatctatctatctatctatctatctatctatctatctatctatctatctattgctcgaaagagagagggagagaga

SEQ ID NO: 14305 - DNA, 173 bp, Homo sapiens
  D8S1830
  Located on chromosome 8
  Distance between a terminus base of telomere on chromosomal short arm and 5'-terminus of this base sequence : 107025034
  Distance between 3'-terminus of neighbour sequence of sequence listing upward to telomere on chrosomal short arm and 5'-terminus of this base sequence : 88332
acctcaaatcagattagagagccaattcagaaaccacatatatatatatatatatatatatatatatatatatatagtgtgtgtgtgtgtgtgtgtgtgtgtgtgtgtgtgtgtataggctcatgtgattatggaggctggaaagtcctacaatctgccatccacaaggtgca

SEQ ID NO: 14306 - DNA, 293 bp, Homo sapiens
  HUMUT5677
  Located on chromosome 8
  Distance between a terminus base of telomere on chromosomal short arm and 5'-terminus of this base sequence : 107110027
  Distance between 3'-terminus of neighbour sequence of sequence listing upward to telomere on chrosomal short arm and 5'-terminus of this base sequence : 84820
ttccccttcaccagccatcttcgccaccagccagcagtgttctgctttgatgtagtattttatttgtttttctttcaacaatacgttacctgcttaaagtatttgaaagccactgatggattagagtgcaggaatatggtcagtgtcatgagagagatttaaaatgctatgataaacagaggtaaaggaaagcatgtcttgtggaaggtaggaggatgcggtatttgattgattgattgattgattgattgatttttgagatggagtctcactctgctgcctaggctggagtg

SEQ ID NO: 14307 - DNA, 284 bp, Homo sapiens
  AC019056.5_130861
  Located on chromosome 8
  Distance between a terminus base of telomere on chromosomal short arm and 5'-terminus of this base sequence : 107172935
  Distance between 3'-terminus of neighbour sequence of sequence listing upward to telomere on chrosomal short arm and 5'-terminus of this base sequence : 62615
taagtatttgccagcatcttaggaaagaaaatttttctaaaccaaagagagaaaaaaaattgtaggcataaatgctaaatgatgagttaatgggtgcagcacaccagcatggcacatgtatacatatgtaactaacctgcacattgtgcacatgtaccctaaaacttaaagtacagtaataataaaataaaataaaataaaataaatatattcatactgtggaaaaaaataagcctaaagtcttgtactttaaaaatcaaaactcaaagtaaacttttcatgca

SEQ ID NO: 14308 - DNA, 329 bp, Homo sapiens
  AP000856.2_104761
  Located on chromosome 8
  Distance between a terminus base of telomere on chromosomal short arm and 5'-terminus of this base sequence : 107358940
  Distance between 3'-terminus of neighbour sequence of sequence listing upward to telomere on chrosomal short arm and 5'-terminus of this base sequence : 185721
cgtttgtcagtgaaacaaatacatgcacaactcacagaaaatagttatttttttttattctactattctttacattaaaattttggcacccaggaagttttgttcattatttttgacaaattttgtgttagcatgaaagaattctattttaaatagcatacacacacacacacacacacacacacacacacacacacacacacagcgcaagccagctagctgacttttgcccttcaagggcttaattaaagatgcatgcaactatcttctttacacagaaatatggggatttatcattcctaccagtcgttcctcatgtagtggatgag

SEQ ID NO: 14309 - DNA, 271 bp, Homo sapiens
  chr8.fa.O7frz.114927760
  Located on chromosome 8
  Distance between a terminus base of telomere on chromosomal short arm and 5'-terminus of this base sequence : 107428324
  Distance between 3'-terminus of neighbour sequence of sequence listing upward to telomere on chrosomal short arm and 5'-terminus of this base sequence : 69055
agaagtcaactctgccttagattgggctctcttctgaattctaatcagaagatatttttgactcagcaatcatttttagggattctttgatcttcgtctctttcaagtcaccgaaatcagtgtggggggtgtgtgtgtgtgtgtgtgtgtgtgtgtgtgtgtgtaaaataagtggctacttttggatgtatgagtggctctttgccataccccaggttggagctctgtgagcttctgcatgaaaaggaatttcacagcactagaggttaat

SEQ ID NO: 14310 - DNA, 279 bp, Homo sapiens
  AF303733.1_4567
  Located on chromosome 8
  Distance between a terminus base of telomere on chromosomal short arm and 5'-terminus of this base sequence : 107508525
  Distance between 3'-terminus of neighbour sequence of sequence listing upward to telomere on chrosomal short arm and 5'-terminus of this base sequence : 79930
ctaacattaggcaatgtcaactttttaaaattttagtaattctagtaggtttgtagtggtatctcattgtggttttaattgtattttctttattttatatatatatatatacacacacacacacacacacacacacacaccatatatccaggctatacacatagggtatatatgtatagtctctctcgctatatacatatatatatatatatatatatatatatatatatatatatctcctctctctgtgtatataggttattgtttcctagtctgcaa

SEQ ID NO: 14311 - DNA, 135 bp, Homo sapiens
  DISO7_10002599
  Located on chromosome 8
  Distance between a terminus base of telomere on chromosomal short arm and 5'-terminus of this base sequence : 107742181
  Distance between 3'-terminus of neighbour sequence of sequence listing upward to telomere on chrosomal short arm and 5'-terminus of this base sequence : 233377
gcatgtcctttagatctggcttttaagtacatttctccagatagagtgtgtgtgtgtgtgtgtatgtgtgtgtgtgtatgtgtatatatatatatttgtttttgcgaggccttcccccaccatgtggttagtatg

SEQ ID NO: 14312 - DNA, 107 bp, Homo sapiens
  DISO7_10002600
  Located on chromosome 8
  Distance between a terminus base of telomere on chromosomal short arm and 5'-terminus of this base sequence : 107768960
  Distance between 3'-terminus of neighbour sequence of sequence listing upward to telomere on chrosomal short arm and 5'-terminus of this base sequence : 26644
atgaatcactatgacaactggagatctctctctctctctctctctctctctctctctctctctctctctcatcctccttctaagcctttctgcttcccttgctacct

SEQ ID NO: 14313 - DNA, 131 bp, Homo sapiens
  DISO7_10002603
  Located on chromosome 8
  Distance between a terminus base of telomere on chromosomal short arm and 5'-terminus of this base sequence : 107812207
  Distance between 3'-terminus of neighbour sequence of sequence listing upward to telomere on chrosomal short arm and 5'-terminus of this base sequence : 43140
caacatttaagccactcttaagagtttatagattctgtacagaaatggagtgtgtgtgtgtgtgtgtgtgtgtgtgtgtgtgtgtgtgagagagagagagagagaatctaatcctgttagagtctttggaa

SEQ ID NO: 14314 - DNA, 147 bp, Homo sapiens
  DISO7_10002605
  Located on chromosome 8
  Distance between a terminus base of telomere on chromosomal short arm and 5'-terminus of this base sequence : 107833873
  Distance between 3'-terminus of neighbour sequence of sequence listing upward to telomere on chrosomal short arm and 5'-terminus of this base sequence : 21535
gcatgagcaagaaattcttgttgaataaagtgacttaaacttgagattgtttgtttctacagtttaaccatgtctctcccgagtgtgtgtgtgtgtgtgtgtgtgtgtgtgtgcgtattttatagggtgatgatagctcaggcctca

SEQ ID NO: 14315 - DNA, 245 bp, Homo sapiens
  DISO7_10002607
  Located on chromosome 8
  Distance between a terminus base of telomere on chromosomal short arm and 5'-terminus of this base sequence : 107953978
  Distance between 3'-terminus of neighbour sequence of sequence listing upward to telomere on chrosomal short arm and 5'-terminus of this base sequence : 119958
tccagaattaaggtagaaaggatacatttttaagaaataaagagaaagaaagaaagaaagaaagaaaaagaaagaaagaaaagaaagaaagaaaggagggagggagggagggagggagggagggaaggaaggaaggaaggaaggaaggaaggaaggaaggaaggaaggaaggaaggaaggaaggaaggaaggataaatatgagaaggagggaagaaaagagaaagagacagagtacctgagtaca

SEQ ID NO: 14316 - DNA, 102 bp, Homo sapiens
  DISO7_10002608
  Located on chromosome 8
  Distance between a terminus base of telomere on chromosomal short arm and 5'-terminus of this base sequence : 107969199
  Distance between 3'-terminus of neighbour sequence of sequence listing upward to telomere on chrosomal short arm and 5'-terminus of this base sequence : 14976
tgactcagacagatgttagataaggagattagatagatagatagatagatagatagatagatagatagatagatctatgtacatacatagacacttggatgc

SEQ ID NO: 14317 - DNA, 259 bp, Homo sapiens
  AC020607.4_46986
  Located on chromosome 8
  Distance between a terminus base of telomere on chromosomal short arm and 5'-terminus of this base sequence : 108068919
  Distance between 3'-terminus of neighbour sequence of sequence listing upward to telomere on chrosomal short arm and 5'-terminus of this base sequence : 99618
gttgcctttatgacataaagtaacctatttaatgaactatgtatttcaatctatagtaggcagagctttttactgactttataaaccccttattaataaagcacccacacactcacacacacacatgcacacacacacacacacacacagaaaacttctgatatattaagggaaaatttactgggagagcaggtcctcaaatcaacagtttcacttgagattcaggggctcaaacatgatggaacaggtaattaccagt

SEQ ID NO: 14318 - DNA, 299 bp, Homo sapiens
  chr8.fa.O7frz.115695267
  Located on chromosome 8
  Distance between a terminus base of telomere on chromosomal short arm and 5'-terminus of this base sequence : 108178375
  Distance between 3'-terminus of neighbour sequence of sequence listing upward to telomere on chrosomal short arm and 5'-terminus of this base sequence : 109197
ctcaaggtcctctgaagagtaggtgttctttctcccacacatcatatagttcagagtttccaaattatattcagctcatgactccttatcttcatataaatgaatgaatgaatgaatgaatgaataaataaataaataaataaataaataagtttccttgaagcttcttgccagttggctaaacattcttttacctattcttgacactatctcctatcatcctcctggtcacttctcccaattcagtataacttttggcacctgcttcaaatcatttatttcctgctactccaagtaat

SEQ ID NO: 14319 - DNA, 422 bp, Homo sapiens
  chr8.fa.O7frz.115811393
  Located on chromosome 8
  Distance between a terminus base of telomere on chromosomal short arm and 5'-terminus of this base sequence : 108310482
  Distance between 3'-terminus of neighbour sequence of sequence listing upward to telomere on chrosomal short arm and 5'-terminus of this base sequence : 131808
tcttagaacattgattttcttgagtgagaaataatttaaacatttacatattaaaataggctgagtgcagtgctcatacctgtaatcccatcactttgggagggtgatgtgggcaggtcacttcagcccaagagttcaagaccagtctgggcaactagcaaaaccccatctctaccaaacaaaaacaaaacaaatattagctgggcatggtggtacatgcctgtagtcccagctactggggaggctgaggcaggaggattgcttgagcctgagacatcgaggctgcagtgagctgtgattgcatcactgcactccagcctggatgacagagagacaatgtcataaaataaaataaaataaaataaaaataaaataaaataaaataaaataaaagtattatgtaattgaaagcaaatgcataa

SEQ ID NO: 14320 - DNA, 394 bp, Homo sapiens
  chr8.fa.O7frz.115916758
  Located on chromosome 8
  Distance between a terminus base of telomere on chromosomal short arm and 5'-terminus of this base sequence : 108421096
  Distance between 3'-terminus of neighbour sequence of sequence listing upward to telomere on chrosomal short arm and 5'-terminus of this base sequence : 110192
aatttcaatgtagtcgtgcaagccaggctagtcaaataagcctatcccatcgtttgttgttgttgttgttgttgttgttttgagacagagtcttgctcttgtcacccaggctggagtgcagtggcacaatcttggctcactgcaacctccgcctcctgggttcaagtgattctcctgcctcagcctcctgagtagctgggattaaaagcgtccaccaccaagcccggctaatttgtgtctttttagtagacacagggttttgccatgttggccaggctggtctcaaactcctgacctcgtgatccacccaccttggcctccaaaagggctgggattacaggcatgagccaccacatccagccacctatcgcatcttagtgcaacagtaattggt

SEQ ID NO: 14321 - DNA, 360 bp, Homo sapiens
  chr8.fa.O7frz.116041495
  Located on chromosome 8
  Distance between a terminus base of telomere on chromosomal short arm and 5'-terminus of this base sequence : 108544517
  Distance between 3'-terminus of neighbour sequence of sequence listing upward to telomere on chrosomal short arm and 5'-terminus of this base sequence : 123027
gatgaacagacaaactgaacagaaaagagaccatacccatacatatatagaaacctcatacgccagagcagtggaaaaagaataggatcttaaatcagtcatgctaggatgtctggttttccaaaaaggaaagcaaataaattgtattcccagctctcacctaacatgcacacacacacacacacacacacacacaaaataagttctcaagtagatttatggtttaaatatgcatgcaaaaaaaatgaaagcttttagcacaaaatacaggagaatacagaggtagggaagtattcttcaaatctccataaaatatcagtatatacaattacaataagatcactatcctgcactcagata

SEQ ID NO: 14322 - DNA, 308 bp, Homo sapiens
  AC016997.6_146491
  Located on chromosome 8
  Distance between a terminus base of telomere on chromosomal short arm and 5'-terminus of this base sequence : 108881696
  Distance between 3'-terminus of neighbour sequence of sequence listing upward to telomere on chrosomal short arm and 5'-terminus of this base sequence : 336819
agaacctgacagtctgtgactgttgaggggttaccaccacctgcttgtattttgaggtcccctagctttattgtaaatgttgcttaggtgttttggctttgccatctagttgctgtgtgtgtgtgtgtgtgtgtgtgtgtgtgtgtgtgtgtgtgtgtgtggtgtgtgtgtaggaattcagagattgacaatttgggccaccgccatctcccccaaataccagtcaactgcttttaaaactaggacaaactagaaatgagcatttatgaccttccagaaaggctctttgaattaaagaacagtcctaa

SEQ ID NO: 14323 - DNA, 443 bp, Homo sapiens
  chr8.fa.O7frz.116623082
  Located on chromosome 8
  Distance between a terminus base of telomere on chromosomal short arm and 5'-terminus of this base sequence : 108949286
  Distance between 3'-terminus of neighbour sequence of sequence listing upward to telomere on chrosomal short arm and 5'-terminus of this base sequence : 67282
agtgcagtggcatcattattgctcactgcagcctcaaactcctgggctcaagtgatcctcctgcctcaggctccccagtcactgggattacagacacaagccactgcacccaatgccttattgctttttgctctctctctctctctctctctgtctctctcactaactctacctgtctctcatcatggtttgtctctgttcagcttcattctgcaaacaggctttttactatggctgggaagatggtcactggtcccaggttcagtttttccaagcttagcaacctagcaggaagagaaatttgtttcttttagcactgagaatgtcattacccggctttggtacatctatcttactttttgctgataatattctaacatgagggtaggtcaggaggcttgacctcagatacctgtaacctgatctgttactaactttggtgt

SEQ ID NO: 14324 - DNA, 377 bp, Homo sapiens
  chr8.fa.O7frz.116751610
  Located on chromosome 8
  Distance between a terminus base of telomere on chromosomal short arm and 5'-terminus of this base sequence : 109079287
  Distance between 3'-terminus of neighbour sequence of sequence listing upward to telomere on chrosomal short arm and 5'-terminus of this base sequence : 129558
tgtattggacttacagttccacatggctggggaggcctcacagtcatggtagaaggcaaggaggagcaagtcacatcttacatggatgacagcatgcaaagagagcttgtgcagggaaactcccattttaaaactatcagatcttgtgagactcattcactatcatgagaacagtgcaggaaagacacgccccataattcagtcacctctcactgggttcttcccatgatgcaagggaattgtgggatttccaattcaagatgagatttgggtggggacacagccaagccatgtgagagagagagagagagagtgtgtgtgtgtgtgtgtgtgtgtgtgtgtgtgattgttttgttctagatagctgagaactttca

SEQ ID NO: 14325 - DNA, 319 bp, Homo sapiens
  chr8.fa.O7frz.116829354
  Located on chromosome 8
  Distance between a terminus base of telomere on chromosomal short arm and 5'-terminus of this base sequence : 109157217
  Distance between 3'-terminus of neighbour sequence of sequence listing upward to telomere on chrosomal short arm and 5'-terminus of this base sequence : 77553
taacagtaactacttccacctcacttttctgctctcatctgatttgaaacaggttttggattactacctctaaattatgtaaactcttaatcaatgattaatttaagaatcttcgagctgctggtgtgtgtgtgtgtgtgtgtgtgtgtgtgtgcatgtgtgtgtgtgggtgtgtgtgtgtgtgtgtgtggttcttatgtgtcaataaattcagccctagtaaaacactctttttttcttccctagactttttaggcctttattttctcctcagcttgttgaggggataaaggataagtagatggaaccaaggaatagt

SEQ ID NO: 14326 - DNA, 447 bp, Homo sapiens
  AC025962.3_78973
  Located on chromosome 8
  Distance between a terminus base of telomere on chromosomal short arm and 5'-terminus of this base sequence : 109318691
  Distance between 3'-terminus of neighbour sequence of sequence listing upward to telomere on chrosomal short arm and 5'-terminus of this base sequence : 161155
ctgactctgttcttaaatacgaagtaaaatgttcaccaaatactaaacaatgcctaaagtagcctcattctataaatccctattcatggaaaacaatcttggcttggctttggtgtctgtaaatgtgaggattagactccctggaaaagctgaccagacagcagttaacaaataaccctccagcaagaataattcccggatgagctgggcaagatcagggctctcacttcccataaatctttgaccaggcattgcccttctttctgggaactaccatcattgctttccctcccctcccctcccctcttgtacccttccctcccctccctcttttccttccttccttccttccttccttccttccttccttcctccctccctccctccctccctccctctctccctccctccttctctccctcccttcctactaaggaattaaagcag

SEQ ID NO: 14327 - DNA, 202 bp, Homo sapiens
  DISD22_0005895
  Located on chromosome 8
  Distance between a terminus base of telomere on chromosomal short arm and 5'-terminus of this base sequence : 109396593
  Distance between 3'-terminus of neighbour sequence of sequence listing upward to telomere on chrosomal short arm and 5'-terminus of this base sequence : 77455
gcaagagacatacaaataagcagtttccacatgatgatgatgatgatgatgatgatgatgatgatgaaggaagggaggagagaaagagggagtggggaaaaggaggaagaggaaattaagaaggaaaaggaggatgaggaggagaaaggagcataagtaaaaaaatattatgttttatcatgatgatcagtaatcatctgac

SEQ ID NO: 14328 - DNA, 111 bp, Homo sapiens
  DISD22_0005898
  Located on chromosome 8
  Distance between a terminus base of telomere on chromosomal short arm and 5'-terminus of this base sequence : 109481301
  Distance between 3'-terminus of neighbour sequence of sequence listing upward to telomere on chrosomal short arm and 5'-terminus of this base sequence : 84506
tgtaccttgggttcctgggaaaaaggcagagtacaaactgcgtatgtgtgtgtgtgtgtgtgtgtgtgtgtgtgtgtgtgtgtgtgtgagacaggactttggacctagatt

SEQ ID NO: 14329 - DNA, 178 bp, Homo sapiens
  DISO7_10018596
  Located on chromosome 8
  Distance between a terminus base of telomere on chromosomal short arm and 5'-terminus of this base sequence : 110198726
  Distance between 3'-terminus of neighbour sequence of sequence listing upward to telomere on chrosomal short arm and 5'-terminus of this base sequence : 717314
tcaaatatgtaacctctagaaccactaaaacacacacacacacacacacacacgcaaatatctacccaaacagaaacattgaaatatagttaacaatatgcttaaagtagacataaataaattcataaaattcataaattcataaaagcaatttttaaatgttcccttgcttcaatgc

SEQ ID NO: 14330 - DNA, 126 bp, Homo sapiens
  D8S1122
  Located on chromosome 8
  Distance between a terminus base of telomere on chromosomal short arm and 5'-terminus of this base sequence : 110341304
  Distance between 3'-terminus of neighbour sequence of sequence listing upward to telomere on chrosomal short arm and 5'-terminus of this base sequence : 142400
tgctcaaatctgcaatttcaattgtcctgttttctacatcatcccaacattattattattattattattattattattattattattattattattatttttgagacagggtctgattctgtcacc

SEQ ID NO: 14331 - DNA, 299 bp, Homo sapiens
  chr8.fa.O7frz.117448536
  Located on chromosome 8
  Distance between a terminus base of telomere on chromosomal short arm and 5'-terminus of this base sequence : 110414108
  Distance between 3'-terminus of neighbour sequence of sequence listing upward to telomere on chrosomal short arm and 5'-terminus of this base sequence : 72678
ttagtcaagaattatgccagacagggtgtctcaggcctgtaatcccagcactttgggaggccaaggtgggatgactacttgaggccaggagtttgaaatcagcctgggcactatagtgagacccagccaaaagaaagaaagagagaaagacagagagaaagagagagagagagaggaaggaaggaaggaaggaaggaaggaaggaaggaaggaaggaaggaaggaaagaaggaaggaaggaaggaagggagaaaaggtacagttggtagtgtatttttccatcagtaggtacataatgt

SEQ ID NO: 14332 - DNA, 207 bp, Homo sapiens
  chr8.fa.O7frz.117560962
  Located on chromosome 8
  Distance between a terminus base of telomere on chromosomal short arm and 5'-terminus of this base sequence : 110534113
  Distance between 3'-terminus of neighbour sequence of sequence listing upward to telomere on chrosomal short arm and 5'-terminus of this base sequence : 119706
taagaccatgcattcagagtatctgagaggtgaagatgaaaacttgttttaggctccattttggcctaccacaactaactcacacacacacacacacacacacacacacacacacacacacacacacagtctagcctctgtgatccaatataattatttacttactgtgactaatactacttacttagaaggtaagctccatagact

SEQ ID NO: 14333 - DNA, 414 bp, Homo sapiens
  chr8.fa.O7frz.117786156
  Located on chromosome 8
  Distance between a terminus base of telomere on chromosomal short arm and 5'-terminus of this base sequence : 110838543
  Distance between 3'-terminus of neighbour sequence of sequence listing upward to telomere on chrosomal short arm and 5'-terminus of this base sequence : 304223
gtaagcgatacaaactccaagctagcaatgagcaagggattatatctgaatttacaatacacaagttgcaaataaatctctaaactgaaactttaacataaaactgatccaagcttggtgacatccctggggcccaaagcagtaagaaacaaacagtgaacctctcaagaaagacatttctagaaataaagctatgtagaattcttattaggagtaacaatcccttgcataagatctgtctctctctctcccctgcctccctctgtcacacacacacacacacacacacacacacacacacacacaaaaaaaaaagaaagaccgtacaatgatataactcaccttgaatgtagcctgcagacataacaaggagggtaattctcttaagaacttgagataatggataaactgaaa

SEQ ID NO: 14334 - DNA, 355 bp, Homo sapiens
  AC027451.3_129835
  Located on chromosome 8
  Distance between a terminus base of telomere on chromosomal short arm and 5'-terminus of this base sequence : 110880877
  Distance between 3'-terminus of neighbour sequence of sequence listing upward to telomere on chrosomal short arm and 5'-terminus of this base sequence : 41920
acagtttatgccaagtactatcagcgttctctatactattagaagtagagtccttagtatttttgggtctattcataagcagccaactccagaaaccccaaaaccaatgaaagaactttatccttaatattctgttcctctgttcctcatatatatatatatatatatatatatatatatatatatatatgagtttattaagtatttacttacacaatcacaagatcccacagtagctgtctgcaagcttgaggaacaaggatagccagcctgagtctcaaaactgaagaacttggagtccaatgtttgagggcaggaggtattccatgcagaaatatgtaggctggtaggctag

SEQ ID NO: 14335 - DNA, 377 bp, Homo sapiens
  AC018608.4_79625
  Located on chromosome 8
  Distance between a terminus base of telomere on chromosomal short arm and 5'-terminus of this base sequence : 110966989
  Distance between 3'-terminus of neighbour sequence of sequence listing upward to telomere on chrosomal short arm and 5'-terminus of this base sequence : 85757
tttcgacgtctaaatctgtattactggtttgcctctgctctctcctttgtggattggccttttaaaacaatttccctttctgaggagatttggaaaagaggaaaaagaggtgtgttctcaatactcataatccatttttaattttggatttcattttttttgttctgatataattcttgaggcaatacaccatttcataagtgaatgcaagggtatgtgtatatgtgtgtgtgtgtgtgtgtgtgtgtgtgtgtaatgcatatatacatctatctatctatctatctatctatctatctatctatctatctatctatctatctatctagtatctatctgatttgcatggtcaactgtgctgtcagtgaatacagaac

SEQ ID NO: 14336 - DNA, 185 bp, Homo sapiens
  HUMUT6510
  Located on chromosome 8
  Distance between a terminus base of telomere on chromosomal short arm and 5'-terminus of this base sequence : 110967186
  Distance between 3'-terminus of neighbour sequence of sequence listing upward to telomere on chrosomal short arm and 5'-terminus of this base sequence : -180
taagtgaatgcaagggtatgtgtatatgtgtgtgtgtgtgtgtgtgtgtgtgtgtgtaatgcatatatacatctatctatctatctatctatctatctatctatctatctatctatctatctatctatctagtatctatctgatttgcatggtcaactgtgctgtcagtgaatacagaacaggaa

SEQ ID NO: 14337 - DNA, 378 bp, Homo sapiens
  chr8.fa.O7frz.118022281
  Located on chromosome 8
  Distance between a terminus base of telomere on chromosomal short arm and 5'-terminus of this base sequence : 111114777
  Distance between 3'-terminus of neighbour sequence of sequence listing upward to telomere on chrosomal short arm and 5'-terminus of this base sequence : 147406
ctttacataacattacctggatctcaatttcctgtcttccctagttcccagcagtttcatcttacaccgattctcttctagaaccgaaccacgttatgcctgaaaacattgccttgtctcttagcctttgcatatgtggttgctgtttcctgaaataccttgatatgtaagtgtgtgcgagtgtgtgtgtgtgtgtgtgtgtgtgtgtgtatgcatatgtgtagaggtggaagaggtggaggagagaaaaactacaataaaaagatgtttataaaaagtaatagataacagttatatagtcctgactctactcttgatacagttctaagtgctttaaattataatgctatttgagtctcctaacattacggcttagat

SEQ ID NO: 14338 - DNA, 295 bp, Homo sapiens
  chr8.fa.O7frz.118149224
  Located on chromosome 8
  Distance between a terminus base of telomere on chromosomal short arm and 5'-terminus of this base sequence : 111139917
  Distance between 3'-terminus of neighbour sequence of sequence listing upward to telomere on chrosomal short arm and 5'-terminus of this base sequence : 24762
gccttctattccatttaatcttagtgatttatcctttgtcttaactatcacacacacacacacacacacacacacacacacacatatatatatatatatatttgacattggctcaatgttagtcaattcaaaaatattcatttatacttagtacctgctctgtcctgagcattcttctatgtacatacaattgtatgtttaaaaatttgagtttggcagcagcaggctgttcagctaaggagtttcactgtactgtgaagaagcacaggctgtgaagaacctagtgaaccttact

SEQ ID NO: 14339 - DNA, 141 bp, Homo sapiens
  DISD22_0005921
  Located on chromosome 8
  Distance between a terminus base of telomere on chromosomal short arm and 5'-terminus of this base sequence : 111264811
  Distance between 3'-terminus of neighbour sequence of sequence listing upward to telomere on chrosomal short arm and 5'-terminus of this base sequence : 124599
aatgggcacagatatctggctttttttttcttttggccttcacagggtttttaaaaatttgtgtgtgtgtgtgtgtgtgtgtgtgtgtgtgtataaaaccaacatttaaaaatggagagatttcacattgtcttgatactc

SEQ ID NO: 14340 - DNA, 156 bp, Homo sapiens
  DISD22_0005927
  Located on chromosome 8
  Distance between a terminus base of telomere on chromosomal short arm and 5'-terminus of this base sequence : 111353447
  Distance between 3'-terminus of neighbour sequence of sequence listing upward to telomere on chrosomal short arm and 5'-terminus of this base sequence : 88495
aattacacatcaagtcctaagggaaaataagcccgtgtgtgtgtgtgtgtgtgtgtgtgtgtgtgtgtgtgtgtgtgtgtagtacccttaggaaacattaaaataatgttcattgaatttaacaaatatttattgagcttccatgctaagtgttga

SEQ ID NO: 14341 - DNA, 269 bp, Homo sapiens
  DISD22_0005930
  Located on chromosome 8
  Distance between a terminus base of telomere on chromosomal short arm and 5'-terminus of this base sequence : 111442002
  Distance between 3'-terminus of neighbour sequence of sequence listing upward to telomere on chrosomal short arm and 5'-terminus of this base sequence : 88399
gaccacagccgtatttcagttcacaaatttttagaaccttgtcaccacacattaaatggtgtctatttctcctccttttgaatctgggtgagacataatgactgttgcaatgaatagaatgtgctgaaatagataatgctgggtgactttcaaggataggtaaaaaccaaaaacaataaaagtacaggtctctctctctctctgtctctctctctttctctttctcctctcttctctctctttttatgactgctagtacttggaatcca

SEQ ID NO: 14342 - DNA, 256 bp, Homo sapiens
  G10051
  Located on chromosome 8
  Distance between a terminus base of telomere on chromosomal short arm and 5'-terminus of this base sequence : 111480115
  Distance between 3'-terminus of neighbour sequence of sequence listing upward to telomere on chrosomal short arm and 5'-terminus of this base sequence : 37844
ctgccaagagcatgttcttatagaagatgtgaagagggcacaaaggattcatcctctccctaaatgtcatagataggtaggtaggtaggtaggtaggtaggtaggtgggtagatagatagatagatagatagatagatagatagatagatagatagatagatagataaaaattatagataaataatatataggggttccatgtaacttgtcgtgtgaggtctaaaattaaatatgtgctgccttgacatttggtaa

SEQ ID NO: 14343 - DNA, 392 bp, Homo sapiens
  AC025366.2_53250
  Located on chromosome 8
  Distance between a terminus base of telomere on chromosomal short arm and 5'-terminus of this base sequence : 111556496
  Distance between 3'-terminus of neighbour sequence of sequence listing upward to telomere on chrosomal short arm and 5'-terminus of this base sequence : 76125
tagacaggtatcaagaaattcaacatcatatagattttctcctatgttttcttctagaagttttacagttttgttttatatttagaaccgtggtttatttattgtgtgtgtgtgtgtgtgtgtgtgtgtgcatgtgtgtgtaagctgtgaattctaagtctagattcatttgtctgcatatggatgttcatttgtcccaggaccatttgctaaaaagatgatcatttccccattgaatcgcatttgtccctttgtcaaaaacggagtgattatatttgtgtcagtctatttcttagctttctattctgattcactaatttttgtgtctcttctttctccatactgtatttatttatgtgtagctttagaagtcttgaagctaggtaatgtca

SEQ ID NO: 14344 - DNA, 376 bp, Homo sapiens
  chr8.fa.O7frz.118454403
  Located on chromosome 8
  Distance between a terminus base of telomere on chromosomal short arm and 5'-terminus of this base sequence : 111599699
  Distance between 3'-terminus of neighbour sequence of sequence listing upward to telomere on chrosomal short arm and 5'-terminus of this base sequence : 42811
gaagcataattgcatttcatagctccttccttcttcatgcttctgtcactttgggttctttgctgttgttgttgttgttgttgttgttgttgttgttgttgttgttttgagacagagtctcgctctgtcgcccaggctggagtgcattggcacgatcttggctcactgcaacctctgcctcccggttgaagcgattctcctgcctcagcctcccgagtagctgggactacaggcacccgccaccacgcctggctaatttttttgtatttttagtagagacggggttacaccatgttacccactatgatctcaatctcctgacctcttgatcctcccaccttcgcctcccaaagtgcttctgtcactttctaaatta

SEQ ID NO: 14345 - DNA, 434 bp, Homo sapiens
  chr8.fa.O7frz.118534924
  Located on chromosome 8
  Distance between a terminus base of telomere on chromosomal short arm and 5'-terminus of this base sequence : 111823109
  Distance between 3'-terminus of neighbour sequence of sequence listing upward to telomere on chrosomal short arm and 5'-terminus of this base sequence : 223034
cacattcatgaaggtgagtaagccagcccttcatgttttcatttcctcctgtttagacaaccaatgatttaattgcctgttctacttctctatcaaactattgcactgagcaggctatctctctctctctctctctgcccattattggacattatgagatgtataatgtgttccttgatctgaaaaagtaatgcctgaccattcaaatccatgcaatatcttctgtttttgtgtgtgtgtgtgtgtgtgtgtgtgtgcgcgcgcgcgcgcgcgcgcgcgcacgtggtgttttttttttgtttgtttttgttttttttgtcactctcattatttacatcctctactgggaaagcaaagcctgtctgtgtctattcctgtcaagacccgtttgtagccccttagggctatcaatgtcagtttacctcacaggtctt

SEQ ID NO: 14346 - DNA, 265 bp, Homo sapiens
  Z67158
  Located on chromosome 8
  Distance between a terminus base of telomere on chromosomal short arm and 5'-terminus of this base sequence : 111939995
  Distance between 3'-terminus of neighbour sequence of sequence listing upward to telomere on chrosomal short arm and 5'-terminus of this base sequence : 116452
tggagcccatacttttactgtatcatgaaggtaaatttatctctgttgcctacctcacaaaattattttgagaattatatgatgtattgacaaggtcaaggtaaactgaattttatcattttggacattataaaaccacctataataatcatatttctgtgtgtgtgtgtgtgtgtgtgtgtatttgtatatatttgtgaaatatattaaaatttatacaaattatttaaagatggatttgtaccaggtaatgtttcaaaatgca

SEQ ID NO: 14347 - DNA, 153 bp, Homo sapiens
  Z67058
  Located on chromosome 8
  Distance between a terminus base of telomere on chromosomal short arm and 5'-terminus of this base sequence : 111968574
  Distance between 3'-terminus of neighbour sequence of sequence listing upward to telomere on chrosomal short arm and 5'-terminus of this base sequence : 28314
tgaactcctgtgaatgctttggatagataccactttaaagacatacagggaaacacacacacacacacacacacacacacacacacacacacacacacaaacctgtgtgattctgtccacagaactagtatcctgggctatgaggcaggtcac

SEQ ID NO: 14348 - DNA, 252 bp, Homo sapiens
  HUMUT2358
  Located on chromosome 8
  Distance between a terminus base of telomere on chromosomal short arm and 5'-terminus of this base sequence : 112164006
  Distance between 3'-terminus of neighbour sequence of sequence listing upward to telomere on chrosomal short arm and 5'-terminus of this base sequence : 195279
gatttatcacatcatctgcgaataaaggcagttttctaattcttttccaatctggatgtatttatgttctttcttttcttttctttctttttccttccttccttccttccttccttccttccttccttccttccttccttccttccttccctccttctttctttcttcttctctctctctctctctctttttttgcggtattgcttcaacaatgcattctagtagtatgttcaatagaagcagtaagaagga

SEQ ID NO: 14349 - DNA, 427 bp, Homo sapiens
  chr8.fa.O7frz.119516446
  Located on chromosome 8
  Distance between a terminus base of telomere on chromosomal short arm and 5'-terminus of this base sequence : 112287373
  Distance between 3'-terminus of neighbour sequence of sequence listing upward to telomere on chrosomal short arm and 5'-terminus of this base sequence : 123115
gtcaccatcaaatctagtattcatttcctgatgaagatgatcaaaataaaatttaattgttttatccactttcttaaatctgcatgtgacatctccattacctataaaaaggattgtctaagacctttcctatatctatcaccttctccctgttacaactttctataaaacaataacatagaaagcgccttggtgttgatttcacatgcataaaccacagagcaagactatctggttcaaaaactgtgtgtacctcttacatggctcttttaccacatatatatatgttatatgttatatatgttatataatatataatatatatatttatatatattttatatatatatctgtgtgtgtattttatatgtgtgtgtgtgtatatatatatatatatatatatcacttatgctgtaaagcaggataa

SEQ ID NO: 14350 - DNA, 386 bp, Homo sapiens
  chr8.fa.O7frz.119262103
  Located on chromosome 8
  Distance between a terminus base of telomere on chromosomal short arm and 5'-terminus of this base sequence : 112542149
  Distance between 3'-terminus of neighbour sequence of sequence listing upward to telomere on chrosomal short arm and 5'-terminus of this base sequence : 254349
agcaatttagaacagtcactacacacacacacacacacacacacacacacacaatctatttgtctgtctatctattgatctatccacctatccatctatctatctaagacttgaatcattttacctcttccatgatgtgttataaagtgcagagtttttaataacagaaactttaaggactaaggaaagaccaagcagccttccaggccctctatgaatccatgcttagcagtggatttatatcctcttaaataccattattattttctccaattcacatgcatgatacttattaaatgggttaccataggtaatttgacctgagccactgaattcattctaattgtatatcttgtcaatttcagtactggctgatttagcataaa

SEQ ID NO: 14351 - DNA, 134 bp, Homo sapiens
  HUMUT5649
  Located on chromosome 8
  Distance between a terminus base of telomere on chromosomal short arm and 5'-terminus of this base sequence : 112618553
  Distance between 3'-terminus of neighbour sequence of sequence listing upward to telomere on chrosomal short arm and 5'-terminus of this base sequence : 76018
gcattccttacaactgtgtgagccaattcttcaaaataaaactctcttctaattctagctagctagatacatacatacatacatacatacatacatacatacatacatacacagattgattagttgagtgattg

SEQ ID NO: 14352 - DNA, 459 bp, Homo sapiens
  AC020692.3_149017
  Located on chromosome 8
  Distance between a terminus base of telomere on chromosomal short arm and 5'-terminus of this base sequence : 112659753
  Distance between 3'-terminus of neighbour sequence of sequence listing upward to telomere on chrosomal short arm and 5'-terminus of this base sequence : 41066
cagcatcagtttaatgagaaagaaaaatatagagggaaatagtaaaagaaacagcaacatgggtaagctgattaacattaaaagcctctctctctgtttctgtgtgtgtgtgtgtgtgtgtatgtgtgtgctacacatacacatatgagatataaatatgtcagtaaatatgtagaaagagtaaaatatatatgtatatataactaatattacatatatttaattatactatttagtgtaaacattcttataaaactgagatgcctagaaataatggaatacatcttatttgaaatttgtattataacatattcaacatgcttagtgacattttcttttaagtaatgaattataggagtaagtacttgaataaaactagagtagcagatatagtgaatgttgacaatgaccttgaaataaaatagtaaaggacaggtactgtaagtttcatggcaatag

SEQ ID NO: 14353 - DNA, 218 bp, Homo sapiens
  HUMUT5296
  Located on chromosome 8
  Distance between a terminus base of telomere on chromosomal short arm and 5'-terminus of this base sequence : 112786420
  Distance between 3'-terminus of neighbour sequence of sequence listing upward to telomere on chrosomal short arm and 5'-terminus of this base sequence : 126208
agaaggaaggaaggaaggaaggaaggaaagaaagaaagaaagaaagaaagaaagaaagaaagaaagaaagaaagaaagaaagggaaagaaggaaaaatatatttttcccctactacctctgtgaggaggatttctaagatgttagaagattttatttttaatcctctttccctgtgtgtcatcacctggaattatctgtgtgtttgtctgtctgtgtc

SEQ ID NO: 14354 - DNA, 237 bp, Homo sapiens
  AC068954.2_74239
  Located on chromosome 8
  Distance between a terminus base of telomere on chromosomal short arm and 5'-terminus of this base sequence : 112954652
  Distance between 3'-terminus of neighbour sequence of sequence listing upward to telomere on chrosomal short arm and 5'-terminus of this base sequence : 168014
gaggctcaaatatttctaaacaggtagaaaagagaaaaagcattgctatatttgaagattattttttattcaacaccagcttttacaccagaaaaatagaactgcagtcatacttcctatgtaccatagagctggtgtgtgtgtgtgtgtgtgtgtgtgtgtgtgtgtgtgtgtgtgtagagagagacagagaaatttagcttctatttttattggtaaattggatgaagctacaaa

SEQ ID NO: 14355 - DNA, 476 bp, Homo sapiens
  chr8.fa.O7frz.119851935
  Located on chromosome 8
  Distance between a terminus base of telomere on chromosomal short arm and 5'-terminus of this base sequence : 113101924
  Distance between 3'-terminus of neighbour sequence of sequence listing upward to telomere on chrosomal short arm and 5'-terminus of this base sequence : 147035
gcttaattcaaacctgacttaagcctggagtccctaaacccaataacaactgccctgtgggagacccccaacatttaaaataatgatttggaactctctggaggaagatacatataaataaggacagagtagagaagattgcccttcttcctgaagcgtatcctgtaactccacccccaaaaaacaacaacaacaacaacaacaacaacaacaacaacaacaacaaaacactaggatacagggagaagaaacaaaaattgaaataaagatccacaactggactcaattgaaaatacaaatttttctaaaatagttattcaacagaaagataaaataacagaattggatttcacatctccacaatatgggttttaaatgaacagattctgatatgtagtacttgaaaaatctttgtggtcttcatagatactgggcctcaaattacagttatatgaggagataccactgaatgtaca

SEQ ID NO: 14356 - DNA, 275 bp, Homo sapiens
  D8S1698
  Located on chromosome 8
  Distance between a terminus base of telomere on chromosomal short arm and 5'-terminus of this base sequence : 113147539
  Distance between 3'-terminus of neighbour sequence of sequence listing upward to telomere on chrosomal short arm and 5'-terminus of this base sequence : 45139
ccagaaaccataataggtgctggaaatgcaaaggtaagcaaagcagacagaagcctgctctgtatatgctaatagttggtgagaaagatattaattagtagaatttaactagttgaagcaaggggtgtgtgtgtgggtgtgtgtgtgtgtgtgtgttttctggagatgaatgatagccctagtgagagagaggagggatcgaaaagagcaaaaatcaggggctaaatcagacaggattgtacaagttatactcaggatttcatttattttaagct

SEQ ID NO: 14357 - DNA, 270 bp, Homo sapiens
  Z67630
  Located on chromosome 8
  Distance between a terminus base of telomere on chromosomal short arm and 5'-terminus of this base sequence : 113253773
  Distance between 3'-terminus of neighbour sequence of sequence listing upward to telomere on chrosomal short arm and 5'-terminus of this base sequence : 105959
aaaaagcctatgccaagcattagtaagtttcagaatttcaactgatggcaactgctgattttggataatactcagttcactggtctagagattgatggtgcggactataaaatgtaatatggagccacattagcctgtcctaaatgtactcaagagagacaggtcaacagagggaaaagggatttaatttagttgttacgggtgtttgtgtgtatatgtgtgtgtgtgtgtgtgtgtgtgtttactttcacttgaggtaatgaaggattc

SEQ ID NO: 14358 - DNA, 218 bp, Homo sapiens
  D8S1139
  Located on chromosome 8
  Distance between a terminus base of telomere on chromosomal short arm and 5'-terminus of this base sequence : 113623454
  Distance between 3'-terminus of neighbour sequence of sequence listing upward to telomere on chrosomal short arm and 5'-terminus of this base sequence : 369411
ggtactgaggatgaagaactgcatcagatgaacgtatgccactgtgatttagatatctgaaacatcagtaatccagggtgagaattataaaaataaattatatatgcagtatgtagttttatctatctatctatctatctatctatctatctatcatctatcttatcagttctgtttctgtacagaacccagaatattacagattttggcatgaagaa

SEQ ID NO: 14359 - DNA, 193 bp, Homo sapiens
  G10156
  Located on chromosome 8
  Distance between a terminus base of telomere on chromosomal short arm and 5'-terminus of this base sequence : 113623479
  Distance between 3'-terminus of neighbour sequence of sequence listing upward to telomere on chrosomal short arm and 5'-terminus of this base sequence : -193
agatgaacgtatgccactgtgatttagatatctgaaacatcagtaatccagggtgagaattataaaaataaattatatatgcagtatgtagttttatctatctatctatctatctatctatctatctatcatctatcttatcagttctgtttctgtacagaacccagaatattacagattttggcatgaagaa

SEQ ID NO: 14360 - DNA, 475 bp, Homo sapiens
  AP002846.1_13057
  Located on chromosome 8
  Distance between a terminus base of telomere on chromosomal short arm and 5'-terminus of this base sequence : 113663145
  Distance between 3'-terminus of neighbour sequence of sequence listing upward to telomere on chrosomal short arm and 5'-terminus of this base sequence : 39473
tgtagtgagcctgaagatctaaattgcacacgtataaaggctgtctcttctatatactatgaaggatactctataatatgagtactttattcttgagaggtttcataataaatgaagaattcatgaaattcatttttctctgacaaaggctggctttcaagcctgtcttctcaactcaactcaactcaactcaaaatcacactttgataggcaaagcttgaactatttcattctctcttcagtgttttatatgaacaattcctgttctaatgcctatgtgtgtgtatatatatgtatatatatatatatatatatgcataaaggatgatagtaatatgcataataatgcaagagaaaagtatcacaaaacaaaacaatttaattttaaatatttgtaatttagacttttaactacttcaccttgaatattcctatttatcttttaggacttatgtaaggtgtctatccttggact

SEQ ID NO: 14361 - DNA, 415 bp, Homo sapiens
  AP002846.1_36642
  Located on chromosome 8
  Distance between a terminus base of telomere on chromosomal short arm and 5'-terminus of this base sequence : 113686495
  Distance between 3'-terminus of neighbour sequence of sequence listing upward to telomere on chrosomal short arm and 5'-terminus of this base sequence : 22875
ctatcacctcagaggttaggattttaacatataaatttgaggggatagacacaaacattcagaccttagcatgcagttaaaaattatgttgacaagatacatctcatgttatctgttcttaccacaataataatttaaaagccccccccatcaaaaggttatttgagcaatttaggcaatatagataaatgatagatagatgatagatagatagatagagagaagatagatagatagatagatagatagataacacaaaaagttgatcctaaattgtagtgggttaaggattgaataagaattaaaattagagaaaccagtggaaaatgttaagtatattgtgaaatagaagaaaactgttgaagagtggtcttcaagcaaagaaagagcaatagaattaataggcttgacagaa

SEQ ID NO: 14362 - DNA, 199 bp, Homo sapiens
  D8S1779
  Located on chromosome 8
  Distance between a terminus base of telomere on chromosomal short arm and 5'-terminus of this base sequence : 113697721
  Distance between 3'-terminus of neighbour sequence of sequence listing upward to telomere on chrosomal short arm and 5'-terminus of this base sequence : 10811
acctccaaaaggactgaaaatgaaaatagtttataaatgtttcctatagtgtaagaaggagaatttttattttttctaagcccttcagtatttgttaccgcgtgtgtgtgtgtgtgtgtgtgtgtgtgtgtgtgtgtgtacagagatagggtctccctctgtcacccatgctggagtgcagtggtgcagtcatggctca

SEQ ID NO: 14363 - DNA, 275 bp, Homo sapiens
  AP002846.1_99956
  Located on chromosome 8
  Distance between a terminus base of telomere on chromosomal short arm and 5'-terminus of this base sequence : 113752361
  Distance between 3'-terminus of neighbour sequence of sequence listing upward to telomere on chrosomal short arm and 5'-terminus of this base sequence : 54441
cttatgctttgcctagaattaagctgacacaagcagcacagttaatagaagttactggagttgcaattcttgataggtaggtaggtaggtaggtaggtaggtaggtaggtaggtaggtaggtaggaaatacatgtttggtgtccatcaaataggagagcaaatttggagaaatagaagcttctcaactttgaggggaagtaaaatatctcatggaaaactgatagctgattttttagaagctgtacaactgtcctgtcagatcagtaaccatttg

SEQ ID NO: 14364 - DNA, 198 bp, Homo sapiens
  D8S539
  Located on chromosome 8
  Distance between a terminus base of telomere on chromosomal short arm and 5'-terminus of this base sequence : 113810544
  Distance between 3'-terminus of neighbour sequence of sequence listing upward to telomere on chrosomal short arm and 5'-terminus of this base sequence : 57908
cacctggcataagtttctactcaaacagtattccatacaaggcctattctgcttaatatctctaaactttagtttcttaagtattacctttacataccccacacacacacacacacacacacacacacacacacacacacagaccattgtttattgtctgttttcctcattagaatgtcacattgatgaaagcaagaa

SEQ ID NO: 14365 - DNA, 475 bp, Homo sapiens
  AC027189.2_40270
  Located on chromosome 8
  Distance between a terminus base of telomere on chromosomal short arm and 5'-terminus of this base sequence : 113929677
  Distance between 3'-terminus of neighbour sequence of sequence listing upward to telomere on chrosomal short arm and 5'-terminus of this base sequence : 118935
tacttcggctttacatatttgtacctattgaaaaaacaaaccctatcttgtattcattccaaaaaatgcaaatgttatacatgaatctttctaataccctactttttctacaccaatgagaatggagatttttcctctttctctatgtttcaatcacattctaaaccatcctaactgtaaaaggtattacattccatcttctctttacctcatccttgctatttcacaaacacaaattaaatgactattatactttagatacatgatagattatgatagatagatagatagatagatagatagatagatagatagataatcttcacccatgtctttcaagtaaacagtctaatagctatttaaaaaataaccagagcaatgtgatatgtttaatagaggatacagtataactaggaaaacacagctgtggaaccccttagatttgcttacacaaaccaggaagactttctagttg

SEQ ID NO: 14366 - DNA, 425 bp, Homo sapiens
  AC069181.2_92085
  Located on chromosome 8
  Distance between a terminus base of telomere on chromosomal short arm and 5'-terminus of this base sequence : 114101570
  Distance between 3'-terminus of neighbour sequence of sequence listing upward to telomere on chrosomal short arm and 5'-terminus of this base sequence : 171418
gaataggctaagcatagtggttcacgtctgcaatcccagcattttgggaggctgaggaaggtggatcacatgagccaaggagttggagaccagcttgggaaacatggcaaaatctcacctaaataaataaataaataaataaataaataaataaataaataaataaagttagccaggcctggtggcacatgcccatagtcctagatattcgggaggctgaggtgggaggatcactggaaccagggaggttgaggctgtaagtgagcctttatcgggccacttcagtccagcctgggtgacagaaagagattttgtctcaaaagagagagagagagagagagagacagagacagagagagagagatggtttgtttgtattgtatttaggtagggttaagagagtacctcaaacccattagtttact

SEQ ID NO: 14367 - DNA, 177 bp, Homo sapiens
  D8S555
  Located on chromosome 8
  Distance between a terminus base of telomere on chromosomal short arm and 5'-terminus of this base sequence : 114223233
  Distance between 3'-terminus of neighbour sequence of sequence listing upward to telomere on chrosomal short arm and 5'-terminus of this base sequence : 121238
ggcaaagttcagaggcagccagtagaaaacacttcaagatggattcaaagccaaagactatttaatacacacacacacacacacacacacacacacacatacacacacacgtgtcatgccgaggaaaataagaaactatcaatactttacgaacagcattgaaatatggaaccctcc

SEQ ID NO: 14368 - DNA, 389 bp, Homo sapiens
  HUMUT5117B
  Located on chromosome 8
  Distance between a terminus base of telomere on chromosomal short arm and 5'-terminus of this base sequence : 114258675
  Distance between 3'-terminus of neighbour sequence of sequence listing upward to telomere on chrosomal short arm and 5'-terminus of this base sequence : 35265
ccagccttgtgacagagcaaaaccctgtgaaagaaagaaagaaagaaagaaagaaagaaagaaagaaagaaagaaagaaagaaagaaagagaagggagggagggaggaagaaaggaaggaaggaaaagaaagaaagaaaagaaagaaaaataaagaaagaaaaagagaaagaagaggagaaagataggaaggaaggaaggaaggatggaaggaaggaagagagggagaccaaaatgctgtgaaggggaaagaaagctatttgtcaaatagcctctcattgaacagttacacgtgtaatcattttttgtcaggaaaatattatgtgagcttatgagatatcactgattatcaagcagaggatagtgctttctggctgcctctccatatac

SEQ ID NO: 14369 - DNA, 332 bp, Homo sapiens
  chr8.fa.O7frz.121234386
  Located on chromosome 8
  Distance between a terminus base of telomere on chromosomal short arm and 5'-terminus of this base sequence : 114317671
  Distance between 3'-terminus of neighbour sequence of sequence listing upward to telomere on chrosomal short arm and 5'-terminus of this base sequence : 58607
ttgatagctataacaaacttggagtatttgggataaatgtagtatttcttcaagtacatgctattgtgttctactaggttgtttattttttctgctaagtttatcattgctatgacttttgatctttttggatgtagaattagtaaagactcatcacaagttatttatttaaggtcaatttaaaaaaattatgaccgagagagaggtgagagcattgatgaagattctcaattagaagacagacagagagagacagagagagagagagagagagagagagagagaaatacatctgtgtctttagtaacttacaattactgagattgagtcaa

SEQ ID NO: 14370 - DNA, 133 bp, Homo sapiens
  DISD22_0005958
  Located on chromosome 8
  Distance between a terminus base of telomere on chromosomal short arm and 5'-terminus of this base sequence : 114462356
  Distance between 3'-terminus of neighbour sequence of sequence listing upward to telomere on chrosomal short arm and 5'-terminus of this base sequence : 144353
ttaagcctatacggttaaactgtcatttttaagacatggttgggataaagaataaaccaaattcatacacacacacacacacacacacacacacacacagaaacacaaagacaaactgtagttaccagaggat

SEQ ID NO: 14371 - DNA, 231 bp, Homo sapiens
  chr8.fa.O7frz.121484544
  Located on chromosome 8
  Distance between a terminus base of telomere on chromosomal short arm and 5'-terminus of this base sequence : 114570101
  Distance between 3'-terminus of neighbour sequence of sequence listing upward to telomere on chrosomal short arm and 5'-terminus of this base sequence : 107612
aagtcctgaccttctgaactacctgcattggcctcccaaagtgatgggactacaggcgttagtcactgtgcctggcccctctctctctctctctctctctctctctctctctctctctctctctctctatatatatatatatatatatatatatatatatatatgtatattttttttaaggagagaatggtggacagaactctgatcaccatctccatggctgcaatgtct

SEQ ID NO: 14372 - DNA, 352 bp, Homo sapiens
  D8S1142
  Located on chromosome 8
  Distance between a terminus base of telomere on chromosomal short arm and 5'-terminus of this base sequence : 114644501
  Distance between 3'-terminus of neighbour sequence of sequence listing upward to telomere on chrosomal short arm and 5'-terminus of this base sequence : 74169
tttgcttctcctcaacacctaaataatcattattattacattatatctttttacattctctatatataccgaacattatattatgtagtatttattatttttgcaactattaaaatgtacagtgtaaaaatgtacagtcttattttttgcttattttattcattattatattgcccaatcatgcccacattgtgacatgtatcaggcgtagattggtggatggatggatagatacatagatagatagatagatagatagatagatagatagatagatagaaatatatagatatatactattgtttgcttttgctttttctctttttaaaatatgtatcagccttttgttttc

SEQ ID NO: 14373 - DNA, 158 bp, Homo sapiens
  DISO7_10002612
  Located on chromosome 8
  Distance between a terminus base of telomere on chromosomal short arm and 5'-terminus of this base sequence : 114694071
  Distance between 3'-terminus of neighbour sequence of sequence listing upward to telomere on chrosomal short arm and 5'-terminus of this base sequence : 49218
cctgaagtagcctaacaatttgagcaaaaataaataaatatcatagtacttgattataacccataaaacaaaaaacacatgtgtgtttgtgtgtgtgtgtgtgtgtgtgtgtatgtgtgtgtactacaaagggaaagacagtaactttgcagtggaga

SEQ ID NO: 14374 - DNA, 150 bp, Homo sapiens
  DISO7_11615100
  Located on chromosome 8
  Distance between a terminus base of telomere on chromosomal short arm and 5'-terminus of this base sequence : 114862184
  Distance between 3'-terminus of neighbour sequence of sequence listing upward to telomere on chrosomal short arm and 5'-terminus of this base sequence : 167955
ttcccctaaggcctcttacaactttaaaccactcattgaaactaaatgttcaggattttgccgacagagagaaagagagagagagagagagagaaacttggcagtgaaagaagggaaaaataagagaagatggaagaagagtgagacgga

SEQ ID NO: 14375 - DNA, 335 bp, Homo sapiens
  AC025881.3_65054
  Located on chromosome 8
  Distance between a terminus base of telomere on chromosomal short arm and 5'-terminus of this base sequence : 115173464
  Distance between 3'-terminus of neighbour sequence of sequence listing upward to telomere on chrosomal short arm and 5'-terminus of this base sequence : 311130
attcagtggaagttatctggtttattaagtctgttttattcaactacagtatcatccctagttagaagacaagtgatcctcaaatgtatggtgtataaatgagtgatgatgatgatgatgatgatgatgatgatgatgattttatgcctaacactcaagtggctccgatgttgtagatttattttgtgtctttttttgtttagtaaaggctcaattttaaatttcttttctgtttaaatgttttttgcgtatacaaagttaaatgtaaagttattttgttatagcttaaaaactaatcttctgggatattaattaggattgaattcagtccatag

SEQ ID NO: 14376 - DNA, 459 bp, Homo sapiens
  AC025881.3_25109
  Located on chromosome 8
  Distance between a terminus base of telomere on chromosomal short arm and 5'-terminus of this base sequence : 115181907
  Distance between 3'-terminus of neighbour sequence of sequence listing upward to telomere on chrosomal short arm and 5'-terminus of this base sequence : 8108
  misc_feature (1)...(459): n = A,T,G or C
ctccttgaatcgacatttaaggtatgtgattttctatcccactttttncacccttaatttttgttttgttttgttttgttttgttttgttttgttttgtttgagacagattattgctctgttgccaggctggagtgcaatggcgtgatctcggctccctgcaacctccatggctcaagcgattctcctacctcagcctcctgaatatctgggattacaggcatgcgccaccactcccagctgatttttgtatttttagtagagacggggtttcaccatgttgtccctgctggtcttggactcctgacctcaggtggtccaccggcctcggcctccccaagaactgggactacaggcgtgagccatcgcgccntggccttaactttcttgtatggcttccacttcattatttttgtacccagtgtgggtngaggatctttcaacattgaggatctaactg

SEQ ID NO: 14377 - DNA, 313 bp, Homo sapiens
  AC025881.3_50887
  Located on chromosome 8
  Distance between a terminus base of telomere on chromosomal short arm and 5'-terminus of this base sequence : 115208135
  Distance between 3'-terminus of neighbour sequence of sequence listing upward to telomere on chrosomal short arm and 5'-terminus of this base sequence : 25769
aaacctcatagctttattgctgaattctgccaaccacttaaagaaatagtaccaatcctacttcaactattccacaaaacagaggaggagggaatgcttccaacctcattctatgaagccagtattgcgctgataccaaaaccagaaaaagacatttcagaagaagaaagaagaagaagaagaagaagaagaagaagaggaagaggaagaggaagaagaagaagaagaagaagacgactacaggccaataccttttataaatattgaggcaaaagtcctcaacaaaacactagcaaactcaattcaacaatac

SEQ ID NO: 14378 - DNA, 437 bp, Homo sapiens
  AC025881.3_8865
  Located on chromosome 8
  Distance between a terminus base of telomere on chromosomal short arm and 5'-terminus of this base sequence : 115213496
  Distance between 3'-terminus of neighbour sequence of sequence listing upward to telomere on chrosomal short arm and 5'-terminus of this base sequence : 5048
tagtgcaaggttagatgctaagcacagttacaaattgggttcccaaaaagcaactctgagacccatgcacatgcaggaagtttacttcttactacttaccaagaaaactactcttggtaaccacacctgtgaaaagttgaggagctaaaagaagtaaaaaacagggtattagggttcttcagagaaacagaaccagaaccaataggagatggacggatggatggatggatggatggaagaatggatagatggatggatggatagatggatggatggatggataatagttagatagatagatagatagatagatagatagatagatagacatagagatttattataattttatgtagactgacaagtcctgagatctatagctggcaagctggagacccaggacaactgattgtataattccagtcttaatgtagcag

SEQ ID NO: 14379 - DNA, 101 bp, Homo sapiens
  DISD22_0005977
  Located on chromosome 8
  Distance between a terminus base of telomere on chromosomal short arm and 5'-terminus of this base sequence : 115396589
  Distance between 3'-terminus of neighbour sequence of sequence listing upward to telomere on chrosomal short arm and 5'-terminus of this base sequence : 182656
agccatgtgcttgtttaggagtcgaagaagacagagtgcattattattattattattattattattattattattatttctgagtcaaagtagacagcgtt

SEQ ID NO: 14380 - DNA, 148 bp, Homo sapiens
  DISD22_0006059
  Located on chromosome 8
  Distance between a terminus base of telomere on chromosomal short arm and 5'-terminus of this base sequence : 115587796
  Distance between 3'-terminus of neighbour sequence of sequence listing upward to telomere on chrosomal short arm and 5'-terminus of this base sequence : 191106
aacttcccagttcaactaattattctattttccatctttaattttctagtgtctgttctctgatctacagacagacagacagacagacacacgcacacacacacacacacacatttctccacttaaataacaagcaaaccatgcattc

SEQ ID NO: 14381 - DNA, 192 bp, Homo sapiens
  G09582
  Located on chromosome 8
  Distance between a terminus base of telomere on chromosomal short arm and 5'-terminus of this base sequence : 115658794
  Distance between 3'-terminus of neighbour sequence of sequence listing upward to telomere on chrosomal short arm and 5'-terminus of this base sequence : 70850
tgcagaggatttttcacctctctctctcacaaactctatttctgtctctatagagagaggtgatggataggtagatagatagatagatagatagatagatagatagatagatagatatagatagatagatagatccagttatcttatagttaaataattctctcagtattagctgaatgcaagctaagaaga

SEQ ID NO: 14382 - DNA, 354 bp, Homo sapiens
  chr8.fa.O7frz.122734367
  Located on chromosome 8
  Distance between a terminus base of telomere on chromosomal short arm and 5'-terminus of this base sequence : 115738271
  Distance between 3'-terminus of neighbour sequence of sequence listing upward to telomere on chrosomal short arm and 5'-terminus of this base sequence : 79285
acaaagctgtaagaatcaatacagtatgtactgacacaaggattgagcaataaaacaatggaaaaagtaggatttcaacatgtatttatatgtattatttataacaaaagtaacaaagtggtgtagtctctctctctctctctctctctctcaaactcctgaccagcccagaagctcatttgtcatgacccataaatctatatgtagtacaacattggaacacttcttattctgtacacactggatggcaaagtgtgccacctgaagttctggaagttctgctgagtgagatgattattccttactaatgtcttgtatggccacccctgagtaaggctgtactgcaattactat

SEQ ID NO: 14383 - DNA, 475 bp, Homo sapiens
  chr8.fa.O7frz.122880741
  Located on chromosome 8
  Distance between a terminus base of telomere on chromosomal short arm and 5'-terminus of this base sequence : 115957126
  Distance between 3'-terminus of neighbour sequence of sequence listing upward to telomere on chrosomal short arm and 5'-terminus of this base sequence : 218501
gaacatcttaatgaaagtatccacctttgttcctctgtctccagtaatcacaaggcttggcatgtagagggttccaaaattgaatgtgatcttctgactacaattgttttttcttaactgtccttggaatcagtctctttccagccaccttattctgaacacttcatcctgtggctgtgtgaccttaggcaagtcacataatctccctaaatatctatttacttatctaaaaaaagaatcttcaataatctttatgacaatcttaaagattttggtatacattggtaaaatatgaagcactctatatgatgtaaagcactatataaatatccctccttgtatcctcaaatacattacagaacattacacacgcgcagacacacacacacacacacacacatacaaaattaatgtcttaattgaatatataggccaagtcatggtaatccacacaccactctttgaatgtaatctg

SEQ ID NO: 14384 - DNA, 447 bp, Homo sapiens
  AC025479.2_170026
  Located on chromosome 8
  Distance between a terminus base of telomere on chromosomal short arm and 5'-terminus of this base sequence : 115967973
  Distance between 3'-terminus of neighbour sequence of sequence listing upward to telomere on chrosomal short arm and 5'-terminus of this base sequence : 10372
attgagtcttcctatccatgaccatggaatatctttctattgattagttgtaaaaaaaatttttcatcaaacgtttagttttcctcacatagatcttgtgtgtgtgtgtgtgtgtgtgtgtgtgtgtgtgtgtgtgtgtaggctaatacctaaatattttattttagaggttgctaatgtaaatgatattatgtttttaatttcaaattccacatgtttattgctaatatataggaaagtgatggatttttctaatattaaccttgtatccataaaccttgctatatttgcttattagtttcagacagttatttattgttttagattttttacttacaggatcatgacatctacaagcaaagacagttttatttattcttttactatcagtatacctattattttcttttcttctcttattgcattagctaggacattcagtacgat

SEQ ID NO: 14385 - DNA, 426 bp, Homo sapiens
  chr8.fa.O7frz.122975253
  Located on chromosome 8
  Distance between a terminus base of telomere on chromosomal short arm and 5'-terminus of this base sequence : 115997764
  Distance between 3'-terminus of neighbour sequence of sequence listing upward to telomere on chrosomal short arm and 5'-terminus of this base sequence : 29344
gtcctatcaaatttgactgtctacaaagcttgaaatgatcacaatttaccaattatccatctccttttttttgtctgcatgtgtgtgtgtgtgtgtgtgtgtgtgtgtgtgtgtgtcatatattcataacaacaaaaattgtatcattatagaatcaggtattaccctgtccaagaataaaatcaaatgttactctctcttaccttatttttctaataatttatgactgaatgaaaatgagacttagacactgtcaatgtagactcctcccagcatattattactaaataagtctttctgtatacaaggaaaggacttaacggttttttaaataatataatgcattcttaactaagttgcttttggccacagtgattattctgccctcttttggagagaacttaattggaagtaagattatgaacc

SEQ ID NO: 14386 - DNA, 428 bp, Homo sapiens
  AC025479.2_148105
  Located on chromosome 8
  Distance between a terminus base of telomere on chromosomal short arm and 5'-terminus of this base sequence : 116005646
  Distance between 3'-terminus of neighbour sequence of sequence listing upward to telomere on chrosomal short arm and 5'-terminus of this base sequence : 7456
attgtactattccttgcatttaacacagtgtggtgcaaaacacagcacgtagatgaccccaaataaatgtgtggaaaggaataataaaccttttcttagtctgggattcttaaggtagggcagccaacagtcaggagagagttggctctgttgccttgttatattaagttacattgcgttgcattgaattaactgcattatagtgtattatagtatccattcctcatagcctcatagtctttgaatgtccgctgaaatataacaatcagggaagataactctgtgtgtgtgtgtgtggtgtgtggtgtgtgtgtgtgtgtgtgtgtgtctaggtgaaagagagagaaatgataggtgtttattaagagtagccttgagaaagtgaagattagggctaagaagggttgtaacaagtgactgatcacagg

SEQ ID NO: 14387 - DNA, 480 bp, Homo sapiens
  AF284562.2_72408
  Located on chromosome 8
  Distance between a terminus base of telomere on chromosomal short arm and 5'-terminus of this base sequence : 116102672
  Distance between 3'-terminus of neighbour sequence of sequence listing upward to telomere on chrosomal short arm and 5'-terminus of this base sequence : 96598
ttaatattgataacatcttgcgaaaatgtagagtattagccaccattagtattttttgtttaagtgagtgggcttcatgaacagctgccttcacagtcttctcagaccatctgaacttccctttcacagataatccctttttcaacagtgcagaaaatggactacctatacccaaaatagagaatgcagcctgaaacacacacacacacacacacaaacactcacacacacacacacacacacagagaacttcataacagtgctttacaaatatatcttgaaaattaatgcctctgtgattttgctcactctgttgtctctgtttatatatgtgtcaggttctccagagagacagaataggatggatagatagatagataaatggatatggatatagatatagatatagatatagatatggatatagatatagatatagatataaatagatatctccctcagaaaagatttgtcataagg

SEQ ID NO: 14388 - DNA, 241 bp, Homo sapiens
  D8S565
  Located on chromosome 8
  Distance between a terminus base of telomere on chromosomal short arm and 5'-terminus of this base sequence : 116264216
  Distance between 3'-terminus of neighbour sequence of sequence listing upward to telomere on chrosomal short arm and 5'-terminus of this base sequence : 161064
acaaaatgtcccctagagcctccagagggaatgtggcatggtgacacattgaccactattagggttctccagagaaacagaacgataggatggctggagtgatagatgacagacagacatagatagatagatgatagatagatgatagatagatagatagatagatagatagatagatagacagataggtagatagatgggatttatcaggggaagtgcctcatgtaattttggaggctgg

SEQ ID NO: 14389 - DNA, 266 bp, Homo sapiens
  AF178030.1_57532
  Located on chromosome 8
  Distance between a terminus base of telomere on chromosomal short arm and 5'-terminus of this base sequence : 116315018
  Distance between 3'-terminus of neighbour sequence of sequence listing upward to telomere on chrosomal short arm and 5'-terminus of this base sequence : 50561
aaagcagacatgtctcgatactaggattttttttgattcttatacttctaaatgctacaacaaatgagaaatcacacacacacacacacacacacacacacacacacacacacacacattcagctaaggagcccatgcaaataggtggtgagactcaaataagcctttaatcattactcataactctatcttttatttttcttcagttgtgtgtggcagaaaatacaactcacattgtatgactatgaaggaaatcttctgactca

SEQ ID NO: 14390 - DNA, 183 bp, Homo sapiens
  D8S547
  Located on chromosome 8
  Distance between a terminus base of telomere on chromosomal short arm and 5'-terminus of this base sequence : 116329022
  Distance between 3'-terminus of neighbour sequence of sequence listing upward to telomere on chrosomal short arm and 5'-terminus of this base sequence : 13738
ggagatgccaaagtaatatgtgatttaacacacacacacacacacacacacacacacacagacatacacacacagaggaaaatacttggaagaggaaaaaagtgagggaatttcttgcataaacaaattagagtatataggaacgtgatgcaactacacacagtcacatcctgtgcagagcca

SEQ ID NO: 14391 - DNA, 217 bp, Homo sapiens
  AF178030_80858
  Located on chromosome 8
  Distance between a terminus base of telomere on chromosomal short arm and 5'-terminus of this base sequence : 116338320
  Distance between 3'-terminus of neighbour sequence of sequence listing upward to telomere on chrosomal short arm and 5'-terminus of this base sequence : 9115
cagaagaatggtgtgaacccgggaggcggagcttgcagtgagcagagatcgcgccactgcactccagcccaggcaacagagcaagactctgtctcaaataataataataataataataatgatgttaccttttcttttttaaccaagtcatatttaaagacagcttgcagtgcactatcttacattttctgaagttccaattgttgatatttctaag

SEQ ID NO: 14392 - DNA, 379 bp, Homo sapiens
  AF178030.1_96800
  Located on chromosome 8
  Distance between a terminus base of telomere on chromosomal short arm and 5'-terminus of this base sequence : 116354173
  Distance between 3'-terminus of neighbour sequence of sequence listing upward to telomere on chrosomal short arm and 5'-terminus of this base sequence : 15636
aaccaggttcataaaatgcattagtgttattttaaaagaatgccatagcaaaagtcattattttataaacttttcttgccataaaacacacatctagttatgtactggttataaagttataatgaaggtgaataacttctagggatgatggaaggtaattttactatatatttttgaatcacagttatatatatatatatatatatatatatatatatatatatttgttatcaggaacaaaattatactcagacatgcttctttcacattttccttccttgtaaaacctggatcacttgctactgcaattagttgatgccaatttgaaattcttcttggaaactatcataactgtgtaagcacctttaatttactgcac

SEQ ID NO: 14393 - DNA, 451 bp, Homo sapiens
  AF130342.1_72105
  Located on chromosome 8
  Distance between a terminus base of telomere on chromosomal short arm and 5'-terminus of this base sequence : 116606546
  Distance between 3'-terminus of neighbour sequence of sequence listing upward to telomere on chrosomal short arm and 5'-terminus of this base sequence : 251994
atggatacctcatgacctaaacacctcccattatgccccacctcccaacactgttgcattggggattatgtttccaacacatggatttccgggaatcatattcaaaccatagcagtttcacatcttttccaaaccaactaatggcaacaaaaagggttaaacacagtggttcaggctaatggttattaaatctggcagcatataagtattacctgtggaacattaaaatttgttgaggcctgggatccacctccatagattcagatttaatagtttgagggtggagatctatctatctatctatctatctatctatctatctatctatctattatctatctatctatcatctctctctctctctctctctctctctctctctctctctctatctagatcttaaggtagagaagaaagagttgacaaaagaagtagaaataagtggctggag

SEQ ID NO: 14394 - DNA, 355 bp, Homo sapiens
  AF130342.1_72168
  Located on chromosome 8
  Distance between a terminus base of telomere on chromosomal short arm and 5'-terminus of this base sequence : 116606645
  Distance between 3'-terminus of neighbour sequence of sequence listing upward to telomere on chrosomal short arm and 5'-terminus of this base sequence : -352
attcaaaccatagcagtttcacatcttttccaaaccaactaatggcaacaaaaagggttaaacacagtggttcaggctaatggttattaaatctggcagcatataagtattacctgtggaacattaaaatttgttgaggcctgggatccacctccatagattcagatttaatagtttgagggtggagatctatctatctatctatctatctatctatctatctatctatctattatctatctatctatcatctctctctctctctctctctctctctctctctctctctctatctagatcttaaggtagagaagaaagagttgacaaaagaagtagaaataagtggctggagaag

SEQ ID NO: 14395 - DNA, 334 bp, Homo sapiens
  AF130342.1_236358
  Located on chromosome 8
  Distance between a terminus base of telomere on chromosomal short arm and 5'-terminus of this base sequence : 116770817
  Distance between 3'-terminus of neighbour sequence of sequence listing upward to telomere on chrosomal short arm and 5'-terminus of this base sequence : 163817
caatgctttaggtactgaggagctttggtaaagaggagagaagttcattgtcctcttgtattttatatcccttagcaggggcagacagttgaaaaaatatagaactaaataactccaaatagggaaggaaaaaaaatcacaaaaggaaactggtagagagaggctgatacaggagatatgaacttctttagcttgggtcatgcacagaagccacacacacagaagcaggggatattgctgagacacaggagtaaaaagatggccacatacacacacacacacacacacacacacacacacagaagcaggggacactttgctgagactcaggaat

SEQ ID NO: 14396 - DNA, 329 bp, Homo sapiens
  AF130342.1_245214
  Located on chromosome 8
  Distance between a terminus base of telomere on chromosomal short arm and 5'-terminus of this base sequence : 116779911
  Distance between 3'-terminus of neighbour sequence of sequence listing upward to telomere on chrosomal short arm and 5'-terminus of this base sequence : 8760
acaaatctgcagcttctgtattagcagagcgtgtgtgtgtgtgtgtgtgtgtgtgtgtgtgtgtgtgtgtttaaaatgctgagagtacctactttgaaagaatgagaaaagagtaagtggagaatatcaatacccaaagcagaataaggattaatccaaagcatgaaaatataggtcacagctctttccatggcctaagtaccaccggctacatcacttacatccagatattttgggaaaattaccagcaacaagaagtgcttaagtggacagcaaacacatcttgtcttaacaaggtactttgggttccatttacaatctgttgagtt

SEQ ID NO: 14397 - DNA, 354 bp, Homo sapiens
  AF130342.1_304930
  Located on chromosome 8
  Distance between a terminus base of telomere on chromosomal short arm and 5'-terminus of this base sequence : 116839593
  Distance between 3'-terminus of neighbour sequence of sequence listing upward to telomere on chrosomal short arm and 5'-terminus of this base sequence : 59353
acatgttgcatctctgttaaatgggtttccgccattctttctgggaactcactggtctctctctctccctccctccctccctccctccctccctccctctctctctctctctctctctctctctctctcgtctctctctctctctcactctccagagcctattgttgccacattcactgagttcctctctttcattctctaacatttaatctgtttatactcaatctgtttaccttcacccttaaatgtagtttctctttttacatagaacactttgctattcccactcacataacctagtacaaaaatttactaaaagaaaagaaaagatagtttcttgcctatccatagaag

SEQ ID NO: 14398 - DNA, 436 bp, Homo sapiens
  chr8.fa.O7frz.123909384
  Located on chromosome 8
  Distance between a terminus base of telomere on chromosomal short arm and 5'-terminus of this base sequence : 116869560
  Distance between 3'-terminus of neighbour sequence of sequence listing upward to telomere on chrosomal short arm and 5'-terminus of this base sequence : 29613
agttcatctactcttagagtccaatctattttctaaaaaatgtccctcgcttaaaaagatgacaaaagttcaagagttccttagttattacttgtttgctgcaactctcatttcctaaaaattattctatcattttttgactgtgaaatagtatatgcaatgttgtgtgtacaagtttcttttttaaaaaaaggagtgccagaaagagaaaaagaaagagtgagagagagaaaaaagagagagagagattgagaaagagaggagggaaggaaggaaggaaggaaggaaggaaggaaggaaggaaggaaggaaggaaggaaggaaggaaggaaagaaagaaaggagggagggagggaggggaggggagggagaaagaatccttctgtttcagggtaccaacaaagtcaagttaaagtgataaacaccatactggatg

SEQ ID NO: 14399 - DNA, 195 bp, Homo sapiens
  DISO7_10002619
  Located on chromosome 8
  Distance between a terminus base of telomere on chromosomal short arm and 5'-terminus of this base sequence : 116994354
  Distance between 3'-terminus of neighbour sequence of sequence listing upward to telomere on chrosomal short arm and 5'-terminus of this base sequence : 124358
aatcctgtgtattcatttccactaaagacaaggcaaaaagacaatgagaactgatatttttatatatatatatatatatatatatatatatatatatatatatatatatatatataaactatatatatagtgcacatgtagtttatatatatatataaactatatatatatatagtgcacatgtagttcaaggtc

SEQ ID NO: 14400 - DNA, 243 bp, Homo sapiens
  AF130343.1_191118
  Located on chromosome 8
  Distance between a terminus base of telomere on chromosomal short arm and 5'-terminus of this base sequence : 117146222
  Distance between 3'-terminus of neighbour sequence of sequence listing upward to telomere on chrosomal short arm and 5'-terminus of this base sequence : 151673
aatgacataggaatttgtggttagggagagtaagaattctgcagaaaaagagaaaattttgctacctaatattttacaaacatgtttaaagtttcatctttcgcaagtttgataccacctgccctccttcatgctcaccacgtggtgaagcacacacacacacacacacacacacacacacacattcacagagacccatttgttttcggagggtcacagtctccatctttataatgctctgct

SEQ ID NO: 14401 - DNA, 468 bp, Homo sapiens
  chr8.fa.O7frz.124684124
  Located on chromosome 8
  Distance between a terminus base of telomere on chromosomal short arm and 5'-terminus of this base sequence : 117263371
  Distance between 3'-terminus of neighbour sequence of sequence listing upward to telomere on chrosomal short arm and 5'-terminus of this base sequence : 116906
cattatgtttctaggatcacgtgtgatgtgtttcccacacttacagcacctctatatgtctcccataaagttacgtataaggtgttttgctaactgtaggatacatatttgtatctttttatatgcattcatattatttattcatagattcctcagataataaattggcaagcgttttattttcctcattcttataggtttgcattatagtatgttcccctttggcaaaggtttcataattacagatcctcaaaggtgtaatcagaatatatgtgtgtatgtgtgtgtgtgtgtgtgtgtgtgtgtacacagtcaggcattgcttaacaacaggaatgcattctgagaaatgagtcgttaggcaattttgtcattgtgcaaacatcatagggtgtacttatacaaacctgtattgtataccctgctacaaacctaggccgtatggtatagcctattgctcctgtatta

SEQ ID NO: 14402 - DNA, 277 bp, Homo sapiens
  chr8.fa.O7frz.124608450
  Located on chromosome 8
  Distance between a terminus base of telomere on chromosomal short arm and 5'-terminus of this base sequence : 117283030
  Distance between 3'-terminus of neighbour sequence of sequence listing upward to telomere on chrosomal short arm and 5'-terminus of this base sequence : 19191
gaatcaggtgatgtattgtacatcatctctccatttgccctcttgctaatttattttcacgtttctaccatatcttctagcttgtgtgtgtgtgtgtgtgtgtgtgtgtttgttcgtttttacaatttccccatttaacttctcaccaaattttaactttctgcagtgaatttcaagaccatctaggtatctgccatatttgcctggcatccactagaatattctcttcatgcttatattatttccttatccactactttgtcattcaactttcaac

SEQ ID NO: 14403 - DNA, 115 bp, Homo sapiens
  DISO7_10002622
  Located on chromosome 8
  Distance between a terminus base of telomere on chromosomal short arm and 5'-terminus of this base sequence : 117427866
  Distance between 3'-terminus of neighbour sequence of sequence listing upward to telomere on chrosomal short arm and 5'-terminus of this base sequence : 144559
gcactaattattctggcaagagaaattaaaaaaaaaaaaaacacagacacacacacacacacacacacacacacacacacacacacacacacacactggctccattcctatctgg

SEQ ID NO: 14404 - DNA, 321 bp, Homo sapiens
  chr8.fa.O7frz.125159184
  Located on chromosome 8
  Distance between a terminus base of telomere on chromosomal short arm and 5'-terminus of this base sequence : 117454585
  Distance between 3'-terminus of neighbour sequence of sequence listing upward to telomere on chrosomal short arm and 5'-terminus of this base sequence : 26604
aggctttcttatcaatctaaagagggatcttatcccaaattatgaagtcacacacacacacatacacacacacacacacacacacacaaaatgatacttcagggaaaataagtaaattgggttttaatgttgacacttgataaaattttatgaactgtggattaagaataagaattcttgcatggagacttttttctggagatgaaaatggtcctaaagtttggttatgccaagcctggacagaaacacagggggagtttgtttccaccataccatgcaatcacataattgctcttggttcacataatctgaagagtagga

SEQ ID NO: 14405 - DNA, 309 bp, Homo sapiens
  chr8.fa.O7frz.125262887
  Located on chromosome 8
  Distance between a terminus base of telomere on chromosomal short arm and 5'-terminus of this base sequence : 117785334
  Distance between 3'-terminus of neighbour sequence of sequence listing upward to telomere on chrosomal short arm and 5'-terminus of this base sequence : 330428
aatgccacttagactaattaacacaacctttggtgtagataccaataagaatagtttaagtaccaagtaatctactcttaaaatgttgattcttcttaggatatttcagtgctaattaattgtccagaggatgtggattagggataatgtgcattatgctatcaagggcaagctcatatgcgtgtaggcacacacacacacacacacacacacacacacacatcaccccccaaaatgtttacattgaagcaatttaaagtaaattatcacacagactacagaatagtctcagcaaacagtaactaccag

SEQ ID NO: 14406 - DNA, 101 bp, Homo sapiens
  DISO7_10018635
  Located on chromosome 8
  Distance between a terminus base of telomere on chromosomal short arm and 5'-terminus of this base sequence : 118021940
  Distance between 3'-terminus of neighbour sequence of sequence listing upward to telomere on chrosomal short arm and 5'-terminus of this base sequence : 236297
actgtgtactcttgcctctcccataaaacacacacacacacacacacacacacacacactcacacatgaacacatcgtatacaattccaatggaccttatg

SEQ ID NO: 14407 - DNA, 278 bp, Homo sapiens
  HUMUT1382
  Located on chromosome 8
  Distance between a terminus base of telomere on chromosomal short arm and 5'-terminus of this base sequence : 118137990
  Distance between 3'-terminus of neighbour sequence of sequence listing upward to telomere on chrosomal short arm and 5'-terminus of this base sequence : 115949
cccccatgacacgttctcccatgtaacaaatctacacatcctgcacatgtacccctgaactatctatctatctatctatctatctatctatctatctatctatctatctatgtatctatcttccatctatctacccacctacccaaaactcttaagtggaaggcatgaaaggaaggaaagaaggccgcctttgttgtcaaatctggatgtcttcatttgccccctccatctgctctccacctttctctcccctgcctttgcatcaacagccatccttg

SEQ ID NO: 14408 - DNA, 244 bp, Homo sapiens
  D8S1694
  Located on chromosome 8
  Distance between a terminus base of telomere on chromosomal short arm and 5'-terminus of this base sequence : 118256644
  Distance between 3'-terminus of neighbour sequence of sequence listing upward to telomere on chrosomal short arm and 5'-terminus of this base sequence : 118376
tgaccagcacaccactaaatttatgtatgtatgtatgtgtgtacacacatatacattatgtacacatatacacatagatatacatatatggtatatgtgtatattaagagagagagtatattaaactaagagagagactaagttacttttattaaacatctttcctatgtctcaatctccaaacacacacacacacacacacacacacacacacacaatcatcaggaatgagaattttgaagca

SEQ ID NO: 14409 - DNA, 119 bp, Homo sapiens
  Z67216
  Located on chromosome 8
  Distance between a terminus base of telomere on chromosomal short arm and 5'-terminus of this base sequence : 118285776
  Distance between 3'-terminus of neighbour sequence of sequence listing upward to telomere on chrosomal short arm and 5'-terminus of this base sequence : 28888
agaggttccctgctccaaagtgtttaccctgttacacacacacacacacacacacacacacacacacacacacacacacacacatcttaaccccttatatttactatcaggggcacacg

SEQ ID NO: 14410 - DNA, 153 bp, Homo sapiens
  D8S592
  Located on chromosome 8
  Distance between a terminus base of telomere on chromosomal short arm and 5'-terminus of this base sequence : 118368482
  Distance between 3'-terminus of neighbour sequence of sequence listing upward to telomere on chrosomal short arm and 5'-terminus of this base sequence : 82587
tagatagatgatgttgttgttgatgaagatagattagatagatagatagacagatagatagatagatagatagatagatagaataagaactgagttctagaagaaactctagaagaagacaggaacattagccaacaggacatatattcagtc

SEQ ID NO: 14411 - DNA, 306 bp, Homo sapiens
  AC022528.3_49206
  Located on chromosome 8
  Distance between a terminus base of telomere on chromosomal short arm and 5'-terminus of this base sequence : 118427773
  Distance between 3'-terminus of neighbour sequence of sequence listing upward to telomere on chrosomal short arm and 5'-terminus of this base sequence : 59138
cataggtttcactttgagtgagctggagcatgcaaagtgaggaaaaccaacgcaataaatgttgttgttgaagaagaagatagaagatagaggaagaagaaggaggaggagggggagaaaaagatgaagaagaaaaaaagaagaggaggaggaggaggaggagaaggaggaggaggaggaggaggaagaggaggaagaaagtgcagaaggaggaaaactacctacataaggttattgatagaataaaaatgagtgcaaacagttttaaagtgtttttgcacaatgactgccatctggtaaatactt

SEQ ID NO: 14412 - DNA, 460 bp, Homo sapiens
  chr8.fa.O7frz.126098408
  Located on chromosome 8
  Distance between a terminus base of telomere on chromosomal short arm and 5'-terminus of this base sequence : 118490854
  Distance between 3'-terminus of neighbour sequence of sequence listing upward to telomere on chrosomal short arm and 5'-terminus of this base sequence : 62775
cttgctgagttagcaataaagttcactccatatataaatagctcaaaccttgcaggaaaaaatttaaatttgtgcctcagcaaaaagacagatcataacatcaggaacttttaggggttgtgtgactggtaaatatctccaggtttaatatcccaaaccattctaaaggcccactttagatgtggagaagccctgggaagcttatggagggcttgcaatacataacacaccacacacacacacacacacacacacacacacacatacacaaatgcacacattttccctaggtcccaataagtaaagggtagctgggtgcacaaggaagttgttagtttccattatgtatgagagagggaggttcttttttaaaagacaagacacttattatcaatcctaggactgtcagttctgtctccatggctggtaaccttgcctctaggcatctttcctaactgtt

SEQ ID NO: 14413 - DNA, 220 bp, Homo sapiens
  chr8.fa.O7frz.126225430
  Located on chromosome 8
  Distance between a terminus base of telomere on chromosomal short arm and 5'-terminus of this base sequence : 118625777
  Distance between 3'-terminus of neighbour sequence of sequence listing upward to telomere on chrosomal short arm and 5'-terminus of this base sequence : 134463
ctgagcaaactaatacaattcatatagagatatatagtatcattatctctctctctgcctctttcacacacacacacacacacacacacatacaacatacacacacacacacacacagacacatgtgacatttcaaaacatcaaaatatacaaagagcacccataaatctcaaaaaataaaatagaaaaaatgaacaagtgactcaactagacgattcaa

SEQ ID NO: 14414 - DNA, 446 bp, Homo sapiens
  chr8.fa.O7frz.126452292
  Located on chromosome 8
  Distance between a terminus base of telomere on chromosomal short arm and 5'-terminus of this base sequence : 118944066
  Distance between 3'-terminus of neighbour sequence of sequence listing upward to telomere on chrosomal short arm and 5'-terminus of this base sequence : 318069
gtgagtgctttagaaatccagtttttcatttctgaaacctttgatttccctaactttgattcttttcccctttcacttaggaagcagtaagacatagcagtacgattgaaagaaagaaagaaagaaagaaagaaagaaagaaagaaagaaagaggaaatgggagtaattgagattcaaacttttatacagagagaggtaagtcttgagcacatgtatctctaaatcgtcttctgtgctgttgtactcaaaaagtgtgtgtttgtggacagagagaaagacaggcagagagagagaatacgactcagagccatgcttcttaaaacaggaagaatcattaaaattagcaactcagcactaaacagtgagcagaaccacaaggtaaatggtgggtccagattctatcgcagaaaagagtcatttcctgtgactattcatcgtacatcgt

SEQ ID NO: 14415 - DNA, 271 bp, Homo sapiens
  D8S527
  Located on chromosome 8
  Distance between a terminus base of telomere on chromosomal short arm and 5'-terminus of this base sequence : 119078858
  Distance between 3'-terminus of neighbour sequence of sequence listing upward to telomere on chrosomal short arm and 5'-terminus of this base sequence : 134346
tctcccagtgtctccactaccttccccatttagatcctctttgtcttttatttggattgctgcagtgaccctaactgatctgctgtcactgtccttcacctccccagtccatccactacactgcagccaattacctttggaaagagcaaactagatcatgtcaatgcctgcttaagcaaaagtcaaagaatacacacacacaagtgcacacacacacacacacatacacacacatacaataaagaataatgccaaaatctttatcaaggca

SEQ ID NO: 14416 - DNA, 410 bp, Homo sapiens
  chr8.fa.O7frz.126825103
  Located on chromosome 8
  Distance between a terminus base of telomere on chromosomal short arm and 5'-terminus of this base sequence : 119181498
  Distance between 3'-terminus of neighbour sequence of sequence listing upward to telomere on chrosomal short arm and 5'-terminus of this base sequence : 102369
cagttcaaagtgcgtaaagtactaatggggaagaagttcccattttaccatctttaaaataaagataatgattcaaatcttaaaagagtataaaaaactctcttaaatcacatatatgtaaatggccagctcctagcagaacttgataaatgattataaaatgggcaacaggaccttcttaatgtaatatatctgcataagatacacacacacacacacacacacacacacacacacgcacacattctttttagctacggaattcttggttcatagagtcttttaggatactttggattcaagcagatagcaagaattcagtccagaatttagcaactgtaacactcctgttttgctaaacttctgcattcctcatttcctactaggttactaatcgtgagctctacttg

SEQ ID NO: 14417 - DNA, 478 bp, Homo sapiens
  AC023590.2_71156
  Located on chromosome 8
  Distance between a terminus base of telomere on chromosomal short arm and 5'-terminus of this base sequence : 119216950
  Distance between 3'-terminus of neighbour sequence of sequence listing upward to telomere on chrosomal short arm and 5'-terminus of this base sequence : 35042
ataaatggctgcatgctagaatcaggggatcttggtaagcctactaaaatgcattctgtgatacaatggactttgggaacttgcaggaaagggcaggagggggtagggggcgagggataaaagactgcaaatacggtgctgtgtaaactgcttgggtgatgggtgcaccaaaatctcacaaatcaccactaaagaactcactcttataaccaaacaccacctgtaccccaataacctatgaaaaaataaacaatataataataataataaagtaatgtccaaaactgcaaacacacagacacacacacacacacacacacacacacacacacacacacacacatattccagagaccttggatcaaaggcagtgttcacagattcatagaaaaaacaacaatataataatagctacctctatttagttctacttcttggctagtctagactttatttagtcttcattccattatctgag

SEQ ID NO: 14418 - DNA, 458 bp, Homo sapiens
  AC023590.2_134479
  Located on chromosome 8
  Distance between a terminus base of telomere on chromosomal short arm and 5'-terminus of this base sequence : 119291529
  Distance between 3'-terminus of neighbour sequence of sequence listing upward to telomere on chrosomal short arm and 5'-terminus of this base sequence : 74101
tgaccaacatggtgaaatcccgtctctactaaaaatacaaaattagctgggcgtggtggcacatgcctgtaatcccagatactcaggaggctgaggcaggaaaattgcttgaaactgggaggcgaaggttgcagtgaacccagatcgcgccattgcactccagcctgggcaacaagagtgaaactctgtctcaaataaaataaaataaaataaaataaaataaaataaaataaaataaaataaaataaaataaaataaaataataaaataaaataaaataaaataaaataaaataaaaatgaacaaaatgaaaagggggatactaagaatggaagtattatttcagagaaggataaggatagaaggctttattcttgtctggggctcaagactggaccaatggctgcacaactttagagtccattcacagtgtagtctatgcacatggtaccttctag

SEQ ID NO: 14419 - DNA, 213 bp, Homo sapiens
  D8S522
  Located on chromosome 8
  Distance between a terminus base of telomere on chromosomal short arm and 5'-terminus of this base sequence : 119473183
  Distance between 3'-terminus of neighbour sequence of sequence listing upward to telomere on chrosomal short arm and 5'-terminus of this base sequence : 181196
gaaaacaaaacaggctccagtggggtaatagatatatgattccttccctttccaaatttcctaataacttacaatgtgttcataataccctttacactaaaaacacacatacacacacacacacacacacacacacacacacacacacaccccatgtgatgggtaacttaatgtgttaacttggttaagttatggtgtctagttgtttggtca

SEQ ID NO: 14420 - DNA, 365 bp, Homo sapiens
  chr8.fa.O7frz.127213954
  Located on chromosome 8
  Distance between a terminus base of telomere on chromosomal short arm and 5'-terminus of this base sequence : 119749097
  Distance between 3'-terminus of neighbour sequence of sequence listing upward to telomere on chrosomal short arm and 5'-terminus of this base sequence : 275701
ggaagacctttatttgtcttaaactcacttggaacagatctcacatgactaaactgtttaagttattgttatgggttgaattgtgtacctctgaaattcacatattgaagaaaacaccctagtacttcagaatgttattgtttttggaagagatgatctttaaacagataattaaggttagatgaggtcgctggggtcaggtcttaattgaatatgtctggtatccttataagaagagactaggacacacacacacacacacacacacacacacacacagtggaaaaaccatgtgaacacagagaaaagatggctcttagagattgaactgtgctttcccaaaactcataatgttgaagtcctgc

SEQ ID NO: 14421 - DNA, 348 bp, Homo sapiens
  chr8.fa.O7frz.127038638
  Located on chromosome 8
  Distance between a terminus base of telomere on chromosomal short arm and 5'-terminus of this base sequence : 119784485
  Distance between 3'-terminus of neighbour sequence of sequence listing upward to telomere on chrosomal short arm and 5'-terminus of this base sequence : 35023
ctgagtaatctgcaagaaatttactaaaagctttaaatttagatattgattaacttttttcttttctaaattgtattaaccattttcggaacttttgtcttgttttagggattatagtcatgatatatatgatgatcaatagtaataatcaggtacatttatgtaggtatagatatatataaacagagagatagatatataggtggatagatagatagatagatagatagatagatagatagatagatagatctggagaagcacaatgccctgttcattggttctattttccagtttccttagtctttaacaagatcaagtaaaattcacgattctagctatctttga

SEQ ID NO: 14422 - DNA, 118 bp, Homo sapiens
  DISO7_10002633
  Located on chromosome 8
  Distance between a terminus base of telomere on chromosomal short arm and 5'-terminus of this base sequence : 119804206
  Distance between 3'-terminus of neighbour sequence of sequence listing upward to telomere on chrosomal short arm and 5'-terminus of this base sequence : 19373
aattccttatgaggagaaatgtaagggaagagaaaaaagacacacacacacacacacacacacacacacacacacacacacacacacagagctatggggtcaacgactctaggacaaa

SEQ ID NO: 14423 - DNA, 156 bp, Homo sapiens
  chr8.fa.O7frz.127293905
  Located on chromosome 8
  Distance between a terminus base of telomere on chromosomal short arm and 5'-terminus of this base sequence : 119876336
  Distance between 3'-terminus of neighbour sequence of sequence listing upward to telomere on chrosomal short arm and 5'-terminus of this base sequence : 72012
tcattaagcaaagatagtatggactacatgagggcgttaatattctgagatgaagacagaaggttaatgactaaaactttcaaacaagtttctctctctctctctctctccctctctctcgctgtctgtctctctcttgctgtcttccataaagtc

SEQ ID NO: 14424 - DNA, 247 bp, Homo sapiens
  chr8.fa.O7frz.127421283
  Located on chromosome 8
  Distance between a terminus base of telomere on chromosomal short arm and 5'-terminus of this base sequence : 120011754
  Distance between 3'-terminus of neighbour sequence of sequence listing upward to telomere on chrosomal short arm and 5'-terminus of this base sequence : 135262
actttgtactgaaatgagtttgagagagaatattgtatgttacatatacagagtgttgtaaatgtttagatgccaaaagcataaatctgctctgggaaaacgtacacacacacacacacacacacacacacacacaccaaccaggatgttgcaaatctgcatgacagggtaaggtctcataaaggcttccttcccccttgtcctcttccttgtacctctttcatttctagtgactagaaattcctca

SEQ ID NO: 14425 - DNA, 293 bp, Homo sapiens
  AC009514.2_144083
  Located on chromosome 8
  Distance between a terminus base of telomere on chromosomal short arm and 5'-terminus of this base sequence : 120108855
  Distance between 3'-terminus of neighbour sequence of sequence listing upward to telomere on chrosomal short arm and 5'-terminus of this base sequence : 96854
accacaggaatgtatgatcataagtttagtgtgtgtgtgtgtgtgtgtgtgtgtgtgtgtgtgtgtttctgagacggagtttcactcctgttgcccaggctggagcgtagtggcgcaatctcggcccactgcaacctccgcctcccaggttcaactgattctcctgcctcagcctcccgagaaggtgggattataggagtgtgccaccacacccggttaatttttgtgttttcaggagagacaggctttcaccatgttgggcaggctggtctcgaactcctgacctcgtgatc

SEQ ID NO: 14426 - DNA, 265 bp, Homo sapiens
  chr8.fa.O7frz.127620973
  Located on chromosome 8
  Distance between a terminus base of telomere on chromosomal short arm and 5'-terminus of this base sequence : 120200540
  Distance between 3'-terminus of neighbour sequence of sequence listing upward to telomere on chrosomal short arm and 5'-terminus of this base sequence : 91392
ataagctaggtactgtgcaatagataaaacttcataactcaggaatgtgccttggggacctgaatagacagtgatagttttcactgaggtatgctctgtttgtgtgtgtgtgtgtgtgtgtgtgtgtgtgtgtgtgtgtgtgtgtgtgtgtgagataacggggagcagagcagaaaaagaaggaggggaacataataaatttgatctgtaagtcattagcacatttgatttgggaaacatcttgtcaaccataactcctgatctt

SEQ ID NO: 14427 - DNA, 228 bp, Homo sapiens
  X80923.1_1785
  Located on chromosome 8
  Distance between a terminus base of telomere on chromosomal short arm and 5'-terminus of this base sequence : 120362714
  Distance between 3'-terminus of neighbour sequence of sequence listing upward to telomere on chrosomal short arm and 5'-terminus of this base sequence : 161909
aactgtcaaaggtttctggactctcaggtgtgccgtctcacatttggtctgctacagcaggtgcttcaaggctttcttctgccaagatttctttgttttattttatgatgttttctttatgtgtgtgtgtgtgtgtgtgtgtgtgtgtgtgtgtgtgtgttttacttttatttctaacaaacctgtggaccttggggtttaagactgagtgaagctagaaggattaga

SEQ ID NO: 14428 - DNA, 225 bp, Homo sapiens
  D8S1823
  Located on chromosome 8
  Distance between a terminus base of telomere on chromosomal short arm and 5'-terminus of this base sequence : 120437077
  Distance between 3'-terminus of neighbour sequence of sequence listing upward to telomere on chrosomal short arm and 5'-terminus of this base sequence : 74135
tgaagcctcagttccaaaataagaactactccttccccatctttccttagttggctggcccaggcagaacttatttttattcttttttattctttcctacatccaacacccacttgcacatatacacacacacacacacacacacacacacacaggcacatactcacatttttcttctttctctgagaacatctgctgttttagatttatgccatatccttgcag

SEQ ID NO: 14429 - DNA, 409 bp, Homo sapiens
  AC016660.5_55925
  Located on chromosome 8
  Distance between a terminus base of telomere on chromosomal short arm and 5'-terminus of this base sequence : 120532989
  Distance between 3'-terminus of neighbour sequence of sequence listing upward to telomere on chrosomal short arm and 5'-terminus of this base sequence : 95687
tgtagttcaatagaaggcaaacattgggaatatttaaagcaatgtaaaaagtgcccacaataacagagtttttaacattaacaacattttctaaagtcctctataaatattgctacaagcaaagtctcaacaaccgagatcaaatcagcccaatatactaaggcaagctcccatttatacttttgacttactcaagtagtaagaatagagtttagaatgtaaattcaaaggatgaaagagacacacacacacacacacacacacacacacacacagatgcactgacagactgcaaagagacaccacaatgctgagacccagaacatagagatatattgtctcagcactgatggtttatgtagcccacaaaatctttggaaacagtgagatttccaactgatatttcttt

SEQ ID NO: 14430 - DNA, 366 bp, Homo sapiens
  chr8.fa.O7frz.128007291
  Located on chromosome 8
  Distance between a terminus base of telomere on chromosomal short arm and 5'-terminus of this base sequence : 120557525
  Distance between 3'-terminus of neighbour sequence of sequence listing upward to telomere on chrosomal short arm and 5'-terminus of this base sequence : 24127
aaactatggaggcaatttaaaggtaaaatttgtatttcttctaaaaacaaaatcaaaaagcagaaaaattctgcctgtttcttggtaaaagtcaggttgaccacattttcaaaaagaaaattgagagcatgatcagaaaagtataaaaactgaacaaaaaagataaaatacttaaaatgaaaagcacattttcccaagggggggaaaaaggcactaaaatattggtccagaagaagaaaagtgaatacaagccgataaggttataaaagagagagagagagagagagagagagaagcttcccggttccttgttaattcagagatataagtgtcaaagtttctctgaatttgaatgcaatataaatt

SEQ ID NO: 14431 - DNA, 399 bp, Homo sapiens
  AC021945.3_14000
  Located on chromosome 8
  Distance between a terminus base of telomere on chromosomal short arm and 5'-terminus of this base sequence : 120743186
  Distance between 3'-terminus of neighbour sequence of sequence listing upward to telomere on chrosomal short arm and 5'-terminus of this base sequence : 185295
aggcaagtaatctggtctaaatattggtgaaaaatgaagcttgaagtattggagacattttgtcatcaataaaaaaacatttcaggaaaaatttatttaaattacagtaaaatgattaatatgtatcctataagtctttctacaaaatgtctggtaattttataatacaaaggtagaaataaaagcttctctaaaggcaaacgaatgtgtgtgtgtgtgtgtgtgtgtgtgtgtgtgtgtgtgtgtgtgatataaaatgttttaaaatgtaacacacagtctcctcccaaatcagcagattattaatttacctagtcattcattcattcattatttatttcattcaacaagcatttgccaggcatttatcatatgtttagaactgtgctaggtattaca

SEQ ID NO: 14432 - DNA, 232 bp, Homo sapiens
  chr8.fa.O7frz.128301389
  Located on chromosome 8
  Distance between a terminus base of telomere on chromosomal short arm and 5'-terminus of this base sequence : 120816312
  Distance between 3'-terminus of neighbour sequence of sequence listing upward to telomere on chrosomal short arm and 5'-terminus of this base sequence : 72727
ctacactgagcaaatggagtattatttaaccacaaagatgacaaaaaaatgaagtccacacacacacacacacacacacacacacacacacagaaaatggaaacaaagtatgaaatagaagtagaacataaaactgataacagcaatatatgtttaatgataaaaatcagaagtagcctcaatagatgtagtatttatctaaggtgaagaaacgagctactttagacctaat

SEQ ID NO: 14433 - DNA, 420 bp, Homo sapiens
  chr8.fa.O7frz.128489785
  Located on chromosome 8
  Distance between a terminus base of telomere on chromosomal short arm and 5'-terminus of this base sequence : 120940142
  Distance between 3'-terminus of neighbour sequence of sequence listing upward to telomere on chrosomal short arm and 5'-terminus of this base sequence : 123598
aacctcaggtgatctgcttgcctcagacccccaaaatgctgggactacaggcctgagccaccgcgcctggccatggaataccttatgaagtggttactgcagctatttgcatagtgagtgtgtgtgtgtgtgtgtgtgtgtgtgtatgtgtatgtgtgtgtgttgtccaagaccaattgcttctggccctacagaatcacctgtgctctgtttatataaaccagttctattctctttccttcttatttctatctgtatttgttgttttgttctgatcaggttgggagaattcaagcattttcttgaagcaaaactacatgaaatgtgtattatgatcctatttcatgtaaaaaatatacaaatatagccatatgtgtacacatacctagaagatttctgtaagaatacataggcagctat

SEQ ID NO: 14434 - DNA, 391 bp, Homo sapiens
  AC068553.3_27458
  Located on chromosome 8
  Distance between a terminus base of telomere on chromosomal short arm and 5'-terminus of this base sequence : 121012101
  Distance between 3'-terminus of neighbour sequence of sequence listing upward to telomere on chrosomal short arm and 5'-terminus of this base sequence : 71539
ttgtcagtgctaaggaagtaattattttagtcctctgactcactgttgttattgccttttggagagttttgtatcccaagcagctagcaccgtttttatggagtaggcacttaaaaacaattgcttactgttttgaaaagtcgattcaaggacttttgctgctttaggaaatagggctccttcaactattgcttccatttaggatggcttgagatggttgagatggccttaagtacagctcgggttttcttttctttctttctttctttctttctttctttctttctttctttctttctttctttctttttctttctttctttctttctttctttcttttttttttaaatcttttattcttggtttgggggtacatgcgaaggtttgttat

SEQ ID NO: 14435 - DNA, 212 bp, Homo sapiens
  DISO7_10002647
  Located on chromosome 8
  Distance between a terminus base of telomere on chromosomal short arm and 5'-terminus of this base sequence : 121319798
  Distance between 3'-terminus of neighbour sequence of sequence listing upward to telomere on chrosomal short arm and 5'-terminus of this base sequence : 307306
gtcctaacaactcagtagcccatataaaatataatacacataaattggaagaaaaaatgatatttatattttattcctatataagcataatttcttactgatgggatgtgtgtatacccatatattttatatatatatatatatatatatatatatatatatatatatacaaaaatacagatttatatcttaggatcctaggacaagtaagc

SEQ ID NO: 14436 - DNA, 428 bp, Homo sapiens
  AC011626.3_8479
  Located on chromosome 8
  Distance between a terminus base of telomere on chromosomal short arm and 5'-terminus of this base sequence : 121520554
  Distance between 3'-terminus of neighbour sequence of sequence listing upward to telomere on chrosomal short arm and 5'-terminus of this base sequence : 200544
aacaggaatagacgtgagactcaaaataatcttattctagtattaggtcatactcagcccttatgagctaattgcaaaaacaaacaaaaactcatctcattaacagacatacttccacaaattttttgtttgatgagtttcaaaatttttaatgtatttgtttttttaattgtgaactagtgcctttatgatacattccagaagaaatttcttaatacttaaaacctgaaattatcattttatacttttataaatatttttgctatagaaaaatatggtaagatgatcttttaaatatagaaatatgttatactagcatactctgtgtgtgtgtgtgtgtgtgtgtgtgtgtgtgttggtgggggtggggatggaaaataagttcaaggagaaaaagaaatgagataaaattcctgttaaggaagatc

SEQ ID NO: 14437 - DNA, 408 bp, Homo sapiens
  AC011626.3_98585
  Located on chromosome 8
  Distance between a terminus base of telomere on chromosomal short arm and 5'-terminus of this base sequence : 121594626
  Distance between 3'-terminus of neighbour sequence of sequence listing upward to telomere on chrosomal short arm and 5'-terminus of this base sequence : 73644
ttcagtccatctatgaactcagccttttgcttttttccctagtgcttgagtacataattgggatgtacatacatagcagcttgcaggctgtaagactggttctctgatctctggaataagaaacatggtgaaaaggctgagtcaaacatccaagattgcccctgtcaatatcccaaagaaaatctcacacagttacataaaggagcatgcatgaggaagtccattgcagaattatatgtagtgatggggattagaggcagtttggctgtcccttaactggatggtagattgttacagtgtggtagatgcactatgttatattatattatattatattatattatattatattatattatattatgttatattatattatattattacattatgcaacagataagttgt

SEQ ID NO: 14438 - DNA, 455 bp, Homo sapiens
  chr8.fa.O7frz.129741796
  Located on chromosome 8
  Distance between a terminus base of telomere on chromosomal short arm and 5'-terminus of this base sequence : 121708811
  Distance between 3'-terminus of neighbour sequence of sequence listing upward to telomere on chrosomal short arm and 5'-terminus of this base sequence : 113777
gtgaccagtattatctgaagatctactatttcccaggccttctgacagggatacacacacacacacacacacacacacacacacacacacacacacaaattgaatcctgacagtaacattttgaagtagatattatctctggacagagctaatatttttggtatatgtactaataattgtctggtatatgtacttctaaagtatctctttctgttttttttttgtgtgtgtgtacaggtatgttgaaaaatatttgcaaaatttgcatgaattggattatattgtaaaatatttctgcttaaaaaatggcatcatagtgtttcatcatcgtaacccaccaaagtttattttccaatcttatattgtggttatttaggttacttccaatcttatattcttggttatttaggttggaaaatattccatcatatgtgctatcactgattaatttaacc

SEQ ID NO: 14439 - DNA, 477 bp, Homo sapiens
  chr8.fa.O7frz.129426692
  Located on chromosome 8
  Distance between a terminus base of telomere on chromosomal short arm and 5'-terminus of this base sequence : 121753377
  Distance between 3'-terminus of neighbour sequence of sequence listing upward to telomere on chrosomal short arm and 5'-terminus of this base sequence : 44111
actgatttgatcaactttcattacgtttactgaaatttgatgttttggaaacaggtaatatgacctccaatttcttagatgttttgagaaatacagcatattttgctgaagaaaaatatatttttaaaaatctgttgtgttttcttagcctgaataagcttgtcattactactgtcagggatttgaacatttgtgtgtgtgtgtgtgtgtgtgtgtgtgtgtgtgtgtgtgtgtgtgaagaagtatagtttattctcttaaacacttgagattatctaagaggagcttgattatatacagacatataatgcaacatgatggaatttgacacaacggagtttttccctgactcctctacttatttctgagtattatttttctcatctgcaatataaggatcaactataataaagatacattaagtgactagaaaacagagctcaacaaaatgtagtatgaaataggacctggagtagt

SEQ ID NO: 14440 - DNA, 385 bp, Homo sapiens
  AC013545.3_146333
  Located on chromosome 8
  Distance between a terminus base of telomere on chromosomal short arm and 5'-terminus of this base sequence : 121858079
  Distance between 3'-terminus of neighbour sequence of sequence listing upward to telomere on chrosomal short arm and 5'-terminus of this base sequence : 104225
atagttcacagaagtgcaaactagatatgggctgaaaaagccaagatgactttatgaagaaggtaagacttgaagtggcttctactggatacatatgccttaaataggagcaaaagaaaggtttgtctgtttgtttgtttgtttgtttgtttgaggaggggacagagaggagggataggatagagtggggacacaatcatggaaacaggaataagaacaatgcgaggaaggagaccgatgatgagtgaagagataatcagatgctctgtttttgcagtgataataaatacaattactaaataagtgtcagatactgtgccagttgtcatatattcattatcatattttaggtattgagtaactctgtgagttagctattgtttgc

SEQ ID NO: 14441 - DNA, 434 bp, Homo sapiens
  AC022909.4_61746
  Located on chromosome 8
  Distance between a terminus base of telomere on chromosomal short arm and 5'-terminus of this base sequence : 122032556
  Distance between 3'-terminus of neighbour sequence of sequence listing upward to telomere on chrosomal short arm and 5'-terminus of this base sequence : 174092
ctgaagatgagaaacatctgttactgtcttttcagagacagggtgtttgatgggcttatttttctgctttgcttggatattctcagctcagccaaatattgtccctaaagaagtcatcacaaataaggtatgataaacccatgaacttgaggtgttatcaatcataaaaatactgcaaaacatccaagctatagtcatcccctattatatatttatatatatatatatatatatatatatatatagagagagagagagagagagagagagagcgcactaggatattcaaaagattgtacttttcactttctgcagaacagcacccaagaaaccagctctctgtgttagtagtttgaacacaattggaagaaataaaaaaaaaatgctgtgaaacaggtgcaagggtgtcagagtcattgaagcattgatgtaac

SEQ ID NO: 14442 - DNA, 181 bp, Homo sapiens
  G12420
  Located on chromosome 8
  Distance between a terminus base of telomere on chromosomal short arm and 5'-terminus of this base sequence : 122347132
  Distance between 3'-terminus of neighbour sequence of sequence listing upward to telomere on chrosomal short arm and 5'-terminus of this base sequence : 314142
aaggagagagaaaaaggaaggaaggaaggaaggaaggaaggaaggaaggaaggaaagagagaaagaaaatagagaaaagaaaagaatatcactactctaatttttttaacaggcaagttaagagaaggaaagatatgagatactatcagtgttgatatcagtatgttttttttgttgttgt

SEQ ID NO: 14443 - DNA, 222 bp, Homo sapiens
  D8S1728
  Located on chromosome 8
  Distance between a terminus base of telomere on chromosomal short arm and 5'-terminus of this base sequence : 122622020
  Distance between 3'-terminus of neighbour sequence of sequence listing upward to telomere on chrosomal short arm and 5'-terminus of this base sequence : 274707
tgttgtcaagatgttgcgtttttaatatggtggccagatgtatctttttattctgatcatatatttttctgcttttctgaaaatggttatagagtaattttttttaaattccaggtttgactttctagattgctccaattttccgtgtgtgtgtgtgtgtgtgtgtgtgtgtgtgtgtgtgtttaataactgtaaataaaactaccatagggttttgaaagc

SEQ ID NO: 14444 - DNA, 318 bp, Homo sapiens
  chr8.fa.O7frz.130342614
  Located on chromosome 8
  Distance between a terminus base of telomere on chromosomal short arm and 5'-terminus of this base sequence : 122712191
  Distance between 3'-terminus of neighbour sequence of sequence listing upward to telomere on chrosomal short arm and 5'-terminus of this base sequence : 89949
aggtatcatagatggttggaagtttcttctttttaacctttatattgtatcctacctttgctctgttctttatagcttttaatgttttatcatatttatttagttccttgctgcacacacacatgcacatacacacacacacacacacacacgtttctcattgcaaggattttgcccagtctaggatcaaattttgttttccctgggaagttctttctgacctaatcccactacataaactcttagcactcatttccagcactcatttccaggtaatgcaatctggttaattgcttataggtaaagtagatgccagct

SEQ ID NO: 14445 - DNA, 389 bp, Homo sapiens
  AC037486.2_103543
  Located on chromosome 8
  Distance between a terminus base of telomere on chromosomal short arm and 5'-terminus of this base sequence : 122863728
  Distance between 3'-terminus of neighbour sequence of sequence listing upward to telomere on chrosomal short arm and 5'-terminus of this base sequence : 151219
ggactaatgagaaggaacaaagtagggaaactaaagcaaatcaacacataaacaaaggagagtccttgtgcagacccaaaataccagaaacatagttgacctgttggatttaagccctgaactctacctttccccatcctccacacacacacacacacacacacacacacacacacacacacacacaccgaaagaaatttcttaggtgagaaaaatggcatcatggtgaccttcctgggattctcactttagcacagtaaattcgtcgactctggggattggaagaacaatgttacactgccaggatactggttgcccattctgccatgactccccttgaaacagatttgtagaaaatccaaaactagaacaattaggtatatcagcct

SEQ ID NO: 14446 - DNA, 336 bp, Homo sapiens
  HUMUT1959
  Located on chromosome 8
  Distance between a terminus base of telomere on chromosomal short arm and 5'-terminus of this base sequence : 123002894
  Distance between 3'-terminus of neighbour sequence of sequence listing upward to telomere on chrosomal short arm and 5'-terminus of this base sequence : 138777
gaaggaaaggaaaggcaaggaaaaggaaggtaagaagtgaagggaagaagggaaggggataaagaaagggaagggaaaaagggaaggggataaaggaagggaatggaagacaggggaaagagaaaagaaaagaaaagagaagaaggaagaaaggaaggaaggagaaagaaagaaaaagaaagaaagaaggaaggaaggaaggaaggaaagaaagaaagaattggtgtggtgtggtgctgaaaaaaatgtatattctgttgatttggggtggagagttctgtagatgtctattaggtccacttgatgcagagctgagttcaattcctgggtatcctt

SEQ ID NO: 14447 - DNA, 475 bp, Homo sapiens
  AP002089.1_69304
  Located on chromosome 8
  Distance between a terminus base of telomere on chromosomal short arm and 5'-terminus of this base sequence : 123010542
  Distance between 3'-terminus of neighbour sequence of sequence listing upward to telomere on chrosomal short arm and 5'-terminus of this base sequence : 7312
cttactcatttgatagcaccagtgtcctgagaaaaataacatatactccattacccatccatacacttacccaggcactcattcaccatattaactagatagacacatgatgttgctgctcctgttgatgataacaatgttgaggtggatggatggatggatggatggatggatggatggatagataaatggctggacagacagatagctaggtgacagatagaatatgtacacagaaagcattcagatttttctgccatggacctgattttatgtgactgtatcagttttaataactgtattattagataatagtaagtgttaatgagagttaaatgttctttaaattttataacattgtaatcattttaatacaaataaatacacaaatcagaagatagccattgtcaaaccatgtgccctggggctgttttcaaaccaccgtggccataagcagtagcaataagactatgaa

SEQ ID NO: 14448 - DNA, 452 bp, Homo sapiens
  AP002089.1_22801
  Located on chromosome 8
  Distance between a terminus base of telomere on chromosomal short arm and 5'-terminus of this base sequence : 123057276
  Distance between 3'-terminus of neighbour sequence of sequence listing upward to telomere on chrosomal short arm and 5'-terminus of this base sequence : 46259
tattagcctgtcaaatgcatagaattacagatattaataaatcaatcctcaggaccaatctatagaataatgctggaaataaaaatgcttcccattgagaagtgttgtgcattcattaataagcagattttccctaccactctttctctctctctttccctctgtgagccctagaaagattcaccaacttggttctctggtgactctttcctaccctatcccagctacattccccccaacacacacacacacacacacacacacacacaactgagattttacatgtgggcaaataacccttaggaaaatggtggcatttttgacacattgacaaatgtttaaagaatgcgcattcttataggacgtcccggtgatttctatgcacatcatacttgcgaagcatagcccttacttcagtctcacagttcgtcattctttcctagtagacttcc

SEQ ID NO: 14449 - DNA, 266 bp, Homo sapiens
  DID22N_0032436
  Located on chromosome 8
  Distance between a terminus base of telomere on chromosomal short arm and 5'-terminus of this base sequence : 123126698
  Distance between 3'-terminus of neighbour sequence of sequence listing upward to telomere on chrosomal short arm and 5'-terminus of this base sequence : 68970
gctcttcccaatcttagaatgtatctagatagatagacagggagatgatagatagacgatagatagataggtaggtaggtagatagatagatagatagatagatagatagatagatagatagatagatgatagagatacatacatatatacacacacttgtgtgtacgtgtgtgtgtgtatgtgtgtgtgtgtgcatgtgtgtgtgtgtgcttgagagagacagtgggatatacacatatttttttctaggacttcaagggaccac

SEQ ID NO: 14450 - DNA, 170 bp, Homo sapiens
  DID22N_0032448
  Located on chromosome 8
  Distance between a terminus base of telomere on chromosomal short arm and 5'-terminus of this base sequence : 123451714
  Distance between 3'-terminus of neighbour sequence of sequence listing upward to telomere on chrosomal short arm and 5'-terminus of this base sequence : 324750
ggatcttcctagcaggtatctctcatgtactcaggaatataatagatgatagacaaatagatgatatacagatagatgatagataggtagatagatagatagatagatagatagatagatagatagatagatagatagatatggagataaagcttccctgtggagtctta

SEQ ID NO: 14451 - DNA, 137 bp, Homo sapiens
  chr8.fa.O7frz.130980545
  Located on chromosome 8
  Distance between a terminus base of telomere on chromosomal short arm and 5'-terminus of this base sequence : 123510437
  Distance between 3'-terminus of neighbour sequence of sequence listing upward to telomere on chrosomal short arm and 5'-terminus of this base sequence : 58553
gttaacgaacttcaagtaatcaagagcagctataatataaaactctacagaaccatacacacacacacacgcgcgtgcgcacacacacacacacacacacgatacagatgcagctctaggatgactggtaaaccact

SEQ ID NO: 14452 - DNA, 373 bp, Homo sapiens
  AF301238.1_33844
  Located on chromosome 8
  Distance between a terminus base of telomere on chromosomal short arm and 5'-terminus of this base sequence : 123574800
  Distance between 3'-terminus of neighbour sequence of sequence listing upward to telomere on chrosomal short arm and 5'-terminus of this base sequence : 64226
taggtaaatgcactgtaagcacaagcctcagagaatttccacagaaaaagttccaagatgcatgagctcacaagaaaaagttaaaaagaaaaagaaaaacatgcaagaaaaagtcatcaagaacaaaagtcaacaaaattaacagcctgcaatgtagaccttgcagcctcaaagactccagataatttaaccactgttaacaagatataacataaatgtcttggtttttatggaaaaagtacactgcttgagggcagggagttgtgtgtgtgtgtgtgtgtgtgtgtgtgtattgttgtatatgttttgtatattgttatgacgtcatagtgactggaagatcattggttcatagcaggccttcagtacttat

SEQ ID NO: 14453 - DNA, 272 bp, Homo sapiens
  D8S1802
  Located on chromosome 8
  Distance between a terminus base of telomere on chromosomal short arm and 5'-terminus of this base sequence : 123574960
  Distance between 3'-terminus of neighbour sequence of sequence listing upward to telomere on chrosomal short arm and 5'-terminus of this base sequence : -213
ttgcagcctcaaagactccagataatttaaccactgttaacaagatataacataaatgtcttggtttttatggaaaaagtacactgcttgagggcagggagttgtgtgtgtgtgtgtgtgtgtgtgtgtgtattgttgtatatgttttgtatattgttatgacgtcatagtgactggaagatcattggttcatagcaggccttcagtacttatatatattaaatataggaatgataaggaaacaagaaaatatcaaaattgagaggcagatg

SEQ ID NO: 14454 - DNA, 414 bp, Homo sapiens
  AF187000.2_46026
  Located on chromosome 8
  Distance between a terminus base of telomere on chromosomal short arm and 5'-terminus of this base sequence : 123626790
  Distance between 3'-terminus of neighbour sequence of sequence listing upward to telomere on chrosomal short arm and 5'-terminus of this base sequence : 51558
tggatgagtcttacttgatcatgatgaatgatctttttaatgtgctgttgaatttggtttgtgcattttgttgagaatttttgcatctatgctcttcataatatggcctgtaatttgttgttgttgttgttgttgttgttgtatctttgtctggtttttgtgttaaggtaatgctagtgtcatagggtgttttgagtttgcctcaatattccctcatgttcaattttgttgaatagttttcgtagaatttctattagttctcctttaaatgttcggtagaattcagcagggaaatggtcaggtcctggaattttctttgatgggagatgttttattattgctacaatctcagtacttatttttggtctgttcaggttttctatgtcttcatggtccaatcttggtaggttgtat

SEQ ID NO: 14455 - DNA, 385 bp, Homo sapiens
  HUMUT5347B
  Located on chromosome 8
  Distance between a terminus base of telomere on chromosomal short arm and 5'-terminus of this base sequence : 123640307
  Distance between 3'-terminus of neighbour sequence of sequence listing upward to telomere on chrosomal short arm and 5'-terminus of this base sequence : 13103
cagcctgggcaatagaaagagactctgtctcaaaaaaaaaaaaagaaaagaaaaggaagaaagaaaagtaaaagaaagaaagaaagaaagaaagaaagaaagaaagaaagaaagaaagaaagaaagaaagaatcaatatgaagagatgaagcctttgcttaagtgaagttagtgcacagaagtgaggcagaagcagagtcaggaagacctctcagaggaggcaccactgaggagaatttttacatataagccggagttagagagaggtgtatgaaggaaggggattttatttggagatagtagatatgtaaagacacaaagctggaatgaattatggcaagaggtttatttgattacagtggaaacttcaaggaagggagcactg

SEQ ID NO: 14456 - DNA, 210 bp, Homo sapiens
  D8S1726
  Located on chromosome 8
  Distance between a terminus base of telomere on chromosomal short arm and 5'-terminus of this base sequence : 123698867
  Distance between 3'-terminus of neighbour sequence of sequence listing upward to telomere on chrosomal short arm and 5'-terminus of this base sequence : 58175
gcttcatgggaacgctctccttggcatttctcagtgctgaatcagggagaaaagttgggcagattgcctgtgaggctcaacacacacacacacacacacacacacacacacacagagagagagagaaagagagaggagggaaggcaggacagagggaggaagaaccaagtcagagttaggagagcaaacaccacacaatgcagtaatggc

SEQ ID NO: 14457 - DNA, 215 bp, Homo sapiens
  D8S514
  Located on chromosome 8
  Distance between a terminus base of telomere on chromosomal short arm and 5'-terminus of this base sequence : 123706905
  Distance between 3'-terminus of neighbour sequence of sequence listing upward to telomere on chrosomal short arm and 5'-terminus of this base sequence : 7828
ctgaacccagtagagttaggagatatttttaattcatcccactctgtaaccttgagcaatttacctaatctcttgagttttagtttcttcatctctataaaataaagttcacacttaccatatatgtgtgtgtgtgtgtgtgtgtgtgtgtgtgtgttagaaattaaatttgacataattggtgaaaaaggcttagcacaatgcttgccaactgg

SEQ ID NO: 14458 - DNA, 159 bp, Homo sapiens
  D8S1826
  Located on chromosome 8
  Distance between a terminus base of telomere on chromosomal short arm and 5'-terminus of this base sequence : 123820834
  Distance between 3'-terminus of neighbour sequence of sequence listing upward to telomere on chrosomal short arm and 5'-terminus of this base sequence : 113714
tttctacacttcgctttttgttctcacccttcacacacacacacacacacacacacacacacatcatgcttctgattttctgcagttaattttacatccgcaaggacctcaggaagtccttcaagccacctatgcctttcttggggcatctcctaccac

SEQ ID NO: 14459 - DNA, 360 bp, Homo sapiens
  chr8.fa.O7frz.131522356
  Located on chromosome 8
  Distance between a terminus base of telomere on chromosomal short arm and 5'-terminus of this base sequence : 124011447
  Distance between 3'-terminus of neighbour sequence of sequence listing upward to telomere on chrosomal short arm and 5'-terminus of this base sequence : 190454
tttgtcctgacctttagctatcccctctcagactcatcaccacaaagctattgcttatggctactccctgtctttgctaccagggagtacacacacacacacacacacacacacacacacacacacacacacactctctctctctctctctctctctctctctctctctctctctctttcccccccagcactgggttctgattggctcagctgagtcaggccccacccccatgccaatcatacgaccaatgagggtgggctaaggagcctgtccaggaagggtttgggagagggcagtaggtaggtttgccggtggaagtaagagtgctgggcaggcggaactatccatggttacaatcc

SEQ ID NO: 14460 - DNA, 144 bp, Homo sapiens
  DISD22_0006073
  Located on chromosome 8
  Distance between a terminus base of telomere on chromosomal short arm and 5'-terminus of this base sequence : 124118770
  Distance between 3'-terminus of neighbour sequence of sequence listing upward to telomere on chrosomal short arm and 5'-terminus of this base sequence : 106963
tgatataagtccatcggccttttaatattcaaacatctgcccccacttcacacacacacacacacacacacacacacacacacacagagagagagagagagagagagagagagagagagagagcaggtctttgcttattgaagg

SEQ ID NO: 14461 - DNA, 169 bp, Homo sapiens
  DISD22_0006078
  Located on chromosome 8
  Distance between a terminus base of telomere on chromosomal short arm and 5'-terminus of this base sequence : 124344992
  Distance between 3'-terminus of neighbour sequence of sequence listing upward to telomere on chrosomal short arm and 5'-terminus of this base sequence : 226078
cagcactacacttgggaccattttaaactgcagaaagcagaaaaatatggaaaacacagcactaaatagactacaaaaggatgctttttcattcctatggacacacacacacacacacacacacacacacacacacacacacttctctacagtatgagacctgaaacaa

SEQ ID NO: 14462 - DNA, 338 bp, Homo sapiens
  chr8.fa.O7frz.131845102
  Located on chromosome 8
  Distance between a terminus base of telomere on chromosomal short arm and 5'-terminus of this base sequence : 124420752
  Distance between 3'-terminus of neighbour sequence of sequence listing upward to telomere on chrosomal short arm and 5'-terminus of this base sequence : 75591
gaggcctgtatctttaaatgtcatctattaacagatgtctcccaatttgatattcctatcctacatctctccacttgactctgggacccctttatccagcatatatatatatatatatatatatgcacacacacacacacacacatatatatatacacacacatatatacatatggagagatagagagagagagagagagagagagagagagagaaagcagcgagccagagtctcactctgtcgcccaggctggagtgcagtgatgtgatctcaggctcactacaacctccgcctaccacacccggctaccaactcctatttgacagctcctgttaga

SEQ ID NO: 14463 - DNA, 443 bp, Homo sapiens
  AC021305.3_82823
  Located on chromosome 8
  Distance between a terminus base of telomere on chromosomal short arm and 5'-terminus of this base sequence : 124468453
  Distance between 3'-terminus of neighbour sequence of sequence listing upward to telomere on chrosomal short arm and 5'-terminus of this base sequence : 47363
gtaggagcatgcacctataatcccagttactcaggaggctgaggcacaagactcacttgaacccgagaggcagaggttgtaataagccaagattgcacgactgctcctccagcctgggtgacagagcaagactccatctaaaaattaaaaataataataataataataaaaactacaaagagttcatgaatccacagataccacaagcaccactggtaagctgaatacataatgtggcttgaacatacactgttatttttgaaatatatgtaaatgttacacagaaaaaaatgtaaacttcgtaaaagtcactgactttttagtcccttttagtcagcaattgtttttcaagagcataacgaatatcatgtaggagaatcccatgaaagtttcaatgttaaaaaaaagggggagatgatcttatactcggaaatacaaggagt

SEQ ID NO: 14464 - DNA, 443 bp, Homo sapiens; identical to SEQ ID NO: 14463
  AC023188.2_24726
  Located on chromosome 8
  Distance between a terminus base of telomere on chromosomal short arm and 5'-terminus of this base sequence : 124468453
  Distance between 3'-terminus of neighbour sequence of sequence listing upward to telomere on chrosomal short arm and 5'-terminus of this base sequence : -443

SEQ ID NO: 14465 - DNA, 179 bp, Homo sapiens
  chr8.fa.O7frz.131942730
  Located on chromosome 8
  Distance between a terminus base of telomere on chromosomal short arm and 5'-terminus of this base sequence : 124611671
  Distance between 3'-terminus of neighbour sequence of sequence listing upward to telomere on chrosomal short arm and 5'-terminus of this base sequence : 142775
tgactggctcattttaacatagcaaaatggccccagagtttatccacattgcagcgtatgtcaggatttccttctttttaatatgaacacatatatatatatatatatatatatatatatatatatatatatatgcacacacacaccacattttgcttatccgttcatctatggataaa

SEQ ID NO: 14466 - DNA, 394 bp, Homo sapiens
  AF267168.1_88772
  Located on chromosome 8
  Distance between a terminus base of telomere on chromosomal short arm and 5'-terminus of this base sequence : 124611671
  Distance between 3'-terminus of neighbour sequence of sequence listing upward to telomere on chrosomal short arm and 5'-terminus of this base sequence : -179
tgactggctcattttaacatagcaaaatggccccagagtttatccacattgcagcgtatgtcaggatttccttctttttaatatgaacacatatatatatatatatatatatatatatatatatatatatatatgcacacacacaccacattttgcttatccgttcatctatggataaacacttgggttgcttcaacattttagctattgtgactaatgctgctatgaatgtagatatacaaacatctcttcaaggtcctgctttcaattcttttcaatatatacctggaagtggaattgctggatcatatgaggaaccgccatactgtttttcagtgactgtaccattttacaatcccaccaacagtgcacaagatttccaatttctacatac

SEQ ID NO: 14467 - DNA, 429 bp, Homo sapiens
  AF254981.2_37255
  Located on chromosome 8
  Distance between a terminus base of telomere on chromosomal short arm and 5'-terminus of this base sequence : 124790547
  Distance between 3'-terminus of neighbour sequence of sequence listing upward to telomere on chrosomal short arm and 5'-terminus of this base sequence : 178482
agcctagatgcttaggtagaattttaatagaaaacattgaccaggtgcggtggctcatgcctgtaatctcagcactttcggaggccaagacaggtggattacaaggtcaagagatagagaccatcctggccaatatggtgaaaccctgtctctactaaaaatacataaattagccgggcatggtggcgggcacctgtaatcccagctactcaggaggctgaggcaggagaatcgcttgaacccaggaggcagaggttgcagtgagccaagatcgcggcactgcactccagcctggtgacagggtgagactccgtctcaaaacaaaacaaacaacaacaacaacaacaacaacaacaaacaaacaaaaaaaagaaagaaaacactgctgggatgctggtggtataggtttagatcctgagtcattaagaa

SEQ ID NO: 14468 - DNA, 362 bp, Homo sapiens
  chr8.fa.O7frz.132137815
  Located on chromosome 8
  Distance between a terminus base of telomere on chromosomal short arm and 5'-terminus of this base sequence : 124846346
  Distance between 3'-terminus of neighbour sequence of sequence listing upward to telomere on chrosomal short arm and 5'-terminus of this base sequence : 55370
tcaacttcaacaattatcaacacattgtcaagacttcaaaaactattttttgttagctccctttaaaaaaatttctatatttgtatgttttataatgtacataaactataccatatgtgtgtgtgtgtgtgtgtgtgtgtgtgtatatgtgtatatatatatatatatacatacatttacataaaccaaaggtgtgtactcaaaacttcatcacttgtgagggtgtgtagtcaaatggttagagaagtctgctccatgctgccgtcaggagacatttccagtgtgcaaatttgatcacgttgctctgtcttgcatatcactcagtggcttcccattgcttctaagaaagttctgcaaggact

SEQ ID NO: 14469 - DNA, 209 bp, Homo sapiens
  D8S1804
  Located on chromosome 8
  Distance between a terminus base of telomere on chromosomal short arm and 5'-terminus of this base sequence : 124933580
  Distance between 3'-terminus of neighbour sequence of sequence listing upward to telomere on chrosomal short arm and 5'-terminus of this base sequence : 86872
aatcttgtgagaggccccacattttctatgagttcctgaggcaacttcctcatgctttttgtctctataatcccccaaaattttaccagtctctcttctttctcctccctctgtctctgtcaaacacacacacacacacacacacacacacacacacacacacacgcatgctcacaacatggagttcaagcaacaaggtcaacctggct

SEQ ID NO: 14470 - DNA, 453 bp, Homo sapiens
  chr8.fa.O7frz.132352102
  Located on chromosome 8
  Distance between a terminus base of telomere on chromosomal short arm and 5'-terminus of this base sequence : 125064592
  Distance between 3'-terminus of neighbour sequence of sequence listing upward to telomere on chrosomal short arm and 5'-terminus of this base sequence : 130803
tctggagtacagcaaactgtaccctatactttattacacacttaaaaaattgttaaggtcaattgttaaggtcaagtgcagtggctcatgcctgtaatcctaatacttatggaggccaagactgaaggatcacatgaggcgggaggattgcttgagcccaggagttcaagaccagcctgggcaacatagtgagtccctcttgctacaaaaatttttaaatataaagtattatttgtttaatgggttgatgtcaagttaaatgttcttaactcacacacacacacacacacacacacacacacacggggacacaggaaacgttcatagctgatgaaatacttattaccttgatggtggtgatgatattatgagtgtatgcctatgtccaaattcaccaaattgtataattaaatatacaatatattttacagcaattatacctcagtaaagatg

SEQ ID NO: 14471 - DNA, 129 bp, Homo sapiens
  DISD22_0006082
  Located on chromosome 8
  Distance between a terminus base of telomere on chromosomal short arm and 5'-terminus of this base sequence : 125222757
  Distance between 3'-terminus of neighbour sequence of sequence listing upward to telomere on chrosomal short arm and 5'-terminus of this base sequence : 157712
gatgctgaatcctgagtgacagaagcatttgcatattttagaataaactctgtatatttgtgtgtgtgtgtgtgtgtgtgtgtgtgtgtgtgtgtgtgtgtgatgtgtggggctaagcaccactcccag

SEQ ID NO: 14472 - DNA, 204 bp, Homo sapiens
  DISD22_0006090
  Located on chromosome 8
  Distance between a terminus base of telomere on chromosomal short arm and 5'-terminus of this base sequence : 125613399
  Distance between 3'-terminus of neighbour sequence of sequence listing upward to telomere on chrosomal short arm and 5'-terminus of this base sequence : 390513
agctgaattctggtgttcaggtttttaagttctgcctccccagtctctcaactactctacaatttttacttcacaaaaaaagtaaagaaaagaaatagtttttgtttcttgtttttcattataaaagctatatatatatatatatatatatatatatatatatatatatatatgtatatatattactcctgctgtgagctgttt

SEQ ID NO: 14473 - DNA, 141 bp, Homo sapiens
  DISD22_0006093
  Located on chromosome 8
  Distance between a terminus base of telomere on chromosomal short arm and 5'-terminus of this base sequence : 125705605
  Distance between 3'-terminus of neighbour sequence of sequence listing upward to telomere on chrosomal short arm and 5'-terminus of this base sequence : 92002
ccttcacctactcttaatttatgctctaattcctaaagatatatatatatatatatatatacatacatacatactttttttgtcaacagatacgctaaatatacatctataaaactaccaagctacacttaacacctattt

SEQ ID NO: 14474 - DNA, 226 bp, Homo sapiens
  AF228660.2_90058
  Located on chromosome 8
  Distance between a terminus base of telomere on chromosomal short arm and 5'-terminus of this base sequence : 125776504
  Distance between 3'-terminus of neighbour sequence of sequence listing upward to telomere on chrosomal short arm and 5'-terminus of this base sequence : 70758
ccatcagaaattgatagtttctaatcaaagtgaatagattgaaagcattatttgttgtttcattaactactggtcttatgtagatacaggaatacaagcacacacatgtgcacatacacacacacacacacacacacacacacacgtgcacttagccccgtccttatttattcctggtcttctgttccatgccacaattagtgtcaaactataatgagctcaagtc

SEQ ID NO: 14475 - DNA, 190 bp, Homo sapiens
  D8S1832
  Located on chromosome 8
  Distance between a terminus base of telomere on chromosomal short arm and 5'-terminus of this base sequence : 126008570
  Distance between 3'-terminus of neighbour sequence of sequence listing upward to telomere on chrosomal short arm and 5'-terminus of this base sequence : 231840
cagattctgaaggggtgtgcgtgcatgtgtgtgtgtgtgtgtgtgtgtgtgtgtgtgtgtgtgtgtgtgtaggtaggtagtgaggtcattctgagggaaactgctttggtaatgggaatttaaaagatggttggaggccagaagacctctgcactagaaagagcatttgaagccatccagttccgcatta

SEQ ID NO: 14476 - DNA, 250 bp, Homo sapiens
  chr8.fa.O7frz.133264474
  Located on chromosome 8
  Distance between a terminus base of telomere on chromosomal short arm and 5'-terminus of this base sequence : 126339097
  Distance between 3'-terminus of neighbour sequence of sequence listing upward to telomere on chrosomal short arm and 5'-terminus of this base sequence : 330337
taatctagtgacctagtattgcctggtgatgaaatctgtccctgccgttaggttcacttgtgtttctttgtgtttctctctctctgtctctctttctctctcgtacacacacacacacacacacacacacacacacacacacacacacacacacacacacacattttaaacttggtctttaaaatctcagtttttcctgcttaagacaagaagatccctgatgccaagatttctacctgaaaggtcagtt

SEQ ID NO: 14477 - DNA, 240 bp, Homo sapiens
  D8S1799
  Located on chromosome 8
  Distance between a terminus base of telomere on chromosomal short arm and 5'-terminus of this base sequence : 126387066
  Distance between 3'-terminus of neighbour sequence of sequence listing upward to telomere on chrosomal short arm and 5'-terminus of this base sequence : 47719
ggacattctgccccctgaagatattggtttgtttcttatcttctgtcgactgtgtgtgtgtgtgtgtgtgtgtgtgtgagtgaaagagagacctttttattgttgccaagaaaaatctctcattagtgtaaaacaaagttgcgtggctgtttttttcttccttataattttagtttgagtagaaaaccatgttgcactgacatctgcaactctgaggctgccggggtggagttgctgtga

SEQ ID NO: 14478 - DNA, 184 bp, Homo sapiens
  Z67308
  Located on chromosome 8
  Distance between a terminus base of telomere on chromosomal short arm and 5'-terminus of this base sequence : 126695647
  Distance between 3'-terminus of neighbour sequence of sequence listing upward to telomere on chrosomal short arm and 5'-terminus of this base sequence : 308341
gctggatatatgtgcaaaggtttaccaagatatgtgcccaaggatgttcataatataagatttagcagaggtagagaaggacacaatattatgtgatcctaattttgattgtgtgtgtgtgtgtgtgtgtgtgtctgtctgcatatgtaagtaaactggaaaaattcattacaaaagttgccag

SEQ ID NO: 14479 - DNA, 338 bp, Homo sapiens
  chr8.fa.O7frz.133431226
  Located on chromosome 8
  Distance between a terminus base of telomere on chromosomal short arm and 5'-terminus of this base sequence : 126764268
  Distance between 3'-terminus of neighbour sequence of sequence listing upward to telomere on chrosomal short arm and 5'-terminus of this base sequence : 68437
tgaagacaagattctgcattagaaaaacaattctagcaggaaatcctgtgcattcagatcactgagttttggtcatcagtgttgggacttttcttacacacacacacacacacacacacacacacacacacacacatcctaggaaacatcaggccaagtgatcaagaatgcgcatcttcacaaagggttgtgaccatcaagttctttgttcgttagtgtccagaaagttcaaccacattcctttgggatgaattacatggtgactattagggtgggaaaaggaaggagaaaggggaaattcacaaagggcatggcagtttacaatggacagttccata

SEQ ID NO: 14480 - DNA, 371 bp, Homo sapiens
  chr8.fa.O7frz.133934474
  Located on chromosome 8
  Distance between a terminus base of telomere on chromosomal short arm and 5'-terminus of this base sequence : 126890183
  Distance between 3'-terminus of neighbour sequence of sequence listing upward to telomere on chrosomal short arm and 5'-terminus of this base sequence : 125577
ctgtataccaggtgctattctaagtgctttacattatattaactcctataatcttcatagcccagtgagagaaggacagttcttacagataaggaaaagtaggcacagagaagcgaagtcacccatggaaagtcagagatggaactaggaaatggctgagctgggaccagaatctggagagcccagtcctaaaatctccattcttaactccatactctcctcctccctattgacataatttagaaaatgaaaatatattcgaagcccacatttagaaccaaagcttttgtaaataagtatgtgtgtgtgtgtgtgtgtgtgtgtgtgtgtgtgtgtgtgtacaaaaagtctaattaaaatggaggcctatg

SEQ ID NO: 14481 - DNA, 472 bp, Homo sapiens
  chr8.fa.O7frz.134175224
  Located on chromosome 8
  Distance between a terminus base of telomere on chromosomal short arm and 5'-terminus of this base sequence : 127092322
  Distance between 3'-terminus of neighbour sequence of sequence listing upward to telomere on chrosomal short arm and 5'-terminus of this base sequence : 201768
caattccaactttgatactcacccagttctgtgaacttgagctaatcatgtcattttatttggtgttttatttctaaaattcatttagcaaagattaatatacattttgagacagagtctcgctctgtcacccagtctggagtgcagtggcgcaatctcggctcaccgcagcctctgcctcctgggttcaagtgattctcatgcctcagcctcgcgagtagctgggatttatagatgtgtgccaccccccgcccccagctaatttttgtgtgtgtgtgtgtgtgtgtgtgtgtgtttttagaagagacggggttttgccatgttggccaggctggtcttaaactcctgacctcaggtgatcttccggcttcagcctcccaaagagctgggattacagacgtgagccactgcgcccagctaaagattaatatacttttaaaataagtgtcttgaactatttcatgtgctttac

SEQ ID NO: 14482 - DNA, 159 bp, Homo sapiens
  D8S266
  Located on chromosome 8
  Distance between a terminus base of telomere on chromosomal short arm and 5'-terminus of this base sequence : 127438657
  Distance between 3'-terminus of neighbour sequence of sequence listing upward to telomere on chrosomal short arm and 5'-terminus of this base sequence : 345863
tgctgaagccctaactgtctctctctctctctctctctctctctctctcacacacacacacacacacatgcacgcacacgcacatgcatacacactgaagacaggccatgtgaggatataacaaagaagagagccctcatcagaaaccaaatcaaggcc

SEQ ID NO: 14483 - DNA, 407 bp, Homo sapiens
  AC024681.2_173789
  Located on chromosome 8
  Distance between a terminus base of telomere on chromosomal short arm and 5'-terminus of this base sequence : 127661380
  Distance between 3'-terminus of neighbour sequence of sequence listing upward to telomere on chrosomal short arm and 5'-terminus of this base sequence : 222564
gaggtcatatgcttaaatgctattttattctattttcttttctaaatttgttaaacgtgtggctacaaaaacatctctcactaatggatcccaaaccaattgcaagaatgctgggaagaatgtgtgcaacgtgtgtgtgtgtgtgtgtgtgtgtgatgttggttatgcctataacaatttactgtaatgtgttaagaacttgtgggagagtagtcacttggctctggttagtgaatgttctttttatgttttctgactgcagatttttaagtaaatgataaaagtcacattaaaaagtgaatctgtttatattttaggcttcatttcctttatttcttaatattaatcttaagggtaatcttttgatggcagaaatgtttttggatattctttggttgtacctcaag

SEQ ID NO: 14484 - DNA, 448 bp, Homo sapiens
  chr8.fa.O7frz.134583577
  Located on chromosome 8
  Distance between a terminus base of telomere on chromosomal short arm and 5'-terminus of this base sequence : 127686181
  Distance between 3'-terminus of neighbour sequence of sequence listing upward to telomere on chrosomal short arm and 5'-terminus of this base sequence : 24394
tgactgtggccttacagtatagtttgaaatcaggtagtgtgatgcctccagatttgttctttttgcctagtattgatttggctatgcaggctctttcttggttccatatgaatttcagaattgtgtgtgtgtgtgtgtgtgtgtgtgtgtgttttaattctgtgaagaatgatggtggtgttctgatgcggattgcattgaatttgtagattgcttttggcagtatggtcattatcacaatattgattctacccatccatgagcatgggatgtttttccatttatttgtgtctttgatgatttctttcagcagtgttttgtagtttttcttgtagatgtcttttgcctccttttttaggtgtattcccaagtattgtattatttttgcagctattgtaaaaagggttgagttcttgatttgattctctgcttgtttgctactggtata

SEQ ID NO: 14485 - DNA, 104 bp, Homo sapiens
  DISO7_10002654
  Located on chromosome 8
  Distance between a terminus base of telomere on chromosomal short arm and 5'-terminus of this base sequence : 127827147
  Distance between 3'-terminus of neighbour sequence of sequence listing upward to telomere on chrosomal short arm and 5'-terminus of this base sequence : 140518
catatgtgactcatgaggtgtgtttatgtgtgtctgtgtgtgtgtgtgagaataagtttaacaggtacttacacattttttcatcactgataccaccaaactac

SEQ ID NO: 14486 - DNA, 233 bp, Homo sapiens
  AF270510.1_32757
  Located on chromosome 8
  Distance between a terminus base of telomere on chromosomal short arm and 5'-terminus of this base sequence : 127921451
  Distance between 3'-terminus of neighbour sequence of sequence listing upward to telomere on chrosomal short arm and 5'-terminus of this base sequence : 94200
gtatacctatgtaacaaacctgcacgttgtgcacatgtaccctagaacttaaagttttatatatatatatatatatatatatatatatatatatatacaaacacacataaagaaagaaagttgcctatcgaatttccttcttggaaattagcacacttggaaacatgcacactagctcctaaaacatgtaagaaatcctgcacattcatgttagatgtggacatttgttatcc

SEQ ID NO: 14487 - DNA, 143 bp, Homo sapiens
  D8S1793
  Located on chromosome 8
  Distance between a terminus base of telomere on chromosomal short arm and 5'-terminus of this base sequence : 128019489
  Distance between 3'-terminus of neighbour sequence of sequence listing upward to telomere on chrosomal short arm and 5'-terminus of this base sequence : 97805
tgagccgagttcttaccactgcactccagcctgggctgtctctctctctctctctctctctctctcacacacacacacacacacacacacacacacacacacacacacacacaaattcaccttctcatcaagctggacttgtt

SEQ ID NO: 14488 - DNA, 415 bp, Homo sapiens
  AF188028.2_78287
  Located on chromosome 8
  Distance between a terminus base of telomere on chromosomal short arm and 5'-terminus of this base sequence : 128037137
  Distance between 3'-terminus of neighbour sequence of sequence listing upward to telomere on chrosomal short arm and 5'-terminus of this base sequence : 17505
ttagggccaagagttcaagaccagcctgggtgacagagtaagacccttgtctttacaaaaaagttaaaaaaataaaaaagtagcctgacatggtggcgtgcgtctttagtcccagttactcaggaagctgaggtaggaggattgcttgagcctaggagttcgaggctggtgtgagttattgtgccactgcactccagcctcagtgacaaagtgagaccctagcacaaaagggaggaaggaaggatggaaggaaggaaggaaggaaggaaggaaggaaggaaggaaggaaggaaggaaggagggagggataataaatatatgttgttttaaggcactaaatttgtggtcatttgttatgcagcaaaagaatactaacacattctgcctccgggtgtactgtcaacttgaaattaca

SEQ ID NO: 14489 - DNA, 301 bp, Homo sapiens
  AF126403.2_147275
  Located on chromosome 8
  Distance between a terminus base of telomere on chromosomal short arm and 5'-terminus of this base sequence : 128037251
  Distance between 3'-terminus of neighbour sequence of sequence listing upward to telomere on chrosomal short arm and 5'-terminus of this base sequence : -301
gttactcaggaagctgaggtaggaggattgcttgagcctaggagttcgaggctggtgtgagttattgtgccactgcactccagcctcagtgacaaagtgagaccctagcacaaaagggaggaaggaaggatggaaggaaggaaggaaggaaggaaggaaggaaggaaggaaggaaggaaggaaggagggagggataataaatatatgttgttttaaggcactaaatttgtggtcatttgttatgcagcaaaagaatactaacacattctgcctccgggtgtactgtcaacttgaaattaca

SEQ ID NO: 14490 - DNA, 230 bp, Homo sapiens
  D8S508
  Located on chromosome 8
  Distance between a terminus base of telomere on chromosomal short arm and 5'-terminus of this base sequence : 128060385
  Distance between 3'-terminus of neighbour sequence of sequence listing upward to telomere on chrosomal short arm and 5'-terminus of this base sequence : 22833
tgggttcctagcacctggcacattaactgaccctcagcaagcacttcttggatgcgttgactttccaaactggtctccaactaccatcaagcattatatataataattccttaacaacttctcttacaaaaatagggcaaccctgtcgatccacagcacacacacacacacacacacacacacacatatgcacacacatatgcatacaaacatgatattccaggatggcc

SEQ ID NO: 14491 - DNA, 258 bp, Homo sapiens
  D8S1774
  Located on chromosome 8
  Distance between a terminus base of telomere on chromosomal short arm and 5'-terminus of this base sequence : 128136161
  Distance between 3'-terminus of neighbour sequence of sequence listing upward to telomere on chrosomal short arm and 5'-terminus of this base sequence : 75546
cctgaggcttaggcattattagcctcaaggccaattcacttctgagagtgagagtttcgtgtgtgtgtgtgtgtgtgtgtgtgtgtgtgtgtgtgtgtgtgtgtgtgtattgtaggtaaatgcagtgtgtattgtaggtaaatgcaggatgaagccttcctggaggagaccagtgagctgagcttggagagatgtgagcaattagctcgggggatggggagggaatgaagcttccagacaaagtcagcaacctatgca

SEQ ID NO: 14492 - DNA, 302 bp, Homo sapiens
  AF126403.2_20350
  Located on chromosome 8
  Distance between a terminus base of telomere on chromosomal short arm and 5'-terminus of this base sequence : 128164097
  Distance between 3'-terminus of neighbour sequence of sequence listing upward to telomere on chrosomal short arm and 5'-terminus of this base sequence : 27678
catcaagttgtaatacgattgatacttactgttatttatttatttatttatttatttatttatttatttatttatttatttgagatggagtcttgctctgttgcccaggctagagtgcagtggcgcaatctcggctctctgcaactgccacctcccgagttcaagcgattctcctgcctcagcctccctagtagctgggattataggtgcccgccactgggcccagataatttttgtatttttagtaaacaccgtgtttcgccatcttggccaggctggtctctaactcctaacctcgtgat

SEQ ID NO: 14493 - DNA, 209 bp, Homo sapiens
  D8S1813
  Located on chromosome 8
  Distance between a terminus base of telomere on chromosomal short arm and 5'-terminus of this base sequence : 128399361
  Distance between 3'-terminus of neighbour sequence of sequence listing upward to telomere on chrosomal short arm and 5'-terminus of this base sequence : 234962
ggtttattgctttccactccagtcccttgcctctatgcatcacacacacataaaacttgattcgcatcagtctttataatctccacgacaaaaatgaaacaaataacaacaaccgcttctagttagtccctctgccttctgaatcaatgatttatgatgtgtgtgtgtgtgtgtgtgtgtgtgtggtggataccttgggatgatggtgg

SEQ ID NO: 14494 - DNA, 472 bp, Homo sapiens
  AC024382.2_66777
  Located on chromosome 8
  Distance between a terminus base of telomere on chromosomal short arm and 5'-terminus of this base sequence : 128471677
  Distance between 3'-terminus of neighbour sequence of sequence listing upward to telomere on chrosomal short arm and 5'-terminus of this base sequence : 72107
agtaaaggctacaggaacgtaccttaaccatagtgtagaaagcactattgactgttttctatgttcaagagcaaagaaagaaacaccttgtaatggttaatatcagatgtcaacttgactggatcaagggatgcctagatggctggtgaagtgttattctgggtgtgtctgtgagggtgtttccagaggtgattgacatgggagtcagtgaactaagacctgccctcaacgtgaacaggcagtatccagttggctgggggcccctctaagaaaaagcaggcagaagaagagggatactcatctctctcttgctctctctctctctctctctctctctctctctgccagagtgggatgcctttttcttctcctgcccttgatatcagactccagggtctttggcttcttgattctgggattcgaacccatggtctcctgaggttctcaggcctttagcctcacactaggactc

SEQ ID NO: 14495 - DNA, 332 bp, Homo sapiens
  AC024382.2_57004
  Located on chromosome 8
  Distance between a terminus base of telomere on chromosomal short arm and 5'-terminus of this base sequence : 128550602
  Distance between 3'-terminus of neighbour sequence of sequence listing upward to telomere on chrosomal short arm and 5'-terminus of this base sequence : 78453
tggtcactagcaagtttattctacttttcatatgctttccccatttccccccattttcagataattgcactgtatctaaattgtcagaacacatagccattacctgctatgctgtctcagtttagccattatctagtctaacacacacatgcacacacacacacacacccctatatgtacacacatatcaacacctacacatcaacacacacacacacacacacacacacacacacacacacactcctatatccatctctcaaatacgagcatgtggggatggatctctctgctcttgggtctcctccttaactccatggtagtgtactgat

SEQ ID NO: 14496 - DNA, 470 bp, Homo sapiens
  chr8.fa.O7frz.135612748
  Located on chromosome 8
  Distance between a terminus base of telomere on chromosomal short arm and 5'-terminus of this base sequence : 128642148
  Distance between 3'-terminus of neighbour sequence of sequence listing upward to telomere on chrosomal short arm and 5'-terminus of this base sequence : 91214
ataggatttgtagcttccatctcacactccatatgtcttcctcagaagaagagctaagaatatttccttccttccttccttccttccttccttccttccttccttccttccttccttccttttttttctagacaaatttttgctctgtcacccaggctggaatgcagtggcgtgatctcagctcactacaacctccacctcctgagttcaagcaattctcttgcctcagcctcctgagtaggtgggattacaggtgtgctccccaatgcttggctaatttttgtatttttagtatagatggggttccaccatgttggtcaggctggtctcgaatgcctgacatcgtgatccgtccgccttggactcccaaagtgttgggattacaggcgtgagccactgtgcccagcctgatttattttttaaaaaatacaaaagaaaccagccctcactataaccagtgaagcagtttg

SEQ ID NO: 14497 - DNA, 135 bp, Homo sapiens
  DISO7_10002656
  Located on chromosome 8
  Distance between a terminus base of telomere on chromosomal short arm and 5'-terminus of this base sequence : 128702577
  Distance between 3'-terminus of neighbour sequence of sequence listing upward to telomere on chrosomal short arm and 5'-terminus of this base sequence : 59959
gccttatgcagtacatagaaggctctctctctctctctctctctctctctctctatatatatatatatatatatacacacacacacacacacacacatatattttttgcagataagaagaaggatggaaagaagc

SEQ ID NO: 14498 - DNA, 139 bp, Homo sapiens
  DISO7_10002657
  Located on chromosome 8
  Distance between a terminus base of telomere on chromosomal short arm and 5'-terminus of this base sequence : 128720721
  Distance between 3'-terminus of neighbour sequence of sequence listing upward to telomere on chrosomal short arm and 5'-terminus of this base sequence : 18009
ctgtctgacacaactcagctctatagtattttttcttacattgtgttctctgtataaaatatctatctatctatctgtctgtctatctatctatctttcctagtcttatttctagcattattaatagcagtttgttgtt

SEQ ID NO: 14499 - DNA, 161 bp, Homo sapiens
  DISO7_10002660
  Located on chromosome 8
  Distance between a terminus base of telomere on chromosomal short arm and 5'-terminus of this base sequence : 128774045
  Distance between 3'-terminus of neighbour sequence of sequence listing upward to telomere on chrosomal short arm and 5'-terminus of this base sequence : 53185
agaggtgtatgcaaggtatttgtatatatatatatatgtgtgtgtgtgtgtgtgtgtgtgtgtatgtgtacatatatatagagagacttataaatcttattaaaacaagctcttgaagttgaaaaattttatgttttgtcaacaaactgtaatggtagtca

SEQ ID NO: 14500 - DNA, 103 bp, Homo sapiens
  DISO7_10002661
  Located on chromosome 8
  Distance between a terminus base of telomere on chromosomal short arm and 5'-terminus of this base sequence : 128835435
  Distance between 3'-terminus of neighbour sequence of sequence listing upward to telomere on chrosomal short arm and 5'-terminus of this base sequence : 61229
gtgtgctatcactgaggtagaagacatctctctctctctctctctctctctctctctgttttggtctacttttagtaagacttgtatttgattgagttcagaa

SEQ ID NO: 14501 - DNA, 124 bp, Homo sapiens
  DISO7_10002662
  Located on chromosome 8
  Distance between a terminus base of telomere on chromosomal short arm and 5'-terminus of this base sequence : 128895430
  Distance between 3'-terminus of neighbour sequence of sequence listing upward to telomere on chrosomal short arm and 5'-terminus of this base sequence : 59892
  misc_feature (1)...(124): n = A,T,G or C
tgctttcaggtcaccttatggtgtgtgtgtgtgtgtgtgtgtgtgtgtgtgtgtgtgtatgtgtatgtgtgtgtgcacataatacatttacatgaaagttcacaagcnctgaggcagcctacta

SEQ ID NO: 14502 - DNA, 168 bp, Homo sapiens
  DISO7_10002664
  Located on chromosome 8
  Distance between a terminus base of telomere on chromosomal short arm and 5'-terminus of this base sequence : 128906459
  Distance between 3'-terminus of neighbour sequence of sequence listing upward to telomere on chrosomal short arm and 5'-terminus of this base sequence : 10905
tcaaaccacagaagagttgcaaaagtgtagaaggacacacacacatgcacgcacacacacacacacacagagaaaacacatacacagagacacagagagagagagagagagagacttctagagggtcttttgtcataaagaatggaaggagagagcagagatgcccac

SEQ ID NO: 14503 - DNA, 178 bp, Homo sapiens
  DISO7_10002663
  Located on chromosome 8
  Distance between a terminus base of telomere on chromosomal short arm and 5'-terminus of this base sequence : 128906459
  Distance between 3'-terminus of neighbour sequence of sequence listing upward to telomere on chrosomal short arm and 5'-terminus of this base sequence : -168
tcaaaccacagaagagttgcaaaagtgtagaaggacacacacacatgcacgcacacacacacacacacagagaaaacacatacacagagacacagagagagagagagagagagacttctagagggtcttttgtcataaagaatggaaggagagagcagagatgcccacaggtagataa

SEQ ID NO: 14504 - DNA, 193 bp, Homo sapiens
  DISO7_10002665
  Located on chromosome 8
  Distance between a terminus base of telomere on chromosomal short arm and 5'-terminus of this base sequence : 128908167
  Distance between 3'-terminus of neighbour sequence of sequence listing upward to telomere on chrosomal short arm and 5'-terminus of this base sequence : 1530
gcaacctagaaggacatgcaaaacacacacacacaccacacacacacatatacacatgtacaaacacatgcacatacacacagcaatactcacatacacacacacacccatacacacacacatatgcacacacatataccacacacatacacacacacaccccacacacaaaagcatatctacagccacagga

SEQ ID NO: 14505 - DNA, 458 bp, Homo sapiens
  chr8.fa.O7frz.135923184
  Located on chromosome 8
  Distance between a terminus base of telomere on chromosomal short arm and 5'-terminus of this base sequence : 128951564
  Distance between 3'-terminus of neighbour sequence of sequence listing upward to telomere on chrosomal short arm and 5'-terminus of this base sequence : 43204
aatttggcctcatactcctcagtctccatgttttagcttagatattgtttcctccaggcggccctccttgaccttccaattctggttaaattgctctttttctgagttctcattactttactgattttatatatgtgtgtgtgtatatatatatatacacacacacacacacacacatatatatacacacacatatatatatatgttgtgcctagcaagtgtatgacacaaaatacccataaattgaatgaatgaatgaattaataaagaaatgaataacttacccaacctggtaagtggcagggctggccaggtcagtgcaacttcaaagtcgatgttgtcagtgaatgctccagatggattgcagagaagaccaaagttcatgtctcggcacctttcccaatgtacagggcttattgttgggacagagtagtgcctggcctagaagttaaacattc

SEQ ID NO: 14506 - DNA, 212 bp, Homo sapiens
  DISO7_10002667
  Located on chromosome 8
  Distance between a terminus base of telomere on chromosomal short arm and 5'-terminus of this base sequence : 129021500
  Distance between 3'-terminus of neighbour sequence of sequence listing upward to telomere on chrosomal short arm and 5'-terminus of this base sequence : 69478
tcacatgccagttcatctcacagagtgagatgagtccctcaagtacagagattgttcatcttttcatctctgcagttcccatgcccagtacaggtcctggtatgtaaagggcacccaacatgtatgttgaatagatggatggatggatggatggatggatggatggatggatggataaatggatcagtagatggatcaatgggtggatgaat

SEQ ID NO: 14507 - DNA, 447 bp, Homo sapiens
  Z46773.1_5536
  Located on chromosome 8
  Distance between a terminus base of telomere on chromosomal short arm and 5'-terminus of this base sequence : 129324802
  Distance between 3'-terminus of neighbour sequence of sequence listing upward to telomere on chrosomal short arm and 5'-terminus of this base sequence : 303090
tctagcacaggtttagtaaatgagaatttctttccctctttctcctccgtcatccttcctttcctactttccttccttccttctctctctctttctctttctttctctttctttctttctttattctttctttctttattctttcttctttctttcttctttctttctctctctcccttccttccttccttctctctctctctctttctctcttccccttcccttccctccccttccctttccttcctccctcccttctccctctttttctctcttctccttcccttccctttctttctttcttccttcattccttttttccttccttcccttcccttcccttccttccttccttccttccttccttccttccatccttccttccttccttccttccgatagtgtctcactctgccacccaggctggagtgcaatgtcatgatcaca

SEQ ID NO: 14508 - DNA, 132 bp, Homo sapiens
  D8S1720
  Located on chromosome 8
  Distance between a terminus base of telomere on chromosomal short arm and 5'-terminus of this base sequence : 129471565
  Distance between 3'-terminus of neighbour sequence of sequence listing upward to telomere on chrosomal short arm and 5'-terminus of this base sequence : 146316
gtgccacctgcctgaaagaaaatgcccaccctagggaaaaagacacacacacacacacacacacacacacacacagagagagagagagagagagagagagagaccaacgtggcctctctaaataggtagtgg

SEQ ID NO: 14509 - DNA, 207 bp, Homo sapiens
  Z67586
  Located on chromosome 8
  Distance between a terminus base of telomere on chromosomal short arm and 5'-terminus of this base sequence : 129640586
  Distance between 3'-terminus of neighbour sequence of sequence listing upward to telomere on chrosomal short arm and 5'-terminus of this base sequence : 168889
gatctttgtgtgtccgtatgtgtgtgtacacatacattattttttaactgctatatagtattattttcccaaactatttcctacacacacacacacacacacacacacacacatacacaaggaggccaaacatcttgtcttttttttttttttttttttaaagacagggtcttgctctgtcatccaggctggagtgcagtggtgcaa

SEQ ID NO: 14510 - DNA, 395 bp, Homo sapiens
  AC007860.6_6228
  Located on chromosome 8
  Distance between a terminus base of telomere on chromosomal short arm and 5'-terminus of this base sequence : 129655112
  Distance between 3'-terminus of neighbour sequence of sequence listing upward to telomere on chrosomal short arm and 5'-terminus of this base sequence : 14319
ttaatgaatagtgattcgacctaaccaattaaatccctgggagttttaaactcttgtccaacatcagttttatttcacgtcttattataaaacagtacatacctcttccagaaaaagtgaaaaacccttatatcacttagatgtaactaattaaacaaactgatgcatgtgtgtgtgtgtgtgtgtgtgtgtgtgtgtgtatagttgtatggtggtatatatattagtttgtaaatagctcttctactaaatacatgataaatatactttgacatcatcatgtgtacttctactacatcaccatttgactgcttggacaccagacttcaccgttgttcagacctaagtggcaaaaccctttgtatttttctaagtgtctaggcagacatttagga

SEQ ID NO: 14511 - DNA, 183 bp, Homo sapiens
  AC007860.6_125723
  Located on chromosome 8
  Distance between a terminus base of telomere on chromosomal short arm and 5'-terminus of this base sequence : 129774722
  Distance between 3'-terminus of neighbour sequence of sequence listing upward to telomere on chrosomal short arm and 5'-terminus of this base sequence : 119215
tcttaaggtacctttcacactgagcctatgggagtggtggtatgtgcatgtatgtgtgtgtgtgtgtgtgtgtgtatatatggtgtgtatgtatttatgtaaactttatatcatgtttcaatccaattctctctctctctctctccacagagctaagtggtaccacaagaattcaaacctaga

SEQ ID NO: 14512 - DNA, 217 bp, Homo sapiens
  chr8.fa.O7frz.137342932
  Located on chromosome 8
  Distance between a terminus base of telomere on chromosomal short arm and 5'-terminus of this base sequence : 130034731
  Distance between 3'-terminus of neighbour sequence of sequence listing upward to telomere on chrosomal short arm and 5'-terminus of this base sequence : 259826
caaagttctggaattacagataatgggttttattttttaatagtttctgtgctttcagaaaatttttaaaaatgaaatatgtgtctgattttgtttactgtatgtgttgtgtgtgtgtgtgtgtgtgtgtgtgtgtgtgtgtgtgtgtctaagattcaagggctctaacttctctctccaactgttaaagatagtgtctgagtatgctaagactcat

SEQ ID NO: 14513 - DNA, 377 bp, Homo sapiens
  chr8.fa.O7frz.137060028
  Located on chromosome 8
  Distance between a terminus base of telomere on chromosomal short arm and 5'-terminus of this base sequence : 130238109
  Distance between 3'-terminus of neighbour sequence of sequence listing upward to telomere on chrosomal short arm and 5'-terminus of this base sequence : 203161
agaatacttcctcaagatcatttaatacctgtggcagaaagggacaacagagctgaaattagcatgaggtggtctcaagaaatcaggaaagaaagagagaaacaaggaaggaaggaaggagagaaagagaaagaaagaaagagagagagagaaagaaagaaaaagaaagaagaaagaaagaaagcaagaaagagagaaagaaagaaagaaagaaaaagaaagaaagaaagaaagaaagaaagaaagaaagaaagaaagaaagaaagaaagaaagaaagaaagaagaaaagaaagaaaccaggagtcagaattggggaaccaggttcaagattcagttccagccactgatgaggtgtgtaaatttggctaaggtcctc

SEQ ID NO: 14514 - DNA, 439 bp, Homo sapiens
  AC067844.3_110375
  Located on chromosome 8
  Distance between a terminus base of telomere on chromosomal short arm and 5'-terminus of this base sequence : 130364404
  Distance between 3'-terminus of neighbour sequence of sequence listing upward to telomere on chrosomal short arm and 5'-terminus of this base sequence : 125918
aagctacaaaggagtatcaaagtaatacagaagttgagtatcccttatccgaaatgcttaggactataagtgttttgtgtttgaggtgcttttgttgttgttgttgttgtgttttggtatatttgcactatacttatattagttcagcatccctaatccaaaaatcctaaatttgaaatgctccagtgagcatttcctttgagtgtcatgtcaacactcaaaaagtttcagattttggagtgctacagatttcatagctttggatttgggctgcttagcctgaaatatgattattaatactctgtgtgtgtgtgtgtgtgtgtaagttgatagacaaatggaaccttaaatttggtagagcaaataaaaacctaccatctcttaattttcagagagttttagaatcatggaatgtgtcatcttgaggtcaaagtaatta

SEQ ID NO: 14515 - DNA, 281 bp, Homo sapiens
  D8S263
  Located on chromosome 8
  Distance between a terminus base of telomere on chromosomal short arm and 5'-terminus of this base sequence : 130447613
  Distance between 3'-terminus of neighbour sequence of sequence listing upward to telomere on chrosomal short arm and 5'-terminus of this base sequence : 82770
ccctgcctctttagaaattgagtgttattctaaaaaagacaacccacggcctctgcagaaaaatccaaagacagagggagaaaaggatataagcaaggagaacacacacacacacacacacacacacacacacacacacacacaggatatatgcaaagaaacagagggggatcaggtaagttttctctacactgattttctaagtgcgagtctgattctgtcactctcctgctaaacattctttgatggctttccatcactccgactccattttgttacat

SEQ ID NO: 14516 - DNA, 380 bp, Homo sapiens
  chr8.fa.O7frz.137694769
  Located on chromosome 8
  Distance between a terminus base of telomere on chromosomal short arm and 5'-terminus of this base sequence : 130676318
  Distance between 3'-terminus of neighbour sequence of sequence listing upward to telomere on chrosomal short arm and 5'-terminus of this base sequence : 228424
cacttgagctcaggaggtagaggttgccatagccaacatcatgccactgcacaccagcctgggcaacagagcaagtgagactctgtctcaaacacacacacacacacaaacacacacacacacacacacacacacacacatatatatatatatatttactttcattgcaattgcttttggcatcttcgtcaataaatctttgcccattcctatgtccagaatcgtattgcctaggttttcttccagggattttatagttttgggttttacatttaagtctttaaccatcttgagttgatttttgtatatggtgtaagaaaggagtccagtttcagtcttctgcatatggctagacagttcttccagtactgtttattgaa

SEQ ID NO: 14517 - DNA, 140 bp, Homo sapiens
  D8S1842
  Located on chromosome 8
  Distance between a terminus base of telomere on chromosomal short arm and 5'-terminus of this base sequence : 130804958
  Distance between 3'-terminus of neighbour sequence of sequence listing upward to telomere on chrosomal short arm and 5'-terminus of this base sequence : 128260
tttggtttgctgcatctaagagtatatatatatattcacacacacacacacacacacacacacacacacacacacacacagagtcaatacctttatcagtttcagttgttgaaagatgcatgaccctaaaaacaccaaga

SEQ ID NO: 14518 - DNA, 372 bp, Homo sapiens
  AC011257.2_159915
  Located on chromosome 8
  Distance between a terminus base of telomere on chromosomal short arm and 5'-terminus of this base sequence : 130853490
  Distance between 3'-terminus of neighbour sequence of sequence listing upward to telomere on chrosomal short arm and 5'-terminus of this base sequence : 48392
ggcagacatacctaatgctagatgatgagttagtgggtgcagcgcaccagcatggtacatgtatacgtatgtaactaacatgcacattgtgcacatgtaccctaaaacttaaagtataataataataaataaataaataaataaataaataaataaataaaaagaaaaaaatgtaaaaatcattcttagcttgcaggatgcagaacataaaaacaaacaggtagaaagccagatttggcccatgagctgtcatttaccaaactcttgtctatctaaatatgtggtattataaaacacatattttggctctcagtatatacatttataaattgggagtcatatttttgaaggtgataggcagtcataatgagc

SEQ ID NO: 14519 - DNA, 221 bp, Homo sapiens
  D8S1801
  Located on chromosome 8
  Distance between a terminus base of telomere on chromosomal short arm and 5'-terminus of this base sequence : 130979906
  Distance between 3'-terminus of neighbour sequence of sequence listing upward to telomere on chrosomal short arm and 5'-terminus of this base sequence : 126044
tttccgtctgtgattacagtagcctctgtctctttctctctctctctctctctctctctgtgtgtgtgtgtgtgtgtgtgtgtgtgtgtgtgtgtttattccttcttcccatctctttgtgctttctcaatatattgtgctcttctgaacctcgccaagattgagaagataaatgctgtccgcctcacatggttatgatgaaagtcatcaggacccagcct

SEQ ID NO: 14520 - DNA, 368 bp, Homo sapiens
  chr8.fa.O7frz.138156216
  Located on chromosome 8
  Distance between a terminus base of telomere on chromosomal short arm and 5'-terminus of this base sequence : 131090562
  Distance between 3'-terminus of neighbour sequence of sequence listing upward to telomere on chrosomal short arm and 5'-terminus of this base sequence : 110435
ctatcctggttaccagctatagtagaatgaatgaaattaaattattctgtgatagttatcaaataacaaaaagaattttatttcaggaatttgagaactagatttgaaatttaatcgtttgctccagaatgctaacataaacagtaataatagatagatgggtgggtagatagatagatagatagatagatagatagatagatagataggtagatagatagatagatgatagagactgctagatatagtatagaatattctatagtcctcatatggtctttgccacatgtttgtttgcttttttcaaaatatttaatggaagaataagaaatctcagttgatataaaaattctagtgagtcgtgacct

SEQ ID NO: 14521 - DNA, 121 bp, Homo sapiens
  D8S1782
  Located on chromosome 8
  Distance between a terminus base of telomere on chromosomal short arm and 5'-terminus of this base sequence : 131133932
  Distance between 3'-terminus of neighbour sequence of sequence listing upward to telomere on chrosomal short arm and 5'-terminus of this base sequence : 43002
cctaccagaaattgagacctatgcatgaagtcagaacattaaacacacacacacacacacacacacacacacacacacacacacacacacactagaaaagcaccagtccacagaagcagaa

SEQ ID NO: 14522 - DNA, 149 bp, Homo sapiens
  D8S1780
  Located on chromosome 8
  Distance between a terminus base of telomere on chromosomal short arm and 5'-terminus of this base sequence : 131187533
  Distance between 3'-terminus of neighbour sequence of sequence listing upward to telomere on chrosomal short arm and 5'-terminus of this base sequence : 53480
tacactccagcctgggtgacagagcaagaccctgttgctaaaacatacacacacacacacacacacacacacacacacacacatatatatacacatatatatacacatataaatttttttaattagtgtgttcctaataatcagaaatt

SEQ ID NO: 14523 - DNA, 122 bp, Homo sapiens
  D8S1732
  Located on chromosome 8
  Distance between a terminus base of telomere on chromosomal short arm and 5'-terminus of this base sequence : 131300768
  Distance between 3'-terminus of neighbour sequence of sequence listing upward to telomere on chrosomal short arm and 5'-terminus of this base sequence : 113086
gtgggatacccccatgtctcagtcttccagcaacttcccaaccacacccaatacacatacacacacacacacacacacacacacctattcacatactcatttacgcacatggcccctgaagt

SEQ ID NO: 14524 - DNA, 276 bp, Homo sapiens
  chr8.fa.O7frz.138460965
  Located on chromosome 8
  Distance between a terminus base of telomere on chromosomal short arm and 5'-terminus of this base sequence : 131379172
  Distance between 3'-terminus of neighbour sequence of sequence listing upward to telomere on chrosomal short arm and 5'-terminus of this base sequence : 78282
atgtgatttacctaagtcactcacaataaccaactataatattttaaattaacttaaccaaatgcatttatcaaatgtgtattcacttaaagagtatgctagggacatagaaagtttgtgagtgtgtgtgtgtgtgtgtgtgtgttacaatattaaataatatgcaatgtattttatgtgtcatttgtctgcacttaagagctttagaaactaaagaaaagtaactgggaagtgaaatgaccttcccaagtttagttggtgagttactcctagaag

SEQ ID NO: 14525 - DNA, 139 bp, Homo sapiens
  D8S1701
  Located on chromosome 8
  Distance between a terminus base of telomere on chromosomal short arm and 5'-terminus of this base sequence : 131451439
  Distance between 3'-terminus of neighbour sequence of sequence listing upward to telomere on chrosomal short arm and 5'-terminus of this base sequence : 71991
cactctagtctgggtgacagggtaagacctcatatcaaaaaaaaaaaaaaggtgtgtgtgtgtgtgtgtgtgtgtgtgtgtgtgtataaaatgatccaaacactcccacagattggaaagccaagaccaagtaatcttt

SEQ ID NO: 14526 - DNA, 396 bp, Homo sapiens
  AC019167.4_58012
  Located on chromosome 8
  Distance between a terminus base of telomere on chromosomal short arm and 5'-terminus of this base sequence : 131538849
  Distance between 3'-terminus of neighbour sequence of sequence listing upward to telomere on chrosomal short arm and 5'-terminus of this base sequence : 87271
cttacctgtgagcagataacacagggaactgcctgttgcttggcaaatgctcaataaatgttggtttcccatggggcatatgcaaccccaccaaggggacctgccaaatctcctctataaacattcaaagaaacataaaaggacacatagcaggatatcttccacccacccaagacccacaatcccctaagcttttccaagagatatacagaattcccccagacactgtgtgtgtgtgtgtgtgtgtgtgtgtgtgtccttccagcaatcgcccaggcataatcaagcatgagtatgtgtgtgggtgggtgtgtataaacacttataccctcttcttgttttcctacatctggcagcataccacatatactttcctgcaaattgctttattcttaa

SEQ ID NO: 14527 - DNA, 311 bp, Homo sapiens
  chr8.fa.O7frz.138662060
  Located on chromosome 8
  Distance between a terminus base of telomere on chromosomal short arm and 5'-terminus of this base sequence : 131570706
  Distance between 3'-terminus of neighbour sequence of sequence listing upward to telomere on chrosomal short arm and 5'-terminus of this base sequence : 31461
caggaactcacttattcattaaacaaatatttactgaacacctagagtatgttctattctaagtgcaaatataccagcgtgaacacaggcaaaaatcactgccctctaagataccatcatgaaatggtgttatgaaaacccagtatgcctttgtgaaggaaggaaggaaggagggagggagggagggagggagggagggagggaaggagggagggaaggaaggaaggaaggaaggaaggaggaggaggaggaggagggaggaaaggagggagagggaataccaagtgatctattcaagatgtcacttaagc

SEQ ID NO: 14528 - DNA, 421 bp, Homo sapiens
  chr8.fa.O7frz.138751120
  Located on chromosome 8
  Distance between a terminus base of telomere on chromosomal short arm and 5'-terminus of this base sequence : 131673398
  Distance between 3'-terminus of neighbour sequence of sequence listing upward to telomere on chrosomal short arm and 5'-terminus of this base sequence : 102381
ttcgctacagaattactgagagtggctgggcagggaactagatgaaagaagatcaggtataaactgttaagtgctggaatgggtgataagtatgtgggtgtggtggaggaggctgcaggatactattctgtgtctttttttgtatttctgtatatgtttattacggaaaattccaaatagtaaacacacacacacacacacacacacacacacacacacacacacacacacagagagagaacgagagtagagcaacggggtggtggtaggagggacacaggtcttcatgggtattgacagtaggcctgcctgatagggcaagtcagatggaaggaaacagcaatgcaaaagatggagggacacctgctggagtctgtccccgagggggtgggagggtacaaggtctaccttaggaccacgg

SEQ ID NO: 14529 - DNA, 403 bp, Homo sapiens
  chr8.fa.O7frz.138968646
  Located on chromosome 8
  Distance between a terminus base of telomere on chromosomal short arm and 5'-terminus of this base sequence : 131801964
  Distance between 3'-terminus of neighbour sequence of sequence listing upward to telomere on chrosomal short arm and 5'-terminus of this base sequence : 128145
ctttagttggaaacaatccttccttgcccacaattctctgtacctctactgcagtattttctaccacatcctatatgtgtatatatgtatatatacacgtatatatacacacgtatatatgtatattatatgtgtatatatgtgtatatatgtgtgtatatatgtacacacacacacacacacacacacacacacagatcttttcctaccaccagaccgcaagaggcagggattacctatggttcacttctgcatccctacccaatggacactgctgtagttctttcagtgagctggactttcaaagctgcggcttggttaatatttgttgacctggatttattgaattccttttcaggaatttaagaagcatccctttctgaaatagcgtaggatgttcaat

SEQ ID NO: 14530 - DNA, 342 bp, Homo sapiens
  chr8.fa.O7frz.138853891
  Located on chromosome 8
  Distance between a terminus base of telomere on chromosomal short arm and 5'-terminus of this base sequence : 131814610
  Distance between 3'-terminus of neighbour sequence of sequence listing upward to telomere on chrosomal short arm and 5'-terminus of this base sequence : 12243
gtgagactgcgttactgctctccagcctgggcaacacagtgagatcctgtctccaaaacaaacaaacaaacaaacaaacaaacaaacaaacaaacaccaaccccaaactagcggtcgtgggatgagtactcacaaatttattttaaactacttaatttatcatgatgtacattccccaaagatagaagaagcacacatcattaaaaaattaactcattttaagtaaaatgagagcactcattctacaaccagcaaaacggaggaagtgcatacacaggctcatacacacagtgaatagcttctaatttcaagtaaaagaatatgtgagccaataactaggat

SEQ ID NO: 14531 - DNA, 217 bp, Homo sapiens
  D8S1712
  Located on chromosome 8
  Distance between a terminus base of telomere on chromosomal short arm and 5'-terminus of this base sequence : 132175100
  Distance between 3'-terminus of neighbour sequence of sequence listing upward to telomere on chrosomal short arm and 5'-terminus of this base sequence : 360148
actcacagattgttgcgacattaatatgactgatgtgtgtgtgtgtgtgtgtgtgtgtgtgtgtgtgtgagagagagagagagaggggaaggggcatgcttatattctcaaaagatgttatagaataaaacaatattagaatcacagatctagaggaaacgttctggcctgacatcctcactctataataccatttcacgtctccagtcagtgcatt

SEQ ID NO: 14532 - DNA, 295 bp, Homo sapiens
  chr8.fa.O7frz.139713632
  Located on chromosome 8
  Distance between a terminus base of telomere on chromosomal short arm and 5'-terminus of this base sequence : 132204941
  Distance between 3'-terminus of neighbour sequence of sequence listing upward to telomere on chrosomal short arm and 5'-terminus of this base sequence : 29624
aggtttgatcattctacattgtacatatatatcaaaacaacacattgtactccacaaatgtaatacaattatgatttttcaattaaaaataatatttttacttaaaaagtcatcctgcagcctggaggggttgatttgtaaagcctgggtttcaaatacaggaggtggatagggtggagtgtgagtgtgtgtgtgtgtgtgtgtgtgtgtgtgtgtgtgtgtgtgggtgtgggtggaaggtagactggatggtcagatatggatatgatcaatgttaaagctgacaactgaaaga

SEQ ID NO: 14533 - DNA, 257 bp, Homo sapiens
  D8S284
  Located on chromosome 8
  Distance between a terminus base of telomere on chromosomal short arm and 5'-terminus of this base sequence : 132483243
  Distance between 3'-terminus of neighbour sequence of sequence listing upward to telomere on chrosomal short arm and 5'-terminus of this base sequence : 278007
tttgaacacaggtctgccaggctgcattcattctttcatttattcaacaaatccttgtgtgtgtgtgtgtgtgtgtgtgtgtgtgtgtgtgtttaacaaatacaaatgaaatgcttactatgttccaggcatggttccaaatgctttatcaacaccaactcattcaactctcactacatccccagaggattgggactattgttatctcattttacagataaggaaatggaggcacagagacatgcagtaacatgccc

SEQ ID NO: 14534 - DNA, 470 bp, Homo sapiens
  chr8.fa.O7frz.139259732
  Located on chromosome 8
  Distance between a terminus base of telomere on chromosomal short arm and 5'-terminus of this base sequence : 132517647
  Distance between 3'-terminus of neighbour sequence of sequence listing upward to telomere on chrosomal short arm and 5'-terminus of this base sequence : 34147
aagaactatgaacaatactgcaagtaaccacatggacaaatctcacagatataatgagagagagagagagagagagagagagagagagaaagagagagagaaaccctaggcacaaaagagaaagcctaggcataaaagagtatatacagagtagatattgtttggctctatctacgtgaagttcaacaacaggtaaaactaatcaatagtaatagaagtcagaaaaacctggatgtggtggttgtgcgccagtagtcccagcgacttgggaggctgagacagcagaatcgcttgagattgtgccactgcactccagcctgggcaacagagtgagactctgtctcaaaaagaagtgactgcttttagggggaatcctttgtcaactgggagagggcataagaaagccctctgaggtgttagaaatactgtatattttgaacagagtggtggttacataggcatagatgtat

SEQ ID NO: 14535 - DNA, 334 bp, Homo sapiens
  chr8.fa.O7frz.140022929
  Located on chromosome 8
  Distance between a terminus base of telomere on chromosomal short arm and 5'-terminus of this base sequence : 132771669
  Distance between 3'-terminus of neighbour sequence of sequence listing upward to telomere on chrosomal short arm and 5'-terminus of this base sequence : 253552
gtaacaatgtcaagctgaatctttgcaagaatattccggtctggctggagaaggatactagtactagtaaatatggtatctgtgtgtgcatgtgtgtataagagagagaagagaagagaagagaagagaagagaagagaagagaagagaagagaagagaagagaaagagagagagagagggacagagaattaagtagaattatgcatgcatctagatgtctaatgtgtataaggtgttgctactattattattatggccctgttgctattaattatcagaggtacagaaaatgaaattcagaaatattaagtgacttgtccaatatcactaact

SEQ ID NO: 14536 - DNA, 137 bp, Homo sapiens
  DISO7_10002669
  Located on chromosome 8
  Distance between a terminus base of telomere on chromosomal short arm and 5'-terminus of this base sequence : 132961062
  Distance between 3'-terminus of neighbour sequence of sequence listing upward to telomere on chrosomal short arm and 5'-terminus of this base sequence : 189059
ccataataccactttaggagttagggtcattattaatagtctcttaatacattatatattcaataaatacatatcaaatagttactatcatcatcatcatcatcatcatcattgtcattcctgttatgtgtaaggct

SEQ ID NO: 14537 - DNA, 380 bp, Homo sapiens
  AC027761.3_106105
  Located on chromosome 8
  Distance between a terminus base of telomere on chromosomal short arm and 5'-terminus of this base sequence : 133120078
  Distance between 3'-terminus of neighbour sequence of sequence listing upward to telomere on chrosomal short arm and 5'-terminus of this base sequence : 158879
ggaatgactgaatgagtaaataagcaaatgaagaaaatactttcatctgatattagtttcatcacatttatttatttatttatttatttatttatttatttatttatttattttttgagatggagtcttgctctgtggcccaggctagagtgcaggggcatgatctcagctcactgcaacctccacctcccaggttcaagggattcccctgactcagcctcctgagtagctgggattacaggcacacaccacacacccaactaatttttgtatttttagtagggacggggtttcatcatgttggccaggctggtctcgaactcctgacctcaagtgatacacctgcctcggcctcccaaagtgctggtattacagacatg

SEQ ID NO: 14538 - DNA, 374 bp, Homo sapiens
  chr8.fa.O7frz.140566826
  Located on chromosome 8
  Distance between a terminus base of telomere on chromosomal short arm and 5'-terminus of this base sequence : 133242816
  Distance between 3'-terminus of neighbour sequence of sequence listing upward to telomere on chrosomal short arm and 5'-terminus of this base sequence : 122358
ccaaagctactttaggattgaccgtgggatcatggaagactgaaacaagaggcaagagcatagtgctgctggccatgttcctatttttcacactaagatgtaaaagactcccaggaaaattggaacaattgaatagaaagtaaagtcaaggggaaggaaaaaaaaggacaaaaagagagagagagagaaagagaaaagaagggaaaaggaggggaggggagggaaggggaggtacaatcacctataaggtacttactcccacttattgccattttctttatgagaaaactgaggcttagagaacttaaataatttttccataggttatgaagttaagaggcaaagttaaggttcagacctaaggagtcttattc

SEQ ID NO: 14539 - DNA, 387 bp, Homo sapiens
  chr8.fa.O7frz.140669299
  Located on chromosome 8
  Distance between a terminus base of telomere on chromosomal short arm and 5'-terminus of this base sequence : 133299030
  Distance between 3'-terminus of neighbour sequence of sequence listing upward to telomere on chrosomal short arm and 5'-terminus of this base sequence : 55840
ggacttagctgaatctgaagtcctttccagctctcacatgctttgagcctataaaacaccattcacactagaaaagtgtcttcatgcctctctctctctctgtctctctctcctaacatcccaaggccaaaggggtttcatttatctggcaatagcaggttccacactgaggaacaatttttactggtgaaattgtatcgagaaccgtgaaaaagaagtgaacatcacatacactcaaaggtgccagttcatcccgattccatttcccccagaaattgacctaatgtccaaaaccatttcagttaatggctacatgtctattgcttgctctccagcgaaagcaaataacgatccctggatttgttcttaactgagtcctgaaaggtc

SEQ ID NO: 14540 - DNA, 471 bp, Homo sapiens
  chr8.fa.O7frz.140891406
  Located on chromosome 8
  Distance between a terminus base of telomere on chromosomal short arm and 5'-terminus of this base sequence : 133557743
  Distance between 3'-terminus of neighbour sequence of sequence listing upward to telomere on chrosomal short arm and 5'-terminus of this base sequence : 258326
agtgaaacaccatcaagaaagaaaaagaaaaagaaagaaagaaaagaaagaaagaaagaaaggaaggaaggaaggaaggaaggagggaaggagaaaggaaggaaggaaagaaaggaaggaaggaagaaagaaagaaagagagacagaaagaaagaaagagaaagaaagaaagaaagagagacagaaagaaagaaagaaagagaaagaaagaaaggaaggaagaaaggaagagagagatagagagaaagaaagaaagagaggaagaaagaagaaggaaagaaagaaaaagaaagaaagaaagaaaaagaaagaaagaaagaaaaggaaagaaggaaagaggaaggaaggaagggaaggaaggaaaagaaagaaagaaaaggaaagaaggaaagaggaaggaaggaaggaaggaagggaaggaaggaaaagaaagaaagaagaaaagagtattaagtcacagttaagtgcttg

SEQ ID NO: 14541 - DNA, 243 bp, Homo sapiens
  D8S557
  Located on chromosome 8
  Distance between a terminus base of telomere on chromosomal short arm and 5'-terminus of this base sequence : 133678107
  Distance between 3'-terminus of neighbour sequence of sequence listing upward to telomere on chrosomal short arm and 5'-terminus of this base sequence : 119893
cagggtacagacatgcttgaccacttcgattcagacatgaaattgctgagacattgaaacgttatcaaagggcaaatgcaatgtgaacgtgtaatataagtaatccaggggcttaaactttactctgaactgaaataaatggaccaaagtaagcattgttttcctaagcaccaataaacacacacacacacacacacacacacacacacacacacacaacctctaaatctctaggaccccagg

SEQ ID NO: 14542 - DNA, 416 bp, Homo sapiens
  chr8.fa.O7frz.141077494
  Located on chromosome 8
  Distance between a terminus base of telomere on chromosomal short arm and 5'-terminus of this base sequence : 133786757
  Distance between 3'-terminus of neighbour sequence of sequence listing upward to telomere on chrosomal short arm and 5'-terminus of this base sequence : 108407
tgaccaagtatgaatattgtcaccaagtatgaatattgttcatttttacagtcaatggaacctctttcaattggggatctttggaattgtttttgaaatgctagaaagaagaggaactaccacactgaagcatgcagaatgctggtcctttaaaattcacagagaggtcacctggttcatgaccaggctcaggcaggagtgaactacaaacaattttttaagattgttatctttataaactgtgaggtgcgtgtgtgtgtgtgtgtgtgtgtgtgtgagagagagagagagagagagacagagagagagagagagagagagagagagagagagtgagagacagtccctgtttcattgttttaccaaggaaaatggttctccctcttggtggagagtctttggcttagttgtcagta

SEQ ID NO: 14543 - DNA, 393 bp, Homo sapiens
  chr8.fa.O7frz.141189932
  Located on chromosome 8
  Distance between a terminus base of telomere on chromosomal short arm and 5'-terminus of this base sequence : 133899131
  Distance between 3'-terminus of neighbour sequence of sequence listing upward to telomere on chrosomal short arm and 5'-terminus of this base sequence : 111958
tctgctatttagataactgttcctattcccataggcaaccaaggtttttagtttcttttttttttcttggtttataagtaaatgcatttttaaaaatttttaatttttgtgagcacatagtacatatatatatatatatatatatggtacatgagaagatattttgatatgggcatgcaatgatgcaatgcataatagtggtggtttttagtttcttacatattcttccagacatactctgagcagatacaagaaaatatgcacattttccccccaaaaattgtttcccacactaatgctactggattacacactctcctacatttggctttcttcacttaaaaacctaatgtggaggtgttttcagagcatttgtattcatatgaaagctgg

SEQ ID NO: 14544 - DNA, 384 bp, Homo sapiens
  AC021093.9_66931
  Located on chromosome 8
  Distance between a terminus base of telomere on chromosomal short arm and 5'-terminus of this base sequence : 133969464
  Distance between 3'-terminus of neighbour sequence of sequence listing upward to telomere on chrosomal short arm and 5'-terminus of this base sequence : 69940
gatttgtctagaagcaacgatgccccagtagcaatgagcatacccaccccattgtccaataaaagaaaccagggttccttagagtaatgtctgattttagggctgggtcagggagtataaaaatgaggctggagtatctcatggtactacaaagtaaggaggtgctcaaacagcacacacacacacacacacacacacacacaatcacacaatggggggttgtcaaagagacacaggagccaacagaaatagttcccaatgatgaggaactgtggttcagcaagattcagttactcgtccatgagcactcagcaaatggtggtagagccaggacttaaacccaggttctgatcctggaaacaagttcttataagcatcgtccac

SEQ ID NO: 14545 - DNA, 452 bp, Homo sapiens
  chr8.fa.O7frz.141375818
  Located on chromosome 8
  Distance between a terminus base of telomere on chromosomal short arm and 5'-terminus of this base sequence : 134013108
  Distance between 3'-terminus of neighbour sequence of sequence listing upward to telomere on chrosomal short arm and 5'-terminus of this base sequence : 43260
atcggactagcaaggagattctttctaggagaacagtgcctgggtgcaaacctccaggccaagcccctcacattcccggtgccctaggccagccaaagcaggagaagcagcagcgactgaggctgagggaatatcggatcccaaatcaaggagatgtttcagccaaaagagtccccggccccctcacctcctggctctgtgaagccccagcccctcagtctaggcttagacacacacgttcccattcacttccctaaaaggaatcctagaacatgcattttggccagtcccagctcccagtcagagcagcaccaggttcttctctgtaccagtacccagcgatcagaagggtggcacaagcaagcgacacacacacacacacacacacacacacgctccccactatgggtggtgcgcacccctcccatccccaactaaactcagtggcgatc

SEQ ID NO: 14546 - DNA, 436 bp, Homo sapiens
  chr8.fa.O7frz.141504773
  Located on chromosome 8
  Distance between a terminus base of telomere on chromosomal short arm and 5'-terminus of this base sequence : 134149836
  Distance between 3'-terminus of neighbour sequence of sequence listing upward to telomere on chrosomal short arm and 5'-terminus of this base sequence : 136276
gttcactttgacaagactcactcttggaaaagttaccccctcttgggtaataatccctccaacctcccagggttactgagagattaaataaaatggggcacatcaaaagccattaaaaagagaaaggcatttattataattcatgcatgtaaacattcatccattcattcatgcatgtcaatgtcatactcccatcatcagtatttgttcattcattcattcattcattcttgtgtttattgagcacctaacaggtgccaggtattgttttaggtgtggagatgtagagaggaaagaacaaacaaaacaagcttcctgctctgaccacaaacttttaagaatacaagtaaatttacactttgtcagcaggaagtcaaaaagtagaaagagtggaaggaagtgctgggcaggggtaggtactgctttatgtcagatg

SEQ ID NO: 14547 - DNA, 220 bp, Homo sapiens
  chr8.fa.O7frz.141817811
  Located on chromosome 8
  Distance between a terminus base of telomere on chromosomal short arm and 5'-terminus of this base sequence : 134300276
  Distance between 3'-terminus of neighbour sequence of sequence listing upward to telomere on chrosomal short arm and 5'-terminus of this base sequence : 150004
tccagctacatcaaatcagtatgcataagccatataataatagctatcaataaggtacattacataatgaaaaatatgaactgggaggttgtgtgtgtgtgtgtgtgtgtgtgtgtattgcacttgttgcctggacttccatgccaacatgccaaagtcacttggcctctctccaatacactccccaagccatggtcagaatgacctctccaatagaata

SEQ ID NO: 14548 - DNA, 172 bp, Homo sapiens
  D8S1740
  Located on chromosome 8
  Distance between a terminus base of telomere on chromosomal short arm and 5'-terminus of this base sequence : 134499720
  Distance between 3'-terminus of neighbour sequence of sequence listing upward to telomere on chrosomal short arm and 5'-terminus of this base sequence : 199224
tcaatatgggctcagcaaggaccaggagacaagacatctgcatgtggtctgcagtgtgtgtgtgtgtgtgtgtgtgtgtgtgtgtgtatttgcatgtaggaataggagtaggagcagaaggaaagaaggaaggagaagggaataagaagagggagagccagatcagactgct

SEQ ID NO: 14549 - DNA, 102 bp, Homo sapiens
  DISD22_0006120
  Located on chromosome 8
  Distance between a terminus base of telomere on chromosomal short arm and 5'-terminus of this base sequence : 134729915
  Distance between 3'-terminus of neighbour sequence of sequence listing upward to telomere on chrosomal short arm and 5'-terminus of this base sequence : 230023
tcgtactgccatcagaggctcttcctggaaacaaaacaaaacaaaacaaaacaaaacaaaacaaccaagaggatcttcttgtctcattacaagatacttcga

SEQ ID NO: 14550 - DNA, 217 bp, Homo sapiens
  DISD22_0006128
  Located on chromosome 8
  Distance between a terminus base of telomere on chromosomal short arm and 5'-terminus of this base sequence : 134807833
  Distance between 3'-terminus of neighbour sequence of sequence listing upward to telomere on chrosomal short arm and 5'-terminus of this base sequence : 77816
acgtgcaacatcaactatcagtagaaatagatacctagatatttatttatttatttattacatttaatacctgaagatgacttagaataatgtgtgtgtgtgtgtgtgtgtgtgtgtgtgtgtagatggcaaagataaaccaataggtagaaattgaaagactgcttttaatttttaatttggggaaggaaaaggtagcttcaagtcttcataattc

SEQ ID NO: 14551 - DNA, 139 bp, Homo sapiens
  HUMUT909
  Located on chromosome 8
  Distance between a terminus base of telomere on chromosomal short arm and 5'-terminus of this base sequence : 134926315
  Distance between 3'-terminus of neighbour sequence of sequence listing upward to telomere on chrosomal short arm and 5'-terminus of this base sequence : 118265
cattcattagccacaggccattttctttctttctttctttctttctttctttctttctttctttctttctttctttctttctttctttctttttctttttttaattttactttaagttctgggatacatgtgcagaaca

SEQ ID NO: 14552 - DNA, 262 bp, Homo sapiens
  D8S529
  Located on chromosome 8
  Distance between a terminus base of telomere on chromosomal short arm and 5'-terminus of this base sequence : 135034286
  Distance between 3'-terminus of neighbour sequence of sequence listing upward to telomere on chrosomal short arm and 5'-terminus of this base sequence : 107832
tgcccctaacctgtctataacattctccctaataacctaaaatcctaaatgtaattagcatgctggcattgaaaacaatcttgtaaataaataagtaatgatacagaatgatatcgacaatggattgttaggtgaaaaagataggctcaaaaacaatatgctgtatagatttcctgaatatatgtttacacacacacacacacacacacacacacacacacacacacacacacacacacggaagagacatattggaggctaa

SEQ ID NO: 14553 - DNA, 166 bp, Homo sapiens
  Z23840.1_233
  Located on chromosome 8
  Distance between a terminus base of telomere on chromosomal short arm and 5'-terminus of this base sequence : 135034393
  Distance between 3'-terminus of neighbour sequence of sequence listing upward to telomere on chrosomal short arm and 5'-terminus of this base sequence : -155
atgatatcgacaatggattgttaggtgaaaaagataggctcaaaaacaatatgctgtatagatttcctgaatatatgtttacacacacacacacacacacacacacacacacacacacacacacacacacacggaagagacatattggaggctaatagcatttaac

SEQ ID NO: 14554 - DNA, 321 bp, Homo sapiens
  AF155238.2_19889
  Located on chromosome 8
  Distance between a terminus base of telomere on chromosomal short arm and 5'-terminus of this base sequence : 135379416
  Distance between 3'-terminus of neighbour sequence of sequence listing upward to telomere on chrosomal short arm and 5'-terminus of this base sequence : 344857
tctatgttctatggagatccaaagcccacctcaagtgtctgctcatttctgaggacttgggttcaagggctcagggttctggcactttgcttttcttcctgttgaattcattaattttcagtgtcatcattccatctttatttacattatgataagtcaggcataagactccatccctttctgtgactgacacacacacacacacacacacacacacacacacacacacacacagcatcccaaggcctttgtgtgtgtgcaggatccttggctaaaggtggaaggcagaggagagccttcactccatagctatgtctacac

SEQ ID NO: 14555 - DNA, 224 bp, Homo sapiens
  D8S256
  Located on chromosome 8
  Distance between a terminus base of telomere on chromosomal short arm and 5'-terminus of this base sequence : 135379476
  Distance between 3'-terminus of neighbour sequence of sequence listing upward to telomere on chrosomal short arm and 5'-terminus of this base sequence : -261
gttcaagggctcagggttctggcactttgcttttcttcctgttgaattcattaattttcagtgtcatcattccatctttatttacattatgataagtcaggcataagactccatccctttctgtgactgacacacacacacacacacacacacacacacacacacacacacacagcatcccaaggcctttgtgtgtgtgcaggatccttggctaaaggtggaag

SEQ ID NO: 14556 - DNA, 101 bp, Homo sapiens
  D8S1708
  Located on chromosome 8
  Distance between a terminus base of telomere on chromosomal short arm and 5'-terminus of this base sequence : 135506362
  Distance between 3'-terminus of neighbour sequence of sequence listing upward to telomere on chrosomal short arm and 5'-terminus of this base sequence : 126662
caggtgaactgctgtgtttatgtggtcccagggcgatagagtgtggttttgtgtgtgtgtgtgtgtgtgtgtgtgtgcatgtgtgcacgtcctaagccact

SEQ ID NO: 14557 - DNA, 420 bp, Homo sapiens
  chr8.fa.O7frz.142978184
  Located on chromosome 8
  Distance between a terminus base of telomere on chromosomal short arm and 5'-terminus of this base sequence : 135679307
  Distance between 3'-terminus of neighbour sequence of sequence listing upward to telomere on chrosomal short arm and 5'-terminus of this base sequence : 172844
tactcagatccacatgaataagacacactcacacccacatctaggctcatgcaaagatgtgcatacacagctgagaatgcatgtgtacttttaagtataatcaagcccacatattcacactgatacatggaacacactcatttgaatgcaaacttacatttgcttataagcatgtgcatacacacacactcacacacacacgcacatacaaacacacatatgcatgcatgcacacatgcacacacgcatgcacgcacacacatatgcacacgcacacacacatgcacacacgcacacatccacacccgcacacacgcatgcatacacacacatgcacacatatgcgcatgcacacaagcacgcacaaacacacacacacacaagcacatgcacatccttcatagtaaatgttccatcctg

SEQ ID NO: 14558 - DNA, 412 bp, Homo sapiens
  chr8.fa.O7frz.143203646
  Located on chromosome 8
  Distance between a terminus base of telomere on chromosomal short arm and 5'-terminus of this base sequence : 135882816
  Distance between 3'-terminus of neighbour sequence of sequence listing upward to telomere on chrosomal short arm and 5'-terminus of this base sequence : 203089
attggaagattacctatccagtactatgctcattatctgggtgatgagatcattcatacaccaagcctcagcagcacacaatttactcatgtaacaaacctgcacatgtatccccagaacctaaaataaaagaagaaaaaaaaacacccaggtatatgctgcctacaagagactcaattcacattaaataaataaataaataaataaataaataaataaataaataaataaaatgagcaatctaatttacatccagcaggagtcccagaaagggcagggtaagagagatttgagagacagtcttcaaatgactgtggatttcccaagctgatgaaagacatggatgccatgtttaggaggacatcaaatcttaagcaaggattgttcagttgatgtaagatagaatggatgt

SEQ ID NO: 14559 - DNA, 182 bp, Homo sapiens
  D8S1746
  Located on chromosome 8
  Distance between a terminus base of telomere on chromosomal short arm and 5'-terminus of this base sequence : 136020441
  Distance between 3'-terminus of neighbour sequence of sequence listing upward to telomere on chrosomal short arm and 5'-terminus of this base sequence : 137213
gcttagactatgggaccacacctccctcctctctttggcacgtgtgcatacacacacacacacacacacacactcacagaagtaaaacaattgccatgtcctgtgtttctcataattgtcttcaaagatgcctttgcaatggctctccagccttttctgcaaagcagggttgatgttcactg

SEQ ID NO: 14560 - DNA, 172 bp, Homo sapiens
  D8S1710
  Located on chromosome 8
  Distance between a terminus base of telomere on chromosomal short arm and 5'-terminus of this base sequence : 136228226
  Distance between 3'-terminus of neighbour sequence of sequence listing upward to telomere on chrosomal short arm and 5'-terminus of this base sequence : 207603
tggtacacaaagagtaggcgctcggtgcctctgatgcactcatgaatgacccacaggagggctcaaaaagttcccattcttctcagcccctaacgtgcaggcacatgtgcacatgcacacacacacacacacacacacacacacacacacacacccttaactctgatgagct

SEQ ID NO: 14561 - DNA, 259 bp, Homo sapiens
  AF307157.1_109046
  Located on chromosome 8
  Distance between a terminus base of telomere on chromosomal short arm and 5'-terminus of this base sequence : 136365577
  Distance between 3'-terminus of neighbour sequence of sequence listing upward to telomere on chrosomal short arm and 5'-terminus of this base sequence : 137179
ctaaacttgattcaaggttcatattagggccagatcccctcctcatgtcttcacattttttctggaccagcagctattcagttctctctctctttctctctgtatgtgtgtgtgtgtgtgtgtgtgtgtgtgtgcaaatgtgtgctttccacaggaccacaagaggccaagccaaacttctcaaatacgtttaaggcctttgtttgtggcccatcttacaacactccattggccaaagtaagtcatgagctaagtccaa

SEQ ID NO: 14562 - DNA, 170 bp, Homo sapiens
  D8S537
  Located on chromosome 8
  Distance between a terminus base of telomere on chromosomal short arm and 5'-terminus of this base sequence : 136420984
  Distance between 3'-terminus of neighbour sequence of sequence listing upward to telomere on chrosomal short arm and 5'-terminus of this base sequence : 55148
gaattttggacttgccacccaccacaatcacgagccaatttcttaaaatcaatctctctgtctctctctctctacacacacacacacacacacacacacacacacacacacacacaacgcacccttattgattgtttctctgcagaacccaacttacagaggcatatacg

SEQ ID NO: 14563 - DNA, 384 bp, Homo sapiens
  chr8.fa.O7frz.144037930
  Located on chromosome 8
  Distance between a terminus base of telomere on chromosomal short arm and 5'-terminus of this base sequence : 136707079
  Distance between 3'-terminus of neighbour sequence of sequence listing upward to telomere on chrosomal short arm and 5'-terminus of this base sequence : 285925
gctacattacgttaggaattgtatagagatctggactccacatctcagattattttctgaagctggattcctctaagggagattctgagtcaaaaattacaaagcatataagattcttgagaactatttgatctttgccttattggttttattttcaagtgggtccccttgtggatactttaaaaaatattagtaaatgttcttctaactggatggtatgaaataattcattcagaaagatatagttggctctatagacatacacacacacacacacacacacacacacactgctaactgtaattctttttcattgagcaaacggtaaaatttctagtcaaacgtgaacaaaaaatgtatctctactctaattctgccagaacc

SEQ ID NO: 14564 - DNA, 478 bp, Homo sapiens
  AF207067.2_50164
  Located on chromosome 8
  Distance between a terminus base of telomere on chromosomal short arm and 5'-terminus of this base sequence : 136808478
  Distance between 3'-terminus of neighbour sequence of sequence listing upward to telomere on chrosomal short arm and 5'-terminus of this base sequence : 101015
agactcatctcttgctatgtacactgaattccaactatgcttccctgggaaaattcccttgatgtgctagtcttctatttctatcggctggagaggggatgggaggacaggggatgaagcacagccagctcagctgtgtctcaataattgttggaggcattgtctcctcattgaccttgccattatttttggttttctatagatagactgttctctctctctctctctctccatccaccgcgcgccccccattccccgcccccccgcctcagcattgagttctagtacccagttccaggataacagaaaactttcactcgatagtgtgatattacttctattaacacacaccccaagtgatagttgggcaagacaatcaagccatctcttctcaggtataggactgctaaggcagtcctgcattctgaaaatatcactcattcacaagatcatttgctcgtgcattcataactttaac

SEQ ID NO: 14565 - DNA, 258 bp, Homo sapiens
  D8S1108
  Located on chromosome 8
  Distance between a terminus base of telomere on chromosomal short arm and 5'-terminus of this base sequence : 136818653
  Distance between 3'-terminus of neighbour sequence of sequence listing upward to telomere on chrosomal short arm and 5'-terminus of this base sequence : 9697
atgcctacaaaaaccagtgctacaaatgcttcaaataagagtaatgaaggagagaatgactggggatactttactccatgaagtttataacttcaatgctctgtatagagctacacctctacaaactcttctctctttctctatctatctatctatctatctatctatctatctatctatctatctctaatgtgtgcattagaactgaaaaacattatgttgcaagagtttaaataagtgtaagagaccaggcaagct

SEQ ID NO: 14566 - DNA, 122 bp, Homo sapiens
  G09586
  Located on chromosome 8
  Distance between a terminus base of telomere on chromosomal short arm and 5'-terminus of this base sequence : 136818746
  Distance between 3'-terminus of neighbour sequence of sequence listing upward to telomere on chrosomal short arm and 5'-terminus of this base sequence : -165
caatgctctgtatagagctacacctctacaaactcttctctctttctctatctatctatctatctatctatctatctatctatctatctatctctaatgtgtgcattagaactgaaaaacat

SEQ ID NO: 14567 - DNA, 170 bp, Homo sapiens
  chr8.fa.O7frz.144386675
  Located on chromosome 8
  Distance between a terminus base of telomere on chromosomal short arm and 5'-terminus of this base sequence : 137055743
  Distance between 3'-terminus of neighbour sequence of sequence listing upward to telomere on chrosomal short arm and 5'-terminus of this base sequence : 236875
atgttgactgtaatgtcgctacatgatgtaaaactgtatatcaatagggagatgttttctgtgtgtatataagtaaacatttgtttcttacattgtgtgtgtgtgtgtgtgtgtgtgtgtgagtaaacagtgcatttggtaccgatctttgactatcagaacatgaagtt

SEQ ID NO: 14568 - DNA, 387 bp, Homo sapiens
  chr8.fa.O7frz.144719714
  Located on chromosome 8
  Distance between a terminus base of telomere on chromosomal short arm and 5'-terminus of this base sequence : 137201810
  Distance between 3'-terminus of neighbour sequence of sequence listing upward to telomere on chrosomal short arm and 5'-terminus of this base sequence : 145897
tcctcagaattgtgacgatattaagatattattttgttgtcttctggcatctgctgttgctgatgaaaagcccactaacagtgctatttgttgtacccagaattaatctgtatatatatatatatatatatatatatatacacatatacacacagattatatatatacatatacagatatgatattaaatgataaccatttaattctgggaacaacagatacactgccagtgggatatctatatctgtatctacatctatttttggttgtttttcttgaatgttctgcacttttgtttcacttttaatgtttttcaaggtaaaagtagaatttctttatatttatcttacgaagaacttgtcacttatcaagctggagactcatatc

SEQ ID NO: 14569 - DNA, 266 bp, Homo sapiens
  chr8.fa.O7frz.144622027
  Located on chromosome 8
  Distance between a terminus base of telomere on chromosomal short arm and 5'-terminus of this base sequence : 137299400
  Distance between 3'-terminus of neighbour sequence of sequence listing upward to telomere on chrosomal short arm and 5'-terminus of this base sequence : 97203
taggaagtcagttcaagaaagtaccaaagattaaaaaaactttatgtttcagaaaatactactccacaacccagataattgccatatgtatatgaggtgccatgaaaaagtagtagcagaaacatttaagaagaaaacgtgtgtgttgtgtgtgtgtgtgtgtgtgtgtgtgtgtgcatttccatgcatgtgtacttgtgctgggaccacagaaggcatgctgagatgttagggaaagctctctaatggaattgacttctaagatg

SEQ ID NO: 14570 - DNA, 444 bp, Homo sapiens
  AC023781.2_30668
  Located on chromosome 8
  Distance between a terminus base of telomere on chromosomal short arm and 5'-terminus of this base sequence : 137502771
  Distance between 3'-terminus of neighbour sequence of sequence listing upward to telomere on chrosomal short arm and 5'-terminus of this base sequence : 203105
atgaataacattgttaccaggtatatggccttgagcaattcatttaactcttttggcctcagttttttcgtctgtataattgagggtgttgatagtatcaatcacggaagttaggatgagataaaataaccttaaaacatttagcacaatgtctggtatgtgagagcacccaatttcctcttttttcttttcttttctttcttgtctttctttctttctttctttctttctttctttctttctttctttctttctttctttctttctttctttctttctttcatgtcacctcctctctgctaggctctgtgctagtgagaggtatatgactgtgacaactacagatcagctctcagtctcataaataatgcaacccagcaaggaacacatacatgataaaaacacatattatttttaaaatagtccttgtgataattgctatga

SEQ ID NO: 14571 - DNA, 351 bp, Homo sapiens
  chr8.fa.O7frz.144833377
  Located on chromosome 8
  Distance between a terminus base of telomere on chromosomal short arm and 5'-terminus of this base sequence : 137502771
  Distance between 3'-terminus of neighbour sequence of sequence listing upward to telomere on chrosomal short arm and 5'-terminus of this base sequence : -444
atgaataacattgttaccaggtatatggccttgagcaattcatttaactcttttggcctcagttttttcgtctgtataattgagggtgttgatagtatcaatcacggaagttaggatgagataaaataaccttaaaacatttagcacaatgtctggtatgtgagagcacccaatttcctcttttttcttttcttttctttcttgtctttctttctttctttctttctttctttctttctttctttctttctttctttctttctttctttctttctttctttcatgtcacctcctctctgctaggctctgtgctagtgagaggtatatgactgtgacaactacagatcagct

SEQ ID NO: 14572 - DNA, 388 bp, Homo sapiens
  AC025056.2_69985
  Located on chromosome 8
  Distance between a terminus base of telomere on chromosomal short arm and 5'-terminus of this base sequence : 137522578
  Distance between 3'-terminus of neighbour sequence of sequence listing upward to telomere on chrosomal short arm and 5'-terminus of this base sequence : 19456
ttaagtttaccatgctggtaagcatttggggcagtgagtgaaacaagttcattgggtcctgagtctatacactttcctaaatatcactgtgatcaaaaagcagctttttgctttaggcaagaatgtacacaggtcagcatctttttcaatctcttatatatttatttttaaacaaatgtttcacatagactagtcatacggcaaaattaatggcttaagctttgaaatcagacaaaaattttgaatcctgagacacacacacacacacacacacacacactgtctctcacacacacacacacacttggaataaaacaatacataatctttatatcttattttcttttaaaattatatctctggaggggtgtggtagctcatgcctgta

SEQ ID NO: 14573 - DNA, 386 bp, Homo sapiens
  chr8.fa.O7frz.145081504
  Located on chromosome 8
  Distance between a terminus base of telomere on chromosomal short arm and 5'-terminus of this base sequence : 137684370
  Distance between 3'-terminus of neighbour sequence of sequence listing upward to telomere on chrosomal short arm and 5'-terminus of this base sequence : 161404
aagaaagctatcaactatgacctcagaggcaactgcaaaaacaataactataagcaatttgcacattttctccttgactgtatgtgtatatatatatatatatatatatatatatatatatacacaaacacacatacatatacatattttacatatataatatgtagaaatatatattatatatattttattatatatttattatatatattttatgtatattttatatttattatatatattttatgtatattttatatatattatatataaatatataaatattatatatatttctacatattaactattgtttatatttctacatgttaaatattttctctttttccccctgtaattttatacgaattgtattagtccatttc

SEQ ID NO: 14574 - DNA, 220 bp, Homo sapiens
  D8S502
  Located on chromosome 8
  Distance between a terminus base of telomere on chromosomal short arm and 5'-terminus of this base sequence : 137755957
  Distance between 3'-terminus of neighbour sequence of sequence listing upward to telomere on chrosomal short arm and 5'-terminus of this base sequence : 71201
cacagaaagacctccacttccagaaagatgaaatacgtgtacttttctcttatttcttccatcaattacaattaaaaacctgggcaacacacacacacacacacacacaccgcacacacacacacatatatatacacactatacacacgtatgtgtgtctgtgtacatatgacataagaacattctggaaggtggagagataaatgcagatgatatggga

SEQ ID NO: 14575 - DNA, 477 bp, Homo sapiens
  chr8.fa.O7frz.145546548
  Located on chromosome 8
  Distance between a terminus base of telomere on chromosomal short arm and 5'-terminus of this base sequence : 137824743
  Distance between 3'-terminus of neighbour sequence of sequence listing upward to telomere on chrosomal short arm and 5'-terminus of this base sequence : 68566
ataggttgtcactatccttctgtatacttaatgacctcttctttgtgtagagtggggagagagaaagcaagatctctgatgtttcttataagggcaataatcccattataaagaccacaccttcatgatctcatctaatcccaatcacctcccaaaggccctgtctccaagtaccatttcactgggggttagggcttcaaaatataaatgttggaggaacacaaacattcagtctataatattctatccctagccttcacaaaactcatatacttatcacatgaaaaatatattcaaagtactatgaatgaaaaatacttttgactttagagctgataattgaaatcagttaagacttttatagctgttggtacacacacacacacacacacacacacacacacacacacacagatataataaggaattagctcatatgattatgaaggctgagaagtctaagatctgtagtcagca

SEQ ID NO: 14576 - DNA, 424 bp, Homo sapiens
  AC012410.3_40339
  Located on chromosome 8
  Distance between a terminus base of telomere on chromosomal short arm and 5'-terminus of this base sequence : 137896101
  Distance between 3'-terminus of neighbour sequence of sequence listing upward to telomere on chrosomal short arm and 5'-terminus of this base sequence : 70881
ctttctatcagcaaacagatttagatgagatttggaaagttggccttttgggacagatgaaaaacaagaattagattaaataaacacacataatatctctgttctgctgagtggctaagtgacttcaataatactcacatttatctatctatctatctatctgtctatctatctatctctctatctatctatctctctatctatcttctatttacctatctatttatctattatctatctatagatatcacagtgttggtactattttgtgtttggggttattataaataaagtcactaagagaaaaaaataaaatgaattcaacaaatcacagagtagaacaagtatcatatatctactttcacacttacaaatgggttcaaattccacttatagcttttcattattgtaatccagagccaag

SEQ ID NO: 14577 - DNA, 114 bp, Homo sapiens
  D8S274
  Located on chromosome 8
  Distance between a terminus base of telomere on chromosomal short arm and 5'-terminus of this base sequence : 137904255
  Distance between 3'-terminus of neighbour sequence of sequence listing upward to telomere on chrosomal short arm and 5'-terminus of this base sequence : 7730
taagttccccaatttgcacaatgaagatatgtgtgtgtgtgtgtgtgtgtgtgtgtgtaataggatgataagttattctcaattttcacatttctgctgggcttagtggattat

SEQ ID NO: 14578 - DNA, 176 bp, Homo sapiens
  HUMUT1239
  Located on chromosome 8
  Distance between a terminus base of telomere on chromosomal short arm and 5'-terminus of this base sequence : 137985356
  Distance between 3'-terminus of neighbour sequence of sequence listing upward to telomere on chrosomal short arm and 5'-terminus of this base sequence : 80987
agcctgtttggtggtctcttcacatggacgcacatgaaagatagatagatagatagatagatagatagatagatagatagacagatgatagatagagagagacagggcagacttttcaaaagaaaatacaattttagaaaatgattgttgaaatagaagcagctggtagcaatccc

SEQ ID NO: 14579 - DNA, 341 bp, Homo sapiens
  AC012410.3_2054
  Located on chromosome 8
  Distance between a terminus base of telomere on chromosomal short arm and 5'-terminus of this base sequence : 138021060
  Distance between 3'-terminus of neighbour sequence of sequence listing upward to telomere on chrosomal short arm and 5'-terminus of this base sequence : 35528
aaagcaagtatctgttcaacaggatcccttcatcacaagttgtacaagctaacagaatgcacacactcttacacacaacggagatgatttgagaactaatcccttctggcttagcaataacaaaatgctattgagttcttcccttctgtccttctatgtaacatcatgcttataagacagagaaccacatgcacacacacacacacacacacacacacatatatattttctgattagatgacaaataattcaaagaacctctcaagattaaccacaaaaacacatattttccagactctttatgaagctcaatcttggttgagtttcattatgtcataagc

SEQ ID NO: 14580 - DNA, 219 bp, Homo sapiens
  D8S272
  Located on chromosome 8
  Distance between a terminus base of telomere on chromosomal short arm and 5'-terminus of this base sequence : 138021150
  Distance between 3'-terminus of neighbour sequence of sequence listing upward to telomere on chrosomal short arm and 5'-terminus of this base sequence : -251
gagaactaatcccttctggcttagcaataacaaaatgctattgagttcttcccttctgtccttctatgtaacatcatgcttataagacagagaaccacatgcacacacacacacacacacacacacacatatatattttctgattagatgacaaataattcaaagaacctctcaagattaaccacaaaaacacatattttccagactctttatgaagct

SEQ ID NO: 14581 - DNA, 223 bp, Homo sapiens
  DISD22_0006143
  Located on chromosome 8
  Distance between a terminus base of telomere on chromosomal short arm and 5'-terminus of this base sequence : 138125144
  Distance between 3'-terminus of neighbour sequence of sequence listing upward to telomere on chrosomal short arm and 5'-terminus of this base sequence : 103775
tcctgctgaagttacaggtgtgtagaatttacaataaatgccgttgtatatttgacattatttgtaaattgtatcattatttgtaaagcacacaaatgcttttataaattttacagatattaagagagacaaaatgctaagaacacacacacacacacacacacacacacatatataaatataatcactttttaaaagaaagctagttgataaacgcttacca

SEQ ID NO: 14582 - DNA, 133 bp, Homo sapiens
  DISD22_0006145
  Located on chromosome 8
  Distance between a terminus base of telomere on chromosomal short arm and 5'-terminus of this base sequence : 138214472
  Distance between 3'-terminus of neighbour sequence of sequence listing upward to telomere on chrosomal short arm and 5'-terminus of this base sequence : 89105
gatgcagttaccatctgtgaagagagaacagaggaggaaaaagaaaagggttttattattattattattattattattattatttttttttttttttttttttttttttaatttccaggagtctgtgggtcaa

SEQ ID NO: 14583 - DNA, 120 bp, Homo sapiens
  DISD22_0006150
  Located on chromosome 8
  Distance between a terminus base of telomere on chromosomal short arm and 5'-terminus of this base sequence : 138314879
  Distance between 3'-terminus of neighbour sequence of sequence listing upward to telomere on chrosomal short arm and 5'-terminus of this base sequence : 100274
tctttctgcctgagagctctgtgtggtgtatgcgtgtgtgtgtgtgtgtgtgtgtgtgtgtgtgtgtgtgtgtgtgtgtgtgtgtgtgtttaatcctggctggaaagcttgctggcctta

SEQ ID NO: 14584 - DNA, 406 bp, Homo sapiens
  chr8.fa.O7frz.145800473
  Located on chromosome 8
  Distance between a terminus base of telomere on chromosomal short arm and 5'-terminus of this base sequence : 138427870
  Distance between 3'-terminus of neighbour sequence of sequence listing upward to telomere on chrosomal short arm and 5'-terminus of this base sequence : 112871
taatacagtttaccaggcacagagaaaataatagcagaatgtcagtattttgaatgcttaagtatctacctttagtctattgggaagtaaagataagttcaagcctaaaaatgtactcaaagagaaataatatagtaatataagttaataatggaggttataaaaatctttcaaagagtatgatcactaaaataaaatgtaaagtataataggtgttatataagtaaagatgaaaaagtatgtgtgtgtgtgtgtgtgtgtgtgtgtgtgtgtgcgcgtgtgctggtatggcttatgatatgcatgttaggcctgtgtatgtagaagcatattgatttgtgttagtgttggcatatgtgtggggaaggtttgcagggggtcaagtaaaactatgaataggcaatgc

SEQ ID NO: 14585 - DNA, 389 bp, Homo sapiens
  AF215844.3_114528
  Located on chromosome 8
  Distance between a terminus base of telomere on chromosomal short arm and 5'-terminus of this base sequence : 138516250
  Distance between 3'-terminus of neighbour sequence of sequence listing upward to telomere on chrosomal short arm and 5'-terminus of this base sequence : 87974
tacattaccacatttaatcctcacaacaaatctctgggtactgcttccctgttggagacaaggatgccaatactgaaatgtttagttaacttagccaaggtcaaagagattctacaagccattggctaaagggtaaaactcatattctgtggagaacaaaaatctgtagtatcttccttcttgaagcctggcctaactcagaaaaataaagaaaattacctttgaaatcagaaagattcaagtttgaatatgtgcgctctctctctctctctctctctctctctcacacacacacacacacacacagtttctatctataagatcatttacctaaactattggcgcccttattagtaaaatgaaacgaatagtatctgcctaagaaagct

SEQ ID NO: 14586 - DNA, 471 bp, Homo sapiens
  chr8.fa.O7frz.146018066
  Located on chromosome 8
  Distance between a terminus base of telomere on chromosomal short arm and 5'-terminus of this base sequence : 138669002
  Distance between 3'-terminus of neighbour sequence of sequence listing upward to telomere on chrosomal short arm and 5'-terminus of this base sequence : 152363
tacaacctagcagttacgtcaggcgagaacacttcctgtttacaggagactaaaaaacctttgtcccatcctcacttagggctgacgccattttaggcctcagcctgcctgcagccaggcactcattaaaacggtatattgctccacaccaccttgtgttgtctgttggcatgctcttggggtttgaaccgatacaagaaccttacagtgtgtatatacatatatatgcatatacgtgtgtgtttatatatacatctgtgtgtatatatacgtatgaatatatatacacacacacacacacacacacacacacacacacacaaccaaaaacctccatgtgaccttggggagacctcccctgcttctatatagtcagcattatgagaacaatggaagagggacctccagggctctgtgttctcatgggcaatctctactcttcctcctcactcatactcagagccacaagta

SEQ ID NO: 14587 - DNA, 349 bp, Homo sapiens
  AL356097.11_173507
  Located on chromosome 8
  Distance between a terminus base of telomere on chromosomal short arm and 5'-terminus of this base sequence : 138797447
  Distance between 3'-terminus of neighbour sequence of sequence listing upward to telomere on chrosomal short arm and 5'-terminus of this base sequence : 127974
  misc_feature (1)...(349): n = A,T,G or C
caagagtgaaactccatctcacatgaaaaaaaaattttttttaaagggaaaggaaagatggaaaggaaaggaaaggaaaggaaagganaaggaaagaaaggaaaggaaaggaaaggaacaaaatatgaacataaatgggagaatgtgatagggccccttaaattataaaagtatatatgtgttggttttgtgttttcctttgtatgtttttattagctatgaacagaatatgtatggctttttttttttaagttctgggatacatgtgctgaatgtgtaggttttttacataagtatacatgtgctgtggtggtttgctgcacctatcaacctgtcatctaggttttaa

SEQ ID NO: 14588 - DNA, 390 bp, Homo sapiens
  AL356097.11_139862
  Located on chromosome 8
  Distance between a terminus base of telomere on chromosomal short arm and 5'-terminus of this base sequence : 138820134
  Distance between 3'-terminus of neighbour sequence of sequence listing upward to telomere on chrosomal short arm and 5'-terminus of this base sequence : 22338
ggagacttcataatgcagaagtagcaagcaggctctctgctcctaaggagtgcatggtccaataaaaaatgcagtgcatgcaattagggggaaaaagtaaaatagtttgctctattatgaaatggtgtgttataaaaacattgtgtcctcaaatggtttaacttttctaaattaacaggcttcagcttctttcatcatctgttgaatggcacaatttctcagcattatctgaatattctgttttcagaatccttaaaactaaatagagagggagatgaggatggacggatggatagatgatagatagatagatagatagatagatagatagatagatagatagatagatagaaagagtatgtatatgtgtcaagcaccataataggtatt

SEQ ID NO: 14589 - DNA, 370 bp, Homo sapiens
  chr8.fa.O7frz.146831694
  Located on chromosome 8
  Distance between a terminus base of telomere on chromosomal short arm and 5'-terminus of this base sequence : 139098079
  Distance between 3'-terminus of neighbour sequence of sequence listing upward to telomere on chrosomal short arm and 5'-terminus of this base sequence : 277555
caattaagcaagtgattcatctttcctttacaaaaaatcctgactgcccattgtattcatcagggttcatcagagaaatagatagaaagatagattgatagatcaatagatagatagatatctaatagatctatctatctatctatctatctatctatctatctatagatcttgttagtattctctgcctagatagatagatctatctatctatctatctatctatctatctatctatctatctattcatctatctatctatctatctatctacccattgatatggtaagggacagaaagaaagacagacagattatgtggattggctgatgtgattatatggaggcttgagaagtaccacaatctactg

SEQ ID NO: 14590 - DNA, 459 bp, Homo sapiens
  chr6.fa.O7frz.159166528
  Located on chromosome 8
  Distance between a terminus base of telomere on chromosomal short arm and 5'-terminus of this base sequence : 139231313
  Distance between 3'-terminus of neighbour sequence of sequence listing upward to telomere on chrosomal short arm and 5'-terminus of this base sequence : 132864
ccatgctttacttgtaacctatacacatctttatgtttaaggtgttattttttgtttttgtttgtgtgtgtgtatgtttgagatgatatgtagtttggccttgttgctatctaaactgaaaatatctatcttttaattgatgtatttagagcatttacatttaatataattatgggtatattcgattttaaatataccatcttgttagttattgttttgtatttgcttcatccactttttgttttttgtttttcatttttctgttttttaattaatcagatatatttataactttattttatctccattattggcataatctatctatctatctatctatctatctatctatctatctatctacctacctacctacctttgatttttaatggttatcctatagctttaaaataccttttcaattcattatggcctacctttaaaagatccaggaatctg

SEQ ID NO: 14591 - DNA, 420 bp, Homo sapiens
  AC068467.2_92356
  Located on chromosome 8
  Distance between a terminus base of telomere on chromosomal short arm and 5'-terminus of this base sequence : 139439673
  Distance between 3'-terminus of neighbour sequence of sequence listing upward to telomere on chrosomal short arm and 5'-terminus of this base sequence : 207901
cctagattataggtagaacaggaacaacagtctgtactagaagaaaacatctcttcatgtttcaaagttgttctccattcattcctgtgattgctgctatcatcctttgtacaaggtcatgcaggcacatatggttcagttgtatggatgagaaaattgaggctcagtgggtgagctgacttgtcacaggtcacaacctagaaaataatatatcagatatcctctatattcattatttaggtagaaacagaatgaactgtctcaagtgctaatgagcttcttatatattttttgtgcatatatatatatatatatatgtatttgtgtgtgaacaggggaacttaagcatattgtatttattaaattatcacacacattctttggtctcaaaagtcattgatctgtagacatttccaaggt

SEQ ID NO: 14592 - DNA, 163 bp, Homo sapiens
  Z67005
  Located on chromosome 8
  Distance between a terminus base of telomere on chromosomal short arm and 5'-terminus of this base sequence : 139639739
  Distance between 3'-terminus of neighbour sequence of sequence listing upward to telomere on chrosomal short arm and 5'-terminus of this base sequence : 199646
cttctttggaaggatgtgataatattctagtgtgtatgtggggatgtgtgtgtgtgtgtgtgtgtgtgtgtgtatgtgtgtgtgttctttatccatttattcattgatggacatttaagtggtttccatattttggcttttgtgaataatgcgccaatgaacg

SEQ ID NO: 14593 - DNA, 434 bp, Homo sapiens
  AF298853.1_121082
  Located on chromosome 8
  Distance between a terminus base of telomere on chromosomal short arm and 5'-terminus of this base sequence : 139655898
  Distance between 3'-terminus of neighbour sequence of sequence listing upward to telomere on chrosomal short arm and 5'-terminus of this base sequence : 15996
catttgaattacacttgcctagggctcagaaagaaacagcaagcctatcctcgactcctggctagaaaggtgacccaatcaagagaatacttcttgaaatactgtcaccttttggcaacccaagcatttcaagttatatacctgctttagttctcaccatggggcactggacccagattgcttatgttctgctctctgctttgttaagttctgcacatgagcacgtgtgtgtgtgtgtgtgtgtgtgtgtgtgtgattttaggcaaatcaccctatttgtgtatgagttaaagcatttgtaaaatagaaataatattaacaagaacaatcagtatgtttggggtgagaaaaaaatgagttaatatattaaaatccatgagataatccagggcaggaggtcagcctttcattagctgttgtctatgaatagttca

SEQ ID NO: 14594 - DNA, 241 bp, Homo sapiens
  D8S1837
  Located on chromosome 8
  Distance between a terminus base of telomere on chromosomal short arm and 5'-terminus of this base sequence : 139656068
  Distance between 3'-terminus of neighbour sequence of sequence listing upward to telomere on chrosomal short arm and 5'-terminus of this base sequence : -264
acccagattgcttatgttctgctctctgctttgttaagttctgcacatgagcacgtgtgtgtgtgtgtgtgtgtgtgtgtgtgtgattttaggcaaatcaccctatttgtgtatgagttaaagcatttgtaaaatagaaataatattaacaagaacaatcagtatgtttggggtgagaaaaaaatgagttaatatattaaaatccatgagataatccagggcaggaggtcagcctttcatt

SEQ ID NO: 14595 - DNA, 339 bp, Homo sapiens
  AC068476.2_15851
  Located on chromosome 8
  Distance between a terminus base of telomere on chromosomal short arm and 5'-terminus of this base sequence : 139822241
  Distance between 3'-terminus of neighbour sequence of sequence listing upward to telomere on chrosomal short arm and 5'-terminus of this base sequence : 165932
ccagtttataaatcagcatcacagctccaaagcctctgtgtgtcttttcccctgccaaggataaagtccatatttctttgttgacctttaacatttaagatatctaagacaaatctatctatctatttatttatgaaaatttaagctgtacacaccctttgaccacctggggccacttcttggaagtcccctacttcccattccaccccagtatacacaaacatagatacacagcagagtgatgtgtgtgtgtgtgtgtgtgtgtgtgtacataaagttgtttatggaagcacgtttaaagaaatgggaataaccatctatcagctaagcaatcatgaa

SEQ ID NO: 14596 - DNA, 332 bp, Homo sapiens
  AC068476.2_196199
  Located on chromosome 8
  Distance between a terminus base of telomere on chromosomal short arm and 5'-terminus of this base sequence : 139852389
  Distance between 3'-terminus of neighbour sequence of sequence listing upward to telomere on chrosomal short arm and 5'-terminus of this base sequence : 29809
tcagcttactcatctgttgaagctgtgaatttgtgtgaaagggaaatcattcatcaatttcttcactgagtttttattaaacatatgctctatgggcagttagctaggcaatgggaacaaagcttgtcttcaggggcctcaggatggccttcactcttagggacccatttcactaagttacttattattattattattattattactttgagacagagtctcgctctgtcactaggctgcagtgcagtggcatgatcttggctcactgcaacctctgcctcctgggtttaagcgattctcctgcctcagcctcctgagtagctgtgattaca

SEQ ID NO: 14597 - DNA, 224 bp, Homo sapiens
  AC027541.2_82015
  Located on chromosome 8
  Distance between a terminus base of telomere on chromosomal short arm and 5'-terminus of this base sequence : 140012123
  Distance between 3'-terminus of neighbour sequence of sequence listing upward to telomere on chrosomal short arm and 5'-terminus of this base sequence : 159402
tagtacattgaagacatacagcactccagtgtttgttgcaatactctttcacaatagccaagatctagaatcaacctaagtgcccaatgaccaatgagtggatgaagaatatgtcacacacacacacacacacacacacacacacacaaaatggaacagtactcagccataaaaaatgaaattctgtcatttgcaacaacatgggtgaaactggaggacatgat

SEQ ID NO: 14598 - DNA, 404 bp, Homo sapiens
  AC027541.2_111110
  Located on chromosome 8
  Distance between a terminus base of telomere on chromosomal short arm and 5'-terminus of this base sequence : 140110148
  Distance between 3'-terminus of neighbour sequence of sequence listing upward to telomere on chrosomal short arm and 5'-terminus of this base sequence : 97801
actgatatcatggtgagttgtaacatcaacgtgtatgtgattcttttttaaatattaggagttagaaaagtagtgaggaaataaaaccatgtgacaaaaagaagtaaaatgtcaaaatataaacaacctcccaattagaggtctttgccatgtttatgtaatcttcctttttctttcctttctttctttcctttctttcttccttttccttccttccttccttccttccttccttccttccttcctgcctgcctgcctgcctgcctgcctgcctgcctgccttccttcctgccttcctgccttcctgcctgccttcctgcctgccttcctgcctgtcttcctgccttcctgccttccttcctctttttggagacagggtctccctctgtcactcaggttagagc

SEQ ID NO: 14599 - DNA, 445 bp, Homo sapiens
  AC021973.2_76713
  Located on chromosome 8
  Distance between a terminus base of telomere on chromosomal short arm and 5'-terminus of this base sequence : 140329399
  Distance between 3'-terminus of neighbour sequence of sequence listing upward to telomere on chrosomal short arm and 5'-terminus of this base sequence : 218847
gcttctatcctaaaatgcagactcagtgggcagctcctggcctaagggcgacagagaccctggagccaagctaagcctcaccacagcatgcaggggagcacgcctgcagacaggtagacctgtgagtgaaaaatagaaatagttgcttctggaggccactgagattttgaggtagtttattaggtagaatagaataaaataaaataaaataaaatgaaatgaaatgaaatgaaatgaaatgaaatgaaatgaaatgaaatgaaataaaataaaaagctaataagagtgcagactctgctggccagaccagaagacccccactctgttcctttatgtcaaggcttgtgtctccttagacctggttcctccagagggcaagtttgcttctaggtttgggtcctggttcaccccattctggtgctagtagctgatcagttctaggctt

SEQ ID NO: 14600 - DNA, 234 bp, Homo sapiens
  AC021973.2_95120
  Located on chromosome 8
  Distance between a terminus base of telomere on chromosomal short arm and 5'-terminus of this base sequence : 140347898
  Distance between 3'-terminus of neighbour sequence of sequence listing upward to telomere on chrosomal short arm and 5'-terminus of this base sequence : 18054
atgcaaagtgagtaagttctagagagctgctgtacaacacagtgcttgtattaacaacatggtattgtgcactaaaaatttgttgggagagtagttaagcattcttaccccccctgcccaacacacacacacacacacacacacacacacacacacacacatacatatctatatagggacaacaggaaattttggaggtgatggatatgtgtggtatcttgattgtaacgatag

SEQ ID NO: 14601 - DNA, 443 bp, Homo sapiens
  chr8.fa.O7frz.148079964
  Located on chromosome 8
  Distance between a terminus base of telomere on chromosomal short arm and 5'-terminus of this base sequence : 140353106
  Distance between 3'-terminus of neighbour sequence of sequence listing upward to telomere on chrosomal short arm and 5'-terminus of this base sequence : 4974
caaacttggatttgaatcatagctagatggaaaataagtataaaaatatgtgggaaaaacactgttaaaagtgttattttaaaccaaatttatgcgtatatataccctccatacacacacacacacacacacacacacacacacaaagtaactcttccttataggcaaggcacatgtgtctgaatagatgtacacatgtatccatgtgtacttacacacatatataccatagatgtggataaatatagccatgatttttaattgaatatttagtaggtgccagtttctatgctaatgtttcatgtgcagcatttcataaaattctaacaaatctatgattggcatcaccactttaaaaataaggaccgtgggttttggagaaagtaaacattttagtccagcctctagggtcacagagttgctagttgtctgatgctgaagac

SEQ ID NO: 14602 - DNA, 380 bp, Homo sapiens
  AC021973.2_169997
  Located on chromosome 8
  Distance between a terminus base of telomere on chromosomal short arm and 5'-terminus of this base sequence : 140422830
  Distance between 3'-terminus of neighbour sequence of sequence listing upward to telomere on chrosomal short arm and 5'-terminus of this base sequence : 69281
attaagtaggcagtgtagaaggacaaacatggataaatcgagatatgtgattgatagatagatgatagatagatgatgatagatagatagatagatgatagatagatagatagatagatagatagatagatagatagatagatagatcagactacagcttaagtcccacttgtcaactctgtcttctaagcacttacctatattatctcatttaataatttgggatgtgtattgttatccctgttttaaaaacaaggagagtctgggtgcagagagattacaggagttgcccaagattacccactaggaagcggtagacccaggcatcaaatccaggcagtctgactcccttttaagatatctgaaggctttatcttagg

SEQ ID NO: 14603 - DNA, 414 bp, Homo sapiens
  AC021973.2_177564
  Located on chromosome 8
  Distance between a terminus base of telomere on chromosomal short arm and 5'-terminus of this base sequence : 140430248
  Distance between 3'-terminus of neighbour sequence of sequence listing upward to telomere on chrosomal short arm and 5'-terminus of this base sequence : 7038
aacagcctcttagctaaactctagcaatttcctaagtcagaagagtagatagaatatgttcttaaactgtagctattagagaaaaagtgttgcctcacatatgatgagcagtgagtcaagaagtcatcctcactacagcagagaaaatagaaaggattgagccttctaaagatgatcaaaaggaaaagtaatggtgtgtaaaccacctaaccatactgcagaaaagggaaggcagcagaaatatgcacacacacacacacacacacacacacacacacaaagcaagtaaaactagcttccgcccccaacccagacatctagatgtcaaggtttgaatgtgtttcctgagcaatataaactgtaatcattaagggcttttgatgcttctagatcactgtatccattaaggttaag

SEQ ID NO: 14604 - DNA, 427 bp, Homo sapiens
  chr8.fa.O7frz.148532088
  Located on chromosome 8
  Distance between a terminus base of telomere on chromosomal short arm and 5'-terminus of this base sequence : 140721810
  Distance between 3'-terminus of neighbour sequence of sequence listing upward to telomere on chrosomal short arm and 5'-terminus of this base sequence : 291148
agccactagaataagtaggcttagtaaggttttaggctataagatcaacatataggcccagcgcagtggctcacgcctataatcccagaactttgggaggccaaggcaggtggatcacctcaggtcaggagttcgagaccagcctggccaacatggtgaaaccccatctctactaaaaattcaaaaatcagctgggtatggtggcgggcacctgtaatcccggccactcagggggctgaggcagcagaatggcctgaacccaggaggctgaggttgcagtgagcagagatcgcgccattgcactccagcctgggcaacggagagagactccatgtcaaataaataaataaataaataaataaaagactgacatatatatatatatatatatatatatatatatatataaatcaactgcatttccata

SEQ ID NO: 14605 - DNA, 296 bp, Homo sapiens
  D8S1741
  Located on chromosome 8
  Distance between a terminus base of telomere on chromosomal short arm and 5'-terminus of this base sequence : 140865894
  Distance between 3'-terminus of neighbour sequence of sequence listing upward to telomere on chrosomal short arm and 5'-terminus of this base sequence : 143657
caggcattcacgttttccccccaggaacagacgcgcgtgcgcacgtgtgtgtgtgtgtgtgtgtgtgtgtgtgtgtgttagagagagagatagagagagagaaggtgcttttgtgccaattccagccttaactcagtgtcgctgcaaccgcctgagagacctcgaggaagcactgcctgcctgagcccagccagtccccagaaatgagagagacaacattagcaaacgattgctgtcgctttgcaccactgagatggagatgtttgttatgtagccacggataagtggaacaagct

SEQ ID NO: 14606 - DNA, 264 bp, Homo sapiens
  AC021744.3_24949
  Located on chromosome 8
  Distance between a terminus base of telomere on chromosomal short arm and 5'-terminus of this base sequence : 141101811
  Distance between 3'-terminus of neighbour sequence of sequence listing upward to telomere on chrosomal short arm and 5'-terminus of this base sequence : 235621
atttatgtgactgaagtctaccatgacccggtttggcattttaggaaaacaatgattgcttagttcactctgcccctgggaaacatgaagccagatgggaatctgtgaggttctctttggaacctgtagacctgaggtgtgtgagcctcatctctcaaaaataaataaataaataaataaataaataaaataaataaataaataaaaataaaataaaagtaagtgctatgctcagaacatctggttagtatccaaagtctacag

SEQ ID NO: 14607 - DNA, 249 bp, Homo sapiens
  chr8.fa.O7frz.148731072
  Located on chromosome 8
  Distance between a terminus base of telomere on chromosomal short arm and 5'-terminus of this base sequence : 141186395
  Distance between 3'-terminus of neighbour sequence of sequence listing upward to telomere on chrosomal short arm and 5'-terminus of this base sequence : 84320
acatttggtgctgtctttaaccatcctgatgagtgtctcatgctgtctcatcgcggtttggacttacattccaccactgattgataatgttaatgttgctattttaaaaaacattttatttccttaaaacaaatgaaagaggcagagagagagagagagagagaaagatctggggcaaataaaacaaaatctaggatgtgggtatgccagtttctaagtgattttctgtatgtttgaagtcttcagcaa

SEQ ID NO: 14608 - DNA, 331 bp, Homo sapiens
  chr8.fa.O7frz.149079291
  Located on chromosome 8
  Distance between a terminus base of telomere on chromosomal short arm and 5'-terminus of this base sequence : 141460059
  Distance between 3'-terminus of neighbour sequence of sequence listing upward to telomere on chrosomal short arm and 5'-terminus of this base sequence : 273415
cacttactgtatgtttcaagcttcatgcgtatagcacgtgtcagtatgcatttctttttcttcttgcagaataatattccattctgtgtatatatatatgtatatatatgtgtgtatatgtatatatgtgtatatatgtatatatgtgtatacatgtgtatatgtgtatatatgtgtatatgtgtatatatgtgtgtatgtatatgtgttatatatgtgtatgtatatgtgtatatatgtgatgtgtgtgtgtgtgtgtgtgtgtgtgtgtgtatgccacattttgtttttccatattccatcagttgatggacatttgtatcatttgtac

SEQ ID NO: 14609 - DNA, 333 bp, Homo sapiens
  chr8.fa.O7frz.149406362
  Located on chromosome 8
  Distance between a terminus base of telomere on chromosomal short arm and 5'-terminus of this base sequence : 141772618
  Distance between 3'-terminus of neighbour sequence of sequence listing upward to telomere on chrosomal short arm and 5'-terminus of this base sequence : 312228
gacgtcattccactagctaagctaagcaaacagttggagctatcccagctgtcgaagctaacacgctgcatttagactctcttgcaagtcagctgtgttggtaactagaggctctggattgacacattagaatccactcccatacattccccaggttttggctggtaaaaattgattgatatcccataattccttcagcatgtgaacttctcccaaatcaggtgttttgttttgttttgttttgttttgttttgttttgttttgttttgttttgtttggagacagagtctcactcagtagcccaggctggagtacagtgacatgatctcagct

SEQ ID NO: 14610 - DNA, 169 bp, Homo sapiens
  D8S1704
  Located on chromosome 8
  Distance between a terminus base of telomere on chromosomal short arm and 5'-terminus of this base sequence : 141894717
  Distance between 3'-terminus of neighbour sequence of sequence listing upward to telomere on chrosomal short arm and 5'-terminus of this base sequence : 121766
tctgggtgatagagcaagacgctgtctcaaaacacacacacacacacacacacacacacacacacacacacaaaacagcaacctatctttcataggaggagaaacattaagtaaaaattgtcaaagaagccaagtatataatgatgtaaacaagtgtcaatttttagct

SEQ ID NO: 14611 - DNA, 267 bp, Homo sapiens
  DISO7_10000237
  Located on chromosome 8
  Distance between a terminus base of telomere on chromosomal short arm and 5'-terminus of this base sequence : 142103148
  Distance between 3'-terminus of neighbour sequence of sequence listing upward to telomere on chrosomal short arm and 5'-terminus of this base sequence : 208262
tcagtccatccctccataccttttggtgtgtgtgtgtgtgtgtgtgtgtgtgtgtgtgtgtgtgtttagggacagggtctctgtcacccaggctggaatacaatggcacaattatagctcactgcagcctcaaactcctggactcaagcaatccacccatgtcagcctcccaaagcactggcacgagccaccacacctggcccatatttttatgatagcataaaacaattctttttaccatacaattctcatgtattgtaaggaaat

SEQ ID NO: 14612 - DNA, 155 bp, Homo sapiens
  DISO7_10000182
  Located on chromosome 8
  Distance between a terminus base of telomere on chromosomal short arm and 5'-terminus of this base sequence : 142120619
  Distance between 3'-terminus of neighbour sequence of sequence listing upward to telomere on chrosomal short arm and 5'-terminus of this base sequence : 17204
acactgttgaaatgactcggaaaaaaaaaaaaaaagaaactttaccctcactgaatttagctacaaaattctgcaattaaatgaaaccaattcacacacacacacacacacacacacacacacacacacaccccttcttctaagaaagaacagga

SEQ ID NO: 14613 - DNA, 382 bp, Homo sapiens
  chr19.fa.O7frz.3556043
  Located on chromosome 8
  Distance between a terminus base of telomere on chromosomal short arm and 5'-terminus of this base sequence : 142150647
  Distance between 3'-terminus of neighbour sequence of sequence listing upward to telomere on chrosomal short arm and 5'-terminus of this base sequence : 29873
gattcagaaagattacagtcagagcaggcctcatcctgggcccagtaagggggcccccttactctgacatctgggcgtctactctctgttctgtccctcccaggctgtgaccttggcaagggtcgcgctgtattggggcaggggccttgtgcagagaactcctggccttccccggccatctgcttgtggcttggattacaaagtaccattatttattctttggcttcttcctgcctgcctgccttccccagcggggagagagagagagagagagagagagagagagtgtgtgtgtgtgtgtgtgtgtgtgtgctttaccttgagaagaaaattgattcaggcttctgtaaacctcccaactgacttcctgcatcaagttgag

SEQ ID NO: 14614 - DNA, 102 bp, Homo sapiens
  DISD22_0006165
  Located on chromosome 8
  Distance between a terminus base of telomere on chromosomal short arm and 5'-terminus of this base sequence : 142322338
  Distance between 3'-terminus of neighbour sequence of sequence listing upward to telomere on chrosomal short arm and 5'-terminus of this base sequence : 171309
aaatgcacctcatgatgctgtgtgtgtgcgtgcgtgtgtgtgtgtgtgtgtgtgtgtgctttgctcctgcaccctcctggagtaagcacttactttgctaag

SEQ ID NO: 14615 - DNA, 193 bp, Homo sapiens
  chr8.fa.O7frz.150389587
  Located on chromosome 8
  Distance between a terminus base of telomere on chromosomal short arm and 5'-terminus of this base sequence : 142492099
  Distance between 3'-terminus of neighbour sequence of sequence listing upward to telomere on chrosomal short arm and 5'-terminus of this base sequence : 169659
tttcttagaaatacgtgaaatcatggtggggtgtgtcctaaaagtataaacagaattgtacaatatgtagtcttccaatattcttctgttgtttggcttgggtgtttgtttgtttgtttgtttgtttgtttgctgagacaaggtcttgcttagttgccccggctggagtgtagtggtacaatcatagctcatt

SEQ ID NO: 14616 - DNA, 263 bp, Homo sapiens
  D8S1727
  Located on chromosome 8
  Distance between a terminus base of telomere on chromosomal short arm and 5'-terminus of this base sequence : 142733116
  Distance between 3'-terminus of neighbour sequence of sequence listing upward to telomere on chrosomal short arm and 5'-terminus of this base sequence : 240824
tcccaacagagcaatgtcaaggcctcactgcaaaaagggcctgagggtgtgtgggagagatgttggtatggccatcctgagagtacaacctgtcacaggaatatatatatatatatatatatatatacacacacacacacacacacatatatgtataccatccatctatttatcatcaatctctgtatatctatctatcaatctccttacctacccacctatctatctagaaaattatgaattcatcctgtgttgtggcttaa

SEQ ID NO: 14617 - DNA, 257 bp, Homo sapiens
  DISO7_00040990
  Located on chromosome 8
  Distance between a terminus base of telomere on chromosomal short arm and 5'-terminus of this base sequence : 142856832
  Distance between 3'-terminus of neighbour sequence of sequence listing upward to telomere on chrosomal short arm and 5'-terminus of this base sequence : 123453
aaatggtgctaacgtggaggagaaggaagtcagagagagaggaggccaggtttcagcctgtgcctgaagcagaggtcccctttactttcagccattgtctgagccaaagcattcctttccttctcttctcttttctccttctcctccctctcctctctctttgtgtgtgtgcgtgtgtgtgtgtgtgtgtgtgtgtgtgtgtgtgtgtaacacctgttttaattcctgccaccgcttacagcagaccaggtcctgac

SEQ ID NO: 14618 - DNA, 119 bp, Homo sapiens
  D8S1713
  Located on chromosome 8
  Distance between a terminus base of telomere on chromosomal short arm and 5'-terminus of this base sequence : 142999283
  Distance between 3'-terminus of neighbour sequence of sequence listing upward to telomere on chrosomal short arm and 5'-terminus of this base sequence : 142194
caggggctgattgtcagaactgagcaccagagcacacacatgtgcacacacacacacacacacacacacacacacacagaggagaggaggccattgggtgagaccttggtgacagccac

SEQ ID NO: 14619 - DNA, 239 bp, Homo sapiens
  DISD22_0006174
  Located on chromosome 8
  Distance between a terminus base of telomere on chromosomal short arm and 5'-terminus of this base sequence : 143161003
  Distance between 3'-terminus of neighbour sequence of sequence listing upward to telomere on chrosomal short arm and 5'-terminus of this base sequence : 161601
cttcaaccttgagggtaagagagaaagagagagagatactgagagggaaagagagaaagagagagagagagggagagggagagagggagggagagagagagggggagacgaagagagggagagagaggaagagagagagagagagggatggagggacacagagagagagagacagggacatagagagagggagagagggagagggaaagtgagagaggaagagaccacactaagacagg

SEQ ID NO: 14620 - DNA, 157 bp, Homo sapiens
  D8S1751
  Located on chromosome 8
  Distance between a terminus base of telomere on chromosomal short arm and 5'-terminus of this base sequence : 143275911
  Distance between 3'-terminus of neighbour sequence of sequence listing upward to telomere on chrosomal short arm and 5'-terminus of this base sequence : 114669
aggctctagtgctgcccgcccacctggctccacaaccacggcagggccgcagagcctgccagacatggacggacacggagacacacacacacacacacacacacacacacacacacacacagccacccaacctcactcacacatacacgctcagagg

SEQ ID NO: 14621 - DNA, 137 bp, Homo sapiens
  D8S1836
  Located on chromosome 8
  Distance between a terminus base of telomere on chromosomal short arm and 5'-terminus of this base sequence : 143277767
  Distance between 3'-terminus of neighbour sequence of sequence listing upward to telomere on chrosomal short arm and 5'-terminus of this base sequence : 1699
gctgactccgtcctgtgtgaggctaagaggccctgagaaacgcggggggaaagcgggaaacaaccttcgcaggggcataatgtgtgtgtgtgtgtgtgtgtgtgtgtgtgtgtgggggggtatggaggatatgaagg

SEQ ID NO: 14622 - DNA, 188 bp, Homo sapiens
  DISO7_00041028
  Located on chromosome 8
  Distance between a terminus base of telomere on chromosomal short arm and 5'-terminus of this base sequence : 143346130
  Distance between 3'-terminus of neighbour sequence of sequence listing upward to telomere on chrosomal short arm and 5'-terminus of this base sequence : 68226
agtagggctcagtgactggactaggaatgagtgtatccagtgcgcatatggatgtgcgtgcctgtgtgcatttgtgtgtgtgtgtgtgtgtgtgcgcacgtgcacgcaggcaacgggcaagcttcaaggtggttgaatgggcagcacccgcaagcctctggggcttctctctccatgcagaagctgaa

SEQ ID NO: 14623 - DNA, 210 bp, Homo sapiens
  HUMUT721
  Located on chromosome 8
  Distance between a terminus base of telomere on chromosomal short arm and 5'-terminus of this base sequence : 143844732
  Distance between 3'-terminus of neighbour sequence of sequence listing upward to telomere on chrosomal short arm and 5'-terminus of this base sequence : 498414
ggcctaaggcgatttaaggcacattgtcttggaaatggaccactgtatgcattatttccttcaatctctatccagctctatctatctatctatctatctatctatctatctatctatctatctatccatccatccatccatccatccatccatctgcccgcctgcccgcccacccacctgcctacctacctacccatcagaggagaccaa

SEQ ID NO: 14624 - DNA, 298 bp, Homo sapiens
  DISD22_0006189
  Located on chromosome 8
  Distance between a terminus base of telomere on chromosomal short arm and 5'-terminus of this base sequence : 143989293
  Distance between 3'-terminus of neighbour sequence of sequence listing upward to telomere on chrosomal short arm and 5'-terminus of this base sequence : 144351
tgtctagctgagaggatttgtactatatactatcttccagcatatatatatatatatatatatatatatatatatatatatatatatattttttttttttttttttttttttttttttgaaaaaaaacaggctcttgctctgttactcaggctagagtgcagtggtgcaatcagttcacagcagccttgaactcctggcctcccacctcggcctcccaaagggcggggattacaggtgtgagccaccacacccagccccaacatggtaaacttttctggggccttaacaatggatatg

SEQ ID NO: 14625 - DNA, 106 bp, Homo sapiens
  DISD22_0006197
  Located on chromosome 8
  Distance between a terminus base of telomere on chromosomal short arm and 5'-terminus of this base sequence : 144266568
  Distance between 3'-terminus of neighbour sequence of sequence listing upward to telomere on chrosomal short arm and 5'-terminus of this base sequence : 276977
ggtgagcatgtgcatgagagtgagtgtgtgtgtgtgtgtgtgtgtgtgtgtgtgtgtgtgtgattgcaaagtttcctttcgcgctgacgaggctttgaggcaagtt

SEQ ID NO: 14626 - DNA, 133 bp, Homo sapiens
  DISO7_10000317
  Located on chromosome 8
  Distance between a terminus base of telomere on chromosomal short arm and 5'-terminus of this base sequence : 144476165
  Distance between 3'-terminus of neighbour sequence of sequence listing upward to telomere on chrosomal short arm and 5'-terminus of this base sequence : 209491
aggcaactcaatttcagagacattaaaatatggagaaagtgtatcttagaatcaatgaattgtgatatatacatgcatgcacacacacacacacacacacacacgcacacaccccacaggcaacaaactatgt

SEQ ID NO: 14627 - DNA, 116 bp, Homo sapiens
  DISO7_00005816
  Located on chromosome 8
  Distance between a terminus base of telomere on chromosomal short arm and 5'-terminus of this base sequence : 144720594
  Distance between 3'-terminus of neighbour sequence of sequence listing upward to telomere on chrosomal short arm and 5'-terminus of this base sequence : 244296
aatgttcttgaatgcctggggccagtgagtctcccgtcttttccgggggctgtgtgtgtgtgtgtgtgtgttggggacgccttcagcacttggccaggcagtggacaacccaactg

SEQ ID NO: 14628 - DNA, 179 bp, Homo sapiens
  chr8.fa.O7frz.152422615
  Located on chromosome 8
  Distance between a terminus base of telomere on chromosomal short arm and 5'-terminus of this base sequence : 145254853
  Distance between 3'-terminus of neighbour sequence of sequence listing upward to telomere on chrosomal short arm and 5'-terminus of this base sequence : 534143
atgccaatcttaagtgagatagtaacataatatgttaaattggttaaaaaaaatgtgaacacaacctcaaaagaatagtttccagcatagcacttctggtctctctctctctttccatacacacacacacacacacacacacacacacacacacgtttgtatggtttctggctcataac

SEQ ID NO: 14629 - DNA, 336 bp, Homo sapiens
  chr8.fa.O7frz.152129998
  Located on chromosome 8
  Distance between a terminus base of telomere on chromosomal short arm and 5'-terminus of this base sequence : 145377969
  Distance between 3'-terminus of neighbour sequence of sequence listing upward to telomere on chrosomal short arm and 5'-terminus of this base sequence : 122937
taccagttcctgtttggtagatccatactgtttgtaattattacagctttttggtgggcttttagtaatatgcagtgttttatttttatttttatttatttatttatttatttatttatttgagatggagtctcgctctgtcgcccaggctggagtgcagtggtgcgatctcagctcactgcaagctctgcctcccggttcacaccattctcctgcctcagcctcccaagtagctgggactataggcccccgccaccacgcccggctaattttttttgtattttcggtagagacagggtttcaccgtcagccaggatggtctcgatctcctgacct

SEQ ID NO: 14630 - DNA, 337 bp, Homo sapiens
  AL354977.10_11632
  Located on chromosome 9
  Distance between a terminus base of telomere on chromosomal short arm and 5'-terminus of this base sequence : 122847
  Distance between 3'-terminus of neighbour sequence of sequence listing upward to telomere on chrosomal short arm and 5'-terminus of this base sequence : 0
cttcctgcatactaattatctgacttttggcaacttaatatctccaagtctcaacttcctcatctgtaaaacaggaataaacaaataagtaatgatatttaacatacaatacagaggattgttataaggtacataatgagcccttaataaagtatagctattattattactaccaactttccaacacacacacacacacacacacacacacttctctgtgttcctaatgcactatatacagagcattatgtaagtagagaatgttatatacatcaagtatctctggaggtcagaatggttggtttctgatccttcgttaccagtttctgtgactttg

SEQ ID NO: 14631 - DNA, 412 bp, Homo sapiens
  AL353577.13_32343
  Located on chromosome 9
  Distance between a terminus base of telomere on chromosomal short arm and 5'-terminus of this base sequence : 258017
  Distance between 3'-terminus of neighbour sequence of sequence listing upward to telomere on chrosomal short arm and 5'-terminus of this base sequence : 134833
ttctccactattgtacatggagggcagaccaattttcctttggtttataggctagcagacccataacaaaccaaacaaacaaacaattttccatttgtatctgatggaaagactgcatatctcccacagtacctacattttaagctggatgcaagaaatgcaagagcctttgaggttatctcacttggaatgttctttggaaagaaacttgggctctgataaatgcttaacaaccagctgagatagggttgtgtagaacacacacacacacacacacacacacgcacacgctatatatttattataaatgttgctgatataaaggatgtgtatctcataacttacaaataataatagtaatatatacagtactctttattgtaaactccttatgaccaattgattcttacag

SEQ ID NO: 14632 - DNA, 381 bp, Homo sapiens
  AL353577.13_64773
  Located on chromosome 9
  Distance between a terminus base of telomere on chromosomal short arm and 5'-terminus of this base sequence : 290481
  Distance between 3'-terminus of neighbour sequence of sequence listing upward to telomere on chrosomal short arm and 5'-terminus of this base sequence : 32052
atcagtggattaaggtggtaacagccaaatctctccatcggaaagatatggtcctccctttgcaactggctagcaaatatccacttttctataaaccttttagctaatagttttgtaataattgatgactcttatgtaaaccaattattttattagggtttcaaaaatgatattttgtctaatgctatcattctttctacatttatcagcttgcgtgtgtgtctgtgtgtgtgtgtgtgtgtgtgtgtgtgtgtgtaaagaagcaattactctcatcaagagcaggataaatggttaattctctctctttaataaccaattttcaaattaaggagtggtataatagtcatcccaagggtgtcaaatgaagttcattactct

SEQ ID NO: 14633 - DNA, 249 bp, Homo sapiens
  HUMUT685
  Located on chromosome 9
  Distance between a terminus base of telomere on chromosomal short arm and 5'-terminus of this base sequence : 386698
  Distance between 3'-terminus of neighbour sequence of sequence listing upward to telomere on chrosomal short arm and 5'-terminus of this base sequence : 95836
gaacaaggtctgcctgatgccaaagcttgtgccctttcttggtgcctcccgctagaaaagaaaaagcaacaggtcaccacccttcaacaaaacacacatacacacacacacacacactattctccacggaggaatagtactctagatttgagaaagagcagtattgagaggttttgtaatcccagtgactgtgtgtgtgtgtgtgtgtgtgtgtgtgtgtgtgtgtgtgaaagccaacaggagaagagc

SEQ ID NO: 14634 - DNA, 175 bp, Homo sapiens
  D9S1871
  Located on chromosome 9
  Distance between a terminus base of telomere on chromosomal short arm and 5'-terminus of this base sequence : 427472
  Distance between 3'-terminus of neighbour sequence of sequence listing upward to telomere on chrosomal short arm and 5'-terminus of this base sequence : 40525
actattgttggaggcaggatggggaactcagaaccccattttctaagtgtctgcacctactttccaaccctgtttcttcgaaacacacacacacacacacacacacacacacacacacacacacacacacacatcaaaatgaatatgttctgaatattctgtccccaaaagttaa

SEQ ID NO: 14635 - DNA, 128 bp, Homo sapiens
  D9S288
  Located on chromosome 9
  Distance between a terminus base of telomere on chromosomal short arm and 5'-terminus of this base sequence : 519995
  Distance between 3'-terminus of neighbour sequence of sequence listing upward to telomere on chrosomal short arm and 5'-terminus of this base sequence : 92348
agcaacctcaacagggaaaagaggagagagaaagagaggaataagcatgaacacacacacacacacacacacacacacacacacacacacacacgcacgcacacacccactggcctttctggatgatt

SEQ ID NO: 14636 - DNA, 108 bp, Homo sapiens
  D9S1873
  Located on chromosome 9
  Distance between a terminus base of telomere on chromosomal short arm and 5'-terminus of this base sequence : 605700
  Distance between 3'-terminus of neighbour sequence of sequence listing upward to telomere on chrosomal short arm and 5'-terminus of this base sequence : 85577
caagccaagttccatgctgagtgctgcagtgggcagatgtgtgtgcacacaacacacacacacacacacacacacacacacacacacagagacaataaatcctggggg

SEQ ID NO: 14637 - DNA, 184 bp, Homo sapiens
  AL133283.9_125546
  Located on chromosome 9
  Distance between a terminus base of telomere on chromosomal short arm and 5'-terminus of this base sequence : 689739
  Distance between 3'-terminus of neighbour sequence of sequence listing upward to telomere on chrosomal short arm and 5'-terminus of this base sequence : 83931
aacctgtcagttaagtaaactggattttaaaaataacttctattttacaaagaataaaacagggtttgggaaatttctcccagtgacacacacacacacacacacacacacacacacacacacacaccccaaagttcttagagaaatacaagtgaagctgtgcttgataggcagtgacctactg

SEQ ID NO: 14638 - DNA, 435 bp, Homo sapiens
  AL133283.9_121553
  Located on chromosome 9
  Distance between a terminus base of telomere on chromosomal short arm and 5'-terminus of this base sequence : 693571
  Distance between 3'-terminus of neighbour sequence of sequence listing upward to telomere on chrosomal short arm and 5'-terminus of this base sequence : 3648
caggtaagataggtgtacatggaccatgcaaatttgctaggccatgatatgattgcttcaccagaaattgacaaatttacacaccgtgtttcagtcactgaggccccacaatctcaaattaggtattcatgtcactcacaccacaagacagtaggtattaaagcattcctcccaattaagatgataagatggcacatacttagttttagacatattcccctacaaacctcaaattgagagagttgcttgagtgtgtaagtgtatgagtgtgtgtgtgtgtgtgtgtgtattcagaaagagaacggaaaacacttgtggggtgtgtttataccataaagaaaggggaaaaaaaagttaacttgagacctggtatctgaaggaggtatattcaggttggctgcattcattgccctctgtaagctaggactgatctgg

SEQ ID NO: 14639 - DNA, 375 bp, Homo sapiens
  AL133283.9_113333
  Located on chromosome 9
  Distance between a terminus base of telomere on chromosomal short arm and 5'-terminus of this base sequence : 701823
  Distance between 3'-terminus of neighbour sequence of sequence listing upward to telomere on chrosomal short arm and 5'-terminus of this base sequence : 7817
ggttaacactagcagttacctcagtttggaggattaaaaagtctaatatatgtaatagggcctggcacttaatacattgttagttctatttatattttattaaagaacttgtctctcatatggtacctttctgatattgtttctagcacctcttctcctgagtgcccagaaacagcatgctgatgccttcctgcccaagaccttctacacacacacacacacacacacacacacacacacacacacacacacacaccgtacatctgtcctcgcctgaacgggatccaggttttatttaggccattctagttcctcatatccattttctctttctctcagctattttagaaaacaatgattacttcgaactaaggt

SEQ ID NO: 14640 - DNA, 248 bp, Homo sapiens
  D9S1813
  Located on chromosome 9
  Distance between a terminus base of telomere on chromosomal short arm and 5'-terminus of this base sequence : 701880
  Distance between 3'-terminus of neighbour sequence of sequence listing upward to telomere on chrosomal short arm and 5'-terminus of this base sequence : -318
gggcctggcacttaatacattgttagttctatttatattttattaaagaacttgtctctcatatggtacctttctgatattgtttctagcacctcttctcctgagtgcccagaaacagcatgctgatgccttcctgcccaagaccttctacacacacacacacacacacacacacacacacacacacacacacacacaccgtacatctgtcctcgcctgaacgggatccaggttttatttaggccatt

SEQ ID NO: 14641 - DNA, 308 bp, Homo sapiens
  AL133283.9_83939
  Located on chromosome 9
  Distance between a terminus base of telomere on chromosomal short arm and 5'-terminus of this base sequence : 731334
  Distance between 3'-terminus of neighbour sequence of sequence listing upward to telomere on chrosomal short arm and 5'-terminus of this base sequence : 29206
aagcaatcagctctaaagtcatacaggagagttagggtttgaacacagatctgcctgggtccatagctgctgcctcattttttatgtctcagcatgtgcacgcatgtgcactggcacacacacacacacacacacacacgcgcacgcgcgcacacataccatttctcaaacatgcccatttaatttacctatgtctgaaattcatcattttcacaatccatggaatattaagagctggaggatacctcatttaacataacaatttcattttacagatgaacaagaaatgataagcaagtgatttgtcc

SEQ ID NO: 14642 - DNA, 388 bp, Homo sapiens
  AL133283.9_70034
  Located on chromosome 9
  Distance between a terminus base of telomere on chromosomal short arm and 5'-terminus of this base sequence : 745195
  Distance between 3'-terminus of neighbour sequence of sequence listing upward to telomere on chrosomal short arm and 5'-terminus of this base sequence : 13553
cagagcaacatcagtacatttaacccctgacaatatgggtatcccccgaaatttacaccatcattaccaatgtatgggaatcctagtctcaaggtgtgctacttacccactgagtgttatcttgtcaatttgatgagcaaaaacaaaacaaaacaaaacaaaacaaaacaaaacaaaacaaaatcaccattgctttaatttatactcccgagttcagttttctccaaaggattatttcccctttatgagtggtctcttcatgactctgcccatttatctattggttggcaacatatgacctcaaattatctttttgtaaggtgtaccaatatagcaaaacaggaggttcacagaatcaggagacctagaccttgccattaactagtta

SEQ ID NO: 14643 - DNA, 209 bp, Homo sapiens
  D9S1792
  Located on chromosome 9
  Distance between a terminus base of telomere on chromosomal short arm and 5'-terminus of this base sequence : 834688
  Distance between 3'-terminus of neighbour sequence of sequence listing upward to telomere on chrosomal short arm and 5'-terminus of this base sequence : 89105
aattaggaacaaaccatctgtgcaccctattaaggtaccactggttcttactgcccaccctcttcagcatacacaaatataggcctacattttacacatgcatgcgcgtgtacacacacacacacacacacacacacacacacacactttccttagcaacctcatgcttctggactgtgtacagaatgaatgacagccactatgataat

SEQ ID NO: 14644 - DNA, 155 bp, Homo sapiens
  Z66879
  Located on chromosome 9
  Distance between a terminus base of telomere on chromosomal short arm and 5'-terminus of this base sequence : 888123
  Distance between 3'-terminus of neighbour sequence of sequence listing upward to telomere on chrosomal short arm and 5'-terminus of this base sequence : 53226
ggctcacagatttgttttgttcggcctatagaattggtccttacagtaggttagtagagggggttgtgtgtgtgtgtgtgtgtgtgtgtgtgtgtgtgtgtgtgtgcgcgcgcacaagagtcaaattagttgctaagtaagaaacataaaaatca

SEQ ID NO: 14645 - DNA, 403 bp, Homo sapiens
  chr9.fa.O7frz.4893502
  Located on chromosome 9
  Distance between a terminus base of telomere on chromosomal short arm and 5'-terminus of this base sequence : 1137034
  Distance between 3'-terminus of neighbour sequence of sequence listing upward to telomere on chrosomal short arm and 5'-terminus of this base sequence : 248756
aggacatacacattcataccatagcagaggagaagaaaaattaagcatgttttgccttaaactcttaagaattctacacacacacacacacacacacacacacacacactacactacactacagcttatatttaatgctgaaagtctgaatgctttccccctaagagcaggaataaggcaaaggtgtccattctcaccatttcttttgaatatctcactggaaacctgggccagtgcaacagggcaagaaaaagaaataaaaggcattttgaaaagaaagaaacaaaactgtccctattcacagatggcatgattttctacacaggaaatcccaagaaattacaaaataaattttaagactaataagtgattttagcagggctgcaagatacaaggttaacac

SEQ ID NO: 14646 - DNA, 352 bp, Homo sapiens
  AL136231.12_22813
  Located on chromosome 9
  Distance between a terminus base of telomere on chromosomal short arm and 5'-terminus of this base sequence : 1209281
  Distance between 3'-terminus of neighbour sequence of sequence listing upward to telomere on chrosomal short arm and 5'-terminus of this base sequence : 71844
atgtgagtggagcatctagaacagcgtttggcagcccatacatgctcaataaatggcaagttttattgttatgattagaatgagttggaccattcaggccccaatcaacaacacttctctctctctctctctctctctctctctcacacacacacacacacacacacacacacatatggaatacagcagaacatctgggtgagaaagtaccttcagtgaccctcaaggttaaagttagaaccagcctggctccaagctttacccttgatgcccacttctgtgcatggatcttacagcatttaggtctggctctgtcccctggcattgcaggtaagtattgctccacatggag

SEQ ID NO: 14647 - DNA, 136 bp, Homo sapiens
  D9S1686
  Located on chromosome 9
  Distance between a terminus base of telomere on chromosomal short arm and 5'-terminus of this base sequence : 1270152
  Distance between 3'-terminus of neighbour sequence of sequence listing upward to telomere on chrosomal short arm and 5'-terminus of this base sequence : 60519
aaatgcgtaatagcagagatcagaggagaattttctgagttttcagtattctctctctctctctctctctctctctcacacacacacacacacacacacacacacacacacacacttctatgccaacaaccctaaa

SEQ ID NO: 14648 - DNA, 362 bp, Homo sapiens
  AL136231.12_89755
  Located on chromosome 9
  Distance between a terminus base of telomere on chromosomal short arm and 5'-terminus of this base sequence : 1276093
  Distance between 3'-terminus of neighbour sequence of sequence listing upward to telomere on chrosomal short arm and 5'-terminus of this base sequence : 5805
aaactgacaaacctttagctacactaaccaagaaaaaagagaaaagactcaaattactaaaatcagaaatgaaagaagagacattaccactgattttacagaaataattttttgtttgtttgtttttgagacggagtcttgctctgtcgcccaggctagagtgcagtggcacaatctcagttcactgccacctctgccacccaggctcaagcaattcttccacttcaccctcccaagtagctaggattacaggcaagcaccaccaaacccagcttgtgtgtgtgtgtgtgtgtgtgtgtgtgtgtgtgtgtgtgtgtgtgtgtgtatttttgatagagacacggtttcaccatattggccag

SEQ ID NO: 14649 - DNA, 335 bp, Homo sapiens
  AL136231.12_117233
  Located on chromosome 9
  Distance between a terminus base of telomere on chromosomal short arm and 5'-terminus of this base sequence : 1303750
  Distance between 3'-terminus of neighbour sequence of sequence listing upward to telomere on chrosomal short arm and 5'-terminus of this base sequence : 27295
aagtaaagatcctcagaagctttccttcctaggctcacccaccagaggtaatcattaacagtttcttgcatatcctccaggaatgttctgcgcaaacacacacacacacacacacacacacacacacacacacggacgcaaacaaataccatccctctctcttctctctctgtatacgtacgcatatgtttaattctgcaagttgctttgtttaaaactcaataccttttggaggtatttatatatcagcatattcagatacaatttactttttttaaaaagggtaatatgccattgtattaatattccatactttaagttcctctatcgatgga

SEQ ID NO: 14650 - DNA, 202 bp, Homo sapiens
  D9S1810
  Located on chromosome 9
  Distance between a terminus base of telomere on chromosomal short arm and 5'-terminus of this base sequence : 1504209
  Distance between 3'-terminus of neighbour sequence of sequence listing upward to telomere on chrosomal short arm and 5'-terminus of this base sequence : 200124
caagcaaaactttttattgtgatcacaactgtcttaatgccattctaggatgaagtgtgtgtgtgtgtgtgtgtgtgtgcacgcgtgtgtgtgtgtgtgtgtgagagagagagagattagagaagtctagagaagtcctgtccaggcctccctcccttgtaggaaggggtggattccctgcttttggatgctctgctgtcag

SEQ ID NO: 14651 - DNA, 378 bp, Homo sapiens
  chr9.fa.O7frz.5425460
  Located on chromosome 9
  Distance between a terminus base of telomere on chromosomal short arm and 5'-terminus of this base sequence : 1645306
  Distance between 3'-terminus of neighbour sequence of sequence listing upward to telomere on chrosomal short arm and 5'-terminus of this base sequence : 140895
gcattgagtagttccatgtactagagtagtgtttttaaatttttggcagtaacagacctctttttattaaaacaaatttaattacaaaatccatcccattttacttaccaaacaggaacatgttttcccatatgtacgtgtgtgtgtgtgtgtgtgtgtgtgtgtgtgtgtgtgtatacatatatatatgagtatctgtttgatgggaaaatacgtccctgtttctggaaaccctgaactatttctacacagcctctggttcctcagagagtgggctgcaaccctatgattcaatgtatggagaatacaagaaatctattctgagaattcagttaagcttatgttaagcttaaatatgaaatcttcatttacacgata

SEQ ID NO: 14652 - DNA, 201 bp, Homo sapiens
  G09151
  Located on chromosome 9
  Distance between a terminus base of telomere on chromosomal short arm and 5'-terminus of this base sequence : 1876926
  Distance between 3'-terminus of neighbour sequence of sequence listing upward to telomere on chrosomal short arm and 5'-terminus of this base sequence : 231242
tgcaaatacttgatcagccaaaatgttatgcaagtatctctaacaagatataagataaagagaagaagagagagatacagataaagggatagatttttctatctatatcgagatttttctatctatatcgtctatatctatctatctatctatctatctatctatctatctatatctagttcaggtcttggtttctgctgt

SEQ ID NO: 14653 - DNA, 276 bp, Homo sapiens
  G08748
  Located on chromosome 9
  Distance between a terminus base of telomere on chromosomal short arm and 5'-terminus of this base sequence : 1876940
  Distance between 3'-terminus of neighbour sequence of sequence listing upward to telomere on chrosomal short arm and 5'-terminus of this base sequence : -187
cagccaaaatgttatgcaagtatctctaacaagatataagataaagagaagaagagagagatacagataaagggatagatttttctatctatatcgagatttttctatctatatcgtctatatctatctatctatctatctatctatctatctatctatatctagttcaggtcttggtttctgctgtatactgctcagtggtggtgccatcgagagttgaagactccagggtaggagatgtatagtaccctagagaatagatggcaacttttggca

SEQ ID NO: 14654 - DNA, 379 bp, Homo sapiens
  G10050
  Located on chromosome 9
  Distance between a terminus base of telomere on chromosomal short arm and 5'-terminus of this base sequence : 1876948
  Distance between 3'-terminus of neighbour sequence of sequence listing upward to telomere on chrosomal short arm and 5'-terminus of this base sequence : -268
atgttatgcaagtatctctaacaagatataagataaagagaagaagagagagatacagataaagggatagatttttctatctatatcgagatttttctatctatatcgtctatatctatctatctatctatctatctatctatctatctatatctagttcaggtcttggtttctgctgtatactgctcagtggtggtgccatcgagagttgaagactccagggtaggagatgtatagtaccctagagaatagatggcaacttttggcaaaattcccctgcaaccaggaggagagacaagccgcaaatgagaggaccgtgcagaccagccctcagtgtgttgcagtaggaaccgttgagcactatgggccctgagagctt

SEQ ID NO: 14655 - DNA, 258 bp, Homo sapiens
  D9S1681
  Located on chromosome 9
  Distance between a terminus base of telomere on chromosomal short arm and 5'-terminus of this base sequence : 1962602
  Distance between 3'-terminus of neighbour sequence of sequence listing upward to telomere on chrosomal short arm and 5'-terminus of this base sequence : 85275
aggcagttgcacagatagttatatactaatgttcacagcagcattattcacaaaaactaaaaagataaaaataaactaaatgtccatcaatggacaaatgaataaacaaaatgtagtgtgtgtgtgtgtgtgtgtgtgtgtgtgtatgtgtgtgtatatatatctatataatacatgtatttatatatataatgaaacattattcctccatgaaaaggaatgatcttctgacacatgctggaacatggctgaatctga

SEQ ID NO: 14656 - DNA, 438 bp, Homo sapiens
  AL135786.17_20088
  Located on chromosome 9
  Distance between a terminus base of telomere on chromosomal short arm and 5'-terminus of this base sequence : 1994406
  Distance between 3'-terminus of neighbour sequence of sequence listing upward to telomere on chrosomal short arm and 5'-terminus of this base sequence : 31546
tcaacttaatacactgttgacgaagtgtgggagagacactcatctatgccaatggggtggtgggaatgcaaaatcgtacgacccttttggaagagaatttcacagtatttaacaaaactatgtgtgtgtgtgcgtgtgtgtgtgtgtgtgtgtgtctgtatacacacagttagaaatagtagagacagggtttcgccacattggccaggctggtctcaaacttgtgacctcaggtgatccgcctgccttggcctcccaaagtactgggatttacaggcatgagctactgcacccagtcaaaatttctggattttaaaaattatttgcaacattataataagatgacttcaccctgccacttttattttctccctcagtgagtgaagtcaggataaacaacatcccttttttgttcctcctaccatgaacaaagtaaca

SEQ ID NO: 14657 - DNA, 156 bp, Homo sapiens
  DISD22_0006211
  Located on chromosome 9
  Distance between a terminus base of telomere on chromosomal short arm and 5'-terminus of this base sequence : 2066695
  Distance between 3'-terminus of neighbour sequence of sequence listing upward to telomere on chrosomal short arm and 5'-terminus of this base sequence : 71851
ctcaactctgtgactaattcagttcttctgtgtgaatgtgtatatgtgtgtgcgtgtgtgtgtgtgtgtgtgtatgtgtatatatatatatatatttgcctttctccatgtaaaattaggcctgaaaaaccacaaaactgccagacgaagacctag

SEQ ID NO: 14658 - DNA, 285 bp, Homo sapiens
  DISD22_0006213
  Located on chromosome 9
  Distance between a terminus base of telomere on chromosomal short arm and 5'-terminus of this base sequence : 2143692
  Distance between 3'-terminus of neighbour sequence of sequence listing upward to telomere on chrosomal short arm and 5'-terminus of this base sequence : 76841
gcacggtatctcatttaatcccccaccccttgccattaccaaagagagagagagagagagagagagaaatactagaatttatcctcattttacagtagagaaaacagagggtcaagaagataatgtaaagtgcccaagaacacacagctgatcacaaaaatcaagcttgggggccattagcctaaccacagacccttactcttaacccatctgcttcaatccattttgctacaaatgtttacatttataagcagggcagaaaaacctcatccaggttattgaact

SEQ ID NO: 14659 - DNA, 102 bp, Homo sapiens
  DISD22_0006215
  Located on chromosome 9
  Distance between a terminus base of telomere on chromosomal short arm and 5'-terminus of this base sequence : 2251778
  Distance between 3'-terminus of neighbour sequence of sequence listing upward to telomere on chrosomal short arm and 5'-terminus of this base sequence : 107801
ttcatgtctgggtgcctacgtgtcccctcaccccctgcaacacacacacacatgtgcaaacacacacacacacacacacacacctgttcctgctagcctttg

SEQ ID NO: 14660 - DNA, 163 bp, Homo sapiens
  AL136980.5_72851
  Located on chromosome 9
  Distance between a terminus base of telomere on chromosomal short arm and 5'-terminus of this base sequence : 2398824
  Distance between 3'-terminus of neighbour sequence of sequence listing upward to telomere on chrosomal short arm and 5'-terminus of this base sequence : 146944
cacttaaggatggcttacagaaggaatgagcttgcaaaaactataagagagagagagtgtgtgtgtgtgtgtgtgtgtgtgtgtgtgtgtacctatgcagtgtatgtgtgggtctataggtatgtatcacacgtccacatgcatgttcatagcctccatgcac

SEQ ID NO: 14661 - DNA, 281 bp, Homo sapiens
  AL136980.5_153537
  Located on chromosome 9
  Distance between a terminus base of telomere on chromosomal short arm and 5'-terminus of this base sequence : 2479339
  Distance between 3'-terminus of neighbour sequence of sequence listing upward to telomere on chrosomal short arm and 5'-terminus of this base sequence : 80352
tcagaaacagctcagttatcagcacacaatggacatttcagagtcccttttcatgcttctcttcattttattttgcacccatctcagaacctagagtgacacaggatgcaatatttcaggaaggccgaggcacgagaattgcttgaacccaggaggcggtggttgcagggagccgagattacaccactgcactccagcctgagtgacagagcgagactctgtctcaaaaacaaacaaacaaacaaacaaacaaaaaaccgtgattgcttgacaagacttta

SEQ ID NO: 14662 - DNA, 454 bp, Homo sapiens
  chr9.fa.O7frz.6092428
  Located on chromosome 9
  Distance between a terminus base of telomere on chromosomal short arm and 5'-terminus of this base sequence : 2537582
  Distance between 3'-terminus of neighbour sequence of sequence listing upward to telomere on chrosomal short arm and 5'-terminus of this base sequence : 57962
tgtggtattctgttatagccacacaaaatggactgagacagggatctagtaagaagctatgctctctgtcaaaatgtttctgcatttctgagaggcagtgaacccacaatggcttagggggtgtgtgtgtgtgtgtgtgtgtgtgtgtgtgtgtgtgtgtgtgtgtgtgtaaaagctaagaaaaagtaaagtactggagagggaaaaaaaatcagttaataactcaaagtattatcccaggatgtcatcattggccttagctgtgctgaatttgggtgaaaaaaaagtaagatttaaggaaatatattctacactctttctactcaaggtacagggttgagttttcaaaatcatacttgctgggtttttttttactattttattgaggtattcagtaccacctttaacaaggagaaagcaggagccatgtgtgtcaatcttgattaaagaccta

SEQ ID NO: 14663 - DNA, 239 bp, Homo sapiens
  AL353741.10_4060
  Located on chromosome 9
  Distance between a terminus base of telomere on chromosomal short arm and 5'-terminus of this base sequence : 2777484
  Distance between 3'-terminus of neighbour sequence of sequence listing upward to telomere on chrosomal short arm and 5'-terminus of this base sequence : 239448
gtgaaattgataggaagcctactgcattcatacttaatttatataagcagaaaacttcgaggtcaaatggacaaaagacttatttgaatttgaattataaaaacagagaatcatggcccctcaatcaatttccagacttaagtcagtttatagacccataaccccttgaatgaaggggaggccatgtccccttgaggaaggaccccactacattactgacaatttatgcagtaaatctt

SEQ ID NO: 14664 - DNA, 466 bp, Homo sapiens
  chr9.fa.O7frz.6542811
  Located on chromosome 9
  Distance between a terminus base of telomere on chromosomal short arm and 5'-terminus of this base sequence : 2781657
  Distance between 3'-terminus of neighbour sequence of sequence listing upward to telomere on chrosomal short arm and 5'-terminus of this base sequence : 3934
acttgaatggattgaaggatacaaagtattgatcctgagtgtgtctgtgagggttttgccaaaggagattaacgtttgtgtcggtgggctgggaaaggcagacccacccttaatctgggtgggcaccatctaatcagctgccagcgtggctagaatataagcaggcagaaaaatatggaaagagaaactgacctagctcccccaaggctatatctttctcccatgctggatgcttcctgccctcaaacatcagactccaagttcttcagatttggaactgggactggctctcctttctcctcagcctacagatggcctattgttggaccttgtgactgcatgagttaatacttaataaactcccctttatatatatatatatatatatatattccattagttctgtccctctagagaaccctgactaatacaggcagcaaatatgtaactgttcacagcatttcac

SEQ ID NO: 14665 - DNA, 222 bp, Homo sapiens
  D9S1852
  Located on chromosome 9
  Distance between a terminus base of telomere on chromosomal short arm and 5'-terminus of this base sequence : 2912514
  Distance between 3'-terminus of neighbour sequence of sequence listing upward to telomere on chrosomal short arm and 5'-terminus of this base sequence : 130391
gaatcacaacatacacccacacccacccacacccatacacacacacacacacacacacacacacacacacacacacaactgtcagttgcaacactggcaatattagaaaacaaaaacaaaaataaaatctggaaacagccagtgttaatcaataaaagactcgttaagatatatttctatgattgaatgctatttataatgttacttgtaaaagaatgtttc

SEQ ID NO: 14666 - DNA, 316 bp, Homo sapiens
  AL360221.9_59020
  Located on chromosome 9
  Distance between a terminus base of telomere on chromosomal short arm and 5'-terminus of this base sequence : 2943859
  Distance between 3'-terminus of neighbour sequence of sequence listing upward to telomere on chrosomal short arm and 5'-terminus of this base sequence : 31123
ggctttctatcttggactaaaccgctctaccagcttctctttttccccaacttgtagatggcctattttgggacttcaccttttaatcgtgtgagccaattatccttaataaactcagatagatagatagatagatagatagatagatagatagatagatagatagagtgtatatatacattgtgtgtgtgtgtatatatatatagatatatatatatctatatatatatatctatatagctatatatatatatatctatatagctatatatatatatatatatctatatctatctatctcctactggttctgtcc

SEQ ID NO: 14667 - DNA, 232 bp, Homo sapiens
  AL353718.4_147168
  Located on chromosome 9
  Distance between a terminus base of telomere on chromosomal short arm and 5'-terminus of this base sequence : 3200664
  Distance between 3'-terminus of neighbour sequence of sequence listing upward to telomere on chrosomal short arm and 5'-terminus of this base sequence : 256489
gaactaatatgcaacctgactaaatttcatctaaaaatacctgacaatgattgttgcgtgatgcatatttcttttagagactccccttattttcatactataattaccatgggcttttttctttttatttatttatttatttatttatttatttatttatttatttttttgtgggggactgagtctcgctcttgtcgcccaggctggagtgcagtagtgcaatcttggctca

SEQ ID NO: 14668 - DNA, 202 bp, Homo sapiens
  D9S937
  Located on chromosome 9
  Distance between a terminus base of telomere on chromosomal short arm and 5'-terminus of this base sequence : 3262274
  Distance between 3'-terminus of neighbour sequence of sequence listing upward to telomere on chrosomal short arm and 5'-terminus of this base sequence : 61378
ggggcagataccataactcattttctaaagatattctaaaatgtaaactcacataccgataacatgattcctgcccatctatcattcatctatgtatgtatgtatgtatgtatgtatgtatgtatgtatctatctatctatctatctatcatctgtccatcggtccatctgtcatctatcatcatgaaggcagagagaccac

SEQ ID NO: 14669 - DNA, 147 bp, Homo sapiens
  chr9.fa.O7frz.7141597
  Located on chromosome 9
  Distance between a terminus base of telomere on chromosomal short arm and 5'-terminus of this base sequence : 3322783
  Distance between 3'-terminus of neighbour sequence of sequence listing upward to telomere on chrosomal short arm and 5'-terminus of this base sequence : 60307
agcacttgaacagtagatttgaacaccctctctatatttcttttcttttctttcttccttctttctcctcctcctcctcctcctccttcttctcactctctctctttctctctcttcccccccaccacatgtaacgctatggctcac

SEQ ID NO: 14670 - DNA, 204 bp, Homo sapiens
  D9S281
  Located on chromosome 9
  Distance between a terminus base of telomere on chromosomal short arm and 5'-terminus of this base sequence : 3533028
  Distance between 3'-terminus of neighbour sequence of sequence listing upward to telomere on chrosomal short arm and 5'-terminus of this base sequence : 210098
cataggttattgattagttttaggcatatctctctctgtgtgcgtgtgtgtgtgtgtgtgtgtgtgtgtgtgtgtgtgtgtgtgtatttttttttgagacagagtctcactctgtttcccgggctgaatgcggtgttgcgatgatggctaactgcagccacaacctcctgggctcaagtgatcctcccacttcagcctcccagg

SEQ ID NO: 14671 - DNA, 173 bp, Homo sapiens
  G10183
  Located on chromosome 9
  Distance between a terminus base of telomere on chromosomal short arm and 5'-terminus of this base sequence : 3628308
  Distance between 3'-terminus of neighbour sequence of sequence listing upward to telomere on chrosomal short arm and 5'-terminus of this base sequence : 95076
ctgctggcattagctgatctactcaataagtattatgttattttttaaagtcatccatccatccatccatccatccatccatccatccatccatccatccattcatcttgggctcaaagctgtacctggaacacaccgagtatgttctcactttacgtgctattcttgctccc

SEQ ID NO: 14672 - DNA, 453 bp, Homo sapiens
  chr9.fa.O7frz.7611687
  Located on chromosome 9
  Distance between a terminus base of telomere on chromosomal short arm and 5'-terminus of this base sequence : 3756690
  Distance between 3'-terminus of neighbour sequence of sequence listing upward to telomere on chrosomal short arm and 5'-terminus of this base sequence : 128209
aatcgttataggcaggagttaccactgagtgataccctgtgtcgcttgcttctctcatttgaaagtgtcccatcagacgtcatttaaaggaaatattaccttattgttgagtaaatgctttccttctcattttattctctccaaattgtaattcctccaactttgttattttattttcaacattgctttgagtattttcggttcttcacatttttgtatacattttagaatcatcttgttaatttctacacacacacacacacacacacacacacacacacacacacactgctgttaatgattgagattgtgggaatatattgctcttcctaaattatattgttggcacccaagaagcctgaagaactcctgaaataaaaaagcccaaggcagagcttctagggtctagcatctgggaactcactgattctctagcaacagtaatgaaattgg

SEQ ID NO: 14673 - DNA, 451 bp, Homo sapiens
  AL161443.8_1706
  Located on chromosome 9
  Distance between a terminus base of telomere on chromosomal short arm and 5'-terminus of this base sequence : 3761401
  Distance between 3'-terminus of neighbour sequence of sequence listing upward to telomere on chrosomal short arm and 5'-terminus of this base sequence : 4258
agaggtttaattgacttatggttctgcaggctgtataggaagcatggatggggaggcctcagaaaacctacaatcatggcagaaggcaaaggggaagcagctcatcttatatggtctgagcaggaggaagagatagcagtgggagatgccacacacacacacacacacacacacactctctctctctctctctcttaaacagccagatcctgtgagaactctatcacaagacagcactagggagatggtgctaaaccattagaaaccacccccgtgatccagtcacctcccaccaggccccacctccaatattggggattccaattcaacatgagctttgggtggggacacagagccaaaccatatcacctgtcatgggagagcactgctctagactacttctaaactgttctgagatcttggaaaagtcacttgactttgtcaagagtat

SEQ ID NO: 14674 - DNA, 191 bp, Homo sapiens
  chr9.fa.O7frz.7765921
  Located on chromosome 9
  Distance between a terminus base of telomere on chromosomal short arm and 5'-terminus of this base sequence : 3912845
  Distance between 3'-terminus of neighbour sequence of sequence listing upward to telomere on chrosomal short arm and 5'-terminus of this base sequence : 150993
ctaaggaattcctacctgctacacaggtattgtaagatcgatctatcgatctatctatcgatctatctatctatctatcttaccttgactgttatcttacctcctaacttattagcagagtaaagagccccacctattagtgtaactgttaataaaaatgttcttaagcctgatcaaccttgttaattgtc

SEQ ID NO: 14675 - DNA, 439 bp, Homo sapiens
  chr9.fa.O7frz.7918629
  Located on chromosome 9
  Distance between a terminus base of telomere on chromosomal short arm and 5'-terminus of this base sequence : 4022297
  Distance between 3'-terminus of neighbour sequence of sequence listing upward to telomere on chrosomal short arm and 5'-terminus of this base sequence : 109261
agaaatggaaactttccagtaccccttcccccaggctttattattattattattattattatttttgcaggctttaagtggttattcctgagacaagtgttatgtggtacaacaaacatgggcttgaattccagtttcctagctgcgtagtcctggggagattactttagcactctggccttcagcttcctcacctgtagtaaattctgccttacagtgttgttgggaggattcaagaagcaattttatttcagtttcttagtgcactacctggtccatagtaagggtttagtaaatcccagccagtcttattgttgtgcagcccttagagctttcagagtatgttcgtatctactgtttcactattctccccacaatcctttgccataagctagtttggaatttatcatcccattttagaggtgaagatgctaacatc

SEQ ID NO: 14676 - DNA, 281 bp, Homo sapiens
  chr9.fa.O7frz.8275688
  Located on chromosome 9
  Distance between a terminus base of telomere on chromosomal short arm and 5'-terminus of this base sequence : 4328535
  Distance between 3'-terminus of neighbour sequence of sequence listing upward to telomere on chrosomal short arm and 5'-terminus of this base sequence : 305799
atggtagcatgcaagtaaatagaaagcagccatcaaatatgattgaatccttttctccgtagtgataacattctcttctgttttattgaatcttccatttcattttctgagaaaacaagtcttttctctctctcttgaacttacgaattctcaaacacacataagcattgtctctctgtccctatttctctgtctctgtctcttacacacacacacacacacacacacacacacacacacacgctttctgttccaggctagctacttcagtgattcatctc

SEQ ID NO: 14677 - DNA, 269 bp, Homo sapiens
  AL135923.15_14659
  Located on chromosome 9
  Distance between a terminus base of telomere on chromosomal short arm and 5'-terminus of this base sequence : 4568183
  Distance between 3'-terminus of neighbour sequence of sequence listing upward to telomere on chrosomal short arm and 5'-terminus of this base sequence : 239367
attccttaatccaatcaagttaacaactaaaattaatcatcaacatctcctggtgtataagctaaggtaccagaatttccaaaccaactagaccacagcatttctcaaagcaaaaattttgttctgcatctgggcctttatgtatatatgtgtcattatatgcacacatgtatgtatgtatgcctctgtctatctatctatctatctatctatctatctatctatctatctatctatctatccatagctgtatggtaagttaggctcaa

SEQ ID NO: 14678 - DNA, 139 bp, Homo sapiens
  D9S286
  Located on chromosome 9
  Distance between a terminus base of telomere on chromosomal short arm and 5'-terminus of this base sequence : 4692728
  Distance between 3'-terminus of neighbour sequence of sequence listing upward to telomere on chrosomal short arm and 5'-terminus of this base sequence : 124276
tggagtgcgctcatactggcagcagtggcatggaaggatgcacttgcacacatatgctgatggataagggaaggcaaggtctgtccacacacacacacacacacacacacacacaccagcaaagccatgtaggtggtgg

SEQ ID NO: 14679 - DNA, 373 bp, Homo sapiens
  AL135788.11_64957
  Located on chromosome 9
  Distance between a terminus base of telomere on chromosomal short arm and 5'-terminus of this base sequence : 4770859
  Distance between 3'-terminus of neighbour sequence of sequence listing upward to telomere on chrosomal short arm and 5'-terminus of this base sequence : 77992
cattgtttcctttagaatcagaagaatgcatacatctttatcaaagatgaatctctaattcatctttaatatattaacctggtgatcctgggtgttgcaccaaatttcttgaatatgtgtgtatatacatatagacatatgtcttctctctctctctctctctctctctctctctctctctatatatatatatatatatatatatatacaggattatatgtatgtttatatttatgtatgtatttgtgtgtatatatatgtgtgtctgtgtgtaatatatataatttttcccaccaagtgatttagtcttatacagactaaagttggaaatcaatagaccaaaatgtacatgtgtataggttgcgaagatgac

SEQ ID NO: 14680 - DNA, 172 bp, Homo sapiens
  D9S1676
  Located on chromosome 9
  Distance between a terminus base of telomere on chromosomal short arm and 5'-terminus of this base sequence : 5009416
  Distance between 3'-terminus of neighbour sequence of sequence listing upward to telomere on chrosomal short arm and 5'-terminus of this base sequence : 238184
aaagttctgccccaaaatcacattttataaataagataaaaacaatactatatgtctctattcatgcactgcacatatatatatacacacacacacacacacacacacacacacatatatatatatgtgctgtgaagagataatggcaaatatctgacaacctttacacatg

SEQ ID NO: 14681 - DNA, 300 bp, Homo sapiens
  chr9.fa.O7frz.9361081
  Located on chromosome 9
  Distance between a terminus base of telomere on chromosomal short arm and 5'-terminus of this base sequence : 5094052
  Distance between 3'-terminus of neighbour sequence of sequence listing upward to telomere on chrosomal short arm and 5'-terminus of this base sequence : 84464
cctctgattatgaactaaacagaggacatgaagttacatcactgaatacatagtgtgtgtgtgtgtgtgtgtgtgtgtgtgtgtgtgtgaatgccacgtgcacttttatccatcacctataaaatactgccacaattaattatatcccaggaagtgttcgacagtggagagataatttgatttttaaaaaacatgctatgagaaaactaatgtactcaatgggaatacagcatcattccataaaagaaattcgttcatttaaaataaaaagccttcaattaagaggtatgtcattccttt

SEQ ID NO: 14682 - DNA, 416 bp, Homo sapiens
  chr9.fa.O7frz.9472370
  Located on chromosome 9
  Distance between a terminus base of telomere on chromosomal short arm and 5'-terminus of this base sequence : 5205047
  Distance between 3'-terminus of neighbour sequence of sequence listing upward to telomere on chrosomal short arm and 5'-terminus of this base sequence : 110695
attgttctgcatagtttatgagacgcttatcaaaaagaactggggtaagttattcatcaaagttttatcattaatagcattaatagcaaaagcataccttttggaaccatggaatattacagaaatagaaagttgcagttcaaatgctgtttgtatatagagagaaaacaagaagacaaattttatgagatttcaggtacctcaggactggttttgaagtattatagatcaaatatgtgaaggttataaaccagggctcccaggtaagctggtatagaacaaaatcaccagtggaacagaaactgaaaatacttccgctgaaaagatatatactgaatgcaaaatatgtgtgtgtgtgtgtgtgtgtgtgtgtgtgtgtgtgtgtgtatagcaagtttcatttatagaccaatgca

SEQ ID NO: 14683 - DNA, 475 bp, Homo sapiens
  AC051658.3_91303
  Located on chromosome 9
  Distance between a terminus base of telomere on chromosomal short arm and 5'-terminus of this base sequence : 5384980
  Distance between 3'-terminus of neighbour sequence of sequence listing upward to telomere on chrosomal short arm and 5'-terminus of this base sequence : 179517
cgtttgtaattgaacgaataacatgcagacacatgtttataccaccttaaggtatacctattttgcatattaccatcaagttctattttatggagtttctctctctctctctctctctctctctcttttagatagggtcttgttctgtcgcccaggctggagtgcagtggcacaatcacaggtcactgcagcctggaaatcctgggctcaagctatcctcccgcctctacccccagagtatccgggaatactggcaagtgccaccacatttggtttttcaatttttattgggaaggggtcttgctatgttgcccagactggtcttgaactcctggactcaaaacaatcctcccaaactggcctcccaaggtggtggaattacaggcatgagccaccatgcccaatcgattttttttttttctctgtaaaatttaaatgtcagcaaggacatatgttgagtaattgtgacaaggtg

SEQ ID NO: 14684 - DNA, 428 bp, Homo sapiens
  chr9.fa.O7frz.9795304
  Located on chromosome 9
  Distance between a terminus base of telomere on chromosomal short arm and 5'-terminus of this base sequence : 5463063
  Distance between 3'-terminus of neighbour sequence of sequence listing upward to telomere on chrosomal short arm and 5'-terminus of this base sequence : 77608
agtcattggaaaggcttctctctttgtttccttgtgtgggtgatttctaaaatcctcgtaacgtgctggggatcccacggaattgctgtgctccagcgctgggggattgtgtgtgcgcgttgcctgcgcgtgagtgtgagtgtgggtgcgcccggacgcggggagagctgggcccgctgcgcccgctggcgaatccctgaatctggaccactgacccactgaaagggccagagagccggataaaggaggggcaggcaggagaggtgggtgaaggaggcaacacacacacacacacacacacacacacacacatacacacacacagacacacagacacacacacaccagaggagggggcggggtgacgtcactccccagcatccatccaccaggccagaaaagaccctctccaacagattcactcatct

SEQ ID NO: 14685 - DNA, 473 bp, Homo sapiens
  AL353638.6_111239
  Located on chromosome 9
  Distance between a terminus base of telomere on chromosomal short arm and 5'-terminus of this base sequence : 5623579
  Distance between 3'-terminus of neighbour sequence of sequence listing upward to telomere on chrosomal short arm and 5'-terminus of this base sequence : 160088
gaaataacatacagaaccatcaagtatcattcaataaaaacaaacttgtgctagaaaaacctatgaagaattcttacaaaagggagtatttcttgtgttgaaaacctttgttaagattttaattccttggtaaacatacagaaagcccattgagtttctttgaacaacatcacaggatttttattatagaaagacagaatctaccagactatgataataatgttatcaagaaagaaagaaaaagaaagaagaaagaaagaaagaaagaaagaaagaaagaaagaaagaaagaaagaaagaaagaacgaaagaaagaaagaaagaaagaatctgaattttaaaattaggctgagggcttattaaacttttaattatatacctcgaagtttggctgggtgcagtggctcatgcctgttatcccaggacttggggaggccaaggcaggcagatcacttaaggtcaggaattcaaca

SEQ ID NO: 14686 - DNA, 422 bp, Homo sapiens
  chr9.fa.O7frz.10111923
  Located on chromosome 9
  Distance between a terminus base of telomere on chromosomal short arm and 5'-terminus of this base sequence : 5815745
  Distance between 3'-terminus of neighbour sequence of sequence listing upward to telomere on chrosomal short arm and 5'-terminus of this base sequence : 191693
gtattgcctggtatttaatcatacagactctgaagctcaattgtgttaactcaaacatagcctaattatttactggctctgagacctcagccatattaccttttgtaaaacctcagtatactcatctttaaaatgagagtgataataggtcttgtgtcctaagtttctcattaggaatataggaattaatgtttgtaaagcaattagaagagtgttgggcatattttttaagtactgtataaatattagctttcatcactggttttccttccttccttctttctttccttccttcctctcccccagtgtgcgcacgcacacacacacacacacacacacacacacacacacacacacacaagagctaaggtttcttctcaatgatattaagaagttaaattacaagacctttaagctacaaa

SEQ ID NO: 14687 - DNA, 433 bp, Homo sapiens
  chr9.fa.O7frz.10240318
  Located on chromosome 9
  Distance between a terminus base of telomere on chromosomal short arm and 5'-terminus of this base sequence : 5956813
  Distance between 3'-terminus of neighbour sequence of sequence listing upward to telomere on chrosomal short arm and 5'-terminus of this base sequence : 140646
taggttgatagctcgtaaacacaaacaatactgccaaaaaaccatatatatatatatatatgtgtgtgtgtgtgtgtgtgtgtgtgtatatatgtgtgtgtgtgtatatatatatatgtgtgtatatgtatatatatatctgttatgttttcccaataatcaatatttaatatctaaggcaaatttattttttctcctggaaattacaacaaaatctgcctcatttgttttcataacattttgcattctttggcttctggagttagtccagagacaaactcttcactctgttgccttcacacaaaatagctggttaagttttatttgtaaatctcagtagattcctaacacactcagagaagaaaaagcaaactcagaataatttaccaaatatgaatgtagaaacgtgtaagcatgacgaattaatgataac

SEQ ID NO: 14688 - DNA, 276 bp, Homo sapiens
  AL354722.8_55558
  Located on chromosome 9
  Distance between a terminus base of telomere on chromosomal short arm and 5'-terminus of this base sequence : 6023506
  Distance between 3'-terminus of neighbour sequence of sequence listing upward to telomere on chrosomal short arm and 5'-terminus of this base sequence : 66260
gaaggaaacgactttctagataagcaataaatgatcatcagggcttaattttgcagaatattttgtgcaaaaattgaatgagaacacacatatgaagatgctacaagagtattctattgtacaactgggtaagcttagttttatgaattctaaagataggccccttatacacacacacacacacacacacacacacacacacacaagcatgatatatatatataaagctaaatatagtctgtatcatttatctgtaacataatgacatatacctgg

SEQ ID NO: 14689 - DNA, 416 bp, Homo sapiens
  chr9.fa.O7frz.10341738
  Located on chromosome 9
  Distance between a terminus base of telomere on chromosomal short arm and 5'-terminus of this base sequence : 6055399
  Distance between 3'-terminus of neighbour sequence of sequence listing upward to telomere on chrosomal short arm and 5'-terminus of this base sequence : 31617
aaatctttccaaattgaatgtctaaaatccaagaaaaaatgatgggcaaaaatactggtgaatatttgagtacatctaagtaaatacatacatacatacacacacacacacacacacacacacacacacacacagacacacagtcaaataactgtatcctttaaaatacatcactgagctagcaagacaaaaaagtccacagaggtcaaagaataaaaaagcaaaaattgtagaagttgttcagtaaatgccaaagtcagcattaccctctctaaatgaaatcttgatatccttgagcatctgtttatataaggtgcaatacacagaaggaaaagcccaagttttaccccatgtatggagaacactagaagacatcatgtaaatctgagaacctaaggaacagcaactcagtataa

SEQ ID NO: 14690 - DNA, 362 bp, Homo sapiens
  chr9.fa.O7frz.10535077
  Located on chromosome 9
  Distance between a terminus base of telomere on chromosomal short arm and 5'-terminus of this base sequence : 6249782
  Distance between 3'-terminus of neighbour sequence of sequence listing upward to telomere on chrosomal short arm and 5'-terminus of this base sequence : 193967
ggtgagttacttaagtcactgagtttcagttttgtcacctgtaaaatggagacaataatgcctatttctcagagttgctctagagacaaaatgatacagtattttgaggagagctcattcatattaaactcccaatttttttgtttgtttgggaagactaatataagtgttgatttgctttgtttttttcattataattatcaggtttccctacatatatgtatatatatatatatatatatattttctatttgcttctatttgaaatatcaagtgaacaaaacattttttaataacttctcagcattctagcttgagattttaagctgtaatctatcccagaatttctgatgtcttcaatg

SEQ ID NO: 14691 - DNA, 311 bp, Homo sapiens
  chr9.fa.O7frz.10636026
  Located on chromosome 9
  Distance between a terminus base of telomere on chromosomal short arm and 5'-terminus of this base sequence : 6365045
  Distance between 3'-terminus of neighbour sequence of sequence listing upward to telomere on chrosomal short arm and 5'-terminus of this base sequence : 114901
ctttattgcttctcaggacttcggacttatatgtacagcctcctgattgtctgtctggactttgagagatctcttcttccccatcatctttactcagctatcatacacacacacacacacacacacacacacacacacacacacacatatagatatatatattccagcactgttcatacgtgtactcaaaactcagcagtttacaaataatctgatgaggaaataggcaaactacatgaagatttcactgaagaagatagacagatggtgagtaaccacatgaaaagacgttcaacatcaatagccattag

SEQ ID NO: 14692 - DNA, 219 bp, Homo sapiens
  Z66919
  Located on chromosome 9
  Distance between a terminus base of telomere on chromosomal short arm and 5'-terminus of this base sequence : 6494183
  Distance between 3'-terminus of neighbour sequence of sequence listing upward to telomere on chrosomal short arm and 5'-terminus of this base sequence : 128827
gagggtcacagcaggatagaggtcctctcttcctgattctgttgtgcttgtctcagcaagttcctgctgagtgtgtgtgtgtgtgtgtgtgtgtatgtgtgtgtgtgtgtctgtgtgtggtctctgcaggggcaggtttctgaagggtgcacgggttctccagtggccactgccagcagtacatggtacttccctgtaggcactttcctgaagaacggc

SEQ ID NO: 14693 - DNA, 331 bp, Homo sapiens
  chr9.fa.O7frz.10867174
  Located on chromosome 9
  Distance between a terminus base of telomere on chromosomal short arm and 5'-terminus of this base sequence : 6596217
  Distance between 3'-terminus of neighbour sequence of sequence listing upward to telomere on chrosomal short arm and 5'-terminus of this base sequence : 101815
aagatgaatagaacttccacaagtcattgtcaaaaaccagacaattccaataacaaatgtgcgagggacttcaacagcaccacacacacacacacacacacacacacacacacacacgagttccaaatggccattaacataaagaaaaggtggtatacacattcagtagagtaataatcagcaataaaaaggagtgaagtactgacacaatgctacaacataacgaacctcaaaaacattacgctaaatgaaaggagtcagtcattatatgaaatgcccaatataggcaaacccatgagagttagaaagtagattcgtgattgtctagacc

SEQ ID NO: 14694 - DNA, 174 bp, Homo sapiens
  HUMUT7622
  Located on chromosome 9
  Distance between a terminus base of telomere on chromosomal short arm and 5'-terminus of this base sequence : 6620773
  Distance between 3'-terminus of neighbour sequence of sequence listing upward to telomere on chrosomal short arm and 5'-terminus of this base sequence : 24225
aaagtagccatccgtgtgtccagggaaatgagatagatgatagaaagattagatagatagatagatagatagatagatagatagatagacagatagatagggaaattctttcttatttcagtatgccaagaaatatagataaaatgatggtgtctgtaaatcatcaaagaaagc

SEQ ID NO: 14695 - DNA, 386 bp, Homo sapiens
  AL133479.11_14495
  Located on chromosome 9
  Distance between a terminus base of telomere on chromosomal short arm and 5'-terminus of this base sequence : 6723231
  Distance between 3'-terminus of neighbour sequence of sequence listing upward to telomere on chrosomal short arm and 5'-terminus of this base sequence : 102284
caactagaatttgatgttgagttctaggcacaatgttttgagaatgactttttcaaaccataggacaactagaaaggtaaagaagctgggaaatacaccaaaaataaataaataaataaataaataaataaataataataaaggagatgaaggaagagggcatatttagcttgaaagagatacatagaataaaaacagcagctgtctttaataatttgaataatggtcatttagaaaatagtaaaacaaatccaaacaaaataaaatagactaaccagggcattaaagttacaacaaacgtagagttccacttaagaaacacctcctaagtaatagtactgctgagcagtgaaatttactaccttgtcagaaactaaagttccata

SEQ ID NO: 14696 - DNA, 265 bp, Homo sapiens
  AL133479.11_22054
  Located on chromosome 9
  Distance between a terminus base of telomere on chromosomal short arm and 5'-terminus of this base sequence : 6730727
  Distance between 3'-terminus of neighbour sequence of sequence listing upward to telomere on chrosomal short arm and 5'-terminus of this base sequence : 7110
gacatggcatttacgtattgtaccagttataatttcccattaatatttaatattccataatatcatcatacttgttttaattttttaataactcacagtcttttactcattttcaagggttcagtattgaaatttgattccttaaataatactgttttatatatacacacacacacacacacacacacacacacacacacattgatatatatatatataaaactctcctggccacctaaaactttagaatcaattcgttacgaat

SEQ ID NO: 14697 - DNA, 290 bp, Homo sapiens
  AL133479.11_51706
  Located on chromosome 9
  Distance between a terminus base of telomere on chromosomal short arm and 5'-terminus of this base sequence : 6760462
  Distance between 3'-terminus of neighbour sequence of sequence listing upward to telomere on chrosomal short arm and 5'-terminus of this base sequence : 29470
tttggaatagtttcagtaggaaactcttctattatgtttttccaaaaaacaactcatggattttttgctcttttgaatgtttgtgtgtgtgtgtgtgtgtgtgtgtgtgtgtgtgtgtgtgtgtgtgcctgtctcctttggttcagctctaattttggttatttcttgtcttctgccagctttggcattggtttactcttggttctctagctcttttagttgtgatgttaggttgttaatttgagattgttctaactttttaatgtgaggatttagtgctctaaatttcc

SEQ ID NO: 14698 - DNA, 314 bp, Homo sapiens
  AL133479.11_106424
  Located on chromosome 9
  Distance between a terminus base of telomere on chromosomal short arm and 5'-terminus of this base sequence : 6815028
  Distance between 3'-terminus of neighbour sequence of sequence listing upward to telomere on chrosomal short arm and 5'-terminus of this base sequence : 54276
gtcctcaataaagtgactcatgtcatgatatgaggatatttagaaactctcaatgttaacatgtaatctgtatatatacatatatatacacacatatgtttatatatgtatatgtttatatatatttccatatacataatacaagaagttgtttgattttatatatataaaatgcttatatatatttaaaatgtttatatataatgtttatatatataaaatcaaaaaacttcatatatatatatatatatatatatatgtatgtatgtatgtatgtataatcaaaccacttcttactctgcttgaacagctgt

SEQ ID NO: 14699 - DNA, 167 bp, Homo sapiens
  AL133479.11_127617
  Located on chromosome 9
  Distance between a terminus base of telomere on chromosomal short arm and 5'-terminus of this base sequence : 6836350
  Distance between 3'-terminus of neighbour sequence of sequence listing upward to telomere on chrosomal short arm and 5'-terminus of this base sequence : 21008
agtgacattctcttggtagtgaattatcttgcactctcccaagactgtattagttctcttgggaatgaattagagagagagagagagagagagagagagagagagtgtgtgtgtgtgtgtgtgtgtgtgtgtgtgtgtgtgtgaggtgcactctggctgttataaag

SEQ ID NO: 14700 - DNA, 309 bp, Homo sapiens
  chr9.fa.O7frz.11328744
  Located on chromosome 9
  Distance between a terminus base of telomere on chromosomal short arm and 5'-terminus of this base sequence : 7014619
  Distance between 3'-terminus of neighbour sequence of sequence listing upward to telomere on chrosomal short arm and 5'-terminus of this base sequence : 178102
tcagctctgatagttcaaataaacttcatcttcttttctaaagactttcattaaacaaatgtgctaataaccaggtaattaactggacatattttgtgtatatatatatatatatacacacacacacacaatatataatatatataatatatatataaaacataaatttatgatatattttacatattcctctctctgcatctctatcttaagtcttcaacccaaacaatcctcaaagggcagaggtttcataatatgactctcagcagtaagctaggacatctgctgatagtttgcctttgataatta

SEQ ID NO: 14701 - DNA, 190 bp, Homo sapiens
  D9S921
  Located on chromosome 9
  Distance between a terminus base of telomere on chromosomal short arm and 5'-terminus of this base sequence : 7113897
  Distance between 3'-terminus of neighbour sequence of sequence listing upward to telomere on chrosomal short arm and 5'-terminus of this base sequence : 98969
tctttcatgttggctcctgtgcccttttgattgatccatctatctatctatctatctatctatctatctaatgatcattatagctgacttacctataataaatatatttacatttaataaatattatatatatatatatatatatattttactcacttacttactttctggcatcacaagattctccagg

SEQ ID NO: 14702 - DNA, 229 bp, Homo sapiens
  D9S168
  Located on chromosome 9
  Distance between a terminus base of telomere on chromosomal short arm and 5'-terminus of this base sequence : 7192718
  Distance between 3'-terminus of neighbour sequence of sequence listing upward to telomere on chrosomal short arm and 5'-terminus of this base sequence : 78631
ggtttgtggtctttgtaaggtagtgcaaagtacatgagtaaaatgatgcttatgacaggaacaaatattctgcaagtacaaattttccacttagtaactatcttacaaactctgttcagtaagtattcaaacagtcaatgtgggaccatgaaggtgtcattttggcttattgtacacacacacacacacacacacacacactcacaatgatagttatacaaacaaacca

SEQ ID NO: 14703 - DNA, 315 bp, Homo sapiens
  AL161788.13_46735
  Located on chromosome 9
  Distance between a terminus base of telomere on chromosomal short arm and 5'-terminus of this base sequence : 7381210
  Distance between 3'-terminus of neighbour sequence of sequence listing upward to telomere on chrosomal short arm and 5'-terminus of this base sequence : 188263
tggcatctctgtaattctagtaacagggcatcacctatcccccttcacaaacacctccctcctctaaaacttctgagacctttgcttcatacaacataggtttcttttatttatttatttatttatttttgcagttcttttttgccttaggccaaggtgatgacatcatgatctcctaggttggtctcaagccatgctggatgagggatgggtattttttgcttgaattttaccactcttctcattttgcctgtgggctccttgcctatgctgattgcagtttatggaaggcaggtacagtcaaggttggaagtg

SEQ ID NO: 14704 - DNA, 392 bp, Homo sapiens
  AL161788.13_85046
  Located on chromosome 9
  Distance between a terminus base of telomere on chromosomal short arm and 5'-terminus of this base sequence : 7419536
  Distance between 3'-terminus of neighbour sequence of sequence listing upward to telomere on chrosomal short arm and 5'-terminus of this base sequence : 38011
aaatgctcaacatcactaatagagaaatgcaaattaaaaccacaatgagatatcatctcataccattcagaatgcctattattaaaaagttatatatatatatatatatatatatatatatatatatatatatatatatagcagatgctggcaaggctgtggagaaaagaaacacttatacactgttggtgggaatgtaaatttgttcagccatggcagcaagcaacttagagatttctcaaagaacttaaaacagaactattacttgacccagccatcccattattgggtctatatccaaaggaaaataaatcattctaccaaaaaggcacatgcactcctatgttcattgcagcactattcacaatattaaagacatggaatcaacctac

SEQ ID NO: 14705 - DNA, 206 bp, Homo sapiens
  Z67570
  Located on chromosome 9
  Distance between a terminus base of telomere on chromosomal short arm and 5'-terminus of this base sequence : 7498259
  Distance between 3'-terminus of neighbour sequence of sequence listing upward to telomere on chrosomal short arm and 5'-terminus of this base sequence : 78331
ttcagtaatggcttaagaaaatgtgtgtgtgtgtgtgtgtgtgtgtgtgtgagaagtgttgtatatattgatttgacacattttaggaactcaatcaatagtacatatgtaactatgatttctgtttcctcagataacagctgagaaagacttttatatactataatgtttaactgctttgtatgaagtccagaggttagtaccct

SEQ ID NO: 14706 - DNA, 369 bp, Homo sapiens
  AL162413.6_103454
  Located on chromosome 9
  Distance between a terminus base of telomere on chromosomal short arm and 5'-terminus of this base sequence : 7548007
  Distance between 3'-terminus of neighbour sequence of sequence listing upward to telomere on chrosomal short arm and 5'-terminus of this base sequence : 49542
gctgtattgaatagcagtaacatcttgtcaagtttaaaatatgagtagagtaaaaatatatgaaaacagtgatacaacatgtgaaaggagataaaagaaatagcgttctaagcttcttatgtcatcccaaaattggtaaaggtcatattttatgtcggtgtcaaataaaaaagaaatgaaacttatagtctgttgggtaaccaataagcatggaactgtatacacacacacacacacacacacacacacacatatacatacatatataaacagacacacacacacctctaataagaaaaccaagaatgattctttttgaaaaatcacttatggagagagaaaaaggacatagaataggcaagacaagta

SEQ ID NO: 14707 - DNA, 162 bp, Homo sapiens
  D9S256
  Located on chromosome 9
  Distance between a terminus base of telomere on chromosomal short arm and 5'-terminus of this base sequence : 7610914
  Distance between 3'-terminus of neighbour sequence of sequence listing upward to telomere on chrosomal short arm and 5'-terminus of this base sequence : 62538
cacacattgtgaaatggtaaccataatccaactaacacatcctttactacagttaccattgtgtggtgtgtgtatgtctgtgtgtgtgtgtgtgtgtgtgtgtgtgtgtgatgaaaacacgtaagatctactcttttaccaaatttcaagtaaacagtatgg

SEQ ID NO: 14708 - DNA, 169 bp, Homo sapiens
  D9S269
  Located on chromosome 9
  Distance between a terminus base of telomere on chromosomal short arm and 5'-terminus of this base sequence : 7645900
  Distance between 3'-terminus of neighbour sequence of sequence listing upward to telomere on chrosomal short arm and 5'-terminus of this base sequence : 34824
ttccagaaatagcccgcagaaaaaacgaaactataatctcaaaggatgcaaacacacacacacacacacacacacacacacactcacactccctgcacacaaaaatcaacaacctggaattgattttcattggccagatttagtcacattcttatctttggagttacag

SEQ ID NO: 14709 - DNA, 354 bp, Homo sapiens
  AL354952.6_140845
  Located on chromosome 9
  Distance between a terminus base of telomere on chromosomal short arm and 5'-terminus of this base sequence : 7714937
  Distance between 3'-terminus of neighbour sequence of sequence listing upward to telomere on chrosomal short arm and 5'-terminus of this base sequence : 68868
ttgcaagcctcaaagtaacctcaagccaaaaaaacatgcaataaatacagaaaaaataaaaagcaagaaactaaatcatatcacccagagaaaaccaacttcactagaggaaaacaggaagggagggagggagggaaggaaggaaggaaggaaggaaggaaggaaggaaggaaggaaggaaggaaagaaggaaggaagtactataaaacaaccagaaaacaaataacaaaatggaaagagaaagtcctgacttatcaataaaaacattaaatgtaaatagactaaactctccaatcaaaagacatagactggctgaatggatgcaaaaacaagtctcattgatctgttgcttac

SEQ ID NO: 14710 - DNA, 268 bp, Homo sapiens
  chr9.fa.O7frz.12339339
  Located on chromosome 9
  Distance between a terminus base of telomere on chromosomal short arm and 5'-terminus of this base sequence : 7805820
  Distance between 3'-terminus of neighbour sequence of sequence listing upward to telomere on chrosomal short arm and 5'-terminus of this base sequence : 90529
ataatgcttcaaatgttcttaagagtatggataaatgcatttaaaagtgtcttagaaagccacatcaaccaataaatatagtcaactcaagtgaagggtcctaggtttgagcaaggtcaaagctgaatttctaattgctattgtattttaattttaggtatgtatgtatgtatgtatgtatgtatgtatgtatgtatgtatttagagacagggtctcactatgttgcctaggctagagtgaagttgctatttactggcacgattgtag

SEQ ID NO: 14711 - DNA, 347 bp, Homo sapiens
  chr9.fa.O7frz.12481226
  Located on chromosome 9
  Distance between a terminus base of telomere on chromosomal short arm and 5'-terminus of this base sequence : 7948159
  Distance between 3'-terminus of neighbour sequence of sequence listing upward to telomere on chrosomal short arm and 5'-terminus of this base sequence : 142071
ttgaattaggtgattatgattgaccatccagctagatcttggtgttgctattggtaaaaaaaaacaaaaagtctactagattttatttgcatagatattcatctgtatcttttagtgggcaccataagatagatagatagatagatagatagatagatagatagatagatgatagatagatagatagaatatataatctatgtatctatagatacaatatataatctatctatctatctatatatatataatataatctcaagaaaatacattttaaagacaacattaagcattttaccctataggtctacactaatgctggcttaccttgaaactttgtattagga

SEQ ID NO: 14712 - DNA, 417 bp, Homo sapiens
  chr9.fa.O7frz.12575866
  Located on chromosome 9
  Distance between a terminus base of telomere on chromosomal short arm and 5'-terminus of this base sequence : 7982461
  Distance between 3'-terminus of neighbour sequence of sequence listing upward to telomere on chrosomal short arm and 5'-terminus of this base sequence : 33955
atggactccatagactattcctactctctctcaaaaataccggtcctgacatgcatatgttcatgcatgatcaaatacacacacacacacacacacacacacacacatacatacacacacacacacacacagaacaagggcaggtagaaactaattgaaaacagatgaattggaattcttttgtttttgaaagtatggttatataaaatttgcacaagaaatgtactaggacacaaatctgaaaatcaagtaaagttgaagggttcattcaatggtaatctcgttccattcagaattagagagacagaaagaaacaaattgcctgcttcagtggttgtcttatgctccagacagcctgcttaataagttagtttttttctctatggaaagtagatctatagatcttgtccgaagctt

SEQ ID NO: 14713 - DNA, 337 bp, Homo sapiens
  HUMUT873B
  Located on chromosome 9
  Distance between a terminus base of telomere on chromosomal short arm and 5'-terminus of this base sequence : 8166768
  Distance between 3'-terminus of neighbour sequence of sequence listing upward to telomere on chrosomal short arm and 5'-terminus of this base sequence : 183890
tgaggattccagcaatgcttatttgaaaatccaaacatcttttttaacttgataaaggttttctttcttttctttctttgtttctttctttgtttctttgtttctttgtctgtttgttcgtttctttctttctttctttctttctttctttctttctttctttctttctttccttccttccttccttccttcctccttccttcctttctcccttccttccttctttccttccttccttccttccttccctcccttctcccttctttccttccttctttccttctttcttcctttattttattttattttttttttgagacagagtcttgctctgcca

SEQ ID NO: 14714 - DNA, 318 bp, Homo sapiens
  chr9.fa.O7frz.12854281
  Located on chromosome 9
  Distance between a terminus base of telomere on chromosomal short arm and 5'-terminus of this base sequence : 8275005
  Distance between 3'-terminus of neighbour sequence of sequence listing upward to telomere on chrosomal short arm and 5'-terminus of this base sequence : 107900
attgatggacttaggttgactcagtatcttggctatgatgaataatattgcaatagaaatagaagggcagataagctctatgatacatcaatttcattatatatatatatatatatatatatataaagaatagtgagactgttgaattatatggtaattctatttttaattttttgaggaatcttcatactgttttcagtaatcgccatactaatttacattttcaccaacagtaagtacccaagttatatttcatttttgtccaaatcctcatcacatgttatctttttttctctttggtaatagccattctaacta

SEQ ID NO: 14715 - DNA, 454 bp, Homo sapiens
  chr9.fa.O7frz.12980845
  Located on chromosome 9
  Distance between a terminus base of telomere on chromosomal short arm and 5'-terminus of this base sequence : 8424528
  Distance between 3'-terminus of neighbour sequence of sequence listing upward to telomere on chrosomal short arm and 5'-terminus of this base sequence : 149205
catggtttcataaggttagataaatctgaaaagccagatccatatggaagtaggagaatcgcttgaactcgggaagcggaggttgcagtgagcccagttagtgccgttgcactctagcctgggtgacagagtgagactccgtctcaaaataaataaaatctctgtgagaaaatgtgtgtgtgtgtgtgtgtctgtgtgtgcgtgtgtgtgtgtgtgtgtgtgtgtgtaatttcctaacatttctgggcaccaatgatctctttaatatctacggttctctttttatatagctacaatacacaatgttagagtatattaaacaaaattaggctaagtatctccaaaagagttactactggaagtgaaataaaaaatgaaacaatttttgtttatattaggttttttatataaaaatcccagttgacattgaatcctgtataccaagattcataga

SEQ ID NO: 14716 - DNA, 198 bp, Homo sapiens
  chr9.fa.O7frz.13147512
  Located on chromosome 9
  Distance between a terminus base of telomere on chromosomal short arm and 5'-terminus of this base sequence : 8543035
  Distance between 3'-terminus of neighbour sequence of sequence listing upward to telomere on chrosomal short arm and 5'-terminus of this base sequence : 118053
catttatgtcaagaaatctggaaagtttttgaagtgtccgtattgtagaatttcaaaaactgtctatatctatctgtctatctatctatcatctatctatctatctatctatctatctatctatctatctatctatctatttatctatctatacatttatccatacaaacacctattcattcaactatccaaacagtc

SEQ ID NO: 14717 - DNA, 393 bp, Homo sapiens
  chr9.fa.O7frz.13306542
  Located on chromosome 9
  Distance between a terminus base of telomere on chromosomal short arm and 5'-terminus of this base sequence : 8721985
  Distance between 3'-terminus of neighbour sequence of sequence listing upward to telomere on chrosomal short arm and 5'-terminus of this base sequence : 178752
agaaagttctaagaacctcttgactaagtatcatgaatatataacagcaatacctagtgataggaacagttattaatgggaatacaacactatgaagaggtgaaaagcaaaataaatatgactttaacagaatagaattttgggtggggtgtgtgtcaaaaattattaaacttcctctctccaaatattactttgattccattctttctctctccctctctctctctctctctctctcacacacacacacacacatacacacacatgcacacacacacctctctgggactcaaaatctcagtatattagaaatttcaaacttgtcccaatgtgtctgatactcttttctcttttttctcttttgttttactctccatgattcaaactacatgt

SEQ ID NO: 14718 - DNA, 425 bp, Homo sapiens
  AC016685.5_98080
  Located on chromosome 9
  Distance between a terminus base of telomere on chromosomal short arm and 5'-terminus of this base sequence : 8734679
  Distance between 3'-terminus of neighbour sequence of sequence listing upward to telomere on chrosomal short arm and 5'-terminus of this base sequence : 12301
ttcctaggtttccgtctagtacttttataatttcaggtcctacaattgtctttaatccattttgagttaacttttgtatatgatgagaaatatggtctagtttggctcttctgcatgtggctaaccagttttcctagcaccatttattgaataaagtatccttccccagtatgtatatctatatgtatgtgttgttgttgttgttgttgacactgtcaaagatcaagtggttgtagatatgtaaatgtattcctgagttttctattttgttccattgttctatatgcctattttaataccactatcatgatgttttggttaatatacgcttgtagtataatttaaagtcaagtaatgtgatacctccagctttattttatgtagttattattatttttgttttgttagaaatgctgtggctatta

SEQ ID NO: 14719 - DNA, 348 bp, Homo sapiens
  AC016685.5_164243
  Located on chromosome 9
  Distance between a terminus base of telomere on chromosomal short arm and 5'-terminus of this base sequence : 8765503
  Distance between 3'-terminus of neighbour sequence of sequence listing upward to telomere on chrosomal short arm and 5'-terminus of this base sequence : 30399
aaagagtcagcatccttaagataacttgggagcatgattgcctgtatatactactaaacagctgttaataattattaagtattttacattaccttatttaagaatttgcacatacaaagcatttttacatatactttctcactaaattctttattattattattattattattattgttattattattttaagtgcaggatatgcaggtttgttacataggtaaatgtgtgccatggtttaaattctttaatgctttaaattcttaagcagtaaagctaaacaaatattcagacttgtttcatagataaagaatttagatatatgtgttaagtgaattgaccaacatc

SEQ ID NO: 14720 - DNA, 193 bp, Homo sapiens
  chr9.fa.O7frz.13537363
  Located on chromosome 9
  Distance between a terminus base of telomere on chromosomal short arm and 5'-terminus of this base sequence : 8855883
  Distance between 3'-terminus of neighbour sequence of sequence listing upward to telomere on chrosomal short arm and 5'-terminus of this base sequence : 90032
tcgtactttccaaataagaattacctgatcttattacctgtacatctttatggttataacagtagtctttgtctagaacgatattatttgtgtgtgtgtgtgtgtgtgtgtgtgtgtgtgtgtgtgtgtgtgtgtgaatgtttccagatctatctaatcaactactatagtaagacagaatgtaattctgcat

SEQ ID NO: 14721 - DNA, 405 bp, Homo sapiens
  chr9.fa.O7frz.13654863
  Located on chromosome 9
  Distance between a terminus base of telomere on chromosomal short arm and 5'-terminus of this base sequence : 8986377
  Distance between 3'-terminus of neighbour sequence of sequence listing upward to telomere on chrosomal short arm and 5'-terminus of this base sequence : 130301
ctccaaatcaaacagagatttattttttcaattcctatgtttttccaattaaaacatttggtagcttaaaatgggaatttattttatctctcatggttctgtggaatgactggatttagctgcacaattctcatttggggtctttctatgggttggattcatctgaaggcttgaaatccaagatggcttcttccttcatatggctggtatccaggttgaattactggaactggggtctggccaggcatacatttctctctctctctctctctctctctctctctctctctcccccccgacccccaacttcttctatattgcatcttccatatcgaatcttcacactcttagtttgggcaccttcacagcatggtagtttatgagtcaacagacatcttgcactat

SEQ ID NO: 14722 - DNA, 405 bp, Homo sapiens
  chr9.fa.O7frz.13749011
  Located on chromosome 9
  Distance between a terminus base of telomere on chromosomal short arm and 5'-terminus of this base sequence : 9080696
  Distance between 3'-terminus of neighbour sequence of sequence listing upward to telomere on chrosomal short arm and 5'-terminus of this base sequence : 93914
ctcgtcatactgagtgaattctcatgagatctgatagtttaaacgtgtggcactaaccctttgctcgctcactctctctctctctctctctctcctgccaccatgtaagaggtgtcttacttccccttcaccatctgtcatgattttaagtttcctgaggcctcctcagccatgtgtaattatgagtgaattaaatttcttctctttataaatgacccagtctcaggtagttcttacagcagtgtgaaaatggatgaatacactggacacaccaatttctaggtttgtgacattggccttgtttgcatcttagtttattaataaataaataagaggtataataatagtatcttctctacagggtttcgagagaattaaataacatgtcatgtaagattcttggag

SEQ ID NO: 14723 - DNA, 267 bp, Homo sapiens
  AL138753.8_13349
  Located on chromosome 9
  Distance between a terminus base of telomere on chromosomal short arm and 5'-terminus of this base sequence : 9239665
  Distance between 3'-terminus of neighbour sequence of sequence listing upward to telomere on chrosomal short arm and 5'-terminus of this base sequence : 158564
agttagacagaactgatatggcacagatgtacaccagtgcagaaaaaaataattagttggataaataaatatatgtttgtgtagtgctatgtgtgtgtgtgtgtgtgtgtgtgtgtgtgtgtatacacacagatatctgtatgtgtgtacatatacagatatctttaaatgtaacaacaataatgtcatttattgtaaacctgatagagcagtagagtgatgatgttgaagagcttgccacctctacagtttagtctggaagcagtc

SEQ ID NO: 14724 - DNA, 312 bp, Homo sapiens
  AL138753.8_17722
  Located on chromosome 9
  Distance between a terminus base of telomere on chromosomal short arm and 5'-terminus of this base sequence : 9244008
  Distance between 3'-terminus of neighbour sequence of sequence listing upward to telomere on chrosomal short arm and 5'-terminus of this base sequence : 4076
gtaacctgaacatatcaaatccactttcccctaagttactactttggaaagatatttcccagactattattttctgaaagataattcctaaagctgtcattcttaccttggttttcctttctctctctctctctctctctctctctctgtttctatctctctcattgctaatggtacttggaagttagttaaaattctcagggaatagaaacaattattaaataactttagatacctgatatgcctgacatgaccaaatatgccctaaatttatactttctgggctcagatcgaagttcagatctaagttca

SEQ ID NO: 14725 - DNA, 287 bp, Homo sapiens
  AL138753.8_20170
  Located on chromosome 9
  Distance between a terminus base of telomere on chromosomal short arm and 5'-terminus of this base sequence : 9246394
  Distance between 3'-terminus of neighbour sequence of sequence listing upward to telomere on chrosomal short arm and 5'-terminus of this base sequence : 2074
ctgattaatggcagataccaacctatggaccacatagtacaaactcatgaagagtaattgttttctcatgttatttcatctaattttagtgtgtgttaagggtgccttcggagaggacttcacacccctacccctcgccattgtgtatagacatttgaaaattccttaactacattatctctgtgtgtgtgtgtgtgtgtgtgtgtctcccctcctctctttctctctgaaatcaagtacagatttacccagccaataagattgtatgtttcatgaaactgttagca

SEQ ID NO: 14726 - DNA, 382 bp, Homo sapiens
  AL138753.8_54841
  Located on chromosome 9
  Distance between a terminus base of telomere on chromosomal short arm and 5'-terminus of this base sequence : 9281037
  Distance between 3'-terminus of neighbour sequence of sequence listing upward to telomere on chrosomal short arm and 5'-terminus of this base sequence : 34356
acaagcttaggctttaggttagttgaaaaatatgctatagaagaatgatgctggaattcccatattattctttgctgggaagaacacatttgaagaatgggatacacttctgggtacttcaatttcaatacaacattaaccagtgggagaatgttggatgaatatcaacagaataggaatatatctggaaatggaatgatttaaaagcagtgtgtgtgtgtgtgtgtgtgtgtgtgtgtgtgtgtgtacacatatacatatgtttgtatatgtattaattacaaaattaccatggagaagaaaaattagagtaactggattgggaaaggtgacagccacagtgttgtcacagttggggctgttcttatcatttgtgatgcta

SEQ ID NO: 14727 - DNA, 309 bp, Homo sapiens
  AF001295.1_1149
  Located on chromosome 9
  Distance between a terminus base of telomere on chromosomal short arm and 5'-terminus of this base sequence : 9293044
  Distance between 3'-terminus of neighbour sequence of sequence listing upward to telomere on chrosomal short arm and 5'-terminus of this base sequence : 11625
agtattgaccaaatgtcagttgtctcttcagacttcctatggtttaaaaataaatgaaaagaaaaaagctctgttttcttacctaaatttgagttatattaccaaaggccccttaggtaatggggcctttatacgttccagagtaagtagcatatggtgtgtgcatgcatgtttctctctctctctctctctctcattctgtgtgtgtgtgtgtgtgtgtgtgtgtgtgtgtgtgtgtgtcagtggagagagagagagacgaagaaaagggaggagtgataatccttctaaacgtatacaagttgcttg

SEQ ID NO: 14728 - DNA, 366 bp, Homo sapiens
  AL138753.8_110733
  Located on chromosome 9
  Distance between a terminus base of telomere on chromosomal short arm and 5'-terminus of this base sequence : 9336956
  Distance between 3'-terminus of neighbour sequence of sequence listing upward to telomere on chrosomal short arm and 5'-terminus of this base sequence : 43603
gcaccaatgtaggtttattgattgtaatacatgtacagtctgcagtggggaatgtcagtagtagggaagtttgtgcatgtgtgaggacagggagtatatggaagctctctacttttctctaaatgttgctgtaaacctaaaactgctctaagaaataaagcatatatatatatatatatatatgtgtgtgtgtgtgtgtgtgtgtgtgtgtgtgtgtgcgcgcgcgcgtgtgtgtgtgtgtgtatatatatatacacacatatatatgagggttttttttgaaaaaggagtttatgtgctttagaaaaagattaatcctacattgttgttcagaaataacggaaagtaaatgaaactcgcagaaag

SEQ ID NO: 14729 - DNA, 165 bp, Homo sapiens
  D9S267
  Located on chromosome 9
  Distance between a terminus base of telomere on chromosomal short arm and 5'-terminus of this base sequence : 9517811
  Distance between 3'-terminus of neighbour sequence of sequence listing upward to telomere on chrosomal short arm and 5'-terminus of this base sequence : 180489
gcaatgttttgggctctttctgtgtgtgtgtgtgtgtgtgtgtgtgtgtgtgtgtgtctgtgtactcaacaacttaaccaagtgttttatttccttatgccctgggtttttatacttttgctagagtttggcttttagtttgcttttggttgcctcaatcagtaa

SEQ ID NO: 14730 - DNA, 427 bp, Homo sapiens
  AL161449.7_8379
  Located on chromosome 9
  Distance between a terminus base of telomere on chromosomal short arm and 5'-terminus of this base sequence : 9572844
  Distance between 3'-terminus of neighbour sequence of sequence listing upward to telomere on chrosomal short arm and 5'-terminus of this base sequence : 54868
cgtattgccttgttatgctaagcctcaggagtcagagtcacaaaaaccaacatattttcaaagtgagaataaacaaccccgtctcctgatggaagcatggcaaagcatttgcaaacatattttaaagccaccacctaaatatgacatttaaacttttctatagataggatcttaatttaacaacaaaaggaagggaaacaaagaactaccaagacatctaagaaaataggaaatttgggatgtttagaaaactaaaaaggcttacacaatgtgtgtgtgtgtgtgtgtgtgtgtgcgcgcgcgtatgtgtatgaactgtcaactgaattaaccataaatttgggctgattattgtttattactacacagtttcatgaaagcacatattttagacagattttccttcttgtccagcaagtaaggatta

SEQ ID NO: 14731 - DNA, 363 bp, Homo sapiens
  AL161449.7_14995
  Located on chromosome 9
  Distance between a terminus base of telomere on chromosomal short arm and 5'-terminus of this base sequence : 9579482
  Distance between 3'-terminus of neighbour sequence of sequence listing upward to telomere on chrosomal short arm and 5'-terminus of this base sequence : 6211
tcagaattgaagtttactcttgaagaaatttaacattagaacaaaaagccaaatacctatgtctaaaaccagcccaaagaattagctgtttcatatatacgatatatatattacacacacatacatatgtacatgtatatgtttatttgtgtacgatagagatatatattctgtgtgtgtatatatatatgtgtgtataaatatataaagagtgagagagccagaaagagataggcaagagggagatacacacacacacacacacacacacacacacacacacatcactggttaattatatttgaagacaataaaaggaaaaaagtttatagtattttttctagtaatattgaggaccaagcc

SEQ ID NO: 14732 - DNA, 227 bp, Homo sapiens
  D9S1687
  Located on chromosome 9
  Distance between a terminus base of telomere on chromosomal short arm and 5'-terminus of this base sequence : 9579613
  Distance between 3'-terminus of neighbour sequence of sequence listing upward to telomere on chrosomal short arm and 5'-terminus of this base sequence : -232
catgtatatgtttatttgtgtacgatagagatatatattctgtgtgtgtatatatatatgtgtgtataaatatataaagagtgagagagccagaaagagataggcaagagggagatacacacacacacacacacacacacacacacacacacatcactggttaattatatttgaagacaataaaaggaaaaaagtttatagtattttttctagtaatattgaggacc

SEQ ID NO: 14733 - DNA, 217 bp, Homo sapiens
  G09657
  Located on chromosome 9
  Distance between a terminus base of telomere on chromosomal short arm and 5'-terminus of this base sequence : 9656187
  Distance between 3'-terminus of neighbour sequence of sequence listing upward to telomere on chrosomal short arm and 5'-terminus of this base sequence : 76347
tgtcctattagcttgctggctagacttattaaataaatctatctgtctatctatctatctatctttctatctatctatctatattttaatgagatttccatgatcatcttgttccttgctgatctagccattgacagctttccctggaatatatggaatatattatcacaaggagaaggcactcatcatatttagggaacgaatccatcaaacctca

SEQ ID NO: 14734 - DNA, 174 bp, Homo sapiens
  AL161449.7_96019
  Located on chromosome 9
  Distance between a terminus base of telomere on chromosomal short arm and 5'-terminus of this base sequence : 9660658
  Distance between 3'-terminus of neighbour sequence of sequence listing upward to telomere on chrosomal short arm and 5'-terminus of this base sequence : 4254
tgaggttcatactgatttggagagtaagtgaggcctaactttttaagacagcagtgggagccacatagaaccatattcgtgtgtgtgtatgtgtatgtgtgtgtgtgtgtgtgtgtgtgcgtgtgcgtgtgtatgttttgagtcacatctgtaggttacatcttcggatgtaaa

SEQ ID NO: 14735 - DNA, 248 bp, Homo sapiens
  D9S268
  Located on chromosome 9
  Distance between a terminus base of telomere on chromosomal short arm and 5'-terminus of this base sequence : 9660689
  Distance between 3'-terminus of neighbour sequence of sequence listing upward to telomere on chrosomal short arm and 5'-terminus of this base sequence : -143
ggcctaactttttaagacagcagtgggagccacatagaaccatattcgtgtgtgtgtatgtgtatgtgtgtgtgtgtgtgtgtgtgtgcgtgtgcgtgtgtatgttttgagtcacatctgtaggttacatcttcggatgtaaattaggaaaaaactttcctaatttttcccatctacttggtaactttgctacaaaatcctttcaatacttattaaaaataattaatggactcatgtatatcctggtg

SEQ ID NO: 14736 - DNA, 308 bp, Homo sapiens
  AL161449.7_106419
  Located on chromosome 9
  Distance between a terminus base of telomere on chromosomal short arm and 5'-terminus of this base sequence : 9671022
  Distance between 3'-terminus of neighbour sequence of sequence listing upward to telomere on chrosomal short arm and 5'-terminus of this base sequence : 10085
ttctgcttcactcaaagataactttatatatatgtatatatggtttatatattacataatttgcatcagttatcctgggtaataactgccggagagatgggagtatatatatatgtgtgtgtatagataggtagatagatagatagatagatagatagatagatagatagataatctttgagtgaagcaggtttatcctctactagttaattaaataaagttcatgcattggagacaagtattctaaggagaattttttttctgttttatactaaagttaaaagctttatggcatagatactttatgg

SEQ ID NO: 14737 - DNA, 262 bp, Homo sapiens
  HUMUT2420
  Located on chromosome 9
  Distance between a terminus base of telomere on chromosomal short arm and 5'-terminus of this base sequence : 9671094
  Distance between 3'-terminus of neighbour sequence of sequence listing upward to telomere on chrosomal short arm and 5'-terminus of this base sequence : -236
tcctgggtaataactgccggagagatgggagtatatatatatgtgtgtgtatagataggtagatagatagatagatagatagatagatagatagatagataatctttgagtgaagcaggtttatcctctactagttaattaaataaagttcatgcattggagacaagtattctaaggagaattttttttctgttttatactaaagttaaaagctttatggcatagatactttatggcacagggctgagcgtgtgtgtgagtg

SEQ ID NO: 14738 - DNA, 167 bp, Homo sapiens
  AL161449.7_143335
  Located on chromosome 9
  Distance between a terminus base of telomere on chromosomal short arm and 5'-terminus of this base sequence : 9708025
  Distance between 3'-terminus of neighbour sequence of sequence listing upward to telomere on chrosomal short arm and 5'-terminus of this base sequence : 36669
ttactgattggctacattaccttgctattcctgctgctaatatatgtgtgtgtgtgtgtgtgtgtgtgtgtgtgtgtgtgtgtgtgtgtgtgtgtatatatgaaatactttattactgttattatccttttggagtggtatgaagaataccagaaatctgtggtatt

SEQ ID NO: 14739 - DNA, 444 bp, Homo sapiens
  chr9.fa.O7frz.14479981
  Located on chromosome 9
  Distance between a terminus base of telomere on chromosomal short arm and 5'-terminus of this base sequence : 9808093
  Distance between 3'-terminus of neighbour sequence of sequence listing upward to telomere on chrosomal short arm and 5'-terminus of this base sequence : 99901
agatgcattaaagtcacttagaagtttgtgctttattttgtttaaaaaagattctgggactcctgattctaggtctatagtcacccccatgtatcctgccacacacacacacacacacacacacacacacacacacacacacacagagagagaaagagagagagagagggatttctcattagctaccttcaccaaagcaaaatagatggttctgcgccttggagacgactcccacacccatgcccacttaatatcacaagtatcatgctctaaacaattttaccctttcctacaattcctgatattcactttagcctaaataatttctttacttattagtgtaaaaatggcagaatgttattagtacaagtgaactctatagatctaacttctggaatatctctgcaaacataaatatccctttaaaattgtaaagctcattca

SEQ ID NO: 14740 - DNA, 274 bp, Homo sapiens
  AC025383.3_147804
  Located on chromosome 9
  Distance between a terminus base of telomere on chromosomal short arm and 5'-terminus of this base sequence : 9929648
  Distance between 3'-terminus of neighbour sequence of sequence listing upward to telomere on chrosomal short arm and 5'-terminus of this base sequence : 121111
ctttcataaggaagtgtttcataggaggctctgctacaaaactgcttgttagggaaggacagatgccaagggaagctgctgttggcactgtattgcagaagtattgtattgtattgtattgtattgtattgtattgtattgtattgtattgtatttattgtattgtattgtattgtatccaggagaagccacagaatcaggaagtaaaaccctttccttccagtgtctctccagcatcctccactgacaaagcttagcattgaatcagatggta

SEQ ID NO: 14741 - DNA, 251 bp, Homo sapiens
  D9S1808
  Located on chromosome 9
  Distance between a terminus base of telomere on chromosomal short arm and 5'-terminus of this base sequence : 10027464
  Distance between 3'-terminus of neighbour sequence of sequence listing upward to telomere on chrosomal short arm and 5'-terminus of this base sequence : 97542
ctctgtgtatgtacgtttgtgcatatgtaagttgtgtgtgtgtgtgtgtgtgtgtgaatatacaattggaaggaaatattggaacccacaatatcttaatagtgtgtgcttttgctctatgatgggagacagttgatttatgaatgatttggggaactatgctggcatagtagttatgctgtggagtgaatgactgactttgactctgaagtccatcacttattgtgttcccttacatacactttggcttc

SEQ ID NO: 14742 - DNA, 223 bp, Homo sapiens
  chr9.fa.O7frz.14793312
  Located on chromosome 9
  Distance between a terminus base of telomere on chromosomal short arm and 5'-terminus of this base sequence : 10125829
  Distance between 3'-terminus of neighbour sequence of sequence listing upward to telomere on chrosomal short arm and 5'-terminus of this base sequence : 98114
cataatctttggcttatgtgacaagggattccctgttaagaataatttaacaaatatgtcctttaaaagatcgcaataataatgatgggcattacacacacacacacacacacacacacacacacacacacagtgatcttcagagtacaggaaagagggcatctgatgcatttccaggcattatcctcaggtgaaaatggactagcaagagtaggaaggtagc

SEQ ID NO: 14743 - DNA, 349 bp, Homo sapiens
  chr9.fa.O7frz.14886313
  Located on chromosome 9
  Distance between a terminus base of telomere on chromosomal short arm and 5'-terminus of this base sequence : 10218661
  Distance between 3'-terminus of neighbour sequence of sequence listing upward to telomere on chrosomal short arm and 5'-terminus of this base sequence : 92609
ctgcttaacgtctaatctgtaaattgatctccaactgaacagaagtatggataccgcaatgctttatgttcaacattttttacatctgcctggactcaggggtcctattatttacttatgttatatctgatatcatgaggctggacaaaaagccagatctagaatagatctgtggtgacagggatgcggggtgggagacatgggaatctggtcagtatgagtaatgttctctgtgtttgtggtgcttcgaatatcttctatttctctctctctctctctctctctctctttctctcaatctcaaggaacagcctcctacttctatgtagatttgaagttgacattcaat

SEQ ID NO: 14744 - DNA, 164 bp, Homo sapiens
  AL158157.8_36196
  Located on chromosome 9
  Distance between a terminus base of telomere on chromosomal short arm and 5'-terminus of this base sequence : 10380146
  Distance between 3'-terminus of neighbour sequence of sequence listing upward to telomere on chrosomal short arm and 5'-terminus of this base sequence : 161136
atagaccaaatgtttggtctaagaactcccctctctaccgtcccccctcctaccaaatacacacaggtgcttacgcgcgcgcgcgcacacacacacacacacacacaaagataaactataactttccccaaaaaattgcagtcactttccatttgacttctagt

SEQ ID NO: 14745 - DNA, 319 bp, Homo sapiens
  AL158157.8_48987
  Located on chromosome 9
  Distance between a terminus base of telomere on chromosomal short arm and 5'-terminus of this base sequence : 10392940
  Distance between 3'-terminus of neighbour sequence of sequence listing upward to telomere on chrosomal short arm and 5'-terminus of this base sequence : 12630
ccatgtggctaatgtttagaacatttaagaaatctttaaaacttttataatttgagagggtcagttgtaggtcattttccagcacacacacacacacacacacacacacacacacacacacacaaatctaaagggctcttgttgctaaatgcatgtttgtgagagattgtcaatcaatgaacgatcccttgtgccatgttttttggagccatactactatcaaagtaagaaaagtagcaataaatgaagaatcaagcacttatggagaaatggctggtacagccatgtgctacaactgtactcatactggctaggaagt

SEQ ID NO: 14746 - DNA, 210 bp, Homo sapiens
  AL158157.8_128739
  Located on chromosome 9
  Distance between a terminus base of telomere on chromosomal short arm and 5'-terminus of this base sequence : 10472664
  Distance between 3'-terminus of neighbour sequence of sequence listing upward to telomere on chrosomal short arm and 5'-terminus of this base sequence : 79405
gacctgacttatttcacctaacaggatgtcctcctgactcatctatgttgttccaaatgacaggatttcattcttatggctaagtagtattctattgtgtatttgtgtgcgtgtgtgtgtgtgtgtgtgtgtgtgtgtgtgtgtgtatgtaatgtatgtatgtatatggcacattgtctttactcacttaagttgattctatgtcttggc

SEQ ID NO: 14747 - DNA, 258 bp, Homo sapiens
  AL158157.8_174145
  Located on chromosome 9
  Distance between a terminus base of telomere on chromosomal short arm and 5'-terminus of this base sequence : 10518038
  Distance between 3'-terminus of neighbour sequence of sequence listing upward to telomere on chrosomal short arm and 5'-terminus of this base sequence : 45164
atagatgagaacgtggtatttgactctgtgtctgagttgtttcacttaaaagataatggcttccagcttcatgcatgttgctgcaaaagacatgatttcattcttttttatggctgaacagtattccattgtgggtgtatgatgtgtgtgtgtgtgtgtgtgtgtgtgtgtgtgtgtgtgtgtgtgtgtgtgtattagacacattttccttatccagtcattcgctgatggacacttaggttgattccatgacattac

SEQ ID NO: 14748 - DNA, 166 bp, Homo sapiens
  Z66865
  Located on chromosome 9
  Distance between a terminus base of telomere on chromosomal short arm and 5'-terminus of this base sequence : 10518151
  Distance between 3'-terminus of neighbour sequence of sequence listing upward to telomere on chrosomal short arm and 5'-terminus of this base sequence : -145
ctgaacagtattccattgtgggtgtatgatgtgtgtgtgtgtgtgtgtgtgtgtgtgtgtgtgtgtgtgtgtgtgtgtgtattagacacattttccttatccagtcattcgctgatggacacttaggttgattccatgacattactattgcgaatgatgctgtcaa

SEQ ID NO: 14749 - DNA, 433 bp, Homo sapiens
  HUMUT6211B
  Located on chromosome 9
  Distance between a terminus base of telomere on chromosomal short arm and 5'-terminus of this base sequence : 10620407
  Distance between 3'-terminus of neighbour sequence of sequence listing upward to telomere on chrosomal short arm and 5'-terminus of this base sequence : 102090
tttagtatgcatttgttcattgtccgtcttctcaactagaatttaagctccatgagataggggtgtagatttctctaattctactatcgtacttgccagcacaagatgtgagcattgagtaaatatttgtagatgaggccgggcatggtggatcacacctgtaatccctgcactttgagaagctaaggtgggaagacaacttaagctcaggacttcaagatcggcctgagaaatacggttagaccccatttctaaaaaagaaagaaagaaagagagagagagagagagagagagagagagagagagagaaggaaagaaagaaagaaagaaagaaagaaagaaagaaagaaagaaagaaagaaagaaagaaagaaagaaagaaagaaagaaaagaaagaaaagcaagcaagcatggtacctacacctgtggtcc

SEQ ID NO: 14750 - DNA, 403 bp, Homo sapiens
  AL133478.11_60885
  Located on chromosome 9
  Distance between a terminus base of telomere on chromosomal short arm and 5'-terminus of this base sequence : 10630217
  Distance between 3'-terminus of neighbour sequence of sequence listing upward to telomere on chrosomal short arm and 5'-terminus of this base sequence : 9377
catctagtacaattcacgattgtatattttgtgagttgtatttgtaatgtttgtcttcctcaatggaccctaactccacagcagcagaagaagtgtgggttctgctcaccattgtgtcctcagcatctaccctagcacaaaactcttaggtgatacttagtaactatagaaggaaggaaggaaagaaggaaggaagggaggaaggaaggaaggaaggaaggaaggaaggaaggaaggaaggaaggaaggaaggaattagacagagattcacttttccactgttcctccaatgtctctgcccaccctttcttcttatattaattcataaagtatcgtaaggaatcaattggggactctcagagatagagggatagatctccttctatcaatgttaggattgaag

SEQ ID NO: 14751 - DNA, 446 bp, Homo sapiens
  AC025149.3_81218
  Located on chromosome 9
  Distance between a terminus base of telomere on chromosomal short arm and 5'-terminus of this base sequence : 10748151
  Distance between 3'-terminus of neighbour sequence of sequence listing upward to telomere on chrosomal short arm and 5'-terminus of this base sequence : 117531
taaatacaagacatgtcaaagctatttcaatgactggagtggcactcaatatgtgctttagacaactccctccatcacagggaagtgtgtctaaagaacattagaagatggacaagaacaaccattgggcattttattttgcaaatttttaaaaagcaattttctaagaacaaaaggactgcattgggcttagcaaatttataaagatagtactgtactgcccgcatttcttcattgtagttgagtcttcttcccacaatggcttattgtgcacattacgaagtcttcagggtcttcagaattaaagtgacagagtgtgtgtgtgtgtgtgtgtgtgtgtgtgtgtgtgtgtgtgtttaaaatgcacatttgagaatggaatattcttccttcctctaaacataatatgcctttacagactcctccaataagtctagtcatcttga

SEQ ID NO: 14752 - DNA, 453 bp, Homo sapiens
  chr9.fa.O7frz.15474410
  Located on chromosome 9
  Distance between a terminus base of telomere on chromosomal short arm and 5'-terminus of this base sequence : 10786942
  Distance between 3'-terminus of neighbour sequence of sequence listing upward to telomere on chrosomal short arm and 5'-terminus of this base sequence : 38345
atatcggtcacttaattccaactgctggaaaaggaagtaaccagggagtcgtggttggcagagaaaccaaaaatgaactgttattgtggttgacttcagagaaggaattattcagaccacatctaaaccccttccaattcaccacctaggtcaaattactctatacccaaaggttttatttaaccacttccatcactttgctcaacaccccccacctctctctctctctctctctctctctgtgtgtgtgtgtgtgtgtgtgtgtgtgtgtgtgtgtgtgtgtgtgtgtgtatttaatatgttacagtgaagcctggctctgtccctcactagtgacatgatcttgtacaaaattacttactcttaagagtcttggtgtctggatcttgaaaactgcaataatattatctaccttgtaaaatcattgcaagattctatcacattaagcaccaa

SEQ ID NO: 14753 - DNA, 420 bp, Homo sapiens
  AL136366.19_14908
  Located on chromosome 9
  Distance between a terminus base of telomere on chromosomal short arm and 5'-terminus of this base sequence : 10842196
  Distance between 3'-terminus of neighbour sequence of sequence listing upward to telomere on chrosomal short arm and 5'-terminus of this base sequence : 54801
attattgatctaccaagctcctcaccctgctaggtataacagtgtgtgtgtgtgtgtgtgtgtgtgtgtgtgtgtgtgtgtgtgtgtgtgtgtaagctcctcaccctgctaggtataacagtgtgtgtgtgtgtgtgtgtgtgtgtgtgtgtgtgtgtgtgtgtgtgtattctaccatattctgggttctgggcaaaacagcagattatcaaagtcctaacccacatgaggcttacggtctaggaggggtaagaaacagtaaaccaagaaacaaatgaatatgaaatatgtgaggtagctatggggcaaagagtacagcagggtaaggagaaaaagacctgggaagaagagagtggtagctggagtggtaggagattttgggggcacatgtaatttaagtcttcctctgaatgaggtaag

SEQ ID NO: 14754 - DNA, 271 bp, Homo sapiens
  D9S1869
  Located on chromosome 9
  Distance between a terminus base of telomere on chromosomal short arm and 5'-terminus of this base sequence : 10878531
  Distance between 3'-terminus of neighbour sequence of sequence listing upward to telomere on chrosomal short arm and 5'-terminus of this base sequence : 35915
cctaacttgaagtgtaaatggtgaatgcttctctatatctcatcttgaccactactttactgaagagtgaaaaatgacagatgcaaattatttttcagaaagtagacatttccactggtagttcttcctcctaagtgatcttttcttctctctcatgctctaccccctttctctctctagcattcttcctccctacacacacacacacacacacacacacacacacacacacacgaagacatccattaatattaagaacagtcttccgtaa

SEQ ID NO: 14755 - DNA, 163 bp, Homo sapiens
  D9S274
  Located on chromosome 9
  Distance between a terminus base of telomere on chromosomal short arm and 5'-terminus of this base sequence : 10959161
  Distance between 3'-terminus of neighbour sequence of sequence listing upward to telomere on chrosomal short arm and 5'-terminus of this base sequence : 80359
tctagtttctgaggtgagcagtcagttatacctcatggcaattttttccttcagcattgcatttaaatggttatctctatgtaatgggtactctgtgtgtgtgtgtgtgtgtgtgtgtgtgtgtgtgtgtagaaatggattgtcccgtgaaggatcacttgaa

SEQ ID NO: 14756 - DNA, 415 bp, Homo sapiens
  AL137017.9_45251
  Located on chromosome 9
  Distance between a terminus base of telomere on chromosomal short arm and 5'-terminus of this base sequence : 10992639
  Distance between 3'-terminus of neighbour sequence of sequence listing upward to telomere on chrosomal short arm and 5'-terminus of this base sequence : 33315
tagcttgaattacaaggatgagttgcaaaagcataatgttcagtaagaaaagaaaaatgcagccaggtgtggtggtatgcacctgtagtcccagctacatggaggaggctggggtgggaggattaattgagcctgggaggttgaggctgcagtcagctgtgatgacgccacagaatgagaccttttcaaaaagagaaagaaagaaggaaggaaggaaggaaggaaggaaggaaggaaggaaggaaggaaggaaggaaggaaggagagagaaagagagagggagaaaaaagagagaaagaaaaagagagagagagagagaaagagagagagagagaaagtaaggagggaagggagggagagagggaagggaaggagggaaaaatgcaaaagaatacatgtgctatgatactcagtg

SEQ ID NO: 14757 - DNA, 414 bp, Homo sapiens
  AL137017.9_122455
  Located on chromosome 9
  Distance between a terminus base of telomere on chromosomal short arm and 5'-terminus of this base sequence : 11069889
  Distance between 3'-terminus of neighbour sequence of sequence listing upward to telomere on chrosomal short arm and 5'-terminus of this base sequence : 76835
tgtttgactaatcagaaggaaatctgctctctgaattcaaaggcctctgcatagatattaacaacatagagagaagaaaatggctcattaatgatttatgaaaattgttgtcaccgtcaaccaaagcatattttgtgatgaatgaaatgacttgttacacacacacacacacacacacacacacacacacacgccctaccccctgcagctatgggcccttcttggctgtcatagtgtgaatcaccactcgagggagcccaaggttctctggtcctgggctacctacagtcaccaggatgcaatggaacatgttggggagacatgtccttctgccactctactgcagggtggacatttggggccgagacaattcttggtgtgggggcccatcctgtgcactgtacgatgttaagc

SEQ ID NO: 14758 - DNA, 165 bp, Homo sapiens
  AL137017.9_164854
  Located on chromosome 9
  Distance between a terminus base of telomere on chromosomal short arm and 5'-terminus of this base sequence : 11112335
  Distance between 3'-terminus of neighbour sequence of sequence listing upward to telomere on chrosomal short arm and 5'-terminus of this base sequence : 42032
gcatcagaaatagacaggtgacaaaatttttctttctatgtgacacaggttcagcacatgaatccaaagaggcataaacacacacagacacagacacagacacacacaaacacacacacacacacacacacatatatatatatatattcatgtcctgaacctgtg

SEQ ID NO: 14759 - DNA, 329 bp, Homo sapiens
  chr9.fa.O7frz.15956370
  Located on chromosome 9
  Distance between a terminus base of telomere on chromosomal short arm and 5'-terminus of this base sequence : 11217048
  Distance between 3'-terminus of neighbour sequence of sequence listing upward to telomere on chrosomal short arm and 5'-terminus of this base sequence : 104548
taaagtgagtaaccatatccagacttttttctttcattaagttcaattttctgttatcagttttgcttaaatcaaggtacatatgcatttcctcttgggaaagcatctctctctctgtctctctctctgtctgtctgtctctccgtatctctctctctatatatctacacacacatatgtacacatacatatattttaaaggtgttctgttatctttatttgcaaagtagacaaatggcaatattattctttaaagccactaaagattacacacacacacacacacacacacacacacacacacacgctgaactcgatttgtaatgaga

SEQ ID NO: 14760 - DNA, 418 bp, Homo sapiens
  AC025378.2_41005
  Located on chromosome 9
  Distance between a terminus base of telomere on chromosomal short arm and 5'-terminus of this base sequence : 11414186
  Distance between 3'-terminus of neighbour sequence of sequence listing upward to telomere on chrosomal short arm and 5'-terminus of this base sequence : 196809
tgataattagtgtttccagcacaccagcagagaaaaaggcacacattttggaactttcaaaagacatttcaaaagaatgtcaaatgtcaaaagaccacactatgcgtcaggcaccgatactgtctaatggtagagaaggaaatgcagtgtggttagaatagcacagatgtatgtatgtatgtatgtatgtatgtatgtattatgtagaatcacatgaaattgctactattaaaccattttttacctgttaaatggcaattttatgtattccggcctgatcgtgtgcaaggtgctgagggtgaaagaagatgagttttagctgacaatggcgtaggggcagggcatacgtgccaaggaaagtcagcaaagtttccagatgcctttgctggctttgtgctgagcattaaaggatgagtaa

SEQ ID NO: 14761 - DNA, 307 bp, Homo sapiens
  chr9.fa.O7frz.16075820
  Located on chromosome 9
  Distance between a terminus base of telomere on chromosomal short arm and 5'-terminus of this base sequence : 11414297
  Distance between 3'-terminus of neighbour sequence of sequence listing upward to telomere on chrosomal short arm and 5'-terminus of this base sequence : -307
caccgatactgtctaatggtagagaaggaaatgcagtgtggttagaatagcacagatgtatgtatgtatgtatgtatgtatgtatgtattatgtagaatcacatgaaattgctactattaaaccattttttacctgttaaatggcaattttatgtattccggcctgatcgtgtgcaaggtgctgagggtgaaagaagatgagttttagctgacaatggcgtaggggcagggcatacgtgccaaggaaagtcagcaaagtttccagatgcctttgctggctttgtgctgagcattaaaggatgagtaa

SEQ ID NO: 14762 - DNA, 357 bp, Homo sapiens
  AL354672.21_49653
  Located on chromosome 9
  Distance between a terminus base of telomere on chromosomal short arm and 5'-terminus of this base sequence : 11442843
  Distance between 3'-terminus of neighbour sequence of sequence listing upward to telomere on chrosomal short arm and 5'-terminus of this base sequence : 28239
gactagatacttgtccaaattgagaatgtaaacatcaaacagaccaggtaatcatttgagttcctcaaatattgaagtttcactgatatcggagttttaaatataaaaatgcttgccagcacacacacacacacacacatacacacaatacttgtttcattggcatgcacacacttatttctagaaactctgaataaagctttacacttattaccgccccatctcactccctccctagtccctaccaaatgtttgggtcttatttcctcctagtttcagtaaatgttgaaagaaccagaattcatttggtgatcaataagcagtttgtaagggtctacaatgagtcagatacctagg

SEQ ID NO: 14763 - DNA, 413 bp, Homo sapiens
  chr9.fa.O7frz.3695548
  Located on chromosome 9
  Distance between a terminus base of telomere on chromosomal short arm and 5'-terminus of this base sequence : 11607096
  Distance between 3'-terminus of neighbour sequence of sequence listing upward to telomere on chrosomal short arm and 5'-terminus of this base sequence : 163896
taaaatactgagcatggaacaccaagatactctatgtaaagtattttggtagatagagaaaaacaagttggcaagatggttcagaattcctatagaatataaagtgctgtgaaccattttagttgatagcgccacacacacacacacacacacacacacacacacacacacacacacacacacacacacacacagtttatctcacttgaaatcgtgttaaacaccctgaaacagagccttactcatgtgagaaagagacttggaaacgtctaagagaagctcttattttaagattgcattctccatgttatatgagtatttctttccttgtgtagtaagcactttgcgcgtctgtcaggccttgctacctctgagtgccttcctcctttcttctcctattaaccatagcctat

SEQ ID NO: 14764 - DNA, 239 bp, Homo sapiens
  chr9.fa.O7frz.1682411
  Located on chromosome 9
  Distance between a terminus base of telomere on chromosomal short arm and 5'-terminus of this base sequence : 11806189
  Distance between 3'-terminus of neighbour sequence of sequence listing upward to telomere on chrosomal short arm and 5'-terminus of this base sequence : 198680
cctgaattagacttttcaggacaaaagaaataatgtaacaacttatgatgttttatggagctttcatttgagtaaaacatatatatatatatatatatgacacctataggatgaatcttggatttgtacgtgtggattagaaaggcaggagtgcattgggggaaatggcactgaactaataagttcctgtctgtgatttgacctgctctgcgcctgactagctgcatattcatgtcaat

SEQ ID NO: 14765 - DNA, 470 bp, Homo sapiens
  AL353590.11_75259
  Located on chromosome 9
  Distance between a terminus base of telomere on chromosomal short arm and 5'-terminus of this base sequence : 11914028
  Distance between 3'-terminus of neighbour sequence of sequence listing upward to telomere on chrosomal short arm and 5'-terminus of this base sequence : 107600
tcatactgtctagcatccagaccgtggtttctaataccattctccaataaaaggagttgggattctgtgaagaaattgctaagtctaggactggggcaggacatatataagataagcctgaatcattttatagtgtcagagtgtaagaatgtgctaaaaagaaaacacacacacacacacacacacacaactgtggggatatgccaaagagaacaggagccgattaaagagctaccaatggtcaaagctgcaaaaatctgagcaacaaaacaaataaagtaatattcaattacaacccaaagtataaaataaatataacaaataaataagagtccatatttatttatttaaaataaataattgaatgaatgaaaaaataaataggggagtagagacatttgctatgcagaaaaatttcaaataaattatggaaatatttcactctccgctgtttatggattgtgcatagt

SEQ ID NO: 14766 - DNA, 411 bp, Homo sapiens
  chr9.fa.O7frz.1869427
  Located on chromosome 9
  Distance between a terminus base of telomere on chromosomal short arm and 5'-terminus of this base sequence : 11944199
  Distance between 3'-terminus of neighbour sequence of sequence listing upward to telomere on chrosomal short arm and 5'-terminus of this base sequence : 29701
catgatctgaataagaaattcaacacagaaataaataaatatcatttttaataatgaaacaaatcttgaaaccaaagaatatatatatatatatacatacacacacacacacacacacacacacacatatattagagaacttcaacaatagattagatcaagcagaagaaagaatttctgaactttaaaactggttttttggaataaaccagtcagaccaaaaaataatagtaataataaatagaaaaaagattttaaaagaatgaggaaggcctatggaatgccattaagcaaaccaatgttcacacaacgggaatttcagaaagagaaggaatagaaaaaggcataggtaacttatttaataaaataatagctgaatattttccaagtcttggaaaagatacagacatc

SEQ ID NO: 14767 - DNA, 459 bp, Homo sapiens
  chr9.fa.O7frz.2933946
  Located on chromosome 9
  Distance between a terminus base of telomere on chromosomal short arm and 5'-terminus of this base sequence : 12120182
  Distance between 3'-terminus of neighbour sequence of sequence listing upward to telomere on chrosomal short arm and 5'-terminus of this base sequence : 175572
aatatttccaggcttatcatttacatttgaaggggccaagtatgttcatggagctaatataagcctttatttatttatttatttatttatttatttatttatttatttatatttttgaggcacagtctccctctgttgcccaggctggagtgcagtggcatgatctcagctcactgcaacctctacctcccgggttcaagcgattctcctgcctcagcctcctgagtagctgggactacaggcgtgtgccaccacacccagctaatttttgtatttttaatagagacagggtttcaccatgttgcccaggctggtctttgaactcctgacctcaggtgatccaccctcctcagcctcccacagtgctgggattacaggcatgagccaccatgcctggccttaaacctttatttttaatacctgggaggtatagatgagtaacgtttagtgattcttgaa

SEQ ID NO: 14768 - DNA, 190 bp, Homo sapiens
  chr9.fa.O7frz.2853497
  Located on chromosome 9
  Distance between a terminus base of telomere on chromosomal short arm and 5'-terminus of this base sequence : 12200517
  Distance between 3'-terminus of neighbour sequence of sequence listing upward to telomere on chrosomal short arm and 5'-terminus of this base sequence : 79876
accgagtctttgataaggttaggttcgaggaaattgactacctgagcagtcagtgtgtgtgtatgtgtgtgtgtggtaagatgtatgtatgtataatacctgaatgtacaactcagtgatatttttaaaataatcttcaacacatcacgccaaagaaaaggcgtttcttgcaacttaaggttagttgtag

SEQ ID NO: 14769 - DNA, 444 bp, Homo sapiens
  chr9.fa.O7frz.2641371
  Located on chromosome 9
  Distance between a terminus base of telomere on chromosomal short arm and 5'-terminus of this base sequence : 12412540
  Distance between 3'-terminus of neighbour sequence of sequence listing upward to telomere on chrosomal short arm and 5'-terminus of this base sequence : 211833
tctagtgccaattgacttagagtttttctttctttctttcttttttgtttttggtttaaaattaggagtgtatcagtttgtcagggttctccagagaaacataaccaagaagatggatgatggatagatggatggatggatggatggatggatggatggatggatggatggatggatagacaggcaggcaggcggatggatggatggatagatagatagatagatagatagatagatagatagatagatagataaattttaaggaactggcttacaccattgcagaagctggcaaatccaaaatctgcagggtaggcttgcaggttggagagtcacggaagacccaatgcagcagtttgagcttgaaagtggtctgctgggagaatgtcttcttcctctggggaggtcagtcttttttctcttaagacttccaactgattgaat

SEQ ID NO: 14770 - DNA, 457 bp, Homo sapiens
  chr9.fa.O7frz.2442884
  Located on chromosome 9
  Distance between a terminus base of telomere on chromosomal short arm and 5'-terminus of this base sequence : 12610979
  Distance between 3'-terminus of neighbour sequence of sequence listing upward to telomere on chrosomal short arm and 5'-terminus of this base sequence : 197995
tttaggcatcaatctatgacactacccattctcaggctcttggaaactgaattaataagcagaggttgcttgatgaatacaaaatcaaatataattgaatgatgctcagggattatttcaaccaagcgtcaaaagaacttaatgagcacccttgctccaaaactggaatgtaccagaataccagactcacactttctctctttctctctctctctctctctctctcacacacacacgaacacacacacgcacacacacaccttacatgtccctttggagataatctctcagtgtggattccttcttcagatgtctgccactaaactcttctactatgcattgctttttgctggttttactcttagggtgacacctgttttcacatagtagatttactttctgtgatctgtatatcaatgacaatgtttgttttttagtcagttatggctactgaaat

SEQ ID NO: 14771 - DNA, 397 bp, Homo sapiens
  AC019222.4_9448
  Located on chromosome 9
  Distance between a terminus base of telomere on chromosomal short arm and 5'-terminus of this base sequence : 12674077
  Distance between 3'-terminus of neighbour sequence of sequence listing upward to telomere on chrosomal short arm and 5'-terminus of this base sequence : 62641
taccatttgatccagtaatcacactactgggtatctacccagaggaaaataagtcattgttcaaaaaagatacttgcacgctcatgtttatagcagcacaattcacaattgcaaaatcgtggaatcagcccaaacacccatcaatcaacaaatggacaaagaaacgttgagatatatatatatatatatatatatacatatatatatgtgtgtgtatatatatcacatatatatgtgatatatatattcatatatatatgtctatggatatatatatggatatatatatccatatatatatgtggatgaagtgatcagggaacacttctggactgctggtgggtatgtaaaccatatatatatatatgtctccaatctcatccaggtcactgtaaat

SEQ ID NO: 14772 - DNA, 296 bp, Homo sapiens
  chr9.fa.O7frz.2335805
  Located on chromosome 9
  Distance between a terminus base of telomere on chromosomal short arm and 5'-terminus of this base sequence : 12718111
  Distance between 3'-terminus of neighbour sequence of sequence listing upward to telomere on chrosomal short arm and 5'-terminus of this base sequence : 43637
catagccataaagcttaaggtctttatttgcctgtctttaaagagtcctttataaagccagcttgtcttcccacccccaccccaatgtcattcttttaaacaggcagggacattttagtagcacactgtactcctaatgcctgttgctactccttattggagagagagagagagagagagtgtgtgtgtgtgtgtgtgtgtgtgtgtgtgtgtgtggttgagagagagggagtaaaacacagctttatgatgatcaggcagaagcttgagtaaagtggaaatatctcggataagaa

SEQ ID NO: 14773 - DNA, 365 bp, Homo sapiens
  chr9.fa.O7frz.2206531
  Located on chromosome 9
  Distance between a terminus base of telomere on chromosomal short arm and 5'-terminus of this base sequence : 12847489
  Distance between 3'-terminus of neighbour sequence of sequence listing upward to telomere on chrosomal short arm and 5'-terminus of this base sequence : 129082
gtctagaggaatcctcacagacagcagctttcagggagaatagaagtgtgtgtgcgtgtgtgtgtgtgtgtgtgttttccggacttttaaaagtgtccaactctcagttaatctttctaaatccagacaagggaaggcttcattaatgaaggtctctccagatgcaaattttcctcactaaagacagctttgcagggacacttctgtttgctgaccctctgacagccatctcaaaataggacaaataaatatatttaggagtgaaatatttttatttccttcaaaatctatgttctgctttaggcaaatagaggcagggctgagaacttccctgcatctacttcttaattgtcttcagctcaaca

SEQ ID NO: 14774 - DNA, 394 bp, Homo sapiens
  AC026661.2_165429
  Located on chromosome 9
  Distance between a terminus base of telomere on chromosomal short arm and 5'-terminus of this base sequence : 13007223
  Distance between 3'-terminus of neighbour sequence of sequence listing upward to telomere on chrosomal short arm and 5'-terminus of this base sequence : 159369
tagaaagcatgagcttaatgagaatactgttaacaataaaaacgtttatgagtacctactatgttaagcactgagtgcttttcgtgctttactaagtgctaagggctttactaggatatatcatttactctataaaaaatctctggagcaggcatttggggtgtgtgtgtgtgtgtgtgtgtgtgtgtgtgtgttttctgactatccagaatttgtttagcagtgcggattcatctcttctccacattctgtccaaaaagttccatgtgaacttagtctaccctcagtaacaggtgtggcatatgaccccagattggcaagtcagagcactacttttcccctgaagacagtgattgatccgtagatgagcacataatccaaggtacgataacct

SEQ ID NO: 14775 - DNA, 313 bp, Homo sapiens
  chr9.fa.O7frz.3207420
  Located on chromosome 9
  Distance between a terminus base of telomere on chromosomal short arm and 5'-terminus of this base sequence : 13007304
  Distance between 3'-terminus of neighbour sequence of sequence listing upward to telomere on chrosomal short arm and 5'-terminus of this base sequence : -313
tcgtgctttactaagtgctaagggctttactaggatatatcatttactctataaaaaatctctggagcaggcatttggggtgtgtgtgtgtgtgtgtgtgtgtgtgtgtgtgttttctgactatccagaatttgtttagcagtgcggattcatctcttctccacattctgtccaaaaagttccatgtgaacttagtctaccctcagtaacaggtgtggcatatgaccccagattggcaagtcagagcactacttttcccctgaagacagtgattgatccgtagatgagcacataatccaaggtacgataacct

SEQ ID NO: 14776 - DNA, 311 bp, Homo sapiens
  AL354658.9_5422
  Located on chromosome 9
  Distance between a terminus base of telomere on chromosomal short arm and 5'-terminus of this base sequence : 13078861
  Distance between 3'-terminus of neighbour sequence of sequence listing upward to telomere on chrosomal short arm and 5'-terminus of this base sequence : 71244
taccaattagacaatggttgacaaggaaacaaagtaatatgttctgttggaaaatttagaaaagttaaaaaaattatagcaggaaaaatttgccaaaaaacaagaaatattaaggggtgtgtgtgtgtgtgtgtgtgtgtgcgcattttaactgcaatatcacactgtgatgacacagatactgtgccattattctaagataacatgctgttagtaatgggttcacagtgctcacttatattaatctagagctgtggctgtattccatacagtttcctagggtttgggtaattaggagcattaccaattta

SEQ ID NO: 14777 - DNA, 245 bp, Homo sapiens
  HUMUT537
  Located on chromosome 9
  Distance between a terminus base of telomere on chromosomal short arm and 5'-terminus of this base sequence : 13282220
  Distance between 3'-terminus of neighbour sequence of sequence listing upward to telomere on chrosomal short arm and 5'-terminus of this base sequence : 203048
aaggcaggttgaaaagcagcctcacaatatgttccccttaatgtggaaaacccaggtatataatattaaatagccaatagtactgagagctaattatgtgcacagctctatgtttgtgtgtgtgtgtgtgtgtgtgtgtgtgttgtgggtacgtaatacagaagtgcatttagaatttatttttcatggctctttcttaatagtggcatgcgaaacgatgttttactctttctgtattgccctgt

SEQ ID NO: 14778 - DNA, 139 bp, Homo sapiens
  DISO7_10018882
  Located on chromosome 9
  Distance between a terminus base of telomere on chromosomal short arm and 5'-terminus of this base sequence : 13589623
  Distance between 3'-terminus of neighbour sequence of sequence listing upward to telomere on chrosomal short arm and 5'-terminus of this base sequence : 307158
tggcttgtaattcagggcattttacctatttcataacttattactaaatttatatatatatatatatatatatatatatatatatatatatatatatatatatatataaatttaatgagctcatcattgaactcatcaa

SEQ ID NO: 14779 - DNA, 175 bp, Homo sapiens
  DISD22_0006232
  Located on chromosome 9
  Distance between a terminus base of telomere on chromosomal short arm and 5'-terminus of this base sequence : 14013221
  Distance between 3'-terminus of neighbour sequence of sequence listing upward to telomere on chrosomal short arm and 5'-terminus of this base sequence : 423459
gcaacaaggtagagtatattcagagataatcatgtaattatgtttaatcaggtagatacattcttcaaacacacacacacacacacacacacacgcacacacgcgcgtgcacatgcacacacacagtaccctttctcccccaaaagagtaattaacagtgtaactcctttggcaa

SEQ ID NO: 14780 - DNA, 334 bp, Homo sapiens
  chr9.fa.O7frz.389101
  Located on chromosome 9
  Distance between a terminus base of telomere on chromosomal short arm and 5'-terminus of this base sequence : 14121187
  Distance between 3'-terminus of neighbour sequence of sequence listing upward to telomere on chrosomal short arm and 5'-terminus of this base sequence : 107791
tatcagtagcatactaaggctgtcagatctgcatgaagctattgattcactagttatcattatagtggcttagcagcccgctggggggtacctgtccttcaggtgattaggaatttcatgcctccatcagtgtaagtttgaacacttgggttacgaagaaatttgtcctaatgaggtttggccccagatgccctgccaggtgtgcatctgagtgtggtttctattcttcatcaccctctacacacacacacacacacacacacacacatccgtcttgtgttttttggtgggctcagagccacgagggagctattagttatccttccaaaattca

SEQ ID NO: 14781 - DNA, 383 bp, Homo sapiens
  chr9.fa.O7frz.478245
  Located on chromosome 9
  Distance between a terminus base of telomere on chromosomal short arm and 5'-terminus of this base sequence : 14210408
  Distance between 3'-terminus of neighbour sequence of sequence listing upward to telomere on chrosomal short arm and 5'-terminus of this base sequence : 88887
attaaacaagctatgccacaccctaaattctggttctgggttttactattcagtcagttttatcaaattaagatgatcatgtcttcccttctgaaaaattataggggaagaaaaaccatagaactttcccccagtatatagcattgaattacacatattcctacacacacacacacacacacacacacacacacacacacaccactcacacatatatacgtacatacatatataatagaatttttatataatatgtaaaattttaaaaatatatatttttagaagggctgggggtggtgggggcggtggctcacacctgaaatcccagcactttgggaggccgaggtgggcaaatcacctgaggtcaggaattcgagactagc

SEQ ID NO: 14782 - DNA, 396 bp, Homo sapiens
  AL136365.9_74945
  Located on chromosome 9
  Distance between a terminus base of telomere on chromosomal short arm and 5'-terminus of this base sequence : 14501358
  Distance between 3'-terminus of neighbour sequence of sequence listing upward to telomere on chrosomal short arm and 5'-terminus of this base sequence : 290567
aaaattgaagtcattaggttgataaaattgaagtcattccacttttgggatcttttgctaccctcagggatctgacttcttgggcatattaaaatgtcaattttaatcccctgagctacaaattttcttaagttcttcatacgttttatttttggaatcatattattattattattattattattattattattatttttgagacagattctcgctctgtcgcccaggctggggtgcagtggcgccatctcggctcactgcaacctctgcctcctgggttcaagtgattctcctgcctcagcctactgagtagctgggactacaggcacgtgccatcacgcgtggctatttttttttctgtatttttagcagagatggtgtttcaccatgttagcc

SEQ ID NO: 14783 - DNA, 264 bp, Homo sapiens
  AL136365.9_165267
  Located on chromosome 9
  Distance between a terminus base of telomere on chromosomal short arm and 5'-terminus of this base sequence : 14591744
  Distance between 3'-terminus of neighbour sequence of sequence listing upward to telomere on chrosomal short arm and 5'-terminus of this base sequence : 89990
ctggcttatttcacttagcctaatgttctcaaggttcatccatgttatagcatgtattggaattccattcctttttaaggctgaataatatcccactgtgtgtgtgtgtgtgtgtgtgtgtgtgtgtgtgtgtgtgtgtgtacaccacgttttatacattcatgcactgatggacatttgggttgctttcaccttttggctattgtgaatgctgctgccatgaacattggtatacaatgtgtgtcatatttgaggcttagcaaa

SEQ ID NO: 14784 - DNA, 279 bp, Homo sapiens
  Z67287
  Located on chromosome 9
  Distance between a terminus base of telomere on chromosomal short arm and 5'-terminus of this base sequence : 14605322
  Distance between 3'-terminus of neighbour sequence of sequence listing upward to telomere on chrosomal short arm and 5'-terminus of this base sequence : 13314
tcataaggatgtcccaggctgaatttgtataggtatatatttttatgtgtgtgtgtgtgtgtgtgtgtgtgtgtgtatatatatatataactatgtccagggaatagtatgtaagtataatatataatactgatacatgtagcatatgatataatacttatataatattccctggacataattatgctctacaatatatgtatggcctatacatacttatactaaaaaattatccattgtttatccaaagttgaattcaactgggcatcctatgttttt

SEQ ID NO: 14785 - DNA, 433 bp, Homo sapiens
  chr9.fa.O7frz.953126
  Located on chromosome 9
  Distance between a terminus base of telomere on chromosomal short arm and 5'-terminus of this base sequence : 14711276
  Distance between 3'-terminus of neighbour sequence of sequence listing upward to telomere on chrosomal short arm and 5'-terminus of this base sequence : 105675
tttaacataaagcggtgtttattattttcaagagtcttttctgcatttactgagataatcatgtggtttttgtctttagttctgtttatgtgatgaatcacatttattgatttgcatatgttgaaccaaccttatatcccagggataaagcctactttatcacggtggataagctttttgatgtgctggtgaattccttttgccaatattttgttgaggatttttgcatcgatgttcatcaaggatattggcctgaagtgtgtgtgtgtgtgtgtgtgtgtgtgtgtgtgtgtgtgtgcctgccaggttttggtatcaggatgatactggcctcatagaatgagttagggaggaatccctcctcctcaattttttggaatggtttcagtaggaatggcaccagcttttctttatacatctggtagaatttggt

SEQ ID NO: 14786 - DNA, 467 bp, Homo sapiens
  chr9.fa.O7frz.1079663
  Located on chromosome 9
  Distance between a terminus base of telomere on chromosomal short arm and 5'-terminus of this base sequence : 14763335
  Distance between 3'-terminus of neighbour sequence of sequence listing upward to telomere on chrosomal short arm and 5'-terminus of this base sequence : 51626
gcttggtgagtgttcttgtgtgtgtgtgcgcatgtatacaacactgtaagaatatacatttatcccatgggactctataaagccatgttaattgtatcatttactcatttatttatttatttatttatttatttatttattttaaagatgcagttttactctgttgcccagactggagtgcagtggtgcgatcatagctcactgcagccttgaccttctgggctcaggtaatcctgctgccttggcctcccaagtatctgggactagaggcatacaccaccatgcccagccccatgttaattttaaatgaaaaaatgtacagccaacagagattctttcctgatatatttttttgctagcagcaaagttgttcacctctgattttcattgtcctttttcaagaagtgaatctcttgcaggcccattcttactgagtcgtcatttcttcatagcgagctacaaagctg

SEQ ID NO: 14787 - DNA, 240 bp, Homo sapiens
  DISO7_10002674
  Located on chromosome 9
  Distance between a terminus base of telomere on chromosomal short arm and 5'-terminus of this base sequence : 14867059
  Distance between 3'-terminus of neighbour sequence of sequence listing upward to telomere on chrosomal short arm and 5'-terminus of this base sequence : 103257
tgatttgatcatatggagtagaggttagtgtgaagtctggtgtctaactcctgaaagccacctccagctcccatctgagtagttttgtgatcctgggaaagctgtataatctctcagaatttcaactgtgatacaatagtagtagtaccactctgagggtccatttgtgtgtgtgtgtgtgtgtgtgtgtgtgtgtgtgtgtgtgcgttttgtgaaaacgtacacagagcacttagaaca

SEQ ID NO: 14788 - DNA, 102 bp, Homo sapiens
  DISO7_10002676
  Located on chromosome 9
  Distance between a terminus base of telomere on chromosomal short arm and 5'-terminus of this base sequence : 14961855
  Distance between 3'-terminus of neighbour sequence of sequence listing upward to telomere on chrosomal short arm and 5'-terminus of this base sequence : 94556
tagagtgagggcattggcaacctggcaatctttgtttccaaaacaaaacaaaacaaaacaaaaaaaagcaagcccccaatagctattgacttaggccagatc

SEQ ID NO: 14789 - DNA, 119 bp, Homo sapiens
  DISO7_10002680
  Located on chromosome 9
  Distance between a terminus base of telomere on chromosomal short arm and 5'-terminus of this base sequence : 15079525
  Distance between 3'-terminus of neighbour sequence of sequence listing upward to telomere on chrosomal short arm and 5'-terminus of this base sequence : 117568
tttgatatcctgcatgttccttttctttcgccttgactttaaaattaagcccctgcataagatggtgtgacagatatttatttatttatttatttttttactatagttgctgcatcggc

SEQ ID NO: 14790 - DNA, 443 bp, Homo sapiens
  chr2.fa.O7frz.91339678
  Located on chromosome 9
  Distance between a terminus base of telomere on chromosomal short arm and 5'-terminus of this base sequence : 15447069
  Distance between 3'-terminus of neighbour sequence of sequence listing upward to telomere on chrosomal short arm and 5'-terminus of this base sequence : 367425
gaaggtatctggtcttatggattataaaattaaactttcttatcattgtacctaaaccaaaatatgcttcctatacaaagaagttttctttcaagagttaagaccacctcccgacatcccccttaacacacacacacacacacacacacacacagagagagagagagagagagagagagaattgagagcattagtggctttctcccttagactgattttttcttactgttattttcagccactttgttaacagtggagttaaagggcaggatagatgtaacacccatttcacatacatgttgcaacatcagagatgctggttttcattaaaaacaccagttctaaattccttctaaaatatatttttaaaaatcagtacacttggcaccttggaaatgctgaaatgttatcatgaatggtggttactagttatgagtcaactg

SEQ ID NO: 14791 - DNA, 469 bp, Homo sapiens
  AL358053.10_335305
  Located on chromosome 9
  Distance between a terminus base of telomere on chromosomal short arm and 5'-terminus of this base sequence : 15745560
  Distance between 3'-terminus of neighbour sequence of sequence listing upward to telomere on chrosomal short arm and 5'-terminus of this base sequence : 298048
gagcttagaatattctaagagcaagcagaaggctagagggcttgtagtgaagtgactaagaggaggctgggcagcagggccacatcctgcagggcctccaaggccattgtaagaagtttggtattattttactggtaatggaaagccactggatgaatttaaataaagagttaaactttaaattggtctggcatgctacctggaatagacttgggtgtaggcaaggtaagtgtctgtgtgtgtgtgtgtgtgtgtgtgtgtgtgtgtgtgtgtgtgtgttttgaggcatgaagtaagtgtggaggcaggaagagaagtgtggaggcaggaagagaagtttggagactatttcagtgttccagatgagagataatcgtggcttagactgagactgttgaagtgaaatattatgagttaaagtatattccctcaaaaaaaaaaaggtatgttgagatcctaatccttggta

SEQ ID NO: 14792 - DNA, 105 bp, Homo sapiens
  DISD22_0006253
  Located on chromosome 9
  Distance between a terminus base of telomere on chromosomal short arm and 5'-terminus of this base sequence : 16037938
  Distance between 3'-terminus of neighbour sequence of sequence listing upward to telomere on chrosomal short arm and 5'-terminus of this base sequence : 291909
ggctttcagcttattactaagctctattaaagaataatgtttaggctgtgtgtgtgtgtgtgtgtgtgtgtgtgtgtgtgtgtgcacatgcacttagctatgctt

SEQ ID NO: 14793 - DNA, 439 bp, Homo sapiens
  chr9.fa.O7frz.16291454
  Located on chromosome 9
  Distance between a terminus base of telomere on chromosomal short arm and 5'-terminus of this base sequence : 16149612
  Distance between 3'-terminus of neighbour sequence of sequence listing upward to telomere on chrosomal short arm and 5'-terminus of this base sequence : 111569
agaggctagcttgatatcagatgttcaagaccagcctgggcaacatagtgagacactgcctctacaaaaaaataaaataaaattaattagccaggcatggttgtgtgggcctgtagtcccagctacttgggaggctgaggtgagaggatcacctgagtccactcggtcaaggctgcagtgagttatgatcatgccactgcactccagcctgagcaagagtgagaccctgtctaaaaaaaaaaaaaagagagagagagagagagaaagaaagggaaggaagaaagggagggagggagggagggaaggaaggaaggaaggaaggaaggaaggaaggaaggaaggaaggaaggaaggaagggaaggaaggaagaaaaaaagtcactagtcttccaccagaacgctcctaagtgtaaggctaatcttgtctacctgatctgag

SEQ ID NO: 14794 - DNA, 206 bp, Homo sapiens
  chr9.fa.O7frz.16399923
  Located on chromosome 9
  Distance between a terminus base of telomere on chromosomal short arm and 5'-terminus of this base sequence : 16331901
  Distance between 3'-terminus of neighbour sequence of sequence listing upward to telomere on chrosomal short arm and 5'-terminus of this base sequence : 181850
tgcctgtaatcccagctacttgggaggctgaggcaggagaatcacttgaacccgggaggcagaggttgcagtgagccaagatcacaccactgcactccagcctgggtgacagagcgagactccatctcaaaaaaaaaaaaaagaaagaaagaaagaaaaaagaaaaatacatatcaaaaaccacaatgagataccactcattatct

SEQ ID NO: 14795 - DNA, 374 bp, Homo sapiens
  chr9.fa.O7frz.16627168
  Located on chromosome 9
  Distance between a terminus base of telomere on chromosomal short arm and 5'-terminus of this base sequence : 16517699
  Distance between 3'-terminus of neighbour sequence of sequence listing upward to telomere on chrosomal short arm and 5'-terminus of this base sequence : 185592
tcctaacaccatattacaattcagaaacaccagaagaatacacacacaccaaacacacacacaaacacacacacacacacacacacacaccccccatgcaattcattctgctgactaggatgagattgaataataaagttgtgaaccaattataacacttaatttgcactttataatatctatactgtgttcatactatctacttgaatatatattgttttcatatttttaaacaaaactacttttcaaaaatgcatttggagataattttttagaaaaaaacaaatgagtccgggcgcactggctcatgcctgtaatcctaacacattgagagggtgaggcaggtggattgcctgagctcagtagttccagac

SEQ ID NO: 14796 - DNA, 288 bp, Homo sapiens
  chr9.fa.O7frz.16735237
  Located on chromosome 9
  Distance between a terminus base of telomere on chromosomal short arm and 5'-terminus of this base sequence : 16543211
  Distance between 3'-terminus of neighbour sequence of sequence listing upward to telomere on chrosomal short arm and 5'-terminus of this base sequence : 25138
cttagtaagcttgttgattagcagggtaccaagtgggagtattctctccaaagtaacaacaaagagcgggagctttcggcagcaagcctgccaggttttcaggactgtttcccgctgtgcccctcagtgcatggccccacactgcctcagaaaccttcttacattgtaggcagctgcttgttcgggatctgtctctctctctctctctctctggagcccacctccatcttctgccttcattctcgtctgttggcctgcatttcttcttaggcttgttttacagtgact

SEQ ID NO: 14797 - DNA, 252 bp, Homo sapiens
  AC040910.2_117764
  Located on chromosome 9
  Distance between a terminus base of telomere on chromosomal short arm and 5'-terminus of this base sequence : 16750820
  Distance between 3'-terminus of neighbour sequence of sequence listing upward to telomere on chrosomal short arm and 5'-terminus of this base sequence : 207321
gatgacaaattactggtttgactttgctgtttggggatttttttcttcttcttggattggtcttttataattattattattattattattattattattattattattatttgagacagggtcttgctctgttgcccaggccgcagtgcaacggcctgatctcggctcactgcatcctcaaactcctaggctcaagtgatccttccctctcaacctgtggagtagatgggactacagtcgcataccactatc

SEQ ID NO: 14798 - DNA, 400 bp, Homo sapiens
  chr9.fa.O7frz.17054564
  Located on chromosome 9
  Distance between a terminus base of telomere on chromosomal short arm and 5'-terminus of this base sequence : 16874369
  Distance between 3'-terminus of neighbour sequence of sequence listing upward to telomere on chrosomal short arm and 5'-terminus of this base sequence : 123297
caggacaattgcttgaaaccaggaggtggttgcagtgagctgagattgcaccactgtactctagcctgggagacagagtgagactctgtctcaaaaacaaaaaaaaaggactgttgttcgtagtgtatagtacataatacagtgtaatacctgtattataggcaaagctgtatatagttaaattaacctgtagtatatatatgaacatatatgtgtgtgtgtatatatatacacatatgtatacacgtatatatatatatacacgtgtgtgtgtgtatatatatatatatatatatatatatatatatatatatatgcattttaaccagaattttgttccgctttctgccctttctttgttgattacattaggattggatgcctatgaaacagtttatga

SEQ ID NO: 14799 - DNA, 452 bp, Homo sapiens
  chr9.fa.O7frz.17566430
  Located on chromosome 9
  Distance between a terminus base of telomere on chromosomal short arm and 5'-terminus of this base sequence : 17115959
  Distance between 3'-terminus of neighbour sequence of sequence listing upward to telomere on chrosomal short arm and 5'-terminus of this base sequence : 241190
agacatgtctacacttccatgttcattgtagcattattcacaatagccaagatatagaaacaacctaagtgtcctctgatgaatgaatggacagaggaaatgtttatacacacacacacacacacacacacacacacacacccagaggaaaattcagctttaaaaaataaaggaaatcctgcaatgtgcaacaacatatatgaacatggaggacattatgctaagcgaaataagccagacgcagaaagaaaaatactgcatgattccatttatacgtagaatttttaaaaatcttactcacagaaacagagtagaaggtggttgggggtggttgggggaatgaggagataattggtcaaagggtaaaaacttttggtcataagatgaataatctctggagatcatggtacagtgctatataatgcattgtgtacttgaaatttgctaagaga

SEQ ID NO: 14800 - DNA, 112 bp, Homo sapiens
  G09314
  Located on chromosome 9
  Distance between a terminus base of telomere on chromosomal short arm and 5'-terminus of this base sequence : 17187400
  Distance between 3'-terminus of neighbour sequence of sequence listing upward to telomere on chrosomal short arm and 5'-terminus of this base sequence : 70989
aataagtccattaactcactcatccattcattcattcattcattcattcattcattcattcctcaacaggcaggtgtatagagtacctgctctgtacctgtcactgtgcagg

SEQ ID NO: 14801 - DNA, 262 bp, Homo sapiens
  D9S1782
  Located on chromosome 9
  Distance between a terminus base of telomere on chromosomal short arm and 5'-terminus of this base sequence : 17370693
  Distance between 3'-terminus of neighbour sequence of sequence listing upward to telomere on chrosomal short arm and 5'-terminus of this base sequence : 183181
ttgggtgatccactgagaagcagagcgagagagagacagagggaaaactctgtgactccaagatctgtgggaagaaagcagatgccctcacctgcagtaggccctcaaccccagcattctcttctctatgatgtgggcttcaggtgtgtgtgtgtgtgtgtgtgtgtgtgtgtgtgtgtgtgtgtgtgtacgcatgcacgcgtgtgctgttactgctcccaggactcaaatcttccatgcctggaatgtggagccaggtgtc

SEQ ID NO: 14802 - DNA, 356 bp, Homo sapiens
  AL353775.5_89656
  Located on chromosome 9
  Distance between a terminus base of telomere on chromosomal short arm and 5'-terminus of this base sequence : 17458728
  Distance between 3'-terminus of neighbour sequence of sequence listing upward to telomere on chrosomal short arm and 5'-terminus of this base sequence : 87773
tgagaaatacctaatgtaggtgatgggttgatggatgcagcaaaccaccctggtacgtgtatacctatgttacaaaactgcatgttctgcacacgtatcccaggacttaaagtataataataataataataataataataataataaaatatgttgtttaaaagcagggatatgttctatcacaggagtggaagatacaaacctggactccctgcaaatactgcacccaaagtgaaccccaataatctgtacctgcaggaatttactctcaaaaggaagacaaatatatgtgtctacctgtattggagaccatatggatgagaattaattaacttccatgtagaatacgaagttta

SEQ ID NO: 14803 - DNA, 133 bp, Homo sapiens
  D9S156
  Located on chromosome 9
  Distance between a terminus base of telomere on chromosomal short arm and 5'-terminus of this base sequence : 17473569
  Distance between 3'-terminus of neighbour sequence of sequence listing upward to telomere on chrosomal short arm and 5'-terminus of this base sequence : 14485
atcacttttaactgaggcggactcaaggaatgtctttctctctctctctacaccacacacacacacacacacacacacacacacacacacacacaacccaaacatactctcttccctctattcaccaccatct

SEQ ID NO: 14804 - DNA, 217 bp, Homo sapiens
  chr9.fa.O7frz.17644207
  Located on chromosome 9
  Distance between a terminus base of telomere on chromosomal short arm and 5'-terminus of this base sequence : 17506695
  Distance between 3'-terminus of neighbour sequence of sequence listing upward to telomere on chrosomal short arm and 5'-terminus of this base sequence : 32993
ggacctaagattgtaagatacagacagaaagagatagggagggagcaagaaatagacacacacacacacgcatgcacacacacacacacacacacaaaacagggacctctgtttcaaattgtcccctactacaaattgtcctttactactttttaaattaaaaattcagacaatgtccccaccatccccaaacagcaattactttagtaatcaggaa

SEQ ID NO: 14805 - DNA, 117 bp, Homo sapiens
  D9S1839
  Located on chromosome 9
  Distance between a terminus base of telomere on chromosomal short arm and 5'-terminus of this base sequence : 17726940
  Distance between 3'-terminus of neighbour sequence of sequence listing upward to telomere on chrosomal short arm and 5'-terminus of this base sequence : 220028
  misc_feature (1)...(117): n = A,T,G or C
ccatagtcagtgtgcgcttatgtacttggggnntgtgtgtgtgtgtgtgtgtgtgtgtgcatttatgtatgctctgtggctacatatacacacacgtatttccttgagataaacaag

SEQ ID NO: 14806 - DNA, 452 bp, Homo sapiens
  AL159994.6_120846
  Located on chromosome 9
  Distance between a terminus base of telomere on chromosomal short arm and 5'-terminus of this base sequence : 17837123
  Distance between 3'-terminus of neighbour sequence of sequence listing upward to telomere on chrosomal short arm and 5'-terminus of this base sequence : 110066
tcttatttcctaggtcaaggacagaggggaaaatggggaaaggacaaaagagggggccactgcttccattcatggtcaataaatgtatcacaagatacagacctgaactaagaattcttcttcttcttcttcttcgtttttttttttttctttcgagatggagtctcgctgcaatgcccaggctggagtgcaatggtacaatcttggctcactgcaacctctgcttcccgggttcaaggaattctcccacctcagcttcccaagtagctgggttaacaggcacatgccaccatacccggctaatttttgtattttagtagagacagggtttcaccatattggccaggctggtctcaaactcctgacctcaagtgatctgcccgccttggcctccgaaagtgctgggattacaggcgtgagccaccacgcctggccagaattattctttagta

SEQ ID NO: 14807 - DNA, 388 bp, Homo sapiens
  AL356435.6_34739
  Located on chromosome 9
  Distance between a terminus base of telomere on chromosomal short arm and 5'-terminus of this base sequence : 17926572
  Distance between 3'-terminus of neighbour sequence of sequence listing upward to telomere on chrosomal short arm and 5'-terminus of this base sequence : 88997
gtggaattggattcttattgtaaaagtattagtgtgtttactatttctgctaccttcttagctacctgtgattatgtgaatttatatttttatatgaaatttaaatgaggagtataattattatttctgaattcccgtactgaggaaaaattttttgttattaaaggaggtaagtgattatacccacatcagaatcaacatagaaaaagtgtgaagcctgtttttcaatattttctttaaaaaattaagaaaacgacaaagctaacaacaacaacaacaacaaaagcccctgaaaagattaaatcctcctaaacctaagtaaatggcggaaaaccatttaccacaagttgccaaaatgttgtatgtttctattgaaagttttcactga

SEQ ID NO: 14808 - DNA, 388 bp, Homo sapiens; identical to SEQ ID NO: 14807
  AL161631.8_90694
  Located on chromosome 9
  Distance between a terminus base of telomere on chromosomal short arm and 5'-terminus of this base sequence : 17926572
  Distance between 3'-terminus of neighbour sequence of sequence listing upward to telomere on chrosomal short arm and 5'-terminus of this base sequence : -388

SEQ ID NO: 14809 - DNA, 455 bp, Homo sapiens
  chr9.fa.O7frz.18007745
  Located on chromosome 9
  Distance between a terminus base of telomere on chromosomal short arm and 5'-terminus of this base sequence : 17929424
  Distance between 3'-terminus of neighbour sequence of sequence listing upward to telomere on chrosomal short arm and 5'-terminus of this base sequence : 2464
  misc_feature (1)...(455): n = A,T,G or C
gaagttgaatagaatgaccagtagtcaggataatgctactgtgtgtgtgtgtgtgtgtgtgtgtgtgtgnttgtttgagacaaagtctagctttgtcccccgggctggagtgcagtggcgcgatcttggctcactgcaacctccacctccgaggtccaagcaattctcctgcctcagcctcccgagtagctgggactacgggcattcaccaccatgtccagttaatttttgtatgtttagtagagatggagtttcaccatgttggctgggctggtctcgaactcttgatctcaagtaatctgccagcctcagccacccaaagtgctgggattacaggtgtgaggcaccatgcctggccatgtgtgtttttatctttaaattttattttaattgatggatagtatagaaagatgagttcttcagcctatctcttgacactgtcggacagattgaag

SEQ ID NO: 14810 - DNA, 213 bp, Homo sapiens
  chr9.fa.O7frz.18131525
  Located on chromosome 9
  Distance between a terminus base of telomere on chromosomal short arm and 5'-terminus of this base sequence : 18118182
  Distance between 3'-terminus of neighbour sequence of sequence listing upward to telomere on chrosomal short arm and 5'-terminus of this base sequence : 188303
actgcaatgaacaaattaaagtacttacatgtataatttgcatacatgcacacacacacacacacacacacgcaaacacagtgtcccttctgaattctgctttagtagggaggggcaaaaaaacctaatggcttaaaaataaaattcacttaaatgtaaaacacagatgggaatgtgaaaagtttgatgctcaggcattaaatactgatacat

SEQ ID NO: 14811 - DNA, 274 bp, Homo sapiens
  chr9.fa.O7frz.18325269
  Located on chromosome 9
  Distance between a terminus base of telomere on chromosomal short arm and 5'-terminus of this base sequence : 18205198
  Distance between 3'-terminus of neighbour sequence of sequence listing upward to telomere on chrosomal short arm and 5'-terminus of this base sequence : 86803
ccatagttcactgtaacctcaaactcctgggctcagatgatcctcccaccttagcctcctgagaaactaggactacaggcatgtgtcatcattcccagctaatttttatttatttatttatttatttatttttgtaaagacagtgtctcgcatgttgcacaggctggtcttgaacacctgggctcaagccatctgcccaccttggcctcccaagattacaggcctcccaagattacaggcgtgagctactgtgtctggcctaacttaaattgac

SEQ ID NO: 14812 - DNA, 480 bp, Homo sapiens
  chr9.fa.O7frz.18519318
  Located on chromosome 9
  Distance between a terminus base of telomere on chromosomal short arm and 5'-terminus of this base sequence : 18402594
  Distance between 3'-terminus of neighbour sequence of sequence listing upward to telomere on chrosomal short arm and 5'-terminus of this base sequence : 197122
cagtgccattctgttatttaattcagagtaacctcagctgggtgtggtcgctcatggctataatcctaatgctttgagaggctgaggcaagagggtctcttgaggccaggagttccagaccagcctgggcaacatagcaaaaccctgtctgtacaaagtttgaaaattagttaggtgtggtggtatgtgcctgtattcatagctactcaggaggctgaggcaggattgcttgaacccaagagcttgaggttacagtgagctaagattgagtcattgcactccagcctgggtaacagagccagacattgcctctaaaaaacccaactgtgataataataataataataataataatctttagcaatttaaatatggagataataaaatttattttttccccagattcctctgtaccccaggtaattttttggttaatattcttgaatagaaacataatattctctaggcaaattcttagaa

SEQ ID NO: 14813 - DNA, 453 bp, Homo sapiens
  AL354738.2_25222
  Located on chromosome 9
  Distance between a terminus base of telomere on chromosomal short arm and 5'-terminus of this base sequence : 18631311
  Distance between 3'-terminus of neighbour sequence of sequence listing upward to telomere on chrosomal short arm and 5'-terminus of this base sequence : 228237
tagtattcagtccaactagactcacctcttcatccatcctttattccatccatccatccatccatccatccatccatccatccattaaaccttcatttattcagttatgtaggcaatatttattaaaatcccattgtatttttacaggggatacgaaactgaacaacaccatttatgtttctatgaatcttatagataggaatgcagatagaaaatagttacaaaatgtgttgtaattgaagtatgaaacaaataggaacctgtggaaagaagcttttcaaggagcatgtttatggagaggaagggattaccaaagctttcacagagaaaacaacgtatgtcattttgttaagggctttctggtttcttgtcagaagcgcactggcataggcccagaggtgagaaagtttgtggtgtatcctagagagtgaggatagtctggctaagtacttc

SEQ ID NO: 14814 - DNA, 316 bp, Homo sapiens
  chr9.fa.O7frz.18954233
  Located on chromosome 9
  Distance between a terminus base of telomere on chromosomal short arm and 5'-terminus of this base sequence : 18833612
  Distance between 3'-terminus of neighbour sequence of sequence listing upward to telomere on chrosomal short arm and 5'-terminus of this base sequence : 201848
cacgagataattatcaaggtgatgttttaaaatgaagaagaaaatccacaggctttggttaaagattctgcattatttaggatgtgattcccaaaccttcagggttcccagaagacagaaaagaggccccttgtggtttagaaaagctagagagagagaaagggagaaaaagagagagagagagagagagagagagagaggaaatggaacataaagaatggtaaaggcagctacaaaggcactaatagagcaatcttaggtgtaagtaagaaaagagaacactcctgtgatcaggttctgtaacaagctgaacaga

SEQ ID NO: 14815 - DNA, 145 bp, Homo sapiens
  D9S157
  Located on chromosome 9
  Distance between a terminus base of telomere on chromosomal short arm and 5'-terminus of this base sequence : 18940900
  Distance between 3'-terminus of neighbour sequence of sequence listing upward to telomere on chrosomal short arm and 5'-terminus of this base sequence : 106972
tggggatgcccagataactatatcttgggtgtgtgtgtgtgtgtgtgtgtgtgtgtgtgtgtgtgtgtgtatgtgcatgcacatttatctatttgtgtaagtatgcataactgggtctaccagatgaaatgtggcttgccttgct

SEQ ID NO: 14816 - DNA, 376 bp, Homo sapiens
  AL139115.5_58073
  Located on chromosome 9
  Distance between a terminus base of telomere on chromosomal short arm and 5'-terminus of this base sequence : 19022053
  Distance between 3'-terminus of neighbour sequence of sequence listing upward to telomere on chrosomal short arm and 5'-terminus of this base sequence : 81008
gtagagcatcctaaaggagcttacaactgaagatgaaaactagcatgtgaataattacatgttacatataaagaaaacgtttctcattatattaacataaatattatatatgtgtgtgtatatatagtttaacttatttgtattacacacacacacacacacacacacacacacacacgtttaacctgtattctgtctcccctgttactttgcttattttagaatatggcaatattttaatattttggacagccaaactgacatttattcaatatattgagttcctagtatgttccaggcactgtggaagggtgctgaagacacaaagaggagtaaaaatatgcatccttttcttaaatagttggaagcctagtga

SEQ ID NO: 14817 - DNA, 260 bp, Homo sapiens
  AL139115.5_91962
  Located on chromosome 9
  Distance between a terminus base of telomere on chromosomal short arm and 5'-terminus of this base sequence : 19055936
  Distance between 3'-terminus of neighbour sequence of sequence listing upward to telomere on chrosomal short arm and 5'-terminus of this base sequence : 33507
tcattcgctatatttggtgaactgtctctctcagcagctcaaatgtcagtttttatagagaagaggaaagctctctcttgttcgcattctcattgaggcactcctccctccttcttcctttccctctcttcttccctctctcttttgtgaacacacacacacacacacacacacacacacaccccaaatagttaaagccaatggattgatgatttgaccccgttgtgttatcaagactagttctgaattactaatggcca

SEQ ID NO: 14818 - DNA, 418 bp, Homo sapiens
  AL139115.5_99872
  Located on chromosome 9
  Distance between a terminus base of telomere on chromosomal short arm and 5'-terminus of this base sequence : 19063813
  Distance between 3'-terminus of neighbour sequence of sequence listing upward to telomere on chrosomal short arm and 5'-terminus of this base sequence : 7617
ccatggtcattatcttcatacactcagtcactgggtggagaggggttcaatttttctatccagcccaagtggtagagctagaattaatgagtagaaaccatggggagatagattctggctcaatataagaaaaacttttggctatcaaagctgggtttttggtgtgtgtgtttttgtgtgtgcgtgtgtgtgtgtgtgtgtgtgtgtgtgtgttttgcctcagcaatgactgaattccctatcactgcccatgtttgacccccttgttcccaccgcccatgttggaacacacactgacctgctagttccctcccatcatgtgaggcacaccagtcatctcttgtgagttttgtggttagtaatttgttactaataatgtcactttttaatgatgtcactcttacttggattccagtga

SEQ ID NO: 14819 - DNA, 292 bp, Homo sapiens
  chr9.fa.O7frz.19387942
  Located on chromosome 9
  Distance between a terminus base of telomere on chromosomal short arm and 5'-terminus of this base sequence : 19169757
  Distance between 3'-terminus of neighbour sequence of sequence listing upward to telomere on chrosomal short arm and 5'-terminus of this base sequence : 105526
aagaacataatgctttagactcacatttctgttcaaacagaagcgcctattcacttacaactagaatatcaccagtgtcaaagagcacaaaaatgttcacattgttccaggaagaaatgttacaaatcttttctgatatgtgtatgtgtgtgtgtgtgtgtatatatatatatatatatatcgtactatatctgggtgattgatccaatactggggctttgcagtacctagtatgtttgaattatttgcgtcttttgaggtcataaataactaaattatggacatgttggaa

SEQ ID NO: 14820 - DNA, 231 bp, Homo sapiens
  AL390299.6_70467
  Located on chromosome 9
  Distance between a terminus base of telomere on chromosomal short arm and 5'-terminus of this base sequence : 19198504
  Distance between 3'-terminus of neighbour sequence of sequence listing upward to telomere on chrosomal short arm and 5'-terminus of this base sequence : 28455
gataggctggtgtccttataagaaaaggaagaggcagcatcctctcatctctctctctctctctctctctctctctcgctttgtgcgtgtgtgtgtgtgtgtgtgtgtgtgtgtttgtgtgtctgtctctctccatgcaggaagagagaagaatccatgtgaggacacagtgagagggcagccttcaacaagccagaaaaagaggcctgctatggtctgaatgttcatgtc

SEQ ID NO: 14821 - DNA, 185 bp, Homo sapiens
  chr9.fa.O7frz.19459756
  Located on chromosome 9
  Distance between a terminus base of telomere on chromosomal short arm and 5'-terminus of this base sequence : 19306558
  Distance between 3'-terminus of neighbour sequence of sequence listing upward to telomere on chrosomal short arm and 5'-terminus of this base sequence : 107823
cctcagtaatacagattgtgcttcccctcattacagattattgctccacctcggcagacagaatctcattgtgtgtgtgtgtgtgtgtgtgtgtgtgtgtttctatatagtccacaggggtgatcctcaagatgtttaaccacttgtgcatcaaaggccctgactaatctgaacagtcattctgg

SEQ ID NO: 14822 - DNA, 292 bp, Homo sapiens
  AL353134.11_128534
  Located on chromosome 9
  Distance between a terminus base of telomere on chromosomal short arm and 5'-terminus of this base sequence : 19403479
  Distance between 3'-terminus of neighbour sequence of sequence listing upward to telomere on chrosomal short arm and 5'-terminus of this base sequence : 96736
gaacactgttcatgtagcttctctctcacttgctttcgcaggttctcctcaatggtaccttctccattaagcttttctctccaacttgaaagaatctttagttaaataagtagtgtgtgtgtgtatatgcatgtgtgtgtgtgtgtgtgtgtgtgtgtacctaacttcaaatcagccaattactggatataaattggtagtcaaccattagccccacggtactgttttttgtttgttttttgttcttggtatcactgacacaatttttcactttaagccaagttccttacat

SEQ ID NO: 14823 - DNA, 180 bp, Homo sapiens
  D9S925
  Located on chromosome 9
  Distance between a terminus base of telomere on chromosomal short arm and 5'-terminus of this base sequence : 19601601
  Distance between 3'-terminus of neighbour sequence of sequence listing upward to telomere on chrosomal short arm and 5'-terminus of this base sequence : 197830
gtctgggttctccaaagaaatagaaccaaaaagatatatacctaatacatatcttattggtgtatatatatgtctgtctatctatctatctatctatctatctatctatctatctacctacctatctatctatagagagatatggatatagatataattactataaggccttggctcaca

SEQ ID NO: 14824 - DNA, 462 bp, Homo sapiens
  AL445674.10_105092
  Located on chromosome 9
  Distance between a terminus base of telomere on chromosomal short arm and 5'-terminus of this base sequence : 19798684
  Distance between 3'-terminus of neighbour sequence of sequence listing upward to telomere on chrosomal short arm and 5'-terminus of this base sequence : 196903
  misc_feature (1)...(462): n = A,T,G or C
acaggcctatagtcctcactacttgggatgctaaggcaggaaggtcaattgaacctagaagttcaaggcnttcagtgagctatgatntgtgctagtgtatccagcttgggggacacagtgagaccctgtnctttaaaaaaaaaaaaaaaaaaaaaaaaggctatcatctgcagcctaaaaaattttatgcagctactcaatacacaataaaacacacacacacacacacacacacacacacacaactttcctacttcattttgcactactttctagaaggtattaaaatgaatcaataanaattgacatataaccaaagtcaggatgcaagggaaaagctccatgatcagagagatatggtaacaagaatgaatctaagtaaatgaagatttagaacaaactgctgnactagcttcatagaaaaagaaagtgctattgtccattaattcatgnttctaagaa

SEQ ID NO: 14825 - DNA, 480 bp, Homo sapiens
  chr9.fa.O7frz.20059945
  Located on chromosome 9
  Distance between a terminus base of telomere on chromosomal short arm and 5'-terminus of this base sequence : 19842970
  Distance between 3'-terminus of neighbour sequence of sequence listing upward to telomere on chrosomal short arm and 5'-terminus of this base sequence : 43824
  misc_feature (1)...(480): n = A,T,G or C
acaaacttaaggattgaaggagctgataaatttctttagttcctctgtctgctttacatatatatatatatatatatatatatatatatatatatatatatatataaaattattattttctttttttcttttttgagacaaagtcttgctctgtcacccagactggagtgcagtagcatgatctcggctcactgcaacctccgcctcccgggttcaagcgattctcttgactctcagcctcccaagtagctgggattacagacgcgtgtcaccatttctggctgatttttatatttttttgtagagacagggtttcaccctgtntggctggtgaaccaggctggtctcgaactcctgacctcaagtgatctacccgcctcggcctctgaaagtgctgggattacaggcatgagccaccgcacctggctactttacctttattttaaagtcttcattttagaatactgtatgccatagctt

SEQ ID NO: 14826 - DNA, 321 bp, Homo sapiens
  chr9.fa.O7frz.20164946
  Located on chromosome 9
  Distance between a terminus base of telomere on chromosomal short arm and 5'-terminus of this base sequence : 20003409
  Distance between 3'-terminus of neighbour sequence of sequence listing upward to telomere on chrosomal short arm and 5'-terminus of this base sequence : 159959
tgtataacatcctaaggccaggttttaaaagttcaagtacaggttttaaaagttcaaaggagtagtcagtttaataaccgcaccccatagcaactgattgataaaggatcccattactacaaaataaaaattagcactctgctccggcactagttctaggtgggctaagttcattttgctgatcttcctatataatatgtgcatgcatgtgtgtgtgtgtgtgtgtgtgtgtgcagtagcatggttataatattaccccaatttgtaaaaagggaaattggggcataggaaggtggtaagttacttgttcaaggactcgta

SEQ ID NO: 14827 - DNA, 269 bp, Homo sapiens
  AL359640.6_53997
  Located on chromosome 9
  Distance between a terminus base of telomere on chromosomal short arm and 5'-terminus of this base sequence : 20048996
  Distance between 3'-terminus of neighbour sequence of sequence listing upward to telomere on chrosomal short arm and 5'-terminus of this base sequence : 45266
tgtcctgatctacaaagatgagcattaactacccatggactttcactaacataactactacaggctacatttgaggaagaaaaatataggaaaggtgggcaaaaagcaaaacaatggtgatccccaaaggggtatgagagtgtgtatatgtatgtatgtatgtatgcatgttacatggcttctcttcaataatatttctggtattcttttcctaatgagtgtctgggactattgaacttccccaaccctttgaagttagacatgaccac

SEQ ID NO: 14828 - DNA, 314 bp, Homo sapiens
  chr9.fa.O7frz.20277243
  Located on chromosome 9
  Distance between a terminus base of telomere on chromosomal short arm and 5'-terminus of this base sequence : 20167195
  Distance between 3'-terminus of neighbour sequence of sequence listing upward to telomere on chrosomal short arm and 5'-terminus of this base sequence : 117930
ttcttatcatctgtcagaaggtagaaaaaaataggatggttcactcaaaaaacagaaaaggttaaaggctgttcatttcattcttgtgtgaagaactgtgggattttgagcatgcccaaaaggcagcatcccttttcttatacattgttactgaaggttaatacacacacaggcacacacacacacacacacacacacacacacacatcatgaaaattttctcacacaaatgaatataaaaaacttatttacacaaataaatacagaaaatttagtcatgtaaaataaataagttagtactccaatgaccttcc

SEQ ID NO: 14829 - DNA, 446 bp, Homo sapiens
  AL353895.2_112859
  Located on chromosome 9
  Distance between a terminus base of telomere on chromosomal short arm and 5'-terminus of this base sequence : 20210298
  Distance between 3'-terminus of neighbour sequence of sequence listing upward to telomere on chrosomal short arm and 5'-terminus of this base sequence : 42789
ctaatgccagatgacaagttagtgggtacagcgcaccagcatggcacatgtatacctatgtaactaacctgcacattgtgcacatgtaccctaaaacttaaagtataataataataataataataataaataaaataaaataaaataaaaattttaaaaaaataaaaaataaagaaatttgaaaagtctgcccatttccttcccaacagatattaaaggcaatctgttgaagacattatactgaaaggactatcatattttaaagacaagatcactgtctccataggtttttgaaacatttttaaaaactatatagctgtattaattagagcacttattttctacaataatagtgaccttaaatttctttaaaaaaattacaataagctacaagtatcaaagaagcaaagtcatctagagtagtctacataggagctctttggact

SEQ ID NO: 14830 - DNA, 161 bp, Homo sapiens
  Z66682
  Located on chromosome 9
  Distance between a terminus base of telomere on chromosomal short arm and 5'-terminus of this base sequence : 20232989
  Distance between 3'-terminus of neighbour sequence of sequence listing upward to telomere on chrosomal short arm and 5'-terminus of this base sequence : 22245
cacaggggtgtgtatgtgtatgtatcacgcatatgcatgtgtatcaatgcctgtgtgtatatgtgtgtacatgtctactatctgtgtgtgtgtgtgtgtgtgtgtgtgtgtgtgtctccccagccctgagggaattaatcacccctgcatcaatagctagc

SEQ ID NO: 14831 - DNA, 239 bp, Homo sapiens
  chr9.fa.O7frz.20650324
  Located on chromosome 9
  Distance between a terminus base of telomere on chromosomal short arm and 5'-terminus of this base sequence : 20321722
  Distance between 3'-terminus of neighbour sequence of sequence listing upward to telomere on chrosomal short arm and 5'-terminus of this base sequence : 88572
aatgacctaattagtgaatgacagaggcatggctcaaactgagggttcctgaacccaggcatgatgtttttctctatgccatatgaaaaggattcttttgaaagtatatttatatatatatatatatatatatatatatatataaaatgtgtgtgtgtgtatatatatatatgtacacacacacacatatgtaatctctagttcatcattgttttctctatacaatggtctttgtcagt

SEQ ID NO: 14832 - DNA, 152 bp, Homo sapiens
  chr9.fa.O7frz.20559358
  Located on chromosome 9
  Distance between a terminus base of telomere on chromosomal short arm and 5'-terminus of this base sequence : 20412737
  Distance between 3'-terminus of neighbour sequence of sequence listing upward to telomere on chrosomal short arm and 5'-terminus of this base sequence : 90776
tattgaatagatctggatgctaactctatattaggtacagtggaagatcatacacaaacacacacacacacacacacacacacacacacacacacggttactgttcctaaagttttttcaacctatttcttaggtcatacacctgtaaactg

SEQ ID NO: 14833 - DNA, 403 bp, Homo sapiens
  chr9.fa.O7frz.20482032
  Located on chromosome 9
  Distance between a terminus base of telomere on chromosomal short arm and 5'-terminus of this base sequence : 20482669
  Distance between 3'-terminus of neighbour sequence of sequence listing upward to telomere on chrosomal short arm and 5'-terminus of this base sequence : 69780
cagatgaccaattcatacagagcatgagctaaaggaaatttacttttttagccattatgcacacacacacacacacacacacacccatctcgtgatacttcattcttcaaatgtttagtactttcaggcttttaaaaaaaaataaacaactcataagttatataatcactaaaagagctaagaagtggaacatcaaattcacttcagaccatgttgaaataaagtctttaatctgaactgtgtcactccaagtgggttctcagcatgtaggtagcaggcagcttttcatggtgtacaacttgagggacatgataagctgtttacctgtccaagaggaacttcaacatcatgagtgaagtggccaacatttcagccattgctcttacagattgtaacctttgag

SEQ ID NO: 14834 - DNA, 417 bp, Homo sapiens
  chr9.fa.O7frz.20731589
  Located on chromosome 9
  Distance between a terminus base of telomere on chromosomal short arm and 5'-terminus of this base sequence : 20638766
  Distance between 3'-terminus of neighbour sequence of sequence listing upward to telomere on chrosomal short arm and 5'-terminus of this base sequence : 155694
gtagtggcatgcacttgtaatcccagctactcgggaggctgaggtgggagaatcccttgagcctgagaggcggaggttgcagtgaactgagatcaggccactgcactccagtctgggtgagagagtgagactgtgtcacaaaagaaaaaaaaaaaaacaaaacacacacacacacacacacacacacacacacaaagaatctaggtctctatctcctttctccaagcaacatgtatccctgaaacacaaggactactctctggaactgcttagtggctggtgcactgagtgggtatgcccaaaacgcacatggttttacttgcatgagggagtcgaagtttaacttgcaggtttcccagtaattgtttacaaaagggtttctcctcaagccaccactacagaatatccttgctaggc

SEQ ID NO: 14835 - DNA, 448 bp, Homo sapiens
  AL391834.3_173252
  Located on chromosome 9
  Distance between a terminus base of telomere on chromosomal short arm and 5'-terminus of this base sequence : 20876861
  Distance between 3'-terminus of neighbour sequence of sequence listing upward to telomere on chrosomal short arm and 5'-terminus of this base sequence : 237678
taacatctggttctgctttaaccatagccagtgtctcatttgtaatctgttctgtatactttctatatgctacatttttagggatttgctcaagaacataaaaaaatctttgtatacaatattcttagcctctcctgtggactctcgcatacagccaatcccacaaggccagtggtctctcttcagcacacccgtcatgactctggctaattgagaaaaaaaaaaaaagatttgtgtgtgtgtgtgtgtgtgtgtgtgtgtgtgtgtgtgtgcgtgcgcgtgtgtgtgtagagataagggctccatatgttgcccaggctggtcttgaattcctggccttgagtgatcctcctgcctcagcctcccaaagcatttgtccattttaaaatcgggttttttaatatatattcaggagactaaactcttattagatacgtgatgtgcaaat

SEQ ID NO: 14836 - DNA, 189 bp, Homo sapiens
  AL158206.8_55584
  Located on chromosome 9
  Distance between a terminus base of telomere on chromosomal short arm and 5'-terminus of this base sequence : 20981820
  Distance between 3'-terminus of neighbour sequence of sequence listing upward to telomere on chrosomal short arm and 5'-terminus of this base sequence : 104511
taatatgccagccttcagataggcctggtgatctcttcccattgtatttccccactgtgtgtgtgtgtgtgtgtgtgtgtgtgtgtgtgtgactgtgtatccaagacccaagataactggctggagctgtgggttcagcctgcaaccatggagcaagagggatccccctgatggagatcaaactgatgt

SEQ ID NO: 14837 - DNA, 231 bp, Homo sapiens
  AL158206.8_80034
  Located on chromosome 9
  Distance between a terminus base of telomere on chromosomal short arm and 5'-terminus of this base sequence : 21006243
  Distance between 3'-terminus of neighbour sequence of sequence listing upward to telomere on chrosomal short arm and 5'-terminus of this base sequence : 24234
gctttagaatcctgaatgtgatagggtcagagggtgatgatgtaagtcatattatatgtgtacatatagatctggtataaagatatatatatatatatatatatgtatatatatatatatgtatatatttatatatgtatatacacaggcatgcaggaaacgagttagagatgacctgttttggaaaccacggtgtggaaagttcttataattatgccaatgatttgaatg

SEQ ID NO: 14838 - DNA, 183 bp, Homo sapiens
  AL158206.8_84791
  Located on chromosome 9
  Distance between a terminus base of telomere on chromosomal short arm and 5'-terminus of this base sequence : 21010982
  Distance between 3'-terminus of neighbour sequence of sequence listing upward to telomere on chrosomal short arm and 5'-terminus of this base sequence : 4508
ggtgatggcaaactgagagccattgacagggacttggcctgggaaactcttttcccatcccttgtgaagaaagaccaaaacccattttattcttattaaaacacacacacacacacacacacacacacacacacacacacacacacactctcacacttctagtgaagttgagtttaatcgcac

SEQ ID NO: 14839 - DNA, 354 bp, Homo sapiens
  AL158206.8_127797
  Located on chromosome 9
  Distance between a terminus base of telomere on chromosomal short arm and 5'-terminus of this base sequence : 21053985
  Distance between 3'-terminus of neighbour sequence of sequence listing upward to telomere on chrosomal short arm and 5'-terminus of this base sequence : 42820
cattctttattgagccatagaaagatctctatctttgttcttttaatttctcaatgtctttgcatttgtgtgtgtgtgtgtgtgtatatatatatatatatatagagagagagagagagagagagagagagagacagagtcttactctgtcacccaggtgggagtgcagtggcatgatcttggctcactgcaacctccgcctcccaggtttgaggaattctctttcctcagcctcccgagtagctgggattacaggtgccagccaccacacctggctaatttttttttgtatttttagtagaggtgggtttttaccatgttggccaggctggtcttgaactcttgacctcaagt

SEQ ID NO: 14840 - DNA, 437 bp, Homo sapiens
  AL158206.8_140410
  Located on chromosome 9
  Distance between a terminus base of telomere on chromosomal short arm and 5'-terminus of this base sequence : 21066563
  Distance between 3'-terminus of neighbour sequence of sequence listing upward to telomere on chrosomal short arm and 5'-terminus of this base sequence : 12224
tttgtacaggttctgaagcatcactggatggtgtcatttcaacatctgtgctggtgctgtttggaagctcaattttttctgtgatataatttaaacacacacacacacacacacacacacacacacacacacacacacagagagagagagagagagagagagaaagcaaatggaatcaatgggggtaaagagcaatattgaaaagagtttcctaaaatgttgggctaaagcagaggatagtggtgtcccaggggcgataaggcccagggctgatattgagccaagcgggaaaggatttttaccgttcttccccatgtctttcagtatacggcctgcccccttaatagcgccctggcttcctgctctggcatgacactttaccttgggtgccctatcagctcccatgatatgcctttcttgagcctaggcaaatttac

SEQ ID NO: 14841 - DNA, 274 bp, Homo sapiens
  AL158206.8_159376
  Located on chromosome 9
  Distance between a terminus base of telomere on chromosomal short arm and 5'-terminus of this base sequence : 21085491
  Distance between 3'-terminus of neighbour sequence of sequence listing upward to telomere on chrosomal short arm and 5'-terminus of this base sequence : 18491
ttatacaaatgaacaaggattgactttttaaatagtggtgaaattatttttctggaaatgtctttggttaaatggcagagagtttaggacaatacaatggagacagctttccccacatattgcttcattgcaagatattagttgggatatctaccgacctacctacctacctacccacctacctacctacctacctacctacctacctacctacctacctacctatctacctatctacctacatgtctctgtgaaacatttacctttgaagagc

SEQ ID NO: 14842 - DNA, 259 bp, Homo sapiens
  D9S1684
  Located on chromosome 9
  Distance between a terminus base of telomere on chromosomal short arm and 5'-terminus of this base sequence : 21108984
  Distance between 3'-terminus of neighbour sequence of sequence listing upward to telomere on chrosomal short arm and 5'-terminus of this base sequence : 23219
cccaactctgagacaacctagattcactttcccttatctcacaaaaacaaaacataacctcttctccaaacagaaaaaacaaaaacaagccctaccagaaactgaattcttccaaacaaaaaccaggaacatttagattattgagacctgtgggcaaggacatgaccacattcacaggcgtgcacacacacacacacacacacacacacacacacacacacacacagttgcatatgattaaacatctctagaaggagct

SEQ ID NO: 14843 - DNA, 242 bp, Homo sapiens
  AL133281.11_50515
  Located on chromosome 9
  Distance between a terminus base of telomere on chromosomal short arm and 5'-terminus of this base sequence : 21140157
  Distance between 3'-terminus of neighbour sequence of sequence listing upward to telomere on chrosomal short arm and 5'-terminus of this base sequence : 30914
cattttcatgaatcattccaagattttcccagataaaattaatttcctttctctctctctttccacacacacacacacgcgcgcacacacacacacacacacacacacacacacacacacacacagagtctccctgtactgtaggagggttcatagccttctttgattatcaatgtatttttatttctgtttccctactaggttgtgaactcttccttgacaaggagtctcagacatctatg

SEQ ID NO: 14844 - DNA, 335 bp, Homo sapiens
  AL133281.11_54269
  Located on chromosome 9
  Distance between a terminus base of telomere on chromosomal short arm and 5'-terminus of this base sequence : 21143928
  Distance between 3'-terminus of neighbour sequence of sequence listing upward to telomere on chrosomal short arm and 5'-terminus of this base sequence : 3529
aacagcaactaggattcacaaccgaaataaaaattaattcacaggcattgtaaacatcagcttctagtgtgtgtgtgtgtgtgtgtgtgtgtgtttgtgtgtgtatgccagcatcaaatagctgtctataaagtcacttctgttggcagggttgaaatgcttctgaagtggagaagtatgtctttagcttacatttgaagagatctcatagttaagtggtcaacttgtattgataagacatctatactcctcacagataaataatgtgccaccttataaaatttgaaaactggaaaattagtaccttttcagaaacaagctcagatgtagaccta

SEQ ID NO: 14845 - DNA, 359 bp, Homo sapiens
  AL133281.11_83285
  Located on chromosome 9
  Distance between a terminus base of telomere on chromosomal short arm and 5'-terminus of this base sequence : 21172812
  Distance between 3'-terminus of neighbour sequence of sequence listing upward to telomere on chrosomal short arm and 5'-terminus of this base sequence : 28549
tgctctttctgcttaaactgagacatttgtcttctcctgccattggtcattgatgctcctggttcttgggccttcagatctggaatgaatcacaccactggctttcttcgttctccatcttgcagatggcaaaactgggatctctcagcttccacaatcacaatagctaattcccacaacaaatctcctcacatatactgtgtgtgtgtgtgtgtgtgtgtgtgtgtgtgtgtgtgtgtgtgtctgtgtctatgtgtgtatgtattctattggttctgtttctctggagaaccctaaccacataaatggttgccattcttattaccacagaaaggaaccttaactggtcattgcaaatg

SEQ ID NO: 14846 - DNA, 186 bp, Homo sapiens
  D9S162
  Located on chromosome 9
  Distance between a terminus base of telomere on chromosomal short arm and 5'-terminus of this base sequence : 21172980
  Distance between 3'-terminus of neighbour sequence of sequence listing upward to telomere on chrosomal short arm and 5'-terminus of this base sequence : -191
aattcccacaacaaatctcctcacatatactgtgtgtgtgtgtgtgtgtgtgtgtgtgtgtgtgtgtgtgtgtgtctgtgtctatgtgtgtatgtattctattggttctgtttctctggagaaccctaaccacataaatggttgccattcttattaccacagaaaggaaccttaactggtcattgc

SEQ ID NO: 14847 - DNA, 349 bp, Homo sapiens
  AL133281.11_84298
  Located on chromosome 9
  Distance between a terminus base of telomere on chromosomal short arm and 5'-terminus of this base sequence : 21173977
  Distance between 3'-terminus of neighbour sequence of sequence listing upward to telomere on chrosomal short arm and 5'-terminus of this base sequence : 811
gatcagacatttatgctgactttaaactcaaaatatataccagagttgtgtgtgtgtgtgtgtgtgtgtgtgtgtgtgtgtcacaatgcactcagaatctgaccacttctggaggcctctactattaccacctgcccgataagtgcaatagcctctggcttattggtctccctgccctgtctgccttcatcccagcttgttctcaacacagcagccagagtgaccctgcacaaaatgttgtcagaatatatttctcctccactgaaagccttccaaatggccccctatctcagagcagaagtcaatgcccttatagagagactccagatctacaactacctgcttccaa

SEQ ID NO: 14848 - DNA, 339 bp, Homo sapiens
  AL133281.11_134963
  Located on chromosome 9
  Distance between a terminus base of telomere on chromosomal short arm and 5'-terminus of this base sequence : 21224479
  Distance between 3'-terminus of neighbour sequence of sequence listing upward to telomere on chrosomal short arm and 5'-terminus of this base sequence : 50153
tacataatgctatggactgaatgtttgtgtaccaaccccacccacattcaaatgttgaagctctaacccccaatgtaactgtatttgaagatagtataaagaagtaatttaagttaaatacaatcataagggtggggctttgatctaatatttgtgtccctataaaaagagacacttaagaacacttgtttctctctctctctctctccgtgtgtgtgtgtgtgtgtgtgtgtgtgcatgtgtgcacatgcacacaggctatacaagaaaacagcaagaagttgaacatctatgagctagaagaaaccaaatcagtggataccttgatcttggacttcc

SEQ ID NO: 14849 - DNA, 276 bp, Homo sapiens
  AL158077.7_110650
  Located on chromosome 9
  Distance between a terminus base of telomere on chromosomal short arm and 5'-terminus of this base sequence : 21316286
  Distance between 3'-terminus of neighbour sequence of sequence listing upward to telomere on chrosomal short arm and 5'-terminus of this base sequence : 91468
agcttggttgagctacttaatccttgtaagtatgggctatcttagcagaacacaggtaagataatggtatttagatccccctatatgttttttatttttacataatttcagatttacagaaaagttgcaagaatagtgcaaagaatttatgaataccctcacccaggttccctgtattaacattgtgtgtgtgtgtgtgtgtgtgtgtgtgtgtattcacaaacacataattttgaaccctttaagaaaaagttataggcgtgatattcctttact

SEQ ID NO: 14850 - DNA, 301 bp, Homo sapiens
  AL390784.4_44541
  Located on chromosome 9
  Distance between a terminus base of telomere on chromosomal short arm and 5'-terminus of this base sequence : 21411174
  Distance between 3'-terminus of neighbour sequence of sequence listing upward to telomere on chrosomal short arm and 5'-terminus of this base sequence : 94612
cttgtattaaggaagcatccttctattcctggtttactaaattgtttttttaaatacaaaatttgagttgaactttattacaatcttgtcattatccttcgaaataatcatatttttcttcttctaacaactgacattatgtgtgtgtgtgtgtgtgtgtgtgtgtgtgtatacatacacatatatgtatttcctaatataaaccatctttacattcctgggaactattttatttggttgtagtatagcgtttatttaagttggtgctgaattttatttgctagtatttagcacttctcat

SEQ ID NO: 14851 - DNA, 478 bp, Homo sapiens
  chr9.fa.O7frz.21641605
  Located on chromosome 9
  Distance between a terminus base of telomere on chromosomal short arm and 5'-terminus of this base sequence : 21444101
  Distance between 3'-terminus of neighbour sequence of sequence listing upward to telomere on chrosomal short arm and 5'-terminus of this base sequence : 32626
catctgacatcaaaggttctaccaactgtagagctgggatgttctccagttaagttctctggatgatcttacacattgctgaagagcaggtaaggggctcctccatcaggcctttgatgagttcccgccaggaagtatcacttcatcattaagaggtttggccataatgggaacttacttcatagaacttttggggaagtgtccaaatcttccaccaatttctttaagattgtattgttgtttttcttaagttgtgtgtgtgtgtgtgtgtgtgtgtgtgtgtgtgtgttttaacatattctggatatttttttcaaacctgtgacttagcttctcattttcttaacagtgtctttagaagaggaaaagttttttatttttacaaagtccaacttaccaattgtttcttttatggcttagtgttcgtacgtatatatgttctaagaaatatttgcttaacctaatgtcacaaaggata

SEQ ID NO: 14852 - DNA, 463 bp, Homo sapiens
  chr9.fa.O7frz.21560308
  Located on chromosome 9
  Distance between a terminus base of telomere on chromosomal short arm and 5'-terminus of this base sequence : 21469969
  Distance between 3'-terminus of neighbour sequence of sequence listing upward to telomere on chrosomal short arm and 5'-terminus of this base sequence : 25390
caactgtactctttcaggacatgctcattggttccagtattctgctatttgtctgttgatttcaatacaactctgaatgaaagatgctcagatccctgagccctagtctggaagatacagcaacaataaatgtttgtgaaaatgaaaaaagaaaataaacatagtgaacatattttaaaaagtgcaataaagatcagcaaagtccaactacagtcacaacaaaggctggccatgtcaggaaaaaatatatgcaatatgtattttttacacataaaataagtttttgtgacatctttgaacgtagattcaaacaaaacatttctatatttgtgtgtgtgtgtgtgtgtgtgtgtgtgtgtgtgtatgagagacagagaaagagagaattataaattgcatcaggcaaaatggaaattggtgattctggataaagggtacatgttagctccttgtactgctttag

SEQ ID NO: 14853 - DNA, 385 bp, Homo sapiens
  chr9.fa.O7frz.21713046
  Located on chromosome 9
  Distance between a terminus base of telomere on chromosomal short arm and 5'-terminus of this base sequence : 21605843
  Distance between 3'-terminus of neighbour sequence of sequence listing upward to telomere on chrosomal short arm and 5'-terminus of this base sequence : 135411
atgaagcactgatacatgctacaacatggatgaaccttgaaaagatgctaagcaaaagaagccaggcaaaaaaagaccacaagttttgtgaattgatttacatgaaatatccaaaataggcaaatccatggagacagaaagtagattaatgactgccaaggattagagatggggaggagaataagagacactgcttgaagagtgaaaggcttcctttggtattcaggaaaatgttcaggaactatgtaaaggaaatgcttgcacagcattgggaatgtgctaaatgtaactaatggtaaattttatattatgtataatttactacacacacacacacacacacacacacacacacacacagaggttaagatttcctagaaggtag

SEQ ID NO: 14854 - DNA, 430 bp, Homo sapiens
  chr9.fa.O7frz.21907188
  Located on chromosome 9
  Distance between a terminus base of telomere on chromosomal short arm and 5'-terminus of this base sequence : 21757294
  Distance between 3'-terminus of neighbour sequence of sequence listing upward to telomere on chrosomal short arm and 5'-terminus of this base sequence : 151066
gacgtcagcactctaaattctctgactttgggctctgggactcataccagcagcccatgggcctttcagcctttggcctctgactaataatttcaccatgaagccacgctattggcttttctggttcgccagcttgcagatggtctgtcacgggtgttctcagcctccattatcttgtaagccaattccctaatgaatctcctctcatttatctatctatctatctatctatctatctatctatctatctatctatctaccttatctatctatctatctgtctatctatctatctatctaatgtctatctatccatccatccatccatccatccatccatccatgctacagattgtgtctctctggaaagccctaactaaaacattaagttaaaggctctgagaaggggagagtatgctggattatctgg

SEQ ID NO: 14855 - DNA, 233 bp, Homo sapiens
  AL355153.3_8123
  Located on chromosome 9
  Distance between a terminus base of telomere on chromosomal short arm and 5'-terminus of this base sequence : 21838746
  Distance between 3'-terminus of neighbour sequence of sequence listing upward to telomere on chrosomal short arm and 5'-terminus of this base sequence : 81022
agatgttaataggtgcttagcacccagggaatacattccaacaaatgaagagttatacattctatgccacacatcccatcccctagggctggggtggcgagagacaagaaggttcatacacacacacagacacacacacacacacacacacacacacacacacacacacacacacactcctaccctctgattggttctgtgcagaatagagactcacatttaaatgaataagc

SEQ ID NO: 14856 - DNA, 192 bp, Homo sapiens
  AC000007.8_7187
  Located on chromosome 9
  Distance between a terminus base of telomere on chromosomal short arm and 5'-terminus of this base sequence : 21856607
  Distance between 3'-terminus of neighbour sequence of sequence listing upward to telomere on chrosomal short arm and 5'-terminus of this base sequence : 17628
ggagttagtccttccaagtatgttctcaactctttattaatcgtgaaaattcagattcatactctttctctatccctgtctctctccccctacttttctccctccctcctgcgcacacacacacacacacacacacacacacacacattcaaatacgactaaaaagtcattccagagtgaaatttagttgac

SEQ ID NO: 14857 - DNA, 244 bp, Homo sapiens
  D9S1778
  Located on chromosome 9
  Distance between a terminus base of telomere on chromosomal short arm and 5'-terminus of this base sequence : 21856613
  Distance between 3'-terminus of neighbour sequence of sequence listing upward to telomere on chrosomal short arm and 5'-terminus of this base sequence : -186
agtccttccaagtatgttctcaactctttattaatcgtgaaaattcagattcatactctttctctatccctgtctctctccccctacttttctccctccctcctgcgcacacacacacacacacacacacacacacacacattcaaatacgactaaaaagtcattccagagtgaaatttagttgacttttagatttttaagaaatttttactctcttataccatcaacatagagaattaagata

SEQ ID NO: 14858 - DNA, 361 bp, Homo sapiens
  AC002052.8_33122
  Located on chromosome 9
  Distance between a terminus base of telomere on chromosomal short arm and 5'-terminus of this base sequence : 21989512
  Distance between 3'-terminus of neighbour sequence of sequence listing upward to telomere on chrosomal short arm and 5'-terminus of this base sequence : 132655
tttaggtgcaaaggtagtctttattttatgtatatatctaaaaatgatctttcatatatagagggagactatatcatatctacttttaattcagagccacatgttagccaactactgaatttgtggaattatggcatattatgataaagctgccaaaaatactgggttaaggaaaaattgatttggcatgatgccattggcaggaggaattaaaaagtgacatgtctttctctttttaggtggagataaataaatatatgtgtgcatatgctgtgtgtgtgtgtgtgtgtgtgtgtgtgtgtgtgtgtatcaaacttaataaaacattgttacaagagcctggcagtaggagatttgataa

SEQ ID NO: 14859 - DNA, 155 bp, Homo sapiens
  DISO7_10018766
  Located on chromosome 9
  Distance between a terminus base of telomere on chromosomal short arm and 5'-terminus of this base sequence : 22051495
  Distance between 3'-terminus of neighbour sequence of sequence listing upward to telomere on chrosomal short arm and 5'-terminus of this base sequence : 61622
gaggcttgagtttgagttacagttaaatgatttcttcttctgttttcttgagggttttgaactcatttcacatccattttctctcatttacacacacacacacacacacacacacatatacacacacagcgagagagagtgagcaggagactctt

SEQ ID NO: 14860 - DNA, 311 bp, Homo sapiens
  DISO7_00022105
  Located on chromosome 9
  Distance between a terminus base of telomere on chromosomal short arm and 5'-terminus of this base sequence : 22182035
  Distance between 3'-terminus of neighbour sequence of sequence listing upward to telomere on chrosomal short arm and 5'-terminus of this base sequence : 130385
accatctgtttcttgctgggaccctgactgatagagtaggccttatccagaaggtaacatctcagcaaagacttgaatgatctgatggaatgagtcacaaagatatctggggagaaatgccaagatcttgcagcagccaggaggccgggtgagtgagctgggcaggagtgtagaagacaaggtcaaaggggcaacagacagtctgtgtatgtgtgtgtgtgtgtgtgtgtgtgtgtgtgtgtgtgtgtgtgtgtgtgtgttggggatggaggtgtgtggtgcaggggagggagatcatgtatggccctgtt

SEQ ID NO: 14861 - DNA, 192 bp, Homo sapiens
  DISO7_00022107
  Located on chromosome 9
  Distance between a terminus base of telomere on chromosomal short arm and 5'-terminus of this base sequence : 22249404
  Distance between 3'-terminus of neighbour sequence of sequence listing upward to telomere on chrosomal short arm and 5'-terminus of this base sequence : 67058
catggtcctgctttaccacctgccttccccatccttttgcatgcttgcctgcctgcctgcctgcctgcctgcctgccttccttccttccttccttccttccttccttccttccttccttccttccttccttccttccttcctctctctttctctctttcacttttcttttcttgtgagcccagtaggaatga

SEQ ID NO: 14862 - DNA, 455 bp, Homo sapiens
  AL392163.5_50978
  Located on chromosome 9
  Distance between a terminus base of telomere on chromosomal short arm and 5'-terminus of this base sequence : 22399731
  Distance between 3'-terminus of neighbour sequence of sequence listing upward to telomere on chrosomal short arm and 5'-terminus of this base sequence : 150135
ctcactgactcaatcagtttctacttattagaatatgcatattggtttttaaagtatttttaatgcatgagacacatttgatgctcaaaaatcagaaaatatggattagcagaattagaagcaaaaatttacccatatgtcactatccagatataactctgataataatttgccatatataatttcatgcatttttctgaacatctctgtatgtctatgggtatttttagaaatgagattgtactgaacatatttagtagaacctgattcttctcctcttgatatattttatgcatcttttcctcgatatatatatatatatatatatatgacacgtggtatatcattgtacatgccatgtattgtccatttactagtcctttattgatggatattttattagattgtttccaattttttactgtcatctacagtgctacagtgatcagctttag

SEQ ID NO: 14863 - DNA, 296 bp, Homo sapiens
  chr9.fa.O7frz.22683755
  Located on chromosome 9
  Distance between a terminus base of telomere on chromosomal short arm and 5'-terminus of this base sequence : 22467628
  Distance between 3'-terminus of neighbour sequence of sequence listing upward to telomere on chrosomal short arm and 5'-terminus of this base sequence : 67442
taagattagcaggtttaacctctatatgtgagcctgaaggggaaatgacagaagagctgataggtgtattccctagataggagatagagagctttatttataaattatacatacacacacacacacacacacacacacacacacacacacacacacgttctaaaacaatgtggaaacagtttgctttttcccttttctacctgtaactgattattttatatgcttttgaatgaaaaattctttttttcccactctgttcattgctttcctacctcacatgtagtcaaggattactt

SEQ ID NO: 14864 - DNA, 431 bp, Homo sapiens
  AL392163.5_151445
  Located on chromosome 9
  Distance between a terminus base of telomere on chromosomal short arm and 5'-terminus of this base sequence : 22500334
  Distance between 3'-terminus of neighbour sequence of sequence listing upward to telomere on chrosomal short arm and 5'-terminus of this base sequence : 32410
gatttataaggccttaagcaagcagtttttttttctcccctctgatgttttattattcaacttctgccttagaaaccacttatatttttcatgccatatcaaccagtgctagaagttgaattttctactttgtcttaacagcattcttataagggaggttttttatcacgaaaaaaggaggtagcagagaggggatgactaaatttgatgtgcaaaaattgagactcagatagattgggtgacttgcccaaagttactacgctagtaaatggtcaatttgggacatattcccaaatcttggctccattcccaccattgttttttacccatattttatttattcattcattcattcattcattcattcattcattcattcatcaacatattaagttcccacactagtgctatgaggcaggtattagtattcc

SEQ ID NO: 14865 - DNA, 409 bp, Homo sapiens
  AL357615.4_52699
  Located on chromosome 9
  Distance between a terminus base of telomere on chromosomal short arm and 5'-terminus of this base sequence : 22696729
  Distance between 3'-terminus of neighbour sequence of sequence listing upward to telomere on chrosomal short arm and 5'-terminus of this base sequence : 195964
gtaaccttttatcaaggtccttagcttctttgcattgggttaaaacatgcttcttcggctcagagaagtttgttattacccaccttctgaagccaacttctgtcagttcgtcaatctcattctccattgaggtttgtggccttgctggaaaggtgttgtgatcatttggagaagaggcattctggattttggaattttcagtatttttgcactggtttttcctcatctttgtggatttatctacctttgatctttgaggctgatgacctttgggtggggttcttattggggcgttatttgttgttgttgttgttgttgctttctgtttgttagtctttcttctaacagtcaggcccctcttctgcaggtctgctgcagtttgctggaggtctactccagaccttgtttg

SEQ ID NO: 14866 - DNA, 428 bp, Homo sapiens
  chr9.fa.O7frz.24654905
  Located on chromosome 9
  Distance between a terminus base of telomere on chromosomal short arm and 5'-terminus of this base sequence : 22969024
  Distance between 3'-terminus of neighbour sequence of sequence listing upward to telomere on chrosomal short arm and 5'-terminus of this base sequence : 271886
tcacagctatgtaagtatctttcagtgagagactaaaaaatttgccatgtagcttgaacccagagggcgaggttgcagtgagccgaattcgcaccactgcactccagcctgggcaacagagcgagactccatctcaaaaataaaataaaataaaataaaataaaataaaataaaaaaataaaataaaataaaaaaataaaataaaataaaataaaattacattatccttgtaaaggggctgataagagaaccattgcatttagaagttagttttaactgactgccaatgtttactttaaggttgcaaaaagaatttaaggactgaattcataaaaagagccgaatttatctgactgtactgtgacaatggcagatacatacaaacctcctattcaggcccttagctaagttccaatttcatgagttag

SEQ ID NO: 14867 - DNA, 342 bp, Homo sapiens
  AC017067.4_160110
  Located on chromosome 9
  Distance between a terminus base of telomere on chromosomal short arm and 5'-terminus of this base sequence : 23085353
  Distance between 3'-terminus of neighbour sequence of sequence listing upward to telomere on chrosomal short arm and 5'-terminus of this base sequence : 115901
taacaaagttcaagtttacagcttcacacaaagaacaacgcctgcctagtcaaaagtaggcttttaaaaaatatttgctgaaaaatggtccacatttgtttaagtaggttttgttgttgttgttgttgttgttgttgttaaataaaagcatatcaagttttcttgagtctatttgaccagcacatttaggagtactgtatattttatcattgagcctttaactttttacaagtaaataatggattttggtcaaagattctaaaggaacacgtacagtcaggaaataagataacattatgaaatttgcaaacattttagctcttgtaaagacagattgcactt

SEQ ID NO: 14868 - DNA, 257 bp, Homo sapiens
  chr9.fa.O7frz.24537503
  Located on chromosome 9
  Distance between a terminus base of telomere on chromosomal short arm and 5'-terminus of this base sequence : 23085438
  Distance between 3'-terminus of neighbour sequence of sequence listing upward to telomere on chrosomal short arm and 5'-terminus of this base sequence : -257
tggtccacatttgtttaagtaggttttgttgttgttgttgttgttgttgttgttaaataaaagcatatcaagttttcttgagtctatttgaccagcacatttaggagtactgtatattttatcattgagcctttaactttttacaagtaaataatggattttggtcaaagattctaaaggaacacgtacagtcaggaaataagataacattatgaaatttgcaaacattttagctcttgtaaagacagattgcactt

SEQ ID NO: 14869 - DNA, 349 bp, Homo sapiens
  AC026274.5_60955
  Located on chromosome 9
  Distance between a terminus base of telomere on chromosomal short arm and 5'-terminus of this base sequence : 23209815
  Distance between 3'-terminus of neighbour sequence of sequence listing upward to telomere on chrosomal short arm and 5'-terminus of this base sequence : 124120
gtattggttactgtagccttgtagaaaacttttaaaacaaaaacaatttattctccctcccccgagaaattaagcaaaagtgatcattgctgttcacatacacacacacacacacacacacacacacacacacacacacacacctggtctttatattcacacacacatataattttccatattatggcttcacattccttatagttatcgtttaatatgagttaattccaagggctgaaatctattctattccttctgttttctctcatgaagccaggaaatacctatcactatgtttaagttacaattgacagataattatcaaagtctcagtttgtataaagcactc

SEQ ID NO: 14870 - DNA, 191 bp, Homo sapiens
  DISO7_10002684
  Located on chromosome 9
  Distance between a terminus base of telomere on chromosomal short arm and 5'-terminus of this base sequence : 23314975
  Distance between 3'-terminus of neighbour sequence of sequence listing upward to telomere on chrosomal short arm and 5'-terminus of this base sequence : 104811
catgcaaatagtacaactggcatatatatcatatatattaacataccatattttatatatatatatatatatatatacatatatataatttcttaaagaaactataaaatcacaggagaaaattacacaataaaacatttaataaattcatacttaaaagttaaatgtgccatatgtttctctaatactga

SEQ ID NO: 14871 - DNA, 272 bp, Homo sapiens
  D9S790
  Located on chromosome 9
  Distance between a terminus base of telomere on chromosomal short arm and 5'-terminus of this base sequence : 23458474
  Distance between 3'-terminus of neighbour sequence of sequence listing upward to telomere on chrosomal short arm and 5'-terminus of this base sequence : 143308
agcttgatggtccaaagaggctccctgctatgtgagataatgaataggaaattgtcacaataatgagccaagtcagatctcacaagcctaactgtgagttgagagtaatgaaagaaacacacacacacacacacacacacacacacacaaatgtctgtcatttaacagaattcgagtttgaaagatggagtgttggaatggaacagcacagtgaaaatattccttgttatttttgtttcatttcactcaccggccacagtgtttgtagtgaa

SEQ ID NO: 14872 - DNA, 233 bp, Homo sapiens
  DISO7_10002683
  Located on chromosome 9
  Distance between a terminus base of telomere on chromosomal short arm and 5'-terminus of this base sequence : 23473008
  Distance between 3'-terminus of neighbour sequence of sequence listing upward to telomere on chrosomal short arm and 5'-terminus of this base sequence : 14262
gaaaggagaggaatacagattacagttagagatagatgatgatagatgatagatagatagatagatagatagatagatagatagatagataacagatagatatagatataattgcttcattgtttaaaaaaaaaaaaaaaaaagaaaatcctggaagaataaagcaaaacaaatagaaaggattaactactttctatctatagaagaaaggtagaggaaattaggatgaaggc

SEQ ID NO: 14873 - DNA, 211 bp, Homo sapiens
  D9S1870
  Located on chromosome 9
  Distance between a terminus base of telomere on chromosomal short arm and 5'-terminus of this base sequence : 23640465
  Distance between 3'-terminus of neighbour sequence of sequence listing upward to telomere on chrosomal short arm and 5'-terminus of this base sequence : 167224
tgggtatggttttctgggcacccctcccctctcttcacgcaccacacacacacacacacacacacacacacacacacacacacacacacatctgttctagaatgaaaaccccagaatgcagaaagtaacctgtgaatagtcactagtaagatttctagttttctggatagattgtgtttgtttgtactcctggttatttgacctgcctcaa

SEQ ID NO: 14874 - DNA, 277 bp, Homo sapiens
  D9S1814
  Located on chromosome 9
  Distance between a terminus base of telomere on chromosomal short arm and 5'-terminus of this base sequence : 23655184
  Distance between 3'-terminus of neighbour sequence of sequence listing upward to telomere on chrosomal short arm and 5'-terminus of this base sequence : 14508
gggcctgtgaacctactgaccttctgtggcaattctgtgtgtgtgtgtgtgtgtgtgtgtgcttgcacatttgtgtatgtgtgcaattgtgcattctcctgagtagaagaaccatggttttccagaaattctcaatggggcacatgattccaaaaaggtaaataccactgacatggagagaataataaattattacttgtccttgcttcaatatcaagtataataaaacattgcaacattcgcttcttacgacctttcataatcccagcaatcgaag

SEQ ID NO: 14875 - DNA, 237 bp, Homo sapiens
  AC000049.11_28967
  Located on chromosome 9
  Distance between a terminus base of telomere on chromosomal short arm and 5'-terminus of this base sequence : 23738511
  Distance between 3'-terminus of neighbour sequence of sequence listing upward to telomere on chrosomal short arm and 5'-terminus of this base sequence : 83050
gcaattgtaacggttaactgtaacgttttctttcacacacacacacacacacacacacacacatgctaggatgcggaaatccccttatgacttgctactttttgattttgtgatattttgtactttttagttgttcagcaactgtcttatttaatggggagattttaagtaacataactagtggctctcagttaaaatgtgaggaagaactacagctcttaaatgtagcaatggcac

SEQ ID NO: 14876 - DNA, 330 bp, Homo sapiens
  AC000049.11_43455
  Located on chromosome 9
  Distance between a terminus base of telomere on chromosomal short arm and 5'-terminus of this base sequence : 23752922
  Distance between 3'-terminus of neighbour sequence of sequence listing upward to telomere on chrosomal short arm and 5'-terminus of this base sequence : 14174
ggtacagttacattctggatcatcaggtatctgaagaatatttcatagactgttaaatgattgcattataaagtcaggtttttttaaagcaagattccaaacagtaaacagtttctctctctctctctctctctctctctctctctctctctcaccaaattagttataatggtttccgcaggatgagaggggttgggaaaaagtttggtgatatttattttcttcgtttcacttttgagttttccaaagtgctatgaccatcatcagtaaaatatacatttccaaagcctttgacacacggtaacagtcctacacagtggatgaactaag

SEQ ID NO: 14877 - DNA, 231 bp, Homo sapiens
  AC000047.6_16145
  Located on chromosome 9
  Distance between a terminus base of telomere on chromosomal short arm and 5'-terminus of this base sequence : 23827436
  Distance between 3'-terminus of neighbour sequence of sequence listing upward to telomere on chrosomal short arm and 5'-terminus of this base sequence : 74184
gattacatctgcaaagaacctatttccaaatgaggccacattcagtttccaggtatacatgaattttggagggaagctattcaaccaagtacaaacttttaactaggttattttccttccttccctccctccttccttccttccttccttccttccttccttccttcctttccttcctccctccctccctccctccctctctctccttctctctgtctttcgaaacacagt

SEQ ID NO: 14878 - DNA, 361 bp, Homo sapiens
  AC000047.6_15120
  Located on chromosome 9
  Distance between a terminus base of telomere on chromosomal short arm and 5'-terminus of this base sequence : 23828383
  Distance between 3'-terminus of neighbour sequence of sequence listing upward to telomere on chrosomal short arm and 5'-terminus of this base sequence : 716
ctggctaacatggtgaaaccccatctctactaaaaatacaaaaaaaaattagccgggcgtggtggcgggtgcctgtagtcccagctacacaagaggctgaggcaggagaatggcatgaacccaggaggcagaggtggagcttgcagtgagccaagatcccaccactgcactccaggctgggtgagagggcaagactctgccgaaagaaaagaaagaaaggaaagaaagaaagaaagaaagaaagaaaggaaggaaggaaggaaggaaggaaggaaggaaggaaggaaggaaggaaggaaggaaagaaaacaaagtattgatatgtgctacactatggatgtaccttgagaacgttatgtca

SEQ ID NO: 14879 - DNA, 385 bp, Homo sapiens
  AL355679.8_118335
  Located on chromosome 9
  Distance between a terminus base of telomere on chromosomal short arm and 5'-terminus of this base sequence : 23955845
  Distance between 3'-terminus of neighbour sequence of sequence listing upward to telomere on chrosomal short arm and 5'-terminus of this base sequence : 127101
aaagtaggaaccagtgtggtacattcaaagagctgccgttcttggaatgtggttagagcacagggtgtgagtataagggggcagagtgagagatgaagcctttcgggcggacataggtcagagtctagcattggaaacaggaatccaagggttaatttggaaattagatgaggtttgtttcgctcattcattcattatttatttatttatttatttatttattagaggcaaggtctcactgtattacccagggggacctcaaactcctgggctctgggaaccttcctacgtcaacctcccaggtagctggaattacagacatgtgccaccgtgcatggctagtatttttaaaaaataagctgtcaacatttacaacttagaaacc

SEQ ID NO: 14880 - DNA, 366 bp, Homo sapiens
  AL137022.8_120264
  Located on chromosome 9
  Distance between a terminus base of telomere on chromosomal short arm and 5'-terminus of this base sequence : 24106825
  Distance between 3'-terminus of neighbour sequence of sequence listing upward to telomere on chrosomal short arm and 5'-terminus of this base sequence : 150595
attcttagcaaaggaaatcagttccttctcccccatttatttatttaatcatttagatatcatggacatatattttatactttgggttataatccaatactactttattatgttgctgaaactggtctggtgtttgctattgcgaactcattcatttggctcctgtgctctgttagagagaaaggggtgtgtgtgtgtgtgtgtgtgtgtgtgtgtgtgtgtgtaattctttactttctggcactacaaaattctccaggattatcatttatatttcttatcccagtcctagaaccagccatttatacaaggatctctggatcctgttatcggagaatgggcgttagaaaccaaatctggacacta

SEQ ID NO: 14881 - DNA, 185 bp, Homo sapiens
  D9S1846
  Located on chromosome 9
  Distance between a terminus base of telomere on chromosomal short arm and 5'-terminus of this base sequence : 24106943
  Distance between 3'-terminus of neighbour sequence of sequence listing upward to telomere on chrosomal short arm and 5'-terminus of this base sequence : -248
aaactggtctggtgtttgctattgcgaactcattcatttggctcctgtgctctgttagagagaaaggggtgtgtgtgtgtgtgtgtgtgtgtgtgtgtgtgtgtgtaattctttactttctggcactacaaaattctccaggattatcatttatatttcttatcccagtcctagaaccagccatt

SEQ ID NO: 14882 - DNA, 237 bp, Homo sapiens
  AL137022.8_90882
  Located on chromosome 9
  Distance between a terminus base of telomere on chromosomal short arm and 5'-terminus of this base sequence : 24136292
  Distance between 3'-terminus of neighbour sequence of sequence listing upward to telomere on chrosomal short arm and 5'-terminus of this base sequence : 29164
tttacaacgtagtcatgttacctaaaatatccagcagtggagactcccttaatgcatgacttctgtgaacattttctttccctcccttccttcccttcctccttccttccttccttccttccttccttccttccttcctccctccctccctccctccctcacttcctcccttccttctttccttccttccttctcctttttctttcttttcccaatatgaagatgcttaggtggtag

SEQ ID NO: 14883 - DNA, 325 bp, Homo sapiens
  AL137022.8_59060
  Located on chromosome 9
  Distance between a terminus base of telomere on chromosomal short arm and 5'-terminus of this base sequence : 24168153
  Distance between 3'-terminus of neighbour sequence of sequence listing upward to telomere on chrosomal short arm and 5'-terminus of this base sequence : 31624
tgagcagtaatcataccactgtactccagcctgggcaacaaagcaagaccctgtcttacacacacacacacacacacacacacacacacacacacacacaaaattgggcaagtatgatagtatcagaattaggaaacacataatattacatttattttaactttgttattaaaaatttcaagtacatttcaaagtagagagaatattataataaagccccacatattgatcacctagccttaataatgataattttactgtatttcctttggctactatctctttgctcagttgttttaaagtaaggtccagataccattacctc

SEQ ID NO: 14884 - DNA, 295 bp, Homo sapiens
  AL137022.8_48813
  Located on chromosome 9
  Distance between a terminus base of telomere on chromosomal short arm and 5'-terminus of this base sequence : 24178380
  Distance between 3'-terminus of neighbour sequence of sequence listing upward to telomere on chrosomal short arm and 5'-terminus of this base sequence : 9902
gacggtctttgatgtgttctatactgaacacactaggtgtgcagcaacaccattacaaaggaagggaaatggaactggtgtttctctcaagtctctctctctctctctctctctctctctgtctctctccttttaaacataaatggtgtgccctgcactctgctaacaaatttataaatattattttgtttaatttttacagtaccatatgagctatacattacaatatttttactatttttactggtatgcaaatggagggacaaagattttggaaatttaatgaaggtaagtg

SEQ ID NO: 14885 - DNA, 204 bp, Homo sapiens
  chr9.fa.O7frz.23346029
  Located on chromosome 9
  Distance between a terminus base of telomere on chromosomal short arm and 5'-terminus of this base sequence : 24260272
  Distance between 3'-terminus of neighbour sequence of sequence listing upward to telomere on chrosomal short arm and 5'-terminus of this base sequence : 81597
agattgagcataatgttatgaaacaagtgttattcctttcgtatattatatattatcatatgtcttttctctctctttctctttctctctctctctctctctctctctctctctcagatagggagggaaaagaccctctgtggagcatgctgactgagtttatttcaacttattaatactagactaagtgaccaaacatacagc

SEQ ID NO: 14886 - DNA, 428 bp, Homo sapiens
  chr9.fa.O7frz.23229172
  Located on chromosome 9
  Distance between a terminus base of telomere on chromosomal short arm and 5'-terminus of this base sequence : 24377047
  Distance between 3'-terminus of neighbour sequence of sequence listing upward to telomere on chrosomal short arm and 5'-terminus of this base sequence : 116571
gacttaaacgtgattctaaggaccttccacctttaaagggaaggaagagaagagccacaaaggaaacagagggatggacaaatagagacaatggtgattaatatggtctggaactgtgtctctgcctaaatctcaggcagaccagcctctagaatgtatgtgtgtgtgtgtgtgtgtgtgtatgtgtgtgtgtgtgtatatatatacgtacatatatatatatacgtatatatatgtatatatatacacacacacacacatacacacacacactatatatatattttatatatagtgtatatatataaaacatatgtatatatgcttattttcttattttataaatatatggttattattttcttaattagtgcatatatatcagaaaagggactgggtgcagtggctcatgtttgtaatctcagcac

SEQ ID NO: 14887 - DNA, 131 bp, Homo sapiens
  DID22N_0033022
  Located on chromosome 9
  Distance between a terminus base of telomere on chromosomal short arm and 5'-terminus of this base sequence : 24489858
  Distance between 3'-terminus of neighbour sequence of sequence listing upward to telomere on chrosomal short arm and 5'-terminus of this base sequence : 112383
tggcagttcttgataatggtagtgggaaatgtagcctgatgtgtgtatgtgtatatatatatatatatatatatatatatagtctcctcctagactaactatatataagtctgggagattgaatatcagtc

SEQ ID NO: 14888 - DNA, 336 bp, Homo sapiens
  chr9.fa.O7frz.22907204
  Located on chromosome 9
  Distance between a terminus base of telomere on chromosomal short arm and 5'-terminus of this base sequence : 24619145
  Distance between 3'-terminus of neighbour sequence of sequence listing upward to telomere on chrosomal short arm and 5'-terminus of this base sequence : 129156
cgctacctttattcaatgtagtactagaagtcctaccagagaaatcagatcaaaaaaaaaggaagaagaagaagaagaagaagaagaagaagaagaagaagaagaagaagaagaagaagaagaagaagaagaagaagaagaagaagaagaagaagagaaagaggaagaggaagaggaagaagaagacgaagacgaagacgaagaagaagaagaagaagaagaagaagaagaagaagaagaagaagaagaggaagaagaagaagaagaagaagaaataaaaggcatccaaaggggaaaggaagaagttatctctaattgtagatgacatgattctgt

SEQ ID NO: 14889 - DNA, 158 bp, Homo sapiens
  DID22N_0033028
  Located on chromosome 9
  Distance between a terminus base of telomere on chromosomal short arm and 5'-terminus of this base sequence : 24694163
  Distance between 3'-terminus of neighbour sequence of sequence listing upward to telomere on chrosomal short arm and 5'-terminus of this base sequence : 74682
aacaatgagccaagcaccatgctaacaccacacacacacacacacacacacacacacacacacacacacagtgatgggtgatttggggtgtcgacttaattaagggatacccagatagctggtaaagcattatttactctgaatcattgcattaatca

SEQ ID NO: 14890 - DNA, 159 bp, Homo sapiens
  DID22N_0033029
  Located on chromosome 9
  Distance between a terminus base of telomere on chromosomal short arm and 5'-terminus of this base sequence : 24793813
  Distance between 3'-terminus of neighbour sequence of sequence listing upward to telomere on chrosomal short arm and 5'-terminus of this base sequence : 99492
gaagagcaattaagtgtttcacccaaggttgtacataaaattaagggagtttaaataaacacaggtgttttgcctgaaatcctttttttctatgctgctgtgtgtgtgtgtgtgtgtgtgtgtgtgtgctatttaacttagattgtgcaatgagacaga

SEQ ID NO: 14891 - DNA, 479 bp, Homo sapiens
  AL163528.3_105184
  Located on chromosome 9
  Distance between a terminus base of telomere on chromosomal short arm and 5'-terminus of this base sequence : 24918556
  Distance between 3'-terminus of neighbour sequence of sequence listing upward to telomere on chrosomal short arm and 5'-terminus of this base sequence : 124584
agactcagatttctcaaagaactaaaactagaactatcattcaatccaacaattccactactgggtatctacccaaagggaaataatttattatatcaaaaacacacttgcactcatacatttaccacagcactattcacaatagcaaagatacggaatcaacctaaatgtagccatcagtggaggggtaaatacacacacacacacacacacacacacacacacacacaccctgtaatactactcagccatgtaaaagaatggaatcacgtcttttgcagcaatgtgaacagaactggaagctgttatcctcagggaaataactcagaacccaaataccacatgttctgacttataagtgggagctaagcaaagcaatggatgcacatgaacatacagagtggaataacagctattggagactacatggtggaagggggataagagttgaataattatctattgagtacaacgtttcc

SEQ ID NO: 14892 - DNA, 325 bp, Homo sapiens
  chr9.fa.O7frz.25310089
  Located on chromosome 9
  Distance between a terminus base of telomere on chromosomal short arm and 5'-terminus of this base sequence : 25010818
  Distance between 3'-terminus of neighbour sequence of sequence listing upward to telomere on chrosomal short arm and 5'-terminus of this base sequence : 91783
tcctatccttcgaagagataatctgcctgcactacctttaattatttctaagttctctatatttaatcttctttctccttctttcctctggtttatttctctccccctcttctctcctaatctctccatccatccatctatccatccatccatccatccatccatccatccatccatccatccagtctttctctctccttatctgtctttctcttactctctattttgtcattaagctctttcatctgcttttgacataaatcataatataaggatcaaaacttatatgttaccaaatagttaaccaatagtatgcattattcct

SEQ ID NO: 14893 - DNA, 327 bp, Homo sapiens
  AL163528.3_41848
  Located on chromosome 9
  Distance between a terminus base of telomere on chromosomal short arm and 5'-terminus of this base sequence : 25204379
  Distance between 3'-terminus of neighbour sequence of sequence listing upward to telomere on chrosomal short arm and 5'-terminus of this base sequence : 193236
cagcatccagatacaggaagctcagaggtcaccagtcaaattcagtcctatgaggaattccccaaggtacatcagaatcaacttagtaaatatcaaacacacacacacacacacacacacacacacacacacacacaaattgttcaaaacatcaagaaaaaagaaacatatcacattcaagcgttctctaatatggctttcagtgggcttttaggagaaaccctgcaggccaggaaaaaagtagaatgctaaattcaaagtgctgaaggtaaaaaacaacaacaacaacaacaaaaaaaaactcttagccaagaatactgtactcaa

SEQ ID NO: 14894 - DNA, 295 bp, Homo sapiens
  chr9.fa.O7frz.25195532
  Located on chromosome 9
  Distance between a terminus base of telomere on chromosomal short arm and 5'-terminus of this base sequence : 25204411
  Distance between 3'-terminus of neighbour sequence of sequence listing upward to telomere on chrosomal short arm and 5'-terminus of this base sequence : -295
cagtcaaattcagtcctatgaggaattccccaaggtacatcagaatcaacttagtaaatatcaaacacacacacacacacacacacacacacacacacacacacaaattgttcaaaacatcaagaaaaaagaaacatatcacattcaagcgttctctaatatggctttcagtgggcttttaggagaaaccctgcaggccaggaaaaaagtagaatgctaaattcaaagtgctgaaggtaaaaaacaacaacaacaacaacaaaaaaaaactcttagccaagaatactgtactcaa

SEQ ID NO: 14895 - DNA, 216 bp, Homo sapiens
  chr9.fa.O7frz.25520352
  Located on chromosome 9
  Distance between a terminus base of telomere on chromosomal short arm and 5'-terminus of this base sequence : 25212435
  Distance between 3'-terminus of neighbour sequence of sequence listing upward to telomere on chrosomal short arm and 5'-terminus of this base sequence : 7729
tcagaacagtcatttatggaacagtttctaatatctgtggtaggctggataacaattacaacaaccccccctccccatccctggccccaaaacacacacacacacacacacacacacacacacacacacacacacacgatatccatgtcttaatttctggagtcagtgaatcttaccttatatgttaaaaaggattctgaagatacgattaaggat

SEQ ID NO: 14896 - DNA, 357 bp, Homo sapiens
  AL445623.1_150970
  Located on chromosome 9
  Distance between a terminus base of telomere on chromosomal short arm and 5'-terminus of this base sequence : 25242931
  Distance between 3'-terminus of neighbour sequence of sequence listing upward to telomere on chrosomal short arm and 5'-terminus of this base sequence : 30280
taatagtaaattcaagcaggtcaggttaccttttggctattaacaccataatattaccatcaaaaagaggaaagttatgaagtcttgtatttataagtgtacgctaaataccactcacctggtctcttaagaaatagaacatcagacatttcaacgtttctttacattcgtctgatttttctgatacacacacacacacacacacacagagagagagagacacacacacacacacacacacttcagacacaggaccagtttatatattgtccaagatggaagacgttataattaactgtttatatcactaactttatataagaaacattcacacttacaagatgttcttatccaagg

SEQ ID NO: 14897 - DNA, 191 bp, Homo sapiens
  chr9.fa.O7frz.25631503
  Located on chromosome 9
  Distance between a terminus base of telomere on chromosomal short arm and 5'-terminus of this base sequence : 25323579
  Distance between 3'-terminus of neighbour sequence of sequence listing upward to telomere on chrosomal short arm and 5'-terminus of this base sequence : 80291
actccacaaatttgttcaattatgtgttaactatatacaaatatatactatatatagtagtgtacacgtaatatatatgtgtatacatcatatatagtattatatatatatatatatatatatatatatatatataatgtatagaaacgtcttacatctttagaaacatctttcaatactcatgaccattg

SEQ ID NO: 14898 - DNA, 384 bp, Homo sapiens
  chr9.fa.O7frz.25722477
  Located on chromosome 9
  Distance between a terminus base of telomere on chromosomal short arm and 5'-terminus of this base sequence : 25414502
  Distance between 3'-terminus of neighbour sequence of sequence listing upward to telomere on chrosomal short arm and 5'-terminus of this base sequence : 90732
gctacctctttgtaatgactgtatgatggatgcaaccgaagggtggggtctgggtgggtcaacactgttaatgacagtatgtatcattctgtccgtcctccaggagaggggagggaagccccctgccctcccctcaggtcttgggctcgctttctctctctctctctctctctcgctctctctctctctctctctctctctctctccctctcttcctctccctctctctcctatctctcgtctctgtcccctgtcactcgcgcgcacacacacacacacgcacacacactttcctccctcttcccccacctccctatgccattttctgcagtcagcgttcaaaaaaagtacgaaaaccatcgggtaatttccaactgaaccgat

SEQ ID NO: 14899 - DNA, 471 bp, Homo sapiens
  chr9.fa.O7frz.26061499
  Located on chromosome 9
  Distance between a terminus base of telomere on chromosomal short arm and 5'-terminus of this base sequence : 25723598
  Distance between 3'-terminus of neighbour sequence of sequence listing upward to telomere on chrosomal short arm and 5'-terminus of this base sequence : 308712
ctctagtccaactatcctttctaacccaataaaaacccaattaatactatttttgtataaataattttggaacttcctatgcttatcatacacacacacacacacacacacacacacacacacgtagaaagagaggttctcactctgtcatgcagtgtggagtgccatggtgacatcataactcattgcagcctccaactcctgggctcaagagatccttctgcctcagtgtcctgagtagctgagactacaggcatgcaccaccatgcccaactaattttaaaatccttttatagagacagagtcttgttgtgttgcccaggctagtcttgaactcttggctcaaatgatcctcccacctcagcctcccaaagtgttgggattacaggagtgagccaccgcatgcttcccagggcgtatttttgaatcgagcacatatcttcctttatctcatcctgcttaatcatttaa

SEQ ID NO: 14900 - DNA, 170 bp, Homo sapiens
  G10010
  Located on chromosome 9
  Distance between a terminus base of telomere on chromosomal short arm and 5'-terminus of this base sequence : 25865085
  Distance between 3'-terminus of neighbour sequence of sequence listing upward to telomere on chrosomal short arm and 5'-terminus of this base sequence : 141016
ctacccctattgctgcaagacctcctaaaaacactgctcattaacaaaggctttgctgataattgctgctgctgctgctgctgctgctgctgctgctgctgctgctcctgctgctcctgctccagccatgagaagactatatataccctttgctgcttcattccaagaat

SEQ ID NO: 14901 - DNA, 346 bp, Homo sapiens
  AP000379.1_2061
  Located on chromosome 9
  Distance between a terminus base of telomere on chromosomal short arm and 5'-terminus of this base sequence : 26040250
  Distance between 3'-terminus of neighbour sequence of sequence listing upward to telomere on chrosomal short arm and 5'-terminus of this base sequence : 174995
gctactatgccaagcagttaataagcattgactattttattttactatatatgtatgtgtgtgtgtgtgtatgtgtgtgtgtgtatatatatatatatatatatatatatatatatatatatatgatggagtctcactctgtcaccaggctggagtgcagtggcgcaatctcagctcactgcaacctcctccacccaggtccaagcaattttcctgcctcagcctcctgagtagctgggactacaggcacacgccaccatgcccagctaatttttgtatttttggtgggatggggtttcatcatgttggccagcatggtctcgaattcttgaccttgtgatccacc

SEQ ID NO: 14902 - DNA, 256 bp, Homo sapiens
  AP000379.1_59904
  Located on chromosome 9
  Distance between a terminus base of telomere on chromosomal short arm and 5'-terminus of this base sequence : 26098131
  Distance between 3'-terminus of neighbour sequence of sequence listing upward to telomere on chrosomal short arm and 5'-terminus of this base sequence : 57535
taaaagctaagtgaaacctcatctctgtctgctgcctcctacagacacacacacacacacacacacacacacacacacacacacacacatatacacatatatacatggaaaatactgattgttaataaagtagccccaagaaaaataggatctcagagactataccatcagtgctagggttgaatgttatcagataaatatctttccctaatgatttgtagctcttcaagaaaccttggaactaagcttcatgaag

SEQ ID NO: 14903 - DNA, 176 bp, Homo sapiens
  D9S171
  Located on chromosome 9
  Distance between a terminus base of telomere on chromosomal short arm and 5'-terminus of this base sequence : 26098136
  Distance between 3'-terminus of neighbour sequence of sequence listing upward to telomere on chrosomal short arm and 5'-terminus of this base sequence : -251
gctaagtgaaacctcatctctgtctgctgcctcctacagacacacacacacacacacacacacacacacacacacacacacacatatacacatatatacatggaaaatactgattgttaataaagtagccccaagaaaaataggatctcagagactataccatcagtgctagggtt

SEQ ID NO: 14904 - DNA, 313 bp, Homo sapiens
  AP000379.1_79672
  Located on chromosome 9
  Distance between a terminus base of telomere on chromosomal short arm and 5'-terminus of this base sequence : 26117672
  Distance between 3'-terminus of neighbour sequence of sequence listing upward to telomere on chrosomal short arm and 5'-terminus of this base sequence : 19360
gcctacatttaacttacatccaacaagtatttattgagcacttattatttgtcagaaaccatgctaagtagcaacaatagaaagaagatgggagagaaatacctctgctacggcatgcaatcaagtggaaggctgatattttaatctaaactttttttaatgtattgaggtggctttttcccccaagcattcatttttgttacacacacacacacacacacacacacacacgcacgcacacacagattatgtatatgcatatatatgcatatatttattttaaaaaattaacagtctttatgtttctgaatgg

SEQ ID NO: 14905 - DNA, 257 bp, Homo sapiens
  AP000379.1_122207
  Located on chromosome 9
  Distance between a terminus base of telomere on chromosomal short arm and 5'-terminus of this base sequence : 26160276
  Distance between 3'-terminus of neighbour sequence of sequence listing upward to telomere on chrosomal short arm and 5'-terminus of this base sequence : 42291
acatgatgttaagtcacttggttagtataataattaccaaatctcttcaactgtctcacgttaagaaatgtgaatatcttgtcctgatcctctccacccccataatatttcataaaatggttttaaagccctaaaacttaaagtataataaataaataaataaataaataaataaataaaaccactgtggaaaaaaaaaaaaagcccttgctgattatgtatttaagccatcagtacattagtggttacaaagtggt

SEQ ID NO: 14906 - DNA, 186 bp, Homo sapiens
  chr9.fa.O7frz.26599310
  Located on chromosome 9
  Distance between a terminus base of telomere on chromosomal short arm and 5'-terminus of this base sequence : 26287149
  Distance between 3'-terminus of neighbour sequence of sequence listing upward to telomere on chrosomal short arm and 5'-terminus of this base sequence : 126616
atacaagatgcttacctgtatcagcagctatagagaaggcataaatataaaataactcttacactgtcacttgcagagatacaaacacacacacacacacacacacactctcacactatagacttggtcctttggggagaacctccgattttttattttccaatctctagtcaggtgatcaagtga

SEQ ID NO: 14907 - DNA, 139 bp, Homo sapiens
  D9S1679
  Located on chromosome 9
  Distance between a terminus base of telomere on chromosomal short arm and 5'-terminus of this base sequence : 26344321
  Distance between 3'-terminus of neighbour sequence of sequence listing upward to telomere on chrosomal short arm and 5'-terminus of this base sequence : 56986
tgctgtggacctaacaaaaatgttttaaaatgattgtgtgtgtgtgtgtgtgtgtgtgtgtgtgtgtgtaaaaatgttatggactggccgggtatggtggctcacgtctctaatcccagcactttggcaggcagaggtg

SEQ ID NO: 14908 - DNA, 153 bp, Homo sapiens
  D9S1833
  Located on chromosome 9
  Distance between a terminus base of telomere on chromosomal short arm and 5'-terminus of this base sequence : 26534550
  Distance between 3'-terminus of neighbour sequence of sequence listing upward to telomere on chrosomal short arm and 5'-terminus of this base sequence : 190090
atctttgcattgttcaagggacaactatgtgtgtgtgtgtgtgtgtgtgtgtgtgtgtgtgtatttttatttatttattatttatttatttattttgaggcaaggtgttgctctgtcgcgcaggctggagtgcagtggaacgatttcggctca

SEQ ID NO: 14909 - DNA, 460 bp, Homo sapiens
  chr9.fa.O7frz.27029431
  Located on chromosome 9
  Distance between a terminus base of telomere on chromosomal short arm and 5'-terminus of this base sequence : 26541475
  Distance between 3'-terminus of neighbour sequence of sequence listing upward to telomere on chrosomal short arm and 5'-terminus of this base sequence : 6772
aaagactgatgtaggaaaacctacagggcagtgttttttcttttcattaaaaaagtttgcaaacatttaaaaaagtctaaggaatagtaatagacatccctatacatcccaaagtagttagaatgtttacatattttttctatccttatgtgtgtatcaacacacacacacaaacacacacacacacacacacacagggctataggtgtttttggtgttaaactatttaaaaagaaatcataggaattactacacttcactcctatgtactttagcacgcatcttctaaggaaaaagacttcttcctatataattaatcctatataggatatatacttatcacaactaagaacattaacaattatatacttatcacaactaagaaaattaacaattatataactgaatatttattcaatattaaacttttttcaattgctttagatttgttttccaaacc

SEQ ID NO: 14910 - DNA, 396 bp, Homo sapiens
  chr9.fa.O7frz.27157317
  Located on chromosome 9
  Distance between a terminus base of telomere on chromosomal short arm and 5'-terminus of this base sequence : 26818269
  Distance between 3'-terminus of neighbour sequence of sequence listing upward to telomere on chrosomal short arm and 5'-terminus of this base sequence : 276334
tgccatttcagtctctatgtatataaagcagcctattcatgtgcatcatgttcaatctccaaggtaaccatacccctctctattttgattctaaaattcaatggcttccaatatttgttgacagtgtgactgtgtgtgtgtgtgtgtgtgtgtgtgtgtgtgtgtgtgtgtgtgcgcgtctacccatggtcactgcctgggaaattacattgtgaaacttgtaacatcttgtattctcaaagtgtaaagaagtgttaaagaatgttggggattagtcaaaaggacacattttgaaggagttttcactggccaaatcagaaattatgtgaacaaaaaaaagaacgtagatctttataccttttttattagaatgtaagtctatgcattcatagtgct

SEQ ID NO: 14911 - DNA, 292 bp, Homo sapiens
  chr9.fa.O7frz.27233121
  Located on chromosome 9
  Distance between a terminus base of telomere on chromosomal short arm and 5'-terminus of this base sequence : 26894019
  Distance between 3'-terminus of neighbour sequence of sequence listing upward to telomere on chrosomal short arm and 5'-terminus of this base sequence : 75354
tccagtagttacatgacgaaatatttctatgagaaatactaattgaaattagactatcaccaggtgtggttgctcacacatgtaatcccagctacttggaagcctgaggcaggagaatcgtttgaggccaagagtttgagaccagcctgggcagcatagtgagactccgtctctaaaaatataaatacatacatacatacatacatacatacatacatacatactataacctatgtggagtaaatagacaccagaggtcactgaatcacactttgcaattagattctagctg

SEQ ID NO: 14912 - DNA, 181 bp, Homo sapiens
  G08755
  Located on chromosome 9
  Distance between a terminus base of telomere on chromosomal short arm and 5'-terminus of this base sequence : 26967016
  Distance between 3'-terminus of neighbour sequence of sequence listing upward to telomere on chrosomal short arm and 5'-terminus of this base sequence : 72705
gttgttgctgggcttagaaatatgaataaccatatgccagatagatggatggatagatagatacatacatacatacatacatacatacatacatacatagacagataaaaccccagaggtcaaggtatcagaaaacataggaaatattatgttcatgcccctgaaaagtgcagtcaatcaa

SEQ ID NO: 14913 - DNA, 426 bp, Homo sapiens
  chr9.fa.O7frz.27357757
  Located on chromosome 9
  Distance between a terminus base of telomere on chromosomal short arm and 5'-terminus of this base sequence : 27022401
  Distance between 3'-terminus of neighbour sequence of sequence listing upward to telomere on chrosomal short arm and 5'-terminus of this base sequence : 55204
tacagtactaatagagcaaggcagcataatattactcttcttttccattattcttgaattcttggtgaagcctattcttggtcttcgcagcctctctctgttacaaacacacacacacacacacacacacgcacactttgccaatgacttttcttctttctttggttcctctcatccaatagttaaaatttaactcagctagaggaaaaaatccatagtagtagaatttaaataatagagcaccagcatcctacacaattcataatgcccccttcagcagtccattctacagggctcttattcatccaggatagaacattcaagccttatgagtttacacatttgacctcttcaggagaataaccgatgtgttgctctccactggccattactctgcctttgtcatcttcatagctaatggtcctt

SEQ ID NO: 14914 - DNA, 428 bp, Homo sapiens
  chr9.fa.O7frz.27434399
  Located on chromosome 9
  Distance between a terminus base of telomere on chromosomal short arm and 5'-terminus of this base sequence : 27099033
  Distance between 3'-terminus of neighbour sequence of sequence listing upward to telomere on chrosomal short arm and 5'-terminus of this base sequence : 76206
gatcactacaaccttgaaatagattcttatttatgacctgatctatttttttgtggacactgggctagaatgaaattagatctgattagatcctggaaaaaaagaaactaaacaaaacacacacacacacacacacacacacacacacacacacgttgttttaatgatggtggatatgcaagaaaataataaagaattttgacaggacagggttttttttttaattctttgcagctcaagttactgctctcttacttgggcatagatagtagaaatacctttttaaatgaaagcatttaaatgaagtatgtccaatgttgttgcataaaatcccatttgacttgattctgcttctttctgatgaaccacatatttatttgctgcatcaagttcctttagaaaaagttataagtttatcaaacacgtgg

SEQ ID NO: 14915 - DNA, 376 bp, Homo sapiens
  AC003953.1_31864
  Located on chromosome 9
  Distance between a terminus base of telomere on chromosomal short arm and 5'-terminus of this base sequence : 27303986
  Distance between 3'-terminus of neighbour sequence of sequence listing upward to telomere on chrosomal short arm and 5'-terminus of this base sequence : 204525
tctatccaaatttaattccttcagagccttgaagtgcactttttgggaggctattccaatgccaaactctctattgggaaatagaaatacctagaactaaaacataaatattctaggttcttgaatttacttctctcccactccactcacttcatttaagttaaatattttaaatctttctgctttttcctaaacttcccctttatcctcaactcctcttgggaactgccatctcagaaattacagtacttttctacttactttttccactcctagatcgtgtgtgtgtgtgtgtgtgtgtgtgtgtttgtgtgtgtgtatggagtggagagggggaaattatgcagatattgtcttgaaagtgcaatacctaagg

SEQ ID NO: 14916 - DNA, 192 bp, Homo sapiens
  AC003953.1_52406
  Located on chromosome 9
  Distance between a terminus base of telomere on chromosomal short arm and 5'-terminus of this base sequence : 27324765
  Distance between 3'-terminus of neighbour sequence of sequence listing upward to telomere on chrosomal short arm and 5'-terminus of this base sequence : 20403
ataagtcactgtttctggcctaattttttaaatacacacagacacacacacacacacacacacacacacacacacaaactactataacttaccccaaataaaatgctatttgaatagtcctataattattaaagaaataaaattaataatttaaaacatgccaaaaaagaaaacttcatgccaaatggtctt

SEQ ID NO: 14917 - DNA, 245 bp, Homo sapiens
  AC003953.1_66619
  Located on chromosome 9
  Distance between a terminus base of telomere on chromosomal short arm and 5'-terminus of this base sequence : 27338962
  Distance between 3'-terminus of neighbour sequence of sequence listing upward to telomere on chrosomal short arm and 5'-terminus of this base sequence : 14005
ctggcagtcagaattctacaatggccttcaagtttcatgcccccgctacacccagtacacacacacacacacacacacacacacacacacaaaatctcttgtataatccccttccattgagtacagatctaatttatgaaaatgatgaaatatcactcccatgattagtttactaatcagttgaccttgggttaataaaaaggggtattaacctggcgagtctgagcaataggatttatgaccta

SEQ ID NO: 14918 - DNA, 469 bp, Homo sapiens
  chr9.fa.O7frz.27870764
  Located on chromosome 9
  Distance between a terminus base of telomere on chromosomal short arm and 5'-terminus of this base sequence : 27538737
  Distance between 3'-terminus of neighbour sequence of sequence listing upward to telomere on chrosomal short arm and 5'-terminus of this base sequence : 199530
accagttagtaaatagagatggtctaatcacattgaccaatcttctccctgatgtcctccagtattttgccactagcttgtcccagggcttaaaatgtctctagccttttgtttcagcagagttgagttcaatctctttcccctattgacatatccttagcccctattcaaataatcttaaagcttttcttgcctgttttattctgtctggtacaatttttctttaacagagagagagacagagacagtgtgtgtgtgtgtgcgtgtgtgtgtgtgtgtgtgtgtgtgtgtgtgtgtgtgtgtagagggactcccaggggacctcaggaacaggcctgctccatgcactcttttatgaaaacagttgtctttaatctgttctatgtgttgaagtattttcctaaaattatatttaaacaaatatcaccatagttttaaaagcatttagagtatgcaactgttatgcatc

SEQ ID NO: 14919 - DNA, 138 bp, Homo sapiens
  D9S259
  Located on chromosome 9
  Distance between a terminus base of telomere on chromosomal short arm and 5'-terminus of this base sequence : 27583796
  Distance between 3'-terminus of neighbour sequence of sequence listing upward to telomere on chrosomal short arm and 5'-terminus of this base sequence : 44590
ggcatcattgctccatcaactatgcatgctaggaatacaatcaaacacacatacatgcatgcacacacacacacacacacacacacacacacacacatttttaaactgttaaagagattccacccataagatccatcc

SEQ ID NO: 14920 - DNA, 146 bp, Homo sapiens
  HUMUT2425
  Located on chromosome 9
  Distance between a terminus base of telomere on chromosomal short arm and 5'-terminus of this base sequence : 27735124
  Distance between 3'-terminus of neighbour sequence of sequence listing upward to telomere on chrosomal short arm and 5'-terminus of this base sequence : 151190
aatttcttgaacacggaacaaaacctctaatgtaagttttaaaatacaaaaatcactgggaaagaggatggatggatagatagatagatagatagatagatagatagatagatagatagacagagatataaatatacaacttgcgg

SEQ ID NO: 14921 - DNA, 245 bp, Homo sapiens
  Z66814
  Located on chromosome 9
  Distance between a terminus base of telomere on chromosomal short arm and 5'-terminus of this base sequence : 27745374
  Distance between 3'-terminus of neighbour sequence of sequence listing upward to telomere on chrosomal short arm and 5'-terminus of this base sequence : 10104
cacaaggctatttaatgcttaggcagctgacttttattactatctcatgggccagatctaactaaaactctccccagtcttcactccacattttctaaaatggaatggagcatctaggcaaagagatttaatgttattaccatttacaaaaacacgcacatgtgcacacacactcccactccacacatacacacacacacacacacacacacaactcgatagagcagcctggtaaatagcatatt

SEQ ID NO: 14922 - DNA, 450 bp, Homo sapiens
  chr9.fa.O7frz.28305669
  Located on chromosome 9
  Distance between a terminus base of telomere on chromosomal short arm and 5'-terminus of this base sequence : 27966430
  Distance between 3'-terminus of neighbour sequence of sequence listing upward to telomere on chrosomal short arm and 5'-terminus of this base sequence : 220811
aatgtcaccatattcaacagatcttctctgatcacccttgttgatttatttcaaaacagagctcttattatcattaggaatattatatatttgtttttatatgttctaattctctttctccttcctctgagctccacaagtgtgtgtgtgtgtgtgtgtgtgtgtgtgtgtgtgtgtgtgtgtgtgtgtgtgttttccactgctttgtcttcaggacctagaaaagaatttgacacaaaacggattttcaatcattatttgctgaatgaatgaatgttaaagaaaccttgagacatccaactccccaaccaaagaattaggtccactgtgcaactccattttctatagtaggtgagcactcttattattcaactacattatgattattattgcaattactttccagtttgagtattttatctttagctacgtatttcagtttggtaagtg

SEQ ID NO: 14923 - DNA, 464 bp, Homo sapiens
  chr9.fa.O7frz.28421039
  Located on chromosome 9
  Distance between a terminus base of telomere on chromosomal short arm and 5'-terminus of this base sequence : 28114727
  Distance between 3'-terminus of neighbour sequence of sequence listing upward to telomere on chrosomal short arm and 5'-terminus of this base sequence : 147847
ttctatcaaacaggatcaacatgagctcatcaaaccagaaagttacatgattaattttgcattttaaagatatctctctggctttagtgtgtctcctccatttcccatttaagttcatgctgggtttttgatcttttaactttcttcatcccatcctcttaccggccccatgcaacaccctcctcaccatcacattatcctcttaggtaaatatcttgttctaataagtaacaggccatttgcataggatttctgggctgggagaatgttgggttgtttgtttgtttgtttgtttgtttgtttgtagaatgtaagattgtatcccttcagggaagaaaggcaagtatagggaagtctggaagactggaagatatacaagataacatgtgatctcacctcaagttgatgagtgctacctccctacatagaagatcatccctgcatgaccatctttgcatattaga

SEQ ID NO: 14924 - DNA, 435 bp, Homo sapiens
  AL442639.2_12206
  Located on chromosome 9
  Distance between a terminus base of telomere on chromosomal short arm and 5'-terminus of this base sequence : 28114756
  Distance between 3'-terminus of neighbour sequence of sequence listing upward to telomere on chrosomal short arm and 5'-terminus of this base sequence : -435
tcaaaccagaaagttacatgattaattttgcattttaaagatatctctctggctttagtgtgtctcctccatttcccatttaagttcatgctgggtttttgatcttttaactttcttcatcccatcctcttaccggccccatgcaacaccctcctcaccatcacattatcctcttaggtaaatatcttgttctaataagtaacaggccatttgcataggatttctgggctgggagaatgttgggttgtttgtttgtttgtttgtttgtttgtttgtagaatgtaagattgtatcccttcagggaagaaaggcaagtatagggaagtctggaagactggaagatatacaagataacatgtgatctcacctcaagttgatgagtgctacctccctacatagaagatcatccctgcatgaccatctttgcatattaga

SEQ ID NO: 14925 - DNA, 259 bp, Homo sapiens
  AL442639.2_126202
  Located on chromosome 9
  Distance between a terminus base of telomere on chromosomal short arm and 5'-terminus of this base sequence : 28228838
  Distance between 3'-terminus of neighbour sequence of sequence listing upward to telomere on chrosomal short arm and 5'-terminus of this base sequence : 113647
tatgtatccatcagttcacctatcctcaacaaacttctttttctgctaatctttttcccttttcgtacaaatgtgatttaaatttttccatcttaaaactataaatgtatgtatatacaaatatatgcatacatacacattatctctctgtgtgtgcatgtgtgtgtgtgtgtgtgtgtgcgtgtgtgtgtgcgcatgtgcttaccttttagagactagaggatccttacagatcatctaagctagtggttctcaaacc

SEQ ID NO: 14926 - DNA, 400 bp, Homo sapiens
  chr9.fa.O7frz.28611451
  Located on chromosome 9
  Distance between a terminus base of telomere on chromosomal short arm and 5'-terminus of this base sequence : 28305216
  Distance between 3'-terminus of neighbour sequence of sequence listing upward to telomere on chrosomal short arm and 5'-terminus of this base sequence : 76119
tatcactggactgaaatcaaagtgtcagcaaggccatatttcctccagaagctctcggagagaatccattccttgcctcttacagaatctggtggcagccagagttttttggtttgtggctgcataactcgaaatctgccccattcttcactttgccaccttctctctctccttctctctctctctctctctctctctgtgtgtgtctgtgtgtgtgtgtgtgtgtgtgtgtgtgtgtgtctgcaaaatttccttccaactccctcttaaaaggacatacatgattacatttacagcccgacctaataatccacaataacctccccgatctcaagaaccctaacttaatcatgttacaaagattgttttttcatataaggtaacatttacaggttccagg

SEQ ID NO: 14927 - DNA, 169 bp, Homo sapiens
  DISD22_0006260
  Located on chromosome 9
  Distance between a terminus base of telomere on chromosomal short arm and 5'-terminus of this base sequence : 28627719
  Distance between 3'-terminus of neighbour sequence of sequence listing upward to telomere on chrosomal short arm and 5'-terminus of this base sequence : 322103
gcttattgttgctttagtgtgggttcttttagtcaatggatagatagatagatagatagatagatagatagatagatagatagatatgtgtatacacatatttatgcatatacttaggtacacatttatttctatgcatttatagaaattgtgccatattgtacatatc

SEQ ID NO: 14928 - DNA, 363 bp, Homo sapiens
  AL355432.3_12095
  Located on chromosome 9
  Distance between a terminus base of telomere on chromosomal short arm and 5'-terminus of this base sequence : 28708835
  Distance between 3'-terminus of neighbour sequence of sequence listing upward to telomere on chrosomal short arm and 5'-terminus of this base sequence : 80947
tactagttacgtaggtacacggataaatttaaaacattttaataatgacatcatatgaaatatttataccatataatacaggctacaaatatttttgaatactggagttattaaatgtaaacacaatttacaaaccttctgatattttcagtttttgaatttacaaaatatttggacagattctttcagaggccccattcagaagaaagtttctaaaatatttgatatatatatatatatatatatatatatatacacagacatataatattttcctcataaaccaattaatattactagtcgataaaatatatttgttatatatatacagacatataatattttcctcataaaccaattgag

SEQ ID NO: 14929 - DNA, 429 bp, Homo sapiens
  AL355433.4_104788
  Located on chromosome 9
  Distance between a terminus base of telomere on chromosomal short arm and 5'-terminus of this base sequence : 28754966
  Distance between 3'-terminus of neighbour sequence of sequence listing upward to telomere on chrosomal short arm and 5'-terminus of this base sequence : 45768
aaatgttacgcaaactatgaacactttgctaggacccaggaagcggtgcatgccagcagtctctagaacataaacttcatcagctttgtagtgaatgtgtctctgggcccaggtttttttgtttttttttaaattctttttattattattattattattatactgtaagttttagggtacatgtgcacaatgtgcaggttagttacatatgtatacatgtgccatgctggtgtgctgcacccatcaactcgtcatttagcattaggtatatctcctaatgctatccctcccccctccccccaccccacaacagtccccagagtgtgatgttccccttcctgtgttcatgtgttctcactgttcaattcccatctatgagtgagaacatacggtgtttggttttttgtccttgtgatagtttactgagaa

SEQ ID NO: 14930 - DNA, 275 bp, Homo sapiens
  D9S169
  Located on chromosome 9
  Distance between a terminus base of telomere on chromosomal short arm and 5'-terminus of this base sequence : 28818734
  Distance between 3'-terminus of neighbour sequence of sequence listing upward to telomere on chrosomal short arm and 5'-terminus of this base sequence : 63339
agagacagatccagatcccactgccatacacacacacacacacacacacacacacacacacacacacacacacatatgtatgtatctctatatatttctatatatatatctatatatttctatatgtatctctatatttctctatctctatctctatcaggaaagaactaaccccctaaagagattagacaattcaggtactagggatatagtctagaacttcctgtgtttagaagatccatattagacggccttaaataatcagtgagttgtta

SEQ ID NO: 14931 - DNA, 145 bp, Homo sapiens
  DISO7_10002686
  Located on chromosome 9
  Distance between a terminus base of telomere on chromosomal short arm and 5'-terminus of this base sequence : 28948366
  Distance between 3'-terminus of neighbour sequence of sequence listing upward to telomere on chrosomal short arm and 5'-terminus of this base sequence : 129357
catccattctcctgcctcctgctctctgtctatatatatacatacatatacatatatatacacacacatacatacacacacacacacacacacacacacacacacatacagagagggagagagagagaagcttcgtgttcttgct

SEQ ID NO: 14932 - DNA, 101 bp, Homo sapiens
  DISO7_10002687
  Located on chromosome 9
  Distance between a terminus base of telomere on chromosomal short arm and 5'-terminus of this base sequence : 28962830
  Distance between 3'-terminus of neighbour sequence of sequence listing upward to telomere on chrosomal short arm and 5'-terminus of this base sequence : 14319
tgtgaacttgcagtaagatatgcctctctggtgtgaaatgagaggtgaaggtgatatatatatatatatatatccatccaggggccacttgctatgttatt

SEQ ID NO: 14933 - DNA, 325 bp, Homo sapiens
  DISO7_10002689
  Located on chromosome 9
  Distance between a terminus base of telomere on chromosomal short arm and 5'-terminus of this base sequence : 29024208
  Distance between 3'-terminus of neighbour sequence of sequence listing upward to telomere on chrosomal short arm and 5'-terminus of this base sequence : 61277
aacctctgcctttgcaacccctgtcctctgggaaaagaaagaaagagagagagagaaagaagaaggaaagaaggaaggaaggaaggaaggaaagaaggaaggaaagaaagaaagaaagaaaaagaaagaaagaaagaaaaagaaaggagggagggagggagggaaggaaggaaggaaggaaggaaggagggagggagggagggaaggaaggaaggaaggaaggaaggagggagggagggagggagggaaggaaggaaggaagaaaggaaggaagaaaggaaggaaggaaggaaaagataaaataccccacatcaacctgctttct

SEQ ID NO: 14934 - DNA, 102 bp, Homo sapiens
  DISO7_10002690
  Located on chromosome 9
  Distance between a terminus base of telomere on chromosomal short arm and 5'-terminus of this base sequence : 29058948
  Distance between 3'-terminus of neighbour sequence of sequence listing upward to telomere on chrosomal short arm and 5'-terminus of this base sequence : 34415
aattacaagtcccaagcaggattaaaaagacacacacacacacacacacacacacacacacacacacacacagcggtaaatggcagaacactagcaccaaag

SEQ ID NO: 14935 - DNA, 121 bp, Homo sapiens
  D9S161
  Located on chromosome 9
  Distance between a terminus base of telomere on chromosomal short arm and 5'-terminus of this base sequence : 29212495
  Distance between 3'-terminus of neighbour sequence of sequence listing upward to telomere on chrosomal short arm and 5'-terminus of this base sequence : 153445
tgctgcataacaaattaccacaaacttaccaacttgaaacacacacacacacacacacacacacacggacacacacacacatatttattatctgtttccggggatcaggagtctaggcatg

SEQ ID NO: 14936 - DNA, 213 bp, Homo sapiens
  DISO7_10002691
  Located on chromosome 9
  Distance between a terminus base of telomere on chromosomal short arm and 5'-terminus of this base sequence : 29304571
  Distance between 3'-terminus of neighbour sequence of sequence listing upward to telomere on chrosomal short arm and 5'-terminus of this base sequence : 91955
aatgcaaatatcgcatatacttatgaatagatctatacctatatgtacaaaatgcatatgcatatgaaaaggatattctaaatagaaaattaaaaaattataaatttctctcttacatacacacacacacacacacacacacacacacacacacacacacacacaccatacaggaaatacaccaaaatgttaacaatggtcatctgagtaatg

SEQ ID NO: 14937 - DNA, 177 bp, Homo sapiens
  D9S263
  Located on chromosome 9
  Distance between a terminus base of telomere on chromosomal short arm and 5'-terminus of this base sequence : 29420960
  Distance between 3'-terminus of neighbour sequence of sequence listing upward to telomere on chrosomal short arm and 5'-terminus of this base sequence : 116176
tacctgggtggtgaccagtggtatatataattctctgtatgtacatgtgtgtgcgtgtgtgtgtgtgtgtgtgtgtgtgagagagagagagagagaatgcaagtgaaagacaatgacatctttaaagaactgaaagaaaaacaaaacctatcaacccatgatcctctgcccaaatga

SEQ ID NO: 14938 - DNA, 410 bp, Homo sapiens
  chr9.fa.O7frz.29874633
  Located on chromosome 9
  Distance between a terminus base of telomere on chromosomal short arm and 5'-terminus of this base sequence : 29603629
  Distance between 3'-terminus of neighbour sequence of sequence listing upward to telomere on chrosomal short arm and 5'-terminus of this base sequence : 182492
accaatacggtgaaacctcgactctactaacaatacaaaaactagccaggtgtggtggcaggcacctgtcatcccagctactcaggaggctgagacatgcgaatcactttaacctgggtggtggaggttgctgtgagccgagatcgcactactgcactccagcctggccaacagagtgagactctgtcttataaaaacaaaacaaaacaaaacaaaacaaaacaaaacaaaacaaacaaaacaagaaagtgttacctctgcttctatttttgaggagactgtggaaaattagcatcaatctttggtagtattcaccagtggaaccatctgggcctggtgcattatttttttgaaaggtaattattgattcaacatcttaaacagaggtaagcctattcagattgtatcaa

SEQ ID NO: 14939 - DNA, 232 bp, Homo sapiens
  D9S1678
  Located on chromosome 9
  Distance between a terminus base of telomere on chromosomal short arm and 5'-terminus of this base sequence : 29987382
  Distance between 3'-terminus of neighbour sequence of sequence listing upward to telomere on chrosomal short arm and 5'-terminus of this base sequence : 383343
cccaggttgtattataaatctcaaaaccgtaatctgtctctatctctctctgtctctctctctgtctctgtctctctctctgtctctgtctctctctctctctctatgtctctctctctctctctctctctctctgtctctgtctctctctctctctctctctccctccctctgtgtgtgtgtgtgtgtgtgtgtgtgtgtgtgtgtgtgtgtgtgtgtgcattgccttgga

SEQ ID NO: 14940 - DNA, 150 bp, Homo sapiens
  chr9.fa.O7frz.6616441
  Located on chromosome 9
  Distance between a terminus base of telomere on chromosomal short arm and 5'-terminus of this base sequence : 29994356
  Distance between 3'-terminus of neighbour sequence of sequence listing upward to telomere on chrosomal short arm and 5'-terminus of this base sequence : 6742
gccaaactaggtttatcatttccctttaatggtgtaaattgtgtgtgtatgtgtgtgtgtgtgtgcgcatgcgcatgtgtgtgcacgtgtgtgtgtgcatgtgtgcgtgtttgagagagagagagaggacttctgaaagcttaaagattt

SEQ ID NO: 14941 - DNA, 87 bp, Homo sapiens
  D9S270
  Located on chromosome 9
  Distance between a terminus base of telomere on chromosomal short arm and 5'-terminus of this base sequence : 30037054
  Distance between 3'-terminus of neighbour sequence of sequence listing upward to telomere on chrosomal short arm and 5'-terminus of this base sequence : 42548
aatgtgactgctgttaaaactagaggctcagccgctttgtgtgtgtgtgtgtgtgtgtgtgtgtaaaattccagaaggactacacct

SEQ ID NO: 14942 - DNA, 172 bp, Homo sapiens
  D9S1875
  Located on chromosome 9
  Distance between a terminus base of telomere on chromosomal short arm and 5'-terminus of this base sequence : 30134269
  Distance between 3'-terminus of neighbour sequence of sequence listing upward to telomere on chrosomal short arm and 5'-terminus of this base sequence : 97128
tgataatgcacattgcaggttttggtttccaggtctcaagatgagaaacacagacacacacacacacacacacacacacacacatacacacacacacatttctgtggcatcgcacaatcttcttccaaagatattttcttcttagattttcatgacaccaccctctacttgt

SEQ ID NO: 14943 - DNA, 424 bp, Homo sapiens
  chr9.fa.O7frz.30571023
  Located on chromosome 9
  Distance between a terminus base of telomere on chromosomal short arm and 5'-terminus of this base sequence : 30318005
  Distance between 3'-terminus of neighbour sequence of sequence listing upward to telomere on chrosomal short arm and 5'-terminus of this base sequence : 183564
gtctagacatacgtatttcctcaccatccctcaaattctattatgactactcacttgcaccattattggtgaggtttgtactaaaagtcataactacagtccagactatatgaagacgagtagtgtgtgggtgcatgatttcttttatatataacatatatgatgtgtgtgtgtgtgtgtgtgtgtgtgtgtggacaagtgagagagagaatcaataaccaaacattctagcagtatacattggatagttttaaaacagctttattttctttctttctgcccagatatggggcagaaattggggaaattaacctggccataaggtcttgtaattggatatcacacataaatatcctcaagccttacatcttctttatataactgatgaagacattctacgtacaatgtaagtctttgtgctaag

SEQ ID NO: 14944 - DNA, 268 bp, Homo sapiens
  AL158072.9_3063
  Located on chromosome 9
  Distance between a terminus base of telomere on chromosomal short arm and 5'-terminus of this base sequence : 30400774
  Distance between 3'-terminus of neighbour sequence of sequence listing upward to telomere on chrosomal short arm and 5'-terminus of this base sequence : 82345
tttccagacctgtttagtagacagactgggacacacacacacacacacacacacacacacacacacacacagtctctccctctctctctctctgcatatacatgtatacacaaatatatgtttaatttttaaacatgtcatctcatgagtttatactgaatatagtacttcatggcttttactgaacttcttgattacatctctatctttttctacattgagaatcttgattcccataagcacacagtatgacagaattggaacatcc

SEQ ID NO: 14945 - DNA, 428 bp, Homo sapiens
  AL158072.9_3912
  Located on chromosome 9
  Distance between a terminus base of telomere on chromosomal short arm and 5'-terminus of this base sequence : 30401520
  Distance between 3'-terminus of neighbour sequence of sequence listing upward to telomere on chrosomal short arm and 5'-terminus of this base sequence : 478
ttaattcctgcatgttaacaaatatttttaatgttctttatgttgttactcattgtttctttaagtacaagacattggtctaaaaaaaaaaagtctgatgaccatttaattttccctgtccccagttacatgctatatatatatatatatatatatatatatatatatatatatatatatatatatatatttttttttttttttttttttttttttacctgaatgtcctccagtttttcatttgcaagttcataggtttattcaaaaattttgatgttgcctatcctgtactacaattctcaggttcacagtatactctttaaatatgtgttcttggttttttttcaggaactttttttttttacttaaaatttttatttgttctgttcttctgctttagtttacttactcagacattcctatcatgc

SEQ ID NO: 14946 - DNA, 317 bp, Homo sapiens
  AL158072.9_8491
  Located on chromosome 9
  Distance between a terminus base of telomere on chromosomal short arm and 5'-terminus of this base sequence : 30406088
  Distance between 3'-terminus of neighbour sequence of sequence listing upward to telomere on chrosomal short arm and 5'-terminus of this base sequence : 4140
taaaggaaattcagtttaccttgaaatttataaaataatataactgaggaattggtatttttgtaaatataagcaaggttaaacttttttgatatgttaaaagaaattttaggtatgtgggccaaatgtcattttctttttgatacacacacacacacacacacacacacacacacacacacacacttactttagcatctcactttttgtaaaggcaagatttaaaacactttaaacagcaagaaacttgagctttctcttttgattttaatttcaataatagagcatgagctgttcaggaggttcaagtttctatt

SEQ ID NO: 14947 - DNA, 166 bp, Homo sapiens
  D9S1868
  Located on chromosome 9
  Distance between a terminus base of telomere on chromosomal short arm and 5'-terminus of this base sequence : 30412961
  Distance between 3'-terminus of neighbour sequence of sequence listing upward to telomere on chrosomal short arm and 5'-terminus of this base sequence : 6556
acatagtcaagagcgccttaacatagcggctggaattttcatatatgatcttggtagtaatgtgtgtgtgtgtgtgtgtgtgtgtgtgtgtgtgtgtgtgtgtattatattgctactaaatatatatgagaccagattggatagtgaatcagttgacgtttatttg

SEQ ID NO: 14948 - DNA, 378 bp, Homo sapiens
  AL158072.9_31809
  Located on chromosome 9
  Distance between a terminus base of telomere on chromosomal short arm and 5'-terminus of this base sequence : 30429328
  Distance between 3'-terminus of neighbour sequence of sequence listing upward to telomere on chrosomal short arm and 5'-terminus of this base sequence : 16201
gaataaacgatgaactgctctaagtttcaggttattcactcaacaaatattgattaaatatgaattttccaggaacagttctttatactggcaatatatgaacagaaaatatactttatcctcaaagaattcatatctatatgaatatatatgcatatatatacagcaatgtatatgtgatatcatatatacatatatatatatatatatatatatatatatagagagagagagagagagagagagagagagagagagaaagcctgcagaaatcactcggatgtcttagaccaagacagaaatgatgacactgatgacactcgtgtcctgtgatctcactgttagatattggatgtattcttgaggttgaactgagac

SEQ ID NO: 14949 - DNA, 383 bp, Homo sapiens
  AL158072.9_124645
  Located on chromosome 9
  Distance between a terminus base of telomere on chromosomal short arm and 5'-terminus of this base sequence : 30522350
  Distance between 3'-terminus of neighbour sequence of sequence listing upward to telomere on chrosomal short arm and 5'-terminus of this base sequence : 92644
ggaattggcagaaattaactacaggttttcttggttttttgttttgttttgttttgttttgttttgtttttgtggggcaaaagaaggggttttgatctcagtagactttcctgtccctggagcttggatttctgtttctgtctcactgttaaaggactgagaccatatctccatataattaggttgtgcaggtaagcagttactgtcttttcctaaatgggtacacacttgtgtaccaggggcagcactgccatggagacctgatcaaaggggcctgcctggtatttaatgaggtggaagaagaatgccacaatgaatacagcctcaactactctgaattatgaggtttatgtggttgagtgtagaagtttctccaaatggac

SEQ ID NO: 14950 - DNA, 269 bp, Homo sapiens
  AL158072.9_194062
  Located on chromosome 9
  Distance between a terminus base of telomere on chromosomal short arm and 5'-terminus of this base sequence : 30591678
  Distance between 3'-terminus of neighbour sequence of sequence listing upward to telomere on chrosomal short arm and 5'-terminus of this base sequence : 68945
catgtataggatcaccaaggagcaaaaatgattcaagaaacaaggaattaaatttatttatcactcatattctccttcagttcctttctcttttcttttatctctctctctctctctctctccctcacacacacacacacacacacacacacacacacagagaacaatgaacccaaggattcagcacttaatctaccagcccagttctatctaatactgaatagtgacaaacagaattattgtgactgtttacaaatggctactgcttc

SEQ ID NO: 14951 - DNA, 358 bp, Homo sapiens
  chr9.fa.O7frz.30919005
  Located on chromosome 9
  Distance between a terminus base of telomere on chromosomal short arm and 5'-terminus of this base sequence : 30665444
  Distance between 3'-terminus of neighbour sequence of sequence listing upward to telomere on chrosomal short arm and 5'-terminus of this base sequence : 73497
tgatggagtactgaagtctcacctattgttattcctgtctggtgaatgtgaaacagaaaaacataggaaaagtttctggtttggattgttattcaaatgtgtgattctatataaaactgctttactatatatatatatatatatatctcttctatataaaactgctgtactataagaccattatttttgatgactgccattcaacacacgtacggggttgaaatagtttaataattgtaaaccttattcttattacattaataatccatagaagtgttgccaagattgagtgaaaatatatgggtttaattcctggtattggtgttatcttgctctgtaatttggattaagtcttcaa

SEQ ID NO: 14952 - DNA, 387 bp, Homo sapiens
  AL360180.5_54133
  Located on chromosome 9
  Distance between a terminus base of telomere on chromosomal short arm and 5'-terminus of this base sequence : 30725136
  Distance between 3'-terminus of neighbour sequence of sequence listing upward to telomere on chrosomal short arm and 5'-terminus of this base sequence : 59334
aaagtcataagatatgccataatttttacaaaaaaatcaaaatcctgtaggaatgattaacatatatatatgataatgtgtgtgtatatatatatatatatatatatatatggagagagagagagacagagagagggacagagagagagagagagacatggatattgatatctatctttgtttatagttttttatacttatgtttgtttctttttggcaacaatgacaaacaaaatatatagaaaaaaatatagcacaattattccctgtagaaacaactcatataatttgcattaaaagtaaaatattataattaattcatcatcatcacaataattttttcaagaattgagtagggtaattcaaaaggctttacacctgattaag

SEQ ID NO: 14953 - DNA, 217 bp, Homo sapiens
  AC016838.4_21999
  Located on chromosome 9
  Distance between a terminus base of telomere on chromosomal short arm and 5'-terminus of this base sequence : 30746467
  Distance between 3'-terminus of neighbour sequence of sequence listing upward to telomere on chrosomal short arm and 5'-terminus of this base sequence : 20944
gtaccacggcttcaagtttagcattttttcgattaccgcatacttgcagagaaccaagtccacccctaagcctgattcactgtgtaacagagcatttttttcttttattattattattattattattattattattattattatactttatgttttaggatacatgtgcacaatgcacaggtttgttacatatgtatacatgtaccatgttggtgtg

SEQ ID NO: 14954 - DNA, 356 bp, Homo sapiens
  AL138893.5_62348
  Located on chromosome 9
  Distance between a terminus base of telomere on chromosomal short arm and 5'-terminus of this base sequence : 31114584
  Distance between 3'-terminus of neighbour sequence of sequence listing upward to telomere on chrosomal short arm and 5'-terminus of this base sequence : 367900
gaccttgtgatccagtaagttaatgcttaataaactcccttttatctctatctatctatctatctatctatctatctatctatctatctatctatctatctatctatctatctatatcttattagttctgtccctctaagagaaccctgactaatacaggcttaatgcagaacaaaaatacaggtggaaaatttgggtggggtgaaaaataggtaaaacttcattattactaatagtgttgtagtagcaaaaataagcttttaatggttaaatataatcttgacttattaaaataaatgatattgtttgtattatttcattttttagacctggtcctggaactgtatagttaagtg

SEQ ID NO: 14955 - DNA, 195 bp, Homo sapiens
  AL138893.5_93837
  Located on chromosome 9
  Distance between a terminus base of telomere on chromosomal short arm and 5'-terminus of this base sequence : 31145973
  Distance between 3'-terminus of neighbour sequence of sequence listing upward to telomere on chrosomal short arm and 5'-terminus of this base sequence : 31033
acttggaccggaacttagacgcttgtctctgctggttctcagacctttgagctgcggatcttgggacttctcagcctccataattttttataatttttctctctctttatacacacacacacacacacacacacacacacacacacagagagagagagagagagagagagagagtcatgcagaacaaatatcctc

SEQ ID NO: 14956 - DNA, 169 bp, Homo sapiens
  D9S319
  Located on chromosome 9
  Distance between a terminus base of telomere on chromosomal short arm and 5'-terminus of this base sequence : 31191911
  Distance between 3'-terminus of neighbour sequence of sequence listing upward to telomere on chrosomal short arm and 5'-terminus of this base sequence : 45743
gccagtgttctccagagaaacagaacttgtaggatatatagacatgatagatagatagatagatagatagatagatagatagatagatgatagacagatagatagaaagatagataatctattataaaaaaaagttaactcaagcagttattttggctgacatatccca

SEQ ID NO: 14957 - DNA, 246 bp, Homo sapiens
  DISO7_10002692
  Located on chromosome 9
  Distance between a terminus base of telomere on chromosomal short arm and 5'-terminus of this base sequence : 31388750
  Distance between 3'-terminus of neighbour sequence of sequence listing upward to telomere on chrosomal short arm and 5'-terminus of this base sequence : 196670
ttggcttctcaacataaacacaaaatcattttgttttattttaacaacttacttagcatcctttctattttatatatacatatgtgtatatatttcatattactatatactattgtactatcatgtcatatatgacaaatatatatttcatatatatatatatatatatatatatgtatatatatatatatcctccttccctccccaaaagtccgtcaacccaaactccaagtttctgcagaagct

SEQ ID NO: 14958 - DNA, 425 bp, Homo sapiens
  AL355584.8_20381
  Located on chromosome 9
  Distance between a terminus base of telomere on chromosomal short arm and 5'-terminus of this base sequence : 31475195
  Distance between 3'-terminus of neighbour sequence of sequence listing upward to telomere on chrosomal short arm and 5'-terminus of this base sequence : 86199
tttcattgtaaggcaatcatactttccatttatttaaaaagtatcttgaatttttcttcctcggagccctcattgttgcacattgattcatgggagctttatgttggaaataattttctatacctgcatgtttgctggccttcaacacatacagttctttctttacacttgataccgtttcaaggtgtgtgtgtgtgtgtgtgtgtgtgtgtgtgtgtgtgtgtgtgtgttcttacttgctgagtcattactttggtacttcttttccattacttttgctttgtaataggttgcaaagttctgcaatcctctttcttcctagacagtcctcacataaatcttggcatcaagtcctctttgttcaacattccaccaaatcccatgctgtagccttactcccgatgatacaattcaggacatgatca

SEQ ID NO: 14959 - DNA, 416 bp, Homo sapiens
  chr9.fa.O7frz.31573874
  Located on chromosome 9
  Distance between a terminus base of telomere on chromosomal short arm and 5'-terminus of this base sequence : 31491347
  Distance between 3'-terminus of neighbour sequence of sequence listing upward to telomere on chrosomal short arm and 5'-terminus of this base sequence : 15727
ggtaatatcttccatagcaatttataaaagacgaagtcatggttttcatgtggtcatttgttttgtaattgtgtatgtgtgtgtgtgtgtgtgtgtgtgtgtgtgtgtgtttgtgtgatgaatcctaaggataaagtgaatcatgtcagctcatggcttacagaagacatttctaaggtgtacacaatatatttgaggcatgaaatttctgacccttcgtctccagtataaaatttaaaaaaaagattgcaaattattaacatgtcttttctggactaaatatcccacaaattacctcaatgattgtttttagggtcaagttatgaaaaaagttaagactgacacgtgtggttgtcttgaagaagagatttctaattaattgattgtaggcagagctacatgctttagatgcaggt

SEQ ID NO: 14960 - DNA, 364 bp, Homo sapiens
  HUMUT5132
  Located on chromosome 9
  Distance between a terminus base of telomere on chromosomal short arm and 5'-terminus of this base sequence : 31614756
  Distance between 3'-terminus of neighbour sequence of sequence listing upward to telomere on chrosomal short arm and 5'-terminus of this base sequence : 122993
ccagaaatttgccagtatatctacttctaatattccttcaagaaagttgataataccttgatagtcattactgaggtaaattaaatttcaggttaaagtatatctggaattttcagtacctattttatttcatatactttatctttctttctttctctttctttccttccttccttccttccttcctctctttctttctttctctctctctctccttccttccttccctctttctttccttccttccttctttctttctttctttctttctttctttctttctttctttctttctttctttctttctttctttcttttctttctttctttctttcttttttgacagagtcttgctttgttgccc

SEQ ID NO: 14961 - DNA, 304 bp, Homo sapiens
  chr9.fa.O7frz.32023196
  Located on chromosome 9
  Distance between a terminus base of telomere on chromosomal short arm and 5'-terminus of this base sequence : 31747820
  Distance between 3'-terminus of neighbour sequence of sequence listing upward to telomere on chrosomal short arm and 5'-terminus of this base sequence : 132700
agatggtcattaggtttcactcccttaaaataatgcatttgtaactatggaaggaaaaaatatatatattattaaaagtttcatgttgcttatattagtaacacaagtataataatggattttggggtcattgcatcgtgtgtgtgtgtgtgtgtgtgtgtgtgtgtatatacactttgtttaaagttggtttatatatataattttatatatatatactttgtttaaagttaatttgaatgcttaaataagactgatactacatttataaatgttttattatacttacaagcatggcttaaat

SEQ ID NO: 14962 - DNA, 402 bp, Homo sapiens
  chr9.fa.O7frz.32133323
  Located on chromosome 9
  Distance between a terminus base of telomere on chromosomal short arm and 5'-terminus of this base sequence : 31857854
  Distance between 3'-terminus of neighbour sequence of sequence listing upward to telomere on chrosomal short arm and 5'-terminus of this base sequence : 109730
tgtacaatagatctcctgaacatattcctcctaactgatattttgtattctttaaccaacatcttccccaatcccctcccctccactaagcccctgataattgtcattctactctctgtttctataagttcaaccttttcagattccacaaacaaatgagatcacgtgatattgtctttctgtgcctggcttaattcacttaacacagtgtcctcgaggttcatccatgttcttgcgaattacaagatttccttcttttcaaaggctgaatagttttgttgtgtgtgtgtgtgtgtgtgtgtgtgtgtatgtgttgcctacaggtgcatataaaatcttctttattaattcattcattggtggacaatttatatattgatggttgattctacatcttaggta

SEQ ID NO: 14963 - DNA, 338 bp, Homo sapiens
  chr9.fa.O7frz.32246285
  Located on chromosome 9
  Distance between a terminus base of telomere on chromosomal short arm and 5'-terminus of this base sequence : 31966789
  Distance between 3'-terminus of neighbour sequence of sequence listing upward to telomere on chrosomal short arm and 5'-terminus of this base sequence : 108533
ttgtgaaggatggtacattaacttttagaagtgatgggctgtgatagtcctgctgtgatactgaatggcactggctgaacttcagcacagtcttccaaagatgtaagatattttctctctatagggcaaagcttacgtacatgagggcagatctgtgaattcatatatttcaacctgtccttgagcagtaaaacataatggtgccatttgaaaataattctataaaatagctcattctatttgttctatagagagatactggaaggtccatacatatatatatatatatatatatgtaagtgtctttatgagatagtagttggagtccacaaagtaat

SEQ ID NO: 14964 - DNA, 421 bp, Homo sapiens
  AL159995.5_82010
  Located on chromosome 9
  Distance between a terminus base of telomere on chromosomal short arm and 5'-terminus of this base sequence : 31982304
  Distance between 3'-terminus of neighbour sequence of sequence listing upward to telomere on chrosomal short arm and 5'-terminus of this base sequence : 15177
caggacctttactgagtttctctgattcctgggccagggctgtatgtgttcagctacatacatggcattgatcaacgtagcatacctttcttcactaggtcagagacaaagaaggacatggacgtcagtcacttcttgtgaggttccaggtcatgggattccaggctgctcttaagctttgcatataactaactgtctcgtgaaccctgggcttaaggcttgaggacactgcttagctaacctcataattgagtgagtcaattccttccattactggtgtgtgtgtgtgtgtgtgtgtgtgtgtgtgtgtaactcttctagaatgattctattggttgctgcttcgcaggtctaaacctgacttatacttaaaaaataaaatgtttaccaagtaatttaattgcatcagtgaataaagatc

SEQ ID NO: 14965 - DNA, 292 bp, Homo sapiens
  AL354704.11_93283
  Located on chromosome 9
  Distance between a terminus base of telomere on chromosomal short arm and 5'-terminus of this base sequence : 32156972
  Distance between 3'-terminus of neighbour sequence of sequence listing upward to telomere on chrosomal short arm and 5'-terminus of this base sequence : 174247
gcttccatttaggatttaattatggtaaacatgttccctattttctcattattttgctatcaagtatgatatttataaataatagttttaaaagcagttaaaaatgcataatctgtcttcttatagagcatccatcctatttgggagagagagagaatataaatagatacacacacacacacacacacacacacacacacaccatgccaaatatcaagaagttgtatgaaagtggaaataattttgtattttttttttgccacaaattctgaaagcagactgcctagtattc

SEQ ID NO: 14966 - DNA, 292 bp, Homo sapiens
  chr9.fa.O7frz.32570404
  Located on chromosome 9
  Distance between a terminus base of telomere on chromosomal short arm and 5'-terminus of this base sequence : 32263695
  Distance between 3'-terminus of neighbour sequence of sequence listing upward to telomere on chrosomal short arm and 5'-terminus of this base sequence : 106431
atagatataccgctagccagactaataaagaagaaaagagagaagaatcaaatagacacacacacacacacacacacaaaatgataaaagagatatcaccactgatcccacaaaatacaaattaccatcaaagaatactataaacacatctacctaaataaaacagaaaatctagaagaaatggataaattcctagacgtatacaccctcccaagactacaccaggaagaagttgaatccctaaatagaccaataacaagttctaaaattgaggcagtaatcaatagcctac

SEQ ID NO: 14967 - DNA, 470 bp, Homo sapiens
  AL359032.13_101797
  Located on chromosome 9
  Distance between a terminus base of telomere on chromosomal short arm and 5'-terminus of this base sequence : 32361248
  Distance between 3'-terminus of neighbour sequence of sequence listing upward to telomere on chrosomal short arm and 5'-terminus of this base sequence : 97261
taaatctgtgctaaattgcaacttttaagtaagactactgggttttattatgctatctattattaaaattaccaatattataaaagcaggccatatatatatatatatatatatatatatatatatatatatatacacacacatacacacacacatttctatacatagtttgtatgtatgcatagttctatatttctgtatatgcatagttccattacttttaatgacaaaaaccacagttacttttgcacaaacctatatattcacacagatatgtgtctatatacagatgtgtatacacacacacacatatttatattctattgagtcacacatatttatttgtattttttgtcttttgcttagatctttgctaataacacaatttacctattgatttttcttcaggaaataaaaaaaatcacaaacttttgaaaaccaacaaaaatagcaggaaagatttagacaga

SEQ ID NO: 14968 - DNA, 349 bp, Homo sapiens
  AL353735.6_14892
  Located on chromosome 9
  Distance between a terminus base of telomere on chromosomal short arm and 5'-terminus of this base sequence : 32512581
  Distance between 3'-terminus of neighbour sequence of sequence listing upward to telomere on chrosomal short arm and 5'-terminus of this base sequence : 150863
taccaatcctttcttccactacatccagcttgctctatttcagacttccttgtgttcaatactttttaaggctttgtaggggaaaaaaaatctatctatctatctatctatctatctatctatctatcatttatctatctgtctagctatgtatctatcttctatctatcaatcatctatctacttatctatccattagttagtgcacataaaacatgcagaatatctattagaaatatattttctcttggcactttccagtcaaaatttcaacacaggctacaattgttttgattctttctacaaaaggttagttttgcctactataatcaattctgtaagtgaagct

SEQ ID NO: 14969 - DNA, 243 bp, Homo sapiens
  HUMUT2100
  Located on chromosome 9
  Distance between a terminus base of telomere on chromosomal short arm and 5'-terminus of this base sequence : 32512617
  Distance between 3'-terminus of neighbour sequence of sequence listing upward to telomere on chrosomal short arm and 5'-terminus of this base sequence : -313
atttcagacttccttgtgttcaatactttttaaggctttgtaggggaaaaaaaatctatctatctatctatctatctatctatctatctatcatttatctatctgtctagctatgtatctatcttctatctatcaatcatctatctacttatctatccattagttagtgcacataaaacatgcagaatatctattagaaatatattttctcttggcactttccagtcaaaatttcaacacagg

SEQ ID NO: 14970 - DNA, 411 bp, Homo sapiens
  AL353735.6_77831
  Located on chromosome 9
  Distance between a terminus base of telomere on chromosomal short arm and 5'-terminus of this base sequence : 32586440
  Distance between 3'-terminus of neighbour sequence of sequence listing upward to telomere on chrosomal short arm and 5'-terminus of this base sequence : 73580
gagcatctgcttaagtagaaatagtttggggaggacaaagaatatataaatatatatcccctttgtatcttcacaaaacacatttaattatttgattttaattttcatgtatctatctgtatatctgtatctgcacctataatttatctatcatctatctatctatctatctatctatcatctatctatctatctatatatctatctatgtatttagctagctagctatctgtcattactttggggaggggtcattactcatgttaaaaaatgttttttgaagaaagtctttaacccttatttttctagaagggtgattatctttaaaatagagaggtaaatgtcaatgtgatttataagatgtgtgagaaagtaattacaacagaggttaattgacatttatggaattgt

SEQ ID NO: 14971 - DNA, 474 bp, Homo sapiens
  chr9.fa.O7frz.32948138
  Located on chromosome 9
  Distance between a terminus base of telomere on chromosomal short arm and 5'-terminus of this base sequence : 32705613
  Distance between 3'-terminus of neighbour sequence of sequence listing upward to telomere on chrosomal short arm and 5'-terminus of this base sequence : 118762
tgcctatcatttgatccagcaatcctactacggggtatctacctagagaaaaagcagccattatatgaaaaagatacttgcacatgcatgtttctagcaaatgcaaaaatgtaaaactgcccaaatgcccatcaatcaatgagtgggtaagaagttgtgatatgtatacacacacacacacacacacacacacacacacacacgtatatacatatatagatatataatagtattccatggtgtatatatatatatatatatatatacatatatatatatatatatatatatatatatacaccatggaatatacaccatggaatactatatataccatggaatactaaatataccatggcatatatgtataccatggaatactattcagccataaaaaggaatgaaataatggcattcacagaaacctggatggaattggagaccatcattctaagtgaagtaagaacaggaatg

SEQ ID NO: 14972 - DNA, 370 bp, Homo sapiens
  AL355582.3_43205
  Located on chromosome 9
  Distance between a terminus base of telomere on chromosomal short arm and 5'-terminus of this base sequence : 32729195
  Distance between 3'-terminus of neighbour sequence of sequence listing upward to telomere on chrosomal short arm and 5'-terminus of this base sequence : 23108
ttcattggttctaacaatgaaggcaagggctgtaggaaagacttgcggagactttattcagtgagtctggagcagcaagtgatatggagctgaaccagagtgtccagataatacaattttgtaaaaagcaactatctgtatactcgtgtagagagaaaacactgaatctttgctcaaccctacacttttgagttctgggtataaataaaaaaggtaaacacacacacacacacacacacacgttataactagatcataaggtaaaattctgcttctaggagagcataaactgagtctttcctcatatagacctccctcaaatagttggtccaggaaaatcccaccacttccaaagattagcagtattaga

SEQ ID NO: 14973 - DNA, 353 bp, Homo sapiens
  AL355582.3_62512
  Located on chromosome 9
  Distance between a terminus base of telomere on chromosomal short arm and 5'-terminus of this base sequence : 32748441
  Distance between 3'-terminus of neighbour sequence of sequence listing upward to telomere on chrosomal short arm and 5'-terminus of this base sequence : 18876
taattagtacattcagtgcatgactccttctggtaaaaacgtaatgaaacacattaggagctccagtcaagttcatataatatcatcaaaaggcaaacaatgtctttaagaagaaaaatgtatgaaagttatggaatcaaaacattttatgccagaaagacacaaacatgcgcgcgtgcacacacacacacacaaacacacacacacacacacacacacacaaacacattacatggatagttcatagttgccattatccgtgagagaagtaattgtggtttgagtgaattgggaggaagattaagaaagaatccattttctgtgatcttttgtacaacgtcaaagcaacttac

SEQ ID NO: 14974 - DNA, 471 bp, Homo sapiens
  chr9.fa.O7frz.33052989
  Located on chromosome 9
  Distance between a terminus base of telomere on chromosomal short arm and 5'-terminus of this base sequence : 32797383
  Distance between 3'-terminus of neighbour sequence of sequence listing upward to telomere on chrosomal short arm and 5'-terminus of this base sequence : 48589
aactttggccataatctgatacatatgcgggccaccgttagagctaccaggtgtgtaatgaacacacattctggtactgacattagtagtggcattgatcgtgaccaagcagttggagcatgttacttatattgactctccttggtaagtaactggaaaaatccaactcaaactgccctacacacacacacacacacacaaatatttactgaaatgacagatttttatgtgtatctaagcttcagatttgggttattctaatttataaaattaggactttgttttattctatttcagtcattttagctcatggctttagtctaggattctatgtgatgatttttttgcaactatagactatagtgaatattccaacgagttcactttcccccaaaagataataagcttctcttttaaaagatccagctaaaatcgaggtagttcttcttgtcattgaataggtcataatgc

SEQ ID NO: 14975 - DNA, 294 bp, Homo sapiens
  AL354854.5_45417
  Located on chromosome 9
  Distance between a terminus base of telomere on chromosomal short arm and 5'-terminus of this base sequence : 32888975
  Distance between 3'-terminus of neighbour sequence of sequence listing upward to telomere on chrosomal short arm and 5'-terminus of this base sequence : 91121
atgtcctacctttgatctaaagtagaaagcaacaacttgaaaaacaattgttcaaatctaaaaattatcttcttatatgaaatccattcaataatttttttcataaatatctgaacatcattgagcacttttctaaaagtcaatgtgtaaaattttacatatatatacatacacacatgcatacacacatcatatatatatatatatatatatatacacacacatcccatatttacagtaagcaaaaattcaaacaaacgtcgacaacatctgacataatgttacagctagcca

SEQ ID NO: 14976 - DNA, 351 bp, Homo sapiens
  chr9.fa.O7frz.33147571
  Located on chromosome 9
  Distance between a terminus base of telomere on chromosomal short arm and 5'-terminus of this base sequence : 32907960
  Distance between 3'-terminus of neighbour sequence of sequence listing upward to telomere on chrosomal short arm and 5'-terminus of this base sequence : 18691
atgttacagacaatccaattagacttgtttagttattttaaaatgtacaattaagttattattgactataattgccctgttgtgttatcaaatagtaagtattctttttctacctatttttgtacccattaaccatccctacctctccctaccccagacccccactacccttcccagcctttgattaccatccttcaactttgtgtgtgtgtgtgtgtgtgtttgtgtgtgtctgtgtgtgtgtgacaggcttgctctgtggcccaggctggggtgcagttgtgcaatctctgctaacctcagcttgcctggcctgattcgatttttatgttgctcaaataagtgagaaca

SEQ ID NO: 14977 - DNA, 398 bp, Homo sapiens
  AL354854.5_128660
  Located on chromosome 9
  Distance between a terminus base of telomere on chromosomal short arm and 5'-terminus of this base sequence : 32972176
  Distance between 3'-terminus of neighbour sequence of sequence listing upward to telomere on chrosomal short arm and 5'-terminus of this base sequence : 63865
ctcaggaatagtcttaatttcctttttttcgaaggaatcatatgccactgtttgtgtacatgatttgaattatttttgaaaagagatgtttgaaaaatatcatgtaggaactctggaaatcagattctccctttccttaacatttcctgtgcttgaactttgtgtgtgtgtgtgtgtgtgtgtgtgttttccaaactgtttttataaagactgcatttcttattatttgtggttattgaagtcccttttcatttagctcatgataaccaatgatttgacagagatttccatgaattccaagcatttcagccaacagtgaagccgagtatctcctcagaccttttctgaacatgagtcctgtccagagcatgtatgtggctttctaaatttcctagtat

SEQ ID NO: 14978 - DNA, 120 bp, Homo sapiens
  DISO7_10002694
  Located on chromosome 9
  Distance between a terminus base of telomere on chromosomal short arm and 5'-terminus of this base sequence : 33262907
  Distance between 3'-terminus of neighbour sequence of sequence listing upward to telomere on chrosomal short arm and 5'-terminus of this base sequence : 290333
acatgattatacatacacgagtgcatgcacacacacacacacacacacttttaaaggtctcattataagagtcatcaataactacagacccattaaaatcaagagcatgtgaactcttgt

SEQ ID NO: 14979 - DNA, 189 bp, Homo sapiens
  Z67043
  Located on chromosome 9
  Distance between a terminus base of telomere on chromosomal short arm and 5'-terminus of this base sequence : 33433048
  Distance between 3'-terminus of neighbour sequence of sequence listing upward to telomere on chrosomal short arm and 5'-terminus of this base sequence : 170021
cagggcagtggttatttacaaaacagtttagaagtatgacaatatatttagcaaccagtagagccagagccatattggtgcataatggctgaataccaggtctaactcctccccgaccccaccagacacacacacacacacacacacacacacacacacacacacacacaggtgtcctcaatccgagct

SEQ ID NO: 14980 - DNA, 366 bp, Homo sapiens
  AL162231.13_27323
  Located on chromosome 9
  Distance between a terminus base of telomere on chromosomal short arm and 5'-terminus of this base sequence : 33451674
  Distance between 3'-terminus of neighbour sequence of sequence listing upward to telomere on chrosomal short arm and 5'-terminus of this base sequence : 18437
atggttgaacatacagatgaacaggtcacaatgaatatatgaaaaaataaatgaaagatgaaagaaggaagaatgggctgatgaagagataaagatgagtagacatatagacacatggatggatggatggatggatggatggatggatggatggatggatgaggcagaaaaatacaggcaattaaatctgctccactatatactctagatctggaatgggaaacagaatagcactccacaatagtgtcttctgagaggtctatctcttgggtctggcagaacagttctctgggtgaccgtacactgacccagttctcctccctttctcacttggaatgcaaaatcttgagataaggaagaggtgac

SEQ ID NO: 14981 - DNA, 235 bp, Homo sapiens
  chr9.fa.O7frz.36904627
  Located on chromosome 9
  Distance between a terminus base of telomere on chromosomal short arm and 5'-terminus of this base sequence : 33730860
  Distance between 3'-terminus of neighbour sequence of sequence listing upward to telomere on chrosomal short arm and 5'-terminus of this base sequence : 278820
ctgatccaaatttgactgatacagatacaataacaaaaaactgagtaagctaaaaagtaacagacaaaagagattttcagattaaacacacacacacacacacacacacacacacacacggtttttagatggatcaccacataaatgacaaagtttcaattcaccaggaagatattataattacaaacttgtattggcctgatagaattaatagaaggacctgtaattctagcac

SEQ ID NO: 14982 - DNA, 442 bp, Homo sapiens
  AL353662.5_91752
  Located on chromosome 9
  Distance between a terminus base of telomere on chromosomal short arm and 5'-terminus of this base sequence : 33834402
  Distance between 3'-terminus of neighbour sequence of sequence listing upward to telomere on chrosomal short arm and 5'-terminus of this base sequence : 103307
gaagtctcgaattagctcaatcacagcttctccatcaagctccaatgccctcattaggagccctttccagtcagaatgcccacttcccttaaagaacaattgccatggaataaaagccactgtgctgtgtgtgtgtgtgtgtgtgtgtgtgtgtgtgtgtgtgtgtgtgtggtttatttgggtgaagggaggttaggatatctagctctttctgaacgcatttctttaatgaattgcccagattattttattgccctgtatatttgcattcctcagttgtagcaggggaataggcatatattaactcttgggtttgatgcttctctgaggctcactagggaagacctatgcttactctacaagtgtcatggcctgtggggttcatgtatatatatatatatccatttaattgtctaatctaatctatttcctacctttctgg

SEQ ID NO: 14983 - DNA, 200 bp, Homo sapiens
  D9S1805
  Located on chromosome 9
  Distance between a terminus base of telomere on chromosomal short arm and 5'-terminus of this base sequence : 33926361
  Distance between 3'-terminus of neighbour sequence of sequence listing upward to telomere on chrosomal short arm and 5'-terminus of this base sequence : 91517
agctattcgggaggctgaggcgggagaatcacttgaacccaggaggtggaggttgcagtgagccaagattgtgtcactgcactccagcctgggttacagagtgagactccatctcaattaaaaacacacacacacacacacacacacacacacacacacacaaataacaatattagaaagacaatacatgaacaaaatga

SEQ ID NO: 14984 - DNA, 386 bp, Homo sapiens
  AL354989.3_94169
  Located on chromosome 9
  Distance between a terminus base of telomere on chromosomal short arm and 5'-terminus of this base sequence : 34012229
  Distance between 3'-terminus of neighbour sequence of sequence listing upward to telomere on chrosomal short arm and 5'-terminus of this base sequence : 85668
catttctggcattgtgaacagcatgagcatgaaacaaaataattatatttcattgaagaatttttcatgtatgatatttataagcaattatttctagagtttgaagtccatggcaagaggtgatgatagtagaggctggactgaggagactcttggttttgttttgttttgttttgttttgttgaggcagggtcttgctctgtcacccaggtgcgagtgcagtggcaccatcatggctcactgcagccttgacctcctgggctcaagtagagacagggtctcactgtgctgcctgagctgttcataaattcctgggctgaagtaatacttctttctcggccttccaaagtctggccccgaggagagtcttaatgccatgctaagta

SEQ ID NO: 14985 - DNA, 285 bp, Homo sapiens
  chr9.fa.O7frz.36171641
  Located on chromosome 9
  Distance between a terminus base of telomere on chromosomal short arm and 5'-terminus of this base sequence : 34094579
  Distance between 3'-terminus of neighbour sequence of sequence listing upward to telomere on chrosomal short arm and 5'-terminus of this base sequence : 81964
cttaaggtcaggagtttgagaccagcctggccaacatggtgaaccccatctctaccaaaaatacaaaaaattagccgggcgtggtggcgggtgcctgtaatcccagctacttgggaggctgaggcaggctaatcgcttgaacccaagaggcagaggttgcagtgagccagtgttgcgccactgcactccagcctgggtgacaacagtgaaactccatctcaaaataaataaataaataaataaataaataaataagacagggtttacagctgaattagcaggata

SEQ ID NO: 14986 - DNA, 263 bp, Homo sapiens
  D9S1817
  Located on chromosome 9
  Distance between a terminus base of telomere on chromosomal short arm and 5'-terminus of this base sequence : 34263306
  Distance between 3'-terminus of neighbour sequence of sequence listing upward to telomere on chrosomal short arm and 5'-terminus of this base sequence : 168442
agctgtagtgagccctgattgcaccactgccactgcactccagcctggtcatagagagagatcctgtctctctctctctctctctctctcacacacacacacacacacacacacacacacacacacacaaaaggcttagataaccacaaggactgtatgttaaacattaaacctacatttaaataaccaaatcatattttcttgaatccaaaattattctgaaaaacaaaacaaagaaatttaaagtctcaaggctcctaacg

SEQ ID NO: 14987 - DNA, 378 bp, Homo sapiens
  AF029308.1_201007
  Located on chromosome 9
  Distance between a terminus base of telomere on chromosomal short arm and 5'-terminus of this base sequence : 34315935
  Distance between 3'-terminus of neighbour sequence of sequence listing upward to telomere on chrosomal short arm and 5'-terminus of this base sequence : 52366
gatgctgtgaggactaaatgagctgtatacataaaaggcctggcccagaatgagcactcagagatggtggatgtagttttttgtgggaataaaatgttaagacaggttccccaagcttcatctgcgtaaagttttaacatgatctctggatgcttgtcagataattgtctagattaatcacttgaaaagcattacacacacacacacacacacacacacacacactgttttgtgatctgcttttttcgacaaaacaaaatactggaacaaaatttcatgtttcaattcttcatctagatcataattgtaaatagctaattgtgtggtgatatgcagagtgatatttaatcagtcccctattctgaaacattgaggtgg

SEQ ID NO: 14988 - DNA, 358 bp, Homo sapiens
  AF029308.1_137919
  Located on chromosome 9
  Distance between a terminus base of telomere on chromosomal short arm and 5'-terminus of this base sequence : 34378911
  Distance between 3'-terminus of neighbour sequence of sequence listing upward to telomere on chrosomal short arm and 5'-terminus of this base sequence : 62598
gagcagtatacactgcaccatatttgtagtcttttatcccttgaccccctcctacttttctccccaagcccccaaagtccattgtatcattctatgccttcgcatcctcatagctaactcccacatatcagtgagaacatatgatgtttggttttcccttcctgagttacttcactagaataataatctccagtctcatccaggtcactgcaaatgctgttaattcattccttttcatggctgtgtagtattccatcatacacacacacacacacacacacacacacacacacacacgcacatatgtatacgtataaaaaaccacagttttttttatccactcattgatcagtatttg

SEQ ID NO: 14989 - DNA, 283 bp, Homo sapiens
  D9S1878
  Located on chromosome 9
  Distance between a terminus base of telomere on chromosomal short arm and 5'-terminus of this base sequence : 34501512
  Distance between 3'-terminus of neighbour sequence of sequence listing upward to telomere on chrosomal short arm and 5'-terminus of this base sequence : 122243
gggaaacacagtgcctctgtgtgtgtgtgtgtgtgtgtgtgtgtgtgtgtgtgtgtgtgtgtgtgtgttggggaggaagatgtaagagtctatctcttacctcacccatcactgcctctgaaaggtgaacttgatttcaagtacaacaaagcccaaagagtagaatataaaatcagaacagaaagtccaacactccaaaaagaattgctcatgaaaagtttatggcattcaaaatttataggaaatgtgataggatttcattttgttggtacttgtccaagga

SEQ ID NO: 14990 - DNA, 376 bp, Homo sapiens
  AL139008.10_115773
  Located on chromosome 9
  Distance between a terminus base of telomere on chromosomal short arm and 5'-terminus of this base sequence : 34512133
  Distance between 3'-terminus of neighbour sequence of sequence listing upward to telomere on chrosomal short arm and 5'-terminus of this base sequence : 10338
ttcttatgcagagctagaccagcttcccacatgttccagggcagactcactttgagcaggctgtatgtgtgtgtgtgtgtgtgtgtgtgtgtgtgtgtgtgtgttccttgctttctgctataaattgaagattgtggagggcagggcttttatacattttaaaatttaaatattagtctttttattattgaattgtagcaacttttagaaaatatattcttgacataagtcccttgacagatacatatgaatattttctctcagtctgagatttccctgtttcttaatagtgtcttttgatggttagaagacttaaattttaatgaactcaatttttttgaaacaatgtggccagtgctttctgtcaattccttaa

SEQ ID NO: 14991 - DNA, 418 bp, Homo sapiens
  chr9.fa.O7frz.33690419
  Located on chromosome 9
  Distance between a terminus base of telomere on chromosomal short arm and 5'-terminus of this base sequence : 34691170
  Distance between 3'-terminus of neighbour sequence of sequence listing upward to telomere on chrosomal short arm and 5'-terminus of this base sequence : 178661
cttctaatgaacgctttactagaatttaggccatgaatgagaaggcctaaaccctttactagaatttaggccatgaatgagaaggcatatatatatgcacctaggagatagatagatatatatatagatatagatatatagatatatatatatatgcacctaggagatatatatatatatatatatatatatatatgcacctaggtaatctgaaaaaaaaactggctttcaattatataggttaaaaatactggaaaataacatttaattagactcaaatcaagagctgccagattccacattgaaatgcaacattactgaaaacagaatttttgaaggttctgtatttatgagtattagtaagaaattatttcagctcccctttttagtatagcactccaggcaagaaatagactat

SEQ ID NO: 14992 - DNA, 434 bp, Homo sapiens
  chr9.fa.O7frz.33865506
  Located on chromosome 9
  Distance between a terminus base of telomere on chromosomal short arm and 5'-terminus of this base sequence : 34866934
  Distance between 3'-terminus of neighbour sequence of sequence listing upward to telomere on chrosomal short arm and 5'-terminus of this base sequence : 175346
aactggcaatttactgtagtgtactcaaaatcaactgtgaaccctgagcatcctctgcatgaggtaattctatttttaaaatattactatgagatttaagaactataatgcctaactccttttgcacattaatatttaaacattaaataataattgcattcaaaagaaagccacttctaagaagtaaaacacactgttttgaaaaggggtaagaatctctttggaagaataatgagaatgaacaggagtaagagaaaactgtagcctgaaagctagtttcattgactctgcatgagactagaacacacttaatgaatttctgtttctttacagacagctaattaaagtccattgacagattatatatatagcattattatatatatatatatatatatatagcattcttgatgttggagtgaacatacaaagaa

SEQ ID NO: 14993 - DNA, 321 bp, Homo sapiens
  AC024504.2_30795
  Located on chromosome 9
  Distance between a terminus base of telomere on chromosomal short arm and 5'-terminus of this base sequence : 34935285
  Distance between 3'-terminus of neighbour sequence of sequence listing upward to telomere on chrosomal short arm and 5'-terminus of this base sequence : 67917
ctttaaatgtttggtagaattcacttgtgagtccatccagccctgagcttttccttgataggcaaatttttattactgattcaatctgcttactcatatgtgtgtgtgtgtgtgtgtgtatttatatatatttatatatatttatatatttataacatatatataattttttttccaaattacccttcctttcttatgttcttctgggactctgatgacataaagattagaccttttggcattttaccacaataccctagggagagctgttgttcatttttttcaatgcttttgtctcttattcaaattggatagtttctg

SEQ ID NO: 14994 - DNA, 341 bp, Homo sapiens
  AC024504.2_101796
  Located on chromosome 9
  Distance between a terminus base of telomere on chromosomal short arm and 5'-terminus of this base sequence : 34952499
  Distance between 3'-terminus of neighbour sequence of sequence listing upward to telomere on chrosomal short arm and 5'-terminus of this base sequence : 16893
aggcttaagtagtggcttgtagcagagggaaaatggaagcatgaaactggtgtttgaatctcagctctgcaacttattagctgaatgaagtctttcctgttctttaatctctctgaatctagtttactcatttctaaaatgagaataatacttaccacaacagttttaagtaaggattaaatcaataagagatttttatatacatatatacaggatattatgtgatggaatccatttatctatctatctatctatctatctatctatctatcatctatctatctatcaagatagggagaaagagagagagagaagagatccttaagaataagctgtaggta

SEQ ID NO: 14995 - DNA, 159 bp, Homo sapiens
  G08752
  Located on chromosome 9
  Distance between a terminus base of telomere on chromosomal short arm and 5'-terminus of this base sequence : 34952709
  Distance between 3'-terminus of neighbour sequence of sequence listing upward to telomere on chrosomal short arm and 5'-terminus of this base sequence : -131
caggatattatgtgatggaatccatttatctatctatctatctatctatctatctatctatcatctatctatctatcaagatagggagaaagagagagagagaagagatccttaagaataagctgtaggtaatattaggcatattttttgagtcagcag

SEQ ID NO: 14996 - DNA, 448 bp, Homo sapiens
  chr9.fa.O7frz.34043955
  Located on chromosome 9
  Distance between a terminus base of telomere on chromosomal short arm and 5'-terminus of this base sequence : 35045444
  Distance between 3'-terminus of neighbour sequence of sequence listing upward to telomere on chrosomal short arm and 5'-terminus of this base sequence : 92576
ctttcatattagccatgttatcagatcgcataagcttctctagtgatcttatcttcaatttcctgaactacatgatatagtctattgctctttggaaatgcctcaatatttccaaaatttatctaataccttaaaaaggaacaccaacagatgaacttagttttcagcattaaaagcaagataaatatttataatacaatgaaaaacagtcttacgtaaaattgcactaatgcttgtcatccattatcaactgacatggtaaacatatggacctgcaatgtgtgtgtgtgtgtgtgtgtgtgtacaatgcacatatacatatacacatggtcatgcacttcataaaaatgtttcagtcaacaacagaccacatataaaatagcggtcccataagattataatgtggctggaaaatccctatcatctagtaacttcacgacatcatagc

SEQ ID NO: 14997 - DNA, 134 bp, Homo sapiens
  G08747
  Located on chromosome 9
  Distance between a terminus base of telomere on chromosomal short arm and 5'-terminus of this base sequence : 35351383
  Distance between 3'-terminus of neighbour sequence of sequence listing upward to telomere on chrosomal short arm and 5'-terminus of this base sequence : 305491
gtgcacctctacacccggactccagtctttttaataatgaattagatagatagatgacagatgatagatgattgatagattgatagatagatagatagatagatggatggataagatagatgtgtgtgggcaca

SEQ ID NO: 14998 - DNA, 378 bp, Homo sapiens
  chr9.fa.O7frz.34626130
  Located on chromosome 9
  Distance between a terminus base of telomere on chromosomal short arm and 5'-terminus of this base sequence : 35637511
  Distance between 3'-terminus of neighbour sequence of sequence listing upward to telomere on chrosomal short arm and 5'-terminus of this base sequence : 285994
gaagtgacactaggcctttaagaggattggcagcaatggctggatgcagtggctcattccggtaatcccagtatctgggaggctaagggtggaagattgattgaggccaggagtttgagactagcctgggcaacaaagcaagaccccatctatctatttctttctctctctctctctctccctccctctctctctctctctccacacacacacacacacacacacacacacacacacatacacatatatatatatatatacctccttactctctgtcactcactcattctctctctctatgtgtatatatgactggcagctttcacgttcaattctgggagccatgagccacctctgagaagctgaactattctgtac

SEQ ID NO: 14999 - DNA, 379 bp, Homo sapiens
  chr9.fa.O7frz.34823482
  Located on chromosome 9
  Distance between a terminus base of telomere on chromosomal short arm and 5'-terminus of this base sequence : 35707632
  Distance between 3'-terminus of neighbour sequence of sequence listing upward to telomere on chrosomal short arm and 5'-terminus of this base sequence : 69743
ctacaaattctgataggtgcagagaaaagattttaacgaagtttattagttcataatttttttaaagaacaaaatttgcaattttactttgccttaatgagttaacacaatgtgttcaatgtattatgtagaataatactcatgaaatagatgctttctgtggactcaaaaatagaggctttacattcacagttctgtctacctggaactccccaccatgcacatacacactttctctctctctgtctcctctctctctctctcacacacacacacacacacacacacacacacacacacaccccttcacaaattcattccagggcatccttcattcttcacctgattggaaaagtgattctatgtccaacgtgagtag

SEQ ID NO: 15000 - DNA, 115 bp, Homo sapiens
  DISD22_0006272
  Located on chromosome 9
  Distance between a terminus base of telomere on chromosomal short arm and 5'-terminus of this base sequence : 35994632
  Distance between 3'-terminus of neighbour sequence of sequence listing upward to telomere on chrosomal short arm and 5'-terminus of this base sequence : 286621
aggactgccagttggttcaaaataattagaatctaggggatacacacacacacacacacacacacacacacacacacacacacacacacacgcacaccagctgagaagacctgcc

SEQ ID NO: 15001 - DNA, 134 bp, Homo sapiens
  D9S1788
  Located on chromosome 9
  Distance between a terminus base of telomere on chromosomal short arm and 5'-terminus of this base sequence : 36163207
  Distance between 3'-terminus of neighbour sequence of sequence listing upward to telomere on chrosomal short arm and 5'-terminus of this base sequence : 168460
ggacaaatggctgacatcatctctctgattctagcctaactggggaagtgtgtgtgtgtgtgtgtgtatgtgtgtgtgtgtgtgtgtgtgtgtatgcatgcatgttggggacgtcagtgtggagggagttagct

SEQ ID NO: 15002 - DNA, 215 bp, Homo sapiens
  D9S165
  Located on chromosome 9
  Distance between a terminus base of telomere on chromosomal short arm and 5'-terminus of this base sequence : 36200834
  Distance between 3'-terminus of neighbour sequence of sequence listing upward to telomere on chrosomal short arm and 5'-terminus of this base sequence : 37493
cagaggagttacaaatatagacagggagaaaactaaaatgaatcctttgatacattatttaaatttgagaaattggtgtgaattcattattttcaatatagtgatagatgaaataagaatggtgtgtgtgtgtgtgtgtgtgtgtgtgtgtgtgtgtgtgtattgtctgggagcagaaatttcccaaggccatgagcacatctagcagccaagtc

SEQ ID NO: 15003 - DNA, 360 bp, Homo sapiens
  chr9.fa.O7frz.35369810
  Located on chromosome 9
  Distance between a terminus base of telomere on chromosomal short arm and 5'-terminus of this base sequence : 36253798
  Distance between 3'-terminus of neighbour sequence of sequence listing upward to telomere on chrosomal short arm and 5'-terminus of this base sequence : 52749
aacaatgtatttgtatcagcaataaaaagatgaacaacccagcttatctaaataggcaaaaagtcgtgaatcaacattcggagatatataagtagctatatagtacaggaaaaagtgcccaccattattagttttcaggaaaatgcaagctaaaaccacaatgagatatcactttacactcactagaatgttaaaatgttgagaatgtggagaaattggaggcaattggaaatcacacacacacacacacacacacacacacacacacacaccccagctctctcaggtcaccagctcaattccttcacaaaagaaggattcagcttgtgacttgcacatttctgcataggctactgttgg

SEQ ID NO: 15004 - DNA, 446 bp, Homo sapiens
  AL356218.4_142525
  Located on chromosome 9
  Distance between a terminus base of telomere on chromosomal short arm and 5'-terminus of this base sequence : 36400170
  Distance between 3'-terminus of neighbour sequence of sequence listing upward to telomere on chrosomal short arm and 5'-terminus of this base sequence : 146012
gtacaggagcatgagctagacgggaagacccctgtgcctccaccaccccatgcatggagggagggcaccaggaccccaagctgttgctccctgagaatcaggtggtaacttctctccctgctcccatactctctttcagcaggagagtttttatgggctagagctttccagcgaccaaattcttctctctgaaattccctctggcttgtttggcagggccggctgttctcaatagtgttacctgcctggcatgcaatagtgggtgtgtgcgggactgtggagatgagagcaggccctcctaattgcaggtctgttggccacagccctagatcctgtcttggagaggccagagaaggtggcaggggaggaggaggaggaggaggagtgtcagtcttgagggagggggaagggcaaagactcgctcactgagtcctatagattaaggt

SEQ ID NO: 15005 - DNA, 395 bp, Homo sapiens
  AL158156.5_21684
  Located on chromosome 9
  Distance between a terminus base of telomere on chromosomal short arm and 5'-terminus of this base sequence : 36584102
  Distance between 3'-terminus of neighbour sequence of sequence listing upward to telomere on chrosomal short arm and 5'-terminus of this base sequence : 183486
atcatgaggtcaggagtttaagaccagcctgaccaacatggtgaaactccatctctgctaaaaacccaaaaattagccaggtgtggtggtgcacacctgtaatcccagctactcaggaggctgaggcaagagaatcgcttgaacccagcatgcggaggttgcagtgagccgagatagcaccactgcactccagcctgggcaacagagcaagaatctgcctcaaaataaataaataaataaataaataaataaataaataaataagagaaagagacactagagcttctctctccgtcgtgtgaggatacagcaagaaggtggctgtctacaaggcagaaagggggccctcaccaggaactgaatctgctggcgccttgatcttggatattagagcc

SEQ ID NO: 15006 - DNA, 431 bp, Homo sapiens
  AL158156.5_28112
  Located on chromosome 9
  Distance between a terminus base of telomere on chromosomal short arm and 5'-terminus of this base sequence : 36590675
  Distance between 3'-terminus of neighbour sequence of sequence listing upward to telomere on chrosomal short arm and 5'-terminus of this base sequence : 6178
tagcaaactaacacaggaacagaaaatgaaatattgttctcacttataagtgggagctaaatgatgagaacacatggacacacagaggggaacaacacacactggggcctatcgaagggtggagggtgggaggagagagagggtcaggaaaaataactaatggatattaggcttaatatgtgggtgatgaaataatctgtacaacaaacccccatgagatgagtttacctatgtaacaaacctacacatgtacccctgaacttaaaacaaaaaataatcttttaaaaatgttcatgttcaattcaaatcctagagtttcatccaaaatagcaggcacagtgtttgtttgtttgtttgttttcccttgggacagggtctcgctctgttgcccagactggagtgcagtggtgcagtcatagctcactgcatcc

SEQ ID NO: 15007 - DNA, 468 bp, Homo sapiens
  chr9.fa.O7frz.40624634
  Located on chromosome 9
  Distance between a terminus base of telomere on chromosomal short arm and 5'-terminus of this base sequence : 36816876
  Distance between 3'-terminus of neighbour sequence of sequence listing upward to telomere on chrosomal short arm and 5'-terminus of this base sequence : 225770
cttgcagttacaaagcttaaagggaagcaaaattcatcataaagaaacaaagaaaaacatcaccaaagacaaaatcttgctataaaattatccgtcatcaaacatctgaacctgacaactccttgtttctgctcaccatccatgtttttcctctcctgtacctctgactccagcagtatgtcctgcctgggatgcccatctgcctgttcttctgtcagtccgtccatccatccatccatccatccatccatccatccatccattcattcattgattcactcagcagcagttattgaatatcttctgtgtgccaggatctgggctgtataggtataccctagacatgtctcagagtgcagctcaaatgccacctcttccaagtaccagatgcgtccctgattccctattccctgccctacaaaggtgaaactgctctcccccttctctgtgtgtccatagcacttcctg

SEQ ID NO: 15008 - DNA, 101 bp, Homo sapiens
  DISO7_10002705
  Located on chromosome 9
  Distance between a terminus base of telomere on chromosomal short arm and 5'-terminus of this base sequence : 36926800
  Distance between 3'-terminus of neighbour sequence of sequence listing upward to telomere on chrosomal short arm and 5'-terminus of this base sequence : 109456
caattaacatctgcacctggggtgtgtgtgtgtgtgtgtgtgtgtgtgtgtgtatacataaattgatatgttgattctaattgtataaggatggtcaaaga

SEQ ID NO: 15009 - DNA, 314 bp, Homo sapiens
  DISO7_00022313
  Located on chromosome 9
  Distance between a terminus base of telomere on chromosomal short arm and 5'-terminus of this base sequence : 37030233
  Distance between 3'-terminus of neighbour sequence of sequence listing upward to telomere on chrosomal short arm and 5'-terminus of this base sequence : 103332
cagctgtctgggacagaagggatcccagccatgaagtggctgtgagctgcacctctccaagccaggaccgaggcccaggaccagatgaaatgcagctgcacccaagcgcacccccaattccggcatctgacccggaaccagcagcagccgccactgctacaagagagcattccaacactgagcgcttctagggacttcttcagaaaaacaaaacaaaacaaaacaaaacaaaacaaaacaaaacaaaacaaaacaaaacaaaacttagtccctcttttctattaccagtgcatatccctgtttaagccttgcct

SEQ ID NO: 15010 - DNA, 381 bp, Homo sapiens
  chr9.fa.O7frz.41070737
  Located on chromosome 9
  Distance between a terminus base of telomere on chromosomal short arm and 5'-terminus of this base sequence : 37231988
  Distance between 3'-terminus of neighbour sequence of sequence listing upward to telomere on chrosomal short arm and 5'-terminus of this base sequence : 201441
aatgacattggtttcatgtaagttgaaagaattttaaaagttatctattaacattttttcaacatatccaatttttttatatatatatatatatatatatatattcaaaaacaaaaagagctttatgaattttattgattataaagttgataaatatgcataaagaaaatgtaaatgatacacaaaagcataaagaataaatttaaaatcacacaagatactatctcccagaggcagccactgtttacatttcagataatctttcagacatttctctataaatccagctattattaatgtataactttataaaaaggtagtaaaaaatgcaacataagctagccctcagagtaataagttcaaaagaatttaacagttgaa

SEQ ID NO: 15011 - DNA, 247 bp, Homo sapiens
  X58125.1_157
  Located on chromosome 9
  Distance between a terminus base of telomere on chromosomal short arm and 5'-terminus of this base sequence : 37393988
  Distance between 3'-terminus of neighbour sequence of sequence listing upward to telomere on chrosomal short arm and 5'-terminus of this base sequence : 161619
ggttgagtcgttcttaaccagcttggccacatcctggttttcagggtcttattggcccaagcttctgcagctatttcaacagtttcctttttgttatacagctatttcaacaggggtgtgtgtgtgtgtgtgtgtgtgtgtgtgtgtgtgtgtgtgtgtgtgtgaaactgctgcctggaattttctcctatgaccaccttgtattatttctgtctcattatattagtaactgaggcagaaagtgttg

SEQ ID NO: 15012 - DNA, 157 bp, Homo sapiens
  G10043
  Located on chromosome 9
  Distance between a terminus base of telomere on chromosomal short arm and 5'-terminus of this base sequence : 37468960
  Distance between 3'-terminus of neighbour sequence of sequence listing upward to telomere on chrosomal short arm and 5'-terminus of this base sequence : 74725
cactcactatcgcgagaacagcaccaaggggacggtgctaggcctgctttttgggcccctcaaagcttgtctgctgctgctgctgctgctgctgctgctgctgctgctgctgctgctctgagatgacctttgggactgaaggacagaaaagccatca

SEQ ID NO: 15013 - DNA, 430 bp, Homo sapiens
  AL135785.10_17406
  Located on chromosome 9
  Distance between a terminus base of telomere on chromosomal short arm and 5'-terminus of this base sequence : 37533854
  Distance between 3'-terminus of neighbour sequence of sequence listing upward to telomere on chrosomal short arm and 5'-terminus of this base sequence : 64737
atccagcctttaaagtaatgagagcaataataatcatcataatactaaggccataccaccttaccagtgagaagctgaaccaataattcagaatgtatcgaagacccacgtatgaataattcttactgttggaaattgcttttgcatccttcttcttccttctcctcctccccctcctcctcctcctcctcctcctcctccttcttcttcttctttttagacagggtctcactctgtctcctaggcggagtacagtggcatgatcatagctcactgtagcctcgaactcctgggctcaagaaatcctcctgcctcagcctcccaagtagctgggactacaggcacatgccatcatgtccagctagtttttagaattttttgtagagatgggatcttgctgcgttgcccaggctatccttgaactcctggc

SEQ ID NO: 15014 - DNA, 372 bp, Homo sapiens
  chr9.fa.O7frz.41448665
  Located on chromosome 9
  Distance between a terminus base of telomere on chromosomal short arm and 5'-terminus of this base sequence : 37648252
  Distance between 3'-terminus of neighbour sequence of sequence listing upward to telomere on chrosomal short arm and 5'-terminus of this base sequence : 113968
cacgatcttcaatttatagcagaaagccaggaacacacacacacacacacacacacacacacacacacacacagcctgctcaaagtgagtctgccctggaacgtgggaagctggcctagctctgcacaagaagggaaccctgtataaactgacttagcagagaaggtcatcccagaggaaatgaaccctgtgcgctgagctctgaagagcaggagggctggggtggtacaggggatggtggtgtttgtgggactgaaagtaagattatctggaattatctgggtgggtccaatctaatcccagaagcccttaaaagcaaagaacttagcctggaaggagaagacagttgcatgcatgtactacagtttggtt

SEQ ID NO: 15015 - DNA, 179 bp, Homo sapiens
  DISO7_10002696
  Located on chromosome 9
  Distance between a terminus base of telomere on chromosomal short arm and 5'-terminus of this base sequence : 38290205
  Distance between 3'-terminus of neighbour sequence of sequence listing upward to telomere on chrosomal short arm and 5'-terminus of this base sequence : 641581
actccaggcagatagacagccagagatagatagatagatagatagatagatacatagatacatagatacatagatagatacatagatagagtagatagacagagtagacagacagacagacagacagacagatagatagatagatagatataaaaccatgagactagatatgaccacga

SEQ ID NO: 15016 - DNA, 175 bp, Homo sapiens
  DISO7_10002697
  Located on chromosome 9
  Distance between a terminus base of telomere on chromosomal short arm and 5'-terminus of this base sequence : 38290209
  Distance between 3'-terminus of neighbour sequence of sequence listing upward to telomere on chrosomal short arm and 5'-terminus of this base sequence : -175
caggcagatagacagccagagatagatagatagatagatagatagatacatagatacatagatacatagatagatacatagatagagtagatagacagagtagacagacagacagacagacagacagatagatagatagatagatataaaaccatgagactagatatgaccacga

SEQ ID NO: 15017 - DNA, 274 bp, Homo sapiens
  D9S163
  Located on chromosome 9
  Distance between a terminus base of telomere on chromosomal short arm and 5'-terminus of this base sequence : 38470884
  Distance between 3'-terminus of neighbour sequence of sequence listing upward to telomere on chrosomal short arm and 5'-terminus of this base sequence : 180500
acagcgctcagaaatcatataatttttgtgatcattgttagttttgcctgttttgttgtctgtttatgtctttgtgtgtgtgtgtgtgtgtgtgtgtgtgtgtcctttcccttattgaattggactaactccaaaccttctaactcatgagtgtggaatcttccatgctgaagaaataagagcaccttgctcccttcagcctttcagggcattctcaggcaactgagaaccatgtgagggtgtctgggaggaatactccctaagatgtgcagca

SEQ ID NO: 15018 - DNA, 296 bp, Homo sapiens
  chr9.fa.O7frz.37866964
  Located on chromosome 9
  Distance between a terminus base of telomere on chromosomal short arm and 5'-terminus of this base sequence : 38585436
  Distance between 3'-terminus of neighbour sequence of sequence listing upward to telomere on chrosomal short arm and 5'-terminus of this base sequence : 114278
tcttcctataggctaccactattaatactttcttgtgtatctttccagagtcagtttctgaatataagcacacacacacacacacacacacacacacacacacacaccaccatcttctttttaaaacgcaaatagtagcatattctaacacattccctgtgccttgctgttttgcacttagtatatcttggtgaatcatcccacatcagagcatatagacctgcagcagcagcagctcctctgccaccttgcacttcccactctccttctttgtaacaggtgcatagtataccatt

SEQ ID NO: 15019 - DNA, 386 bp, Homo sapiens
  AL160274.4_19542
  Located on chromosome 9
  Distance between a terminus base of telomere on chromosomal short arm and 5'-terminus of this base sequence : 38657353
  Distance between 3'-terminus of neighbour sequence of sequence listing upward to telomere on chrosomal short arm and 5'-terminus of this base sequence : 71621
ttgtgctcaggagttcaagacaagcctgggcaacatggcgaaacatcgtctctacaaaaagtacagaaattagctgggtgtggtggcacgcacctgtagtcccagctatttggaaggctgaggtgggaggattgcctgagcccaggagattaaggctgcagtgagccgtgatcatgccacagcacttcagccgaggcaacagggtgagaccctgtctcaaaataaataaataaataaataaataaataaataaataaataaataaataaaagagggaacagatgagaagctaaaaggagttatcgttttagagaggaattgttttcacattggatattcaagtactatgctgttttagtagcctgaatcactaaataagtgtaggc

SEQ ID NO: 15020 - DNA, 131 bp, Homo sapiens
  DISO7_10002699
  Located on chromosome 9
  Distance between a terminus base of telomere on chromosomal short arm and 5'-terminus of this base sequence : 38708512
  Distance between 3'-terminus of neighbour sequence of sequence listing upward to telomere on chrosomal short arm and 5'-terminus of this base sequence : 50773
aggttgtgcctatgaccctttgggtcgtccttttttgtctatttccctcccctccttcccaagcactgtatgtgtgtgtgtatgtgtgtgtgtgtgtgtacatgcacatgtgcgtgcatgatctgtgcctc

SEQ ID NO: 15021 - DNA, 103 bp, Homo sapiens
  DISO7_10002702
  Located on chromosome 9
  Distance between a terminus base of telomere on chromosomal short arm and 5'-terminus of this base sequence : 38991570
  Distance between 3'-terminus of neighbour sequence of sequence listing upward to telomere on chrosomal short arm and 5'-terminus of this base sequence : 282927
gatcacagatgggcttaaggggtggagggtgtgtgtgtgtttgtgagagagagagagagagagagagagagagagagagagattgccaggtgaggaaggtgat

SEQ ID NO: 15022 - DNA, 361 bp, Homo sapiens
  AL133410.26_90374
  Located on chromosome 9
  Distance between a terminus base of telomere on chromosomal short arm and 5'-terminus of this base sequence : 39114289
  Distance between 3'-terminus of neighbour sequence of sequence listing upward to telomere on chrosomal short arm and 5'-terminus of this base sequence : 122616
ttgagttcaaagttcttacaagaccatcaagtgaagatatcctgtgggcaattaggtatatgatttgaaagctgatagaaatggactggtgattcattcttggcacatagaaattggttattggagcaatgggcataggtattaccatggagagagagagagagagagagagagagagagagagagagagagagagttgagtggaaaacgaaatctagaatagatccctgaggatcatcaatcaacccaggggcaggtagagaaggaagggtcagtaagagactgagaaagagctgccagctggttggaagaaacctggacagtgtggtgtcatggagggtgtaccactacagtcagctgt

SEQ ID NO: 15023 - DNA, 239 bp, Homo sapiens
  chr9.fa.O7frz.38541087
  Located on chromosome 9
  Distance between a terminus base of telomere on chromosomal short arm and 5'-terminus of this base sequence : 39143302
  Distance between 3'-terminus of neighbour sequence of sequence listing upward to telomere on chrosomal short arm and 5'-terminus of this base sequence : 28652
accagtcctatctacctttcaggaggagtgccactccctcttcccagatgtatgcaacacaacacacacacacacacacacacacacacgcacacacacacgcagagagagagaggttagtagccctttcaaagccttcagactcacctgtgtatattttatatcatgtatattttaccaagtttccctgtcctgcatcttctcttcccataatgcctatcttgaatcctgttcactct

SEQ ID NO: 15024 - DNA, 441 bp, Homo sapiens
  AL133410.26_154029
  Located on chromosome 9
  Distance between a terminus base of telomere on chromosomal short arm and 5'-terminus of this base sequence : 39177801
  Distance between 3'-terminus of neighbour sequence of sequence listing upward to telomere on chrosomal short arm and 5'-terminus of this base sequence : 34260
tgagccagtatacaggcagcgcttgtgaggctgctgagggtttttactgctcctaaccacaggggaacagaaaggggaagaaaatcaacaaggaagttacacagttccatgctgactcccaagccccacaggtggagtttcagcctgctcagtggcttaagacgccatgccaaaatacacacacacacacacacacacacacacacacacacacaccttccacacatctgttttttttaggtttggtaagtggagaaaatggctcctaagtgaggaggcagctgtgaagtcaaagggtcttagttttggatttagagagagctaggtttgcatcctcagtttggtctaggtttgagcctcagtttccttatctgtaaaaggagggtttttttgtttttgtttttgtttttttttaaataagattaacgtaaggattaaacc

SEQ ID NO: 15025 - DNA, 194 bp, Homo sapiens
  AL135841.11_73014
  Located on chromosome 9
  Distance between a terminus base of telomere on chromosomal short arm and 5'-terminus of this base sequence : 39292304
  Distance between 3'-terminus of neighbour sequence of sequence listing upward to telomere on chrosomal short arm and 5'-terminus of this base sequence : 114062
tgcagtctatcaacttgttaacattttactacatttgctttgctttatcattctgtgtgtgtgtgtgtgtgtgtgtgtgtgtgtgtgtgtgtatacatagttttcctgaatgatttcaaggtaggttgtgtatgtcatgtgtattccataaaaacacatatattctttcactgtattccactacaatgatcaaa

SEQ ID NO: 15026 - DNA, 329 bp, Homo sapiens
  AL135841.11_85410
  Located on chromosome 9
  Distance between a terminus base of telomere on chromosomal short arm and 5'-terminus of this base sequence : 39304559
  Distance between 3'-terminus of neighbour sequence of sequence listing upward to telomere on chrosomal short arm and 5'-terminus of this base sequence : 12061
tattccatcaagctggagtaagtctcttctcccccctaggcctcagtttccccatgtgctccatgagaaggctgaataattgcttcccagggcatcccagctctgagggttgtcgtggaccctccagtgctgacctctgcaagcagggagcggtccttgatgaaggtggctgcccacactgatgaatgtgaggggtgtgtgtgtgtgtgtgtgtgtgtgtgtgtctgtgtgaaggggagatctgaattcctggttgtccatcaagaaacattcaacagttagtagagctatgtcaggttttggaagggattcagaatgaaagcaaacaa

SEQ ID NO: 15027 - DNA, 430 bp, Homo sapiens
  chr9.fa.O7frz.38895413
  Located on chromosome 9
  Distance between a terminus base of telomere on chromosomal short arm and 5'-terminus of this base sequence : 39425940
  Distance between 3'-terminus of neighbour sequence of sequence listing upward to telomere on chrosomal short arm and 5'-terminus of this base sequence : 121052
tagttcagtttctttggttatgactttattattatcattatcattatttctggaagtcaccagaatccctgctcatgggtctttggaattcaccagaaacctgattctggttcctccatatctatccctaataattatcaagaatttcctccctgctttctctctctctctctctctctctctctctctctctccttttttctttttgagacaagatttggctgtgttgctgaggctagagtgtggtggcgagatcttggcttactgcaacctccgcctcctgggctcaaaccatccttctacctcaacctccctagtagttgggaccacaggcacatgccactgcacccagctaatttttgtattttaggtatagatggggtttcaacattttgcccaggctggtctcaaactcctggacttccaaagt

SEQ ID NO: 15028 - DNA, 454 bp, Homo sapiens
  AL161792.20_75625
  Located on chromosome 9
  Distance between a terminus base of telomere on chromosomal short arm and 5'-terminus of this base sequence : 39617920
  Distance between 3'-terminus of neighbour sequence of sequence listing upward to telomere on chrosomal short arm and 5'-terminus of this base sequence : 191550
tctaaatcttagacaactgaatgactgttagacatcactaaatttaatggggcataaaattctgcggaaacccaggtgcttcggtctatggtactgtgtgtgtgtgtgtgtgtgtgtgtgtgtgtgtgtgtgtgtgtgtgtgacagggtcttactctatcacccaggctggagtgcagtggcaggatcatggctcactgcagcctcaacttcctaggttcaagctatcctctcccctcagccacctgagtagctaggactacaggcatgtgccaccatgtccggctaatatttgtaatttttttagaactagggtctcgctatgttgcccaggctgatcttgaactcctggcctcaagcaatcctcctgcctcaacctactgaagtgctggggttagagatgtgagccattgtgtcaggctcttacacctttgttaaatatttagcggtgcttt

SEQ ID NO: 15029 - DNA, 454 bp, Homo sapiens
  AL161792.20_112058
  Located on chromosome 9
  Distance between a terminus base of telomere on chromosomal short arm and 5'-terminus of this base sequence : 39655279
  Distance between 3'-terminus of neighbour sequence of sequence listing upward to telomere on chrosomal short arm and 5'-terminus of this base sequence : 36905
acctggccactttatagtattaagtcttctatttccttgttgatcttctgcctagttgttctatccactattaaaagtaagcagagtttctttctttctttcttttcttttctttctttctttttctttctttctttctttctttctctctttcttttcttccttcctttctttctttctctctctctttctttcttttcttccttccttcctttctttctttcttttttttttttttgagacggagtctcgctttgtctcccaggctggagtgcagtggcgcgatctctgctcactgcaacctccacctcccaggttcaagcgattctcctgcctcagcctcctgagtagctgggactacaggtgcccaccaccacacctggctaatttttgtatatttagtagagacggggtttcaccgtgttagccaggatgatctcgatctcctgacctc

SEQ ID NO: 15030 - DNA, 260 bp, Homo sapiens
  AL161792.20_141056
  Located on chromosome 9
  Distance between a terminus base of telomere on chromosomal short arm and 5'-terminus of this base sequence : 39662859
  Distance between 3'-terminus of neighbour sequence of sequence listing upward to telomere on chrosomal short arm and 5'-terminus of this base sequence : 7126
taagaaacttgtttctgccacacacatcttaccttctgatttgattttgtgagaaaagcctggtttgtttgtttgtttgtttgtttttgcctgagcatggtgcacatttcaatctggaatgaaggagtatagtgagggggaggtgcggcgcacctcagctgtgcaggtgtgtggtgttacttaaagcacaccatagcggctactgggaagcctgggtcccagccctgttgctaagctgctgcttgacctggagtagctcc

SEQ ID NO: 15031 - DNA, 175 bp, Homo sapiens
  D9S1791
  Located on chromosome 9
  Distance between a terminus base of telomere on chromosomal short arm and 5'-terminus of this base sequence : 39737331
  Distance between 3'-terminus of neighbour sequence of sequence listing upward to telomere on chrosomal short arm and 5'-terminus of this base sequence : 74212
tcaaaataagtctgggacaaaaccatagatgggcttgattaaaatgaggtacaatttttactactaggtaaaataaaatcacacacacacattgtgtgtgtgtgtgtgtgtgtgtgtgtgtgtgtgtgtgtgtgtgtggggcaggcagtcccatacataggttgcccaagattac

SEQ ID NO: 15032 - DNA, 274 bp, Homo sapiens
  HUMUT5061B
  Located on chromosome 9
  Distance between a terminus base of telomere on chromosomal short arm and 5'-terminus of this base sequence : 39753100
  Distance between 3'-terminus of neighbour sequence of sequence listing upward to telomere on chrosomal short arm and 5'-terminus of this base sequence : 15594
atagcctgggtgacagagtgagactgtctccaagaaagaaagagagagagaaagggagggagggaaggagggaaggaaggatggaaggaaagaaggaaggaaggaaggaaggaaagaaggaaagaaagaaagaaaagaaagagagagaaagaaaaagaaagaaagaaagaaaaagaaagaaagaaagaaagaaaaaaagaaagaaggcaggcgggcgggcaacagaagcacagccaattagctactttacttttgggaaagaccacgaagagaa

SEQ ID NO: 15033 - DNA, 322 bp, Homo sapiens
  chr9.fa.O7frz.39337074
  Located on chromosome 9
  Distance between a terminus base of telomere on chromosomal short arm and 5'-terminus of this base sequence : 39838052
  Distance between 3'-terminus of neighbour sequence of sequence listing upward to telomere on chrosomal short arm and 5'-terminus of this base sequence : 84678
actgccataactgtctttatacataccccttatagaacctgtgtgagaattttaggagggttgtatatatagtatcagaattggaattttatatttttttctctgttatatagtttttgctttcatatttttattattggtaaggataaatgtgtgtgtgtggtgtgtgtgtgtgtgtgtgtgtgtgtgtttcttcaaccacagtattctaggaattttctgatcacatccttagccctatcctctatggcttctttaaagactaattgagtctgtaattgattgtaatacattgaataaatgtaatgcatgagtccataat

SEQ ID NO: 15034 - DNA, 368 bp, Homo sapiens
  chr9.fa.O7frz.39457705
  Located on chromosome 9
  Distance between a terminus base of telomere on chromosomal short arm and 5'-terminus of this base sequence : 39955420
  Distance between 3'-terminus of neighbour sequence of sequence listing upward to telomere on chrosomal short arm and 5'-terminus of this base sequence : 117046
cctaaccatagttgcacattagaattgcttggggtgctttaaagagtattggttccacccccagagcaattaaatcagaatatcattgaggtttttgaaattcagaagcttcagaatctctactttctatctgtggactttggtaaattatttagcctctctgtgtcttagtttctttgtctgtaaaaatggatgaaataacacggcatagggttgttgtgaagattaaatgagttaatccatgaaaagcatttagagtggtgctcaataaatgtagctattattattattattattattattattattattattttgagatggcgtctcgtgctgttgcccaggctagagtgcagtggttagattcg

SEQ ID NO: 15035 - DNA, 107 bp, Homo sapiens
  D9S1859
  Located on chromosome 9
  Distance between a terminus base of telomere on chromosomal short arm and 5'-terminus of this base sequence : 39970948
  Distance between 3'-terminus of neighbour sequence of sequence listing upward to telomere on chrosomal short arm and 5'-terminus of this base sequence : 15160
cctcagtttagtctgggaacacaaagaagacaaggacaagcacaagcgcaaacacacacacacacacacacacacacacacacacacgccaactgtaaatgaatgcg

SEQ ID NO: 15036 - DNA, 372 bp, Homo sapiens
  chr9.fa.O7frz.39664590
  Located on chromosome 9
  Distance between a terminus base of telomere on chromosomal short arm and 5'-terminus of this base sequence : 40146483
  Distance between 3'-terminus of neighbour sequence of sequence listing upward to telomere on chrosomal short arm and 5'-terminus of this base sequence : 175428
tcctatgctgttatgtcagaagcccccactctggatggatcagaccttatggggtctctggggacacagaaagaaatcagatgtagtccctgccctgagcgcctcagtctgaggggagacagagcatgcatagaccaggctgatgcagagtgactcacactgagacgcaggcgaggactaggggctgggaatggagggacggagcaactgatgtgttgtgtgtgtgtgtgtgtgtgtgtgtgtgtgtgtgcacgcgtgtgtgtgactgtcagaagatgaaaaggatcagggaggagggaattcctacatgtttgtgcctgggacctcatgcagaggaaagacaggaatgaaaactagaaaggaagcaggaac

SEQ ID NO: 15037 - DNA, 331 bp, Homo sapiens
  AL390874.9_234693
  Located on chromosome 9
  Distance between a terminus base of telomere on chromosomal short arm and 5'-terminus of this base sequence : 40226133
  Distance between 3'-terminus of neighbour sequence of sequence listing upward to telomere on chrosomal short arm and 5'-terminus of this base sequence : 79278
acatttgtcacgtttggacgctgaacggcaatgtgcccccagctcccccctgtcgctcacacgctctcacaaacacacatacacacacacacacacacacacacacactcatgcacacacatctccagccaccctcgctccactcagcaagaacagagtcagggatgtggcctgttcctgggaaatcagaaccccctgcttggggaggctaggcaatgcaggtgacagcacgccccgactccagccagctctccctactctctactccccaagaatggctgggacctctccatctccacactgttgtttctgctatgtcctttgtacaaag

SEQ ID NO: 15038 - DNA, 315 bp, Homo sapiens
  HUMUT6556
  Located on chromosome 9
  Distance between a terminus base of telomere on chromosomal short arm and 5'-terminus of this base sequence : 40272983
  Distance between 3'-terminus of neighbour sequence of sequence listing upward to telomere on chrosomal short arm and 5'-terminus of this base sequence : 46519
acatcattgctggctcctgccacaatgatcttccccttttctctatgtaatttctgaactttttttccaaacttaacttagatacacatacttgcttattttgcaggccacctcaagttctttgtgaaagtgaaggctgggaaaggtgaactgacagaaaaagaaagatggaaggaaggaaggaagaaggaaggaaggaggaaggaaggaaggaaggaaggaaggaaggaaggaaggaaggaaggaaggaaggatggatgagagagagagagagagaaagaaagagaagaggaaaggaattcctggtgcctcttt

SEQ ID NO: 15039 - DNA, 341 bp, Homo sapiens
  chr9.fa.O7frz.39880691
  Located on chromosome 9
  Distance between a terminus base of telomere on chromosomal short arm and 5'-terminus of this base sequence : 40377421
  Distance between 3'-terminus of neighbour sequence of sequence listing upward to telomere on chrosomal short arm and 5'-terminus of this base sequence : 104123
tacactcagatatttccgaattacataaataacactcatagtagacacacattttggatacccaaaagaatatacacaagtactaacttataaacacacacgaataccccacgagtataaagatacacacacacacacacacacacacacacaggcaaacaacttttggacacaaactcatatatttttacatcttttaaaaatacatatactgtaatgaacacactgagtcccttatataaacacacaggccctaacttgcagacccccggaaggacgccagcgtgaacattcagaaacagagaaaaacacagacaaactcacagatatttggactgatg

SEQ ID NO: 15040 - DNA, 199 bp, Homo sapiens
  D9S1874
  Located on chromosome 9
  Distance between a terminus base of telomere on chromosomal short arm and 5'-terminus of this base sequence : 40566243
  Distance between 3'-terminus of neighbour sequence of sequence listing upward to telomere on chrosomal short arm and 5'-terminus of this base sequence : 188481
ggccaagggataaacagaccagaataacagagtgtgtgtgtgtgtgtgtgtgtgtgtgtgtgtgtgtgtgtgtgtgtgtgttttcaagtataaagaagagtgtagtacattatacaggtgagatttttaatttggggaaaggatggattagttagtaagtgatattggagaaaagttacatttctgctccatactatac

SEQ ID NO: 15041 - DNA, 304 bp, Homo sapiens
  chr9.fa.O7frz.40182649
  Located on chromosome 9
  Distance between a terminus base of telomere on chromosomal short arm and 5'-terminus of this base sequence : 40799872
  Distance between 3'-terminus of neighbour sequence of sequence listing upward to telomere on chrosomal short arm and 5'-terminus of this base sequence : 233430
ttaggtaacatagtgagacctcatctctacgaaacacacacacacacacacacacacacacacacacacacacacacacaaactagccaggtatggtggtgcatgcctatagtcccagctaatatggaggctgaggtgggaggagggcttgagccctggaggttgaggctgcagtaagccaacatggtgccactgccgccactgcgtgccagcagcctggatgacagcgcatgacaaccttcgcgataaataaataaagtaagtaagtaaaactaagtgtgtaggtctgttagcaactgttcta

SEQ ID NO: 15042 - DNA, 180 bp, Homo sapiens
  HUMUT801
  Located on chromosome 9
  Distance between a terminus base of telomere on chromosomal short arm and 5'-terminus of this base sequence : 54948379
  Distance between 3'-terminus of neighbour sequence of sequence listing upward to telomere on chrosomal short arm and 5'-terminus of this base sequence : 14148203
actctagcctgggcaacagagcaagactccatctcaaaaaataaataaataaataaataaataaataaataaataaaaaataaaaaagaattaggaagaacaatttaataataaagtaagttacaaagaaaatttgtaggctggatgcggttgctcaagcctgtatcccaggattttgga

SEQ ID NO: 15043 - DNA, 196 bp, Homo sapiens
  DISD22_0006288
  Located on chromosome 9
  Distance between a terminus base of telomere on chromosomal short arm and 5'-terminus of this base sequence : 55232363
  Distance between 3'-terminus of neighbour sequence of sequence listing upward to telomere on chrosomal short arm and 5'-terminus of this base sequence : 283804
ttccagctagttgcaaagactaaagaaaatatgctactcaaggtaaatgatttgtaacccctgagcagagtcacagtctccctctctctctctgtctctctctgtctctctctctcacacacacacacacaccacacacacacacacacacacattttagaatcttcaaaaaccacttccaatacaaactaggtac

SEQ ID NO: 15044 - DNA, 233 bp, Homo sapiens
  Z66667
  Located on chromosome 9
  Distance between a terminus base of telomere on chromosomal short arm and 5'-terminus of this base sequence : 55529960
  Distance between 3'-terminus of neighbour sequence of sequence listing upward to telomere on chrosomal short arm and 5'-terminus of this base sequence : 297401
tgggcaggtggtcagtataattgatttccagttatgtatggttaaaatttaataatagaaaaaacatcctccgtaaagggaagtattgagaatacatctataaaatgttttcttaagagtagaataagttaatctgtggataataggtgtgtgtgtgtgtgtgtgtgtgtgtgagaataatccctctaagtcacagatttttacaatactaatatttgaaacacccaagcacg

SEQ ID NO: 15045 - DNA, 188 bp, Homo sapiens
  DISD22_0006301
  Located on chromosome 9
  Distance between a terminus base of telomere on chromosomal short arm and 5'-terminus of this base sequence : 55723262
  Distance between 3'-terminus of neighbour sequence of sequence listing upward to telomere on chrosomal short arm and 5'-terminus of this base sequence : 193069
ccttcagctagttgcaaagactaaagaaaatatgctactcaaggtaaatgatttgtaacccctgagcagagtcacagtctctctctctctctctgtctctctctctctctctcacacacacacacacacacacacacacacacacattttagaatcttcaaaaaccacttccaatacaaactaggtat

SEQ ID NO: 15046 - DNA, 223 bp, Homo sapiens
  DISO7_10018866
  Located on chromosome 9
  Distance between a terminus base of telomere on chromosomal short arm and 5'-terminus of this base sequence : 56099630
  Distance between 3'-terminus of neighbour sequence of sequence listing upward to telomere on chrosomal short arm and 5'-terminus of this base sequence : 376180
tgtctccaaggtcctcaagaaaaacactcctggaaacaagaaagaggctaaataagattttgtttgtttgtttgtttgtttgaagattttaaagatgtacaattacaagttttctgaaagaaatgctctaaggaaaaaaagtgaatgacagtgtgtatcccttttagcactaagaaagcttttgtttgttttggtttgtgtttacccttacaccagtaaggcc

SEQ ID NO: 15047 - DNA, 208 bp, Homo sapiens
  DISD22_0006338
  Located on chromosome 9
  Distance between a terminus base of telomere on chromosomal short arm and 5'-terminus of this base sequence : 56614595
  Distance between 3'-terminus of neighbour sequence of sequence listing upward to telomere on chrosomal short arm and 5'-terminus of this base sequence : 514742
aagtcactgcatagcaccactaaaatatggtgaccgataaaatgggcaaaggtcattcagtgaaagtttcaaagcaaagagaatgaatgaatatatatatatatatatatatatatatatatatatatatatatggatgtttactttttggattacagttttcagattatgtttgttttaaataagccagtctgctttcataataatt

SEQ ID NO: 15048 - DNA, 207 bp, Homo sapiens
  DISD22_0006342
  Located on chromosome 9
  Distance between a terminus base of telomere on chromosomal short arm and 5'-terminus of this base sequence : 56751516
  Distance between 3'-terminus of neighbour sequence of sequence listing upward to telomere on chrosomal short arm and 5'-terminus of this base sequence : 136713
ttcctccatcccattcagatggctccttccttccttcctccctccctccctccctcttttttttcctcccttcctccctcccattcagtctggcttttatactccttccttccttccttccttccctccttccgtccgcactgtttctgtgctttttgaaacattgtttatacttgtagtgtaagtctacactacaggtctgtctgg

SEQ ID NO: 15049 - DNA, 431 bp, Homo sapiens
  AL353729.3_92747
  Located on chromosome 9
  Distance between a terminus base of telomere on chromosomal short arm and 5'-terminus of this base sequence : 56951517
  Distance between 3'-terminus of neighbour sequence of sequence listing upward to telomere on chrosomal short arm and 5'-terminus of this base sequence : 199794
gatcatgtagagtacgtgctttaaaaaaaaacttaggccaggcactgtggctcacgcctgtaatcacagcactttgggaggccaaggcaggtggatcacctgaggtcagaaggttgagaccagcctggccaatgtggcaaaaccccgtatccactgaaaatacaaaaattagccgggtgtggctgtgtgtgcctgtagtcccagctgctcaggagggtgagacaggagaattgcttaacccaggaggtagaggttgcagtgagccgagatcgcgccactgcactccagcctgggcgacagagcaagactccacctcaaaataataataataataataattaataaataaaaaatgtaatggtcaatccaggtgtcagtataattgatttggacataaaatagctaatctaagcagtaatttgattcctaaa

SEQ ID NO: 15050 - DNA, 455 bp, Homo sapiens
  AL353791.4_135170
  Located on chromosome 9
  Distance between a terminus base of telomere on chromosomal short arm and 5'-terminus of this base sequence : 57068583
  Distance between 3'-terminus of neighbour sequence of sequence listing upward to telomere on chrosomal short arm and 5'-terminus of this base sequence : 116635
gaggtcaggagatcgagaccatcctggctaacacagtgaaaccccgtctctactaaaaatacaaacaattagtcgggtggggtggcgggcgtctgtagtcccagctactcgggaggctgaggcaggagaatggcatgaacccaggaggcggagcttgcagtgagtcgagatcgcgccactgcactcaagcctgggtaacagaggagacgccagactccgtctcaaaaaacaaaaaacaaaaacaaacaacaacaacaacaaaaacatgcaccacaaatgttcccaaagtgtctgataatattgttatggtagtgatgcttgaagaagaaaatgctaatattagaagaactgctcataaaagagaaaacggtgggaaacatgataaaaaccacagtgatggattattagcagatcatttctcccaagctttaggtgaaagcttcctttggagttac

SEQ ID NO: 15051 - DNA, 314 bp, Homo sapiens
  chr9.fa.O7frz.43022708
  Located on chromosome 9
  Distance between a terminus base of telomere on chromosomal short arm and 5'-terminus of this base sequence : 57118696
  Distance between 3'-terminus of neighbour sequence of sequence listing upward to telomere on chrosomal short arm and 5'-terminus of this base sequence : 49658
tgttaagatatcgaggtaaacaagatgcatctaagttaatatatgctttcatcttttaaaagtctacttcattcctaccaaatattttttagcaaccctgatgatcaagctgagaaacactggtttcagacacacacacacacacacacacacacacacacacacacacgagacacacacacacacacacacaccacccccccacccccccccgccccgatgtaacccagtgcagactcagctgcccaccgcttgcaaagtcagtaacaaggaggaagtctgtagtgaaaggaaagttactttgtttccaaagc

SEQ ID NO: 15052 - DNA, 155 bp, Homo sapiens
  Z66589
  Located on chromosome 9
  Distance between a terminus base of telomere on chromosomal short arm and 5'-terminus of this base sequence : 57178640
  Distance between 3'-terminus of neighbour sequence of sequence listing upward to telomere on chrosomal short arm and 5'-terminus of this base sequence : 59630
tgagccaatgccttgtaataaatctcattttacacacacatgcacacacacacacacacacacacacacacacacatccttattggttcattttctctggagaagccaaatttaaaaaataacatcagacagtattaagtggggacagaaatcca

SEQ ID NO: 15053 - DNA, 109 bp, Homo sapiens
  DISO7_10018846
  Located on chromosome 9
  Distance between a terminus base of telomere on chromosomal short arm and 5'-terminus of this base sequence : 57231139
  Distance between 3'-terminus of neighbour sequence of sequence listing upward to telomere on chrosomal short arm and 5'-terminus of this base sequence : 52344
caaattctaagatgtgtggctctctgcatatatagctacgtgcgcgcgcacacacacacacacacacacacacacacaaaggattttcaacagagatgcaatctacaaa

SEQ ID NO: 15054 - DNA, 378 bp, Homo sapiens
  AL354874.4_44728
  Located on chromosome 9
  Distance between a terminus base of telomere on chromosomal short arm and 5'-terminus of this base sequence : 57253866
  Distance between 3'-terminus of neighbour sequence of sequence listing upward to telomere on chrosomal short arm and 5'-terminus of this base sequence : 22618
cactccagtctggtgacagagcaagattccatctaaaaaagaaaagaagaaagaagaaaaaagaaagaagaaaggagaagaagacgaaagaagaagaaagaagaagaagaagaggaggaagaggaggaggaggaagaggaggaggaagaggaggaagaacaagaggaggaagaagaaggagaagaagaggaagaagaattattgtgaaaaggttatattgtgagtataaagagtaattattttgaaaatattttctcactttccattttatcttttaactgtctgcaagaaagatagaaaatggcacaaacctaaatcattctctctgctctccatcatctatctactctccatattactcaagagtactgcttcaag

SEQ ID NO: 15055 - DNA, 138 bp, Homo sapiens
  DISD22_0006365
  Located on chromosome 9
  Distance between a terminus base of telomere on chromosomal short arm and 5'-terminus of this base sequence : 57545969
  Distance between 3'-terminus of neighbour sequence of sequence listing upward to telomere on chrosomal short arm and 5'-terminus of this base sequence : 291725
aataatctcttctgcttccctctttcccactctttccctgtctaaggtgtgtggtggtggtggtggtggtgtgtgtgtgtgtgtgtgtgtgtgtgtgtgtgtgtgtgtctaacctgattgggagagtaagccaaacgg

SEQ ID NO: 15056 - DNA, 389 bp, Homo sapiens
  chr9.fa.O7frz.45058553
  Located on chromosome 9
  Distance between a terminus base of telomere on chromosomal short arm and 5'-terminus of this base sequence : 57878378
  Distance between 3'-terminus of neighbour sequence of sequence listing upward to telomere on chrosomal short arm and 5'-terminus of this base sequence : 332271
caatttccacatcttaaatcatagacctaagtcagtcaaagtcagtcatatatatagatatatgtgtgtgtgtatatatatatatatatatacaggcacctacttaagtgatatgatttaagcatggcaataatgagataggaatcatactattattccatttttacaggtgaagaaatcaaggtctacaaaagaaatcaaataatatgtccaaattcatatgggctttgatttttgaactttcaaatttttgtctttgcttaataccttttgttttaaaataatttgactcataagaagttaaaaaaagaagtaaaatgaatgaccatgctattttcaggcaactttccccaatgattatatctaacttaacctagtacattgccaaa

SEQ ID NO: 15057 - DNA, 353 bp, Homo sapiens
  chr9.fa.O7frz.44955028
  Located on chromosome 9
  Distance between a terminus base of telomere on chromosomal short arm and 5'-terminus of this base sequence : 57952978
  Distance between 3'-terminus of neighbour sequence of sequence listing upward to telomere on chrosomal short arm and 5'-terminus of this base sequence : 74211
gtattgcatttgaataggaaatactctgaattgagggttatttcttttaacagttgcaattagattggttagtgacaattatctgtaattttcaggcaatgcctaggcaagtgcccaaggcacagtagcctcctccttgcctccgtgtgtgtgtgtgtgtgtgtgtgtgtgtgtgtgtgtgtagggtggtaacatttctgggaatttgtcttaacataaaatgataccacctttcacaaaacgacctagaggaagttggaaatcccactatcctggcttcctgctgagcaatatctgcttctctttctgactcaggctgatgcatctgtatacttagcttcacttctccagta

SEQ ID NO: 15058 - DNA, 103 bp, Homo sapiens
  DISD22_0006380
  Located on chromosome 9
  Distance between a terminus base of telomere on chromosomal short arm and 5'-terminus of this base sequence : 58084795
  Distance between 3'-terminus of neighbour sequence of sequence listing upward to telomere on chrosomal short arm and 5'-terminus of this base sequence : 131464
catttgccagaataatctgggcttagtgtgagtgtgtgtgtgtgtgtgtgtgcctgtgtgttctactaatatctcactgaggctagtgctctatacaacataa

SEQ ID NO: 15059 - DNA, 102 bp, Homo sapiens
  DISD22_0006396
  Located on chromosome 9
  Distance between a terminus base of telomere on chromosomal short arm and 5'-terminus of this base sequence : 58505933
  Distance between 3'-terminus of neighbour sequence of sequence listing upward to telomere on chrosomal short arm and 5'-terminus of this base sequence : 421035
ataccacttatgtaggtgcctgtatatatatatatatatatacacacacacacacacacatatctatatatatgactgactttgactgacttaggtctatga

SEQ ID NO: 15060 - DNA, 163 bp, Homo sapiens
  DISD22_0006401
  Located on chromosome 9
  Distance between a terminus base of telomere on chromosomal short arm and 5'-terminus of this base sequence : 58715345
  Distance between 3'-terminus of neighbour sequence of sequence listing upward to telomere on chrosomal short arm and 5'-terminus of this base sequence : 209310
cagtggtcaagccttgtattagaaaagacagaaagaaggaaaagaaagaaggcaggaaggaaggcaaggggaaggaaaggaagtggaagggaaggggaagagaaggggaagagaaggggaggggaaggggaggggaggggaaacgttgctttggacagaataa

SEQ ID NO: 15061 - DNA, 120 bp, Homo sapiens
  DISO7_10002709
  Located on chromosome 9
  Distance between a terminus base of telomere on chromosomal short arm and 5'-terminus of this base sequence : 58967277
  Distance between 3'-terminus of neighbour sequence of sequence listing upward to telomere on chrosomal short arm and 5'-terminus of this base sequence : 251769
cacaaatacgcacagacagacagacacacacacacacacacacacacattttcagatctgatgtgtatggaattcctgccagctttacctttaaagtgtagtaattccaaatgttgttga

SEQ ID NO: 15062 - DNA, 397 bp, Homo sapiens
  chr9.fa.O7frz.45410617
  Located on chromosome 9
  Distance between a terminus base of telomere on chromosomal short arm and 5'-terminus of this base sequence : 59250150
  Distance between 3'-terminus of neighbour sequence of sequence listing upward to telomere on chrosomal short arm and 5'-terminus of this base sequence : 282753
catacctgtaattccagctactcgggaggctgaggcaggagaatcacttgaacctgggaggcagcagttgcggtgagctgagattgcaccactgcacttcagcctgggcagcaagagtgaaactccatctcaacaacaacaacaacaacaacaacaacaacaacagcaacagcaacaaccaccacaaaacccaaatgcatttccttggcacagtaaaactgaaacagaaaaagtgtaaagtaaatacaagtaactgaaacagtttatgtatattattctacttctcatttgataaaatttgtaaagtaatgagcagagtgtatttctccagggacccagatatatacatttattcattcaataaaaattcatgcttacaatggccactgatacttat

SEQ ID NO: 15063 - DNA, 101 bp, Homo sapiens
  DISO7_10002913
  Located on chromosome 9
  Distance between a terminus base of telomere on chromosomal short arm and 5'-terminus of this base sequence : 59508127
  Distance between 3'-terminus of neighbour sequence of sequence listing upward to telomere on chrosomal short arm and 5'-terminus of this base sequence : 257580
cgacagcttgatgtgtacagtttcagtcacccagtaactccaacacacacacacacacacacacacattcacacaccacactccaacaccaacaaagtata

SEQ ID NO: 15064 - DNA, 181 bp, Homo sapiens
  DISD22_0006422
  Located on chromosome 9
  Distance between a terminus base of telomere on chromosomal short arm and 5'-terminus of this base sequence : 59861828
  Distance between 3'-terminus of neighbour sequence of sequence listing upward to telomere on chrosomal short arm and 5'-terminus of this base sequence : 353600
tcatgctgtctgttagagataaagataggagtacaaaggggaatttttgggtgaggtacacgggtgaaatgagttttcagggcctcatcctgtgtgttcaccttctgtgtgtgtgtgtgtgtgtgtgtgtgtgtgcatgcgtgcatgtatgtgtgtgtgccggtcctggacagtcacagct

SEQ ID NO: 15065 - DNA, 306 bp, Homo sapiens
  AL161457.4_156764
  Located on chromosome 9
  Distance between a terminus base of telomere on chromosomal short arm and 5'-terminus of this base sequence : 60285019
  Distance between 3'-terminus of neighbour sequence of sequence listing upward to telomere on chrosomal short arm and 5'-terminus of this base sequence : 423010
agacaatgtaatggtgattcatacctgtaatcccagcactttcagaggccaaggtggtaggattgcttaagcctgggagtttgagaccagcctgggcaacataaggagaccttgtctttacaataaataaataaataaataaataaataaataaataaataaaattagccaggtgtgatggtgtgcacttgtagtcctagctaattgggaggctgaggtgagaggattgctcaagcctgggaaattgatgatgcagtcagccatgatcataccactgcgctccagcttgagtgacagagtgagacc

SEQ ID NO: 15066 - DNA, 195 bp, Homo sapiens
  D9S1862
  Located on chromosome 9
  Distance between a terminus base of telomere on chromosomal short arm and 5'-terminus of this base sequence : 60294345
  Distance between 3'-terminus of neighbour sequence of sequence listing upward to telomere on chrosomal short arm and 5'-terminus of this base sequence : 9020
acatcaggattgtgggttctttaaatccatggccctaggatgaagaatgagcttttattctcgtgtgtgtgtgtgtgtgtgtgtgtgtgtgtgtgtgtgtgtgtgtgtggtgaggatgagggtgtagcagcagaagactggagtttttctgaactcccttaattcacaatgctgtcttcatacagtgctctcatg

SEQ ID NO: 15067 - DNA, 241 bp, Homo sapiens
  D9S1777
  Located on chromosome 9
  Distance between a terminus base of telomere on chromosomal short arm and 5'-terminus of this base sequence : 60337981
  Distance between 3'-terminus of neighbour sequence of sequence listing upward to telomere on chrosomal short arm and 5'-terminus of this base sequence : 43441
ctcccaaatacctgttacccaaatccaccaattattaacattttgctgcctttgctttctctctctctttctctctttctgtggtgtgtgtgtgtctgtgtgtgcatgcatatgtgtgtgtgtgtgtgtgtgtgtgtgtgtgtttgcgtatttgggaattacatcctgaatatatacatatatacacatacggaatttttagtgatccttgaggtgtgctccctatgaaccagcattgcct

SEQ ID NO: 15068 - DNA, 462 bp, Homo sapiens
  AL356219.5_81608
  Located on chromosome 9
  Distance between a terminus base of telomere on chromosomal short arm and 5'-terminus of this base sequence : 60576823
  Distance between 3'-terminus of neighbour sequence of sequence listing upward to telomere on chrosomal short arm and 5'-terminus of this base sequence : 238601
tactaaattgatagccatccttagtttttcatgtcagtttgatgcttgaacattccttgattatccagtgctaaaaggaggaagaaaacatttatgaagcatctacttaatgtgtaaggacttaaaaaatgagacatcctttctgaactcaaggtagcttatctaagaacaacagaaatacgcatatatgcattaaactttccatttttgtgtctattcatgtgccaggcactgtgatggatagaaaatggatggatggatggatggatggatggatagacagaggttattgccctcaaggggccaatagtgtactagaaagagaagaaatttaaactgaggattacaatatagtcagtaagtgtcacaatagagttagtcccagagcacgtgagtacagagaagaaacgctgccctttgcctcaggaggggtaggagaggattcatacgaggaagtcatgc

SEQ ID NO: 15069 - DNA, 144 bp, Homo sapiens
  D9S1879
  Located on chromosome 9
  Distance between a terminus base of telomere on chromosomal short arm and 5'-terminus of this base sequence : 60622025
  Distance between 3'-terminus of neighbour sequence of sequence listing upward to telomere on chrosomal short arm and 5'-terminus of this base sequence : 44740
ctaaatcagcaacaacagcagtggttttgtgtgtgtgtgtgtgtgtgtgtgtgtgtgtgtgtgtgtgtgtgtgtgtgtaggtggggataacattaggccagaagggatggatgagagggtggaggttgctgagggtttctttga

SEQ ID NO: 15070 - DNA, 290 bp, Homo sapiens
  D9S1787
  Located on chromosome 9
  Distance between a terminus base of telomere on chromosomal short arm and 5'-terminus of this base sequence : 60655101
  Distance between 3'-terminus of neighbour sequence of sequence listing upward to telomere on chrosomal short arm and 5'-terminus of this base sequence : 32932
gagaatcacttgtaccccggaggcaaaggttgcagtgagttaagattgtaccactgcactccagcctgggcggcagagcaagactgcatctgaaacacacacacacacacacacacacacacacacgcatacacacacacacacacacacacacgcatacacacacacacacacaaaatagagggaaagatagagccaggtatgtaagtgtgcttttgtttgattccatttgtccacctccctcattcaccacacacatggttcagtgtctagacacatctctggggctt

SEQ ID NO: 15071 - DNA, 232 bp, Homo sapiens
  AL162730.9_69233
  Located on chromosome 9
  Distance between a terminus base of telomere on chromosomal short arm and 5'-terminus of this base sequence : 60827984
  Distance between 3'-terminus of neighbour sequence of sequence listing upward to telomere on chrosomal short arm and 5'-terminus of this base sequence : 172593
tcaagtagcatgtagttgtaggtaggattaaaagactagggttccgggaggtgaaggttgcagtgagccaaaatcacgccactgcactccagcctgggtgacagagcgagactctgtcatagatggatggatggatggatggatggatggatggatggatagatagatagatagatagatagatagctggatagatagataagatagataagacaagactaggcttcaagct

SEQ ID NO: 15072 - DNA, 200 bp, Homo sapiens
  DISO7_10002710
  Located on chromosome 9
  Distance between a terminus base of telomere on chromosomal short arm and 5'-terminus of this base sequence : 61091812
  Distance between 3'-terminus of neighbour sequence of sequence listing upward to telomere on chrosomal short arm and 5'-terminus of this base sequence : 263596
tctagcacataagcaggagattagataataattttaagtgcagctgccgggctccctgtgcctaaccctaaccctaaccctaacccctaacccctaaccctaaccctaaccctaactctaaccctaaccctttaggactaagttaattaacatctcctaaattgaacactagttattcattaatagatacgcatgtgaca

SEQ ID NO: 15073 - DNA, 376 bp, Homo sapiens
  AL353693.6_60052
  Located on chromosome 9
  Distance between a terminus base of telomere on chromosomal short arm and 5'-terminus of this base sequence : 61356910
  Distance between 3'-terminus of neighbour sequence of sequence listing upward to telomere on chrosomal short arm and 5'-terminus of this base sequence : 264898
caagtgtctatcaatggttgactggattaagaaaaaagttgtgtgtgtgtatatatatatatatatatatatacacacacacacacacacacacacacacatgcaacactatggaatactatgcagccataaaaaagaatgaaatcatattctttgtagcaacatggatagagctatagtcattattctaagtgaactaactcagaaacagaaaaccaaactcctcatgttctcacttacatgtggaagctaaacagtgggtacacacggatatgaagatggaaactatagataccagggactccaaaagaggagagggtggtaaaggtgacggttgaaaaccttacctatctggtacaatgttcactatttgcgt

SEQ ID NO: 15074 - DNA, 315 bp, Homo sapiens
  X75525.1_163
  Located on chromosome 9
  Distance between a terminus base of telomere on chromosomal short arm and 5'-terminus of this base sequence : 61511475
  Distance between 3'-terminus of neighbour sequence of sequence listing upward to telomere on chrosomal short arm and 5'-terminus of this base sequence : 154189
aatgagtcactgcaataaacctacaaaatggaatctagaaacacactatggcatttcatctgaggtactgagattgtggccgcagggtcgctttttttcttcatgcaatgctcactgaagaaagaagtctaacacacacacacacacacacacacgcacgcacacacacacagtggcaaaaagtagactgtggcaaatctccatgttattgattctatgtgagctctactcattcagtatgttcccttaagctaaaatactacgtctcttttcagtgttttcaatgtaaatctatatgcggttagatgaactagc

SEQ ID NO: 15075 - DNA, 459 bp, Homo sapiens
  AL162421.6_127785
  Located on chromosome 9
  Distance between a terminus base of telomere on chromosomal short arm and 5'-terminus of this base sequence : 61528723
  Distance between 3'-terminus of neighbour sequence of sequence listing upward to telomere on chrosomal short arm and 5'-terminus of this base sequence : 16933
tctggctagaaactctagtacaatgttgaatagaagtggcaagagcagatatcatgttttgttcctaatctaagagggacagacttcagttctttcactattatattagctgtggggtcttattattattattattattattattatttctgagatgaagtctcactctgttgcccaggctggagtgctgtggtgcaatctaggctcactgcaacctccacctcctgggttcaaacaattatcctgtctcagcctcctgagtagctaggattacaggcacgctccaccatgatgagtaatttttgtatttttgtagtagagatggggtttcaccatgttggtcaggctggtcttgaactcctgacctcaggtgatccgcccacctcggcctcccaaagtgctgggattacaggtgtgagccaccatgctcagctgctgtaggctgttatagacactgtt

SEQ ID NO: 15076 - DNA, 459 bp, Homo sapiens
  AC008248.3_124726
  Located on chromosome 9
  Distance between a terminus base of telomere on chromosomal short arm and 5'-terminus of this base sequence : 61549724
  Distance between 3'-terminus of neighbour sequence of sequence listing upward to telomere on chrosomal short arm and 5'-terminus of this base sequence : 20542
cacagtcaaggttgaatatcaccatcctaagctgcaggcagagatctacatgaggaatctcttattaatgatgatgatgatgatgatgacgatgatatggtaacacaaaacctcttgtattcactcaggcaaagctccacaatcagatgaccatgtttacccaagcaggcaggaatcaggtgtaactaacactttctgcagctctcatgaagacatgcagttttgtgtaggaaatagattttcccttttcttacctatgacaccaaagggtttcatgtcctgggtaggaatcaataagatcagtgctgaattcaacttcttcttctagaagatggggaagattaatccttggttcttctgttgaaactgctgcttcttcatcttttggaggaactagggctggctcacttctcaaaggattttgctccatcacagaactgtctatcacagtttggctaa

SEQ ID NO: 15077 - DNA, 209 bp, Homo sapiens
  D9S273
  Located on chromosome 9
  Distance between a terminus base of telomere on chromosomal short arm and 5'-terminus of this base sequence : 61751131
  Distance between 3'-terminus of neighbour sequence of sequence listing upward to telomere on chrosomal short arm and 5'-terminus of this base sequence : 200948
agctgggtgtggtcagggaaggaaagaaaaagagtcctaccaatcctattatcatcccagggttactgtagccatccccaaagccatgcctccctgaggagcaacattggaggcttaacaatgtgtgtgtgtgtgtgtgtgtgtgtgtgtgtgtgtgtgtgcgcgcgcgcatgtgtgttcacataaaacttcactaaaataacccagct

SEQ ID NO: 15078 - DNA, 299 bp, Homo sapiens
  AC022857.2_149373
  Located on chromosome 9
  Distance between a terminus base of telomere on chromosomal short arm and 5'-terminus of this base sequence : 61777415
  Distance between 3'-terminus of neighbour sequence of sequence listing upward to telomere on chrosomal short arm and 5'-terminus of this base sequence : 26075
gaaacagaaccaataggatctatctatgtatgtatctgtctgtctgtctgtctgtctatctatctatctatctgtctatctatctatctatctatctatctatctatctatctatctagatgtatacaggaagtgatttattaaaaagaattggctcatgtgattatggaggctaagaagtcccatgatctgcagatggcaagctagcgacgcaggagagccaatgttgtagctccagtctgagtctgaaggcctgagaaccaagagagctgatggtgtaagttccagtctaagttcaa

SEQ ID NO: 15079 - DNA, 168 bp, Homo sapiens
  chr9.fa.O7frz.69749989
  Located on chromosome 9
  Distance between a terminus base of telomere on chromosomal short arm and 5'-terminus of this base sequence : 61878454
  Distance between 3'-terminus of neighbour sequence of sequence listing upward to telomere on chrosomal short arm and 5'-terminus of this base sequence : 100740
atgtagttatgcattcaggtctaggttcttggagtgtttgattacatatccatctatttatatctatttacctatctagatagatagagatagatagatagatagatagatagatagatagatagacagacagatagatagatatagtttcacctacagaatggttct

SEQ ID NO: 15080 - DNA, 342 bp, Homo sapiens
  chr9.fa.O7frz.69828839
  Located on chromosome 9
  Distance between a terminus base of telomere on chromosomal short arm and 5'-terminus of this base sequence : 61957207
  Distance between 3'-terminus of neighbour sequence of sequence listing upward to telomere on chrosomal short arm and 5'-terminus of this base sequence : 78585
tcacagttaaagttgctggtagagaagaaagcaaaactaaaggggttgaagtcattggcccatgttctttctaaccattggaacatacctggacatgctgagatcggggttctcacctctgactgctgcatctttgtccaggccttgatgtagagttcatataggaagaagtaaaggaacttagagggtgtttgctcctgagggatggcagggaggtaaaaaaacaaaacaaaacaaaacaaaacaaaaaaacaaaaaaaaacctggcctactttcttagctgatttttcctttaattgaagttcataatgctaattagttctgtagttctagcagaaatga

SEQ ID NO: 15081 - DNA, 461 bp, Homo sapiens
  AL162390.9_124837
  Located on chromosome 9
  Distance between a terminus base of telomere on chromosomal short arm and 5'-terminus of this base sequence : 62185605
  Distance between 3'-terminus of neighbour sequence of sequence listing upward to telomere on chrosomal short arm and 5'-terminus of this base sequence : 228056
taagcatggtagaattctagctctttatcatttgggttaatttgatcacacatgaaaggttcacttataccaaaggtgatgacattcccgaggctggttatccttttttttaaattattattattattattattattattattattattattttgagatggagtttccctcttgttgcccaggctggagtgcaatggcacgatcttggctcactgcaacctctgcctcccaagttcaagcgattctcctgcctcagcctcttgagttgctgagattacaaggcatgtgccactatgcccggctaattttttgtaattttttaatagagacggggtttcaccgtgttcaccaggatggtcttgctttcctgacctcatgatccacccgcctcggcctcctttaaatgagcatgaaacaactagaaatccttagacctattgtcggatcataggactcttaag

SEQ ID NO: 15082 - DNA, 420 bp, Homo sapiens
  chr9.fa.O7frz.70110771
  Located on chromosome 9
  Distance between a terminus base of telomere on chromosomal short arm and 5'-terminus of this base sequence : 62220719
  Distance between 3'-terminus of neighbour sequence of sequence listing upward to telomere on chrosomal short arm and 5'-terminus of this base sequence : 34653
cagcactaggattccatagataaaagaagaatttgggctggctgtggtagctcacgcctgtaatcccagcactttgggaggctgagatgggaggactgcttgagcccaggagatcaaaaccaatctgggcaacacagtaacaccccaactctacaaaagaaatgtaattttaaaaaggacaatttgatattattaaatcatactgatattattcccccatttaacagctcatacacacacacacacacacacatttagtatcatttaatatcatatacacactcttatcgtgtacaaaatagtatatgataaaattgaacaaccatccctaataaaagctttcaggaaaataaaataattcctcagcagtataaaagatcagctctgaaacctttcctctgcaaggtcaacagtaaaata

SEQ ID NO: 15083 - DNA, 251 bp, Homo sapiens
  D9S166
  Located on chromosome 9
  Distance between a terminus base of telomere on chromosomal short arm and 5'-terminus of this base sequence : 62400607
  Distance between 3'-terminus of neighbour sequence of sequence listing upward to telomere on chrosomal short arm and 5'-terminus of this base sequence : 179468
aaatcatgcaattcatttcacacacacacacacacacacacacacacacacacacacactaccaacaccaccatgcttggattgatttagaaatgtaggttaaatcagcaattcatgtcagacacacacacgcgcgcgcacacacacacacacacactactaacaccaccaccaccatcatcaacaacataatcatcaactcagtttctacacaaaatccttcacttcttagttttcccagtgaattagga

SEQ ID NO: 15084 - DNA, 165 bp, Homo sapiens
  D9S1799
  Located on chromosome 9
  Distance between a terminus base of telomere on chromosomal short arm and 5'-terminus of this base sequence : 62578627
  Distance between 3'-terminus of neighbour sequence of sequence listing upward to telomere on chrosomal short arm and 5'-terminus of this base sequence : 177769
tgcagtttcaatccacatctcaacagtgtgtgtgtgtgtgtgtgtgtgtgtgtgtgtgtgtgtgtgtgtgtgtgtgcgcgcgcgcgcgcatacacatgtacatgcaacctgaaaggctgagtttaaaatttatctataagagcaaagggctaaaatagttggcaa

SEQ ID NO: 15085 - DNA, 391 bp, Homo sapiens
  AL356318.1_4816
  Located on chromosome 9
  Distance between a terminus base of telomere on chromosomal short arm and 5'-terminus of this base sequence : 62633127
  Distance between 3'-terminus of neighbour sequence of sequence listing upward to telomere on chrosomal short arm and 5'-terminus of this base sequence : 54335
aaggtaaggagtttgagaccagcctggccaatatggtgaaacccagtctctactacaaatacaagaattagctgggcttggtggtgcacgcctatagcccagctactcgggaggctgaggcagaagaatcgctggaacacgggaggcgggggttgcagtgagctgagatcatgccactgcactccagcctgggtgacagagctagactccgtctcaaaaataaaataaaataaaataaaataaaataaaaagaaaaaagtttttattctgttaacagctatgacaactttattagtgacatctgggagcactatttatagtcatttcccaagactatatgaatgattcttcagttttacatccattagtttcaatgacttgacatgatcta

SEQ ID NO: 15086 - DNA, 261 bp, Homo sapiens
  AL356318.4_42554
  Located on chromosome 9
  Distance between a terminus base of telomere on chromosomal short arm and 5'-terminus of this base sequence : 62670994
  Distance between 3'-terminus of neighbour sequence of sequence listing upward to telomere on chrosomal short arm and 5'-terminus of this base sequence : 37476
atcatgttgagctattcaacagtgttggaaagaatatcattttcacttattatcttatctatgaatcttctgagtgagagaactggtaaaacaaacaaacaaacaaacaaacaaaaacagacccgaaccaaaaaacaacaaaacaaaactcccccaaaaaaggctgtgaatattgatattaagttgtttccaattgtttccaatacaaaactcctttcagggccagccctggacaagaagtttaacgttatggtatgctca

SEQ ID NO: 15087 - DNA, 227 bp, Homo sapiens
  chr9.fa.O7frz.70838874
  Located on chromosome 9
  Distance between a terminus base of telomere on chromosomal short arm and 5'-terminus of this base sequence : 62806600
  Distance between 3'-terminus of neighbour sequence of sequence listing upward to telomere on chrosomal short arm and 5'-terminus of this base sequence : 135345
gccttaatgatctcgtaaagaccctatttccagctggccacattagggtctagggcttcaacacatggattttggcaggacccaatcagtccacagcatgtgtggccatgcatgtgcgtgcacacacacacacacacacacacacacacggagtacactaagccaagagctaatgctgtggtgggagccctggttatgaaatatttacattgaggataacctgagtc

SEQ ID NO: 15088 - DNA, 193 bp, Homo sapiens
  chr9.fa.O7frz.70938528
  Located on chromosome 9
  Distance between a terminus base of telomere on chromosomal short arm and 5'-terminus of this base sequence : 62908217
  Distance between 3'-terminus of neighbour sequence of sequence listing upward to telomere on chrosomal short arm and 5'-terminus of this base sequence : 101390
agacaagaatcctttatggaagatttttatggcgttactaagaaaatgtgactttaattttggcagaatatctaaataaaaatgctttatgccattgtttgaaattacacacacacatacacacacacaaacagacacacaatatgagcccttagaaataagaaacttggtttaactacatgctttgtatcct

SEQ ID NO: 15089 - DNA, 406 bp, Homo sapiens
  AL160273.4_176652
  Located on chromosome 9
  Distance between a terminus base of telomere on chromosomal short arm and 5'-terminus of this base sequence : 62989723
  Distance between 3'-terminus of neighbour sequence of sequence listing upward to telomere on chrosomal short arm and 5'-terminus of this base sequence : 81313
ggtcttatgttcatgctaatgaaatggtccttgtgttgaagggagcggacatctaaggacaactttaacccaaagaggtgacatgattaaaaattcaccttggaagctttttccaaggtcacagtgtgaagaatagattgggaagtggtgagattgcaaagaacataatcactcaggagcagatgtggtgatttggacgagaatagatgtatatctgcactagggcaggatcaatagtgataaagaggggaaacaagatataggtaggtaggtaggtaggtaggtagattgatgagactgatgttgattagggagatggaaatggcaggatttagtgactgaagggatatagcagaagtgactgagatagagtcatgctttggtatactgagtggttaacagtggt

SEQ ID NO: 15090 - DNA, 406 bp, Homo sapiens; identical to SEQ ID NO: 15089
  AL161913.3_72944
  Located on chromosome 9
  Distance between a terminus base of telomere on chromosomal short arm and 5'-terminus of this base sequence : 62989723
  Distance between 3'-terminus of neighbour sequence of sequence listing upward to telomere on chrosomal short arm and 5'-terminus of this base sequence : -406

SEQ ID NO: 15091 - DNA, 225 bp, Homo sapiens
  D9S936
  Located on chromosome 9
  Distance between a terminus base of telomere on chromosomal short arm and 5'-terminus of this base sequence : 63014456
  Distance between 3'-terminus of neighbour sequence of sequence listing upward to telomere on chrosomal short arm and 5'-terminus of this base sequence : 24327
agttttcataacacaaaagagaacatattctccatattcttctgcaactctctgaacatatcttcaagacagacaggcagacagatgatagatagatagatagatagatagatagatagatagatagatagatagatagatagatagatcatcgcattttttaaaaaagttaaccagtattcaattctataactatatcataatttatcattcctcttttgatga

SEQ ID NO: 15092 - DNA, 235 bp, Homo sapiens
  D9S301
  Located on chromosome 9
  Distance between a terminus base of telomere on chromosomal short arm and 5'-terminus of this base sequence : 63014456
  Distance between 3'-terminus of neighbour sequence of sequence listing upward to telomere on chrosomal short arm and 5'-terminus of this base sequence : -225
agttttcataacacaaaagagaacatattctccatattcttctgcaactctctgaacatatcttcaagacagacaggcagacagatgatagatagatagatagatagatagatagatagatagatagatagatagatagatagatagatcatcgcattttttaaaaaagttaaccagtattcaattctataactatatcataatttatcattcctcttttgatgaacatttaggt

SEQ ID NO: 15093 - DNA, 196 bp, Homo sapiens
  chr9.fa.O7frz.71346278
  Located on chromosome 9
  Distance between a terminus base of telomere on chromosomal short arm and 5'-terminus of this base sequence : 63314732
  Distance between 3'-terminus of neighbour sequence of sequence listing upward to telomere on chrosomal short arm and 5'-terminus of this base sequence : 300041
tcaaagttacaattccttgataacacacatctatgtttctgtacagcaacagaagacatgtttctaccagtctctatgggattcccccaaactctgtgtgagtgtgtgtgtgtgtgtgtgtgtgtttgagagagagagagcaagagagagagagaaaatgcttgcgcaaacagacaaccttaagatgtccttaatt

SEQ ID NO: 15094 - DNA, 264 bp, Homo sapiens
  D9S1806
  Located on chromosome 9
  Distance between a terminus base of telomere on chromosomal short arm and 5'-terminus of this base sequence : 63413093
  Distance between 3'-terminus of neighbour sequence of sequence listing upward to telomere on chrosomal short arm and 5'-terminus of this base sequence : 98165
gggagcaacattttgacattaactgttctgggctttttagaaattatttatttttattgtgttctatgtatttaaggtatacaacatgttttgatatacatatacatagtggaatgattactgcagtcaagcaaatttatatccatctcctcacagttacctttttattttctttttctttgtgagtggatgtgtgtgtgtgtgtgtgtgtgtgtgtgtgtgtgtgtgtgcacgcacatgtgcatgtactgagaacacctaaaa

SEQ ID NO: 15095 - DNA, 437 bp, Homo sapiens
  chr9.fa.O7frz.71553333
  Located on chromosome 9
  Distance between a terminus base of telomere on chromosomal short arm and 5'-terminus of this base sequence : 63519188
  Distance between 3'-terminus of neighbour sequence of sequence listing upward to telomere on chrosomal short arm and 5'-terminus of this base sequence : 105831
catgccaataaaattacatcacgggtgtattacaaaatgcaggactgctaaaggaggggaacaagcataaacacagacttgaagaaactttaacctggtgtggtggctcacacctgtaatcccagcactttggaaggccaaggcaggaagatcacttgagcccaggagttcaagactagcctgagcaacacagtgggactccatctctataaaaaatattttaaaacttaaccaagtgggactaaagcatgtgcctttagtcccagctacgtgggaggatcaatttagcctgggaggtggagggtgcggtgagccgagattgcgccactgcactctggcctgggtgaagagggagaccctgtctcaaaaacaaacaaacaaacaaacgacaacaacaacaacaaaaaccaagagtctttgagctacagttacatagg

SEQ ID NO: 15096 - DNA, 414 bp, Homo sapiens
  AL161732.3_181392
  Located on chromosome 9
  Distance between a terminus base of telomere on chromosomal short arm and 5'-terminus of this base sequence : 63583066
  Distance between 3'-terminus of neighbour sequence of sequence listing upward to telomere on chrosomal short arm and 5'-terminus of this base sequence : 63441
agaaatcaatttgattttgtctaagcatactcccaaagaatctcttcaactacagattcctctctctctctctctctctctctctctctctctcacacacacacacacacacacacacacaaacacacacacaagagaaagagagacagagagagagaaatttcctatttaatccttctttgacatccttgaggctctgggcaatttgactaatttctatatcagtttctctgattcaggagaaaattgagaacaatactacttaaagcaaaaaaagtctatgtgttaattcttataaaatgcaattctagtatgaaaactaataggtgactaaaaggtattattaacaactgcaggaaggaattctaaagataaagagcagcaaactacctagataaattcaacctttcacaa

SEQ ID NO: 15097 - DNA, 408 bp, Homo sapiens
  chr9.fa.O7frz.71629928
  Located on chromosome 9
  Distance between a terminus base of telomere on chromosomal short arm and 5'-terminus of this base sequence : 63583072
  Distance between 3'-terminus of neighbour sequence of sequence listing upward to telomere on chrosomal short arm and 5'-terminus of this base sequence : -408
caatttgattttgtctaagcatactcccaaagaatctcttcaactacagattcctctctctctctctctctctctctctctctctctcacacacacacacacacacacacacacaaacacacacacaagagaaagagagacagagagagagaaatttcctatttaatccttctttgacatccttgaggctctgggcaatttgactaatttctatatcagtttctctgattcaggagaaaattgagaacaatactacttaaagcaaaaaaagtctatgtgttaattcttataaaatgcaattctagtatgaaaactaataggtgactaaaaggtattattaacaactgcaggaaggaattctaaagataaagagcagcaaactacctagataaattcaacctttcacaa

SEQ ID NO: 15098 - DNA, 293 bp, Homo sapiens
  HUMUT739
  Located on chromosome 9
  Distance between a terminus base of telomere on chromosomal short arm and 5'-terminus of this base sequence : 63713011
  Distance between 3'-terminus of neighbour sequence of sequence listing upward to telomere on chrosomal short arm and 5'-terminus of this base sequence : 129531
ctatcttcctgctttccttgctttacattaatcttccttccttcctttctttctttctttctttcctttctttctttccttccttcttcctttctctttttcttttcctctttctttctttttctttttctttctttcttctttctttctttttctttcattccttccttccttcttcttttcttcctttctctttttctttttctctttctttctctctctctttctttctttctctttctttctttctttctttcttgacaaggtttcactctgatacccaggctagagtg

SEQ ID NO: 15099 - DNA, 316 bp, Homo sapiens
  AL138751.5_106939
  Located on chromosome 9
  Distance between a terminus base of telomere on chromosomal short arm and 5'-terminus of this base sequence : 63861076
  Distance between 3'-terminus of neighbour sequence of sequence listing upward to telomere on chrosomal short arm and 5'-terminus of this base sequence : 147772
tatttatcaagcactaccgaagagtctagaaaacatggatctagggcagaagaagaaaacaaaaatgctggcaggggccagacaggcaaagaactggagctgattggcaggaacttcagcccctgaagggcagaaactccagtctagcatgtgttgtcattcaagaatgaggggcccagtgtcctggccttagtgtttttgttttgttttgttttgttttgttttaaagaaactgaaaacttggattttaatttaaaatttttcaataaataaagtgctcttcaggccaaacaaaatagatcagtaagcctgatgc

SEQ ID NO: 15100 - DNA, 388 bp, Homo sapiens
  AL135924.11_132521
  Located on chromosome 9
  Distance between a terminus base of telomere on chromosomal short arm and 5'-terminus of this base sequence : 64119411
  Distance between 3'-terminus of neighbour sequence of sequence listing upward to telomere on chrosomal short arm and 5'-terminus of this base sequence : 258019
tcaactggtaacactgtctaggttgaatgtgattttttttttttttttgagatggagtctcgctctgtcgcccaggctggagtgcagtggcgtgatcttggcttgctgcaacctccgcctccggggttcaagcaattttcctgcctcagtctcccgaatagctgggaatacaggcacatgccaccatgcccggctaattctctgtgtgtgtgtgtgtgtgtgtgtgtgtgtgtgtgtgtgtgtgtgtgtgtagtttcagtagtagagatggggtttcactgtgttagccaggatggtctcgatctcctgacctcatgatctacctgccttggcctcccaagagtgtgatttttaattgccttttgagtcaaatcattcagctggtaat

SEQ ID NO: 15101 - DNA, 161 bp, Homo sapiens
  D9S1822
  Located on chromosome 9
  Distance between a terminus base of telomere on chromosomal short arm and 5'-terminus of this base sequence : 64161150
  Distance between 3'-terminus of neighbour sequence of sequence listing upward to telomere on chrosomal short arm and 5'-terminus of this base sequence : 41351
aattcccccaggctgagtgtttcaggaaacaccataaataaataaaattgtctgtgtgtgtgtgtgtgtgtgtgtgtgtgtgtgcaattctctagagaaaagatctagagctttcaccaaattcccaagagcccacgacccttacagcagaagccaaactc

SEQ ID NO: 15102 - DNA, 161 bp, Homo sapiens
  DISD22_0006439
  Located on chromosome 9
  Distance between a terminus base of telomere on chromosomal short arm and 5'-terminus of this base sequence : 64314507
  Distance between 3'-terminus of neighbour sequence of sequence listing upward to telomere on chrosomal short arm and 5'-terminus of this base sequence : 153196
caggtacttgggtatcagagacattatttgtttatcaagacctaacaaaacactttcttattttttaaaatttctgtgtgtgtgtgtgtgtgtgtgtgtgtgtgtgtgtgtgtattttacctttcacattgttcttttttaaaccttgctttggaaggaac

SEQ ID NO: 15103 - DNA, 125 bp, Homo sapiens
  DISD22_0006441
  Located on chromosome 9
  Distance between a terminus base of telomere on chromosomal short arm and 5'-terminus of this base sequence : 64452292
  Distance between 3'-terminus of neighbour sequence of sequence listing upward to telomere on chrosomal short arm and 5'-terminus of this base sequence : 137624
ttggtactaggtgagaaggtacacattttctggaacactgagccataattgtgtgtgtgtgtgtgtgtgtgtgtgtgtgtgtgtgtgtgtgattaaattatttgagctatagcttcaagattcca

SEQ ID NO: 15104 - DNA, 152 bp, Homo sapiens
  DISD22_0006447
  Located on chromosome 9
  Distance between a terminus base of telomere on chromosomal short arm and 5'-terminus of this base sequence : 64532175
  Distance between 3'-terminus of neighbour sequence of sequence listing upward to telomere on chrosomal short arm and 5'-terminus of this base sequence : 79758
tcctatgagtcaggaaagagggccagttgaaactgggctcacacacacacacacacacaaactaggctcacatgtgttttcccatcagctaaacaagttttcagaagtacagaaataactcgttggggaaggggacccaggacaatgacaat

SEQ ID NO: 15105 - DNA, 424 bp, Homo sapiens
  AL359635.11_84600
  Located on chromosome 9
  Distance between a terminus base of telomere on chromosomal short arm and 5'-terminus of this base sequence : 64628928
  Distance between 3'-terminus of neighbour sequence of sequence listing upward to telomere on chrosomal short arm and 5'-terminus of this base sequence : 96601
aattagtcagatttcaggacctttttctgaataattgatagaataaacagacaaaaatatcagtaaggatacagaaaacctccaaaatattatcaatcaccttgaattaattaatatttatggggccaggcttggggctcatgcctgtaattccagcactttggcaggccttgagctcaggaattcgagacaagcctgggcaacacacacacacacacacacacacacacacacacacacacgtgtatatatatatgcacacacacacatcagctaaaagcagcagaatacacattttcttcaagagaacacagaatatttagcatgatatgctatattctaggccataaataaatctcaacagacttaaaataattcagctaatacaaagtatattctgtaactacagtggaattaagtttga

SEQ ID NO: 15106 - DNA, 361 bp, Homo sapiens
  chr9.fa.O7frz.72635640
  Located on chromosome 9
  Distance between a terminus base of telomere on chromosomal short arm and 5'-terminus of this base sequence : 64633371
  Distance between 3'-terminus of neighbour sequence of sequence listing upward to telomere on chrosomal short arm and 5'-terminus of this base sequence : 4019
atcaaggtaatcttgaggacagagacttcctttgttagccagggcactctaggggaacagaaattacacacacacacacacacacacacacacacacacaggaactggttcatggaggctaaaaagtctcaaaatctgcaggccaaaggcttgagaacccggagtcctcattgtgtaagttccactcagagtctgaagaggggagaagacagatgtcccagctcagagacctttaggcagagagagaaaattctgtcttgctcagcctttggttcttttcaggcctccagtggattagatgaggctcacccacataggggaaggagtctgatttcctcagtctaccaatgcaaaggttaat

SEQ ID NO: 15107 - DNA, 349 bp, Homo sapiens
  AL359635.11_212692
  Located on chromosome 9
  Distance between a terminus base of telomere on chromosomal short arm and 5'-terminus of this base sequence : 64681401
  Distance between 3'-terminus of neighbour sequence of sequence listing upward to telomere on chrosomal short arm and 5'-terminus of this base sequence : 47669
gcttgtaacaagataacaatcaaggcatttttgtggccatgtttatgtatatgagcaagcaatggcaagtgagatactagtttgggggcttaaataagataaaagtagttaaactttattaaaatgcacatattaaaataaattttgaaatacattgtattcaaatattgtattagggttctcttagacaactcataggatacccccacacacacattttatgtgtgtatgtatatatatatatatatatatatatatatatatatatatatatgtatatacacacacacatgcgtacatatatatacaggagtttattaagtattaacttacatgatcacaaggttcc

SEQ ID NO: 15108 - DNA, 187 bp, Homo sapiens
  DISO7_10002712
  Located on chromosome 9
  Distance between a terminus base of telomere on chromosomal short arm and 5'-terminus of this base sequence : 64771116
  Distance between 3'-terminus of neighbour sequence of sequence listing upward to telomere on chrosomal short arm and 5'-terminus of this base sequence : 89366
ccaaatcaggaaccaattctatctttttacaaatatatttttgagttcttgggtttgggaggaacagaggctctcttggatcatctttgtgtgtgtgtgtgtgtgtgtgtgtgtgtgtgtgtgtgtgtgtgtgtgtgttggggagggagctgttatggggatatgtgtggtctgaagcacacctgga

SEQ ID NO: 15109 - DNA, 113 bp, Homo sapiens
  DISO7_10002713
  Located on chromosome 9
  Distance between a terminus base of telomere on chromosomal short arm and 5'-terminus of this base sequence : 64778799
  Distance between 3'-terminus of neighbour sequence of sequence listing upward to telomere on chrosomal short arm and 5'-terminus of this base sequence : 7496
tgagaagctctgttaattccgttgtgtgtgtgtgtgtgtgtgtgtgtgtgtgtgtgtgtgtgtgtgtgtttccaagtgggctgaaataaataatgcagacagtgacatctgga

SEQ ID NO: 15110 - DNA, 104 bp, Homo sapiens
  DISO7_10002714
  Located on chromosome 9
  Distance between a terminus base of telomere on chromosomal short arm and 5'-terminus of this base sequence : 64784678
  Distance between 3'-terminus of neighbour sequence of sequence listing upward to telomere on chrosomal short arm and 5'-terminus of this base sequence : 5766
cctttgagagtcaaggccctttagtggtatgaatgaggtgttgtttaaaacacacacacacacacacacacaatgtaaatgtcagatttcgttaccatattctt

SEQ ID NO: 15111 - DNA, 164 bp, Homo sapiens
  DISO7_10002718
  Located on chromosome 9
  Distance between a terminus base of telomere on chromosomal short arm and 5'-terminus of this base sequence : 65034122
  Distance between 3'-terminus of neighbour sequence of sequence listing upward to telomere on chrosomal short arm and 5'-terminus of this base sequence : 249340
gctagaactatatgaagatcaggtgtgtgtgtgtgggtgtgggtgtttgcatgtgtgtgtgtgtgtgtgtgtgagagagtgtgtgttgaaaaggggtagactaaaataaatcaaagtccagtttcagatagcagaaatttaagatggcaacttgacagtagatg

SEQ ID NO: 15112 - DNA, 473 bp, Homo sapiens
  chr9.fa.O7frz.73392938
  Located on chromosome 9
  Distance between a terminus base of telomere on chromosomal short arm and 5'-terminus of this base sequence : 65089054
  Distance between 3'-terminus of neighbour sequence of sequence listing upward to telomere on chrosomal short arm and 5'-terminus of this base sequence : 54768
gttctgaacatacaacgaaattagaaaaagtggaataataaataattcacttgttttccttcagcttcataaggtttctactaatctgttttccttatgggccaaactcttagagaaatttgatcaggtgcctttaaaaatatagaaacacgttcagagaacttcaaagaatacaaaaaataatgtatttcttttccaaaataacttcactttcatcataaaacatgaaaaatggtgaaagaatcatttccaaaagaaaacctaaacttgtctgatttcaggacacacttttatctttaaaaaatttttccttactgttgtgaaaggaaaagaaaagctcaggaccccaaattcactatgccaaaagggaagagttaaacttggaagctgagtcataaaaataaataaataaataaataaataaataaaacaacccaaatctgcctctccttttgttcctaaattgacagcta

SEQ ID NO: 15113 - DNA, 457 bp, Homo sapiens
  AL359997.6_165023
  Located on chromosome 9
  Distance between a terminus base of telomere on chromosomal short arm and 5'-terminus of this base sequence : 65124967
  Distance between 3'-terminus of neighbour sequence of sequence listing upward to telomere on chrosomal short arm and 5'-terminus of this base sequence : 35440
gattagattctatcctaagagcaacagaagatcactgacagtgttttaaatagatagactagtttattagatttgcagtttagaagttccctttttttgtaattattggacagtgtagagaccggatggtgagagatgagttaggaagttgtgacagctctctatacctaccgctaatgtagaggattatttattttcatttcattaccattcgtgtaaggtgtgtgtgtgtgtgtgtgtgtgtgtgtgtgtatagctagtttctctatagaaattatatggaagagtaagaaggcttcactttaaaattcatgtttttaatgagagtattttctgaatatgagacacttaccctcatttattttggccagggtgttggaactcgccataaggcattgatcaggattatggtttcccgttctgaaattgacatgaatgatatcaaagcattctatca

SEQ ID NO: 15114 - DNA, 393 bp, Homo sapiens
  chr9.fa.O7frz.73551803
  Located on chromosome 9
  Distance between a terminus base of telomere on chromosomal short arm and 5'-terminus of this base sequence : 65273084
  Distance between 3'-terminus of neighbour sequence of sequence listing upward to telomere on chrosomal short arm and 5'-terminus of this base sequence : 147660
attctggatacaagttatcaggtatatgttttacaaatattttctcccaattggtatcattttgagtttctttaacagtgcctctcagagagcaaaatactttacttttgacaaagatcttttatcacttttaattttttaaattatatatatatatatatatatatatacttttttgaaacagagtttagctcttgttgcccaggctggagttcaatggcacgatcttggctcactgcaaactctgcctcccaggttcaagcaattctcctgcctcagcttcctgagtagctgggattaccggcatgcaccaccacgcctggctaattttgtatttttagtagagatggggtttctccatgttggccaggctggtttctaacttctgacctc

SEQ ID NO: 15115 - DNA, 300 bp, Homo sapiens
  AL355604.7_123934
  Located on chromosome 9
  Distance between a terminus base of telomere on chromosomal short arm and 5'-terminus of this base sequence : 65387096
  Distance between 3'-terminus of neighbour sequence of sequence listing upward to telomere on chrosomal short arm and 5'-terminus of this base sequence : 113619
ttaatttgagaacttctcagtcattatttctgcaaatgtttcttctgctccattttcttcttcttctctttttgatattccaattatatacatgttgcaacttttgatataactccacagttcttgtctgttctgttacagtctattctattctattctattctattctattctattctattctattctattctattctattctattctattctattctattatctcctcctcctttttttcttctttgtatttcatttcaaatatttctatttacctatgctgaaatttacagattctc

SEQ ID NO: 15116 - DNA, 209 bp, Homo sapiens
  G10096
  Located on chromosome 9
  Distance between a terminus base of telomere on chromosomal short arm and 5'-terminus of this base sequence : 65547588
  Distance between 3'-terminus of neighbour sequence of sequence listing upward to telomere on chrosomal short arm and 5'-terminus of this base sequence : 160192
cctccacaatcataggaaccaatttcttaaaataagttgatctttgtatgtatcatctttctgtgtctgtctatctatctatctatctatctatctatctatctatctatcatctatctatctatctatctatctatctatctatctatctatctatatctatctattcattcatcctattagttctgtttctctggagaatcctatta

SEQ ID NO: 15117 - DNA, 401 bp, Homo sapiens
  chr9.fa.O7frz.73888428
  Located on chromosome 9
  Distance between a terminus base of telomere on chromosomal short arm and 5'-terminus of this base sequence : 65570549
  Distance between 3'-terminus of neighbour sequence of sequence listing upward to telomere on chrosomal short arm and 5'-terminus of this base sequence : 22752
ctacataaactgaatcatttggagcaacaggtatttgttgcccaggtgatagcctgaagaaagacaaattggccacacacacacacacacacacacacacacacgccccgtaactatttaaactctataatatacactgagcaatgtgcacacttggttaatataatttcattgtgtgatacatgataggcaaaaatgctggtcccatgtggattcatgacaaaatatagctgcctccgtggccgccttcccttgttaggttctgaaaagctttacaacaaatgtgaaaatgccatatttccatcagtgacaggtatcagcttcatttataaatgtatattttgaaactattttacagctcttcttcctatgcaagaaagtttatttcaaggctgtcataa

SEQ ID NO: 15118 - DNA, 101 bp, Homo sapiens
  DISO7_10018926
  Located on chromosome 9
  Distance between a terminus base of telomere on chromosomal short arm and 5'-terminus of this base sequence : 65680167
  Distance between 3'-terminus of neighbour sequence of sequence listing upward to telomere on chrosomal short arm and 5'-terminus of this base sequence : 109217
ttaccactgtgctttggccaaaaggcattgtgtgtgcgtgtgtgtgtgtatgtgtgtgtttgtataaagatgaaaagatgggagcatatgtgacaaggttt

SEQ ID NO: 15119 - DNA, 323 bp, Homo sapiens
  chr9.fa.O7frz.74318438
  Located on chromosome 9
  Distance between a terminus base of telomere on chromosomal short arm and 5'-terminus of this base sequence : 65762489
  Distance between 3'-terminus of neighbour sequence of sequence listing upward to telomere on chrosomal short arm and 5'-terminus of this base sequence : 82221
gttcttatttctacagttcaccattagaactcttcttaaggcttcccatattctcaaggctttaaacatgtgcacacacacacacacacgtgggcatttatctatgtatctatgtatctatgtatctatctatctatctatctatgtatctatctatctgtctatctatctatctatctatctatctatctatctatctatctatctatctctatctatctaccatctaaagctattcttggttgaaagaaggtacatgacaagtcattttgaagaaatgaccacatgaatatccaggatagtatctacctctccatggtttc

SEQ ID NO: 15120 - DNA, 309 bp, Homo sapiens
  chr9.fa.O7frz.74215304
  Located on chromosome 9
  Distance between a terminus base of telomere on chromosomal short arm and 5'-terminus of this base sequence : 65792459
  Distance between 3'-terminus of neighbour sequence of sequence listing upward to telomere on chrosomal short arm and 5'-terminus of this base sequence : 29647
cctaatgctagatgacgatttagtgggtgcagcgcaccagcatggcacatgtatacatatgtaattaacctgcacattgtgcacatgtaccctaaaacttaaagtataataaaaaaattaaataaataaataaataaataaataaataaaaagaaaagtgcttttcaaactttcccattaaaatacccacaaaggcaaaggaaatttaatacacaacctcacagggattgctgtgaggaagaaatagaataatatcataaaatacttggcccgtgttagatgtttgtcttgttattgttcttaatgtcc

SEQ ID NO: 15121 - DNA, 383 bp, Homo sapiens
  AC021177.6_15891
  Located on chromosome 9
  Distance between a terminus base of telomere on chromosomal short arm and 5'-terminus of this base sequence : 65814552
  Distance between 3'-terminus of neighbour sequence of sequence listing upward to telomere on chrosomal short arm and 5'-terminus of this base sequence : 21784
cgaaagacatagcattaaagtaattgttataatctattattaataaaagaaaagcaacaaattgaaaaaacaaacacttgtatagtgtttctatagaagagagtacttctctcttatcttttatcatcatttctccaccaaactttattattattattattattattattattattattattattattattttggtagagagatggttttgccatgttggccaggctggtctcgagctgctgacctcaagtgatccacctgcctcagcctcccaatgtgctgggatcacaggcgtgagccactgtgcccagcctccaccaaacttcttaaaagtatactctctactccctcttcttggctacagataccttaactttctgtca

SEQ ID NO: 15122 - DNA, 423 bp, Homo sapiens
  AC021177.6_71796
  Located on chromosome 9
  Distance between a terminus base of telomere on chromosomal short arm and 5'-terminus of this base sequence : 65882573
  Distance between 3'-terminus of neighbour sequence of sequence listing upward to telomere on chrosomal short arm and 5'-terminus of this base sequence : 67638
ggatatcaggaactagtgttcttacattaatgcaactgcttcccgagtagagtgggaaggtaaacataaaaactcattatttggaaaaataatttaaaattgtaataactcaggtgcaatatatacaaagtgttttttgttttgttttgttttgttttgttttttggagacagttttgctcttgttgcgcaggctggagtgcaatggcacgatctcagcccactgcaacctccgcctcctggcttcaagtgattctcctgcctcagcctcctaaatagctgggattacaggcatgtaccaccatgcccagctaattttgtatttttagtagagatggggtttctccatgttggccaggctggtctcgaactcttgacctcaggtgatccacccaccttggccttctaaagtgctggaattaca

SEQ ID NO: 15123 - DNA, 480 bp, Homo sapiens
  chr9.fa.O7frz.74444164
  Located on chromosome 9
  Distance between a terminus base of telomere on chromosomal short arm and 5'-terminus of this base sequence : 65927670
  Distance between 3'-terminus of neighbour sequence of sequence listing upward to telomere on chrosomal short arm and 5'-terminus of this base sequence : 44674
cctgcctaaggtagatctttatagctgtgtgagaatggactaatacaatcatccgatttgttgaggccctgagtagaatgaaaagaaagaggaaaaataaatttaatcttttctaaagctgcaacattcattttctcctgcctctggaaatcggtatttcttgttttgtgccttaagactcagattggaactccgttcattagcttcctggttcttgggccttcaggtttggtttggaactacaccactggtttacctgggctttcagcttgcagacagcaattgtgaatcttctcagcctccacagtcacataagccaatccctcactatacatatatatatatatatatatatatatatatatacacacacacacacacacacatgtgtgtgtgtatacacatatatatgtatatgtgtatatatatagatagtgtacatgtacatacacacacacacaaatgctccttgacttataa

SEQ ID NO: 15124 - DNA, 460 bp, Homo sapiens
  AC024679.3_136790
  Located on chromosome 9
  Distance between a terminus base of telomere on chromosomal short arm and 5'-terminus of this base sequence : 65999364
  Distance between 3'-terminus of neighbour sequence of sequence listing upward to telomere on chrosomal short arm and 5'-terminus of this base sequence : 71214
tctcatgcttctatacctgataacaaaaattatcacaaaagactgcaaaaaccacaactttgtgtaaaggccatcacaagtttatttaaaaaaatacttctgcaaggacatatgcccatctaatctcggactggtggtacccttgttattgatctttgtagcgaagtataattatttcaaaacaattatgtaaacctcctcattgttttctttaaaaacttttgtcctccttttcatccctaaaaacacgcatagtttacaatggcatgaatattctcattgcaatgttctattcccaaataaacgtcttttcttttagagaatgtccctctatttgttaagttgactctatctatctatctatctatctatctatctatctatctatctacctagtgcttatgtgaatgtttatgtaggtatgtttgtatatgtattctgtaacctcattttctggaat

SEQ ID NO: 15125 - DNA, 338 bp, Homo sapiens
  chr9.fa.O7frz.74527585
  Located on chromosome 9
  Distance between a terminus base of telomere on chromosomal short arm and 5'-terminus of this base sequence : 66021373
  Distance between 3'-terminus of neighbour sequence of sequence listing upward to telomere on chrosomal short arm and 5'-terminus of this base sequence : 21549
gcgctcaataagtaaatacattattttctttatgtagaatagattcctaaaagtgagatatcttgtcaagttaaattttttttatcttatcccttcaaatccataacactactcccgatgacatatatatatatatatatatatatgttatttcttaaattttctaatggaataccccagatccttttgagtgtctcagatttcaatcataactttatctgaccataaatgaaaaacttctgtgagtagttttagattctgttttcccttgggtgtctctctggtttattactatcttttaaaacccaataagtctattcctggtactatgaactcac

SEQ ID NO: 15126 - DNA, 388 bp, Homo sapiens
  HUMUT6023
  Located on chromosome 9
  Distance between a terminus base of telomere on chromosomal short arm and 5'-terminus of this base sequence : 66083820
  Distance between 3'-terminus of neighbour sequence of sequence listing upward to telomere on chrosomal short arm and 5'-terminus of this base sequence : 62109
caccaatgcagtctagcctgggtgacagagcaaaaccctgtctcaaatgaaagaaagaaaagaaagaaaagaaagaaaggaaagaaagagaaagaaagaaagaaagaaagaaagaaagaaagaaagaaagaaagagaaagaaagaaagaaaggtggaaagaaggaaggaaggaaagatgagcatctaagatacagaatttcaaaatagaaataaaaggaaaaatagctctacaatttctaacagcctgagtgacagaacaagaccctgtctcaactaaataaacaaatgaaagacaggagggaaggaaggaaggaaggaaggaaggaaggaaggaaggaaggaaggaaggaaggaaggaaggaaattatagcacctaagatgcagtcc

SEQ ID NO: 15127 - DNA, 334 bp, Homo sapiens
  chr9.fa.O7frz.75026821
  Located on chromosome 9
  Distance between a terminus base of telomere on chromosomal short arm and 5'-terminus of this base sequence : 66267175
  Distance between 3'-terminus of neighbour sequence of sequence listing upward to telomere on chrosomal short arm and 5'-terminus of this base sequence : 182967
aagagtaaatcatacctaaagcaagaaattttaaagggacataataaagataaaagtagaagaatgaaataaagaagagacaaaaaattgagaaatccaataaaaccaaagtttggttgtttgaaaagatcagcaaaattgagtgacttttagctagattcacacacacacacacacacatgcacacacacacagaaagagagagagagagagagaacagactcaaattacaagaatcagaaatgaaaaggagatattactactgactttatagaaataaaatggattataaaggaatatatgaataattctatgccagctaattagataacag

SEQ ID NO: 15128 - DNA, 267 bp, Homo sapiens
  chr9.fa.O7frz.75055342
  Located on chromosome 9
  Distance between a terminus base of telomere on chromosomal short arm and 5'-terminus of this base sequence : 66291944
  Distance between 3'-terminus of neighbour sequence of sequence listing upward to telomere on chrosomal short arm and 5'-terminus of this base sequence : 24435
tacggatgctagaaatttgtactaggcggtgggaaccttatttaccaaaactttttctctagaactttcaataagtgtatctggctgacaatattcctctctccctgtgtaccaaatcacccatattatatatatacatatattatatatgtatatattatatatatataaattgtatatattcatatgtgtgtatgcatgtatttttttcctgagtcagattttctaataagcagcaattcacttagtacagtgactccacagaat

SEQ ID NO: 15129 - DNA, 418 bp, Homo sapiens
  AL355152.5_112389
  Located on chromosome 9
  Distance between a terminus base of telomere on chromosomal short arm and 5'-terminus of this base sequence : 66306929
  Distance between 3'-terminus of neighbour sequence of sequence listing upward to telomere on chrosomal short arm and 5'-terminus of this base sequence : 14718
aacagtatggagctttctgatccattagcacaacgtatccctccgtttacttaagccttctttaattttactcagtaatgatttgtagttttcagtgtatagatattgaacatactttgttaaatttattctcaggaattttattttttacatcatgaattacatgtttgaatttcattttccaattgtttgttgttactatgcaactttttaaatttaatttatttattttattttattttattttattttattttattttattttattttatttttttgagacggagtttcgctcttgctgccccggctggagtgcaatggcacgatctcagctgattgcaacctccgcctcccaggttcaagcgattctcctgcctcagcctcccgagtagctgggattacaggcatacgtcacc

SEQ ID NO: 15130 - DNA, 360 bp, Homo sapiens
  chr9.fa.O7frz.75191451
  Located on chromosome 9
  Distance between a terminus base of telomere on chromosomal short arm and 5'-terminus of this base sequence : 66436938
  Distance between 3'-terminus of neighbour sequence of sequence listing upward to telomere on chrosomal short arm and 5'-terminus of this base sequence : 129591
ctctttagttgctaaggcctagccatgagtgccaggtcagctcctagcaacaaggcccattgatagcgccaggccagttcctggctgccaggggccccttttctctctctctctctctctctctctctctctctctctctctctctctctctctctctctatcctctctctctctctccctttctccctttctctctctctctccccctcttctcagggaggacagtcagctggcatgcaccttctgccctctgtcttctgcttcttcctgaggtaatgcaggaagtggagaaatatcttgagatcttcagggaaaatgcaagaggacaaaatccatatcctacgagtatctaaggaaca

SEQ ID NO: 15131 - DNA, 419 bp, Homo sapiens
  chr9.fa.O7frz.75446846
  Located on chromosome 9
  Distance between a terminus base of telomere on chromosomal short arm and 5'-terminus of this base sequence : 66673267
  Distance between 3'-terminus of neighbour sequence of sequence listing upward to telomere on chrosomal short arm and 5'-terminus of this base sequence : 235969
cagataacagattgaggttcagagaggtcaaatgagttgcccaagaccacaaactactcagcagcagagcttcatttcaaaaccaaatccatctggctccaaggcctagagaattttctataatcccagtttttcccagaaaaacccaaggcaccacaggcctaagaggttttttttaatgacaatggaaaataattataaatgatttaaatgagatgaaatatttgaaatccaaatcttacagggttttttcacttgaaaaatcacccaaatagcttaccttttatttacacacacacacacacacacacatacacagagagagagacacagatgcacatacaaataagtgaagacagttggtaaaaatcattaatttgtaatatcattttgcaactagagttctgaaatcacgtatc

SEQ ID NO: 15132 - DNA, 300 bp, Homo sapiens
  chr9.fa.O7frz.75596591
  Located on chromosome 9
  Distance between a terminus base of telomere on chromosomal short arm and 5'-terminus of this base sequence : 66840601
  Distance between 3'-terminus of neighbour sequence of sequence listing upward to telomere on chrosomal short arm and 5'-terminus of this base sequence : 166915
cctgcataacaggtgaaaccccgtctcgactaaaaatacaaaaaatgagccgggcgtggtggcgggtgcctgtagtcccagctactcgggaggctgaggcaggagaatggtgtgaacccagcaggcggagcttgcactgagctgagatcgtgccactgcactccagcctgggagacagagcgagactctgtctcaaaaataaatacatatatacatacatacatacatacatacatacatacatacatacgtatataaaagcacatctaaataatatgctccaaatcaacagtttgatta

SEQ ID NO: 15133 - DNA, 288 bp, Homo sapiens
  chr9.fa.O7frz.75691267
  Located on chromosome 9
  Distance between a terminus base of telomere on chromosomal short arm and 5'-terminus of this base sequence : 66875233
  Distance between 3'-terminus of neighbour sequence of sequence listing upward to telomere on chrosomal short arm and 5'-terminus of this base sequence : 34332
taattactctggtttgagcaatacacatcagatgcatgtatcaaaatatcatatggaccccaaaatatgtacaattattatgtatcaataaaaatgggggtactttatacatgtaactatgttctcatttctttttgttgggctacgtcaattagctaaaaagtttgagaaaagtcacacacacacacacacacacacacacacacaggagctttaagtcaacctcattgttcaacgttataagtgtctggcacattgtaggcactgaataattagtttccattacag

SEQ ID NO: 15134 - DNA, 233 bp, Homo sapiens
  AL133548.6_13999
  Located on chromosome 9
  Distance between a terminus base of telomere on chromosomal short arm and 5'-terminus of this base sequence : 66998972
  Distance between 3'-terminus of neighbour sequence of sequence listing upward to telomere on chrosomal short arm and 5'-terminus of this base sequence : 123451
aaacttctgacctcaggtgatccacctgccttggcctcccaaagtgatgaaattacagccgtgagccaccgtgcccggcctcatcactacttttattgtaataatttttcgctcacaggttggaaacatgtttttggactatagatgttctctgtgtgtgtgtgtgtgtgtgtgtgtgtgtgtgtgtgtgttttaaggcaacttttaaaatggtgcttgaatactacagaatt

SEQ ID NO: 15135 - DNA, 284 bp, Homo sapiens
  AL133548.6_32042
  Located on chromosome 9
  Distance between a terminus base of telomere on chromosomal short arm and 5'-terminus of this base sequence : 67017149
  Distance between 3'-terminus of neighbour sequence of sequence listing upward to telomere on chrosomal short arm and 5'-terminus of this base sequence : 17944
ggtattagatacacgccaacacacacacacacacacacacacacacacacacacactcaacaaaatacacaaataatcctagatcttgtagcgaattgttgatttattcattgtgactgcagctcctagtaatgctattatttgcaggtggtgagtgttggtatgggatggtatggagcaacattttccaaattgtggttgtgatcaatatgttttttataattaaagacggaaaaacatcacagtgcataatatataaggtcaatgtcttgtgatacttgatg

SEQ ID NO: 15136 - DNA, 293 bp, Homo sapiens
  AL133548.6_61476
  Located on chromosome 9
  Distance between a terminus base of telomere on chromosomal short arm and 5'-terminus of this base sequence : 67046416
  Distance between 3'-terminus of neighbour sequence of sequence listing upward to telomere on chrosomal short arm and 5'-terminus of this base sequence : 28983
gcaaatcaggaccttaagtatctaacagtgcagagttgttctttgatagctaaacaatattttatttatcttatttttttctgatcacctgctgccagttgaaatacgttaaagaatgccctttttaaaaatctcttcatgcgtattaaatgctgtctatattgcaaatggagggacattgacaggtgtgtgtgtgtgtgtgtgtgtgtgtgtgtgtgtgtacacagtaatgtatacatgtgggttcattcacacttgggggtttaagggtcatcctgttactaattgtggat

SEQ ID NO: 15137 - DNA, 406 bp, Homo sapiens
  AL133548.6_104154
  Located on chromosome 9
  Distance between a terminus base of telomere on chromosomal short arm and 5'-terminus of this base sequence : 67089123
  Distance between 3'-terminus of neighbour sequence of sequence listing upward to telomere on chrosomal short arm and 5'-terminus of this base sequence : 42414
gctttgagtaggttatttagcctttcttataggaactgaagatgcattttaaatatgaatatgaatagtatctgcttgttcttaggtttgattgttttttcctcaatttccagaatttcacaaagaaaaaaataatatatacacatacacacacatacacacacacacacacacacacacacacacacacacacacccctatatattttttaacagaatagaaataccttaagtatacccatttgggcaactattcccattaacttatcattagaaacattgatgttaatactttccattaataagctggaagtcaaaatgtaccataataaatgcattaatggggaggtcttaatttaatacttgctgattaatccattgcaaatggaaatttatgcagaatgac

SEQ ID NO: 15138 - DNA, 206 bp, Homo sapiens
  D9S175
  Located on chromosome 9
  Distance between a terminus base of telomere on chromosomal short arm and 5'-terminus of this base sequence : 67288965
  Distance between 3'-terminus of neighbour sequence of sequence listing upward to telomere on chrosomal short arm and 5'-terminus of this base sequence : 199436
gtaatgtgctaaataccagagttgaaagatgttctgagtactatatgaacatgaaagatagcagtaagttcttcctggagagagacaaagggacagcatcaaagacacacacacacacacacacacacacacacacacacacagactgaatggctgataagagtttgtgaggtagaaatgttgggagagggcattctaggtaaggg

SEQ ID NO: 15139 - DNA, 241 bp, Homo sapiens
  Z17021.1_126
  Located on chromosome 9
  Distance between a terminus base of telomere on chromosomal short arm and 5'-terminus of this base sequence : 67289010
  Distance between 3'-terminus of neighbour sequence of sequence listing upward to telomere on chrosomal short arm and 5'-terminus of this base sequence : -161
tgaacatgaaagatagcagtaagttcttcctggagagagacaaagggacagcatcaaagacacacacacacacacacacacacacacacacacacacagactgaatggctgataagagtttgtgaggtagaaatgttgggagagggcattctaggtaaggggaacagcataaaaaataagtcatgaactttatattccatactctatacgggtctctgtctacaagccatgactacatgta

SEQ ID NO: 15140 - DNA, 138 bp, Homo sapiens
  D9S284
  Located on chromosome 9
  Distance between a terminus base of telomere on chromosomal short arm and 5'-terminus of this base sequence : 67427333
  Distance between 3'-terminus of neighbour sequence of sequence listing upward to telomere on chrosomal short arm and 5'-terminus of this base sequence : 138082
acttacccacatcatctgtgagttcacaggaaaaaggaagacaaaactagttattttcactgtcttacacacacacacacacacacacacacagagttgtttgactaattattttggctttagaatggttgcattgac

SEQ ID NO: 15141 - DNA, 258 bp, Homo sapiens
  chr9.fa.O7frz.76367911
  Located on chromosome 9
  Distance between a terminus base of telomere on chromosomal short arm and 5'-terminus of this base sequence : 67535604
  Distance between 3'-terminus of neighbour sequence of sequence listing upward to telomere on chrosomal short arm and 5'-terminus of this base sequence : 108133
gtaccatgtggttatagctatcagggaggagtgtatggaacttagaacatagtttgaatgggtatgaagaaccaatcagagttgggatggttagagagctgtggcccacctcaccttaaaggcagagaagggggactccaatgactgtgtgtgtgtgtgtgtgtgtgtgtgtgtgtatcttttttaatctctttcacatttgcactcaatgttgacatagtaaaatgacaactcactcactatcacaagaatagcacc

SEQ ID NO: 15142 - DNA, 433 bp, Homo sapiens
  chr9.fa.O7frz.76456138
  Located on chromosome 9
  Distance between a terminus base of telomere on chromosomal short arm and 5'-terminus of this base sequence : 67608411
  Distance between 3'-terminus of neighbour sequence of sequence listing upward to telomere on chrosomal short arm and 5'-terminus of this base sequence : 72549
ttgctattctctatttcatagcagagcatcatattgccaacaactgaattgaactagctaaataaaaacacacaggcacacacacacacacacacacacacacacacacacacacacacacacagcacagcttaatggtcttcatggtgcaatttcttttttaaaaggctcttccacaaattaccatcttgagtagtaaataaaaattttgtacaaattaacaattccttctgttttagttcattttcttttcttctgccaaattaaaaatttttttaatgacttcttattaaaacactgtaagtagtgttatcccatttttgtcaactgattttttctccctatctttccacatgacttctataatttcttctatctatgtagacattcatccagtaacactgataatttctggtactgatatttgaggtga

SEQ ID NO: 15143 - DNA, 184 bp, Homo sapiens
  D9S276
  Located on chromosome 9
  Distance between a terminus base of telomere on chromosomal short arm and 5'-terminus of this base sequence : 67847792
  Distance between 3'-terminus of neighbour sequence of sequence listing upward to telomere on chrosomal short arm and 5'-terminus of this base sequence : 238948
ctaactcttgggcgatgctctgtctcctgcgcgcgcgcgcgtacgcacacacacacacacacacacacacacacacaccccagagttgccgggtccgtgttttgtttacttgtcttttccaagccacgcgggactggtagggtctcgggaaaaatccagagtgcccccgtggtggcttcagaga

SEQ ID NO: 15144 - DNA, 336 bp, Homo sapiens
  chr9.fa.O7frz.76682518
  Located on chromosome 9
  Distance between a terminus base of telomere on chromosomal short arm and 5'-terminus of this base sequence : 67865056
  Distance between 3'-terminus of neighbour sequence of sequence listing upward to telomere on chrosomal short arm and 5'-terminus of this base sequence : 17080
ttaaactctcattgaaccttgtatgcttctttttattggcacttggcattttcatcttacatgccatctatctatctatctatctatccatccatccgccatccatgcatccttctctttctatttatctatctatctatctatctatctatctatctatctatctatctatctctctatctctctctctgtctatctatctatctatctatctatctatctatctatctatctatctatccgattttctctcctctgctagataataatccccctaaacataggatttctgggccgggtgcagtggctcatgcctgtaataccagcactttggta

SEQ ID NO: 15145 - DNA, 322 bp, Homo sapiens
  AL359253.7_41896
  Located on chromosome 9
  Distance between a terminus base of telomere on chromosomal short arm and 5'-terminus of this base sequence : 67865105
  Distance between 3'-terminus of neighbour sequence of sequence listing upward to telomere on chrosomal short arm and 5'-terminus of this base sequence : -287
tttcatcttacatgccatctatctatctatctatctatccatccatccgccatccatgcatccttctctttctatttatctatctatctatctatctatctatctatctatctatctatctatctctctatctctctctctgtctatctatctatctatctatctatctatctatctatctatctatctatccgattttctctcctctgctagataataatccccctaaacataggatttctgggccgggtgcagtggctcatgcctgtaataccagcactttggtaggccgaggtgggcggatcacctgaggttaggagtt

SEQ ID NO: 15146 - DNA, 198 bp, Homo sapiens
  AL359253.7_103299
  Located on chromosome 9
  Distance between a terminus base of telomere on chromosomal short arm and 5'-terminus of this base sequence : 67921458
  Distance between 3'-terminus of neighbour sequence of sequence listing upward to telomere on chrosomal short arm and 5'-terminus of this base sequence : 56031
gcaatttgtaggcctttagtacgcactgtattagggttctccagggacccagggccagtaggagatatacatctcctgtttacatcctatatatgtgtatgtgtgtatatgtgtgtgtgtgtgtgtgtgtgtgtgtgtggagagagagagagaaagagagatactaattatgaggagtggattcacttgattacagaa

SEQ ID NO: 15147 - DNA, 379 bp, Homo sapiens
  chr9.fa.O7frz.76795741
  Located on chromosome 9
  Distance between a terminus base of telomere on chromosomal short arm and 5'-terminus of this base sequence : 67996580
  Distance between 3'-terminus of neighbour sequence of sequence listing upward to telomere on chrosomal short arm and 5'-terminus of this base sequence : 74924
tattaagagcataagccaagtaaggtctcactcccttagatgtgttctctgtctctctctctctctctctctctctctctctctctctctctctctctctctctctctctgtctctctctctctctctctctctctctcaacaggtctttcctcatagatcagctgtgtctttttattgatccttagcttccaccctggttaatcagtgctcccaacaattccgagcttcccaagatccctttaacaaactacttttctgcttaactcagtcagttacagcaaagaaccagagattaaatgtcattaccagtgccccctttttgcagaggaagaaagtaaaattgaaggcaggctctcacatagcttatgaaagtgagt

SEQ ID NO: 15148 - DNA, 226 bp, Homo sapiens
  AC025550.4_84828
  Located on chromosome 9
  Distance between a terminus base of telomere on chromosomal short arm and 5'-terminus of this base sequence : 68191555
  Distance between 3'-terminus of neighbour sequence of sequence listing upward to telomere on chrosomal short arm and 5'-terminus of this base sequence : 194596
agaaggtactaaaccagtcacttcacctctttatgcctcttcttatttgcaacaaaaaaaaagaagaagaagaagaagagaaagtacaagatggcatccaaaatcacttttacatctccatatatagcacaaaattagaaagaagtttagataccaaacaaatgtctagtcttctaagcatcctacaactacttggaccaatctacctataaatgcactgacattt

SEQ ID NO: 15149 - DNA, 193 bp, Homo sapiens
  D9S1807
  Located on chromosome 9
  Distance between a terminus base of telomere on chromosomal short arm and 5'-terminus of this base sequence : 68224166
  Distance between 3'-terminus of neighbour sequence of sequence listing upward to telomere on chrosomal short arm and 5'-terminus of this base sequence : 32385
gaaaagtctcccaaagttgaagagcattgcctttttattcagtaatgcactgcctaccctcccaaaatgcacacacatgcttatgggtatacacacacacacacacacacacacacacacacacatttgtgggtctgccttccttcaaaatgttctaacgtgggactggtgaggtggataggctgacttgtgc

SEQ ID NO: 15150 - DNA, 353 bp, Homo sapiens
  chr9.fa.O7frz.77135763
  Located on chromosome 9
  Distance between a terminus base of telomere on chromosomal short arm and 5'-terminus of this base sequence : 68361462
  Distance between 3'-terminus of neighbour sequence of sequence listing upward to telomere on chrosomal short arm and 5'-terminus of this base sequence : 137103
tagccaaaccagctagtgagctctgttttgccaatacttttttcctttaagtagactttttttaaaaagcagttttaggttcacagaaaaattgagaagtacagaaagttcccatatactccctgaccttcaacacacacacacacacacacacacacacaggcttcctcactatagacatcctgcactaggcactagaatgtacatgttacaactgatatatgtgcattgatgtaatatcaccccaagtctgtaatttacatgagagttcactcttggagttatacattctatgggtttacacaaaggaataccgacttgtatccaccattatcgtatcatacagagcattt

SEQ ID NO: 15151 - DNA, 460 bp, Homo sapiens
  AL138757.7_128280
  Located on chromosome 9
  Distance between a terminus base of telomere on chromosomal short arm and 5'-terminus of this base sequence : 68492181
  Distance between 3'-terminus of neighbour sequence of sequence listing upward to telomere on chrosomal short arm and 5'-terminus of this base sequence : 130366
atcttgatggcttcatagaatcacctgggaggagagaaatgttgaagtattcgcaggcaggaaacagtgttgaactaaaaccttaaaggagaggatgagggtaatatgtctataggtttggatggttatagggtagatgtactataagtgaaaaaaaatcaaggtatggagcagtatgaatgtcacccttattatatgaatatatgtatgtatatatacatgtaatcagttatttaaaaaacacgcatgtgtgtgtgtgtgtgtgtgtgctcacaggcacacatgtgcatgagttgcatgggtgtgtaaggaaacccggcctgcacctccaggtcggaaaagtaaccactgcactgaggactgagtcccctaacccttaaggagagagtgaatagatttgtgaatacatttgtgttaccaacggatcatccattaaaatgttccatgtaggtttcacaag

SEQ ID NO: 15152 - DNA, 343 bp, Homo sapiens
  chr9.fa.O7frz.77414103
  Located on chromosome 9
  Distance between a terminus base of telomere on chromosomal short arm and 5'-terminus of this base sequence : 68524627
  Distance between 3'-terminus of neighbour sequence of sequence listing upward to telomere on chrosomal short arm and 5'-terminus of this base sequence : 31986
agtgagccaatatcgtatcactgcactccagcctgggtgacagagcaagattctgtcagaaagaaagaaggaaagaaggaaggaaggaaggaaggaaggaaggaaggaaggaaggaaggaagaaaggaaggaagaagaaagaaagagagacagagagagagagaaagaaaagaaagaaagagggagggtgggagagggagggagagagagggagagagagtgagaaaagaaaaagaaagaaagaagagaagagaaaagaaaagaaaaagaaagaagtgtcaatcaggtcgagggtggctaagaggtagagtcagttgaactggaagtcatgagtagagttaag

SEQ ID NO: 15153 - DNA, 171 bp, Homo sapiens
  chr9.fa.O7frz.77516233
  Located on chromosome 9
  Distance between a terminus base of telomere on chromosomal short arm and 5'-terminus of this base sequence : 68622763
  Distance between 3'-terminus of neighbour sequence of sequence listing upward to telomere on chrosomal short arm and 5'-terminus of this base sequence : 97793
tagcagtagcaaaattagtgaaagtactaaaagtctctgatatgcagaaataatggcgtaagctgtcctctctctctccctctctctctgccttggctgccaggcagggaagggccccctgtccagtggacacgtgactcatgtgaccttgtcaatcattggagatgactc

SEQ ID NO: 15154 - DNA, 421 bp, Homo sapiens
  AL161625.6_135409
  Located on chromosome 9
  Distance between a terminus base of telomere on chromosomal short arm and 5'-terminus of this base sequence : 68689652
  Distance between 3'-terminus of neighbour sequence of sequence listing upward to telomere on chrosomal short arm and 5'-terminus of this base sequence : 66718
tctagtgtctttgcaatactcataaaccacagattcattcattcattcattcattcattcattcattcattcatctatttgagacagggtctcactctgttacccaggctgaagtgcagttgcacagtcacagctcactgcagccttgaccctctgggccccagtggtcctcccacctctgcctcccacgaagctgggactacaggcacgcctggctaatttttttttttttattttttgtagagacagggtttcattatgttgcccaggctggacttgaactcctgagttcaaatgatctgcctgcttcggcctcccagagtgctaggactacaggcatgagccatagcacttggccctatgaactttgtacaatatcagaggtaagacaattaattaatttgcctgtacaatatcaaga

SEQ ID NO: 15155 - DNA, 474 bp, Homo sapiens
  AL359314.7_84138
  Located on chromosome 9
  Distance between a terminus base of telomere on chromosomal short arm and 5'-terminus of this base sequence : 68720265
  Distance between 3'-terminus of neighbour sequence of sequence listing upward to telomere on chrosomal short arm and 5'-terminus of this base sequence : 30192
catttggacaagacttcactagaggagcaccttaggaattgacctgtggatctcaacttcgttagggttaaaagattatttgttgggcaagggtaggaccaataacctcattcacaatgcattcattgattcgttgattcacagagcaaatacttctgaacaactcctgtgtttctggcactgttctaggcaccagtgatataggagccaacaagacagacatgtcactgctctcatggagctgcatttcagtgcatggaggcagaaaacaaacaaacaaataaataaataaataaataaataagataatttttaatagcaacgtgtcaacatagtgtgacgggaaggagcatgatgagacagaaggaaggtttaaactgggaaatctgagaaatggtatggttgtatgtgggttggcattcttgcatgatgggagtggccacctgctttcatattctgaagtcagagtgttcc

SEQ ID NO: 15156 - DNA, 185 bp, Homo sapiens
  D9S1834
  Located on chromosome 9
  Distance between a terminus base of telomere on chromosomal short arm and 5'-terminus of this base sequence : 68763264
  Distance between 3'-terminus of neighbour sequence of sequence listing upward to telomere on chrosomal short arm and 5'-terminus of this base sequence : 42525
tgtgtcagagcgaagactccaacccaagtagattccatacctttaaccactacctcatacaatgtgtgtgtgtgtgtgtgtgtgtgtgtgtgtgcgcgcgcgcgtgtgtctgtctctctctcttagacagggtcttgctttgttgcccagggtggagtgctggagtgcaatggcataccacagct

SEQ ID NO: 15157 - DNA, 277 bp, Homo sapiens
  D9S1860
  Located on chromosome 9
  Distance between a terminus base of telomere on chromosomal short arm and 5'-terminus of this base sequence : 68821910
  Distance between 3'-terminus of neighbour sequence of sequence listing upward to telomere on chrosomal short arm and 5'-terminus of this base sequence : 58461
cggatataatagttgggcagaagataatttttaactttcttgtaatgtctttgtcatgttcttatgaaataacagtatcatgggataaaaccttgttaatagcacaaaagtcaaaagttatactataggctgcaaataatcattcctgtctcaaccttaacaggctctcatttctctcccttctttctccctctctctccctacacacacacacacacacacacacacacacacacacacacaccagagcattatgacatgtgcattatgcccactt

SEQ ID NO: 15158 - DNA, 200 bp, Homo sapiens
  chr9.fa.O7frz.77878561
  Located on chromosome 9
  Distance between a terminus base of telomere on chromosomal short arm and 5'-terminus of this base sequence : 68946975
  Distance between 3'-terminus of neighbour sequence of sequence listing upward to telomere on chrosomal short arm and 5'-terminus of this base sequence : 124788
cacttagataacactgagaccaacaccaacctcccctaaacacacacacacacacacacacacacacacacacacacactatacccagctggcctcatctcccttctgaactcaagggagctttaggagtttcttcaaccctactccatttctccacacctcttcttctccctttagagcatgctgttctaagtacttta

SEQ ID NO: 15159 - DNA, 194 bp, Homo sapiens
  G08756
  Located on chromosome 9
  Distance between a terminus base of telomere on chromosomal short arm and 5'-terminus of this base sequence : 69098743
  Distance between 3'-terminus of neighbour sequence of sequence listing upward to telomere on chrosomal short arm and 5'-terminus of this base sequence : 151568
aaatagtaatgcatttgtgataggtacagtagcaatataaaaaggaagatctgatattcacatatctcattgtattgcttatttgtgggggtatttcaagataactgtagataggtagatagatagatagatagatagatagatagatagatagatagatagatattaataggtaaactagaagctttcagaag

SEQ ID NO: 15160 - DNA, 414 bp, Homo sapiens
  chr9.fa.O7frz.78006349
  Located on chromosome 9
  Distance between a terminus base of telomere on chromosomal short arm and 5'-terminus of this base sequence : 69212566
  Distance between 3'-terminus of neighbour sequence of sequence listing upward to telomere on chrosomal short arm and 5'-terminus of this base sequence : 113629
atctatttaagtcctttgtccatcttttaatcaggttgtttgttttttgagttgtaagagtttacatacaaacatacacacacacacacacacacacacacaatgttagctgcttatcagatatatgatttgcaaatatttcccattttgtgtgttaccttttcttcctttttttccctgctaacttttattttaggttcatggggtacatgtgtgggtttgttgtgtgggttaattgtgtgtcactggggtttgatgtataaattattttgtcacccaggtagagagcatagtacccgatagatagttttttgatcctcaccctccccacaccctccaccctcaagtaggccttggtgtttgttgtttccttctttgtgtccatgtgtactggatagagtttgaatacatgtc

SEQ ID NO: 15161 - DNA, 218 bp, Homo sapiens
  D9S1674
  Located on chromosome 9
  Distance between a terminus base of telomere on chromosomal short arm and 5'-terminus of this base sequence : 69331356
  Distance between 3'-terminus of neighbour sequence of sequence listing upward to telomere on chrosomal short arm and 5'-terminus of this base sequence : 118376
ttagaagtgagccaaactcaaagatcttttttacattatttctgttgtgttagggttctccagagagagagagagagagtgtgtgtgtgtttgtgtgtgtgtgtgtgtgtgtgtgtgtgtgtgtgtaaagagagggaaaagggagagacttattttaaggaattggtgtacatgattgcggatgccaccaagttcaaagtcagtctacagggtaggcc

SEQ ID NO: 15162 - DNA, 391 bp, Homo sapiens
  chr9.fa.O7frz.78237258
  Located on chromosome 9
  Distance between a terminus base of telomere on chromosomal short arm and 5'-terminus of this base sequence : 69426094
  Distance between 3'-terminus of neighbour sequence of sequence listing upward to telomere on chrosomal short arm and 5'-terminus of this base sequence : 94520
gtcgtatatgcatagtggtcagtttctgtaatctgtattctttcctttgatatgtctgcatatactttaccaccaccaaactatttcactactgcagctttataaattgcattaatgtcttccagagtagttcttctcattcttctttcataatttactggatattaccacatatttttcctagctacattttagtataattttgacaaatcacttcttacctcctaccccatgctccaaaaaccaccatcttgggatcacatgaagttgtgtgtgtgtgtgtgtgtgtgtgtgtgtgtgtgtgtgtgtgtgtaaaaattgggagggagtcaataacatctttattatgataaatttttatatccaagaataagatatggatttccatttc

SEQ ID NO: 15163 - DNA, 199 bp, Homo sapiens
  chr9.fa.O7frz.78308717
  Located on chromosome 9
  Distance between a terminus base of telomere on chromosomal short arm and 5'-terminus of this base sequence : 69497741
  Distance between 3'-terminus of neighbour sequence of sequence listing upward to telomere on chrosomal short arm and 5'-terminus of this base sequence : 71256
gttaggtttagatgaagtcatgagagtggtgccgtcacgatgggattagtttccttataagaggaagagacatgacatgatctctctctctctctctctctctctctctcctccaagcccacacacaaagaagaggtcatgtgaaccatctgcaagccaggaagagggccctcactaagaacagaatcttctggtaact

SEQ ID NO: 15164 - DNA, 181 bp, Homo sapiens
  chr9.fa.O7frz.78510445
  Located on chromosome 9
  Distance between a terminus base of telomere on chromosomal short arm and 5'-terminus of this base sequence : 69699049
  Distance between 3'-terminus of neighbour sequence of sequence listing upward to telomere on chrosomal short arm and 5'-terminus of this base sequence : 201109
aatgtaacagatactatttggcagaaagtaaaaactgtcttaactctccccatatttggcaatacagttctctctctctctctctctctctctcagcagatttccaattacacttcatagacggatctcagctggtccttttttcctgttacataaacttgacaatgactatttggactat

SEQ ID NO: 15165 - DNA, 368 bp, Homo sapiens
  G08757
  Located on chromosome 9
  Distance between a terminus base of telomere on chromosomal short arm and 5'-terminus of this base sequence : 69834989
  Distance between 3'-terminus of neighbour sequence of sequence listing upward to telomere on chrosomal short arm and 5'-terminus of this base sequence : 135759
gctgcttagctaaacatggctaagttttcataatgataaccaaaaacctattgggtttgttttccagtcaattttatataattttccttcttgactttataaatatgaaactgtctgtagacaatgttggtaaagattaataatttgttcttcatggtaagtgatttataaaacacctaatcataggtatttatctactgattcatctatctacctatctatccatctatcttatctaaaaactgtcaatcatctatctatctatctatctatctatctatctatctatctatctatctatctatctatctgtcatgcatccatccatcctgtgtgaggctgtatttcagtggttaaaagcttgggct

SEQ ID NO: 15166 - DNA, 296 bp, Homo sapiens
  chr9.fa.O7frz.79022854
  Located on chromosome 9
  Distance between a terminus base of telomere on chromosomal short arm and 5'-terminus of this base sequence : 69969400
  Distance between 3'-terminus of neighbour sequence of sequence listing upward to telomere on chrosomal short arm and 5'-terminus of this base sequence : 134043
gatgaattgtacctcaggataagaaacaaccaacagtggagagtggacatcactggtcttaaaatccttgcccttctctgacagagagaatctctttcaggctgccacttttcatatctctgtcaactgctatgttggctatgtgttgggatctatcatttctcccttccttccttccttccttccttccttccttccttccttccttccttcctttctttctctctttctttttcttttttttcagggtctcgctctgtcacccgggctggagtgcagtcacacgatcatggttc

SEQ ID NO: 15167 - DNA, 119 bp, Homo sapiens
  G10172
  Located on chromosome 9
  Distance between a terminus base of telomere on chromosomal short arm and 5'-terminus of this base sequence : 70071672
  Distance between 3'-terminus of neighbour sequence of sequence listing upward to telomere on chrosomal short arm and 5'-terminus of this base sequence : 101976
ctctactcttttcacttgttcttccatctgtccatccatccatccatccatccatccatttattcattcattcatcaatccatccattaaatccagatatttaaggagcacccatatgc

SEQ ID NO: 15168 - DNA, 168 bp, Homo sapiens
  DISD22_0006457
  Located on chromosome 9
  Distance between a terminus base of telomere on chromosomal short arm and 5'-terminus of this base sequence : 70237440
  Distance between 3'-terminus of neighbour sequence of sequence listing upward to telomere on chrosomal short arm and 5'-terminus of this base sequence : 165649
taaagcaatgccttgctggaagatacatatatatatatatatatatatatatatatatatatatatatatatatatatatatatacatacacacacacacacacacacacacacacacacacaagggaggtggggactggttttggtggggaagggttgagttggtct

SEQ ID NO: 15169 - DNA, 300 bp, Homo sapiens
  chr9.fa.O7frz.79145183
  Located on chromosome 9
  Distance between a terminus base of telomere on chromosomal short arm and 5'-terminus of this base sequence : 70354453
  Distance between 3'-terminus of neighbour sequence of sequence listing upward to telomere on chrosomal short arm and 5'-terminus of this base sequence : 116845
atgattcaactctaccattgtaacatacaagcagccatagataacacacaaacagataggtactgttgtaaataaaactttattcacaaaagcaagtggtaagctagatttggccccctgatcattgtttgttgacccttgctcaatgacatggtaggtgctaggttttcttttctgtttatatttagggtgaatactcttatattcattcattcattcattcattcattcattcattcattctggaatcacttcttgaacacctattttgtcccactgtccaagatttctataactgaa

SEQ ID NO: 15170 - DNA, 395 bp, Homo sapiens
  DISO7_00006052
  Located on chromosome 9
  Distance between a terminus base of telomere on chromosomal short arm and 5'-terminus of this base sequence : 70692500
  Distance between 3'-terminus of neighbour sequence of sequence listing upward to telomere on chrosomal short arm and 5'-terminus of this base sequence : 337747
ataaggaagcattaggttgtatttcacaggactccgtctctatgactgtgtgtgtgtgtgtgtgtgtgtgtgtgtgtgtgtgttttctttctgtaacccaattagctctcttggtgattacatagagctgccattttgacaatttattgttttctgcctgctccatttttccatgcatgtgtcgagggagatagctatttgtcctttgatgcatggatggttggccaagaacccctctctttgcccttggatcttgcctctccttcttctggctgcagcctcagctgcccgagggagtatgtgttagtgagagtgtttggctggagggctctgtctccacccactactgcccgtgccactcttggaagttttctgattcccaagatactgaatgc

SEQ ID NO: 15171 - DNA, 370 bp, Homo sapiens
  chr9.fa.O7frz.79562185
  Located on chromosome 9
  Distance between a terminus base of telomere on chromosomal short arm and 5'-terminus of this base sequence : 70766796
  Distance between 3'-terminus of neighbour sequence of sequence listing upward to telomere on chrosomal short arm and 5'-terminus of this base sequence : 73901
tggatcatgaggtcagaagatggagaccagcctggctaacatggtgaaaccccatctctactaaacatacaaaaaaattagccgggcatggtggcgggtgcctgtagttccagctactcaggaggctgaggcaggagaatggcatgaacccaggaggcggagcttatagtgagcggagatcgcgccactggactccagcctgggtgacagagcaagtctccgtgtccacacacacacacacacacacacacacacacacacacacaaaattgttgctatgtctcaaaatctttttcaagactatctattacgttacttgaaatctgcagaccttgaagtgtaaaaagtagctgattaaatgtagcagttt

SEQ ID NO: 15172 - DNA, 153 bp, Homo sapiens
  D9S153
  Located on chromosome 9
  Distance between a terminus base of telomere on chromosomal short arm and 5'-terminus of this base sequence : 71111738
  Distance between 3'-terminus of neighbour sequence of sequence listing upward to telomere on chrosomal short arm and 5'-terminus of this base sequence : 344572
ttatggcagcccaaatggactaagacagtcaccctcagataaatgaacacacacacacacacacacacacacacacacacacacacacggaaaacaaattaatatctgttctataactgcacttagaatgatgagttttgggcaacattctgc

SEQ ID NO: 15173 - DNA, 409 bp, Homo sapiens
  chr9.fa.O7frz.79972965
  Located on chromosome 9
  Distance between a terminus base of telomere on chromosomal short arm and 5'-terminus of this base sequence : 71199708
  Distance between 3'-terminus of neighbour sequence of sequence listing upward to telomere on chrosomal short arm and 5'-terminus of this base sequence : 87817
gaacaatcagaagtaatggactactcttggaaacagtctacatctttcacaactaaaataaaatttagaaattcaatctgtagaatgacaagatgagaagaaataaaggaaataacttcatctctgagaaaaaagggaaattatatatatatatatatatatacttacacacatatatatttaaaaacccttaagtacaagagcatttactctgaatttttcaaaatagaaacccatatccccgaaagatatatttatttcttggtgtgtgtaggaggttaaataatgtctgtctaaaattcttgctcactcagaacttaagaatgtgaccttatttggaaacaggggctttgcaaatgcagataacataaaatctaatgtattagggtaagcctttaatccaatgatt

SEQ ID NO: 15174 - DNA, 346 bp, Homo sapiens
  HUMUT457
  Located on chromosome 9
  Distance between a terminus base of telomere on chromosomal short arm and 5'-terminus of this base sequence : 71300889
  Distance between 3'-terminus of neighbour sequence of sequence listing upward to telomere on chrosomal short arm and 5'-terminus of this base sequence : 100772
tttgctggtttaattgtaggccattaatgccttttatcatacctggagtggagtccctaacttacaatttaagtctatttattattactaacattattagccaattaccatgatttagagtcctaaattcacctctctctctctgtctgtgtgtgtgtgtgtgtgtgtgcgcgtgtgtgtgtggtgtataattaatctgaatatgatggtctaaatttgtctgtatatgcatatatatgtagccaatctgaaattttccttgaactgaattttttttttttaattttttaaaaaaatgtttatgagtttattcatagagcactgagcttccatcctctctaaacct

SEQ ID NO: 15175 - DNA, 275 bp, Homo sapiens
  Z67265
  Located on chromosome 9
  Distance between a terminus base of telomere on chromosomal short arm and 5'-terminus of this base sequence : 71311665
  Distance between 3'-terminus of neighbour sequence of sequence listing upward to telomere on chrosomal short arm and 5'-terminus of this base sequence : 10430
tgccttttcagcagaagatacagcaaagaaactttaatttcttgtaaagttactgagggaaaaaaactagtaatagcaaaaaaggaatgatgaccttaggttgtgggttaggatgttatttgttagactataaaggattctgtgtgtgtgtgtgtgtgtgtgtgtgtgtgtgtgtgagagagagagagagagcaagagagcactttaagtaaatgaaaattcagatgtgagaaaattcttttctcagcttgcccaccagtggacattaagaactt

SEQ ID NO: 15176 - DNA, 247 bp, Homo sapiens
  D9S1780
  Located on chromosome 9
  Distance between a terminus base of telomere on chromosomal short arm and 5'-terminus of this base sequence : 71399355
  Distance between 3'-terminus of neighbour sequence of sequence listing upward to telomere on chrosomal short arm and 5'-terminus of this base sequence : 87415
cgctttgtaaagatagcctcatcttatccagattaaaaggataaccaatattatcttctcaccaggaaggaaggcatttgtaaaaaggtctacggttatgctgttgtttcactgcttcaggagaaaattatggaagcagtcacaaaaaattttgacatttccttgtttgtaaactcaaggtgtgtgtgtgtgtgtgtgtgtgtgtgtgtgtgtgtgtgttttaatcatgcagaataagacacaatgt

SEQ ID NO: 15177 - DNA, 286 bp, Homo sapiens
  chr9.fa.O7frz.80294951
  Located on chromosome 9
  Distance between a terminus base of telomere on chromosomal short arm and 5'-terminus of this base sequence : 71530857
  Distance between 3'-terminus of neighbour sequence of sequence listing upward to telomere on chrosomal short arm and 5'-terminus of this base sequence : 131255
aggaatagtgttgaatccgtagattgctttgggcattttgtccattttaacaatattgatttttcctatccatgagcatggaatgtttttccatttgtttgaaccatctacaatttttttcagcagtattttgtagttctccttgtagagatcttttacttccttagttagacatattcctacgtgtgtgtgtgtgtgtgtgtgtgtgtgtgtgtgtgtgtgtgtctattgtaaatgggactgcgttcttgattgatctctctgcttgaactttatcagtgcgtag

SEQ ID NO: 15178 - DNA, 286 bp, Homo sapiens
  chr9.fa.O7frz.80609471
  Located on chromosome 9
  Distance between a terminus base of telomere on chromosomal short arm and 5'-terminus of this base sequence : 71827027
  Distance between 3'-terminus of neighbour sequence of sequence listing upward to telomere on chrosomal short arm and 5'-terminus of this base sequence : 295884
tttccaaggattccttaactacttcctggaggcagggagggaaggagggagagaaagagagggagggaggagggaggaagagagggagagagggagacagagagagagagagagagagtgtgtgcatgtgtgtgtgtgtgtgtgtgtgtgtgtgtgtatgtgtgtgtgtgtgtaatttggtatataatatagttatatataatttgatatttttttaatgactcttggatagcataagaaaatgttaccaaaagagtgaaatcttgattagtttgaacttacctca

SEQ ID NO: 15179 - DNA, 206 bp, Homo sapiens
  D9S1867
  Located on chromosome 9
  Distance between a terminus base of telomere on chromosomal short arm and 5'-terminus of this base sequence : 71980573
  Distance between 3'-terminus of neighbour sequence of sequence listing upward to telomere on chrosomal short arm and 5'-terminus of this base sequence : 153260
atcagccagggtttcaacagagaaacagaaccagtagaatgtatattgcgtgtgtgtgtgtgtgtgtgtgtgtgtgtgtgtgtgtgtgtgtgtgtagagtgagatttatgtgattgtggggactgactaggctaatcaagaatctgtagggtggatcatcaggaagggcaaactgaaaatctcaaccagcggctgatgcagttcac

SEQ ID NO: 15180 - DNA, 241 bp, Homo sapiens
  D9S1843
  Located on chromosome 9
  Distance between a terminus base of telomere on chromosomal short arm and 5'-terminus of this base sequence : 72069547
  Distance between 3'-terminus of neighbour sequence of sequence listing upward to telomere on chrosomal short arm and 5'-terminus of this base sequence : 88768
ccaccatcgagaagttagtttagtactaaaactattttcccaaaaggaaggggcctgccacatcctggaggtagggtaggggtattagtcagggttctttagggaaacagaatcaataagcatatttgtgtgtgtgtgtgtgtgtgtgtgtgtgtgtgtgagagagagagagacagagagagagggggagagagagagagagagaaagagagagataaggaactggctcacacaattatgg

SEQ ID NO: 15181 - DNA, 354 bp, Homo sapiens
  chr9.fa.O7frz.81091499
  Located on chromosome 9
  Distance between a terminus base of telomere on chromosomal short arm and 5'-terminus of this base sequence : 72312057
  Distance between 3'-terminus of neighbour sequence of sequence listing upward to telomere on chrosomal short arm and 5'-terminus of this base sequence : 242269
agtagatgaatgctacatcgatagatctcatgtgaacatcaggtttctgaatcgaaatgcagttcttaagataatgaagtaataattttaaagtttaggaggagaattgatggaaaccttgaattttaaagcctgctaagttaacatttgcatgtagtcacaatgaagatattttggggtacataaaacatcagaaggtttaccatataaaaacgtcatttgaaaacacttgttaagatagcatgtcataaataaataaataaataaataagctctgaaatatacaggaagtatggtaatggtattttattgtcttaaaaaataacggtcagatcaaatggcatattcgtaata

SEQ ID NO: 15182 - DNA, 317 bp, Homo sapiens
  chr9.fa.O7frz.81201900
  Located on chromosome 9
  Distance between a terminus base of telomere on chromosomal short arm and 5'-terminus of this base sequence : 72422857
  Distance between 3'-terminus of neighbour sequence of sequence listing upward to telomere on chrosomal short arm and 5'-terminus of this base sequence : 110446
acctcaggaactttgtttaaataatttcttcaaagctcagctttgggatctgtatgatggagttatattcatgtctcaaaaatgttttatcatgccaatattgtgtgtgtattttatatatatgtgtgtgtgtgtgtgtatatgtgtgtgtgtgtgtgtgtaatactggtataaaccctttggaatgttaaaagcattatacaaatgttggtcattattagagatgaatttacaaagtaaatgaatattaaggccgaatattcatgacagataaaacaaacctaaggtcaaatctgttaggattgttcctgcttaat

SEQ ID NO: 15183 - DNA, 252 bp, Homo sapiens
  D9S922
  Located on chromosome 9
  Distance between a terminus base of telomere on chromosomal short arm and 5'-terminus of this base sequence : 72498748
  Distance between 3'-terminus of neighbour sequence of sequence listing upward to telomere on chrosomal short arm and 5'-terminus of this base sequence : 75574
tcagaggaccactgcctaaggaattcactcacggagcatacatatataagtatatgctctatctctatctatcattatctatctacctgcctacctatctattgattatctatctatctatctatctatctatctacctatctatctttaagatggcttaaggatggccaccttcttggtatgtccttgtgtggctgtgagaagcagctctggtgtttcttgctcttcttatataggcacaaatcccatcat

SEQ ID NO: 15184 - DNA, 252 bp, Homo sapiens
  Z66912
  Located on chromosome 9
  Distance between a terminus base of telomere on chromosomal short arm and 5'-terminus of this base sequence : 72648260
  Distance between 3'-terminus of neighbour sequence of sequence listing upward to telomere on chrosomal short arm and 5'-terminus of this base sequence : 149260
tgtagatcatggacattttgtgtcactgaaaagtagacaaaatcatgacagttacatgtacaaaagtcaaaaggtacacatgtacttttttatgtgtctcttcatgtttataaacatgtcgttacatcacagacacaaacgcacacacacacacacacacacacacacgcacatatttctcatatccttttcccactccctcacatataacaaaaattagttctaggtgataataaactgaaagtcaccctg

SEQ ID NO: 15185 - DNA, 193 bp, Homo sapiens
  chr9.fa.O7frz.81559541
  Located on chromosome 9
  Distance between a terminus base of telomere on chromosomal short arm and 5'-terminus of this base sequence : 72741905
  Distance between 3'-terminus of neighbour sequence of sequence listing upward to telomere on chrosomal short arm and 5'-terminus of this base sequence : 93393
ctaacattctagtgatgctttgtcttgagctatgtttttctacaatgcagtgatggctatttaccaccaaaccagatacatacacatacacacacacacacacacacacacacacacacaatttccccctgatgctttgtggttgttcatctaactgcattctggcatcatctgcttacatgaaccatttatc

SEQ ID NO: 15186 - DNA, 279 bp, Homo sapiens
  chr9.fa.O7frz.81912441
  Located on chromosome 9
  Distance between a terminus base of telomere on chromosomal short arm and 5'-terminus of this base sequence : 73095803
  Distance between 3'-terminus of neighbour sequence of sequence listing upward to telomere on chrosomal short arm and 5'-terminus of this base sequence : 353705
tcatttactagtggcttctagaatctcagttcagcctcttaagacttcaggatttggattttgctttttatttatttatttatttattggcaaaaggtggagagatgaggactgtgactgattcttatttgctgcagtcccaaaatcaataactgatcaaggagactaatgagatatatcaactaaatacagattgagaatccttcatccaaaaatcaaaaatcaaaaatgttgcaaaattcaaaattttgggggcagtgacataatgctccaggtata

SEQ ID NO: 15187 - DNA, 293 bp, Homo sapiens
  HUMUT5494
  Located on chromosome 9
  Distance between a terminus base of telomere on chromosomal short arm and 5'-terminus of this base sequence : 73169792
  Distance between 3'-terminus of neighbour sequence of sequence listing upward to telomere on chrosomal short arm and 5'-terminus of this base sequence : 73710
ccctcccacaaaatatatgccaagggtgctctgaatcctgtggtgtggtccaactgtgatgatagatagatagatagatagatagatagatagatagatagatagatagatagatgatagatagatagacagacagacatatagacagacagaggttgacaaacttttgtggatagtgccagataataaatagtctatgttttgcacctaataaagtgtttctgcaactactcaactctgccattgtagcatgaaagcagctatagacattatgtaaataacgggcaagactg

SEQ ID NO: 15188 - DNA, 383 bp, Homo sapiens
  AL353666.3_157804
  Located on chromosome 9
  Distance between a terminus base of telomere on chromosomal short arm and 5'-terminus of this base sequence : 73171533
  Distance between 3'-terminus of neighbour sequence of sequence listing upward to telomere on chrosomal short arm and 5'-terminus of this base sequence : 1448
gaatgttaataggctggaattctgtcttaaaaatcagtgatcctcatactgtattaaaaccaagtctcataggtatttctgtaatgaagatatacaaatagctaataagcatatgaaaagatgtgaaacattcttaatcatcaggtaaatgcaaataaacaccacagtgagatactatgtcacatttactagggtaagaaaaataataataataataataataataataataataataataataatgtcagataatacagtgtcggcaagggtgtatagaaactggaactctcatacattgctagtgggaaagtaaaacgtgcaaccactttggaaaacagtctggcaattccgcacaaaagctgaacatggagttagcattt

SEQ ID NO: 15189 - DNA, 106 bp, Homo sapiens
  DISO7_10002721
  Located on chromosome 9
  Distance between a terminus base of telomere on chromosomal short arm and 5'-terminus of this base sequence : 73228009
  Distance between 3'-terminus of neighbour sequence of sequence listing upward to telomere on chrosomal short arm and 5'-terminus of this base sequence : 56093
tgccatgactgtctttccatctttgggtttctttttttttttctctctctcactctttctctctctctctctctccttcttctatctcttgatatcatttgttcca

SEQ ID NO: 15190 - DNA, 145 bp, Homo sapiens
  DISD22_0006461
  Located on chromosome 9
  Distance between a terminus base of telomere on chromosomal short arm and 5'-terminus of this base sequence : 73398439
  Distance between 3'-terminus of neighbour sequence of sequence listing upward to telomere on chrosomal short arm and 5'-terminus of this base sequence : 170324
ccttccttcttgaatcatttcaaatgaaaaacagaaattaatataccacacacacacacacacacacacacacacacacacacacacacacagacacatcaatcttaggtataatgaaacaaagaatgtgcattcatagacaagc

SEQ ID NO: 15191 - DNA, 108 bp, Homo sapiens
  DISO7_10002722
  Located on chromosome 9
  Distance between a terminus base of telomere on chromosomal short arm and 5'-terminus of this base sequence : 73553520
  Distance between 3'-terminus of neighbour sequence of sequence listing upward to telomere on chrosomal short arm and 5'-terminus of this base sequence : 154936
agccctgaatacaggtcgttagtttttgttttgttttgttttgttttgttttgttttgttttgttttgttttgttcaatctgagaaataaccagtcccatggatgatt

SEQ ID NO: 15192 - DNA, 169 bp, Homo sapiens
  Z67695
  Located on chromosome 9
  Distance between a terminus base of telomere on chromosomal short arm and 5'-terminus of this base sequence : 73554412
  Distance between 3'-terminus of neighbour sequence of sequence listing upward to telomere on chrosomal short arm and 5'-terminus of this base sequence : 784
aggtcttctacatcctggcgaagcattatgagcctcttggagcttctgcttgcctgacactctcagtctctctgtacacacacacacacacacacacacacacacacagagttagttttctggtattcccattaccaaatgaaattgtgccaaaggaatcaaaataatc

SEQ ID NO: 15193 - DNA, 117 bp, Homo sapiens
  DISO7_10002726
  Located on chromosome 9
  Distance between a terminus base of telomere on chromosomal short arm and 5'-terminus of this base sequence : 73654321
  Distance between 3'-terminus of neighbour sequence of sequence listing upward to telomere on chrosomal short arm and 5'-terminus of this base sequence : 99740
aacattctttctgctcctccctccctcccccatactctttcctctgtgtgtgtgtgtgtgtgtgtgtgtgtgtgtgtatggttgtgtaacttccattatgtatatgttggtaagctt

SEQ ID NO: 15194 - DNA, 175 bp, Homo sapiens
  DISO7_10002727
  Located on chromosome 9
  Distance between a terminus base of telomere on chromosomal short arm and 5'-terminus of this base sequence : 73663937
  Distance between 3'-terminus of neighbour sequence of sequence listing upward to telomere on chrosomal short arm and 5'-terminus of this base sequence : 9499
aacaaattcaactaaggcctggccctgccctgccctgccctgccctgggatgggagagggctttcccctctactctttcctttcttttcattttgtagtgcttttcactccatcaagtcatttttcctttcaggttggggagtgcctgataaagaaagcattataaggctggatt

SEQ ID NO: 15195 - DNA, 474 bp, Homo sapiens
  chr9.fa.O7frz.82481925
  Located on chromosome 9
  Distance between a terminus base of telomere on chromosomal short arm and 5'-terminus of this base sequence : 73721373
  Distance between 3'-terminus of neighbour sequence of sequence listing upward to telomere on chrosomal short arm and 5'-terminus of this base sequence : 57261
atgtactcattaatccactgtcagctattttcatcattttgccagtcttgtttcatttaatgttaacacacacacacacacacacacacacacaactagtgaagcagatgaaaacagcaatgacttagaaatcaggaaaaaaagtggcactactaataattaaattcacaatttggtttcttgaaaaaaacaaatcaaatagataaaccattaactcatctaattgtttaatgggaaaaagcacaaattaacaaaagatatgaaaagacagttcaaagagaagaaactaaaaatgacctttaaacatttcaaaagatgttaaacatcattaataataagagaaatacaaatagacttataacgagattctgtggtttaactagcacattggcaaagatcaacacatttggtaacatcccatgttgacaaaaagaatgaggaaacagccactcctgcttattgtaagtggaagtg

SEQ ID NO: 15196 - DNA, 363 bp, Homo sapiens
  chr9.fa.O7frz.82604462
  Located on chromosome 9
  Distance between a terminus base of telomere on chromosomal short arm and 5'-terminus of this base sequence : 73793281
  Distance between 3'-terminus of neighbour sequence of sequence listing upward to telomere on chrosomal short arm and 5'-terminus of this base sequence : 71434
cttagtcactggatacaggactagtagcatcatatccaacacacggtaaccctcaaatatagaaatcaatgaagaatgtgttctattttagtcagtctcctcatgataaaatgggattaaagattcccatctttaatgggaattaaaggattaaacatccaacttaagtaaaatgccagtcacatcatatagcatgaagaaaaatgctcaataagtgataggcactcatccacccatccatccatccatccatccatccatccatccatctatgcatactgtgaacagatatctgcccatctgcagcacacaagaagggtcaccacatgaacttcttccctcttcatcctcactgtagagtag

SEQ ID NO: 15197 - DNA, 254 bp, Homo sapiens
  HUMUT5024
  Located on chromosome 9
  Distance between a terminus base of telomere on chromosomal short arm and 5'-terminus of this base sequence : 73910686
  Distance between 3'-terminus of neighbour sequence of sequence listing upward to telomere on chrosomal short arm and 5'-terminus of this base sequence : 117042
tattctagctgcctcaggtctctagaactgtatctgccagtggaaaaacatggccaccttcagttgtgtgctttctggcaacacccaattcatcccctaaattgcagttccacaaagaaaggaaggatgatttacaacttggtaaatgctataattaaggggggaaaagcagaagattatctgtctgtctatctatctatctatctatctatctatctatctatctaaagttctgtgattaacaatggtttggg

SEQ ID NO: 15198 - DNA, 138 bp, Homo sapiens
  DISO7_10002728
  Located on chromosome 9
  Distance between a terminus base of telomere on chromosomal short arm and 5'-terminus of this base sequence : 74022874
  Distance between 3'-terminus of neighbour sequence of sequence listing upward to telomere on chrosomal short arm and 5'-terminus of this base sequence : 111934
cctcttcttgtgcacatacagtcacacacacacacacacacacacacagccacagctgcatgcatgctctttgggtttctttttatctttcacctatgttccctttaaaagtaggcatttgaatccctccaagcacag

SEQ ID NO: 15199 - DNA, 116 bp, Homo sapiens
  DISO7_10002729
  Located on chromosome 9
  Distance between a terminus base of telomere on chromosomal short arm and 5'-terminus of this base sequence : 74108430
  Distance between 3'-terminus of neighbour sequence of sequence listing upward to telomere on chrosomal short arm and 5'-terminus of this base sequence : 85418
tgtcagctgacatctttgggatattttgatgggctccaaatattaaagatacacacacacacacacacacacacacacacacacacacacttgggttagagcagacacatctgtga

SEQ ID NO: 15200 - DNA, 325 bp, Homo sapiens
  chr9.fa.O7frz.83112377
  Located on chromosome 9
  Distance between a terminus base of telomere on chromosomal short arm and 5'-terminus of this base sequence : 74363262
  Distance between 3'-terminus of neighbour sequence of sequence listing upward to telomere on chrosomal short arm and 5'-terminus of this base sequence : 254716
acaaaccaatttggactatcttctactgttaaaaactgaactaaactgaactaagaagggaggtgggctaaaaggctgcacatcttttaaggaaacaaagcgtgtgtgtgtgtgtgtgtgtgtgtgtgtgtgtgtgtgtgtgtgtacactttatttctgttgacagatgggtcttagctaccaaacttggaagaaatgtaggcagtaaatcagttttcccattttatgacagactttatcatgaaagatgattctaaatgtaaacacagtgggtaaaatgccacttagagggaatttaataaacatactaatttagacctcagca

SEQ ID NO: 15201 - DNA, 160 bp, Homo sapiens
  chr9.fa.O7frz.83230813
  Located on chromosome 9
  Distance between a terminus base of telomere on chromosomal short arm and 5'-terminus of this base sequence : 74467411
  Distance between 3'-terminus of neighbour sequence of sequence listing upward to telomere on chrosomal short arm and 5'-terminus of this base sequence : 103824
gatgtcatttaggatacagcacagggcttattgtcttggaaatagcctagtgtctaagagaacaaatagaaacagctgaataaagcttcatttggaaaacaaaacaaaacaaaacaaaacaaaacaaaacaaaaaactaatagacttggtgaccagatag

SEQ ID NO: 15202 - DNA, 304 bp, Homo sapiens
  AL162726.7_32432
  Located on chromosome 9
  Distance between a terminus base of telomere on chromosomal short arm and 5'-terminus of this base sequence : 74599079
  Distance between 3'-terminus of neighbour sequence of sequence listing upward to telomere on chrosomal short arm and 5'-terminus of this base sequence : 131508
gaacaattaagcattataccagaggtctggtataatggtttctatttcatacaaaactaaaggtagtttttgtctctcgttctctgtttctgctcaaatatccatcctgctctctctctctctctctctctgccctctctctctccttgtctttgtgtgtgtatgtgtgcatgcaaagatgtgtgtttgtacaaccaaaaaccttggaaatttgtggtgtttttactccagcatcctgactttatttaaatcaagatgtaaataaaactcttttgttttgaagaccaataggaattaaatccaa

SEQ ID NO: 15203 - DNA, 429 bp, Homo sapiens
  AL162726.7_75981
  Located on chromosome 9
  Distance between a terminus base of telomere on chromosomal short arm and 5'-terminus of this base sequence : 74642460
  Distance between 3'-terminus of neighbour sequence of sequence listing upward to telomere on chrosomal short arm and 5'-terminus of this base sequence : 43077
gaggaagacaaacagctaagttgttggttgcaagtccctgttacctccgagacagaccaaacaggttctgggggtgttgaggttgattttgcagatcttgtcagttctgagagcagagcagcacttctttttcagcttcatcatcttttaatattattgtgtgtgtgtgtgtgtgtgtgtgtgtgtgtgtgtgtgtgtgattctttaattattgtttaattgagcacaaagagtacttgcaaaggtgtggcttgaagtagtaactaaattatagtcatgcatcactaaagacaagaatatcttataagaaccatgttgttaggtgatttcattattgtacaaacatcatagagtgtacttaaacaaacctagatgatgctatacacctaggctatgtattctattgtctctaggctacaaacctgtaca

SEQ ID NO: 15204 - DNA, 338 bp, Homo sapiens
  chr9.fa.O7frz.83349450
  Located on chromosome 9
  Distance between a terminus base of telomere on chromosomal short arm and 5'-terminus of this base sequence : 74642551
  Distance between 3'-terminus of neighbour sequence of sequence listing upward to telomere on chrosomal short arm and 5'-terminus of this base sequence : -338
cagatcttgtcagttctgagagcagagcagcacttctttttcagcttcatcatcttttaatattattgtgtgtgtgtgtgtgtgtgtgtgtgtgtgtgtgtgtgtgtgattctttaattattgtttaattgagcacaaagagtacttgcaaaggtgtggcttgaagtagtaactaaattatagtcatgcatcactaaagacaagaatatcttataagaaccatgttgttaggtgatttcattattgtacaaacatcatagagtgtacttaaacaaacctagatgatgctatacacctaggctatgtattctattgtctctaggctacaaacctgtaca

SEQ ID NO: 15205 - DNA, 198 bp, Homo sapiens
  D9S1785
  Located on chromosome 9
  Distance between a terminus base of telomere on chromosomal short arm and 5'-terminus of this base sequence : 74872394
  Distance between 3'-terminus of neighbour sequence of sequence listing upward to telomere on chrosomal short arm and 5'-terminus of this base sequence : 229505
cctgggtctgacaacatctcttgggaacttgagagaaagttatgggtcttcactcaaatagtgtactaattaatagatgatttggcttttctcatgtatttctgtgtgtgtgtgtgtgtgtgtgtgtgtgtgtggttgcttataaggaaaattagatcatttcttaaaataccttaatcctttgcatattgccagtac

SEQ ID NO: 15206 - DNA, 318 bp, Homo sapiens
  AL133391.5_15484
  Located on chromosome 9
  Distance between a terminus base of telomere on chromosomal short arm and 5'-terminus of this base sequence : 74903495
  Distance between 3'-terminus of neighbour sequence of sequence listing upward to telomere on chrosomal short arm and 5'-terminus of this base sequence : 30903
tttggaaatgcaggttagaagagattctttgtatcccagtttggcatggcacactcattaagagccatactgctgaaaatgaaaattaatcttaagtctcttcactcacagcaaaattgtgtgtgtgtgtgtgtgtgtgtgtgtctgtgtgtctgtgtgtgcatgtatgtattccccccaaacccaacttggtgaacattatggattttattctctctgacccaatagacattaactgattatattaactactcaaattcagctgtagtcccactgaatattcctcatctaaagactgaactttaaatttaacctcca

SEQ ID NO: 15207 - DNA, 377 bp, Homo sapiens
  AL133391.5_68619
  Located on chromosome 9
  Distance between a terminus base of telomere on chromosomal short arm and 5'-terminus of this base sequence : 74956482
  Distance between 3'-terminus of neighbour sequence of sequence listing upward to telomere on chrosomal short arm and 5'-terminus of this base sequence : 52669
gtagatgactgaactatggaaggtgtcctgtagagcgatgtctagaaagtaaccccaatgatttgtattcaatgctatctcctcaccatgctctcactttcaaacccccatttgcaacttgcaaatctcaaggcattgtcttcacattttctgtgcctagtgtaagttttgtagaaaaaaaaaatgattgctattgttattatttagtggcacacaggttatctcctatacccctcattctccccagttagcagatatggtatatacacacacacacacacacacacacacacatgtatatacatatatatatatacacacacatatatatatatagctagatgcatagagaagttaactcacctgtgcaagattac

SEQ ID NO: 15208 - DNA, 278 bp, Homo sapiens
  AL133391.5_97415
  Located on chromosome 9
  Distance between a terminus base of telomere on chromosomal short arm and 5'-terminus of this base sequence : 74985330
  Distance between 3'-terminus of neighbour sequence of sequence listing upward to telomere on chrosomal short arm and 5'-terminus of this base sequence : 28471
aacatctcactgaagtgtcagataagctgcagaaagcagaactatatgaaagcctgtgccatctgttatttgtatgccaaggtggaccaaaccctaaagagaacttaagcagtagagcatgtaattattataaattcgttccaaatctgcccctcttcttagctttacaagtgtacatatatgtgtatatatatacatatatatatagatgtgtatatatatatatatatatatatatatataaaatccttctttctaccagcctaaatttgctatct

SEQ ID NO: 15209 - DNA, 386 bp, Homo sapiens
  AL133391.5_98684
  Located on chromosome 9
  Distance between a terminus base of telomere on chromosomal short arm and 5'-terminus of this base sequence : 74986693
  Distance between 3'-terminus of neighbour sequence of sequence listing upward to telomere on chrosomal short arm and 5'-terminus of this base sequence : 1085
atcaaagccgctacatagaattaacttgacctcctgctctaatatagagtggccatcaaaatgcagcaatcaggctacttggctcttttgcagttttactgatagagctccaggggttttgtgtgtgtgtgtgtgtgtgtgtgtgtgtgtgtgtgtgtgtgtgtgttttccagcaatacccagcaacccatagcaaaatttatgctaagtaaggaaatctaattatctccaaataatcagaatctgtatattttgattaaaagtaacaggaaaaactaatttgatttcctaatgtgatacacaaagacaaacttcctgtgtcagggactccctagtaatcctgctgaaaggctgcgccactccaagttggcatctgcttaaagtag

SEQ ID NO: 15210 - DNA, 225 bp, Homo sapiens
  AL133391.5_120853
  Located on chromosome 9
  Distance between a terminus base of telomere on chromosomal short arm and 5'-terminus of this base sequence : 75008910
  Distance between 3'-terminus of neighbour sequence of sequence listing upward to telomere on chrosomal short arm and 5'-terminus of this base sequence : 21831
tcatttcagtagatgtctggacaaaggacataaatagccaagacgcaaaagaagacttataaatgacaaatatagatagatagatagatagatagatagatagatagatagatgatagatagatagatagatagatactcaaatacccaattaaggaaatgcaaattttaaaaatgatgaggcattttttttcacctttccacagaacgctatagaatgttaaat

SEQ ID NO: 15211 - DNA, 322 bp, Homo sapiens
  AL133391.5_143233
  Located on chromosome 9
  Distance between a terminus base of telomere on chromosomal short arm and 5'-terminus of this base sequence : 75031214
  Distance between 3'-terminus of neighbour sequence of sequence listing upward to telomere on chrosomal short arm and 5'-terminus of this base sequence : 22079
acaattaggatggctgtaacttagaaaaaggaatataacaagtggcaaagatgttaagaatttagaacccccttccattgctggtgagaatgtaaaatggtttagccaccccaaaaggaattaaatgtggatacttaaacaaatatatgtgtgtgtgtgtgtgtgtgtgtgtgtgtgtgtgtgtgtgtgtgtatgtacacagcagcactactcaccatagccaaaatatggaaacagcttaaatgtctatcaggtgatgaaaggatgaacaaattgtgatatatgcatacagtggaatattattcagccttaaatagcaagg

SEQ ID NO: 15212 - DNA, 164 bp, Homo sapiens
  D9S264
  Located on chromosome 9
  Distance between a terminus base of telomere on chromosomal short arm and 5'-terminus of this base sequence : 75031286
  Distance between 3'-terminus of neighbour sequence of sequence listing upward to telomere on chrosomal short arm and 5'-terminus of this base sequence : -250
ttccattgctggtgagaatgtaaaatggtttagccaccccaaaaggaattaaatgtggatacttaaacaaatatatgtgtgtgtgtgtgtgtgtgtgtgtgtgtgtgtgtgtgtgtgtgtatgtacacagcagcactactcaccatagccaaaatatggaaaca

SEQ ID NO: 15213 - DNA, 344 bp, Homo sapiens
  AL133391.5_152510
  Located on chromosome 9
  Distance between a terminus base of telomere on chromosomal short arm and 5'-terminus of this base sequence : 75040436
  Distance between 3'-terminus of neighbour sequence of sequence listing upward to telomere on chrosomal short arm and 5'-terminus of this base sequence : 8986
tcagagttcatagaatctcaggaggttttaaaaactcattagctaatagagttgcactaaatcaggaggctcactaataaaataaaattctctagtgtttaactagcaaattgtatttgataattggttctttgtaaattgctctttcatggcccttgtccatagcttatttgatggagggggaaaatacgtgtatgtgtgagtgtgtgtgtgtgtgtgtgtgtgtgtgtataaattaaaaatccagtatctataacttataccatgaagttgctaaaatactgtgtcttctagacatggcaacattttaagtaaaatagaactatacagcactcaagtttgcc

SEQ ID NO: 15214 - DNA, 391 bp, Homo sapiens
  AC026907.1_43463
  Located on chromosome 9
  Distance between a terminus base of telomere on chromosomal short arm and 5'-terminus of this base sequence : 75176397
  Distance between 3'-terminus of neighbour sequence of sequence listing upward to telomere on chrosomal short arm and 5'-terminus of this base sequence : 135617
tgacttaatcttcataagaaccatataaatttgctgtgccccattttgtatgtgaggaaatgagggcaaaaagaggttaagacagttcccttaggtcacatgactacagaagtgggattaaaaccacacaggctggctccagcacctgttttctgagtaccaggccacacacacacacacacacacacacacacacacacacacacacacacacccttctcccctcactctctcctgaggtttcaggatgctgcagaacctgcgatacacacagcttgctccttaacactctggaaccaggtttccagcttcatgtaatggttgctgagcttaacaaaagcaatggtgattttataaccgttctttaattatacatgatcatggaggtaac

SEQ ID NO: 15215 - DNA, 382 bp, Homo sapiens
  AC026907.1_140429
  Located on chromosome 9
  Distance between a terminus base of telomere on chromosomal short arm and 5'-terminus of this base sequence : 75252578
  Distance between 3'-terminus of neighbour sequence of sequence listing upward to telomere on chrosomal short arm and 5'-terminus of this base sequence : 75790
taatttatcagcatgaatcaattcacagataacactcaaaattgctgcaaatgggagttgagaaaaaactgaaaagtttcagctctgactagaggtcagagaagaggccttcatccctgctctcagccatccatcaaatgctcaatacacacacacacacacacacacacacacacacacagcctatttccttctcttggcaatctttgaacaccaagactggctcacaacagtaactgaaaaaaaaaaaaaaaagtgagagaacctgcaaaagaagtggagaaaatgctcacagcatgaactacactctctctcaaaatgcagatatatgaaacaagaatcaaagaatactgatttattctattcatttggcaaacattta

SEQ ID NO: 15216 - DNA, 167 bp, Homo sapiens
  G08753
  Located on chromosome 9
  Distance between a terminus base of telomere on chromosomal short arm and 5'-terminus of this base sequence : 75283276
  Distance between 3'-terminus of neighbour sequence of sequence listing upward to telomere on chrosomal short arm and 5'-terminus of this base sequence : 30316
atttcggccactatttctccaaatactgttcctgatctttctcctgtccttctgggactttatagatagatgatagatagatagatagatagatagatagatagatagatagatagatagatagatatagatatatagatatagatagatgcatatgttggtctgct

SEQ ID NO: 15217 - DNA, 276 bp, Homo sapiens
  D9S167
  Located on chromosome 9
  Distance between a terminus base of telomere on chromosomal short arm and 5'-terminus of this base sequence : 75403049
  Distance between 3'-terminus of neighbour sequence of sequence listing upward to telomere on chrosomal short arm and 5'-terminus of this base sequence : 119606
tcctccagttcaatccatgctgctgcaaatgacagggcttcatttttttatggctgaaaaattttccattgtgcgtataaaccaaattttctttatccattcattcactgatagacacttaggttgattttatatcttgactattgtgaatagcactgcaataaacatgacagtgcaaataatatctctgatatactgatttccatacacacacacacacacacacacacacacacacacacacacacacaggagtgggattgtttgatcttatac

SEQ ID NO: 15218 - DNA, 406 bp, Homo sapiens
  chr9.fa.O7frz.84131902
  Located on chromosome 9
  Distance between a terminus base of telomere on chromosomal short arm and 5'-terminus of this base sequence : 75467438
  Distance between 3'-terminus of neighbour sequence of sequence listing upward to telomere on chrosomal short arm and 5'-terminus of this base sequence : 64113
aatttaagctccatgatagctaggatttttatctgcttattcactgttacatgttttacacccaatggggaatatatatatatatatatggagagagagagagagagagagagaaagagagagagatcagtagcccagcttctgatctgttttgtttgtacttttcactcattttcacacagtgacactgactgccgggtaactgtctctcaggacatttgtgctttgagtctctgcaactctggaccatctctgcaggctaaaagatgtgcctgttgctaagaggaggagccctgcagcaggaatccggtgccagctgacctggaacaacctgatctccagaaagcatccctgttatactcaaatgggccttccagatgagccctgtaaggatatgcatgatagc

SEQ ID NO: 15219 - DNA, 452 bp, Homo sapiens
  AL137847.5_171540
  Located on chromosome 9
  Distance between a terminus base of telomere on chromosomal short arm and 5'-terminus of this base sequence : 75575744
  Distance between 3'-terminus of neighbour sequence of sequence listing upward to telomere on chrosomal short arm and 5'-terminus of this base sequence : 107900
aggatcaaaggaactatttcacagcacagagcatcccacagggagggcggtgggccacaggggaatccccaggagaatgacaggtttctcaatcagtgacaagctcagtgttgtggtaggcagatgatcataaccgatgaccagctaatggcccatcagaagctcctgtgttattccagatccattggaagattgacatagtcatctctctctctctctctctctctctctctctttcccccagcctgccttctctctcataaacatgtcattaatgttcatgctaccaacagctggatcatctgagtccctccagctgcctctcaactggcccaggggaacagaacacctgagccattttcacttgggtgttgggcccatccgtggccatatggtgcctcaggccctggaggcctccttccctcaaaccactttccttactaggtggaaac

SEQ ID NO: 15220 - DNA, 401 bp, Homo sapiens
  AL161786.6_124216
  Located on chromosome 9
  Distance between a terminus base of telomere on chromosomal short arm and 5'-terminus of this base sequence : 75585320
  Distance between 3'-terminus of neighbour sequence of sequence listing upward to telomere on chrosomal short arm and 5'-terminus of this base sequence : 9124
atgagtgctcctaacctgatcctatgttcccaagatttaagaaaagaaccttttttttttcctgaagcactaggagaaaatagataccttctacatagcaaagaaaaagcttagaaaaatacatcattcatctttaatgatatctagaaattcagttctaatacaaaataatttatctttaaacatttcccagctttcttttaagtttgtttaaagtaccatctttaatagagatagatagagataggtagatagatgattgatagttacatgatagatagatagatagatagatagatagatagatagatagatagacatgccatcctgcttcattattcactttgtctctaatcctgccccatctgtctcaggttcgttcctatccaacttcattacac

SEQ ID NO: 15221 - DNA, 201 bp, Homo sapiens
  D9S924
  Located on chromosome 9
  Distance between a terminus base of telomere on chromosomal short arm and 5'-terminus of this base sequence : 75585509
  Distance between 3'-terminus of neighbour sequence of sequence listing upward to telomere on chrosomal short arm and 5'-terminus of this base sequence : -212
ccagctttcttttaagtttgtttaaagtaccatctttaatagagatagatagagataggtagatagatgattgatagttacatgatagatagatagatagatagatagatagatagatagatagatagacatgccatcctgcttcattattcactttgtctctaatcctgccccatctgtctcaggttcgttcctatccaa

SEQ ID NO: 15222 - DNA, 410 bp, Homo sapiens
  AL161786.6_38596
  Located on chromosome 9
  Distance between a terminus base of telomere on chromosomal short arm and 5'-terminus of this base sequence : 75650592
  Distance between 3'-terminus of neighbour sequence of sequence listing upward to telomere on chrosomal short arm and 5'-terminus of this base sequence : 64882
agtaagtccacttgtgatacaaagagactacaggatgtccctaaaacatttctctctgtctctctctctctctctctctctctctctctctctctctctcactctctctctctcttactctttcactctctctgaaagctggctggccagcagcaggaatagtgttcactatgttgcttcacatcacaaactcaatattgtgctaagccagtcatctcaacagtgagtccacatgcatccatctgagcacactgtttcatctagcccactgcttattcccaaccacattcaccaaattccactcctttctcctttcacccaggcctctccaatgttcaccacgcaagcaaaaatatcaagagtcctgccgtagaccttaaccaccagtaaacttgaacaatagagcattg

SEQ ID NO: 15223 - DNA, 130 bp, Homo sapiens
  D9S152
  Located on chromosome 9
  Distance between a terminus base of telomere on chromosomal short arm and 5'-terminus of this base sequence : 75724651
  Distance between 3'-terminus of neighbour sequence of sequence listing upward to telomere on chrosomal short arm and 5'-terminus of this base sequence : 73649
ccagttttttactctcttctctctctctctctctctctctctctctctctctcacacacacacacacacacacacacacacaccattccttgtcagtgccaatagcagccatttagaaagctaacataac

SEQ ID NO: 15224 - DNA, 284 bp, Homo sapiens
  AL450026.6_13265
  Located on chromosome 9
  Distance between a terminus base of telomere on chromosomal short arm and 5'-terminus of this base sequence : 75734285
  Distance between 3'-terminus of neighbour sequence of sequence listing upward to telomere on chrosomal short arm and 5'-terminus of this base sequence : 9504
tatgcctacaactgctcttaaacatatggtattaatttttttaatcatcttgaatatccatttcctactctaacatatttcagggctataagcctgcatagagtgcttggcgtgtatgcgcgcacacacacacacacacacacacacacacacacacacaatgtcaatattgaggagtggccacactttgagaaccatcagtctataggatcattaagggtaaggctcctctatctcttttagagctttatcttctcttcatctctagcactccagtctagaca

SEQ ID NO: 15225 - DNA, 393 bp, Homo sapiens
  AL353641.2_114491
  Located on chromosome 9
  Distance between a terminus base of telomere on chromosomal short arm and 5'-terminus of this base sequence : 75756904
  Distance between 3'-terminus of neighbour sequence of sequence listing upward to telomere on chrosomal short arm and 5'-terminus of this base sequence : 22335
cacaatagtgctatgctgaatctgtttatgtgtctgtctgtcttttctactagattggcaaggattaattattatttgtctttttgtatctctgctactcacagcagtccccaacagaggtattcaataaatgtttgtttggtgaatggatggaggatggatggatggatggatggatggatggatggatggatggacggacggacggatggatagatttacggatgagtggatggaagagtggatgagtggatgggtgggttggtgggtgagtggaagagtggataaatgatgaatgaattaatggatagttagatggatgaatagatagatagatagatggatgaaaatattttcttaagtcttcagctctgtcttcagactagaatctca

SEQ ID NO: 15226 - DNA, 456 bp, Homo sapiens
  AL354920.10_127745
  Located on chromosome 9
  Distance between a terminus base of telomere on chromosomal short arm and 5'-terminus of this base sequence : 75845643
  Distance between 3'-terminus of neighbour sequence of sequence listing upward to telomere on chrosomal short arm and 5'-terminus of this base sequence : 88346
caatttagatttctagcataccagacattattcattcctgctttgcctgcaggggacactttcctgggtcgctcactgctgccggcacccgtaaattaggcagggaagatcccagttaagtgtgtgtgtgatacattacacacaaagaagtatataaaatctacatgtacagcttgaaataaaagaatagataaacatctgtgtaatcaatatctaggctaagaaatagaacattaccagttcactagaggacatttggtgcctcttccaagagctttcgttttgaattttaggttaatcattcttttcttctctgcatagttttagtgtgtgtgtgtgtgtgtgtgtgtgtgtgtgtgtgtcttttaactacaaatgtattgcttaattttcttgtttttaaattttctgtaattgaggatcatacggattgtattcttacaatcagcaatatgg

SEQ ID NO: 15227 - DNA, 218 bp, Homo sapiens
  chr9.fa.O7frz.84631533
  Located on chromosome 9
  Distance between a terminus base of telomere on chromosomal short arm and 5'-terminus of this base sequence : 75896050
  Distance between 3'-terminus of neighbour sequence of sequence listing upward to telomere on chrosomal short arm and 5'-terminus of this base sequence : 49951
atgtcaaatagatcacgactctactttaggggagggggagaaaagcttaataaacatcaaccattattttagaggatcacgtacatgcagaaaaacctgtatgtgtgtgtgtatatacatatacatatacacacacacacacacacacacacacacacacacacacacagatagttcagaattagatgatttgtgtagctactgaccaattgagtaac

SEQ ID NO: 15228 - DNA, 468 bp, Homo sapiens
  chr9.fa.O7frz.84713058
  Located on chromosome 9
  Distance between a terminus base of telomere on chromosomal short arm and 5'-terminus of this base sequence : 75943194
  Distance between 3'-terminus of neighbour sequence of sequence listing upward to telomere on chrosomal short arm and 5'-terminus of this base sequence : 46926
tgatcactgcttctaaagctagaaagtgccacaactggacaaccaatcatttggaatttcttccatatgtctaaataaaatttctcctcaacttcattagctcctcattacctgtttttccctgtcatgctgtgtcttacctgcatgctttgcctaggctgccttcctctacctagaatgactttccccttgccttcacctgtctaacttctactcatcctgtatcacatgccccaggaagacttcactccctaccatttagagatatggtttttcccttgattctccaacaaataccgtgtgtgtgtgtgtgtgtgtgtgtgtgtgtgtgtctgtctccctgcatttatggactttgcaattatctgtgtctacattattgtctaaaaatgtttgatgtgtgtgacactataaggtaataagatttacctgtaagaagataccatatagttatccattgttatggca

SEQ ID NO: 15229 - DNA, 377 bp, Homo sapiens
  AC007943.2_147971
  Located on chromosome 9
  Distance between a terminus base of telomere on chromosomal short arm and 5'-terminus of this base sequence : 75975190
  Distance between 3'-terminus of neighbour sequence of sequence listing upward to telomere on chrosomal short arm and 5'-terminus of this base sequence : 31528
ggctatgattccagttaatgtattttatattatgatttagaaacacatatatatacacacacataaatatatctctcacacacacacacacacacacacacacacacaaaagcactggtatttttaattgcttcatcctggaacaaactgctcaatgctagcttgtaaatgcagaagaaatgatagagttagaaaatcactattttgcaatcacaaaaaaaggcacaaatatcaatggatgctaaagccactagatgaaaagggtattcatacaatcttaaagtatcacctcacatattaattataaaagggaaaatatatatttacaatggagatatctaggagatatcactgtatccaagtgatcaaccttataa

SEQ ID NO: 15230 - DNA, 123 bp, Homo sapiens
  D9S1877
  Located on chromosome 9
  Distance between a terminus base of telomere on chromosomal short arm and 5'-terminus of this base sequence : 76099201
  Distance between 3'-terminus of neighbour sequence of sequence listing upward to telomere on chrosomal short arm and 5'-terminus of this base sequence : 123634
atgtacttgcagtctttagaatggttgtgtgtgtgtgtgtgtgtgtgtgtgtgtgtaacgtgtcttatcctcacaataacctcataattctacccctagcagtctgagcccaaagcccctatc

SEQ ID NO: 15231 - DNA, 445 bp, Homo sapiens
  chr9.fa.O7frz.84894506
  Located on chromosome 9
  Distance between a terminus base of telomere on chromosomal short arm and 5'-terminus of this base sequence : 76205108
  Distance between 3'-terminus of neighbour sequence of sequence listing upward to telomere on chrosomal short arm and 5'-terminus of this base sequence : 105784
tacaaactatttacaaactggctgattgtggtagcatgtgcctgtagtcctagctacttgggaggctgagggtgagaggatcaattgagcccagaaggttgaggccacagtgaactgtgaccatgccactgtattccagcctgggtgacagagcgagacccagtcttaaaagaagaaagagacagacagagagagaaggaaagaaagaaagaagagaaagaaggagagaaagaaagaaagaaagaaagaaagaaagaaagaaagaaaggaaagaaagaaagaaagaaagaaagaaagaaagaaagaaagaaagaaagaaagcaagcaagcaagcaagctgctatttgtcctataggatttctcacactttagaattggctgatcatatactgtattttcatttaacttgttcctctgtttcctacatttcctgttaaccagtaag

SEQ ID NO: 15232 - DNA, 418 bp, Homo sapiens
  chr9.fa.O7frz.85088807
  Located on chromosome 9
  Distance between a terminus base of telomere on chromosomal short arm and 5'-terminus of this base sequence : 76396598
  Distance between 3'-terminus of neighbour sequence of sequence listing upward to telomere on chrosomal short arm and 5'-terminus of this base sequence : 191045
tgaatttctaacgacattaagtttactgagttcatggcaccatatgttgagtttatttataatccttctataaaatcaataatgaatgatggcttcagtttcctgaaagaggcccctctctaagtgtggtgttaaagatgagtgctaacgggcaggaagtgtgctgggaatatatgcaggcactaggtaaacaaaacagtccagagagtttgggttggaaattagttgttgctttgacatgtggcatgatttatccctttgctactcatatttctctatcaggcagctgctaggcttcttctaatgtacttgcctgagtatgcctgcacacacacacacacacacacacacacacacacacacaccccacacacaactgtggctggaagcctcttttaggagttctctttgcatctaa

SEQ ID NO: 15233 - DNA, 401 bp, Homo sapiens
  AL356134.7_160400
  Located on chromosome 9
  Distance between a terminus base of telomere on chromosomal short arm and 5'-terminus of this base sequence : 76560240
  Distance between 3'-terminus of neighbour sequence of sequence listing upward to telomere on chrosomal short arm and 5'-terminus of this base sequence : 163224
gaggtatctgtcttcctgaaattcactcatcatcccctttctatacagttttcctacatgtctgtattccctaaaaaatacattgtgtgtccgggtgcagtggctcacaccctataatcccagcactttgggaagccgaggcaggtagattgcttgagcccaggagtttgagaccagtctggacaacatggtgaaatactgtcgctacaaaaagtacaaaaattagctgggtgtggtgctgcgtgcctgtagtcctagctactcaaggggctgaggtgggaggatcacttgagctcagcctgggtgacagagtgagaccctgtcaaaacaaacaaacaaacaaacaaaaaaacaacattgtgcaagtctgcacactgagtaactttacaagtggaattacg

SEQ ID NO: 15234 - DNA, 154 bp, Homo sapiens
  chr9.fa.O7frz.85346434
  Located on chromosome 9
  Distance between a terminus base of telomere on chromosomal short arm and 5'-terminus of this base sequence : 76716675
  Distance between 3'-terminus of neighbour sequence of sequence listing upward to telomere on chrosomal short arm and 5'-terminus of this base sequence : 156034
gttaggtcaattggttcctaacaagaaactgctcagtgggagtcccccgccctccaccccagagagagagagagagagagagagagagagagagagagagaacacagagacagagatagagggagatgtgtgagctggaccatatgtatctaca

SEQ ID NO: 15235 - DNA, 466 bp, Homo sapiens
  AL354692.11_6699
  Located on chromosome 9
  Distance between a terminus base of telomere on chromosomal short arm and 5'-terminus of this base sequence : 76868000
  Distance between 3'-terminus of neighbour sequence of sequence listing upward to telomere on chrosomal short arm and 5'-terminus of this base sequence : 151171
ctgtatgttgaatggtttgaaggggcaataatggatgcagaaataccagtcgggaggttattccacttttctaggtaaaagtcacagtagtgcaagagacaatggtaagagatatatagacatgaaatataaacattctgagtcaatagtacttgatgcttatttgaatgagagagagagagagagagagagagagagagagagagatctaagagaaataaaagtaaattgctaaatgcagtatggtgagccaaaggctatcaaggacagtagagacacctagccagtcactgtcagcaaaggcaaatacaaggaagcatgtgacctcaagttgtatattgtttatttgaagaaactagataaaaataataaaaagttaactcacaatcaaggcagtgaatagcaagcatcaaatgagtgctttggacacggtggtttgtgggtgttgactgcttagttgtggata

SEQ ID NO: 15236 - DNA, 328 bp, Homo sapiens
  chr9.fa.O7frz.85472472
  Located on chromosome 9
  Distance between a terminus base of telomere on chromosomal short arm and 5'-terminus of this base sequence : 76868138
  Distance between 3'-terminus of neighbour sequence of sequence listing upward to telomere on chrosomal short arm and 5'-terminus of this base sequence : -328
tgagtcaatagtacttgatgcttatttgaatgagagagagagagagagagagagagagagagagagagatctaagagaaataaaagtaaattgctaaatgcagtatggtgagccaaaggctatcaaggacagtagagacacctagccagtcactgtcagcaaaggcaaatacaaggaagcatgtgacctcaagttgtatattgtttatttgaagaaactagataaaaataataaaaagttaactcacaatcaaggcagtgaatagcaagcatcaaatgagtgctttggacacggtggtttgtgggtgttgactgcttagttgtggata

SEQ ID NO: 15237 - DNA, 139 bp, Homo sapiens
  chr9.fa.O7frz.85588787
  Located on chromosome 9
  Distance between a terminus base of telomere on chromosomal short arm and 5'-terminus of this base sequence : 76950287
  Distance between 3'-terminus of neighbour sequence of sequence listing upward to telomere on chrosomal short arm and 5'-terminus of this base sequence : 81821
ctactgatctgaaagcaatcatcttatcttcatataggaagaaatatattttctgtttagcttactgtgtgtgagtgtgtgtgtgtgtgtgtgtgttaaatttgaagtgttcctcttctttaggcaattcatacacaaa

SEQ ID NO: 15238 - DNA, 196 bp, Homo sapiens
  Z67640
  Located on chromosome 9
  Distance between a terminus base of telomere on chromosomal short arm and 5'-terminus of this base sequence : 77103878
  Distance between 3'-terminus of neighbour sequence of sequence listing upward to telomere on chrosomal short arm and 5'-terminus of this base sequence : 153452
gcagcctaagggtgtgtgtgtatgtgtgtgagcatgcgtgtatgtgtatgagcatgcatgcgtgtgtgtgtgtgtgtgtgtgtgtgattttggcttaatttttctttctttgaactgttcttagcctataagagagaaaggagatgttatagattattgaacaaaatatgctcataccctatgccaggtagaggca

SEQ ID NO: 15239 - DNA, 425 bp, Homo sapiens
  AC015930.3_137975
  Located on chromosome 9
  Distance between a terminus base of telomere on chromosomal short arm and 5'-terminus of this base sequence : 77133989
  Distance between 3'-terminus of neighbour sequence of sequence listing upward to telomere on chrosomal short arm and 5'-terminus of this base sequence : 29915
gttcagaaccgtagtgcatttgtcaaatgcattgtgtgtgtcttcacccctgcagcttccctgtcagatgattcaatacaaggcaatgatctctccactaagggggaagaaagaaagtgagaaagaaagaaaacagctcagagcccttaaccctgggttgtggctatttttctcatagacaggctgctctctcttatctgattggagcctccgtgttctctgaataggaaataaatctctacacaaaaatccaagggttagtttccaggtgtttgataggaagctttcatcccaagtggtttgtttatttatttatttatttatttatttatttatttatttatttttgtcggggggagtttgttgcattatttgaccaaggacagtgttgaccacctccggtttctacttctctttcgaagttt

SEQ ID NO: 15240 - DNA, 474 bp, Homo sapiens
  AC015930.3_85132
  Located on chromosome 9
  Distance between a terminus base of telomere on chromosomal short arm and 5'-terminus of this base sequence : 77197403
  Distance between 3'-terminus of neighbour sequence of sequence listing upward to telomere on chrosomal short arm and 5'-terminus of this base sequence : 62989
acatgagtggaggataccagggataaaacagacaccagcaaagagacctcaatggaggtttatggctggcgtggtggcacgcatctgtagtcccagctacttgggagactgaggtgggaggactgtttgaatccaggaggttgaggctgcagtgagctgtgatcatgccactgcactgcactccagcctgtatgacagagtgagaccctgtctcaaagaaagaaagtagaaagaaagaaagaaagaaagaaagaaagaaagaaagaaagaaagaaagaaagaaagaaagaaagaggaaaaaaaggaggtttatgcacacagtgtgggaggtacaagggttgaaagcatgaggctttccagtgttgagagcaggaagaactttagggcacagggacacagagtcagagataagactgtctggcccacctgccaggattttgtacaatcacgctgcataatgattcttgaaaatac

SEQ ID NO: 15241 - DNA, 320 bp, Homo sapiens
  AC007524.10_137924
  Located on chromosome 9
  Distance between a terminus base of telomere on chromosomal short arm and 5'-terminus of this base sequence : 77197451
  Distance between 3'-terminus of neighbour sequence of sequence listing upward to telomere on chrosomal short arm and 5'-terminus of this base sequence : -426
tcaatggaggtttatggctggcgtggtggcacgcatctgtagtcccagctacttgggagactgaggtgggaggactgtttgaatccaggaggttgaggctgcagtgagctgtgatcatgccactgcactgcactccagcctgtatgacagagtgagaccctgtctcaaagaaagaaagtagaaagaaagaaagaaagaaagaaagaaagaaagaaagaaagaaagaaagaaagaaagaaagaaagaggaaaaaaaggaggtttatgcacacagtgtgggaggtacaagggttgaaagcatgaggctttccagtgttgaga

SEQ ID NO: 15242 - DNA, 480 bp, Homo sapiens
  AC024515.2_25667
  Located on chromosome 9
  Distance between a terminus base of telomere on chromosomal short arm and 5'-terminus of this base sequence : 77285303
  Distance between 3'-terminus of neighbour sequence of sequence listing upward to telomere on chrosomal short arm and 5'-terminus of this base sequence : 87532
aaagaacatgcctgacctaccccacaggactagtggagaatcaaatatgtagagcattattttattttattttattttattttattttattttattttacttttgagatggagtctcactctgtcacccaggctggagtgcaggggcgcgatctcggctcactgcaacctccgcctcccaggttcaagcgattctcctgcctcagcctcccgagtagctgggactacaggtgtgtgccactgcgcccagctaatttttgtatttttagtagagacggggtttcaccatgttggccaggatggtctcgatctcttgaccttatgaccctcctgcctttgcctcccatagtgctggaattacagatgtgagccactgtgcccagcttgtttatttatttttaaggaaggctcattgaagtataatatgcccatagtataattcacccttttcagtacacagttctgtgagtcttagcaaaca

SEQ ID NO: 15243 - DNA, 404 bp, Homo sapiens
  AC024515.2_122534
  Located on chromosome 9
  Distance between a terminus base of telomere on chromosomal short arm and 5'-terminus of this base sequence : 77373834
  Distance between 3'-terminus of neighbour sequence of sequence listing upward to telomere on chrosomal short arm and 5'-terminus of this base sequence : 88051
aagttcatcctaaatctgactctctctaaatttctattattaagaggaattaaacatcattcattacccaaattaggataaatgggcagatacagaaataatcaacatgggatcaaactacacatgttgcattttattttattttattttattttattattttattttatttttatttttattttttcagatagagtctcactctgtcacccaggctggagtacagtggtgcagtctcagctcactgcaacctccacctcccaggttcaagcgattctcatgccttagcctcccaagtagctgggattacaggtgtgtaccaccacacctgcctaatttgtgtgtgtgtgtgtgtgtgtgtgtatgtgtgtttagtacagatgggatttcaccatgttggctag

SEQ ID NO: 15244 - DNA, 190 bp, Homo sapiens
  D9S1790
  Located on chromosome 9
  Distance between a terminus base of telomere on chromosomal short arm and 5'-terminus of this base sequence : 77570657
  Distance between 3'-terminus of neighbour sequence of sequence listing upward to telomere on chrosomal short arm and 5'-terminus of this base sequence : 196419
aaaaataaagttggccttgaaacccaacacacacacacacacacacacacacacacacacacacaattttgttttctatatatataaacaaaattttacaaagcaaaatgcttccttgctacaagttatgcattctaatactcttttttaactcgttttggtaaaatgtgggttgtaccctactaaatgg

SEQ ID NO: 15245 - DNA, 286 bp, Homo sapiens
  DISO7_00002482
  Located on chromosome 9
  Distance between a terminus base of telomere on chromosomal short arm and 5'-terminus of this base sequence : 77687149
  Distance between 3'-terminus of neighbour sequence of sequence listing upward to telomere on chrosomal short arm and 5'-terminus of this base sequence : 116302
ggattgctcagcgacataaaaccaggggataaatgttttgctgaatccctgctgcttccccatcttccagctaccccaagcccacacacgggaacacacacacacacacacacttagcacatatctagcatgcagcaccaactaatgtcagtggaatgaaaaaacgatgcttgttcacaggcctcccaatccacagggctcagaagggaacaaaataggaaccttgcctgtgcaatcagagaagggcaggtagggtgttggatgaacccatctcttgcaagttaga

SEQ ID NO: 15246 - DNA, 300 bp, Homo sapiens
  D9S919
  Located on chromosome 9
  Distance between a terminus base of telomere on chromosomal short arm and 5'-terminus of this base sequence : 77750198
  Distance between 3'-terminus of neighbour sequence of sequence listing upward to telomere on chrosomal short arm and 5'-terminus of this base sequence : 62763
taggatttgagacaaatgaaagcaattgtgcaattatataaatatataaatagatacaatgtgtgtatatatacagtgtgtgtgggtatatattatatgtagtgtatagatagatagatacatagatagatagatagatagatagatagatagatagatagatagatagatatgctaatatgtgagtcctatgttctatagtaagaacatttgaaccgagaagtgattatgggcaaagataaatgatcaataagaactgcaccagtaacttacaatagtgtctttcccagaagcagctaa

SEQ ID NO: 15247 - DNA, 300 bp, Homo sapiens; identical to SEQ ID NO: 15246
  G10060
  Located on chromosome 9
  Distance between a terminus base of telomere on chromosomal short arm and 5'-terminus of this base sequence : 77750198
  Distance between 3'-terminus of neighbour sequence of sequence listing upward to telomere on chrosomal short arm and 5'-terminus of this base sequence : -300

SEQ ID NO: 15248 - DNA, 150 bp, Homo sapiens
  D9S1865
  Located on chromosome 9
  Distance between a terminus base of telomere on chromosomal short arm and 5'-terminus of this base sequence : 77912684
  Distance between 3'-terminus of neighbour sequence of sequence listing upward to telomere on chrosomal short arm and 5'-terminus of this base sequence : 162186
tgcagcaaaaacagtaattataggaggaaaatttatagcctatctatgcatgcatacatacacacacccatgcgcgcgcacgcgcacacacacacacacacacacacacacacacatatgaaaagaataaggctgaaaattactggacat

SEQ ID NO: 15249 - DNA, 458 bp, Homo sapiens
  chr9.fa.O7frz.86780227
  Located on chromosome 9
  Distance between a terminus base of telomere on chromosomal short arm and 5'-terminus of this base sequence : 78074060
  Distance between 3'-terminus of neighbour sequence of sequence listing upward to telomere on chrosomal short arm and 5'-terminus of this base sequence : 161226
ttaacatgtacatatgcaatgaacattttctaagtaggaaaagtccatgtatagttaaagcaattccataataattagaaataagtatgataatagaataaccatacctaacttaatgcttatatgtacttgcagtctttagaatggttgtgtgtgtgtgtgtgtgtgtgtgtgtgtgtgtgtaacgtgtcttatcctcacaataacctcataattctacccctagcaatcttatataacatggtacatcatttcccaagctacaggtaatcttattttcaatttatcaggtctttagccaatccctacttactgttaacttaagctataactgaagttttaattttttaatttttaattttaatttttgggccgggtactgtggctcatgcctataatcccagcactttgggaggctgaggtgggtggatgacttgaggtcaggagttcgtaactag

SEQ ID NO: 15250 - DNA, 151 bp, Homo sapiens
  HUMUT1228
  Located on chromosome 9
  Distance between a terminus base of telomere on chromosomal short arm and 5'-terminus of this base sequence : 78195890
  Distance between 3'-terminus of neighbour sequence of sequence listing upward to telomere on chrosomal short arm and 5'-terminus of this base sequence : 121372
gggagcatcagtttgagtgaatgtgtgtcagcctagagagatagatagagcatctatctctctgtatctatctatctatcatctatctgtctgtctgtccgtctgtctatctatctacctatctatctattgatcgaactcactcattacc

SEQ ID NO: 15251 - DNA, 214 bp, Homo sapiens
  AL161447.6_134461
  Located on chromosome 9
  Distance between a terminus base of telomere on chromosomal short arm and 5'-terminus of this base sequence : 78318979
  Distance between 3'-terminus of neighbour sequence of sequence listing upward to telomere on chrosomal short arm and 5'-terminus of this base sequence : 122938
gcatgagaactgcttgaacttgggagatggaggttgcagtgagctgagattgtgccactgcactccagcatgggggacagcgagactccgctcaagaaaaaaaaaaaaaaagtatatacacacacacacacacacacgtacataacgcaagtaaaaaaatgattaaatttttttgatgatgactgcaattaagtaaacattcatgtgaacttgg

SEQ ID NO: 15252 - DNA, 216 bp, Homo sapiens
  HUMUT2103
  Located on chromosome 9
  Distance between a terminus base of telomere on chromosomal short arm and 5'-terminus of this base sequence : 78690597
  Distance between 3'-terminus of neighbour sequence of sequence listing upward to telomere on chrosomal short arm and 5'-terminus of this base sequence : 371404
acaatgaacatccatataccctccaattagattcaataattgttaatgttttcccatatatagttttttaacagcccagatatccccaagttctcatactttctctatcatctatgtattaattatctatctatctatctatctatctatctatctatctatcttctatccatccatccactcatctgtccatattaggagttgacaaatcatggt

SEQ ID NO: 15253 - DNA, 466 bp, Homo sapiens
  chr9.fa.O7frz.87561948
  Located on chromosome 9
  Distance between a terminus base of telomere on chromosomal short arm and 5'-terminus of this base sequence : 78808637
  Distance between 3'-terminus of neighbour sequence of sequence listing upward to telomere on chrosomal short arm and 5'-terminus of this base sequence : 117824
attactctgaagtccatgcttcagaaggactctgaagtctttccttctttccttccctccttcccttcctccgtccctccctccctccatccctcactcccaaccttccttccagatgcatttaaatgcttacaatcctcccttccttcgtccctcccacctcttccccttcctttctttcttccttccttccttccttccttccttccttccttccttccttccttccttccacagatgcattttaaatgcttacagtgtaccagaaaatgtgctaggacgatggtcccagtatttatgaagggtacaatcttgtggaaaataagtaactaaacaaacggtcaggaattgaggcaatttctgtgaaggaaaagacagcattttgtgatcgagaagaacaggaggtacctctgtcccccactttagaaagagggagtaaggaagtgtaggatttgacaggttagca

SEQ ID NO: 15254 - DNA, 203 bp, Homo sapiens
  AL159996.7_12617
  Located on chromosome 9
  Distance between a terminus base of telomere on chromosomal short arm and 5'-terminus of this base sequence : 78981889
  Distance between 3'-terminus of neighbour sequence of sequence listing upward to telomere on chrosomal short arm and 5'-terminus of this base sequence : 172786
ggtagcttaggtgtcactttgtcccctaactgctttggatgtttctgcatccactcttaggttggtggaagtctgaggccctctctagatttctgctgaatatggggaatgtaagcgtgtgtgtgtgtgtgtgtgtgtgtgtgtgtgtaacacggggggccacattctcctgactttctctgcttatctgactttgttcactt

SEQ ID NO: 15255 - DNA, 262 bp, Homo sapiens
  D9S1812
  Located on chromosome 9
  Distance between a terminus base of telomere on chromosomal short arm and 5'-terminus of this base sequence : 78981897
  Distance between 3'-terminus of neighbour sequence of sequence listing upward to telomere on chrosomal short arm and 5'-terminus of this base sequence : -195
aggtgtcactttgtcccctaactgctttggatgtttctgcatccactcttaggttggtggaagtctgaggccctctctagatttctgctgaatatggggaatgtaagcgtgtgtgtgtgtgtgtgtgtgtgtgtgtgtgtaacacggggggccacattctcctgactttctctgcttatctgactttgttcacttgttgagtttgatggcatcattttgttcccaataagaaacatctttgcttccataatgaggaatgtac

SEQ ID NO: 15256 - DNA, 433 bp, Homo sapiens
  AL159996.7_35359
  Located on chromosome 9
  Distance between a terminus base of telomere on chromosomal short arm and 5'-terminus of this base sequence : 79004590
  Distance between 3'-terminus of neighbour sequence of sequence listing upward to telomere on chrosomal short arm and 5'-terminus of this base sequence : 22431
acaagtgcatagaaacgttaatttttcttctggcaggggaggacttacaagttttctaaatattttaaatgaaaggaaatctgagagatttagactaacttccttataatgggatattattcccttcatcctgaccctgtccctataacatacacatacacacacacacacacacacacacacactcgtcaccacatattgtttccctaatcatataaatcattcatgtggaaagccctcatgtattccagatatttcaacattgtttatgttgggctgaatttaggtgttatctttctttcctcactttttctttttggcatccaaatacttctctttagagataagctattattcaacaaatagagcttcaaataaaaacctgcccagttattctaaggtcaactgcctctgactcaagcagttgctaaat

SEQ ID NO: 15257 - DNA, 249 bp, Homo sapiens
  AL159996.7_62223
  Located on chromosome 9
  Distance between a terminus base of telomere on chromosomal short arm and 5'-terminus of this base sequence : 79031479
  Distance between 3'-terminus of neighbour sequence of sequence listing upward to telomere on chrosomal short arm and 5'-terminus of this base sequence : 26456
gacttgctgttattggatatttaggttgtttctgtttctctacctacatctatctatctatctatctatctatctatctatctatctatctatctatcatctcttatctatcatcttatctatctatctatcatctatctatctatctatctatctatctatctatctatctatctatctatctatgttttactagcctaaagagtattaaactcttttcttatagttaaatctttgtgtacatcctca

SEQ ID NO: 15258 - DNA, 207 bp, Homo sapiens
  D9S1680
  Located on chromosome 9
  Distance between a terminus base of telomere on chromosomal short arm and 5'-terminus of this base sequence : 79279871
  Distance between 3'-terminus of neighbour sequence of sequence listing upward to telomere on chrosomal short arm and 5'-terminus of this base sequence : 248143
aagacagtattaaaaaaacccaacaatttctcactccttatatatgtacatttacatatgtacacacacatagaaatacgtatatacatgtacacacataccacatacatatatatttatacacatatgtgtgtgtgtgtgtgtgtgtgtgtgtgtggtatttttcagttcacacctggaaagtgaaagtagtgctcccatttagct

SEQ ID NO: 15259 - DNA, 148 bp, Homo sapiens
  Z67411
  Located on chromosome 9
  Distance between a terminus base of telomere on chromosomal short arm and 5'-terminus of this base sequence : 79341327
  Distance between 3'-terminus of neighbour sequence of sequence listing upward to telomere on chrosomal short arm and 5'-terminus of this base sequence : 61249
tgcagtacattaacgcattgtgtgtgtgtgtgtgtgtgtgtgtgtgtgtgtaatgcagttttctctaagaacatgaaaatagtggaccatagagaggatagttggggaggccatgaaggacttgaaataccatccaaaggctgtaatt

SEQ ID NO: 15260 - DNA, 388 bp, Homo sapiens
  AL136367.4_142914
  Located on chromosome 9
  Distance between a terminus base of telomere on chromosomal short arm and 5'-terminus of this base sequence : 79486412
  Distance between 3'-terminus of neighbour sequence of sequence listing upward to telomere on chrosomal short arm and 5'-terminus of this base sequence : 144937
tagccatttcaccattacatagttttagaaaaataatcccaaatcctttaccttataaaagaaagaaaggaagaaagaaagaaagaaagaaagaaagaaagaaagaaagaaagaaagaaagaaagaaaagaaagaaaagaaagaagaaagaaagaaaaactgcctcaatattatgttcaggcctctattgttgtcaatgtttatgaaaaacaaatggccttcaattaatcatttgatgctggaaagggttgtaaggcctctcaagctatattagtgaataaatttctgtttatttaaccacaatttttagagaatagttgcaagactcctaaaagaatggcattgttctgggcaggggaggcagctttaggtactgtacagacctgaa

SEQ ID NO: 15261 - DNA, 450 bp, Homo sapiens
  AL136367.4_47206
  Located on chromosome 9
  Distance between a terminus base of telomere on chromosomal short arm and 5'-terminus of this base sequence : 79581780
  Distance between 3'-terminus of neighbour sequence of sequence listing upward to telomere on chrosomal short arm and 5'-terminus of this base sequence : 94980
cctgtcagcactccataatgtctgtcagcactccaaaatgtcgacgctgtaggtcactatttatttatttatttatttattatttttatttttttcttttttgagacggagtctcactctgttgccaggctggagtgcggtggcccgatctcggctcactgcaacctccgcttcccaggttcaagtgattctcttgcctcagcctccccagtagctaggattacaggcatgtgccaccacacccagctaatttttatatttttagtagagatggagtttcaccatattggccaggatggtctcgatctcttgacctcgtgatccacccgcctcggcctcccaaagtgctggaattacaggcgtgagccactgcgcccggccaggtcactatttagacacatgaaaatacacttgtgatatcagactcagtgagattagcagaatgcataa

SEQ ID NO: 15262 - DNA, 458 bp, Homo sapiens
  chr9.fa.O7frz.88687574
  Located on chromosome 9
  Distance between a terminus base of telomere on chromosomal short arm and 5'-terminus of this base sequence : 79706027
  Distance between 3'-terminus of neighbour sequence of sequence listing upward to telomere on chrosomal short arm and 5'-terminus of this base sequence : 123797
cacctgcagtccaagttacttgggaggctgaggtaggaggattacctgagtccaggaggtagaggctgcagtgagccatagtcacaccactgcactccggcctgggcaacagagtgagaccctgttggaaggaaggaaggaaggaaggaaggaaggaaggaaggaaggaaggaaggaaggaaggaaggagggagaaggcaaagaaagagaaagaaagaaggggaaagaaaggaagaaagaaatgaaggaaggaaagaaaggaggggaggggaggggaagggaggggaggagggggaggagaggggaggagagggggtccaccccaagactgaagtccctccctggatccttggctgtccattgctgagtccttctctagaggccagagttccctgcccagttggagtcctagttattaaataaaaccttctctggtacacttctgtgattcagaactc

SEQ ID NO: 15263 - DNA, 447 bp, Homo sapiens
  chr9.fa.O7frz.88799307
  Located on chromosome 9
  Distance between a terminus base of telomere on chromosomal short arm and 5'-terminus of this base sequence : 79820628
  Distance between 3'-terminus of neighbour sequence of sequence listing upward to telomere on chrosomal short arm and 5'-terminus of this base sequence : 114143
gctactgagcactcagatagtaagactgaggaactgcatttttaatttttgtggactttagttaatttaagactaatttaaatagctacatgtattaggattctccggagaaacagaaccataagtgtgtgtggagagagagagagtgtgtgtgtgtgtgtgtgtgtgtgtgcgtgtgtgtagaggaggggattgattttaaggaattggcttctgtgattgtggagggtggcaagtccagaatttgctggggtagtcggggcaggggtgggggtgcagggtggagatcggggaggagttgaggcctcatctggactctgaaggccatctgctggcagaattccctctgcaggccttccactgataggatgatcccacccacccctattagggagagtggttggctttactcagagtctgctgatttagatgttaatctcctggtaa

SEQ ID NO: 15264 - DNA, 265 bp, Homo sapiens
  D9S257
  Located on chromosome 9
  Distance between a terminus base of telomere on chromosomal short arm and 5'-terminus of this base sequence : 79949028
  Distance between 3'-terminus of neighbour sequence of sequence listing upward to telomere on chrosomal short arm and 5'-terminus of this base sequence : 127953
acaggtaaatacattctaccctacacacacacacacacacacacacacacacacacacacacacacacacccttatgaccacctggaaggttctgagtcagaattctgcgctccttggagttcggttctgcctcctcctctccccagcctggtctcgccctgactgcaggaggtcttgcccacaccctggatgccccaggtctcctgagtaccctccagccacacccacagacctaggggacacacactggagagcacttcaaac

SEQ ID NO: 15265 - DNA, 428 bp, Homo sapiens
  chr9.fa.O7frz.89025148
  Located on chromosome 9
  Distance between a terminus base of telomere on chromosomal short arm and 5'-terminus of this base sequence : 80000122
  Distance between 3'-terminus of neighbour sequence of sequence listing upward to telomere on chrosomal short arm and 5'-terminus of this base sequence : 50829
tgtagttccagctattcaagaggctgaggaagaatggcttgaacccgggaggcagaggttgctgtgagccgatatcgcgccgttgaactccagcctgggccacagagcaagactccatctcaaaaaataaataaataaataaataaataaataaataaataaataggagagattggaaaacttatctcagcttttggtgtttgttagtcaggaagatgtgtgaaggcctcctaactcttggggatctctttgtccctacttgggaatcccaccttatcattagtgaggttttgcctgggcacgaaacctggattttttgcgattggtacaaaacctggatcaaccgtttcccggtttcctagttgttgccttaagcttctcacacacaaggtagtttcataccgttctcataacctaaattgtcatcg

SEQ ID NO: 15266 - DNA, 245 bp, Homo sapiens
  HUMUT556
  Located on chromosome 9
  Distance between a terminus base of telomere on chromosomal short arm and 5'-terminus of this base sequence : 80128641
  Distance between 3'-terminus of neighbour sequence of sequence listing upward to telomere on chrosomal short arm and 5'-terminus of this base sequence : 128091
acccactgtatcctgggcagtcaccggtcaaggagatatgccccttccccgtttgcttttcttttcttcccttctcttttcttctttttgcttctcttttctttctttctttctttctttctttctttctttttctttttctctcttcccctctttctttcctgccttcctgcctttcttcttttcttctttcctcccttcctcccttccttctttcctcccgcctcagcctcccaaagtgctgg

SEQ ID NO: 15267 - DNA, 243 bp, Homo sapiens
  HUMUT976
  Located on chromosome 9
  Distance between a terminus base of telomere on chromosomal short arm and 5'-terminus of this base sequence : 80128658
  Distance between 3'-terminus of neighbour sequence of sequence listing upward to telomere on chrosomal short arm and 5'-terminus of this base sequence : -228
cagtcaccggtcaaggagatatgccccttccccgtttgcttttcttttcttcccttctcttttcttctttttgcttctcttttctttctttctttctttctttctttctttctttttctttttctctcttcccctctttctttcctgccttcctgcctttcttcttttcttctttcctcccttcctcccttccttctttcctcccgcctcagcctcccaaagtgctgggatgactggcgggag

SEQ ID NO: 15268 - DNA, 289 bp, Homo sapiens
  HUMUT740
  Located on chromosome 9
  Distance between a terminus base of telomere on chromosomal short arm and 5'-terminus of this base sequence : 80128663
  Distance between 3'-terminus of neighbour sequence of sequence listing upward to telomere on chrosomal short arm and 5'-terminus of this base sequence : -238
accggtcaaggagatatgccccttccccgtttgcttttcttttcttcccttctcttttcttctttttgcttctcttttctttctttctttctttctttctttctttctttttctttttctctcttcccctctttctttcctgccttcctgcctttcttcttttcttctttcctcccttcctcccttccttctttcctcccgcctcagcctcccaaagtgctgggatgactggcgggaggcaccatgcctgcttggcccaaagagaccctcttggaaagtgagacgcaga

SEQ ID NO: 15269 - DNA, 412 bp, Homo sapiens
  chr9.fa.O7frz.90186880
  Located on chromosome 9
  Distance between a terminus base of telomere on chromosomal short arm and 5'-terminus of this base sequence : 80223660
  Distance between 3'-terminus of neighbour sequence of sequence listing upward to telomere on chrosomal short arm and 5'-terminus of this base sequence : 94708
ttatgtcttgtgatcttcctaaactcagttattagttttggtagtttgttgttgaatctatagaattttctgcataaaaataaaacatgtaatcttcaaattaaagaattttacttcttccatttaaataagatcactttctatatcttatttttattggctagaatggctaggatctctaatacattgttgaataagaatgaaagggtggtcatttttgctgtgtcctgatattagaagaagagcgtgtgtgtgtgtgtgtgtgtgtgtgtgtgtgtgtgtgtgtgtgtgtggtattgcaaaataaatttatttgaagataaaatgtcttataaaaggtcagaggcaattcgagatcccagattcagcttgtctcataaaaagattcaacttcaagtagcacaatttcttg

SEQ ID NO: 15270 - DNA, 338 bp, Homo sapiens
  AL353726.2_150917
  Located on chromosome 9
  Distance between a terminus base of telomere on chromosomal short arm and 5'-terminus of this base sequence : 80440501
  Distance between 3'-terminus of neighbour sequence of sequence listing upward to telomere on chrosomal short arm and 5'-terminus of this base sequence : 216429
ataggagcataagtcacaggtcctgcccagagttgaggggaggggagtatccaaaggtgtcaacaccagcaggtacagttcactggggatcatcttagggtcttatcaccacatctatatttagaaaatcgaataggattatatagaagataccagaatgtatcacatgtaataggagtatgtacttctaaataaaaattgtatttagtaatgtaaattgtgtgtgtgtgtgtgtgtgtgtgtgtgtgatgaaaatgtatttcttaccaatggtctagagcaaaacagtctgaaagcccctgacctgggaggttttcttgcaaacactgaagataaga

SEQ ID NO: 15271 - DNA, 404 bp, Homo sapiens
  AL353726.2_164132
  Located on chromosome 9
  Distance between a terminus base of telomere on chromosomal short arm and 5'-terminus of this base sequence : 80453718
  Distance between 3'-terminus of neighbour sequence of sequence listing upward to telomere on chrosomal short arm and 5'-terminus of this base sequence : 12879
ttaaattggatgtctagtgagaaggtctagcatggcggatgctgcggctactggtccaggaagcacattttgagaaccactcagctagaagattattgcattcatccaggtgagagaagatgaatctgaaataaggcaatggtgaaagaggcaggacaaatctgagaaatatttaggagtattattacaattctccaaagaaacagaacaaatagaatgtgtgtgtgtgtgtgtgtgtgtgtgtagagatttattatgaggaattggctcacaggattatggaggctgagaagactcatggtctactgcctgcaagctggagactcaggaaagttgatggtgtacttcaaaggcctgagggcgtgaaagccagtgatgtagattcgtagattccagtctaagtt

SEQ ID NO: 15272 - DNA, 176 bp, Homo sapiens
  chr9.fa.O7frz.90511503
  Located on chromosome 9
  Distance between a terminus base of telomere on chromosomal short arm and 5'-terminus of this base sequence : 80646016
  Distance between 3'-terminus of neighbour sequence of sequence listing upward to telomere on chrosomal short arm and 5'-terminus of this base sequence : 191894
aagtttcaagctttaagaccagggtcggtttctatgtttatccaaagactgtctatgggacaattggattggtttcatttacaaaatgagctaactgaaacagtgtggaacagtatttctctctctctctctctctctctctctctcttttttgagacagcatcttatgctattgc

SEQ ID NO: 15273 - DNA, 225 bp, Homo sapiens
  AL158076.5_153088
  Located on chromosome 9
  Distance between a terminus base of telomere on chromosomal short arm and 5'-terminus of this base sequence : 80749608
  Distance between 3'-terminus of neighbour sequence of sequence listing upward to telomere on chrosomal short arm and 5'-terminus of this base sequence : 103416
gcaattagtttacttgatttcaagactcataatatagctacagcaatcaagttgtttggtattggtagagggatagagacatagattaaagtaacataacataacataacataacataacataacataacataacataacataacataacatagacctaggaatagacccacataaatatgcccaaccgactgggcaaaagcaattcaacagaggaaagataacc

SEQ ID NO: 15274 - DNA, 255 bp, Homo sapiens
  chr9.fa.O7frz.90794780
  Located on chromosome 9
  Distance between a terminus base of telomere on chromosomal short arm and 5'-terminus of this base sequence : 80929116
  Distance between 3'-terminus of neighbour sequence of sequence listing upward to telomere on chrosomal short arm and 5'-terminus of this base sequence : 179283
aactccttacctcaggtgatccacccgcctcggcctcccaaagtgctgggattacaggcatgagccaccgtgcccggcctaattatgatatttttaatcacacattcttgggaactgggtggacatctcttgcatgtagagtatccataaactgagtgttcgtgtgtgtgtgtgtgtgtgtgtgtgtgtgagaaccacaaccacacacttttaaaaggtagagaaacggccctcctggtaaacgtgcttgtaact

SEQ ID NO: 15275 - DNA, 194 bp, Homo sapiens
  Z67220
  Located on chromosome 9
  Distance between a terminus base of telomere on chromosomal short arm and 5'-terminus of this base sequence : 80977123
  Distance between 3'-terminus of neighbour sequence of sequence listing upward to telomere on chrosomal short arm and 5'-terminus of this base sequence : 47752
tgacacccttcagccagattctccaatttttcacattttaccatatttgcctcatcattccttctctctgtagatagagatgcaattgtaaacacacacacacacacacacacacacaggtcttttttaattcacaacacttctgactcacaccagtgtgttggttttttccacaccaacgaccaagggttctg

SEQ ID NO: 15276 - DNA, 145 bp, Homo sapiens
  D9S906
  Located on chromosome 9
  Distance between a terminus base of telomere on chromosomal short arm and 5'-terminus of this base sequence : 81301845
  Distance between 3'-terminus of neighbour sequence of sequence listing upward to telomere on chrosomal short arm and 5'-terminus of this base sequence : 324528
gcttccataattgggtgaaacaatccatcatatatctatctatctatctatctatctatctatctatctatctatctatctatctatcctattggttctatttctctggaaaatcctgactaatgcagcctgaagccagtatgtc

SEQ ID NO: 15277 - DNA, 180 bp, Homo sapiens
  D9S1820
  Located on chromosome 9
  Distance between a terminus base of telomere on chromosomal short arm and 5'-terminus of this base sequence : 81548922
  Distance between 3'-terminus of neighbour sequence of sequence listing upward to telomere on chrosomal short arm and 5'-terminus of this base sequence : 246932
agtttaggaatcctgttttgcccaaacacaatgaaaaggaaaggaaatgagaatatatgggtatatgtatgaagtgtgtgtgtgtgtgtgtgtgtgtgtgtgagagagagagagagagagaagcaaattagaatgaaaagatgcacttgaaaaaatccattggcctgactttaaatgttc

SEQ ID NO: 15278 - DNA, 240 bp, Homo sapiens
  D9S1797
  Located on chromosome 9
  Distance between a terminus base of telomere on chromosomal short arm and 5'-terminus of this base sequence : 81678911
  Distance between 3'-terminus of neighbour sequence of sequence listing upward to telomere on chrosomal short arm and 5'-terminus of this base sequence : 129809
agctatctcagttatcagatcaaagaaacattttatatatacacacacacacacacacacacacacacacatacatacacacatacatggaccagcactatcctaggtttcaggcacttactgagtatcttggaacagatccctcgtgtataaagggggactactgtgttatattttttgacttaccagtttcctggaacagaaaatacatgtttagagaaggctgaattgataaatgtg

SEQ ID NO: 15279 - DNA, 287 bp, Homo sapiens
  G08732
  Located on chromosome 9
  Distance between a terminus base of telomere on chromosomal short arm and 5'-terminus of this base sequence : 81743466
  Distance between 3'-terminus of neighbour sequence of sequence listing upward to telomere on chrosomal short arm and 5'-terminus of this base sequence : 64315
caacagagggagaacctgtctataaaaatagaaagagagatagatagatagatagatagatagatagatagatagatagatagataaaaataattagagaacaggaaatagctatggttttctgtttgattcagagtttcacctctttataaaatgcttagctacattttcctgtgtcctcatatttcagtgcacctgcctcaatcattttattaaaatgcttttatgtctaactaaacatccccctttgtttactattctccttcctttattgcaaccagcacaga

SEQ ID NO: 15280 - DNA, 204 bp, Homo sapiens
  Z66858
  Located on chromosome 9
  Distance between a terminus base of telomere on chromosomal short arm and 5'-terminus of this base sequence : 81889933
  Distance between 3'-terminus of neighbour sequence of sequence listing upward to telomere on chrosomal short arm and 5'-terminus of this base sequence : 146180
aaactgtgtttcagtctctaacttcagtttcttagcattctatggcctctgaacaaaatctactaatatgaaagcattagtgggagacacacacacacacacacacacacacacacgtattcccatccaaatattccttcagaaaatattgcaattcaggaatgtgatgcctttcctggggtaagtctagcccagtttgtctgt

SEQ ID NO: 15281 - DNA, 247 bp, Homo sapiens
  DISO7_00000031
  Located on chromosome 9
  Distance between a terminus base of telomere on chromosomal short arm and 5'-terminus of this base sequence : 82007279
  Distance between 3'-terminus of neighbour sequence of sequence listing upward to telomere on chrosomal short arm and 5'-terminus of this base sequence : 117142
tatgcccatgacaattgggatctctccccagggtctctcccaggagacgcatgagatcctggaggcttccttggtccctgcagatgaagagagaaggcttccatcctccagtatatcctggttgctactggcatcagcactgcaaaaaccttgtgtggtcagttacatcccagaagtgtgtgtgtatgtgtgtgtgtgtgtgtgtgtgtgtgtgtgtgtgatatttgggcactgacagtttggcgat

SEQ ID NO: 15282 - DNA, 369 bp, Homo sapiens
  AL354853.9_74302
  Located on chromosome 9
  Distance between a terminus base of telomere on chromosomal short arm and 5'-terminus of this base sequence : 82021960
  Distance between 3'-terminus of neighbour sequence of sequence listing upward to telomere on chrosomal short arm and 5'-terminus of this base sequence : 14434
ttagatgactcaactgcatgtattcagggcacgatggtctcccttacatagcactgatcactctggaaatttcccatgcaatttagaattatttgattaatgcctgtctataagattctgttgtgtgggggatgtgcatgtggtgtttgtgtgtgtgggaatatgtgtgttgtatgggggatgtgtgtgtgtgtgtgtgtgtgtgtgctgtgatgtgtatctaggagaaagaagtgataaataatactcaagtctcggcagtgtatattttatcagctgctagtagaagatggattgggttgggtttttgtttttgacttttatttttattttttaggttttgctattacattgtcctaggagactgta

SEQ ID NO: 15283 - DNA, 434 bp, Homo sapiens
  chr9.fa.O7frz.92031249
  Located on chromosome 9
  Distance between a terminus base of telomere on chromosomal short arm and 5'-terminus of this base sequence : 82090153
  Distance between 3'-terminus of neighbour sequence of sequence listing upward to telomere on chrosomal short arm and 5'-terminus of this base sequence : 67824
ataagtagcagtcagcattcaggtttatacaagggacagtttgcacattttcctctgtataaactaataaagaaaggagaaaatgagaaagaaaataaagaaagaaagaagaaagaaatgaagaaagaaagaaagaaagaaagaaagaaagagacagaggaaagaaagaaagaagaaagagaaagagagagagagaaagaaagaaagaacgaaaaaaagaaagaaagaaagaaagaaagaaagaaagaaagaaagaaagagaaatcccctcttactatcctagctcttcatagatgtgatagagactgtttaccagccttactttctctctgataatatagttagactgtattttcattcttcctttgcaattagatgtggccattgggctgtgtcccagcaaatggaatgtgaatagaagtggtatgtactcc

SEQ ID NO: 15284 - DNA, 469 bp, Homo sapiens
  AL354853.9_174388
  Located on chromosome 9
  Distance between a terminus base of telomere on chromosomal short arm and 5'-terminus of this base sequence : 82122119
  Distance between 3'-terminus of neighbour sequence of sequence listing upward to telomere on chrosomal short arm and 5'-terminus of this base sequence : 31532
attaaagatatcctgttggaagtcacacatctttatggatgatattgtatgattgagtgtccttttgcttttttaatgtgtctacttgtgaatgtatgtatatatatatatgtatatatatatatatatatatacagagagagaaaaagagagagagagagatggaaagagagagaaagagctactgtacatccatttggcaataaaactagatggaatagaaataaattctaaaaattgtcacatccatttactttgctgggcagaatgcagtgcagggcctggatagattgtgggtatctatttggttctagcaaaaggttgtcatatattgcagagaatattttattttttaagtaatttagagtcattttattagttaacatgaataatagcaccatgaaaataatttcttgttacagagttttcttatgagattttcagttttatttcattctactctggcaac

SEQ ID NO: 15285 - DNA, 404 bp, Homo sapiens
  chr9.fa.O7frz.92119226
  Located on chromosome 9
  Distance between a terminus base of telomere on chromosomal short arm and 5'-terminus of this base sequence : 82178290
  Distance between 3'-terminus of neighbour sequence of sequence listing upward to telomere on chrosomal short arm and 5'-terminus of this base sequence : 55702
tctttgctgttttacctgaagtactgagtacccaatatactggtcatcataatgtgtgtgtgtgtgtgtgtgtgtgtgtgtgtgtgtgtgtgtgtgtgtgagaaatactgggagagggagatgaatgagggaaaaggatgttctaatatttattcagtgtttatattaactcatgaaatcctcaccactctgcaggagttggtgccattagctctgttgtacaatgatgaaactggaaacaaggaagagatcgggaatggaatgtctctgatgttacacagcaataagagggaaggctaggatacaaccaaagcattgtggatgtcaatgcccatcccataagctgtctgtagacagagctggtcccagtgacttgggcgttactcaggccatagtatagattg

SEQ ID NO: 15286 - DNA, 433 bp, Homo sapiens
  chr9.fa.O7frz.92606222
  Located on chromosome 9
  Distance between a terminus base of telomere on chromosomal short arm and 5'-terminus of this base sequence : 82556865
  Distance between 3'-terminus of neighbour sequence of sequence listing upward to telomere on chrosomal short arm and 5'-terminus of this base sequence : 378171
cattcctgatgaccaaactacttgtgatgcttgagtcacaaaaacaacacttgtatcatcagtctgcattcatgacttgggcattcaaaatgattatctctgtgtgtgtgtgtgtgtgtgtgtgtgtgtgtgtgtgtgtgtgtgtgtgtatttatttcaaaatgtcaaatatagaaacaaatttttagttgaatattggtttccttttttcaaattaaacctttttattttaagtagttacaataatctattaatagttatctctttgtctcctagtgatatactctctcttcttttttttgttatactttaagttctggggtacatgtgcagaacttgcaggtttgttatataggtatacaagtgtcatggtggtttgctgcatccatcaacccgtcatctacattaggtatttctcctaatgctatccttc

SEQ ID NO: 15287 - DNA, 160 bp, Homo sapiens
  D9S1796
  Located on chromosome 9
  Distance between a terminus base of telomere on chromosomal short arm and 5'-terminus of this base sequence : 83042048
  Distance between 3'-terminus of neighbour sequence of sequence listing upward to telomere on chrosomal short arm and 5'-terminus of this base sequence : 484750
gccatgtattgggtcttgattggtaaaatatgtaacatataaatgtgtgtgtgtgtgtgtgtgtgtgtgtgtgtgtgtgtgagagagagagagagagagagagagagagaaatactgaattcccatgatccatttgtttgtttgaaggtccaatatccgt

SEQ ID NO: 15288 - DNA, 145 bp, Homo sapiens
  D9S1842
  Located on chromosome 9
  Distance between a terminus base of telomere on chromosomal short arm and 5'-terminus of this base sequence : 83093166
  Distance between 3'-terminus of neighbour sequence of sequence listing upward to telomere on chrosomal short arm and 5'-terminus of this base sequence : 50958
tgaaactgtctgtccatgtcatacatgcatgtgtgtgtgcgtgtgtgtgtgtgtgtgtgtgtgagcatactacttctgacccccgccccccaggccctccagctggagcactctgttgctcttgattgttagcaggtcccagata

SEQ ID NO: 15289 - DNA, 462 bp, Homo sapiens
  AL353645.3_101281
  Located on chromosome 9
  Distance between a terminus base of telomere on chromosomal short arm and 5'-terminus of this base sequence : 83400395
  Distance between 3'-terminus of neighbour sequence of sequence listing upward to telomere on chrosomal short arm and 5'-terminus of this base sequence : 307084
ttccactgtagtatgtttatggaccaccttgtgtctttttattaaactccaggaacagaagttcagtttctgggaatccatagcataccgtttttgttgttgttgttgttgttgttgttgtttttgtttttgagacagggtcttgctctcttgcccacactggagggcagtggagtgatcacggctcactgcagccttgacccccccaggctcaagcaaacctccaacctcagccttccaagtagctgggattacaggtgcacactaccatgcctggctaattttttaattttttttttgttagagtcagtgtctctctatgttgcccaggctggtctcaaactcctgggctcaagcaatcctcccaccttggcctcccaaagtgctggaattacaggtgtgagtcacagcaccagacctgttttgttttcaagtggaggctttaagatgtgagctagcatg

SEQ ID NO: 15290 - DNA, 483 bp, Homo sapiens
  AL353645.3_94104
  Located on chromosome 9
  Distance between a terminus base of telomere on chromosomal short arm and 5'-terminus of this base sequence : 83409057
  Distance between 3'-terminus of neighbour sequence of sequence listing upward to telomere on chrosomal short arm and 5'-terminus of this base sequence : 8200
tcctgcaaacaggatacagccaccttcacaggcactgccccagggaaagagcctgcatgatctccatttcttcacattaccattttctgattaagatttgaaggtggggccgggcgcggtggctcacgcctgtaatcccagcactttgggaggccgaaggcgggcggatcgcgaggtcaggtgatagagaccatcccggctaacacggtgaaacctcgtctctactaaaaatacaaaaaattagccgggcgtggtggcgggcacctttagtttcagctactccggaggctgaggcaggagaatggcgtgaatccgggtggcggagcttgcagtgagtcgagatggcgccactgcactccagcctgggcgacagagcaagactctgcctcaacaacaacaacaacaacaacaacaacaacaacaacaacaacaaagagttgaaggtggggagctaaggaggagttaagtatgtctgattggcag

SEQ ID NO: 15291 - DNA, 240 bp, Homo sapiens
  D9S1815
  Located on chromosome 9
  Distance between a terminus base of telomere on chromosomal short arm and 5'-terminus of this base sequence : 83610073
  Distance between 3'-terminus of neighbour sequence of sequence listing upward to telomere on chrosomal short arm and 5'-terminus of this base sequence : 200533
agggatgactgaagcctggagtagaaagaaaaaaatgttttactttttcattctgagagtgtaatttgttccaccataagtagtttgttcctgaatgttctcccaacattccccaaaccagtctcactcccctgtaaaacacagacacagacacacacacacacacacacacacacacacacacacactttgaaatgccagcatttgttcttttgttttctgcatcaggtccctaaaatg

SEQ ID NO: 15292 - DNA, 160 bp, Homo sapiens
  D9S1781
  Located on chromosome 9
  Distance between a terminus base of telomere on chromosomal short arm and 5'-terminus of this base sequence : 83634964
  Distance between 3'-terminus of neighbour sequence of sequence listing upward to telomere on chrosomal short arm and 5'-terminus of this base sequence : 24651
ggtccttacctaattgccaaatttcttggtgaggttactcctggtttaacattgactcttatatcccaagtgaagaaaatgtatgtgtgtgtgtgtgtgtgtgtgtgtgtgtgtgtgtgtgtgtaaaagagaagtgaaatgtcacttctctattaggtgg

SEQ ID NO: 15293 - DNA, 358 bp, Homo sapiens
  AL160054.5_63624
  Located on chromosome 9
  Distance between a terminus base of telomere on chromosomal short arm and 5'-terminus of this base sequence : 83796637
  Distance between 3'-terminus of neighbour sequence of sequence listing upward to telomere on chrosomal short arm and 5'-terminus of this base sequence : 161513
ggtgtgcacctgtagtcacagctattcagaaggccgaggtgggaggatcagttaagcctgggaggttgaggcagcagtgagctgtggtcaagccactcactccagcctgggtgacagagcaagactccgtctcaaaataaaaataaagataaaaataaataaataaataaataaataaataaataataattttgttagagacaaagtctcactatgttacccaggctggtctcaaactcctggctgcaagcactcctcgcatcttggcctcacaaagcactgggattacaggtgtgaaccactgcacctggctaagacttctttatatattctggatcctagacctttactggctata

SEQ ID NO: 15294 - DNA, 183 bp, Homo sapiens
  HUMUT2399
  Located on chromosome 9
  Distance between a terminus base of telomere on chromosomal short arm and 5'-terminus of this base sequence : 83804498
  Distance between 3'-terminus of neighbour sequence of sequence listing upward to telomere on chrosomal short arm and 5'-terminus of this base sequence : 7503
gctgatgaggatatggccatttatctagtgtggcaagctatggatagatgatagatagatagatagatagatagatagatagatagatagatagataagaaaacaaactccaaatcctgattttggggggtaatccaatatctggggtttggggagaggagaaggagtcacccaaagcaagga

SEQ ID NO: 15295 - DNA, 271 bp, Homo sapiens
  D9S278
  Located on chromosome 9
  Distance between a terminus base of telomere on chromosomal short arm and 5'-terminus of this base sequence : 83850704
  Distance between 3'-terminus of neighbour sequence of sequence listing upward to telomere on chrosomal short arm and 5'-terminus of this base sequence : 46023
tttttggagacacagaaccaataggatatgtgtgtgtgtgtgtgtgtgtgtgtgtgtgtgtgtgtgtgtgtgtgcatgttctgtctggctgaactcctggtggaggcaccccaaaaacagtggcaagggagttcccataagcgactctgactcagggtagagggttcgtttttacatgtttagcaacatgtttgatcttttcatgttttgggcacaaccttaacaactttatcagtgcctgggaacattcaaagtgtccgcatgagttcga

SEQ ID NO: 15296 - DNA, 400 bp, Homo sapiens
  AL160054.5_130013
  Located on chromosome 9
  Distance between a terminus base of telomere on chromosomal short arm and 5'-terminus of this base sequence : 83858252
  Distance between 3'-terminus of neighbour sequence of sequence listing upward to telomere on chrosomal short arm and 5'-terminus of this base sequence : 7277
tatcacttccttggttaagtttactcgtaagtattttattatttttgatactattataaatgaaattgttttcttaatttcctttttggattgttcatttttagtgtacagaaacaccactgacttttggatgttaactttgtatcctgcaacgtttctgaatttgattattagttctaacgtgtgcgtgtgtgtgtgtgtgtgtgtgtgtgtgtgtataatccttaagattttctacatataagatcacatcatctgcaaacagggataattgtactacttcctttcctatgtttatgccttttatttcttttccttgactaatttctctggctagaacttctagtactatattgagtagaagtggtgaaagctggcgtccttgctaagctcttagtct

SEQ ID NO: 15297 - DNA, 432 bp, Homo sapiens
  chr9.fa.O7frz.89764119
  Located on chromosome 9
  Distance between a terminus base of telomere on chromosomal short arm and 5'-terminus of this base sequence : 84103955
  Distance between 3'-terminus of neighbour sequence of sequence listing upward to telomere on chrosomal short arm and 5'-terminus of this base sequence : 245303
catgaagttggccaaatatcactgctggcaacattgcttgacttctacccatagaaaggtgctgggtattagtcagggtcctctagaggagcagaaccaataggatgcgtgtgtgtgtgtgtgtgtgtgtgtgtgtgtgtgtgtgtgtagacagagatactgatttattttaaggaactggctcatgtgatagtgaaggctgacaagtacaaaatctgcagggcaggccagcaggttggagaccagggaagagtggaagacttgatgcttcagctggagtccaaaggcaaaggcagtctgggggcagaattccctcctcctagggagaggtcggttttcccctaaggccttcaactgactgcatgagatccacccacattacagaaaggaacctgcttcactcaaaatctactggttgaaatgttaatcaac

SEQ ID NO: 15298 - DNA, 436 bp, Homo sapiens
  chr9.fa.O7frz.89861756
  Located on chromosome 9
  Distance between a terminus base of telomere on chromosomal short arm and 5'-terminus of this base sequence : 84253511
  Distance between 3'-terminus of neighbour sequence of sequence listing upward to telomere on chrosomal short arm and 5'-terminus of this base sequence : 149124
gaagtctttggacctcaaatagtcaacatttttgttgctgttcctcctgttaatggtgtctttggaacatgatttccccaaaaacctaattgatttctggtccattagcttccattcaggttcaaacctcagtcactatgcccataacatgtgtgtgtgtgtgtgtgtgtgtgtgtgtgtgttttttcctgaatatagactcaaacctttctgtattataatgtttactcacccttattcctcttcttctcaactttctggaggctctcaggcttgtgtgggaatggcataccctcactatgatctttctctttaatcactgagaaagatttatagctgttgttgaacaaattattttcaagtctcgtcttattgtttgtgatctgaaagcagttggctcttccaaccctgcagtgactagaatgtttggactttc

SEQ ID NO: 15299 - DNA, 221 bp, Homo sapiens
  DISO7_10002732
  Located on chromosome 9
  Distance between a terminus base of telomere on chromosomal short arm and 5'-terminus of this base sequence : 84302985
  Distance between 3'-terminus of neighbour sequence of sequence listing upward to telomere on chrosomal short arm and 5'-terminus of this base sequence : 49038
aaactcaagtccacctggtcctctctctctctctctctttctctcctctctctcctactttgtccctccctttctctctgtctctctctctctccttctctccttctctctccttttctctccatctctctctctctctttctctgtctctccctttctctctgcctctgtttctctctccctctccccactccagctctaaagggatggctcctctatga

SEQ ID NO: 15300 - DNA, 187 bp, Homo sapiens
  DISO7_10002736
  Located on chromosome 9
  Distance between a terminus base of telomere on chromosomal short arm and 5'-terminus of this base sequence : 84546141
  Distance between 3'-terminus of neighbour sequence of sequence listing upward to telomere on chrosomal short arm and 5'-terminus of this base sequence : 242935
catcgttcatggaagtttatgttattatattgagggaacaaattttgaaaaaaaagttagtatgaatacattttaccaaaactaaataactgtgtccgtgtgtgtgtgtgtgtgtgtgtgtgtgtgtgtgtgtgtgtgtgtgtagagaaactcaagtttgaaaaggtagacatcaaactgttaccag

SEQ ID NO: 15301 - DNA, 115 bp, Homo sapiens
  DISO7_10002738
  Located on chromosome 9
  Distance between a terminus base of telomere on chromosomal short arm and 5'-terminus of this base sequence : 84568001
  Distance between 3'-terminus of neighbour sequence of sequence listing upward to telomere on chrosomal short arm and 5'-terminus of this base sequence : 21673
catctggattcagttgaaagggcagagttacaaataaatggaaaacacacaaacacacacacacacacacacacacacccacacacacaatgtaagtccataagaagtcggtaaa

SEQ ID NO: 15302 - DNA, 97 bp, Homo sapiens
  DISO7_10002737
  Located on chromosome 9
  Distance between a terminus base of telomere on chromosomal short arm and 5'-terminus of this base sequence : 84583055
  Distance between 3'-terminus of neighbour sequence of sequence listing upward to telomere on chrosomal short arm and 5'-terminus of this base sequence : 14939
gtttacaagttcctgagaccacccatgagctgtgtgtgtgtgtgtgtgtgtgtgtgtgtgtgtgtgtgtgtgtgtatctgaccctaagcagatgttg

SEQ ID NO: 15303 - DNA, 466 bp, Homo sapiens
  chr9.fa.O7frz.93800052
  Located on chromosome 9
  Distance between a terminus base of telomere on chromosomal short arm and 5'-terminus of this base sequence : 84690488
  Distance between 3'-terminus of neighbour sequence of sequence listing upward to telomere on chrosomal short arm and 5'-terminus of this base sequence : 107336
tcgtctagatacttgagaatacagtaacaaaaatattatccccggccgggcgtggtggctcatgcctgtaatcccagcactttaggaggccaagatgggcagatcacctgaggtcaggagttcaagaccagcctgaccaacaaggtgaaaccccgtctctactaaaaatacaaaattaaccaggcgtggtggtgcatacctgtaatcccagctacttgggaggttgaggcaggagaatcgcttgaacctgggaagtggaggttgcagtgagccgagatcatgccattgcactccagcctgggcaacaagagtgaaactccttctcagaccaaaacaaaacaaaacaaaacaaaacaaaacaaaacaaaaaaagaccttcaactgattagatgaggcccacccccattatgaagggaaatgggctttatgatgaagggaaattctgctttacttgaagtctactgat

SEQ ID NO: 15304 - DNA, 218 bp, Homo sapiens
  AL354751.7_99647
  Located on chromosome 9
  Distance between a terminus base of telomere on chromosomal short arm and 5'-terminus of this base sequence : 84876012
  Distance between 3'-terminus of neighbour sequence of sequence listing upward to telomere on chrosomal short arm and 5'-terminus of this base sequence : 185058
ggacacgctaagatatgcatacacaggcacacatgtacatagttgcacaaatgcatacatatgtacaaagatgcacacattgatacacacatgcacatgtgtgcctacacacacacacacacacacacacacacacagtaccactaccaccaccaaggaagtccaacattgtagaacaaccaggggaagaaagcccgtcaactgagtagacagcaagc

SEQ ID NO: 15305 - DNA, 425 bp, Homo sapiens
  AL354751.7_101061
  Located on chromosome 9
  Distance between a terminus base of telomere on chromosomal short arm and 5'-terminus of this base sequence : 84877400
  Distance between 3'-terminus of neighbour sequence of sequence listing upward to telomere on chrosomal short arm and 5'-terminus of this base sequence : 1170
agactgtttgccacttgaatatagaacaataaaattacccaatctaaataatagtcagaaaatagaccaaacaaatgaacagagcttcagggatgtagaacaataaaattactcaacctatagtcagaaaatacacacacacacacacacacacacacacacacacacacacacacacacaaaatgaacagagcttcagggcctgtaggacaataagaaaagttctaaagtttgtgtcaacagtcctggaagagaagaagggagagggtgggtgcggaaagtacacaaagaaagagtgtctgaacacttcccaaatttggcaaaggacaaaactatagattcaagaagctgagcaaatcttaaatgggataaatggaaagaaatccacattaagacacattatagtcaaacttatgaaatgcaca

SEQ ID NO: 15306 - DNA, 260 bp, Homo sapiens
  AL136097.10_117669
  Located on chromosome 9
  Distance between a terminus base of telomere on chromosomal short arm and 5'-terminus of this base sequence : 84998169
  Distance between 3'-terminus of neighbour sequence of sequence listing upward to telomere on chrosomal short arm and 5'-terminus of this base sequence : 120344
gcctaggtgacagactgaaatcccttctctaaaaataaataaataaaagttttaagccaatacatatatatgtatacttacatatatacatacacacacatatatatatatatatatatattttttttttttgagacagagtctaactctgtcacccaggctggagtgcagtagcacactttcggctcactgcaacctcaacttcctgggctcatgtcattctcttacttcagcctgtggagtagttggaactaaaggtt

SEQ ID NO: 15307 - DNA, 279 bp, Homo sapiens
  AL137848.4_122035
  Located on chromosome 9
  Distance between a terminus base of telomere on chromosomal short arm and 5'-terminus of this base sequence : 85220946
  Distance between 3'-terminus of neighbour sequence of sequence listing upward to telomere on chrosomal short arm and 5'-terminus of this base sequence : 222517
atgtacaactcgtgaatagcactgacatccaaatggacacattggaaacagatcaaatggaaaaaaatggcttcttggctctcttgttggaaaaagagagttgtcctcatcatcatcatcatcatcatcatcatcatcatcatcatcatctgtgtcttccatatccttcagcatcatattcttcagtgcgatgtgtgaagggctaaagaagggtttggcagagcacaaagccaggaataataggagcacatactccttcatggtgtcttagtgtagaag

SEQ ID NO: 15308 - DNA, 321 bp, Homo sapiens
  AL157827.17_75215
  Located on chromosome 9
  Distance between a terminus base of telomere on chromosomal short arm and 5'-terminus of this base sequence : 85311341
  Distance between 3'-terminus of neighbour sequence of sequence listing upward to telomere on chrosomal short arm and 5'-terminus of this base sequence : 90116
aactcctgacctcgtgatccatccgcctcggcctcccaaagtgctgagattacaggcatgagccactgcgcctggccttcagttagctagtattttgttatggattttagtatctatgtccatcaaggatatcggtctgtattgtttgttgttgttgttgttgttgttgttgttgttgttgtgtcctttcctggttttggtattaaggtgatgctggcttcatagaatgagttagggagggttccttctttctctatcttacagaatagtgtcaaaacgattggtatcaattcttctttgaatgtctggtagaattctgct

SEQ ID NO: 15309 - DNA, 101 bp, Homo sapiens
  DISD22_0006505
  Located on chromosome 9
  Distance between a terminus base of telomere on chromosomal short arm and 5'-terminus of this base sequence : 85574891
  Distance between 3'-terminus of neighbour sequence of sequence listing upward to telomere on chrosomal short arm and 5'-terminus of this base sequence : 263229
ttgacaatttcagaaggtgcaatagtttttggtttttttgtttgtttgttttttgttttttttttttcctaaaaacctgaatgttctagagtggtaacagt

SEQ ID NO: 15310 - DNA, 103 bp, Homo sapiens
  DISD22_0006508
  Located on chromosome 9
  Distance between a terminus base of telomere on chromosomal short arm and 5'-terminus of this base sequence : 85684996
  Distance between 3'-terminus of neighbour sequence of sequence listing upward to telomere on chrosomal short arm and 5'-terminus of this base sequence : 110004
atgtgcctttgtgtcaggggtgtgtgtgtgtgtgtgtgtgtgtgtgtgtgtgtgtgtgtttatcctgccttgggtttattgagctctatggatctgtgaattt

SEQ ID NO: 15311 - DNA, 418 bp, Homo sapiens
  chr9.fa.O7frz.95001697
  Located on chromosome 9
  Distance between a terminus base of telomere on chromosomal short arm and 5'-terminus of this base sequence : 85922505
  Distance between 3'-terminus of neighbour sequence of sequence listing upward to telomere on chrosomal short arm and 5'-terminus of this base sequence : 237406
acgaggtaaggagatcgagaccatcctggctaacatggtgaaaccccatccccactaaaaatacaaaaaactagctgggcacagtggtgggtgcctgtagtcccagctacttgggaggcagaggcaggagaatggcttgaacccaggagatggagcttgcagtgagccgagattgcaccactgcactccagcctggtgacagagcgagactctgtgtcaaataaataaataaataaataaataaataaataaataaaaataaaaataaaataaaattggagggtgattcaggcagggctgcaagcacagatgaaggtcaccagagagccctgcaggaacctcttctctctgcagaggtgactttttagttgggatctgattgaggaggcagaacccacaattgagtactgaggacaag

SEQ ID NO: 15312 - DNA, 128 bp, Homo sapiens
  DISD22_0006523
  Located on chromosome 9
  Distance between a terminus base of telomere on chromosomal short arm and 5'-terminus of this base sequence : 86196360
  Distance between 3'-terminus of neighbour sequence of sequence listing upward to telomere on chrosomal short arm and 5'-terminus of this base sequence : 273437
gagtagccttgcattgggcagcaataaagaaagctggacaaaatatagacacacacacacacacacacacacacacacacacacacacacacacacacatacacataactgaaggaccagagatctca

SEQ ID NO: 15313 - DNA, 203 bp, Homo sapiens
  D9S197
  Located on chromosome 9
  Distance between a terminus base of telomere on chromosomal short arm and 5'-terminus of this base sequence : 86325461
  Distance between 3'-terminus of neighbour sequence of sequence listing upward to telomere on chrosomal short arm and 5'-terminus of this base sequence : 128973
tggcctggcttttaggaaccacaactcatcctctgtgcctttctttgtaagcctgtaaatctatctgcaatattgagaaaaatacctcagatctctaaacagttattgggtagtgtagagttcttaggaggacacatacacacacacacacacacacacacacacacacacgcacacttgcaatatagtctcccagaaattgt

SEQ ID NO: 15314 - DNA, 427 bp, Homo sapiens
  AL358779.4_195981
  Located on chromosome 9
  Distance between a terminus base of telomere on chromosomal short arm and 5'-terminus of this base sequence : 86531060
  Distance between 3'-terminus of neighbour sequence of sequence listing upward to telomere on chrosomal short arm and 5'-terminus of this base sequence : 205396
ctccatctgattgaaaatcagggcatgtagggtgatggtttgggctgcagccaggtctgtgcctgctgtggcctctgagctctggagtcaaatggggattgtggaagaggctgcctagagtggcagaaaccctaccctggaatggggagctggctcagctgcgggctcactgtgtgagcctcagcaacttgccatccctctctggtttcagttagtggcatcacgcctcatggtgctctgtctatatcctggttcaggttcagtggaggggagaccctgggccccctccttgagtgccttatctatctatctatctatctatctatctatctatctatctatcacctgtctatcttatctatgatctatcaatcatctatcttatctatgatctgtgtatcatctacctatcattgatctgtcatct

SEQ ID NO: 15315 - DNA, 258 bp, Homo sapiens
  D9S196
  Located on chromosome 9
  Distance between a terminus base of telomere on chromosomal short arm and 5'-terminus of this base sequence : 86533901
  Distance between 3'-terminus of neighbour sequence of sequence listing upward to telomere on chrosomal short arm and 5'-terminus of this base sequence : 2414
accacactgcgggacttcaacccctccgtaaacacacaagccaatgcttcataacgcattgcaaatgccttctcatatatatatatatctgagaaagagagaggacatagagattcaatatatgtttatatatctcagtgtgtgtgtgtgtgtgtgtgtgtgtgtgtgttatgtgtgtgtgtgtataattagccatcagggaaatgcaaactaaaaccataataccgctggccaggagtggttttgaggtgtaatccc

SEQ ID NO: 15316 - DNA, 90 bp, Homo sapiens
  D9S1689
  Located on chromosome 9
  Distance between a terminus base of telomere on chromosomal short arm and 5'-terminus of this base sequence : 86564813
  Distance between 3'-terminus of neighbour sequence of sequence listing upward to telomere on chrosomal short arm and 5'-terminus of this base sequence : 30654
tctgggtgatagggcgagactctgtcacacacacacacacacacacacacacacacacagccacctatttctgatgccaatcacaagccc

SEQ ID NO: 15317 - DNA, 177 bp, Homo sapiens
  HUMUT8063
  Located on chromosome 9
  Distance between a terminus base of telomere on chromosomal short arm and 5'-terminus of this base sequence : 86746040
  Distance between 3'-terminus of neighbour sequence of sequence listing upward to telomere on chrosomal short arm and 5'-terminus of this base sequence : 181137
acagagcaaggttgcccagagcaaggctctgtctcttaaaaagagaaagaaagaaagaaagaaagaaagaaagaaagaaaaaaattgtcctagcaagcacatttttggtgaggctctggagttggggccccaactgggtacagggccatagggaccccactgttggtgctgagtgga

SEQ ID NO: 15318 - DNA, 397 bp, Homo sapiens
  AL357073.3_36074
  Located on chromosome 9
  Distance between a terminus base of telomere on chromosomal short arm and 5'-terminus of this base sequence : 86790108
  Distance between 3'-terminus of neighbour sequence of sequence listing upward to telomere on chrosomal short arm and 5'-terminus of this base sequence : 43891
ttcgctcaattaagtggagaggcagcaagggacgtggcagcagaaagccctgcccacagctcacagtgtgagaggtgcagccagggcacaggctgccagctccaggtcagagagtccaccagcaggcgggtctcattccaggaagagacttgcaggaaagaggtgccagagctcctggggaagctgcagctgggtctccctctcctggaccagttctgcctctggtcctggcccatggaggatgtttgcatgaaagaaggaaggaaggaaggatggatggaaggaaggaaggaaggaaggaaggaaggaaggaaagaaggaaacaatggtcttcgaatacaggtggcacggcacaggacacggcactgtgactgtgtactccagcactttaaagtcc

SEQ ID NO: 15319 - DNA, 291 bp, Homo sapiens
  chr9.fa.O7frz.96084276
  Located on chromosome 9
  Distance between a terminus base of telomere on chromosomal short arm and 5'-terminus of this base sequence : 87061418
  Distance between 3'-terminus of neighbour sequence of sequence listing upward to telomere on chrosomal short arm and 5'-terminus of this base sequence : 270913
ctcacttaagtaacgtagcctaagtttcttaaacccaagatctcattttagctacctaggtatattgtccagagtactgaatatgagcacatttcacatgacaggctcttaaatgcaagtgtgtgtgcgtgtatgtgtctgtggtgtgtgtgtgtgtgtgtgtagtccttgcattgcctggcatcttgttacagtaattcatgcacataagaaccatgtccttgctttgccttgcctggtagagaactatgcaaagcaagaacaaggctccagtatgaacaagtttgtatt

SEQ ID NO: 15320 - DNA, 397 bp, Homo sapiens
  chr9.fa.O7frz.97098261
  Located on chromosome 9
  Distance between a terminus base of telomere on chromosomal short arm and 5'-terminus of this base sequence : 87212655
  Distance between 3'-terminus of neighbour sequence of sequence listing upward to telomere on chrosomal short arm and 5'-terminus of this base sequence : 150946
gacagatgcttaaacagaagtaacaatggtcttaatagttcctcttgccaatacatcctgtctcttggaactgttctcttcttttgaagactgttgggagaagaaagaaatacaaagaagaatttgaagatttccttgatggcccaagggatactctcagcacatctgccttccttaaagaccttattagcatccctgaaatgtgctatgagagatttaacccatttggtgctattctttagagatagccttaaaaaaaaatatatatatatatatatatatgtatattttagagatgggatctccttatgttgcccaggctggtcttgaactcctgcatcagcctctgaaagtgctgggattataaacataagccacgtcaccaggcctaaagatc

SEQ ID NO: 15321 - DNA, 176 bp, Homo sapiens
  D9S287
  Located on chromosome 9
  Distance between a terminus base of telomere on chromosomal short arm and 5'-terminus of this base sequence : 87336469
  Distance between 3'-terminus of neighbour sequence of sequence listing upward to telomere on chrosomal short arm and 5'-terminus of this base sequence : 123417
accactacattgttcaagggtcatttgtgtatatatatgtgtgtgtctgtgtgtgtgtgtgtgtgtgtgtgtgtgtgtgtgtgctgcttttgtcacagaacaagtcatagcatttttttatgttcttagaaacacttcacaaatgtcatttttgattgctgcgtgaggagcatcct

SEQ ID NO: 15322 - DNA, 116 bp, Homo sapiens
  Z67506
  Located on chromosome 9
  Distance between a terminus base of telomere on chromosomal short arm and 5'-terminus of this base sequence : 87415170
  Distance between 3'-terminus of neighbour sequence of sequence listing upward to telomere on chrosomal short arm and 5'-terminus of this base sequence : 78525
tggaatttaggttcaggacttcactgtgtgtgtgtgtgtgtgtgtgtgttttaaacctttgaagagttttgtagggactgaaaatatttgaggatgaatgtctaaatgcaaggctt

SEQ ID NO: 15323 - DNA, 125 bp, Homo sapiens
  D9S1809
  Located on chromosome 9
  Distance between a terminus base of telomere on chromosomal short arm and 5'-terminus of this base sequence : 87428910
  Distance between 3'-terminus of neighbour sequence of sequence listing upward to telomere on chrosomal short arm and 5'-terminus of this base sequence : 13624
agctcctgttcaacatctcctcccgcataaggcaagagtggagcatatgtgtacagaggaccagacacacgtgcatatgcacacacacacacacacacacacatctcccaggaagcacaaacctt

SEQ ID NO: 15324 - DNA, 437 bp, Homo sapiens
  chr9.fa.O7frz.97442689
  Located on chromosome 9
  Distance between a terminus base of telomere on chromosomal short arm and 5'-terminus of this base sequence : 87532162
  Distance between 3'-terminus of neighbour sequence of sequence listing upward to telomere on chrosomal short arm and 5'-terminus of this base sequence : 103127
atagttacctcagttgactccagttcctctccttccttctttcctttctttctttttttctctttatatatatatgtgtgtgtgtgtgtgtgtgtgtgtgtgtgtgcgtatgtatgcatatgcgatgtatcatatcacacacacacatatacagttgtcccttggtatccatgtgggattggttccaggacctctcttgggtaccaaaatgtgtggattctcaagtccttgatataaaatagtgtatttgcatataacctgttatcctcccatatactttaaatcatctgtagtttacttagtgcaatgtaaagtctacataaatagcttttatattgtattgtttaggaaataatgacaaggtctgcgtacatgtttagtgcagatggaattttttagtatttcaatttgtagttagttgaatccactgatatgaa

SEQ ID NO: 15325 - DNA, 330 bp, Homo sapiens
  AL159167.6_50738
  Located on chromosome 9
  Distance between a terminus base of telomere on chromosomal short arm and 5'-terminus of this base sequence : 87607169
  Distance between 3'-terminus of neighbour sequence of sequence listing upward to telomere on chrosomal short arm and 5'-terminus of this base sequence : 74570
tctagtcttacaagaggttccaggaacacctcatacattttctgtcccagacctacaatcagtcattattccaagaagtcttggtttcttttagagagaaagtgtgtttcaagaccacagtctggtgctagtaatgaacattgctactgttgacttggttattatttttgggccttttcagtggccagatttgtgtgtgtgtgtgtgtgtgtgtgtattttatatttatacacatatatgtgtatgtatacgtatatttgtgatatatattttatatatgtatgtacacatatgtgatgataaaatacctcgaggttatacgtccatatt

SEQ ID NO: 15326 - DNA, 213 bp, Homo sapiens
  chr9.fa.O7frz.97552484
  Located on chromosome 9
  Distance between a terminus base of telomere on chromosomal short arm and 5'-terminus of this base sequence : 87607286
  Distance between 3'-terminus of neighbour sequence of sequence listing upward to telomere on chrosomal short arm and 5'-terminus of this base sequence : -213
cagtctggtgctagtaatgaacattgctactgttgacttggttattatttttgggccttttcagtggccagatttgtgtgtgtgtgtgtgtgtgtgtgtattttatatttatacacatatatgtgtatgtatacgtatatttgtgatatatattttatatatgtatgtacacatatgtgatgataaaatacctcgaggttatacgtccatatt

SEQ ID NO: 15327 - DNA, 184 bp, Homo sapiens
  Z66576
  Located on chromosome 9
  Distance between a terminus base of telomere on chromosomal short arm and 5'-terminus of this base sequence : 87902854
  Distance between 3'-terminus of neighbour sequence of sequence listing upward to telomere on chrosomal short arm and 5'-terminus of this base sequence : 295355
ctcttatttgatctatcccccccaaacacatacacacacacacacacacacacagagagagagagagagagagacagagacagagagagaaagagtgccatggcatgctataatgtacttaggatattcaaagcctggattagaaattgcagggttgaagtcaagtagcacaagaacaaaggaa

SEQ ID NO: 15328 - DNA, 202 bp, Homo sapiens
  D9S1786
  Located on chromosome 9
  Distance between a terminus base of telomere on chromosomal short arm and 5'-terminus of this base sequence : 87910366
  Distance between 3'-terminus of neighbour sequence of sequence listing upward to telomere on chrosomal short arm and 5'-terminus of this base sequence : 7328
tgtcttcaaggtatttgcactcccttgttcattacagtactattcacaatagccaagatatggaagtaaccccaatatccattaacagatgaataaggaaaatgtggcacacacacacacacacacacacacacacacacacaatggaatatcatttagcctttaaaaagagaaggaaatcctgacatttatgacaacatgg

SEQ ID NO: 15329 - DNA, 452 bp, Homo sapiens
  chr9.fa.O7frz.97896808
  Located on chromosome 9
  Distance between a terminus base of telomere on chromosomal short arm and 5'-terminus of this base sequence : 87985921
  Distance between 3'-terminus of neighbour sequence of sequence listing upward to telomere on chrosomal short arm and 5'-terminus of this base sequence : 75353
ccatgtaggatctacaactgtaacaagatacattctgtatacagaaaagggctgcaaaggattatttatttatttatttatttatttagagatagagtctcactctgtcacccaggctggagtgcagtggcgcgatctcagctcactgcaatccccacctcccgggttcaagcgattctcctgcctcagcctctcgggtagctgggattacactaccacgcccagctaatttttgtatttttagtagaaatgaagttttgccatgttggccaggctggtctcgaactcctgatctcaggcgatccacctgcctcagcctcccaaagtgctgggattataggcgtgagccaccgcactgggctgaaaatgagtatttaaaattgtgtgttaaaaggtagattatgggtgattttcttccccaaattttatgtagtaaggctaaactgccttaa

SEQ ID NO: 15330 - DNA, 219 bp, Homo sapiens
  Z67255
  Located on chromosome 9
  Distance between a terminus base of telomere on chromosomal short arm and 5'-terminus of this base sequence : 88072885
  Distance between 3'-terminus of neighbour sequence of sequence listing upward to telomere on chrosomal short arm and 5'-terminus of this base sequence : 86512
ttaagaagtgaacaccaataggctgaactgaggaatttgtaggtaggaactggggtgggggtgagcaggaaaaagaaggctttcatgcagaaaatggggccttctacactttgtgtgtgtgtgtgtgtgtgtgtgaaatggagttgttgcccaggttgagggcaatggcatgatctcggctcactgcaacctccacctcctgagttcaagcaactctcc

SEQ ID NO: 15331 - DNA, 155 bp, Homo sapiens
  DISO7_10002740
  Located on chromosome 9
  Distance between a terminus base of telomere on chromosomal short arm and 5'-terminus of this base sequence : 88235766
  Distance between 3'-terminus of neighbour sequence of sequence listing upward to telomere on chrosomal short arm and 5'-terminus of this base sequence : 162662
tggtgtcatttgaggtgatagaaacggacacacacacacacacacacacacacacacacacacaaatacacaaaacatctctggtaagacacacaagaggttagtaatattgacagattatggggagggaaaacaggaaagtgccttagtctatg

SEQ ID NO: 15332 - DNA, 145 bp, Homo sapiens
  D9S1851
  Located on chromosome 9
  Distance between a terminus base of telomere on chromosomal short arm and 5'-terminus of this base sequence : 88441007
  Distance between 3'-terminus of neighbour sequence of sequence listing upward to telomere on chrosomal short arm and 5'-terminus of this base sequence : 205086
tgcttgactgtagtaaacatttcactgtatataaaaaaccaggttatcatacacacacacacacacacacacacacacacacacacacaaaaactatgggcatttattacaaataggcctccctgcaagaaatgctaacgggact

SEQ ID NO: 15333 - DNA, 295 bp, Homo sapiens
  DISD22_0006610
  Located on chromosome 9
  Distance between a terminus base of telomere on chromosomal short arm and 5'-terminus of this base sequence : 88730801
  Distance between 3'-terminus of neighbour sequence of sequence listing upward to telomere on chrosomal short arm and 5'-terminus of this base sequence : 289649
ttgttaactagtgtcaagggtaatgtttccaagataaaaagttcatataaaataagaaaagagttgttaaaaattgacctaaagaacttttgcatgatgaaaataatgtaagtcaaaatgcatataaatctgaaaaatattagtaacctgttcatagataattggttaacatcaggtgtgtgtgtgtgtgtgtgtgtgtgtgtgtgtgtgtctataagcttttaaaaacagtgaagaaaatcttaccaaaaaataaaaacaaagcaaaagacatgagtagacatgaattcctggg

SEQ ID NO: 15334 - DNA, 456 bp, Homo sapiens
  chr9.fa.O7frz.99577197
  Located on chromosome 9
  Distance between a terminus base of telomere on chromosomal short arm and 5'-terminus of this base sequence : 88869201
  Distance between 3'-terminus of neighbour sequence of sequence listing upward to telomere on chrosomal short arm and 5'-terminus of this base sequence : 138105
ttagctctattagttcagaacgacttccagcgagtcccagcccttttccattcccagcgcaacgatcgccggaatccaggcgccatccaggcccctctgttccctgaaaagaccacgcagcctccagtgacatcacggagacgaaagggcttggccacctgtggcagccatgataaaacctagggaaaacggagctcgaagtagcttattttatttattttttatttatttatttatttattaaggagtcttgctctgtcgcccaggctgtggtgcagtggcgcgatctcggctcactgcaacctctgcctcccaggttcaagcgattctcctgcctcagcctccccagtagctgggattacaggcgcccaccatcacgcccggctaatttttgtatttttcgtagacggggtttcagcatcttggcgaggctggtcttgaactcctgacttcgtg

SEQ ID NO: 15335 - DNA, 183 bp, Homo sapiens
  chr9.fa.O7frz.99817167
  Located on chromosome 9
  Distance between a terminus base of telomere on chromosomal short arm and 5'-terminus of this base sequence : 89036491
  Distance between 3'-terminus of neighbour sequence of sequence listing upward to telomere on chrosomal short arm and 5'-terminus of this base sequence : 166834
ggacaaagtccttattgcttaccctagctctagcaagtcacaccaggaatgtgggccgccactcctaaggatgcacacatacacacacacacacacacacacacacacacacacacagctttgtaaataaagctcccataattaccgtgatatttacaagtgagcttatagttcaacctgtag

SEQ ID NO: 15336 - DNA, 446 bp, Homo sapiens
  chr9.fa.O7frz.100064771
  Located on chromosome 9
  Distance between a terminus base of telomere on chromosomal short arm and 5'-terminus of this base sequence : 89142431
  Distance between 3'-terminus of neighbour sequence of sequence listing upward to telomere on chrosomal short arm and 5'-terminus of this base sequence : 105757
acaatcgttagcttcctagaactctcttctgctggtgtggagggaaatgaaatggaaggggcagagcgtggggagagctaagtgtggcctgaaccagaaaagttgcagagacataggaggagtggagtgcagcatggtttgagggcaggtgggcaggccagctgagacagggagatgtcttcagactcttttcctggaaccctgttgcttacagatgattgctgtggtgactcagacaccatgatgaccccaagagatgcaaaatgaaaacatgcacccgcgcgcgcacacacacacacagacacacacacacacacacacacacacaggcttttccaatttaaaccacttgacaactttgacgtttagagcatcgagcatggctcattgtgttctgggatgaagctcatagcaactgcagaaagtgatggagtcaaacactatgt

SEQ ID NO: 15337 - DNA, 187 bp, Homo sapiens
  chr9.fa.O7frz.100149745
  Located on chromosome 9
  Distance between a terminus base of telomere on chromosomal short arm and 5'-terminus of this base sequence : 89409577
  Distance between 3'-terminus of neighbour sequence of sequence listing upward to telomere on chrosomal short arm and 5'-terminus of this base sequence : 266700
atgtacagcatggttaccatagttaataatactgtattatgtacttgaaaattactgagagggtagatctcaagtgttttcatcacacacacacatacacacacacacacacacacacacacacacacacacacaaatgtaaccacatgaggtgatgaatatattaattagcttgattgtggtaatc

SEQ ID NO: 15338 - DNA, 220 bp, Homo sapiens
  D9S180
  Located on chromosome 9
  Distance between a terminus base of telomere on chromosomal short arm and 5'-terminus of this base sequence : 89518851
  Distance between 3'-terminus of neighbour sequence of sequence listing upward to telomere on chrosomal short arm and 5'-terminus of this base sequence : 109087
cagtggtttggaatcgaacctataatatttccaaagtatgctggtatcttgtctcctctaactacacacacacacacacacgcatatatatatacatagagagagagagagggacttgctctgttgcccaggctggagtgcagtggcacgatctcggctccccacaacctgcacttcccgggttcaagcaatcctcctgcctcagccccccaaaatagct

SEQ ID NO: 15339 - DNA, 419 bp, Homo sapiens
  chr9.fa.O7frz.96369727
  Located on chromosome 9
  Distance between a terminus base of telomere on chromosomal short arm and 5'-terminus of this base sequence : 89595671
  Distance between 3'-terminus of neighbour sequence of sequence listing upward to telomere on chrosomal short arm and 5'-terminus of this base sequence : 76600
cgttatttcctaagatagagcaggtgtggtatctggaagtgtgggcacatggacatgtggatgctccacagtgcctctgaaggaggggacgtgatgggagtctgtggccctggcaggtcgagttttaaaaagcttggcactcagactgtgtggcttgttatatatcctccaaaagaaaaccaatgaagtcacaacttgcaacaagaggaatgggcctgattcatccatcccttgatgaagaagtaaaatctctctctcacacacacacacacacacacacacacacacacacacacacagaggcaagtaaaatccaccacatgtggggggtggagtggctgttccaaatataaataagatatgagagaaagctattttccagaatgtttgttcaccaaacattcagtgccatacaagga

SEQ ID NO: 15340 - DNA, 234 bp, Homo sapiens
  AL157384.8_101483
  Located on chromosome 9
  Distance between a terminus base of telomere on chromosomal short arm and 5'-terminus of this base sequence : 89925643
  Distance between 3'-terminus of neighbour sequence of sequence listing upward to telomere on chrosomal short arm and 5'-terminus of this base sequence : 329553
ggaattaatctggaacatgtttagtttgagatactcatggtcacccaagtggagatgtcacacaggcagctgaaaatgtggggctcaggggaaaggttcgacctggagatgtggacttaggacctgtcagtgcttgtgtgcacacatgtacacacacacacacacacacacacacacacacacattgtaattctttcatggctctttccagtgatcttgtaacagatcagttca

SEQ ID NO: 15341 - DNA, 346 bp, Homo sapiens
  AL157384.8_84052
  Located on chromosome 9
  Distance between a terminus base of telomere on chromosomal short arm and 5'-terminus of this base sequence : 89943049
  Distance between 3'-terminus of neighbour sequence of sequence listing upward to telomere on chrosomal short arm and 5'-terminus of this base sequence : 17172
gtgagttatgaaaccgtgaaacaaaattaactcggtatcattagtatagccattttatattgaatttaaaatgaagttatgaaagtgattacaggcaaaagtagatatttaaatcatctgggagtttctgtcctctaatacgaagagctctattttcctgaagatctgcatgggtgcgtgcacgcgtgtgtgtgtgtgtgtgtgtgtgtttatctatacaaacctacacacacatacatggacaacagtataggaagccatctttgtaatagaacaatgaatacatttgataagttgttccattaaaaaaaaaaaactaggagaaaggttcataatgtaagcctct

SEQ ID NO: 15342 - DNA, 244 bp, Homo sapiens
  AL157384.8_46384
  Located on chromosome 9
  Distance between a terminus base of telomere on chromosomal short arm and 5'-terminus of this base sequence : 89980757
  Distance between 3'-terminus of neighbour sequence of sequence listing upward to telomere on chrosomal short arm and 5'-terminus of this base sequence : 37362
gatatgtaccagtcttaccagacaaaaaaagattaaatgagataaatattaacaacagcagttgtaactgttaataaataacacaggaaagtatcatttacttgaactctaagactcctctctctcacacacacacacacatacacacacacacacacacacacacacaaacatacgcatgcgcacacgcacagagagagacacgcacacacacagaaaaaataaatctgagccaaggaataag

SEQ ID NO: 15343 - DNA, 183 bp, Homo sapiens
  Z66753
  Located on chromosome 9
  Distance between a terminus base of telomere on chromosomal short arm and 5'-terminus of this base sequence : 90007608
  Distance between 3'-terminus of neighbour sequence of sequence listing upward to telomere on chrosomal short arm and 5'-terminus of this base sequence : 26607
aattttgcccaggagacttgaactcacaatcttccagcctcagcctctcaaatagttgggactacaggtgcacagcactgcacccagccaaattcatattgtttaaatagtctcctctgaatctgtgtgtgtgtgtgtgtgtgtgtgtgtgtgtgtgtgaaaaaccgcagcctcaaactgtct

SEQ ID NO: 15344 - DNA, 343 bp, Homo sapiens
  chr9.fa.O7frz.96923615
  Located on chromosome 9
  Distance between a terminus base of telomere on chromosomal short arm and 5'-terminus of this base sequence : 90114160
  Distance between 3'-terminus of neighbour sequence of sequence listing upward to telomere on chrosomal short arm and 5'-terminus of this base sequence : 106369
cgtgttggtaagaatacagaacggtgttttatttatttgcctgggaggcaaacttaaatgttgatgtttagtttattgttaaaacaaacaaacaggcaaactgttcattattacagaaaccatattgctacagcgaagaaaatttcaaaatataggcaagcaaagcgaaacaaaccaacaaaacaaatcatatttctgctagccagagatcgccactgtgaggtgtgagtatttgtgtgtatacgtgtatgggtgtggtgtgtgtgtgtgtgtgtgtgtgtgttttggagagaaagaaaaataggtttgcttttcagaagcctcaaagatgcagagtgaatag

SEQ ID NO: 15345 - DNA, 151 bp, Homo sapiens
  D9S1816
  Located on chromosome 9
  Distance between a terminus base of telomere on chromosomal short arm and 5'-terminus of this base sequence : 90210602
  Distance between 3'-terminus of neighbour sequence of sequence listing upward to telomere on chrosomal short arm and 5'-terminus of this base sequence : 96099
agggcattatacactgtggcagaggctggagaaaataaaaggtgtgtgtgtgtgtgtgtgtgtgtgtgagagagagagaggaatgaggataaaaacgggagacatattttaatccacattgattaacctcatcagtttatctatctgtaga

SEQ ID NO: 15346 - DNA, 463 bp, Homo sapiens
  chr9.fa.O7frz.100621686
  Located on chromosome 9
  Distance between a terminus base of telomere on chromosomal short arm and 5'-terminus of this base sequence : 90521182
  Distance between 3'-terminus of neighbour sequence of sequence listing upward to telomere on chrosomal short arm and 5'-terminus of this base sequence : 310429
ggccttgagtttatttcttaacacctgacagtggctcacaactctcctgcaaggtaggtggggattattttcccccatttgatgatgggaaaactggggtgcaagggaagtgactagactgaagtcatgttatgatgagcagtgcaggtgggaagtagtctgaggactagttgagagacccctcttcctgctatgcaatatgctcctttcttgacatacatgcggggtgtgtgtgtgtgtgtgtatgtgtgtgtgtgagagagagagagagagagagagagagagagagaaagagacagagagagtttcctgcctgttccaaaggcccctcttctttacccagccctaaactcattgcaggacaagggttagctgcagggtggctgaaactgaacccaaactgggcgtggtgcaaaccattataatagattattcattaattgtactgtttgtggctttaagg

SEQ ID NO: 15347 - DNA, 379 bp, Homo sapiens
  chr9.fa.O7frz.100750963
  Located on chromosome 9
  Distance between a terminus base of telomere on chromosomal short arm and 5'-terminus of this base sequence : 90682143
  Distance between 3'-terminus of neighbour sequence of sequence listing upward to telomere on chrosomal short arm and 5'-terminus of this base sequence : 160498
tcttagtatgaagcaagagcacagtaagacaaaagactacagagccgacacacacacacacacacacacacacacacacacacacacacacacacagagtagtgcattccagaacaatatactcatttcattttcctgttgtcattcagagaggcgagtgcactgggagccacaaaagtgcaatgttgcaaagacttttccaaaacaggatgcgtaatggctgctgtggccactgctggcggtgtgtggggatacctgggtagcagcaggccaccagagagtgtgcatccctccttctgtgctctgcagtggggctcatttttctgggccaggttcttgcctgcctgcaatcctcctctgatgacggagttaccagtga

SEQ ID NO: 15348 - DNA, 399 bp, Homo sapiens
  AL356282.6_29322
  Located on chromosome 9
  Distance between a terminus base of telomere on chromosomal short arm and 5'-terminus of this base sequence : 90782641
  Distance between 3'-terminus of neighbour sequence of sequence listing upward to telomere on chrosomal short arm and 5'-terminus of this base sequence : 100119
ctaccaatgactgtcttcacagaattggaaaaaactactttaaagttcatatggaaccaaaaaagagcccgcatcgccaagtcaatcctaagccaaaagaacaaaagcacactgcttaatgaaaaggaagaaaaaagaggatatatattatatatataatacatttacataaatacaaataataacacacattttgcaaaaccatataccaaaaaaggtacaattggacagacatagggaatggcagtgagaaatggggatgaaaaggaatgaatgggtgaatgaatgaatgaatgaatgaatgtaacagagccgagccttccctgaagcagtgatgttaactgtcacgaactgatgactgaaagcaactaaattctctgtacctgaaggaggttaaac

SEQ ID NO: 15349 - DNA, 320 bp, Homo sapiens
  AL354678.3_132971
  Located on chromosome 9
  Distance between a terminus base of telomere on chromosomal short arm and 5'-terminus of this base sequence : 90862982
  Distance between 3'-terminus of neighbour sequence of sequence listing upward to telomere on chrosomal short arm and 5'-terminus of this base sequence : 79942
tctgtaaccagatttgaaagtaagtgaaaaaaatgtaaagggcaagtgtgtaactgaatatgtattagatctgctgcacaaggggaatagctgtacttggggaatgcctgtgggtatatatccagctgtatccaggtgtgtgtgtgtgtgtgtgtgtgtgtgtgtgtgtgcatgtgcgtgtgtgacccatgcatgttcacagtgcagagccagtggcttgaaatgtgacctccaaaaaagataggtctaagttctaaccctgacaacttgtgaatgtgacctcatttggaaaaagggtctttgcagacgtaattaactga

SEQ ID NO: 15350 - DNA, 462 bp, Homo sapiens
  chr9.fa.O7frz.101077238
  Located on chromosome 9
  Distance between a terminus base of telomere on chromosomal short arm and 5'-terminus of this base sequence : 91015700
  Distance between 3'-terminus of neighbour sequence of sequence listing upward to telomere on chrosomal short arm and 5'-terminus of this base sequence : 152398
gaatggactaatacagttaccaagagcctttactaggcactgactgcttgctaagcagcatgctaaatactttacatatattccttttaactcatttttcagacaagaaacgtgaggttcagagaggataagtcatccacccatagtcaagtgattaataaacaaggaagttgggatccaaacaccaaaacccaaggtctaccaccacgggcggtttccactggagatgcacaccagaatcaccaagggaggtatttagaaatacacaagcctgggccccacctccagaagattctgactggggcagagtctgggcatccctatttatttataaagctccccaggtgctccatgggtacagcttcagtggagagccactgtgttgaatgaatgaatgaatgaatgaatgaatgaatgaatgtatgctggtgtgacctggctaactcaagtaaccgactagct

SEQ ID NO: 15351 - DNA, 353 bp, Homo sapiens
  AL353782.10_121382
  Located on chromosome 9
  Distance between a terminus base of telomere on chromosomal short arm and 5'-terminus of this base sequence : 91026438
  Distance between 3'-terminus of neighbour sequence of sequence listing upward to telomere on chrosomal short arm and 5'-terminus of this base sequence : 10276
ctgcacataattggaatcatagaatatttgtctttttctgtcttctgtattacacttagcagtatgtcctcaagcctcatccatgttgtagcatatgtctgaatttccttcctctttcaggataaattatattccattttgtgtgtgtgtgtgtgtgtgtgtgtgtgtgtgtgtacactaaattttgtttatcctttcatctgtcaatgaacacttaggttgagtcccctttcagctattgtgaataatgctgctatgaacattggtgtacagatatctgtttgagtccctgctttgaattattttgagtgtccttccagaagtggaattactggattcaatggtaattctat

SEQ ID NO: 15352 - DNA, 435 bp, Homo sapiens
  chr9.fa.O7frz.99201739
  Located on chromosome 9
  Distance between a terminus base of telomere on chromosomal short arm and 5'-terminus of this base sequence : 91285572
  Distance between 3'-terminus of neighbour sequence of sequence listing upward to telomere on chrosomal short arm and 5'-terminus of this base sequence : 258781
ttagtaaggcatgacaataagaacaaattcagaaaatgttctttaccagcatggcaagtttttttttgtatttctaaaaggcaaccattttagtggatacaaaattaacataagccatagatctgtgcaccctgtgtgtgtaaacacacacacacacacacacacacacacacacacacacacacgcaggcattcagcctactgaccccgctcgtggctgtgtgctatagacacacagaaatacagtgatccccaggctggtttggcagggcactcattacatagagggaacagacaaagagaaccatcatagaagggctgagaggcccagagaacatggcagacgagctgctggtcatttgtgtcacacactctagcccctttgcagggccctttgacccctttaaggatgtgttgatcttgttagaagctgaa

SEQ ID NO: 15353 - DNA, 244 bp, Homo sapiens
  chr9.fa.O7frz.99060112
  Located on chromosome 9
  Distance between a terminus base of telomere on chromosomal short arm and 5'-terminus of this base sequence : 91356607
  Distance between 3'-terminus of neighbour sequence of sequence listing upward to telomere on chrosomal short arm and 5'-terminus of this base sequence : 70600
cactttgaatacaagattccactgtaacctggcatatctttttgctgataagaaagaattttgttattagcatgcatttactgatacgtatgtgttctttctccctggtacatgcatgtggggtgtgtgtgtgtgtgtgtgtgtgtgtgagagagagagagacttgtgtgtctgtatgtgtgttgttgtttctaaatacctgaagtggaagggagatttccttacacttcagttgatcacattg

SEQ ID NO: 15354 - DNA, 413 bp, Homo sapiens
  chr9.fa.O7frz.98966890
  Located on chromosome 9
  Distance between a terminus base of telomere on chromosomal short arm and 5'-terminus of this base sequence : 91449437
  Distance between 3'-terminus of neighbour sequence of sequence listing upward to telomere on chrosomal short arm and 5'-terminus of this base sequence : 92586
ttcaccaaggaagctacatagctgggaaacaagcacaggaaaataggctcaacatcgttgtcattatagaaatgcaaattaaaaatcaccatgagaggctgggcacagtggctcgtgcctgtaatcccaacactttgggaagtcgaggtgggaggatcactcgagcccaagaggtcgagcccatgattgcaccactgcactccagcctgggtgacagagtgagatgctatctcacacacacacacacacacacacacacacacacacacacacacacacacaaaatcataatgagaaccactacgactgttaaaataaaaacttaagacattaaatttaagagtttaattgagcaaagaacgattcatgaactgtgtggcctcctgagccagaataggtcagaataacgctgg

SEQ ID NO: 15355 - DNA, 312 bp, Homo sapiens
  AL161728.9_28085
  Located on chromosome 9
  Distance between a terminus base of telomere on chromosomal short arm and 5'-terminus of this base sequence : 91449437
  Distance between 3'-terminus of neighbour sequence of sequence listing upward to telomere on chrosomal short arm and 5'-terminus of this base sequence : -413
ttcaccaaggaagctacatagctgggaaacaagcacaggaaaataggctcaacatcgttgtcattatagaaatgcaaattaaaaatcaccatgagaggctgggcacagtggctcgtgcctgtaatcccaacactttgggaagtcgaggtgggaggatcactcgagcccaagaggtcgagcccatgattgcaccactgcactccagcctgggtgacagagtgagatgctatctcacacacacacacacacacacacacacacacacacacacacacacacacaaaatcataatgagaaccactacgactgtta

SEQ ID NO: 15356 - DNA, 197 bp, Homo sapiens
  Z66600
  Located on chromosome 9
  Distance between a terminus base of telomere on chromosomal short arm and 5'-terminus of this base sequence : 91526605
  Distance between 3'-terminus of neighbour sequence of sequence listing upward to telomere on chrosomal short arm and 5'-terminus of this base sequence : 76856
tactcggctgagacatgagaattgcttgaacctggaggtggaagttatagtgagttgagattgcactgctgcactccagcctgggcaacagagcaagactccctctcaaaacaaacaaactatacacacacacacacacacacacacacacacacacacgcacacacacacatatttaacagattataggaggagct

SEQ ID NO: 15357 - DNA, 403 bp, Homo sapiens
  chr9.fa.O7frz.98634587
  Located on chromosome 9
  Distance between a terminus base of telomere on chromosomal short arm and 5'-terminus of this base sequence : 91836978
  Distance between 3'-terminus of neighbour sequence of sequence listing upward to telomere on chrosomal short arm and 5'-terminus of this base sequence : 310176
gctattgagttctgctcagaggaccctgtacagggaggtgatgctggagaactacagccatctggtctccctgggtaaggctggcctgtttaaggtttcagattctgcttgtgggtattttaagctcttacatagcaagctgccatgcttctgactcagaaaaacagttttttcccctattcccccagagaatgcctggctttcacagtgcagttgtgtgtgtgtgtgtgtgtgtgtgtgtgtgtgtgcgcgtgcacatgctgtgagcgtgtggtgtgtctgacactgcatttttcaggcctgtttaccctggctgggctcctcctctaaggttatcctccttcaaaaggaggaatatttttattgactcaagcacagggtagaatcaacatactgcctttag

SEQ ID NO: 15358 - DNA, 185 bp, Homo sapiens
  DISD22_0006615
  Located on chromosome 9
  Distance between a terminus base of telomere on chromosomal short arm and 5'-terminus of this base sequence : 91967444
  Distance between 3'-terminus of neighbour sequence of sequence listing upward to telomere on chrosomal short arm and 5'-terminus of this base sequence : 130063
gactgtcttctgtatccttacagagaggtccaggccagctcaggctgacccccaaatgctgtgagggtagtaaaacattggcaggctgtggggtggggactggctgcgtgcatgtgtgtgtgtgtctgtgtgtgtgtgtgtgtgtgtgacagagagagagagaaaaccagaaatggtgtgagacc

SEQ ID NO: 15359 - DNA, 201 bp, Homo sapiens
  D9S272
  Located on chromosome 9
  Distance between a terminus base of telomere on chromosomal short arm and 5'-terminus of this base sequence : 92092967
  Distance between 3'-terminus of neighbour sequence of sequence listing upward to telomere on chrosomal short arm and 5'-terminus of this base sequence : 125338
actgcactccagcatgggtgacagagtaagagagaacctgtctcaaaaaaataaaaaaataaaaataaataaataaaacaaataaccaaccatgcacactgcacacacgctgtctccttaaccccactccgtctctcatagacacacacacacacacacacacacacacacacacacacacacggtttccctgtaggagag

SEQ ID NO: 15360 - DNA, 360 bp, Homo sapiens
  chr9.fa.O7frz.101796995
  Located on chromosome 9
  Distance between a terminus base of telomere on chromosomal short arm and 5'-terminus of this base sequence : 92176942
  Distance between 3'-terminus of neighbour sequence of sequence listing upward to telomere on chrosomal short arm and 5'-terminus of this base sequence : 83774
gtacagctgaatagcagtcaagacactttctattagtccataaagggaacacaactcaaattcacaagtttttttgtttgtttgttttttttaaagaaatgtattggctcatgaaaccaggtaggacggggatgcagagactcaagcaacgtggcatgacaatgtggtcactcactctgttctctctctcggtgtgtgtatgtgtgtgtgtgtgtgtgtgtgtgtgtgtgtgtgtgtgtgtaagactatgtctatctgtcttgcttctctttttctgtgaatatggctccttccatccaagtgaggacaagattcatgcggcagagatgtctgcaaacagctctaggcttatgttattcc

SEQ ID NO: 15361 - DNA, 320 bp, Homo sapiens
  AL137067.7_537
  Located on chromosome 9
  Distance between a terminus base of telomere on chromosomal short arm and 5'-terminus of this base sequence : 92295796
  Distance between 3'-terminus of neighbour sequence of sequence listing upward to telomere on chrosomal short arm and 5'-terminus of this base sequence : 118494
ccttatgactttatggatgttaactttaaatcaactgaaaccatacccaagagactattctaaatgggaagagatggagttacctttaattaagaagcttaagatgcccctgtcctaggttgaattccctcatcagagaaagggtagaggcttgggtacaagataagacatgttgcagagaagacagttattattattattattattattattataacatctaagttgtagtgggtaattgtttactttacttgctatgacctgaatgtcggtgtccccctaaaattcatatattggaacttaatttctaaggtgatggt

SEQ ID NO: 15362 - DNA, 175 bp, Homo sapiens
  AL137067.7_96850
  Located on chromosome 9
  Distance between a terminus base of telomere on chromosomal short arm and 5'-terminus of this base sequence : 92392259
  Distance between 3'-terminus of neighbour sequence of sequence listing upward to telomere on chrosomal short arm and 5'-terminus of this base sequence : 96143
gtactgcttgactacggaagactatagatgctatgtctgtgtgtgtgtgtgtgtgtgtgtgtgtgtgtgtgtgtgtgtgtgtgtgtgtgtgtggtgtctatagcagctatagtgctgtatctaagtcatacaaaagttctgatgtgaccccagctaattccagccttccattaac

SEQ ID NO: 15363 - DNA, 328 bp, Homo sapiens
  AL137067.7_102026
  Located on chromosome 9
  Distance between a terminus base of telomere on chromosomal short arm and 5'-terminus of this base sequence : 92397394
  Distance between 3'-terminus of neighbour sequence of sequence listing upward to telomere on chrosomal short arm and 5'-terminus of this base sequence : 4960
ggtatagcgtgttaccatctacaccatgttttcacttatgggattcttgctaaatgagtagattttcactgctcttgccacacacacacacacacacacacacacacacacacacaaatgggtaacgatgtgagatgatgggtatgatagtttgcttcacgttctctttatgtgatcctcacaaccatactgaaaaggcacacagaacgtctacttttattctttttgtacagatgaagaaattgaggttcaaggagtaagaatctcctgaagaatccatatgtctttcagtgaaattctgaatgtattgtaatgaagtacggttggt

SEQ ID NO: 15364 - DNA, 220 bp, Homo sapiens
  AL137067.7_104771
  Located on chromosome 9
  Distance between a terminus base of telomere on chromosomal short arm and 5'-terminus of this base sequence : 92400159
  Distance between 3'-terminus of neighbour sequence of sequence listing upward to telomere on chrosomal short arm and 5'-terminus of this base sequence : 2437
ggaaactagatgactgctcagtgtaaatgaccaatggcagggtataaggggtgtgtgcgtgtgtgtgtgtgtgtgtgtgtgtgtgtgtgtgtgtgtgtgtttatgttgagggtgatgtgggggaagagaaaagcagcggatataattttctccaacagccagctaagctgaagggatgtagagcctatgattcaatttttcaaagcagtatttgtaaggc

SEQ ID NO: 15365 - DNA, 137 bp, Homo sapiens
  D9S176
  Located on chromosome 9
  Distance between a terminus base of telomere on chromosomal short arm and 5'-terminus of this base sequence : 92400186
  Distance between 3'-terminus of neighbour sequence of sequence listing upward to telomere on chrosomal short arm and 5'-terminus of this base sequence : -193
tgaccaatggcagggtataaggggtgtgtgcgtgtgtgtgtgtgtgtgtgtgtgtgtgtgtgtgtgtgtgtgtttatgttgagggtgatgtgggggaagagaaaagcagcggatataattttctccaacagccagct

SEQ ID NO: 15366 - DNA, 108 bp, Homo sapiens
  DISO7_10002741
  Located on chromosome 9
  Distance between a terminus base of telomere on chromosomal short arm and 5'-terminus of this base sequence : 92520304
  Distance between 3'-terminus of neighbour sequence of sequence listing upward to telomere on chrosomal short arm and 5'-terminus of this base sequence : 119981
atgtgtcctcttgagccccatccaacccctgcagacacacatacacatacacacacacacacacacacacacacacacacacagccccacccacccttgtctcctcaa

SEQ ID NO: 15367 - DNA, 200 bp, Homo sapiens
  D9S1783
  Located on chromosome 9
  Distance between a terminus base of telomere on chromosomal short arm and 5'-terminus of this base sequence : 92732756
  Distance between 3'-terminus of neighbour sequence of sequence listing upward to telomere on chrosomal short arm and 5'-terminus of this base sequence : 212344
agtggaactcagcacaaggacttatctcaataagtccaaattcctaaagaggaaaaccacttatatcttacctaaacaatgttaaacacacacgcgcgctcacacacacacacacacacacacacactaacagtaaaataacagtaccaaaataacagtaccaaaacttacatataccttcctgtcttttgagttgttaa

SEQ ID NO: 15368 - DNA, 102 bp, Homo sapiens
  DISO7_10002746
  Located on chromosome 9
  Distance between a terminus base of telomere on chromosomal short arm and 5'-terminus of this base sequence : 93034939
  Distance between 3'-terminus of neighbour sequence of sequence listing upward to telomere on chrosomal short arm and 5'-terminus of this base sequence : 301983
ttgctggtgtatgcagatcttaattacttttagaaatttgattgtgtatgtgtgtgtgtgtgtgtgtgtgtctctacaacctggaggtagtctccaagactt

SEQ ID NO: 15369 - DNA, 249 bp, Homo sapiens
  DISO7_10002745
  Located on chromosome 9
  Distance between a terminus base of telomere on chromosomal short arm and 5'-terminus of this base sequence : 93072658
  Distance between 3'-terminus of neighbour sequence of sequence listing upward to telomere on chrosomal short arm and 5'-terminus of this base sequence : 37617
aaggaaatacctatactaacttgcctattatgatagttataaactgttatcacaaaacagtcactgatatgttttattagttagaattgggatatatatatgtgtgtgtgtgtgtgtgtgtgtgtgtgtgtgtatatatatatatatgggtgggtgttttgttgcagctgctgatctttttctttgcagatggtacaaactctcccgagtcaatttcctgggcctatgtccccacctagctgactgaag

SEQ ID NO: 15370 - DNA, 228 bp, Homo sapiens
  AL137072.8_71556
  Located on chromosome 9
  Distance between a terminus base of telomere on chromosomal short arm and 5'-terminus of this base sequence : 93324787
  Distance between 3'-terminus of neighbour sequence of sequence listing upward to telomere on chrosomal short arm and 5'-terminus of this base sequence : 251880
aacatcagactccaagtacttcagctttcgcactcagactggctctccttgctcctcagcttgcagacagcctattgtggaaccctgtgattgtgtgagttaatgctccttaataaactcccctttacacacacacacacacacacacacacacacacacacacacacagacaccctattagttctgcttttctagagaaccctaatacaaacatattgttcactgcc

SEQ ID NO: 15371 - DNA, 407 bp, Homo sapiens
  chr9.fa.O7frz.102640797
  Located on chromosome 9
  Distance between a terminus base of telomere on chromosomal short arm and 5'-terminus of this base sequence : 93430887
  Distance between 3'-terminus of neighbour sequence of sequence listing upward to telomere on chrosomal short arm and 5'-terminus of this base sequence : 105872
ctccatggttaacaccattatgatttttaacacaaaagattagttttacctgttcttgaagtttttataaatagaattttttttttgctgtctacaagagaaacacttcattttgtatatgcatagaaatatatatatatatatatatatatatatatatatatatatattcattttagtagcttttatagtgcaagtggtttttggttacatggatgaattgtgtagtggtgaagtctaagattttagtgcacccatcacctgaatagtgtatgttgtacccaatatgtagctttttattcctctgcccactctcacccttcccctttctgagtccccaaagtacattatatcactctgtatgcctttgcataaccatagcttagcttccacttataagtgagaac

SEQ ID NO: 15372 - DNA, 246 bp, Homo sapiens
  D9S173
  Located on chromosome 9
  Distance between a terminus base of telomere on chromosomal short arm and 5'-terminus of this base sequence : 93637569
  Distance between 3'-terminus of neighbour sequence of sequence listing upward to telomere on chrosomal short arm and 5'-terminus of this base sequence : 206275
ctctggaggatgggaagtgaaagatcaaggtgccagaagatttcgtgtgttgtgagggccctcttccagtttacggacaggctccttgctgtatcctcacatggcgcacacacacacacacacacacacacacacagagagagagagagagagagagagagaaagagaactctagtctcctcctcttcttaaaaggacatcgatctcatcatgaaggcctcaccatcaagacctcagctaaaccca

SEQ ID NO: 15373 - DNA, 392 bp, Homo sapiens
  AL353793.5_28135
  Located on chromosome 9
  Distance between a terminus base of telomere on chromosomal short arm and 5'-terminus of this base sequence : 93776619
  Distance between 3'-terminus of neighbour sequence of sequence listing upward to telomere on chrosomal short arm and 5'-terminus of this base sequence : 138804
ctgcattggaatcagagtattaaggtaggatcttaatatttatcttcaggcagggcgcagtggctcatgcctgtaatctcaatctcagcactttggcgggcagagcatgaggtcaagagatcaagaccatcctgaccaacatgatgaaaacccgtctctaataaaaatacaaaaattagctgggtgtggtggcatgcacctgtagtcccagctactcgggaggctgaggcaggagaattgcttgaacctggtaggcagaggtttcagtgagccaagattgcgccactgtactccagcctggcgatggagtgagactccatctcaaaagactaaataaataaataaataaataataaaaaatttatcttctagtctgatcctctcacttcaaa

SEQ ID NO: 15374 - DNA, 261 bp, Homo sapiens
  chr9.fa.O7frz.103148674
  Located on chromosome 9
  Distance between a terminus base of telomere on chromosomal short arm and 5'-terminus of this base sequence : 94020245
  Distance between 3'-terminus of neighbour sequence of sequence listing upward to telomere on chrosomal short arm and 5'-terminus of this base sequence : 243234
gtatgcttgccatacaataaactgcacatattttaagtatacgatttcaagtacacacacacacacacacacacacacacacacacacacacagagaatgaaacaatagctacagtcaacataataaacatatcatatagtgggtctttttaatgggttctctgttgtaaaaaaactagaaatctgaagtttttaaatcttttttctgaaacttttattttaggcttgggggcacatgtgaaaggtttgttacataggtaa

SEQ ID NO: 15375 - DNA, 326 bp, Homo sapiens
  AL357293.10_84612
  Located on chromosome 9
  Distance between a terminus base of telomere on chromosomal short arm and 5'-terminus of this base sequence : 94080781
  Distance between 3'-terminus of neighbour sequence of sequence listing upward to telomere on chrosomal short arm and 5'-terminus of this base sequence : 60275
atcaaattatgattacttgctcagtgtcttcatttcttatcaggctgttaactctgtgggggaaaggatttgttcttgctcactgtattttatagcacttagcacagtatatggtaaagttacagtaaatatttatggaatgactagctgggataaatgtctattttaaccacaattatttatttatttatttatttatttaattatgttttaagttctggggtacacttgcagaacgtgcaggtttgttacatatgtatacatgtgccatgatggtttgctacacccatcaacctgttatctacattaggtatttctcctaatgc

SEQ ID NO: 15376 - DNA, 442 bp, Homo sapiens
  AL162395.5_99781
  Located on chromosome 9
  Distance between a terminus base of telomere on chromosomal short arm and 5'-terminus of this base sequence : 94262696
  Distance between 3'-terminus of neighbour sequence of sequence listing upward to telomere on chrosomal short arm and 5'-terminus of this base sequence : 181589
ctatactttcctaggccatgactaagttttttatttatttttatttttatttatttatttatttatttatttgtttatttatttttgcacaatactgttaagttttcctgaaacaaagaaggggaaaaatgtattgaccaaggacacgaattaggtcctggcagagaattcttatttttcatgcatagcatcagtgaatagtttgttccagcctattaattatttaaatagttattatctatgtttgtctttcttgcttgaaataaaaactgctgatctaagcttatctgcatcttaacatcttttagcaatacagagtgtgtacaaaacctttttttggcagagcagaaagaggaagatgaatcttactatgagccaagaagctggcagcatgtccgtcatttttacatgaattctcctttaattatgacaacgaacttgt

SEQ ID NO: 15377 - DNA, 227 bp, Homo sapiens
  D9S1690
  Located on chromosome 9
  Distance between a terminus base of telomere on chromosomal short arm and 5'-terminus of this base sequence : 94595423
  Distance between 3'-terminus of neighbour sequence of sequence listing upward to telomere on chrosomal short arm and 5'-terminus of this base sequence : 332285
gactggcccgaaattctactaggctcccaatgcccccaaacaaatcaatgactcctgggaaagggccttcccctgcgagtgcaaagagagaagagaatgggatcagaaagagcgaaaaaaaggtcaaatagccgtgaaaatgcaaggtgagcaaaattacacacacacacacacacacacacacacacacactggcacattagttttaaaactttatgggaggccag

SEQ ID NO: 15378 - DNA, 138 bp, Homo sapiens
  AF025772.1_4762
  Located on chromosome 9
  Distance between a terminus base of telomere on chromosomal short arm and 5'-terminus of this base sequence : 94660598
  Distance between 3'-terminus of neighbour sequence of sequence listing upward to telomere on chrosomal short arm and 5'-terminus of this base sequence : 64948
accactttagtcttcagccatatcagctgctgatatgtgtgtgtgtgtgtgtgtgtgtgtgttttaatataccatgttgtctctcagtcactgccagcttatccatacatatggtattctggttgatagaaccaagta

SEQ ID NO: 15379 - DNA, 138 bp, Homo sapiens
  DISO7_10002748
  Located on chromosome 9
  Distance between a terminus base of telomere on chromosomal short arm and 5'-terminus of this base sequence : 94723706
  Distance between 3'-terminus of neighbour sequence of sequence listing upward to telomere on chrosomal short arm and 5'-terminus of this base sequence : 62970
caagttggttattgtttgaaggaggatggaaaaaaatggggaaagagggtgtatgtaaatttgtcatgaaatatatatatatatatatatatatatatatatatatatatatgagtcagagagaatggctcatggctc

SEQ ID NO: 15380 - DNA, 119 bp, Homo sapiens
  DISO7_10002749
  Located on chromosome 9
  Distance between a terminus base of telomere on chromosomal short arm and 5'-terminus of this base sequence : 94734680
  Distance between 3'-terminus of neighbour sequence of sequence listing upward to telomere on chrosomal short arm and 5'-terminus of this base sequence : 10836
ggccagagtcatcagaaatcaaacctaaagagagaggaagtagggaatggtaagagtaacttaaaaaaacaaacaaacaaacaaacaaaaaaacaaaaggacaagaactgagctcagca

SEQ ID NO: 15381 - DNA, 209 bp, Homo sapiens
  DISO7_10002751
  Located on chromosome 9
  Distance between a terminus base of telomere on chromosomal short arm and 5'-terminus of this base sequence : 94868091
  Distance between 3'-terminus of neighbour sequence of sequence listing upward to telomere on chrosomal short arm and 5'-terminus of this base sequence : 133292
attgaccagcttgcatccatctatctatctatctatctatctatctatctatctatctatctatctatcatctatctatctacatttttatccttatcatctagatgtctatcatctatctgtattagttccctagggctgatgtaacaaatgtaaaaaacagatttcagttgggagtttataatataaaggattcagctgagcaagtg

SEQ ID NO: 15382 - DNA, 101 bp, Homo sapiens
  DISO7_10002752
  Located on chromosome 9
  Distance between a terminus base of telomere on chromosomal short arm and 5'-terminus of this base sequence : 94880509
  Distance between 3'-terminus of neighbour sequence of sequence listing upward to telomere on chrosomal short arm and 5'-terminus of this base sequence : 12209
atagcaacaccctgccactaaacacacacacacacacacacacacacaatacagattaaattaaaatttattacactgtgccaccactcccagatatctga

SEQ ID NO: 15383 - DNA, 369 bp, Homo sapiens
  chr9.fa.O7frz.104288053
  Located on chromosome 9
  Distance between a terminus base of telomere on chromosomal short arm and 5'-terminus of this base sequence : 94941165
  Distance between 3'-terminus of neighbour sequence of sequence listing upward to telomere on chrosomal short arm and 5'-terminus of this base sequence : 60555
aagtctcaggtatacttcctgaagttctttgggttcatttctcaaacacattcatcatgatgaaaatattgtcactgacccggtgtaaattactgctgggcttcaaacctcacaatcttcttttacagcttcaaagtttgtggaataaatagccacgagggcagaggttatatactaacctaacatcccaccataaggagagagagagagagacagtgagagagagagagagagagagagagagagagagcgagagagaaagaaaaccaaacagaaatcatccagtatttatgtaaatttaaaaagtacttaatttagacaatatctaccatctatccatttcttctacagcaacagataatgtaggat

SEQ ID NO: 15384 - DNA, 117 bp, Homo sapiens
  DISD22_0006631
  Located on chromosome 9
  Distance between a terminus base of telomere on chromosomal short arm and 5'-terminus of this base sequence : 95105264
  Distance between 3'-terminus of neighbour sequence of sequence listing upward to telomere on chrosomal short arm and 5'-terminus of this base sequence : 163730
cattaagctgaggattggggatgatgctgtgtgtgtgtgtgtgtgtgtgtgtgtgtgtgtgtgtgtgtccccaagtgaggaaatacaaagtagttaagagatctatcctccttctca

SEQ ID NO: 15385 - DNA, 163 bp, Homo sapiens
  DISD22_0006635
  Located on chromosome 9
  Distance between a terminus base of telomere on chromosomal short arm and 5'-terminus of this base sequence : 95223138
  Distance between 3'-terminus of neighbour sequence of sequence listing upward to telomere on chrosomal short arm and 5'-terminus of this base sequence : 117757
gcagactctatacctggaaaggtttatgaaagtgtagggatgcggtttccaaaagttcacttatttatttatttatttatttatttatttatttattgagcaaatagttatctgtagatgtagtatgactattcttatacctctctatctgctgaggaggatc

SEQ ID NO: 15386 - DNA, 442 bp, Homo sapiens
  chr9.fa.O7frz.104512393
  Located on chromosome 9
  Distance between a terminus base of telomere on chromosomal short arm and 5'-terminus of this base sequence : 95476180
  Distance between 3'-terminus of neighbour sequence of sequence listing upward to telomere on chrosomal short arm and 5'-terminus of this base sequence : 252879
agattcctagactacaatttgtgaggaagttgtgacttctggagaaaggtgggtagattagagagagagagagaggtgatagagagagagagagagagagagagatagatagatagatagatagatagatagggaaatatacaaatattctttattcttcaacatttatgtagcagttggaaacatggtttcatgagatcatcaagggatactatttagagtgagcttagaagaaggctgagcaagtttaggccataaaggagtcataagaaaataagggaaaaataaaaggagaagtagagggtattttcactgtgactaagggagtttcaagaaagaaggtatgatcagcaaggtcaaatgacaatattcaaatattttaaactataaaaatgacaattttatgtgattcaccctagtaagcctaataagttaggaccac

SEQ ID NO: 15387 - DNA, 431 bp, Homo sapiens
  chr9.fa.O7frz.104705334
  Located on chromosome 9
  Distance between a terminus base of telomere on chromosomal short arm and 5'-terminus of this base sequence : 95680783
  Distance between 3'-terminus of neighbour sequence of sequence listing upward to telomere on chrosomal short arm and 5'-terminus of this base sequence : 204161
aagcagtacacaatgtaggttaacaaaccaatactactgtatgtttctgtttggctccaaatataattccctcattgtaacagaccctttgtctcatacttcacagggaaaaagtctgttcagcatgaatttctacaattttctatcttctcatttccatctttggatttacctgcatttctttttatgctttgctatatcttgacattctcaaagtgaaagaaaaatttgttcatttttaatgtagtctcaagctacttcttaaaaatttagattcctgtttctcaattgagcacattctttctgtctttctaatatccgtgtgtgtgtgcgtgtgtgtgtgtgtgtgtgtgtgtgcaggtacacatcctctaacttctcctgccttgtttatataaggtgctgtaaaaaagtctatgtcctggaggcat

SEQ ID NO: 15388 - DNA, 242 bp, Homo sapiens
  Z66775
  Located on chromosome 9
  Distance between a terminus base of telomere on chromosomal short arm and 5'-terminus of this base sequence : 95831065
  Distance between 3'-terminus of neighbour sequence of sequence listing upward to telomere on chrosomal short arm and 5'-terminus of this base sequence : 149851
gttttttaggtacagtggattccttaatggtaagatatcactccttgatttgtaacaatgttaagccatcaaaacataaactcagaacagaaacatttacactaataactatgtcctacatcacacacacacacacacacacacacgcacacacacactatcagtagttgaggcggaaattctaagcaatagttccaaggatacttaaaaagaaggagtttgtattgggcatgagatgaagg

SEQ ID NO: 15389 - DNA, 417 bp, Homo sapiens
  chr9.fa.O7frz.104927024
  Located on chromosome 9
  Distance between a terminus base of telomere on chromosomal short arm and 5'-terminus of this base sequence : 95902415
  Distance between 3'-terminus of neighbour sequence of sequence listing upward to telomere on chrosomal short arm and 5'-terminus of this base sequence : 71108
ttggattaaactcatacgatagactctgatgggaaaaaatcgatctatcatttatttatttttattcctataactaggcattcatgtctcaaagactcaaaatttatctcacccatcatccatcgatccatccagccatccttctattttgttgatgattattagtgacatatttacctacccacctcttctggaagagtacctttatggatgataactgatagaaattatatgacacagagagagggagagtgagtgtgtgtgtgtgtgtgtgtgtgtgtgtgtatgtgtactaaacggggagaagctggcagtggaacaacaaaagaacaaaatgttgggagtagacaaaagaagagccatgttagcaatatgtcattgtaattttagtttttcttgagtagaattggtactgca

SEQ ID NO: 15390 - DNA, 373 bp, Homo sapiens
  chr9.fa.O7frz.105080858
  Located on chromosome 9
  Distance between a terminus base of telomere on chromosomal short arm and 5'-terminus of this base sequence : 96059539
  Distance between 3'-terminus of neighbour sequence of sequence listing upward to telomere on chrosomal short arm and 5'-terminus of this base sequence : 156707
gtatgaattcatggtattgcatatgcagatgaatgatagacacatggtagatagacacatgacagataggtagaaaaaaacacagatgtaaatgcataaatctgtacacagacacatgcaaacatacatacatacatacatacatacatacatacatacatacataccctagctgcgtccactaagagaccattggagctgtggcacctcaatagtaacaaacaattattatgcaaagatcttacttttgaattaccactctccaccagaagaaactaaggctcatgagagaaatggctattttcagcactatggatgttaaatgacaagatgagactgaaatttagggctgtaccaggaaacttagaaaggt

SEQ ID NO: 15391 - DNA, 218 bp, Homo sapiens
  chr9.fa.O7frz.105186809
  Located on chromosome 9
  Distance between a terminus base of telomere on chromosomal short arm and 5'-terminus of this base sequence : 96167706
  Distance between 3'-terminus of neighbour sequence of sequence listing upward to telomere on chrosomal short arm and 5'-terminus of this base sequence : 107794
aaccacgttaaacttaacgatatgtatggacggtttacattttgaacctggcctgtttcaatccaatcccatacttgctgtatggttatggttaatgacaaaaacagtatggacacatacatgcgcatgcacacacacacacactctctctctctctctctctccccccaaatgtcttttggatttaaaagaaagtatctgaatattgaacattcagc

SEQ ID NO: 15392 - DNA, 410 bp, Homo sapiens
  chr9.fa.O7frz.105328433
  Located on chromosome 9
  Distance between a terminus base of telomere on chromosomal short arm and 5'-terminus of this base sequence : 96306504
  Distance between 3'-terminus of neighbour sequence of sequence listing upward to telomere on chrosomal short arm and 5'-terminus of this base sequence : 138580
gcttgtttattcatatcactcatactgtatttgtggttttgtttggggtggtaataaaatttatcttggaatgttattataaagtttgagtaattttacccacctagaattttctctagtgtgagttaacatcaacatccaacctcctacccttcatatactttatagaacagtacattccttccatgctggtttataattctactatgtcataaattaatatttaaaagagagagagagtctcatatatattgcctatcatatatacatatatatttaatacaatatcctatgtatgtgtgtatgtgtgtctatctatctatctatctatctatctatctatctatctatctatctgtctatctatctatctatagctggactttctaagatgtttaattggcatagtt

SEQ ID NO: 15393 - DNA, 207 bp, Homo sapiens
  D9S271
  Located on chromosome 9
  Distance between a terminus base of telomere on chromosomal short arm and 5'-terminus of this base sequence : 96432747
  Distance between 3'-terminus of neighbour sequence of sequence listing upward to telomere on chrosomal short arm and 5'-terminus of this base sequence : 125833
gggatcaatctaagtgttcattggcagatttttggataaagaaaatgtgtgccttcatgcacgcaaacaggcatgcacacacacactcacacacacaaataaaatgctccacacacacacacacacacacaaacaataaaacactctttagcacacacaataaatgttcttcagtcttaaaaatgaaggatgtcctgccatttgtaa

SEQ ID NO: 15394 - DNA, 185 bp, Homo sapiens
  D9S277
  Located on chromosome 9
  Distance between a terminus base of telomere on chromosomal short arm and 5'-terminus of this base sequence : 96485536
  Distance between 3'-terminus of neighbour sequence of sequence listing upward to telomere on chrosomal short arm and 5'-terminus of this base sequence : 52582
atacttatattcggggatatgaaggattcaatgaatgatctctagaaagatttaaagaagaatattcagataaggatgttgaagataatgacactaaatctatggacacacacacacacacacacacacacacacacacacacacacacacacacacacagtttaatgaaggcttaaagaatcca

SEQ ID NO: 15395 - DNA, 399 bp, Homo sapiens
  D9S938
  Located on chromosome 9
  Distance between a terminus base of telomere on chromosomal short arm and 5'-terminus of this base sequence : 96701410
  Distance between 3'-terminus of neighbour sequence of sequence listing upward to telomere on chrosomal short arm and 5'-terminus of this base sequence : 215689
gtaaggggttgaggttttgccaaaacaatatttttccttccttccttccttccttccttccttccttccttccttcctttcattcctccctcctttcttcctttccttccttccttctttcctttctttcttcttctttgtgaagaattactcaaaaaaattactcaactactttcattttgtaaactggaatatgcatgcagggaaaaatcaaaacttgatttccattagaaatgcatgttatccaggtacttgattatttaaaataaatatgtcagtatacattactagatttctggaaaacaaaacattaaatggtttgtagtactaagttggtctctctaaagaagaatttactaaaataattgataaattaatctggatgtcagaaatgtggtg

SEQ ID NO: 15396 - DNA, 452 bp, Homo sapiens
  chr9.fa.O7frz.105911242
  Located on chromosome 9
  Distance between a terminus base of telomere on chromosomal short arm and 5'-terminus of this base sequence : 96885387
  Distance between 3'-terminus of neighbour sequence of sequence listing upward to telomere on chrosomal short arm and 5'-terminus of this base sequence : 183578
gaacttttcctcataagaccagactataatactataatatccctgtatgtgtgtgtgtgtatatatatatatatatatatatatttttttttttttttttgagatggagtctcactctgtcacccaggctggagtgcactggctcgatctcggttcattgcaagctctgccttccgggttcacagcattctcctgcctcagactcccgagtagctgggactacaggctcccgccaccacgcccggctaattttttttgtatttttagtagagatggggtttcaccgtgttagccaggatggtcttgatctcctgaccttgtgatccgcccacctcggcctcccaaagtgctgggattacaggtgtgagccactgcacccggccttatccctcaatattttatagtcagcaatcagtagtagaaaatggaataaatgctaattaagattcacc

SEQ ID NO: 15397 - DNA, 345 bp, Homo sapiens
  chr9.fa.O7frz.106021495
  Located on chromosome 9
  Distance between a terminus base of telomere on chromosomal short arm and 5'-terminus of this base sequence : 96995567
  Distance between 3'-terminus of neighbour sequence of sequence listing upward to telomere on chrosomal short arm and 5'-terminus of this base sequence : 109728
caacaaacctccatgacacgtgtttacctgtgtaacaaacctaaaatacaagtttaagagaagacaagaaaaaaaaagacagttctaaccaaactctcttttaaattcagtgcaagttcaatcaggccgtgtgtgtgtgtgtgtgtgtgtgtgtgtgtgtgtgtgtacacctgcagggataaacaagtttattctacaatttatttggaaattcaaaagacttagaataataaaaatgatttttacaaaagaagaataaagatagaatatgttacctgattccaaaacttattttaacttaaaagcacttaattaaatgtagtattgctataaagataggtgcaa

SEQ ID NO: 15398 - DNA, 285 bp, Homo sapiens
  AL356576.8_96840
  Located on chromosome 9
  Distance between a terminus base of telomere on chromosomal short arm and 5'-terminus of this base sequence : 96995567
  Distance between 3'-terminus of neighbour sequence of sequence listing upward to telomere on chrosomal short arm and 5'-terminus of this base sequence : -345
caacaaacctccatgacacgtgtttacctgtgtaacaaacctaaaatacaagtttaagagaagacaagaaaaaaaaagacagttctaaccaaactctcttttaaattcagtgcaagttcaatcaggccgtgtgtgtgtgtgtgtgtgtgtgtgtgtgtgtgtgtgtacacctgcagggataaacaagtttattctacaatttatttggaaattcaaaagacttagaataataaaaatgatttttacaaaagaagaataaagatagaatatgttacctgattccaa

SEQ ID NO: 15399 - DNA, 373 bp, Homo sapiens
  chr9.fa.O7frz.106138980
  Located on chromosome 9
  Distance between a terminus base of telomere on chromosomal short arm and 5'-terminus of this base sequence : 97122803
  Distance between 3'-terminus of neighbour sequence of sequence listing upward to telomere on chrosomal short arm and 5'-terminus of this base sequence : 126951
ttatcttatgaagctgaacttcacaattctacttccagacatatagcctaagtatgtattcatgctcttgtgcaccaggagacatgtatacaaatattcacagaactattagtttcaacagaaaacactgaaagcaacttaaattttttttggcggcagaacatataacaaatgaccctccctacacacacgtgcacacacacacacacacacacacacacaatagacggcatacggtagtgaaatgaatgaaattcagctaccttcaataagaatgactcttaaaatacaattgtaaatgaagaaaagccagtcacaggaatacagatagagcaggctttttgtttttctaaataaccttagaacaagcaaa

SEQ ID NO: 15400 - DNA, 335 bp, Homo sapiens
  chr9.fa.O7frz.106268895
  Located on chromosome 9
  Distance between a terminus base of telomere on chromosomal short arm and 5'-terminus of this base sequence : 97251983
  Distance between 3'-terminus of neighbour sequence of sequence listing upward to telomere on chrosomal short arm and 5'-terminus of this base sequence : 128807
ctatggattccagacattgtatagaaaatcattgtaaaaatccctgtcctgttctgttctgttctgttctgttctgttctgttctgattaccagtgcatgcagcccccagtcacgtacccccccgcttgctcaatcgatcacgactctctcacgtggaccccctcacagttgtgagcccttaaaagggacaggaattgctcacgtggggagctcggctcttgagacaggagtcttgccaatgctcccggccgaataaaccccttccttctttaactcggtgtctaagggggtttgtctgtggctcttcctgctacatttctaccagttcaaagag

SEQ ID NO: 15401 - DNA, 332 bp, Homo sapiens
  chr9.fa.O7frz.106449665
  Located on chromosome 9
  Distance between a terminus base of telomere on chromosomal short arm and 5'-terminus of this base sequence : 97424563
  Distance between 3'-terminus of neighbour sequence of sequence listing upward to telomere on chrosomal short arm and 5'-terminus of this base sequence : 172245
tggatactatgttcactatctgaatgatgacatcaatagaagcccaaaccccagcatcatggaatatacccttgtaataaaccttcacatgtacccctgaatctaaaattaaaaaaaagtaaaaaagcatgactccaacaatcaaaatatatatatatatatatatatgtatatatatatatacacatatataaattataatgcagagtaataccccgtgggttcaaactgaaactatcttctatgcgatttgtctgctactgctcctttccttccgtatctttctctgtcctgttttcctcagtccattatcagtttcctaatctgcttct

SEQ ID NO: 15402 - DNA, 287 bp, Homo sapiens
  AL161791.8_133597
  Located on chromosome 9
  Distance between a terminus base of telomere on chromosomal short arm and 5'-terminus of this base sequence : 97548199
  Distance between 3'-terminus of neighbour sequence of sequence listing upward to telomere on chrosomal short arm and 5'-terminus of this base sequence : 123304
tacctatgtaacaaacctgcacattctgcacatgtatcccagaacttaaagtataataaaaaaaaaagaagaggaagaggaagaagatgaacaagaataagaagaggaagaggaagaaggagaagaagaagaagaagaagaagaagaagaagaagaagaagaagaagaagaagaaggcagcagctggagataaaaggtcacacaaagaacaatttgtgtaacataaaacctcttgactgtgacaatggaagcaaaaaaaaaaaacagtagaacaatttattcgaagt

SEQ ID NO: 15403 - DNA, 131 bp, Homo sapiens
  DISO7_10002753
  Located on chromosome 9
  Distance between a terminus base of telomere on chromosomal short arm and 5'-terminus of this base sequence : 97645240
  Distance between 3'-terminus of neighbour sequence of sequence listing upward to telomere on chrosomal short arm and 5'-terminus of this base sequence : 96754
aagcacagaatttcaagtggtattttttttactgtgtatgtgtgtgtgtgtgtgtgtgtgtgtgtgtgtgtgtgtagacataaaagaacatttccaatgagagaaaaatacgtgtggaccaatgttatatg

SEQ ID NO: 15404 - DNA, 117 bp, Homo sapiens
  DISO7_10002755
  Located on chromosome 9
  Distance between a terminus base of telomere on chromosomal short arm and 5'-terminus of this base sequence : 97803673
  Distance between 3'-terminus of neighbour sequence of sequence listing upward to telomere on chrosomal short arm and 5'-terminus of this base sequence : 158302
gccagaccagttatccctctactatccaccccaacacacacacacacacacacacacacacacacacacacacacacacacacacacacacacacagtgagtcaggaataaaggcct

SEQ ID NO: 15405 - DNA, 153 bp, Homo sapiens
  DISO7_10002757
  Located on chromosome 9
  Distance between a terminus base of telomere on chromosomal short arm and 5'-terminus of this base sequence : 97832360
  Distance between 3'-terminus of neighbour sequence of sequence listing upward to telomere on chrosomal short arm and 5'-terminus of this base sequence : 28570
aggatgttcatgagcgttccttttcagcagagtaggtcaaaaagaagtttctcttagagattgtgtgtgtatgtgtgtgtgtgtgtgtgtgtgtgtgtgtgtgtgtgtgtgtgtgtgtgtatgtgtagggtgatattcagattactctgtgac

SEQ ID NO: 15406 - DNA, 294 bp, Homo sapiens
  DISO7_10002756
  Located on chromosome 9
  Distance between a terminus base of telomere on chromosomal short arm and 5'-terminus of this base sequence : 97841685
  Distance between 3'-terminus of neighbour sequence of sequence listing upward to telomere on chrosomal short arm and 5'-terminus of this base sequence : 9172
cctagtaacaccctgtctctaccaaaaaaaaaaaaaaaaagaaagaaagaaagaaaagaaaagaaaaggaaagaaaagaaaagaaaagaaaagaaaacattagcctagcacagtggcacatgtctgtagtcccagacacttggaaggctgaggtgagaggattgcttgatccagggagtttgaggctgcagtgagccctgatcgtaccactgcactccaacctggggaacaaagcaagactgtgtctcaaaaaaacaaaaacaaaaacaaactgacattctttctattgccttc

SEQ ID NO: 15407 - DNA, 421 bp, Homo sapiens
  chr9.fa.O7frz.106955333
  Located on chromosome 9
  Distance between a terminus base of telomere on chromosomal short arm and 5'-terminus of this base sequence : 97900118
  Distance between 3'-terminus of neighbour sequence of sequence listing upward to telomere on chrosomal short arm and 5'-terminus of this base sequence : 58139
taagctggtgaatttgtatttatctcatgactaaagtactgaagtaaaagctctaggatctgtgtgtgtgtgtgtgtgtgtgtgtgtatttaaaaggcctttataatctctataattttatgtataattggcaattaaatccattttaattggcttatgaaaataaaagcacttgaatcaaacactatcagaaaaaagaaaaggctagtctaatgctttttcaggtttatttaacttaagtaaaataatacataagctggctttattagaaatgtcttaagaattgccagcataaaattttttgcatttattaagcaatttcacactatcccagccaaatactatacggtgttaaaatttggcataaggttaccaaactataaacccagcccaaaacagaatgatctttgcttacataatc

SEQ ID NO: 15408 - DNA, 350 bp, Homo sapiens
  chr9.fa.O7frz.107068895
  Located on chromosome 9
  Distance between a terminus base of telomere on chromosomal short arm and 5'-terminus of this base sequence : 97994286
  Distance between 3'-terminus of neighbour sequence of sequence listing upward to telomere on chrosomal short arm and 5'-terminus of this base sequence : 93747
aagtttccaagaaagcaattagcatttattgaatattagtataacattaaaattagataattgcctattatttcatatttactttctatagcatctcagtgtccagctgtgacataagcataataacaataaatatgccaaaactgtaaaattttgagactagtcaattttgaaataatttactccaaataattcacaatttcccctcaatttaaaaagaatatatgttttttaattagtgtggatacaactcaaagtatacacacatgcacacacacacacacacacacccctaataatttgtaaaaccaaaacagcatcaattttggaactcttcctagtttccaaca

SEQ ID NO: 15409 - DNA, 361 bp, Homo sapiens
  AC072059.1_161280
  Located on chromosome 9
  Distance between a terminus base of telomere on chromosomal short arm and 5'-terminus of this base sequence : 97994286
  Distance between 3'-terminus of neighbour sequence of sequence listing upward to telomere on chrosomal short arm and 5'-terminus of this base sequence : -350
aagtttccaagaaagcaattagcatttattgaatattagtataacattaaaattagataattgcctattatttcatatttactttctatagcatctcagtgtccagctgtgacataagcataataacaataaatatgccaaaactgtaaaattttgagactagtcaattttgaaataatttactccaaataattcacaatttcccctcaatttaaaaagaatatatgttttttaattagtgtggatacaactcaaagtatacacacatgcacacacacacacacacacacccctaataatttgtaaaaccaaaacagcatcaattttggaactcttcctagtttccaacatgttaaagtgg

SEQ ID NO: 15410 - DNA, 218 bp, Homo sapiens
  DISO7_10002759
  Located on chromosome 9
  Distance between a terminus base of telomere on chromosomal short arm and 5'-terminus of this base sequence : 98103237
  Distance between 3'-terminus of neighbour sequence of sequence listing upward to telomere on chrosomal short arm and 5'-terminus of this base sequence : 108590
aatcacaggaacacgcacacactacaaacacacacacacactacacacacacacacacacacacacacacacagagatacatgactgttatatcagataagtttatcttactttgtctccaaattagaaaaaacaaattgctaacaacaaaatgatcctccataagcttttaaaataaaatttctgaatgaaaactcctctagaggctcaagtattaa

SEQ ID NO: 15411 - DNA, 103 bp, Homo sapiens
  DISO7_10002761
  Located on chromosome 9
  Distance between a terminus base of telomere on chromosomal short arm and 5'-terminus of this base sequence : 98318799
  Distance between 3'-terminus of neighbour sequence of sequence listing upward to telomere on chrosomal short arm and 5'-terminus of this base sequence : 215344
acaagcagaacccagctcctcccgcatcctgatccctacacacacacacacacacacacacacacacacacatgccaccaccaccaccaaccacagagaataa

SEQ ID NO: 15412 - DNA, 374 bp, Homo sapiens
  chr9.fa.O7frz.107575015
  Located on chromosome 9
  Distance between a terminus base of telomere on chromosomal short arm and 5'-terminus of this base sequence : 98442087
  Distance between 3'-terminus of neighbour sequence of sequence listing upward to telomere on chrosomal short arm and 5'-terminus of this base sequence : 123185
agaatgtacagatacgaatctgaggaacaatttataaaataatttcatttattctatatgaagaggggagccttaaagactgtatgaaacttgagagctatgaattgctaataaaaagcagaatctctaacctctcccttagctctttggggattttctttgctttcctgagttaacttatagctattgcctgtcaactcccttccaagaacattacccatcaccttctgtggtctatatataaaatcttggcttccattctttcctaagacaatttcccatgaggatatctgtggttaattgtgtgtgtgtgtgtgtgtgtgtgtgtgtgtgtgtgtgtgtgtgtgtgctggtagcagctttacagatcaaca

SEQ ID NO: 15413 - DNA, 256 bp, Homo sapiens
  D9S1866
  Located on chromosome 9
  Distance between a terminus base of telomere on chromosomal short arm and 5'-terminus of this base sequence : 98595757
  Distance between 3'-terminus of neighbour sequence of sequence listing upward to telomere on chrosomal short arm and 5'-terminus of this base sequence : 153296
cggcctggtactcaatgtatttttaatgtttgaataaaggagtgaaagcaataaaaaaaaattctgcttttagttgtcacttagtaaattcattcattatttataacaggaagacaaaattagaggcctggcataactctacaggctcaggtgtaagccaaacacacacacacacacacacacacacacacacacaacctaatcagagttttttagaaattcagtcttagaaataagataggatggatgtgagggc

SEQ ID NO: 15414 - DNA, 186 bp, Homo sapiens
  D9S1784
  Located on chromosome 9
  Distance between a terminus base of telomere on chromosomal short arm and 5'-terminus of this base sequence : 98775786
  Distance between 3'-terminus of neighbour sequence of sequence listing upward to telomere on chrosomal short arm and 5'-terminus of this base sequence : 179773
ttaaggggactaaacagagacacaggtaaaatatacagtatagcagatgaagatatgtactgttttggagaaaattaagttaggaaacggggatggggagccgtgtgtgtgtgtgtgtgtgtgtgtgtgtgtgtgtgtgtgtgtgtgtgtgtgtgtatgtgcctgcagtttacaatagggttgtca

SEQ ID NO: 15415 - DNA, 407 bp, Homo sapiens
  AL158070.11_100230
  Located on chromosome 9
  Distance between a terminus base of telomere on chromosomal short arm and 5'-terminus of this base sequence : 99119904
  Distance between 3'-terminus of neighbour sequence of sequence listing upward to telomere on chrosomal short arm and 5'-terminus of this base sequence : 343932
agctatattaccttgagcaagttatttaacctctctgcctaagtttcctcagctgtaaaatggaaattatagtagaaattgccacatagagtggttttaaggattaaaagaattaatacacaaaaagagctttgaggtgtgtcaggaggtcctgggtgctaagtaattattacctgctgttactaatactactatagtagtagtagtagtagtagtagtagtagtagtagtagtagtagtaaagaaaactatttctcttcttattctcatgagaaatttacagattagagacatgtataattatctcaatattaaactgttacatctattcttagagaacttctgtaagagtgtcaccttttttctaagaaagataatttctagagccagtattagagtcctgttat

SEQ ID NO: 15416 - DNA, 299 bp, Homo sapiens
  D9S172
  Located on chromosome 9
  Distance between a terminus base of telomere on chromosomal short arm and 5'-terminus of this base sequence : 99409908
  Distance between 3'-terminus of neighbour sequence of sequence listing upward to telomere on chrosomal short arm and 5'-terminus of this base sequence : 289597
atgggaatgagtagcaaacaaaggatgatctgtgtgtgtgtgtgtgtgtgtgtgtgtgtgtcagggcgggagagtgtgtgtgtgtgtgtgtgtgtgtgtgagagatagagagacagagagagagagactgagagactgagagagaatgtacctgtttctaagagaagccctggtaacaggtttctgggtaaatgaaagttgtattgtcttccatcagagatgacttgaaaataaagtgctttaatgctaatactgcagatgtctgcaggaaactcagcaccacactgaacactgtagtt

SEQ ID NO: 15417 - DNA, 296 bp, Homo sapiens
  HUMUT7422
  Located on chromosome 9
  Distance between a terminus base of telomere on chromosomal short arm and 5'-terminus of this base sequence : 99427432
  Distance between 3'-terminus of neighbour sequence of sequence listing upward to telomere on chrosomal short arm and 5'-terminus of this base sequence : 17225
ctagcacacatcacatgcccattttttttcctggagccaatggaggaagtgtgaacattatttcattctggaattaattaagaagcagtatctatctatctatctatctatctatctatctatctatctacctatcatctctattcatccatctaatcatctctatatctatgtatctatccatctatctgtctaccaatcatagttttggttctgaggctctgatgcaacacttgaaaaatagttattgggtttattggcatttgatacctcactgtgtacggagaaacaagcat

SEQ ID NO: 15418 - DNA, 188 bp, Homo sapiens
  D9S299
  Located on chromosome 9
  Distance between a terminus base of telomere on chromosomal short arm and 5'-terminus of this base sequence : 99427479
  Distance between 3'-terminus of neighbour sequence of sequence listing upward to telomere on chrosomal short arm and 5'-terminus of this base sequence : -249
agtgtgaacattatttcattctggaattaattaagaagcagtatctatctatctatctatctatctatctatctatctatctacctatcatctctattcatccatctaatcatctctatatctatgtatctatccatctatctgtctaccaatcatagttttggttctgaggctctgatgcaacactt

SEQ ID NO: 15419 - DNA, 344 bp, Homo sapiens
  chr9.fa.O7frz.108720583
  Located on chromosome 9
  Distance between a terminus base of telomere on chromosomal short arm and 5'-terminus of this base sequence : 99515597
  Distance between 3'-terminus of neighbour sequence of sequence listing upward to telomere on chrosomal short arm and 5'-terminus of this base sequence : 87930
atttctgatgttctgtatgaagactgagaggcactttacaatatgtaagggaaggagatagggttgtgtgtgtgtgtgtgtcccagtgttatcttggtgggagatcttctgctggttgcatctagtctcgcttccacaaacatgaggataaccactcctgtgtcttctgggccctattttctactcagtgcatgggtgcatgtgtgtgtgtgtgcaggtatgtgtatgtgagtgtgtgtgtgtgtgtgtgtgtgtgtgtatccctaccagtgacctgggccattgaatgaagcatttttgacatggggtggattgtataagaggttaggaaatctctaaaggcg

SEQ ID NO: 15420 - DNA, 468 bp, Homo sapiens
  chr9.fa.O7frz.108836737
  Located on chromosome 9
  Distance between a terminus base of telomere on chromosomal short arm and 5'-terminus of this base sequence : 99630102
  Distance between 3'-terminus of neighbour sequence of sequence listing upward to telomere on chrosomal short arm and 5'-terminus of this base sequence : 114161
ttggttctagcagtctagttctagctcagtcaggagagccacatttaataattcagttgtaaagaggtagagtcacctttttcatctcttcataatcgtctcaagtactgggactttgggtccttagcatctctggatttcttccatccagaagacatttaatgtatttccttataagatacagggacattctgccagccatgaaagtagttatctacgccttatttattgaaagatttttcttttttgaggaaatggcaaaattgtacttgactgtgtgttgacaaattgatttttcttttaagattcagcaatatgaacatagaccaatctctccacttttaagacacacacatacatacacacacacacacacacacacacacacatcccaggaaatgctgcataccttcaaggaatgtagtggaactactacgtatggaaagcctaagctttgccttcaactaa

SEQ ID NO: 15421 - DNA, 108 bp, Homo sapiens
  DISO7_10002763
  Located on chromosome 9
  Distance between a terminus base of telomere on chromosomal short arm and 5'-terminus of this base sequence : 99747301
  Distance between 3'-terminus of neighbour sequence of sequence listing upward to telomere on chrosomal short arm and 5'-terminus of this base sequence : 116731
ttctgagttgaatatgaggccaaatttttatctatctatctatctatctatctatctatctatctatctatctatctatctatccatccatccatcctatcatgtctc

SEQ ID NO: 15422 - DNA, 391 bp, Homo sapiens
  AC024404.3_116337
  Located on chromosome 9
  Distance between a terminus base of telomere on chromosomal short arm and 5'-terminus of this base sequence : 100082439
  Distance between 3'-terminus of neighbour sequence of sequence listing upward to telomere on chrosomal short arm and 5'-terminus of this base sequence : 335030
cataatcacaatttgtaggcaggctggaagtggccaccccagagctgagagctatggagaacattcatttctgccaccgcagacagctcagccacagatatggatgatgaaagggaacttggcattgaccttgctgcttttcaaggagcagatgggacctggagtctggttagcaaagaaaaatgaactgagcctccttgatagtatttgaagaacaagagctggacccaactgtctcttcctccctggtgtgtgtgtgtgcatgtgtgtgtgtgtgtgtgtgtgtgtgtgtgtgcatgtgcctatgtacacacaccagctgtgtctgacgtgcaagagaaagacaaacacccttgtccatgctggagctccctattgcacatttggcatt

SEQ ID NO: 15423 - DNA, 258 bp, Homo sapiens
  chr9.fa.O7frz.109258354
  Located on chromosome 9
  Distance between a terminus base of telomere on chromosomal short arm and 5'-terminus of this base sequence : 100086664
  Distance between 3'-terminus of neighbour sequence of sequence listing upward to telomere on chrosomal short arm and 5'-terminus of this base sequence : 3834
ctgaagtgacaggtataagcagtgctgcttaatcctgatgctttggctggagaatactgatgtgtggggtcaatcagttacttttgacagatccaagcttttttactccaagcaagcctgtttctgatctttggtggcttggaatgaggtagaactgttattattattattattattattattattattattattattattattatactttacattctgggatacatttggagaacctgcaggtttgttacataggta

SEQ ID NO: 15424 - DNA, 347 bp, Homo sapiens
  AC024404.3_78989
  Located on chromosome 9
  Distance between a terminus base of telomere on chromosomal short arm and 5'-terminus of this base sequence : 100196821
  Distance between 3'-terminus of neighbour sequence of sequence listing upward to telomere on chrosomal short arm and 5'-terminus of this base sequence : 109899
taagaacatggcagtagctagtgatctcaggcaggttggaatcatggatgggagtaaagggcagcaaccacactgcaggaacttcaggagcaagcaaaagttggagttaggagatgataacaaatataccacactcttaagaaactaaaatggagaaagaaggaaggagaaggagagggatatccagagttatcagaggcgtgtgtgtgtgtgtgtgtgtgtgcacgtgtgtgtatttgtctggggccatatttataatctgaaaaaaagaactagtaaacagggaataattaaatatcaacatgacaagggcagccattgtgcaagtccagttgtcagagttgact

SEQ ID NO: 15425 - DNA, 445 bp, Homo sapiens
  chr9.fa.O7frz.109337816
  Located on chromosome 9
  Distance between a terminus base of telomere on chromosomal short arm and 5'-terminus of this base sequence : 100196821
  Distance between 3'-terminus of neighbour sequence of sequence listing upward to telomere on chrosomal short arm and 5'-terminus of this base sequence : -347
taagaacatggcagtagctagtgatctcaggcaggttggaatcatggatgggagtaaagggcagcaaccacactgcaggaacttcaggagcaagcaaaagttggagttaggagatgataacaaatataccacactcttaagaaactaaaatggagaaagaaggaaggagaaggagagggatatccagagttatcagaggcgtgtgtgtgtgtgtgtgtgtgtgcacgtgtgtgtatttgtctggggccatatttataatctgaaaaaaagaactagtaaacagggaataattaaatatcaacatgacaagggcagccattgtgcaagtccagttgtcagagttgactgacaggtgtatagatagctcacctcacctttacatcggggtggaaagccacagtggaccttaggacaaagggacggttccagaagttcctattctagg

SEQ ID NO: 15426 - DNA, 451 bp, Homo sapiens
  chr9.fa.O7frz.109468163
  Located on chromosome 9
  Distance between a terminus base of telomere on chromosomal short arm and 5'-terminus of this base sequence : 100285780
  Distance between 3'-terminus of neighbour sequence of sequence listing upward to telomere on chrosomal short arm and 5'-terminus of this base sequence : 88514
ttggcatagtgtggataattagatgtgttagaataaataaattagaagggatgagacacagaaattgacacataaagtgagcgccccgaaaagcttaaaaaagttatccaaatgaagaaaacgaggaagaactttccaggcctgtgcagataagtgacacaattattagtataaaaattagtgagttagaaattatagaaagtgtgactagaaatgtaggcagagacatattataaagggccttgtgagccaaggagtgtggtcagtatcttatactcattcattcattttatacacacacacacacacacacacacacacacacacacatttactgacttcctagcacatcatgttaaatcattgaaaagtctcaagaaaggaaatgacatggccacatttgtttattagaatattattagttttggtagcaaagtaaagacagattgaa

SEQ ID NO: 15427 - DNA, 107 bp, Homo sapiens
  DISD22_0006641
  Located on chromosome 9
  Distance between a terminus base of telomere on chromosomal short arm and 5'-terminus of this base sequence : 100435620
  Distance between 3'-terminus of neighbour sequence of sequence listing upward to telomere on chrosomal short arm and 5'-terminus of this base sequence : 149389
gaacatcgtagaatgccttaaagaacacacacacacacacacacacacacacacacacacacacacacacacacacacacacccctggctgcggaggactattcaga

SEQ ID NO: 15428 - DNA, 294 bp, Homo sapiens
  chr9.fa.O7frz.109586642
  Located on chromosome 9
  Distance between a terminus base of telomere on chromosomal short arm and 5'-terminus of this base sequence : 100565831
  Distance between 3'-terminus of neighbour sequence of sequence listing upward to telomere on chrosomal short arm and 5'-terminus of this base sequence : 130104
atagtttgtcaaggattcatgtagctaataaatcatagagtcgggattcaacctcaggcctctttgactcttacctataatttccctagagaagaagttaggccagagggacatggagagagagagagagagagagaatgtgtgtgtatgtgtgtgtgtgtgggggggggggggtgtgtgcatgcatgcatgtgtgttttctcccctagatgggtgagagtttaaggtggggatgacttagctagtagtcaaagataaattgaaaatgcagaaaggataactatcagaccatct

SEQ ID NO: 15429 - DNA, 450 bp, Homo sapiens
  chr9.fa.O7frz.109679643
  Located on chromosome 9
  Distance between a terminus base of telomere on chromosomal short arm and 5'-terminus of this base sequence : 100658385
  Distance between 3'-terminus of neighbour sequence of sequence listing upward to telomere on chrosomal short arm and 5'-terminus of this base sequence : 92260
aaactcactgtaaattgacgtaagatagatgcatagatcagtagtgcagaagcaaaagtcaagaaataaaccctcatatatgtggtcagttgattttcataaaaggtgttaaggtaatagggaaaggatgattttttttttaaatggtgctgaaacaattagatttgtgtatgcagattatgacccttgacctttacagcactctctacacacacacacacacacacacacacacacacacacacacacaacaatcaaaatggaccgtaagcttaaatgtgtgagctaaaactataaaactttcagaagaataatagaagattatatcatcttgggttagggaaaaaaatttttatatatgatgcaaaagttatggacaactaaaagaaaaaagaagacaccattaagaaaatgaaaaggcaagcaacagactagaagcaaatatttgca

SEQ ID NO: 15430 - DNA, 329 bp, Homo sapiens
  chr9.fa.O7frz.109782946
  Located on chromosome 9
  Distance between a terminus base of telomere on chromosomal short arm and 5'-terminus of this base sequence : 100772571
  Distance between 3'-terminus of neighbour sequence of sequence listing upward to telomere on chrosomal short arm and 5'-terminus of this base sequence : 113736
tgaaagtttcagaaagcagtacttaaatagtgggaggaggatcattcaagttccatttcagtttttttcatgcaagaaagaacttctagtagactagaccaaggaaaccacaaatgacttagacagacactaatgtttccagagcaaggaaaacgtctcaacttctttattcacttaggcaataagagctcatgggaaaccacccaattcagggactacaaagtttgggagaactctatgtgtgcatgcgtgtgtgtgtgtgtgtgtgtgtgtgtgtgtgtgtgtgtgtaaaacagaacagactcacctgtcttggtaacctggtagat

SEQ ID NO: 15431 - DNA, 470 bp, Homo sapiens
  chr9.fa.O7frz.109898972
  Located on chromosome 9
  Distance between a terminus base of telomere on chromosomal short arm and 5'-terminus of this base sequence : 100908760
  Distance between 3'-terminus of neighbour sequence of sequence listing upward to telomere on chrosomal short arm and 5'-terminus of this base sequence : 135860
attcagatcaaggttcttatgacccctgaagttgtcacgtgttaaccagaaaacagatctgccaggtgcggtggttcacacctgtaatcccaacacattgggaggtcgaggcgggaagatcacttgaggccagaagttcaagaccagcctggccaacatggcaaaaccttgtctctactaaaaatgcaaaaaattagcctggtgtggtggcaggtgcctgtaatcccagctacttgggaggctgaggcatgataatcatttgaacctgggaggcaaaggttgcagtgagccaagattgcaccactgctctccagcctgggcaacagagtaagagtctgcctcaaaaaataaaataaaataaaataaaataaaataaaataaaataaaataaaataaaataaaggaaaagaaaactgggatctgagctagggcatcaatcaagtttagtctggtagatttgattagaggat

SEQ ID NO: 15432 - DNA, 116 bp, Homo sapiens
  DISO7_10002767
  Located on chromosome 9
  Distance between a terminus base of telomere on chromosomal short arm and 5'-terminus of this base sequence : 100993781
  Distance between 3'-terminus of neighbour sequence of sequence listing upward to telomere on chrosomal short arm and 5'-terminus of this base sequence : 84551
gaggattgttgagggctgggagccagaaataaaatgaggggttttgcgcacacgcgtgcgtgtgtgtgtgtgtgtgtgtgtgtgtttacttgacttttgcaactggctgaagaaca

SEQ ID NO: 15433 - DNA, 101 bp, Homo sapiens
  DISO7_10002768
  Located on chromosome 9
  Distance between a terminus base of telomere on chromosomal short arm and 5'-terminus of this base sequence : 101080259
  Distance between 3'-terminus of neighbour sequence of sequence listing upward to telomere on chrosomal short arm and 5'-terminus of this base sequence : 86362
tgctctcccatctggttctgtgccctggaagctgtattttctctctctctctctctctctctctttcttttctggctcccattgccattgtcactattata

SEQ ID NO: 15434 - DNA, 230 bp, Homo sapiens
  DISO7_10002770
  Located on chromosome 9
  Distance between a terminus base of telomere on chromosomal short arm and 5'-terminus of this base sequence : 101281577
  Distance between 3'-terminus of neighbour sequence of sequence listing upward to telomere on chrosomal short arm and 5'-terminus of this base sequence : 201217
gcagtgattgcagtctggttttgcttttgtgattatttgattaatgtctttcttctgacagtagactataagctccttgtgagtagggatcacatctatctttgttcgccattgatgttccgaatgcccaaccctgagccagacacatagctcgtgctccccaaatatcacacacgtgcgcacgcacacacacacacacacacacacacccagagttggtcttctagctc

SEQ ID NO: 15435 - DNA, 448 bp, Homo sapiens
  chr9.fa.O7frz.111411267
  Located on chromosome 9
  Distance between a terminus base of telomere on chromosomal short arm and 5'-terminus of this base sequence : 101373864
  Distance between 3'-terminus of neighbour sequence of sequence listing upward to telomere on chrosomal short arm and 5'-terminus of this base sequence : 92057
gttggaactcaggtcttctaactccaagtccaaggctctttgcttcatacaaaagctttctggccgggcgtggtggctcacacctgtaatcccagcactttgagaggctgaggcaggcagatcacgaggtcgggagatcgagaacatccgggctaacatggtgaaaccccatctctactaaaaatacaaaaaactagccagggcatggtagtgcgtgcctgtagtcccagctacttggaaggctgaggcaggagaatcgcttgaactcgggaggcggaggttgcagtgagcctagatcgtgccattgcactccagcctgggtgacagagcaagactccatctcaaataaataaataaataaataaataaagttttctaaattcattggaatcacctgaaatctcttgttaaaagtaaccagaattactgatcagaattaccagatttg

SEQ ID NO: 15436 - DNA, 461 bp, Homo sapiens
  chr9.fa.O7frz.111287695
  Located on chromosome 9
  Distance between a terminus base of telomere on chromosomal short arm and 5'-terminus of this base sequence : 101526458
  Distance between 3'-terminus of neighbour sequence of sequence listing upward to telomere on chrosomal short arm and 5'-terminus of this base sequence : 152146
aagtgacataattggtctatgactcagtctcatcatctgtagaatgggaaactactatgaggatcaaattagataagagatgtggaaggccagtatggtggcttacatctgtaatcccagaactttgagagtccagggcaggaggatcaccttagatcgggaattcaggaccagcctggccaacgtggtgaaactaaaatgtctctactaaaaatataaaaattagctgggcgtggtggcaggtacctgtaatcgcagctacttgggaggctgaggcacaagaatcgcttgagccagggaggctgaggttgcagtgagccgagattgcgccacagcactccagcctgggcgatagagcaagacttggtttcaaacaaaacaaaacaaaacaaaacagaacaaaacaagagatgtggaagccctttttagtggtaatatgatgtacacttgcaggtgataat

SEQ ID NO: 15437 - DNA, 352 bp, Homo sapiens
  AL353742.11_121634
  Located on chromosome 9
  Distance between a terminus base of telomere on chromosomal short arm and 5'-terminus of this base sequence : 101736632
  Distance between 3'-terminus of neighbour sequence of sequence listing upward to telomere on chrosomal short arm and 5'-terminus of this base sequence : 209713
gcagagatcgtaccactgtactccagcctcagtgacagagtgggactctgtctccaaaaaaaaaaaaacttcaaaaagcgcatatatacatatatgtgtgtgtgtgtgtgtgtgtatatatatatatatatacacacacatatatataatacacttagcaaagtaaacgtatttataaatatatattataaataaaattatctggttgactcttatcttaaccacttgctcctctatgaacttgttaaatttttttactcttctgtgtttctcatacctatcataatgagttactttgagaaataaatgagaaaatggatatgaaatatctagtgcataggaaatacgtagt

SEQ ID NO: 15438 - DNA, 94 bp, Homo sapiens
  D9S261
  Located on chromosome 9
  Distance between a terminus base of telomere on chromosomal short arm and 5'-terminus of this base sequence : 101919912
  Distance between 3'-terminus of neighbour sequence of sequence listing upward to telomere on chrosomal short arm and 5'-terminus of this base sequence : 182928
aggttgcaagatgtgtgattttgtgtgtgtgtgtgtgtgtgtgtgtgtgtgtttaacctccctcagtatttgtgaaatgggaataccacagcct

SEQ ID NO: 15439 - DNA, 454 bp, Homo sapiens
  chr9.fa.O7frz.110635910
  Located on chromosome 9
  Distance between a terminus base of telomere on chromosomal short arm and 5'-terminus of this base sequence : 102093195
  Distance between 3'-terminus of neighbour sequence of sequence listing upward to telomere on chrosomal short arm and 5'-terminus of this base sequence : 173189
agatgtctgtggagtgatcacgggcatgcttgacaatggtcggaaggagagctcacaggggaagccaaggccctgctgggtgtctcatcacttctcatgagcccagcctgggacaggacatggcctattcccctcaggctgccctgtagccagcccctttccctgggcagtgacaatggctcggagccaggcacccccattagctctccctgcactcccttttcagattctccaccatctaaaaatgtactgtccgtcacacacacacacacacacacacacacacacacacacacacacagagtttggcctcgggtttggccctgtgacaggaacctctgtaccttgatccctgcgctccagtggagctcagagctcagctcttcccagaacttcagagagaaaaagaacaatttcaccccaagccaccccttgagacttaattccttgtcac

SEQ ID NO: 15440 - DNA, 304 bp, Homo sapiens
  AL162389.4_75490
  Located on chromosome 9
  Distance between a terminus base of telomere on chromosomal short arm and 5'-terminus of this base sequence : 102234700
  Distance between 3'-terminus of neighbour sequence of sequence listing upward to telomere on chrosomal short arm and 5'-terminus of this base sequence : 141051
ttacacctcaactagaactctgagttgtacccacaataatccgtgccaggttctgggctgggtgatggggacacaactattaacagaaacaagcctcagcctctaccgtccgtgagctcacagtctagagggggaagctaatgttaaacaaacaaacaaacaaacaaacacaaaaaaactaattcaatcctatataatcagggccatcactgaaatccatgaaatctgctataggagtgagttaacggaaaaataatcttcccaggaaatcttggaaggatttaatgaggaagtgatacttgag

SEQ ID NO: 15441 - DNA, 122 bp, Homo sapiens
  G09125
  Located on chromosome 9
  Distance between a terminus base of telomere on chromosomal short arm and 5'-terminus of this base sequence : 102286809
  Distance between 3'-terminus of neighbour sequence of sequence listing upward to telomere on chrosomal short arm and 5'-terminus of this base sequence : 51805
atatagagatgataaatgacgatgctgatagatagatagatagatagatagatagatagatagatagatagatggcagcatgtaacattaaacttattttgtagcctaagaaattgaatatt

SEQ ID NO: 15442 - DNA, 186 bp, Homo sapiens
  D9S1801
  Located on chromosome 9
  Distance between a terminus base of telomere on chromosomal short arm and 5'-terminus of this base sequence : 102368875
  Distance between 3'-terminus of neighbour sequence of sequence listing upward to telomere on chrosomal short arm and 5'-terminus of this base sequence : 81944
gaagaaaaagtatgtgcacgtgtgtgtgtgtgtgtgtgtgtgtgtgtgtgtgtgtgtgtgtgtgttgacattgggaggcaggagccaaaaaggagtgcctgggtaatatgtgaccagggcaaaccaggttttctaactcatttatccagatcccgggtctttgctgtgtgggtgacgctaagcaac

SEQ ID NO: 15443 - DNA, 116 bp, Homo sapiens
  D9S1835
  Located on chromosome 9
  Distance between a terminus base of telomere on chromosomal short arm and 5'-terminus of this base sequence : 102514394
  Distance between 3'-terminus of neighbour sequence of sequence listing upward to telomere on chrosomal short arm and 5'-terminus of this base sequence : 145333
cctgggccacttggtggggggtgtgtgtgtgtgtgtgtgtgtgtgtgaggtatatatatgtatgtgtgtgtgtgtatatatatatatatatatggctagtttcctgccaaggctca

SEQ ID NO: 15444 - DNA, 258 bp, Homo sapiens
  D9S1677
  Located on chromosome 9
  Distance between a terminus base of telomere on chromosomal short arm and 5'-terminus of this base sequence : 102629630
  Distance between 3'-terminus of neighbour sequence of sequence listing upward to telomere on chrosomal short arm and 5'-terminus of this base sequence : 115120
acatagcaaggccccatctctaactaaaaacaatgaaaagatgtgtatttactctgtgtgtgtgtgtgtgtgtgtgtgtgtgtgtgtgtgtgtgtgtgtttaaacagtggagacaggttacatagatatgcaactggacctgaggtccaaaaagtcagaggcaacttctcaaaacagccaattttacttcattcaatttgattcattaaaatataattaattatttgttacaacattccctcagatattcatcaaatg

SEQ ID NO: 15445 - DNA, 325 bp, Homo sapiens
  AC068485.1_193032
  Located on chromosome 9
  Distance between a terminus base of telomere on chromosomal short arm and 5'-terminus of this base sequence : 102675555
  Distance between 3'-terminus of neighbour sequence of sequence listing upward to telomere on chrosomal short arm and 5'-terminus of this base sequence : 45667
tacaaggatcagatgataagctataagaagagacagaggaactgcaatggacatgagagccacctgcgtccaggaggttaagaagctttaaccattcattcattcattcaatcaatcaatatttatttatttatttatttatttattatttttttagggtctttgtcacccaggccagagcgcagtggcacgatcagagcttactgtagcctcaacctcctgggctcaagcgatcctcccacctcagcctcccaaattgctgggattacaggtgtaagccactacacccagacaataaatatttatcgaagactcttatgtgctc

SEQ ID NO: 15446 - DNA, 316 bp, Homo sapiens
  chr9.fa.O7frz.111825796
  Located on chromosome 9
  Distance between a terminus base of telomere on chromosomal short arm and 5'-terminus of this base sequence : 102753640
  Distance between 3'-terminus of neighbour sequence of sequence listing upward to telomere on chrosomal short arm and 5'-terminus of this base sequence : 77760
gtaacacgctacaaaggtttatagtttaggagtagtaggttgtatcttacagcctatatgtgtgctaggctttaccatttaggtttgtatcagtacactctatgacatttgcaggacgaaattgcctaatgacacatttctcagaatatatctccataattaagtgatgcatgactatattttttctctgcttgcgatttttacataatctacaatgatgtgtgtgtgtgtgtgtgtgtgtgtgtgtgtgtgtgtgtgtgtgttttgagacagagttttgctcttgctgcccaggctacagtgcaatggtaggatc

SEQ ID NO: 15447 - DNA, 310 bp, Homo sapiens
  chr9.fa.O7frz.111604403
  Located on chromosome 9
  Distance between a terminus base of telomere on chromosomal short arm and 5'-terminus of this base sequence : 102976449
  Distance between 3'-terminus of neighbour sequence of sequence listing upward to telomere on chrosomal short arm and 5'-terminus of this base sequence : 222493
ccattcttgagttatttcacttagaatagttatctccagttccatccaggtgctgtgaatgccattattttgttcctttttatggctgagtagtactccatggtgtgtgtgtgtgtgtgtgtgtgtgtgtgtgtgtgtacaccatattttactagttgattgatgggcattttggctggttccatatttttgcaattgcaaattgtgtgctataaacatgtgtgtgcaagtatcttttttgtataatgacttcttttcctctgggtagatacccaggagtgggattgctggatcaaatggtagatctact

SEQ ID NO: 15448 - DNA, 420 bp, Homo sapiens
  chr9.fa.O7frz.111532670
  Located on chromosome 9
  Distance between a terminus base of telomere on chromosomal short arm and 5'-terminus of this base sequence : 103063129
  Distance between 3'-terminus of neighbour sequence of sequence listing upward to telomere on chrosomal short arm and 5'-terminus of this base sequence : 86370
aatctcggctactcaggaggctgaggcaggagaatcgcttgaaccagagagtcggaggttgcagtgagccgagatcacataccactgaactccagcctgggagacagagcaagctccgtctctaaataaataaataaataaataaggaatgattatttccattcttgatgtgttgtgtttccaagaacattcaggtgatgtttccctgcaagcagttagagatcctggcctggaaatgagaatggaagagagatttaggggtcagaagttgcaagaggtaggagataaagccgtgaagaaatgtttctgaaaagaatggtgcaggttatccagcccttcacagaaaacctaacactatagccttcttgaatctgtgaacctggtctatatctccatgtaccgaagtctttaattgttcta

SEQ ID NO: 15449 - DNA, 125 bp, Homo sapiens
  DISD22_0006654
  Located on chromosome 9
  Distance between a terminus base of telomere on chromosomal short arm and 5'-terminus of this base sequence : 103342482
  Distance between 3'-terminus of neighbour sequence of sequence listing upward to telomere on chrosomal short arm and 5'-terminus of this base sequence : 278933
ggtgctcaataattcactgtgggatgaatggatggatggatggatggatggatggatgcatggatgcatggttggatggttgatggataaaccactaggtttatccctccactcacttcttatga

SEQ ID NO: 15450 - DNA, 136 bp, Homo sapiens
  D9S160
  Located on chromosome 9
  Distance between a terminus base of telomere on chromosomal short arm and 5'-terminus of this base sequence : 103478358
  Distance between 3'-terminus of neighbour sequence of sequence listing upward to telomere on chrosomal short arm and 5'-terminus of this base sequence : 135751
aaacctatcttgccacagagacagttgtgtgtgtgtgtgtgtgtgtgtgtgtgtgtgctgacatggatctcatcctaaagaaaaaataaatcttggcttcaatcaaatgaagactcatttcacatggcagcctcct

SEQ ID NO: 15451 - DNA, 470 bp, Homo sapiens
  AL135789.9_91179
  Located on chromosome 9
  Distance between a terminus base of telomere on chromosomal short arm and 5'-terminus of this base sequence : 103548124
  Distance between 3'-terminus of neighbour sequence of sequence listing upward to telomere on chrosomal short arm and 5'-terminus of this base sequence : 69630
gtgtcttcattctgagcagtagatcttaaaaatgggcttaaaatattcagtaaaccatgctgtaaacagcagatgtgctgccatccaggctttgttgttccatttatttatttatttatttattttatttttttacttttattttttagagcattaacctttgcaatttattttttttattatactttaagttttagggtacatgtacacaacatgcaggtttgttacatatgtatacatgtgccatgttggtgtgctgcacccactaactcctcatttaacattaggtatatctcctagtgctatccctcccccctccctccaccccacaacaggccccggtgtgtgatgttccccttcctgtgtccatgtgttctcattgttcaattcccacctatgagtgagaatatgcagtgtttggttttttgtccttgtgatagtttgctgagaatgatagtttccagcttcat

SEQ ID NO: 15452 - DNA, 476 bp, Homo sapiens
  AL158829.4_119034
  Located on chromosome 9
  Distance between a terminus base of telomere on chromosomal short arm and 5'-terminus of this base sequence : 103626917
  Distance between 3'-terminus of neighbour sequence of sequence listing upward to telomere on chrosomal short arm and 5'-terminus of this base sequence : 78323
cttaagtggagacaatgctagtacttcttcacagaattgtgatgagttaaatactagtaagaagagttcagcacatgtaagtgctcagtaatgttacctgcagtcattgccgtcttcatcaccatcatcatgatcaccatcatcatgatcatgatcatgatcatcatcatcatcatcatcatcatcatcatcatcatcatcaatgacatctgtggtttttaatagtggctgcatagtaaaatcacctgagaaatttacaaatagatcctgatatagttagtctggagtgggcattgggtaagggtataattttagagcaacccgcctttaaaagtctgatgtgcagtcacagttgagacccagccttgatctgtgcttctcaaacttgaattgtgcacagatcactagggcagtttgtaaaaaatgcagattctgattcagaaggtctcagggtgttgataatctgcatttcaaac

SEQ ID NO: 15453 - DNA, 446 bp, Homo sapiens
  chr9.fa.O7frz.112847890
  Located on chromosome 9
  Distance between a terminus base of telomere on chromosomal short arm and 5'-terminus of this base sequence : 103728322
  Distance between 3'-terminus of neighbour sequence of sequence listing upward to telomere on chrosomal short arm and 5'-terminus of this base sequence : 100929
tatttgcagtttgtaagaacctctgtcttttggattgagacgtttttattctttgtgtccaaattaacactgcacagaacatggttctctgtgtgtgtgtgtgtgtgtgtgtgtgtgtgtgtgtgtgtgtctgtgtgtgtgtgtagaaaccgtcttttcttttggattaaattcttgcagcctggctgagtgaggagaatttctcccactcttcgagcctacagcagacatgttaggagaatgctgctgcttgcaacacacccagagacggtggggcaggtgacactgcgtgtgtgcccggtgtctctggaagtgtctatacagatgtgtgctgctgctgctgctgctttctgccttaaaatttctggagccaacacccacccactcttacagcctctgtctctttattttcaaggaaaaaagaaagaggcagactgaaatagaag

SEQ ID NO: 15454 - DNA, 474 bp, Homo sapiens
  AL353806.3_111192
  Located on chromosome 9
  Distance between a terminus base of telomere on chromosomal short arm and 5'-terminus of this base sequence : 103769819
  Distance between 3'-terminus of neighbour sequence of sequence listing upward to telomere on chrosomal short arm and 5'-terminus of this base sequence : 41051
catctggcattgtctattacagtaaatgctcagtaaatgtgaactattttacccctgttgtttgacgttaattttttttcaatgaatgactcattgagatactaactcatgcgtcttgaaaacactaccagtctctccagagtaacctccaatatggacaacaggcaaaaatatggtgattattcccagtttgggcatttgtgaaagatgtggctgaggctgtatggatgcgtgtgcacacacacacacacacacacacacacacagaggccgatgggaaaatctaactcagcaggaaagctatcacagagcgctggatttaggcacaatgagtaaacagggatttggaagagaggaatgcaccacataaacaattttcacaatctggtatgaaagcccagatgcttcctgcatgaaggggtgaactcagagagcgtcacagggcaaaatgaagtaaatgctgagactgtccat

SEQ ID NO: 15455 - DNA, 451 bp, Homo sapiens
  AL158823.11_52035
  Located on chromosome 9
  Distance between a terminus base of telomere on chromosomal short arm and 5'-terminus of this base sequence : 103900743
  Distance between 3'-terminus of neighbour sequence of sequence listing upward to telomere on chrosomal short arm and 5'-terminus of this base sequence : 130450
agtaagtgacaggtcaggattccaatccaggtcttctggctctctgttttttactgacattttgctataccgtaaaatgagaaaaatggcttgggcaacatgtaactttcctcctagttctaactttcatgtctctaacattttgatatgccttcacccatcccaagcatgtaaagaaaattccgaagtcaaacatagtagcagcagcagcagcagcagcacctatctgaacccacagttctcgtctaggtgctcacctatctcatctcaaccactctatgaattgcttagcagtcagcacttggactcatcaacgcctgagccctctgtgggaatcacaaactgtttctgatacctggcagctttactcatttatgttatctgtctggcttcctaaggtatttgagtttgcaatgcttgctcctaaaattaactaggcagtggtctaaca

SEQ ID NO: 15456 - DNA, 354 bp, Homo sapiens
  AL137012.6_59360
  Located on chromosome 9
  Distance between a terminus base of telomere on chromosomal short arm and 5'-terminus of this base sequence : 103937484
  Distance between 3'-terminus of neighbour sequence of sequence listing upward to telomere on chrosomal short arm and 5'-terminus of this base sequence : 36290
gtttctacacgtggtccttaatagctataaaatattccaccgaattttacctagataaatgctttatgttggtgatttgatggtttctagtgtttatcttcataaataaggctgcagtgaacatccttgtatttatgttttataaacatccctggttattttctctctgatagaatcctggaaataaaatactgggtaaactagcataggtatataggctcctgaggatatataggtatatcatatatattctacatatatatatatatatataggtatatatacctccaaaaggatgcttttcaaaaggatgaaactggcaagaataaaatctcactagttgccaaatgaaac

SEQ ID NO: 15457 - DNA, 464 bp, Homo sapiens
  chr9.fa.O7frz.113137544
  Located on chromosome 9
  Distance between a terminus base of telomere on chromosomal short arm and 5'-terminus of this base sequence : 104018551
  Distance between 3'-terminus of neighbour sequence of sequence listing upward to telomere on chrosomal short arm and 5'-terminus of this base sequence : 80713
gttgaggatcctactgagtttacctgagacagtcctggcttatgcctgttgtggtgttgtggttattaatatccccttcaactcttttgttgttgttgttgttgttgttgttgagacagggtctgtctctgtcacccaggctggaatgcattgatgtaatcatggctcattgcagcctcgacctcctgggttcaggcaatcctcccgcctcagcctcctgaatagctgggaccacacgcgtatgccaccatacctggcttattttttaacttttttgtagaaaggaggtctcattatgttgctcagactgttcttcaactcctgagctcaagggatactcccaccccagcctcctaaagtgctgggattacagacatgagccactgcacccagcctgcctttcactcttgaaagtgtcccagtttgggtgataaaccatctggtcaccttaaacttgaatgcta

SEQ ID NO: 15458 - DNA, 219 bp, Homo sapiens
  D9S1675
  Located on chromosome 9
  Distance between a terminus base of telomere on chromosomal short arm and 5'-terminus of this base sequence : 104188100
  Distance between 3'-terminus of neighbour sequence of sequence listing upward to telomere on chrosomal short arm and 5'-terminus of this base sequence : 169085
tcacccacaggatcaacagaacaggacatctctctctaatataccaatcattttgttggcattaaatctcttgccctgctactcatgcacacacacacacacacacacacacacacacacacgtgaagacatactgtattataatttttcatgaccacacagtgataacaactgatacataaattactattagacaattacgcattttgttttaccttc

SEQ ID NO: 15459 - DNA, 251 bp, Homo sapiens
  D9S1854
  Located on chromosome 9
  Distance between a terminus base of telomere on chromosomal short arm and 5'-terminus of this base sequence : 104208982
  Distance between 3'-terminus of neighbour sequence of sequence listing upward to telomere on chrosomal short arm and 5'-terminus of this base sequence : 20663
atctgtattctgggacagggatttataccatcagctcctttggtttttagcctttggacttggactgaattataccaccggcttttctgagcctatagcttgagatggtagattgtggaacttaacctccataatcctatgagccaattcctcataataaacacacacacacacacacacacacacacacacacacacacacacacacacacacacaatcagttctgtttgtccagagaactttgactaat

SEQ ID NO: 15460 - DNA, 101 bp, Homo sapiens
  DISO7_10002771
  Located on chromosome 9
  Distance between a terminus base of telomere on chromosomal short arm and 5'-terminus of this base sequence : 104289608
  Distance between 3'-terminus of neighbour sequence of sequence listing upward to telomere on chrosomal short arm and 5'-terminus of this base sequence : 80375
atcacagtctgactttctccactgtcccctctgtttaaacacacacacacacacacacacacacacaccattaatctcctacagtgttaagaacctagccc

SEQ ID NO: 15461 - DNA, 104 bp, Homo sapiens
  DISO7_10002772
  Located on chromosome 9
  Distance between a terminus base of telomere on chromosomal short arm and 5'-terminus of this base sequence : 104309342
  Distance between 3'-terminus of neighbour sequence of sequence listing upward to telomere on chrosomal short arm and 5'-terminus of this base sequence : 19633
acggtgattactgctgggggaagaaagtgaatgtgtgtgtgtgtgtgtgtgcgcgtgtgtgtgtgcgcgcgctcgcgcgtgtgtatgcatgtgtctatgttgga

SEQ ID NO: 15462 - DNA, 211 bp, Homo sapiens
  DISO7_10002773
  Located on chromosome 9
  Distance between a terminus base of telomere on chromosomal short arm and 5'-terminus of this base sequence : 104352752
  Distance between 3'-terminus of neighbour sequence of sequence listing upward to telomere on chrosomal short arm and 5'-terminus of this base sequence : 43306
cttgcattgtaagtagaatccctttttaacctattttagtaacctattactatatatagcattacatattttatagaatggggtgtgtgtgtgtgtgtgtgtgtgtgtgcaaatttatctgtatcttggtagtcaaatagttattttgctccaggaaattacatcagggatacaaagagtaagtttaaaagtctcattcaggacacagagg

SEQ ID NO: 15463 - DNA, 175 bp, Homo sapiens
  D9S1828
  Located on chromosome 9
  Distance between a terminus base of telomere on chromosomal short arm and 5'-terminus of this base sequence : 104431678
  Distance between 3'-terminus of neighbour sequence of sequence listing upward to telomere on chrosomal short arm and 5'-terminus of this base sequence : 78715
ttctgggaaactaagacaaaaagtttctgttgcgtgtgtgtgtgtgtgtgtgtgtgtgtgtgtgtagacagagtcttgctctgttgtgcaggctggagtgcagtggcgcaatctcagttcactgcaacctctgcctcctggattcaagcaattctcctgcctccgtctcccaagt

SEQ ID NO: 15464 - DNA, 147 bp, Homo sapiens
  DISO7_10002776
  Located on chromosome 9
  Distance between a terminus base of telomere on chromosomal short arm and 5'-terminus of this base sequence : 104625757
  Distance between 3'-terminus of neighbour sequence of sequence listing upward to telomere on chrosomal short arm and 5'-terminus of this base sequence : 193904
aaggaagtggttgaaacactgaaactataggtagttgatagataaacaaattcagatatatataaatttagatagatagatagatagattagatagatagatagatagatagatagatagataggtaggtagatcatcggtcttgtg

SEQ ID NO: 15465 - DNA, 222 bp, Homo sapiens
  DISO7_10002777
  Located on chromosome 9
  Distance between a terminus base of telomere on chromosomal short arm and 5'-terminus of this base sequence : 104640279
  Distance between 3'-terminus of neighbour sequence of sequence listing upward to telomere on chrosomal short arm and 5'-terminus of this base sequence : 14375
aatcatgaagcgtcagtgtctctgtgtgtgtgtgtgtgtgtgtgtgtctgtgtaaaactcatgaattatttcataatttgaaatgtggtttgggtaatttttgtggtaatattaaagttacaagttcttagaaaattggagtttaaagtaactttaacagttatttaatctaaagtctcccacaatgaaagaatcttttctagagcatctctgacagaaaca

SEQ ID NO: 15466 - DNA, 279 bp, Homo sapiens
  AL442064.8_57260
  Located on chromosome 9
  Distance between a terminus base of telomere on chromosomal short arm and 5'-terminus of this base sequence : 104769062
  Distance between 3'-terminus of neighbour sequence of sequence listing upward to telomere on chrosomal short arm and 5'-terminus of this base sequence : 128561
aaggatggcttactattcaaagaacagtaatttgatttacatcggtttaattgttctaactttcacatcaaaaaagaaagacttaacctttgacaaaacacacacacacacacacacacacacacacacacacacacagcttttctgatttcagggaaaagctaaaacagattcataagaaaattacactacagaagatggaggctaaggctcatatccatcccaaataattctgcttctcatcagttgcttcttgtttaattgttctttggaaataaa

SEQ ID NO: 15467 - DNA, 472 bp, Homo sapiens
  AL442064.8_127183
  Located on chromosome 9
  Distance between a terminus base of telomere on chromosomal short arm and 5'-terminus of this base sequence : 104838834
  Distance between 3'-terminus of neighbour sequence of sequence listing upward to telomere on chrosomal short arm and 5'-terminus of this base sequence : 69493
tggacttgagtcaaatagtgactcatacaagtttcttgaaagaacacagggttactaatgcacgcggggcttaaaacctagatgacgagttgataggtgcatcaaaccaccatggcacatgtatacctatgtaagaaactgcatgttctgcacatgtatcccggaacttaaagtaaaattttaaaacagaaggaaagaaggaaggaaggaaggaaggagggagggagggcgggagggagggagggaaggaaggagggaaggaaggaaggaaggaaggaaggaaggaaggaaggaaggaaggaaggaaggaaggaaggaaagaaggaaagaaggaaagaaaacaaggcaatacccaatactgaatatgcattgacttccctaaggataagcaaaggagaaaaatctaaatccaccaggcaaatagaacacattgtggttcagaaaaggggaagattctagaatcagagcaaat

SEQ ID NO: 15468 - DNA, 233 bp, Homo sapiens
  Z67008
  Located on chromosome 9
  Distance between a terminus base of telomere on chromosomal short arm and 5'-terminus of this base sequence : 104873569
  Distance between 3'-terminus of neighbour sequence of sequence listing upward to telomere on chrosomal short arm and 5'-terminus of this base sequence : 34263
caggctgaaaactctgcatttaaatacacatctctggcatttctgatgacagtaaacagtgaaaaccaatgccttatcctatgcttgccgaattgttattgttttaacaaacacaaacacacacatgcatgtacgcacgcgcgcacacacacacacacacacacacacatacacactcagtatcctggtagtccacaaaagcagaattgaatctgggttggtctcagttgatg

SEQ ID NO: 15469 - DNA, 175 bp, Homo sapiens
  D9S1683
  Located on chromosome 9
  Distance between a terminus base of telomere on chromosomal short arm and 5'-terminus of this base sequence : 104962298
  Distance between 3'-terminus of neighbour sequence of sequence listing upward to telomere on chrosomal short arm and 5'-terminus of this base sequence : 88496
cattcaagggaacattacacaagatagtcaagcaagatgaagtacaaaaaagtcgtgtgtgtgtgtgtgtgtgtgtgtgtgtgtgtgtatccccagttttagaaagaatggaacatactggttaactcatgtattcatagaacagtatttatagtttagaaataaattctgccca

SEQ ID NO: 15470 - DNA, 192 bp, Homo sapiens
  D9S1880
  Located on chromosome 9
  Distance between a terminus base of telomere on chromosomal short arm and 5'-terminus of this base sequence : 105144702
  Distance between 3'-terminus of neighbour sequence of sequence listing upward to telomere on chrosomal short arm and 5'-terminus of this base sequence : 182229
tggacatcacgaacctaataatttgcctggccaggtgcagatcccagcactttgggaggccaaggtgggtggatcacctgaggtcaggagttcaagaccagcctgaccaacatggtgaaacccattctctactaaaatacacacacacacacacacacacacacacacacacaaattagccaggtgtggtgg

SEQ ID NO: 15471 - DNA, 416 bp, Homo sapiens
  AL354661.6_99808
  Located on chromosome 9
  Distance between a terminus base of telomere on chromosomal short arm and 5'-terminus of this base sequence : 105226213
  Distance between 3'-terminus of neighbour sequence of sequence listing upward to telomere on chrosomal short arm and 5'-terminus of this base sequence : 81319
agtattccagattgaaggagactaaaaatatatgacaataaaattcaataaataatcctggaggccaaggcgggcagatcacttgaggtcaggagttcaagaccagcctagccaacatggtgaaaccccgtctctactaaaaatacaaaaattagccaggcatgatggcacacacctgtaattccagttacttgggaaactgaggcaggagaatcacttaaacccagaaggcagagttgcagtgagccaagatcacgccactgcactccagcctgggtgacagagcaagaccctgtctcaaaaataataataaccattatcatcatcatcatcatcatcatcatcatcatcatcacctggactggattccctaatggaggggagggggaaaaaatcctataaagaacattactggc

SEQ ID NO: 15472 - DNA, 391 bp, Homo sapiens
  chr9.fa.O7frz.114345782
  Located on chromosome 9
  Distance between a terminus base of telomere on chromosomal short arm and 5'-terminus of this base sequence : 105331923
  Distance between 3'-terminus of neighbour sequence of sequence listing upward to telomere on chrosomal short arm and 5'-terminus of this base sequence : 105294
cctgatcatattgcttaccaccccgcacccacttccccacaaccccatcatgtcctctcctcccgccacacacacacacacacacacacacacacacacacacacacagaggaaggggaggaaatcataggagtagcttggcaagactgggccaggtgacaagacagaagccctagatttaatgagtaagtgctagactcccaacactgaggtccacaaggccctttcccccagagacagcagctggcagagatactcagttagaaatcggttttaggaggtgacaagcaggaaagattacttcagcttgtgaaagctagcttagaggaaataatatatactatgcaagagttcagactgcataaaagtctaatgtacgatcgttaagatc

SEQ ID NO: 15473 - DNA, 392 bp, Homo sapiens
  AL135787.13_7142
  Located on chromosome 9
  Distance between a terminus base of telomere on chromosomal short arm and 5'-terminus of this base sequence : 105425386
  Distance between 3'-terminus of neighbour sequence of sequence listing upward to telomere on chrosomal short arm and 5'-terminus of this base sequence : 93072
agacctgagttacctgatacaagtttttcgctaatgtattccagtgatggcttagcactcttcatggatttatagacaagattatttgcttgaagtcagtcaattacaaagtagggaagctgaaatttaaacttttattattattattattattattattattattattattattattctgagacagggtctcactctgtcacctaggtttgagtgcagtggcacaatcatagctcactgcagtctcaacctcctgggctccagtgatccttctgcctcagcctcctgagtagctgggactacagggatgtgccaccatgcccagctaatttttttagtttttgtagagacggggtcttgctaggttgcccaggttggtctcaaaggcctag

SEQ ID NO: 15474 - DNA, 295 bp, Homo sapiens
  D9S1688
  Located on chromosome 9
  Distance between a terminus base of telomere on chromosomal short arm and 5'-terminus of this base sequence : 105480230
  Distance between 3'-terminus of neighbour sequence of sequence listing upward to telomere on chrosomal short arm and 5'-terminus of this base sequence : 54452
catagccttcaaataggaaagtctaggttcataattagataccttttcctgtctggcaagagaccttgtacagtttatatactggtgaactaaattatacaaaacctgagaagccatggtcagagatgattgcgcacgcgtgcgcacacacacacacacacacacacacagagttgttgttttgagatagagtcttgctctgttgccctggctggagtgcaatggggtgactttggctcactgcaacctcaacctcctggctcaagtgatcctcccacctcagcctccgagtagc

SEQ ID NO: 15475 - DNA, 446 bp, Homo sapiens
  chr9.fa.O7frz.114494167
  Located on chromosome 9
  Distance between a terminus base of telomere on chromosomal short arm and 5'-terminus of this base sequence : 105480234
  Distance between 3'-terminus of neighbour sequence of sequence listing upward to telomere on chrosomal short arm and 5'-terminus of this base sequence : -291
gccttcaaataggaaagtctaggttcataattagataccttttcctgtctggcaagagaccttgtacagtttatatactggtgaactaaattatacaaaacctgagaagccatggtcagagatgattgcgcacgcgtgcgcacacacacacacacacacacacacagagttgttgttttgagatagagtcttgctctgttgccctggctggagtgcaatggggtgactttggctcactgcaacctcaacctcctggctcaagtgatcctcccacctcagcctccgagtagctgaggttacaggtacgtgccaccacacccagctaatttttttgtattttttgtagagatgggttttcgtcatgttgctcaggctggtcttgaatttctaggctcaagtgatccaccattgagtgctggccatgtatgcagtagcatcagtacttg

SEQ ID NO: 15476 - DNA, 219 bp, Homo sapiens
  chr9.fa.O7frz.114850965
  Located on chromosome 9
  Distance between a terminus base of telomere on chromosomal short arm and 5'-terminus of this base sequence : 105742853
  Distance between 3'-terminus of neighbour sequence of sequence listing upward to telomere on chrosomal short arm and 5'-terminus of this base sequence : 262173
tctgctcttaccacttctatttacattatactggaagttctagctgggggcaattgggtaaggaaaataaataaaaacacccagattggaaggagagaagtaaaaatacttatatttaaagataacatgatcttatacacagaaaatcttaatgaatacacacacacacacacacacacacacacacacacacacacaagctattggaataagcaagtc

SEQ ID NO: 15477 - DNA, 348 bp, Homo sapiens
  chr9.fa.O7frz.114939391
  Located on chromosome 9
  Distance between a terminus base of telomere on chromosomal short arm and 5'-terminus of this base sequence : 105889561
  Distance between 3'-terminus of neighbour sequence of sequence listing upward to telomere on chrosomal short arm and 5'-terminus of this base sequence : 146489
atggcagttgctattactcactcttaccaggagtaagggccagtgcccttcacacacacaccccccacacacaacacacacaaatgtacacacaaacatagacacaatgcactcagctctcacacacacaccacatacacaccacacacacacatacgcacacacatgtatatacaaacatgcacccaatgcactcaactcaaatacacacaacacatatacaacacatatcttgggcagtttattgtagggtcatacctgcctgcacggtatgatctgtacctgtaccccctctgcgtaccactcagctgtttctaagttttgcactctatctggatccagaaagat

SEQ ID NO: 15478 - DNA, 477 bp, Homo sapiens
  chr9.fa.O7frz.115016554
  Located on chromosome 9
  Distance between a terminus base of telomere on chromosomal short arm and 5'-terminus of this base sequence : 105960173
  Distance between 3'-terminus of neighbour sequence of sequence listing upward to telomere on chrosomal short arm and 5'-terminus of this base sequence : 70264
ttgattataacgcaagtgaaagagattacattggagctaatgggcaaaattattttttttcctccttcccttctgaatacttcgttctctctctctctctctctctctctctctctctctctctctgtctcttttctgagacagggtcttgttctgtcacccaggctggagtgcagtggcacaatcttagttcacagcaatctcaaactcctggactgaagtgatcctcagcctcccgagtagttggaactacaggcatgcaccaccacacctgggtaattatttttacaattaatttgtaaagacaggatcttactttgttgcccaggctggtctcaaactcttggcctcaagcccacctcagcctcccaaagtgctgggattacaagtgtgagccattgcacccaaccaaaattcttttagtttcttttcattgtaagaaatccatggacaagcctcatagaacagagtacttaa

SEQ ID NO: 15479 - DNA, 233 bp, Homo sapiens
  D9S1856
  Located on chromosome 9
  Distance between a terminus base of telomere on chromosomal short arm and 5'-terminus of this base sequence : 106042258
  Distance between 3'-terminus of neighbour sequence of sequence listing upward to telomere on chrosomal short arm and 5'-terminus of this base sequence : 81608
ggatttgggagcaaacttcagacactgcaacagacaagttcaaggagcagcaggcttagtattcacctatcctcccccgacctcaggtggtggagacaacaccaagtgagacaggctgtgtcacccagtctctgtctctgtcacacacacacacacacacacacacacacacacacacagcatcaccttcctcacttgcaaaagcctcagctgttggtgtttttattccacaa

SEQ ID NO: 15480 - DNA, 446 bp, Homo sapiens
  chr9.fa.O7frz.115214111
  Located on chromosome 9
  Distance between a terminus base of telomere on chromosomal short arm and 5'-terminus of this base sequence : 106141203
  Distance between 3'-terminus of neighbour sequence of sequence listing upward to telomere on chrosomal short arm and 5'-terminus of this base sequence : 98712
aactgactttgatatcttgatcttatatcctacacccttgctaaattctttagtatttctacatacacagttttcttactctcaaatttatatgccatttatttatttatttatttatagatggagtcttgctctgtcacccaggctggagtgcagtgatgcaatcggctcactgcaacccccgcctcccaggatcaagaaattctcctgcctcagcctccctagctgggattataggtgcacaccaccacgcccagctaatttttgtatttttagtagacacgtggtttcaccaagttggccaggctggtctcgaactcctgacctcaggtaatgcgcccaccttggccttcctaagtgctgggattacaggcatgagccaccgtgcctgggctgctgtttatttattattttttttttacagctttactgaactagccaggatt

SEQ ID NO: 15481 - DNA, 390 bp, Homo sapiens
  AL162732.25_61010
  Located on chromosome 9
  Distance between a terminus base of telomere on chromosomal short arm and 5'-terminus of this base sequence : 106299843
  Distance between 3'-terminus of neighbour sequence of sequence listing upward to telomere on chrosomal short arm and 5'-terminus of this base sequence : 158194
tttgacgtttatgcaattaaaccaggtaatgcttttatagtttttaaaagtagtgatacgtttttccatattttctgcaatgaacatatctgttttttgtgtgtgtttgtgtgattgtaaaatgaatgtgttcttttaaaagctgtcttcccaatgaaggaagaaaacccataccaacacaacttaaaaaaaaagatgaatgaaaaatagaggtgagttgagggcttttgaagtgatatatatatatatatatataagcacagaaagtcagatcagttactagccacttctaaatctcgaaataagaaatgaaaattattttttaaagttggtcttaaaatcacagagtaaagattttgttcaagaatatgtggtaacagatggtacagt

SEQ ID NO: 15482 - DNA, 439 bp, Homo sapiens
  AL162732.25_84775
  Located on chromosome 9
  Distance between a terminus base of telomere on chromosomal short arm and 5'-terminus of this base sequence : 106323723
  Distance between 3'-terminus of neighbour sequence of sequence listing upward to telomere on chrosomal short arm and 5'-terminus of this base sequence : 23490
agcaactagtaaccaactaatcagaatctctccttttggccaatagaggccactgtatggtggagcagtatgacagaaataaagtaaattgagcaatattactttacctgaggagggggatgtgtgtgtgtgtgtgtgtgtgtgtgtgtgtgtgtgtgtgtataaaacattgagcttactagctttttaaaaaacttttgttaaaacagtattgttgaggtctaattcacatgcaataaaatttaccatcctaagtataaatgatttttaataaatttatagttacacagccataactacagtccagtctgagaacatttcatcacactaaaaaattctctcatgtctctttgcagtcgatcctatttccattcccaaagccctagccagccaaatactaatttgctctctgtctctataaatttgctatttctggaca

SEQ ID NO: 15483 - DNA, 289 bp, Homo sapiens
  D9S930
  Located on chromosome 9
  Distance between a terminus base of telomere on chromosomal short arm and 5'-terminus of this base sequence : 106335174
  Distance between 3'-terminus of neighbour sequence of sequence listing upward to telomere on chrosomal short arm and 5'-terminus of this base sequence : 11012
tggacaacagagtgagatgctgtcttaaaaataaaaaaaaagaattaaggatgccatttttaagttgaatcttgagtctctcagagtcaagataaaagtctgagtgaaacgccatgaggttgggtcactgtgtttgctatctatctacctatctatctatctatctatctatcatcatctatcttatcatcatctatctttatctatctatctatctatctatctatctatctatctatctatttttgtccaggtttcctggcttgtaattcccatagcccttgttaca

SEQ ID NO: 15484 - DNA, 380 bp, Homo sapiens
  chr9.fa.O7frz.115579875
  Located on chromosome 9
  Distance between a terminus base of telomere on chromosomal short arm and 5'-terminus of this base sequence : 106455019
  Distance between 3'-terminus of neighbour sequence of sequence listing upward to telomere on chrosomal short arm and 5'-terminus of this base sequence : 119556
tcagataattcttgtgacagaataccctcctcaagcaccaactgcaagggagacttgtctgttttttgttttgttttgttttgttttgttttgttttgttttttagacagcagagtcttgctctgtcacccaggctggagtccagtggcatgatcatagttcactacagcctcgagctcctgggctcaagcaatcctcccacctcagcctcctaagcaactaggactacaggcatgcactaccacatctggctatttttattgttttttgtagagacagggtctcactacattgccccagctggtctcaaactgctggcttccaacagtccttccacctcagcttcccaaagtgctgggattacagatgtgaaccagtga

SEQ ID NO: 15485 - DNA, 261 bp, Homo sapiens
  chr9.fa.O7frz.115669840
  Located on chromosome 9
  Distance between a terminus base of telomere on chromosomal short arm and 5'-terminus of this base sequence : 106619989
  Distance between 3'-terminus of neighbour sequence of sequence listing upward to telomere on chrosomal short arm and 5'-terminus of this base sequence : 164590
ttgcctgtaatctcagcactttgggaggccaaggcaggaacattgctggaggccaggagtttgagaccagcctgggcaatatagtgagaccttgtctctgttaaacacacacacacacacacacatacacacacaatcgcttgagcccaggagtttaagaccagcccgggcaatatagtgagaacttgtctctattaaacacacacacacgcgcgcacgtgcacacacagagagaaagagtaaaggaagctctgctatgat

SEQ ID NO: 15486 - DNA, 445 bp, Homo sapiens
  AL360235.3_91252
  Located on chromosome 9
  Distance between a terminus base of telomere on chromosomal short arm and 5'-terminus of this base sequence : 106656718
  Distance between 3'-terminus of neighbour sequence of sequence listing upward to telomere on chrosomal short arm and 5'-terminus of this base sequence : 36468
cattcatgaaatactgagtacctaccatgggccagggtagcataggagggaagaatctggagtatgtggcaaggtctgattgactgactctcccctccctcactcccaacaactgattcgagaactaacttcatactgtctggccaagacatttcagatctttatgtgggctgttcctggaaggttattggctgaggttcccagggcaaatgttaggggagttggcttgaagtcactacccgacctggggagacagaaagataatcacacacacacactcacagtacagtcacacacacacacacacacacacacacacacgcacacatgatgagcaaggcacagttgcagtcactggggacttacagtgtttgtggataagtttgatatataaataaatgattaaaactacaaaatgcttcagtggaggtgtcttcaaagtatt

SEQ ID NO: 15487 - DNA, 262 bp, Homo sapiens
  AL360235.3_82774
  Located on chromosome 9
  Distance between a terminus base of telomere on chromosomal short arm and 5'-terminus of this base sequence : 106718895
  Distance between 3'-terminus of neighbour sequence of sequence listing upward to telomere on chrosomal short arm and 5'-terminus of this base sequence : 61732
cagataatgtgacatctccaacccagctccaagaaggagacttaagttgagatttctgttctagggcctggaaatgcgtggcacatggaaggagctcagtaacgcatgcatgcatgcatccatccatccatccatccatccaaccatccatccatccatctatctatttatttattgctctgttgccaggctggagtgcagtggctcaatctcggctcactgagtaatgcgtttttaaatgaatgttgagtgaatttaagtt

SEQ ID NO: 15488 - DNA, 258 bp, Homo sapiens
  chr9.fa.O7frz.115893833
  Located on chromosome 9
  Distance between a terminus base of telomere on chromosomal short arm and 5'-terminus of this base sequence : 106822425
  Distance between 3'-terminus of neighbour sequence of sequence listing upward to telomere on chrosomal short arm and 5'-terminus of this base sequence : 103268
acttgtctagatcattagctgagtgttcaccacatgccagcctctcaagtaagtgctttacaaatgtgacctgccttggtccacacaaacacacacacacacacacacacacacacacacacacacacctcaaaacaaaacaacatgaggaggaattattgtcatccccttttacccatgggaaaagggaggtggaaagacattagttttcttggtaacacaactggtaactggaagattcaaattcaggctgttagt

SEQ ID NO: 15489 - DNA, 374 bp, Homo sapiens
  chr9.fa.O7frz.115979872
  Located on chromosome 9
  Distance between a terminus base of telomere on chromosomal short arm and 5'-terminus of this base sequence : 106899172
  Distance between 3'-terminus of neighbour sequence of sequence listing upward to telomere on chrosomal short arm and 5'-terminus of this base sequence : 76489
gttacactaaattcagcctatcttcaagcaaacagccttaaaaatgtgatctaacccccttccattcctttcttccaagattcaactctttcacataatatgcctgctttttgttcattcttcagtaccactggatcattggggggtgtgtgtgtgtgtgtgtgtgtgtgtgtgtgtgtgtgtgtttgtgttttgtccagagtttataattatctgtgggagggccatgcccagtaggaatccacttggccatatcagaaatattattactaaaaaaaaaattgattcatgaaaatataaaaattgtttagaaaaacacaaaacttactcttaaacccacgatcccagaagaaccactatccacataatgataa

SEQ ID NO: 15490 - DNA, 155 bp, Homo sapiens
  D9S174
  Located on chromosome 9
  Distance between a terminus base of telomere on chromosomal short arm and 5'-terminus of this base sequence : 106920405
  Distance between 3'-terminus of neighbour sequence of sequence listing upward to telomere on chrosomal short arm and 5'-terminus of this base sequence : 20859
tccaaagttccccaggtgatcatcacagggtagggagacaagttcccagatttcagttacaagacataggacgctggcatgaacacacacacacacacacacacacacacacacacacacacctcgaagaggtagccacaagggtcattaaacac

SEQ ID NO: 15491 - DNA, 122 bp, Homo sapiens
  DISD22_0006664
  Located on chromosome 9
  Distance between a terminus base of telomere on chromosomal short arm and 5'-terminus of this base sequence : 107168766
  Distance between 3'-terminus of neighbour sequence of sequence listing upward to telomere on chrosomal short arm and 5'-terminus of this base sequence : 248206
ccagactgaacagatgcaacttttatgatcagaaaaaaatgtgtgtgtgtgtgtgtgtgtgtgtgtgtgtgtataggtgtacttataatttttttttaaggtcagggtataatcaagtgaga

SEQ ID NO: 15492 - DNA, 155 bp, Homo sapiens
  D9S262
  Located on chromosome 9
  Distance between a terminus base of telomere on chromosomal short arm and 5'-terminus of this base sequence : 107248880
  Distance between 3'-terminus of neighbour sequence of sequence listing upward to telomere on chrosomal short arm and 5'-terminus of this base sequence : 79992
tcaaactctatggcgtggccttatcgattgcagtgggaagttgttgaagacttgaagacgtgattcctgctccaatcatcccttcttgctcctctttgtgcacgtacacacacacacacacacacacacacacacacccctgctcaacagaggtt

SEQ ID NO: 15493 - DNA, 335 bp, Homo sapiens
  chr9.fa.O7frz.116139707
  Located on chromosome 9
  Distance between a terminus base of telomere on chromosomal short arm and 5'-terminus of this base sequence : 107340691
  Distance between 3'-terminus of neighbour sequence of sequence listing upward to telomere on chrosomal short arm and 5'-terminus of this base sequence : 91656
cagacttatggtgcttctgttccagtggtgggggagacagatacccaaaaaggtaaacaaacacataatatatagtcagagagttataagtgcaagggagaaaaataaagcaaagtaagagattgggtgaggagggagatggtcagggaagacctctctgaagagatgacatctgaatgcagttggggagtgagacacacacacacacacacacacagactggtggaaacggaactgcaggtgcaaaggcactgaagtcaggacaagtttggtacatttaaggaacagaaagaaggccagcatggatagaggtagaaagtgatgttggagaaata

SEQ ID NO: 15494 - DNA, 425 bp, Homo sapiens
  AL137066.9_142492
  Located on chromosome 9
  Distance between a terminus base of telomere on chromosomal short arm and 5'-terminus of this base sequence : 107413540
  Distance between 3'-terminus of neighbour sequence of sequence listing upward to telomere on chrosomal short arm and 5'-terminus of this base sequence : 72514
atactttaacgtggtccaattcagttatatttgtggccacagtcatacagggtcacatgtagaactcaggaaacaatagtttcaggaagcagcccctctggcttggtccttaccagggagtcaccattgtgaaggaaggcacagcaggcattccagtgggagagagggggctgttagaagaggatcaagctggctctctggtcaccaggttacaggaaacagcagcagcggcagcagcagcagcagcagcaacagaagaaggtgaaaacacctattaagaaacaggtagagtggcagtgaggggcttgctgggactgggagaggtctacagcctggaatgggaagggatgtatgaaaggtgggggtctccttgttttctatctggttatagataaaaagttcttgtctggttgtagatgttaaat

SEQ ID NO: 15495 - DNA, 246 bp, Homo sapiens
  D9S279
  Located on chromosome 9
  Distance between a terminus base of telomere on chromosomal short arm and 5'-terminus of this base sequence : 107453772
  Distance between 3'-terminus of neighbour sequence of sequence listing upward to telomere on chrosomal short arm and 5'-terminus of this base sequence : 39807
tctgacttcccagggagaccactgttaactttctgatttatatcctcccaggcttatttccacacctatttctgtgtgtgtgtgtgtgtgtgtgtgtgtgtgtgtgtgtgtgtgcctgtgtgtatttaggggtcaaatttcaacacaattgagatcaagtttgtatggacaattttgtaacccatatgttttccttagtggcctgatgtgaatatttccttgcattggtccatgttcttctattag

SEQ ID NO: 15496 - DNA, 189 bp, Homo sapiens
  Z67600
  Located on chromosome 9
  Distance between a terminus base of telomere on chromosomal short arm and 5'-terminus of this base sequence : 107627184
  Distance between 3'-terminus of neighbour sequence of sequence listing upward to telomere on chrosomal short arm and 5'-terminus of this base sequence : 173166
agctggtagggcaagtcttctatgttgttattcttcttcaagagcgtcttggccctttgagtttccatatacattttagattgtatctttcaagttctagcgacacacacacacacacacacacacacacacacgcacatgcacacgcagccctctcttcatccctgaactctctgccttcatcctttg

SEQ ID NO: 15497 - DNA, 414 bp, Homo sapiens
  chr9.fa.O7frz.116757271
  Located on chromosome 9
  Distance between a terminus base of telomere on chromosomal short arm and 5'-terminus of this base sequence : 107872980
  Distance between 3'-terminus of neighbour sequence of sequence listing upward to telomere on chrosomal short arm and 5'-terminus of this base sequence : 245607
catcactaattgaccatggtagtcctttccattgagtatggccagcggcctcagagtccttagtattatataatgctacccatcagttgggcttagatgggacatgaagccagtttgtccttccttatcgacacacacacacacgcaccccatgggacatgaagccagtttttccttccttatcgagacacaaacacacagagagagagagagagagagagagagagagagagagagacagagaaactgaggccttgggaagaaggtggagtgacttacccaagacctcagtgaacaagcggaagtgggactaaaagcctcagatttcttcactcctcaaccagtgcttttcctgccctgtgtgtatacactgtatcaaaaggaattaaaattaatttggtcttgagaaatagc

SEQ ID NO: 15498 - DNA, 419 bp, Homo sapiens
  AL162393.11_98632
  Located on chromosome 9
  Distance between a terminus base of telomere on chromosomal short arm and 5'-terminus of this base sequence : 107904182
  Distance between 3'-terminus of neighbour sequence of sequence listing upward to telomere on chrosomal short arm and 5'-terminus of this base sequence : 30788
cagatactagctattcttgtggacgaccctgtaaaccaggtagagaattttgctaaccaaggaaatgaataatccccatgagggcacagcctgtgtttgctttattcattactatgtcctctgttcccagcaagggctagacatagtagatgcttattaaatattcgttgagtgaatgaataatgataattatagtatttatcacatttatctttatggcagcagctatataaggagatagtattatctctttgtgctgacaaaggtgggccattctgagacatgcgcgtgtgtctgtgtgtgtgtgtgtgtgtgtgtctgtgtgactgtgtgtgtgtattgcagtgttggagagaagggcaggaacacccgaaagctttttttgcaacagctctgtgaaatattgatcaatttgattc

SEQ ID NO: 15499 - DNA, 423 bp, Homo sapiens
  AL137850.7_108492
  Located on chromosome 9
  Distance between a terminus base of telomere on chromosomal short arm and 5'-terminus of this base sequence : 108054587
  Distance between 3'-terminus of neighbour sequence of sequence listing upward to telomere on chrosomal short arm and 5'-terminus of this base sequence : 149986
ggcattgtaactgcatcacagctggactgcttcctctgccctatcctgccttcatgtcttctcccctacaggtgttggtcctggggaacccaacctgtgataccagaagaaaacagaactcaagaaacagaaggaaattcctcaatgccttcaagctatagaattacttaatcagaacatgcatttatgtgcacgtgtgtgtgtgtgtgtgtgtgtgtgtgtgtgtgtgtagagatggggtcttgctatgttgcccaggctggtcttgaactcctggcctcaagcagtcttactgcctcagccccgcagaatgctgggattatacgcatgagcaaaaacaacagaataagatgaaaagagaaaatccaagcctacagaaacaaattgagaaccaaaacaacataattcagaaccagcaaataa

SEQ ID NO: 15500 - DNA, 118 bp, Homo sapiens
  D9S1824
  Located on chromosome 9
  Distance between a terminus base of telomere on chromosomal short arm and 5'-terminus of this base sequence : 108118229
  Distance between 3'-terminus of neighbour sequence of sequence listing upward to telomere on chrosomal short arm and 5'-terminus of this base sequence : 63219
gtgttctccagagagacagagccaaaaggatatgtatatcctatatgtgtgtaacacacacacacacacacacacatatatagagaaatttatgcggcattggctcacacaattagga

SEQ ID NO: 15501 - DNA, 315 bp, Homo sapiens
  HUMUT5039
  Located on chromosome 9
  Distance between a terminus base of telomere on chromosomal short arm and 5'-terminus of this base sequence : 108307194
  Distance between 3'-terminus of neighbour sequence of sequence listing upward to telomere on chrosomal short arm and 5'-terminus of this base sequence : 188847
ggaggctgcagtgaactgagatcgtgccactgcactccagcctgggcgacagagtgaaaccttgtctcagatagatagatagatagatgatagatagatagatagatagatagatagatagatagatgatagatagatgatagatagattagatagatagatagatagatagatagatagagatagatgatagatgataggtaggtagatagatgatagatagatagatagatagatagataggtagatagatgatagatagatagatgttagatagatgaatggtatctggagtctgtccccatcatctcaccc

SEQ ID NO: 15502 - DNA, 258 bp, Homo sapiens
  D9S302
  Located on chromosome 9
  Distance between a terminus base of telomere on chromosomal short arm and 5'-terminus of this base sequence : 108307239
  Distance between 3'-terminus of neighbour sequence of sequence listing upward to telomere on chrosomal short arm and 5'-terminus of this base sequence : -270
gcgacagagtgaaaccttgtctcagatagatagatagatagatgatagatagatagatagatagatagatagatagatagatgatagatagatgatagatagattagatagatagatagatagatagatagatagagatagatgatagatgataggtaggtagatagatgatagatagatagatagatagatagataggtagatagatgatagatagatagatgttagatagatgaatggtatctggagtctgtcccc

SEQ ID NO: 15503 - DNA, 275 bp, Homo sapiens
  AL138895.8_124154
  Located on chromosome 9
  Distance between a terminus base of telomere on chromosomal short arm and 5'-terminus of this base sequence : 108413918
  Distance between 3'-terminus of neighbour sequence of sequence listing upward to telomere on chrosomal short arm and 5'-terminus of this base sequence : 106421
tatctttctagatgttggcaagtaactttgaaaatgtttaatactatgcaggtgaaaggaagggaagggggagacacacacacacacacacacacacacacacacacacacacacacagagagacacagacagacagacagacagacatgctctgcagtgtatttggccaggtggccaccagcctgagatttctgatgaagatcaaaaggtgacacattacactgttggcaactatgcagccacctggcaactggatctcagtttatgactttaa

SEQ ID NO: 15504 - DNA, 427 bp, Homo sapiens
  chr9.fa.O7frz.117437455
  Located on chromosome 9
  Distance between a terminus base of telomere on chromosomal short arm and 5'-terminus of this base sequence : 108537193
  Distance between 3'-terminus of neighbour sequence of sequence listing upward to telomere on chrosomal short arm and 5'-terminus of this base sequence : 123000
gaaattgagctgcagtgagctgtgatagcgctaccgcactccagcctggcttacagagaagagagacagagagagagagagagagagagagaagggaggaagggaggaaaggaggagggaaggaaggaaggaaggaaagaaagaagaaggaaatgtagcagcttaaaatgacagttttaacagtccttgccatggtcaggaaaaaagaataacaaaaatacaaataaaaacaaaaagcaaaaaaacccaacagcaatcatttactttgcccatgaactgcctatttctatttatttgaacacagcagtgcccacttgctcatgtactgtctttggctgcttttgggcagcagtggtggagttgaatgttcatgaccgagaccatatggcccacaaagcttaacatattcactatctggcaatttaca

SEQ ID NO: 15505 - DNA, 167 bp, Homo sapiens
  G09235
  Located on chromosome 9
  Distance between a terminus base of telomere on chromosomal short arm and 5'-terminus of this base sequence : 108618664
  Distance between 3'-terminus of neighbour sequence of sequence listing upward to telomere on chrosomal short arm and 5'-terminus of this base sequence : 81044
tgttccaacaatatatatctatccatccatccatccatccatccatccatccatccaagacaggtcttactctgtgccaggcacagatcccagaaaatgcgcaaggcttgtgtgcagcatggaggtctcaggtgcatcctggcaatgccatcatcactgtctgctca

SEQ ID NO: 15506 - DNA, 464 bp, Homo sapiens
  AL160275.10_147277
  Located on chromosome 9
  Distance between a terminus base of telomere on chromosomal short arm and 5'-terminus of this base sequence : 108653127
  Distance between 3'-terminus of neighbour sequence of sequence listing upward to telomere on chrosomal short arm and 5'-terminus of this base sequence : 34296
caaattgatcctaacatttacatgaaaaaacaagcaagaataaaacaggcattgggcgacagtgagactccgtctcaaaaaacaaacaaacaaacaaacaaacaaacaaacaaacaaaaaaacaggcagactccccagtggagtagaatagaaagttcagaaagagacacaaatatatatgaaaatttagtgtatgataataaaggtgtcatctcagatggatgattggaccaaagatattctccttaataaatatgctgaaatgactatataatcatttggagaaagtgtaaagttagatccatacttcctaaatacataataataaatgccaaatggaataggttatatttctgatgtataatgctatacaagcaaacgaagaagtgtgggtgaattcctctataaactggatgtagggaaaggctaacgacaacccaaagtccagattcaatgaaacatta

SEQ ID NO: 15507 - DNA, 228 bp, Homo sapiens
  AL133412.7_61496
  Located on chromosome 9
  Distance between a terminus base of telomere on chromosomal short arm and 5'-terminus of this base sequence : 108934840
  Distance between 3'-terminus of neighbour sequence of sequence listing upward to telomere on chrosomal short arm and 5'-terminus of this base sequence : 281249
atttgtgactttgagcaagttaactaacttttctgtctctcagcttcctcacctagacaataaattggggttgataattgttcccacttcataaagttgttgtgaggactaaattgtgtgtgtgtgtgtgtgtgtgtgtgtgtgcatgtgattatatatacatttgatgtcacaccaatagtgtctgaaatttggtgagcactgtttaactggttgactgtttacatc

SEQ ID NO: 15508 - DNA, 420 bp, Homo sapiens
  AL133412.7_131222
  Located on chromosome 9
  Distance between a terminus base of telomere on chromosomal short arm and 5'-terminus of this base sequence : 109004461
  Distance between 3'-terminus of neighbour sequence of sequence listing upward to telomere on chrosomal short arm and 5'-terminus of this base sequence : 69393
gttaactcatgcttcatgtgagaagattctttttggaattcactaattgtagagaagctatgtgttctggttggtggatgacaaaaatagattactgaagaagacagagctgatagaaaggtgggacagaagccatctgggagttagatagatatacttccagtattggtgatatatatatgtgtgtatttaaatcatatatttatctattgatctatcatctatctatctatctatctatctatctatctatctatctatctatctccctatctatcatcttcctgtcaaccttaaaaaggttttgagacaatgtaaaataaatgcacaggtatatactgaagccattaacacaaagtaaaaggtaggagtcaagatataaaagtagagagtaaagtgaatgtattaagaaatcctgtc

SEQ ID NO: 15509 - DNA, 108 bp, Homo sapiens
  Z66778
  Located on chromosome 9
  Distance between a terminus base of telomere on chromosomal short arm and 5'-terminus of this base sequence : 109155672
  Distance between 3'-terminus of neighbour sequence of sequence listing upward to telomere on chrosomal short arm and 5'-terminus of this base sequence : 150791
attataggcttgtatgccaaaacagtgtgtgattatgcataggggtgtgtgtgtgtgtgtgtgtgtgtgtgtgtgtgtgtgtatttccacccctggggagcggattca

SEQ ID NO: 15510 - DNA, 124 bp, Homo sapiens
  D9S155
  Located on chromosome 9
  Distance between a terminus base of telomere on chromosomal short arm and 5'-terminus of this base sequence : 109204371
  Distance between 3'-terminus of neighbour sequence of sequence listing upward to telomere on chrosomal short arm and 5'-terminus of this base sequence : 48591
ttccttgagtcaatccctgatttcagaaaaatttttagacatctgtgtgtgtgtgtgtgtgtgtgtgtgtatgtgtgtgtgtgtgtgtgtgtgtatgttggggggatggagggaagagtgagga

SEQ ID NO: 15511 - DNA, 119 bp, Homo sapiens
  D9S1776
  Located on chromosome 9
  Distance between a terminus base of telomere on chromosomal short arm and 5'-terminus of this base sequence : 109265343
  Distance between 3'-terminus of neighbour sequence of sequence listing upward to telomere on chrosomal short arm and 5'-terminus of this base sequence : 60848
ggaaagcagacacacaaatgtgcacacgaacacacacacacacacacacacacacacactcactctctctctctctctaatgcccatgtgatatcaaatgtagccttgacaatgctcca

SEQ ID NO: 15512 - DNA, 217 bp, Homo sapiens
  D9S926
  Located on chromosome 9
  Distance between a terminus base of telomere on chromosomal short arm and 5'-terminus of this base sequence : 109267741
  Distance between 3'-terminus of neighbour sequence of sequence listing upward to telomere on chrosomal short arm and 5'-terminus of this base sequence : 2279
aactgaagcacagctaagccggataagaatttatctctatctctaagtgtatctctctgtcttatgtgtatttcctgtatctcagtttctacatctgtgtattatctatctatctatctatctatctatctatctatctatctatctatcatctgtctatctttctatctctctattatctatcagctactatgtgccaggaattgtaggctgagga

SEQ ID NO: 15513 - DNA, 457 bp, Homo sapiens
  chr9.fa.O7frz.118097908
  Located on chromosome 9
  Distance between a terminus base of telomere on chromosomal short arm and 5'-terminus of this base sequence : 109358235
  Distance between 3'-terminus of neighbour sequence of sequence listing upward to telomere on chrosomal short arm and 5'-terminus of this base sequence : 90277
cacaaggctatgacataattcttggttgcctgccaaaatagagaaaaaaggatgaaaaggaagagtttttattgcaaaaagacagcttagggaattttttcttaacttagtgagatggaatcctgagacaaagatttgttagagataacttgtgtaggggtattaaactcaacagagataaagggagatgggtgagtaataagaaaaataaattaacccttggtgttttcttcaggcaatgctgaaaacacacacacacacacacacacacacacacacacacacacacacacacaaaaaaaaaaaaaaaaaaaaaaaaaaaaaccttatgcccaccacatcatcatttgtatcttaagtaaatgcttggggaaaggggttgagccaggaaggaagaacaggtgttgtacatcgaaccaagcctaaatatttggtatggaacagttgaagatttaag

SEQ ID NO: 15514 - DNA, 384 bp, Homo sapiens
  AB020869.1_50388
  Located on chromosome 9
  Distance between a terminus base of telomere on chromosomal short arm and 5'-terminus of this base sequence : 109399605
  Distance between 3'-terminus of neighbour sequence of sequence listing upward to telomere on chrosomal short arm and 5'-terminus of this base sequence : 40913
  misc_feature (1)...(384): n = A,T,G or C
atgaaagatctaatctcagacctcttctctcctgtatcccaaaccagtgcaacaatgaggtttcctctgtncctacatatttatttctacatctccttacgtggtttagaatgatgatgatgatgatgatgatgataatgataaaatcagcaactacctttaatttaccttactatgtgtcagacatagtgcttctcattatataaaaacagtataagcaacacatctatatgtaaaaactctcacgtcgtgaaacatatgtatagagaccctatcgggttaaaccttatgaaacttctaatatgtatttaacctacaaaacaggaatgtcatttggctcaatccaatataatatgccaggtagtttaaattaggtggacaaga

SEQ ID NO: 15515 - DNA, 189 bp, Homo sapiens
  AB020870.1_30182
  Located on chromosome 9
  Distance between a terminus base of telomere on chromosomal short arm and 5'-terminus of this base sequence : 109479489
  Distance between 3'-terminus of neighbour sequence of sequence listing upward to telomere on chrosomal short arm and 5'-terminus of this base sequence : 79500
ttgtctaatggtctgaggaaacacacacacacaagcgcacacacacacacacacacacacacacatacacacagtctttttcttgaatcatcttcggcttagagcacagtagccatgaggataacacttttttcctgtctgacatttcagttctgaactttagacatctgattgcagttggattaagtt

SEQ ID NO: 15516 - DNA, 270 bp, Homo sapiens
  AB020872.1_13170
  Located on chromosome 9
  Distance between a terminus base of telomere on chromosomal short arm and 5'-terminus of this base sequence : 109662407
  Distance between 3'-terminus of neighbour sequence of sequence listing upward to telomere on chrosomal short arm and 5'-terminus of this base sequence : 182729
ctaggttcataaattggaagacttaatagtgttcagatgtgaatttctcccttaggtaatctatagattcaatacaaaccataaaatgtctgtgtgtgtgtgtgtgtgtgtgtatacacacacacatagatatatatggggggtataaattgacaagctatttttaaaatgtctgtgataatgttaagatgtagaacaaccacaaacagtttgaatatcaaagttgccgtacctgatttcataatttactggaaagctgcagtaattatg

SEQ ID NO: 15517 - DNA, 353 bp, Homo sapiens
  AB020873.1_8010
  Located on chromosome 9
  Distance between a terminus base of telomere on chromosomal short arm and 5'-terminus of this base sequence : 109757234
  Distance between 3'-terminus of neighbour sequence of sequence listing upward to telomere on chrosomal short arm and 5'-terminus of this base sequence : 94557
tgacctggtatgaatactcaagttaccttgaatatctgcatttttgatgcaagatagcagctattactttcttctgctcttttctttaaaaatacatacatgcagatagatagatagatagatagatagatagatagatagatagatagatagaatcacacacacacacagagacacacatatttcacccaaaaagcacttccttttgaggacaaacataacagttttgaataaagggtttataatctctacccagtttagatatatgtctgattcctgaagttatctcactgaaatgtattttcataaccatttgccatttgagaatcttgttcagtaagcatgtttaagga

SEQ ID NO: 15518 - DNA, 467 bp, Homo sapiens
  AB020873.1_15783
  Located on chromosome 9
  Distance between a terminus base of telomere on chromosomal short arm and 5'-terminus of this base sequence : 109764828
  Distance between 3'-terminus of neighbour sequence of sequence listing upward to telomere on chrosomal short arm and 5'-terminus of this base sequence : 7241
atactaacctggatttaaatctcagcttatatacagactacacaatttgtactctctgtgccttcacatcctctcttgtaaatagggtcatgataatatgtttctaacactgttggatgttaaagtgtgaatgttcaaggcctgtcatgtagcaagcagacactccacacatggtatattttaaggcaaattctggccttttcacatttaatatttgtaaaaatgaaagctaacgaacaaaagaaagagaaagaaagaaagaaagaaaaagaaagaaagaaagaaggaaggaaggaaggaaggaaggaaggaaggaaggaaggaaggaaggaaggaaagaaagaaagaaagaaagaaaaaaagaaagaaagaaaaagaaagaaacaaactcagatttaatggaaacttccctggattgggtctcagaagttcttttccaaattctgtcactaaccaggttattctaa

SEQ ID NO: 15519 - DNA, 334 bp, Homo sapiens
  AB020873.1_15835
  Located on chromosome 9
  Distance between a terminus base of telomere on chromosomal short arm and 5'-terminus of this base sequence : 109764961
  Distance between 3'-terminus of neighbour sequence of sequence listing upward to telomere on chrosomal short arm and 5'-terminus of this base sequence : -334
ttcaaggcctgtcatgtagcaagcagacactccacacatggtatattttaaggcaaattctggccttttcacatttaatatttgtaaaaatgaaagctaacgaacaaaagaaagagaaagaaagaaagaaagaaaaagaaagaaagaaagaaggaaggaaggaaggaaggaaggaaggaaggaaggaaggaaggaaggaaggaaagaaagaaagaaagaaagaaaaaaagaaagaaagaaaaagaaagaaacaaactcagatttaatggaaacttccctggattgggtctcagaagttcttttccaaattctgtcactaaccaggttattctaa

SEQ ID NO: 15520 - DNA, 262 bp, Homo sapiens
  D9S907
  Located on chromosome 9
  Distance between a terminus base of telomere on chromosomal short arm and 5'-terminus of this base sequence : 109765056
  Distance between 3'-terminus of neighbour sequence of sequence listing upward to telomere on chrosomal short arm and 5'-terminus of this base sequence : -239
gctaacgaacaaaagaaagagaaagaaagaaagaaagaaaaagaaagaaagaaagaaggaaggaaggaaggaaggaaggaaggaaggaaggaaggaaggaaggaaggaaagaaagaaagaaagaaagaaaaaaagaaagaaagaaaaagaaagaaacaaactcagatttaatggaaacttccctggattgggtctcagaagttcttttccaaattctgtcactaaccaggttattctaatacatttgagcatttcttctgcc

SEQ ID NO: 15521 - DNA, 229 bp, Homo sapiens
  D9S177
  Located on chromosome 9
  Distance between a terminus base of telomere on chromosomal short arm and 5'-terminus of this base sequence : 109795872
  Distance between 3'-terminus of neighbour sequence of sequence listing upward to telomere on chrosomal short arm and 5'-terminus of this base sequence : 30554
cccttcatacaaaaactaccacatcaaatacaaatgctgaaaaaagagatattaagttaaaataaacttatggtagccatccctcgaaggctatctaaaaatactcattgtaaaatatttgtgtgtgtgtgtgtgtgtgtgtgtgtgtgtgtgtgtgtgtgtgtgtgtgtatgtattttcctggaagaaggaattacaatgttctcactctttaagattctgacccctg

SEQ ID NO: 15522 - DNA, 319 bp, Homo sapiens
  AB020874.1_25567
  Located on chromosome 9
  Distance between a terminus base of telomere on chromosomal short arm and 5'-terminus of this base sequence : 109874703
  Distance between 3'-terminus of neighbour sequence of sequence listing upward to telomere on chrosomal short arm and 5'-terminus of this base sequence : 78602
ctgcattataatgtccaaagaaaaattagatgttttagtattatagaatacttgcaataataaacatgtaatggcctaaatcaaggaggtaagatgccagcttgccaatttatctagaattatgtttacctccagaccctgggttttcttgggagacaagcagggacattgcatgacaaatgggtatgaattcatatcatatcatatcatatcatatcatatcatatcatatcatatcagtataaagaaagaagaaaagccagtggggaacgtggagagtatagtgtactgattgcttaccatggagaagtcttcatac

SEQ ID NO: 15523 - DNA, 254 bp, Homo sapiens
  AB020875.1_14070
  Located on chromosome 9
  Distance between a terminus base of telomere on chromosomal short arm and 5'-terminus of this base sequence : 109963245
  Distance between 3'-terminus of neighbour sequence of sequence listing upward to telomere on chrosomal short arm and 5'-terminus of this base sequence : 88223
aatatgacatggatgtccaagctagcacaataagatgaaaggcagagagagagactgagagagaaacagagagacagagaggaaggaaggaaggaaggaaggaaggaaggaaggaaggaaggaaggaaggaaggaaggaaggaaggaagtaggggagggagggagggagggagggaaagaatttgaaagggagaaatgatgattggtatttctacaaaataatttatacataagaattccaggagaatgtctat

SEQ ID NO: 15524 - DNA, 446 bp, Homo sapiens
  AB020876.1_3198
  Located on chromosome 9
  Distance between a terminus base of telomere on chromosomal short arm and 5'-terminus of this base sequence : 110052231
  Distance between 3'-terminus of neighbour sequence of sequence listing upward to telomere on chrosomal short arm and 5'-terminus of this base sequence : 88732
gttacaaccttactcaaccaagatttttaaaaatatgcttttatctttcctttactaacttccttgcttcttttctagctcttaatatgtggcttttctcacctactgattaaaggatttgtggcaaaaagacaataaagaatgtggtagtagaagcagcattcattttgtttttgttttttcccttttgttgtttttcattttatttcaaaatgatttcaaacctacagaaaaagttgcaagaataatatgaattcccattcatacacacacataacaatacacacacacattcacacacacacacacacacacacttttttctcctgattgatagttaactgcttacatcatggccctttacctgtgaataatcagggtgtatatactaagaaaaaggatattctcttacattacttagttatattgtcaagttcagccatgta

SEQ ID NO: 15525 - DNA, 390 bp, Homo sapiens
  AB020876.1_22249
  Located on chromosome 9
  Distance between a terminus base of telomere on chromosomal short arm and 5'-terminus of this base sequence : 110071418
  Distance between 3'-terminus of neighbour sequence of sequence listing upward to telomere on chrosomal short arm and 5'-terminus of this base sequence : 18741
  misc_feature (1)...(390): n = A,T,G or C
tggagcaaattaaagattgtacttgttctaatgtggagagcagaaaggcgtatgtatcaatgggagaacattgctgggatgacaggttgatactacacaaagcttgggtgatagacatttttgtgtttatggtgcattgaaatgctgtctttatatacgtgtgtgtgtgtgtgtgtgtgtgtgtgtgtgtgtgtgtgtgtgtttncctggatatttcctttgctttccaaaatctcccagtagtagaagccctcctttgcagaaaagacataaagatctctgttaatagagcaaaagaagacagtaggcaaagcttcaccctggtccaataggcaggtgaatcttcactggtgccatagagttgacccgtcataaggcaagatgactcag

SEQ ID NO: 15526 - DNA, 145 bp, Homo sapiens
  HUMUT536
  Located on chromosome 9
  Distance between a terminus base of telomere on chromosomal short arm and 5'-terminus of this base sequence : 110071500
  Distance between 3'-terminus of neighbour sequence of sequence listing upward to telomere on chrosomal short arm and 5'-terminus of this base sequence : -308
  misc_feature (1)...(145): n = A,T,G or C
caggttgatactacacaaagcttgggtgatagacatttttgtgtttatggtgcattgaaatgctgtctttatatacgtgtgtgtgtgtgtgtgtgtgtgtgtgtgtgtgtgtgtgtgtgtttncctggatatttcctttgctttc

SEQ ID NO: 15527 - DNA, 400 bp, Homo sapiens
  AB020877.1_6896
  Located on chromosome 9
  Distance between a terminus base of telomere on chromosomal short arm and 5'-terminus of this base sequence : 110155945
  Distance between 3'-terminus of neighbour sequence of sequence listing upward to telomere on chrosomal short arm and 5'-terminus of this base sequence : 84300
cactcttaaaccttgcatgaagtttgtatttgtgtaacatcttgccagaaataattactttccttacctattctcccatagttgaagtttaagtaaatgaaggttcactttattgtgtttctaaggatgtgtttattgtactagcctcatgtgcctttttaacctaggcaaaattttatgggtgctttttactacagtgtttctgaagaaagagaaagcataaatcctaaaataatttcacactttattatatatatacatatacttaagtagataagtatatatatatatatatatatatatatatatatatatgtgcatgagtagacaagagcacttaaaaaaaacactgtgctttattgcctttagctgaaacgtagaaactaagtcccatacggtt

SEQ ID NO: 15528 - DNA, 241 bp, Homo sapiens
  AB020877.1_10872
  Located on chromosome 9
  Distance between a terminus base of telomere on chromosomal short arm and 5'-terminus of this base sequence : 110160076
  Distance between 3'-terminus of neighbour sequence of sequence listing upward to telomere on chrosomal short arm and 5'-terminus of this base sequence : 3731
gaccttgtttcataatcacagtataagcagttgtagcaaattctgttaagggtttctttcttacttttcttgctctttctttccctttctttctttatttgtttctttctctttttctcctttcttccttccttccttccttccttccttccttccttccttccttccttccttccctccctccctccctccttccttccctccacaattacaataatagataatcttggaattagaccag

SEQ ID NO: 15529 - DNA, 438 bp, Homo sapiens
  AB020877.1_25411
  Located on chromosome 9
  Distance between a terminus base of telomere on chromosomal short arm and 5'-terminus of this base sequence : 110174504
  Distance between 3'-terminus of neighbour sequence of sequence listing upward to telomere on chrosomal short arm and 5'-terminus of this base sequence : 14187
cgtgactttaatgtctgttaacaggattaaatgatgactatgttattgcaattatattatcactatttccactgctgctattacagttgctgtgtctaaagttattttccttgaataaagaaattctgttgattacttctaatgaaaattgaatatctttctttgattctcccctcccccacactcctttggcatttttccatggaaacagaaggagactgttggaaaagaaatacacacacacacacacacacacacacacacacacacacaattttgacagccaaaatggtggaaggcatctgccaaaaatctacaactttatgccggggcaaacatgtgacttaattttcttccaccaggatggatttgtgctgtcacagcaaaaattgatcttctgtttgtgggaaattatacacagtttgttcttgtctgtgc

SEQ ID NO: 15530 - DNA, 166 bp, Homo sapiens
  G08581
  Located on chromosome 9
  Distance between a terminus base of telomere on chromosomal short arm and 5'-terminus of this base sequence : 110329665
  Distance between 3'-terminus of neighbour sequence of sequence listing upward to telomere on chrosomal short arm and 5'-terminus of this base sequence : 154723
gagatcatgttggcaagcttattctcttggagcctagcctacctctggacacacctggcactgaatagttactctttgaatgcatggaatgaatgggcggatggatggatggatggatggatggatggatggatggatggatagtgtctgtgtctctaaacagtgg

SEQ ID NO: 15531 - DNA, 116 bp, Homo sapiens
  D9S170
  Located on chromosome 9
  Distance between a terminus base of telomere on chromosomal short arm and 5'-terminus of this base sequence : 110403200
  Distance between 3'-terminus of neighbour sequence of sequence listing upward to telomere on chrosomal short arm and 5'-terminus of this base sequence : 73369
caggcacacgcatacacaagtacgtgggcacacagacacacacacacacacacacacacacacacacacacacacacggagtctgcataattagaggtaaaggctattcctgaagt

SEQ ID NO: 15532 - DNA, 428 bp, Homo sapiens
  chr9.fa.O7frz.119194828
  Located on chromosome 9
  Distance between a terminus base of telomere on chromosomal short arm and 5'-terminus of this base sequence : 110441781
  Distance between 3'-terminus of neighbour sequence of sequence listing upward to telomere on chrosomal short arm and 5'-terminus of this base sequence : 38465
tgtactttgccaactaggtaatagagcataggtatatttacaacatcagctaccacttatttttatttatttatttatttatttatttatttatttagagatggagtttcactcttgttgcccaggctggagtgcaatggcgcaatctcagctcactgcaacctccacctcccaggttcaagctattctcctgcctcaacctcctgagtagctgggattacaggcgcctgccaccacgcccagctaattttttgtattttcttttttagcagaggtggggttttaccatgttggtcagcctggtctcaaactcctgacctcgtgatctgcccatctcaggctccgaaagtgctgggattacaggcatgagccaccgcgcccagcccagctaccatttactgagtgcttagtatatgccaggagttctg

SEQ ID NO: 15533 - DNA, 204 bp, Homo sapiens
  G08762
  Located on chromosome 9
  Distance between a terminus base of telomere on chromosomal short arm and 5'-terminus of this base sequence : 110478263
  Distance between 3'-terminus of neighbour sequence of sequence listing upward to telomere on chrosomal short arm and 5'-terminus of this base sequence : 36054
cttcaccagagtataaggtctggaggggtaggaactatatctatattaattcactattgcatccttttccttagcataatgtgtaacacatcgtaggaattaaatacataggatggaataaggataaatgaatggatggatggatggatggacggatggatggataggtggatgaaaggatatggttgcaggaaagaacatata

SEQ ID NO: 15534 - DNA, 385 bp, Homo sapiens
  AL133282.15_26918
  Located on chromosome 9
  Distance between a terminus base of telomere on chromosomal short arm and 5'-terminus of this base sequence : 110560748
  Distance between 3'-terminus of neighbour sequence of sequence listing upward to telomere on chrosomal short arm and 5'-terminus of this base sequence : 82281
gaggtcagtaggtttggtgataatataggaacgatgggataatattcttttccttgggttaagggaagttctagctttttacctcaacaggccttcttatcctcctaggattgctctttaagggtaagtgttgggtgagcatgtgtgtgtgtgtgtgtgtgtgtgtgtgtgtgtgtgtgtgtgtctgcccatatatacaatttgcatatggcaatctgaagtaaatttctaactaatattacctgctagtcactggatatctcctttggatgtccaaagacatcttaatctcctgccttcacactcctcacatcccccaaaactgttcttcctgtcatcctccccatcatggtgaatggcagcagcatccatttagtcactcagt

SEQ ID NO: 15535 - DNA, 241 bp, Homo sapiens
  AL133284.13_12323
  Located on chromosome 9
  Distance between a terminus base of telomere on chromosomal short arm and 5'-terminus of this base sequence : 110676661
  Distance between 3'-terminus of neighbour sequence of sequence listing upward to telomere on chrosomal short arm and 5'-terminus of this base sequence : 115528
aaccatgtaaataggaagtagcagagtcaggatttgaacccaggccgtctggctccaacgtgtgtgtgtgtgtgtgtgtgtgtgtgtgtgtgtgtgtgtgtgtgtgtttctactgtacagtaccaatccctgaaacaacaccattgtttttcccccaaactctacctgtccgactccactttattttaaaaagctgcgtttttcaaatggaaaaaaaaaataccaactgaggaaacctaat

SEQ ID NO: 15536 - DNA, 186 bp, Homo sapiens
  Z16448.1_85
  Located on chromosome 9
  Distance between a terminus base of telomere on chromosomal short arm and 5'-terminus of this base sequence : 110676661
  Distance between 3'-terminus of neighbour sequence of sequence listing upward to telomere on chrosomal short arm and 5'-terminus of this base sequence : -241
aaccatgtaaataggaagtagcagagtcaggatttgaacccaggccgtctggctccaacgtgtgtgtgtgtgtgtgtgtgtgtgtgtgtgtgtgtgtgtgtgtgtgtttctactgtacagtaccaatccctgaaacaacaccattgtttttcccccaaactctacctgtccgactccactttattt

SEQ ID NO: 15537 - DNA, 161 bp, Homo sapiens
  D9S154
  Located on chromosome 9
  Distance between a terminus base of telomere on chromosomal short arm and 5'-terminus of this base sequence : 110676684
  Distance between 3'-terminus of neighbour sequence of sequence listing upward to telomere on chrosomal short arm and 5'-terminus of this base sequence : -163
gagtcaggatttgaacccaggccgtctggctccaacgtgtgtgtgtgtgtgtgtgtgtgtgtgtgtgtgtgtgtgtgtgtgtgtttctactgtacagtaccaatccctgaaacaacaccattgtttttcccccaaactctacctgtccgactccactttat

SEQ ID NO: 15538 - DNA, 369 bp, Homo sapiens
  AL133284.13_20535
  Located on chromosome 9
  Distance between a terminus base of telomere on chromosomal short arm and 5'-terminus of this base sequence : 110684703
  Distance between 3'-terminus of neighbour sequence of sequence listing upward to telomere on chrosomal short arm and 5'-terminus of this base sequence : 7858
gcataaagatagcaacaatagacactgggcactataggaagggggagggagggagagatccggctcaaaaactacctattgggtactatgctcactacctgggtgatggaatcattcatatcccaaacctcagcatcatgtagtagagctatgtaataaacctgaacatgtaccccttgaatccaaaaatctaaaataccagttgaaattcacacacacacacatacatacacacacacacacacacacacacacacacgtatgtatatataataatgagatcttaatgagatctttatggacaaaatcctgacagtgactttgagtttagagaggagccacgctctcaagttgaagattctgctaact

SEQ ID NO: 15539 - DNA, 254 bp, Homo sapiens
  AL133284.13_43083
  Located on chromosome 9
  Distance between a terminus base of telomere on chromosomal short arm and 5'-terminus of this base sequence : 110707291
  Distance between 3'-terminus of neighbour sequence of sequence listing upward to telomere on chrosomal short arm and 5'-terminus of this base sequence : 22219
tttaatgaaaccataaatccacagatccaagaagctcaacaaaccccaaacacaagaaataaatggctaataaagagaaaagcttagaatcagtcagaaaaaaggatctctctctctctctctctctctctctctctctatatatatatacacacacacacatatatacatgaattatatatatgggtgtatatatatatatatatatatatatatatgaacaaagataggactgatggcagatttataatttg

SEQ ID NO: 15540 - DNA, 258 bp, Homo sapiens
  AL133284.13_50484
  Located on chromosome 9
  Distance between a terminus base of telomere on chromosomal short arm and 5'-terminus of this base sequence : 110714764
  Distance between 3'-terminus of neighbour sequence of sequence listing upward to telomere on chrosomal short arm and 5'-terminus of this base sequence : 7219
agatgtgaagcgttattgttaaagtgtaaacccactgttggaggactttcatttcccttggttatctgtggtttacaaacctctgctattataaaacagcactccagaaggacaaagacacacacacacacacacacacacaaaatacacacccacccattcacagacagtggtaaatctcacccacataaaaataacgtacatacagataaatacaaacacacagacacttcagtttgcctatgcatattcagatac

SEQ ID NO: 15541 - DNA, 361 bp, Homo sapiens
  AL133284.13_56851
  Located on chromosome 9
  Distance between a terminus base of telomere on chromosomal short arm and 5'-terminus of this base sequence : 110721028
  Distance between 3'-terminus of neighbour sequence of sequence listing upward to telomere on chrosomal short arm and 5'-terminus of this base sequence : 6006
gaggtcatgctgactgttagaccttttctcactccctttgcaggttcccccttggtaaaattaatgtgcttaactactgatggcttaaaattctgtaacatctccagccaacactgaaggcttaattaacataacggtgaaacccagggccatgggtgaaagtgacacagatgggaaggttgcactggaccccagcaatgggaagagagagagcatactctgtgtgtgtgtgtgtgtgtgtgtgtgtgtgtgtgtgtgtgtgtgtgtgtgtgtgtgtttggtttttgtaataaataggaacttgagcttgtggaaaacaaaacaggaaatctctctggacttcataagtttcaccatccag

SEQ ID NO: 15542 - DNA, 444 bp, Homo sapiens
  chr9.fa.O7frz.119848091
  Located on chromosome 9
  Distance between a terminus base of telomere on chromosomal short arm and 5'-terminus of this base sequence : 110845668
  Distance between 3'-terminus of neighbour sequence of sequence listing upward to telomere on chrosomal short arm and 5'-terminus of this base sequence : 124279
tggagtcatgtacaattgaatcagggccatctgcctccactctaccacctatctctccaaccatagtcacacttgtcttcttccctctttactgcccaccctcatttatacacaggtgtgcatgagcacacacacacacacacacacacacacacacacacaccacctacccccatacatacacagagtcagagtgaagcctgggttacacaaagcacatgtcttccctctctaaatgcaaaacaatttccaccagtggcaccaaactcacttaagcattccaggcatggctgttactaactcctgccctggtaattgcgatccctgaaattgaaagaaattgcaggctagaggaacattatcttctccttggccacttcgccctccatctcctttgcctgtgtgtattagcactgggatcccttgtcctgtcataacactgag

SEQ ID NO: 15543 - DNA, 155 bp, Homo sapiens
  D9S931
  Located on chromosome 9
  Distance between a terminus base of telomere on chromosomal short arm and 5'-terminus of this base sequence : 110949547
  Distance between 3'-terminus of neighbour sequence of sequence listing upward to telomere on chrosomal short arm and 5'-terminus of this base sequence : 103435
atattgcacagtaaaattgctaaacatctatctatctatctatctatctatctatctatctatctatctagttatctatctatcttatagtaaatctactaaaaggacatgtcaaaatgttagtagtagctatttggaggtgacatgactatggg

SEQ ID NO: 15544 - DNA, 217 bp, Homo sapiens
  D9S1802
  Located on chromosome 9
  Distance between a terminus base of telomere on chromosomal short arm and 5'-terminus of this base sequence : 110959193
  Distance between 3'-terminus of neighbour sequence of sequence listing upward to telomere on chrosomal short arm and 5'-terminus of this base sequence : 9491
caacttcatcagaccgttgaatcttctcttatcccctagggaatgaatgttctttctctttctctctcttttaatttttccagtttatatgaataaaagacaaagagagacaagcccaagctacacacacacacacacacacacacacacacacacacacacacacacactcctctgtatttgaggtttcattcctatgggatatctatcctaaaag

SEQ ID NO: 15545 - DNA, 346 bp, Homo sapiens
  AL162589.2_31627
  Located on chromosome 9
  Distance between a terminus base of telomere on chromosomal short arm and 5'-terminus of this base sequence : 110977393
  Distance between 3'-terminus of neighbour sequence of sequence listing upward to telomere on chrosomal short arm and 5'-terminus of this base sequence : 17983
gtcagtttcactttcagaaataaggtgaaaatgcaagactggagagagacagagacagacagacagacagacagacagacagacagacagacagagaattcattgttttgaacctgaggaaatcaagggactgtgttattatgaggaagcagctctgggctcaaactctgctgctcatttgctgagaaaaccaacaacttattcaacctctcttgagtctcagtttcctcatacataaatcatagattataataccgaattcttagttttcatgagaattacattagataataaaacttccatgaaggcatgggttctgccatgctcactgaagtctagtgcctta

SEQ ID NO: 15546 - DNA, 386 bp, Homo sapiens
  AL162589.2_85924
  Located on chromosome 9
  Distance between a terminus base of telomere on chromosomal short arm and 5'-terminus of this base sequence : 111012521
  Distance between 3'-terminus of neighbour sequence of sequence listing upward to telomere on chrosomal short arm and 5'-terminus of this base sequence : 34782
agtcaattctaagctgagcatatcccagtccttgttgactgagtaataataataataacagcatttgtaaaataatagagtgaccctttgctgaggtcctactctgtgccagacactgtaaagtgttttattattattattattattattatttatatatatttttttttacaatctcaatctcagtcttcatgaggtggtcctgagaagcccactgtacagatcttcacatctgaggctcagatagggaagaggataggaatttatgccacccaaccctgggtggcaggaccaagaattatgccagatgtcactggcagctgccacagcagtaatggcacctcctaaggcagagcactctggagaggtttaatgttcgctggcta

SEQ ID NO: 15547 - DNA, 206 bp, Homo sapiens
  AL162589.2_74607
  Located on chromosome 9
  Distance between a terminus base of telomere on chromosomal short arm and 5'-terminus of this base sequence : 111023880
  Distance between 3'-terminus of neighbour sequence of sequence listing upward to telomere on chrosomal short arm and 5'-terminus of this base sequence : 10973
atgttcagcttagaccatatgtacctcaccttccctgaactatccctgtcctgcccccatatgcaaggagatacacaacacaacacacacacacacacacacacacacacatatatacacatgcacacatgcacatagggatgctcatacattcaaaaacatccagtgttccttcactgcctgtaaggtaaagctgaaacactgta

SEQ ID NO: 15548 - DNA, 306 bp, Homo sapiens
  AL392085.7_79718
  Located on chromosome 9
  Distance between a terminus base of telomere on chromosomal short arm and 5'-terminus of this base sequence : 111062238
  Distance between 3'-terminus of neighbour sequence of sequence listing upward to telomere on chrosomal short arm and 5'-terminus of this base sequence : 38152
aggagttgaacctaaggtacagatcaattaattattcattgacatatccaactcatctttctgactagactgccctggggtgtgtgtgtgtgtgtgtgtgtgtgtgtgtgtgtgtgtgtgcgcgcgcgcgcgtgtgtgttgactactgggtggttgatgcctattgggcagagtaagatacgctaagggaaacatggttctactcagctgcaacgagtgggccttaaaaggcagaatgatttctcatcttagcttatcttggtgatcactgtccctgagctgctgtctgcataattgaaagtatgg

SEQ ID NO: 15549 - DNA, 322 bp, Homo sapiens
  chr9.fa.O7frz.120690012
  Located on chromosome 9
  Distance between a terminus base of telomere on chromosomal short arm and 5'-terminus of this base sequence : 111265960
  Distance between 3'-terminus of neighbour sequence of sequence listing upward to telomere on chrosomal short arm and 5'-terminus of this base sequence : 203416
ctgcagatcacctacatatcacatcaaatttgcaggcttgaaggcactgagagcctaacacgggtttcccttcatccttgtgggttctactttgtcttatcagattctggtttgtcctttctcttcttcactttatatccatgtgttcttcctctctttctccttctcctcctctcctcctcctcctttttcttcttcttcttctggctgccatgtagactccagcccacataaagactgtataatttgctacactatactaaatatcaacttgctatataacttactatacctaattctatgtcactcctagtgattctgt

SEQ ID NO: 15550 - DNA, 362 bp, Homo sapiens
  chr9.fa.O7frz.120805343
  Located on chromosome 9
  Distance between a terminus base of telomere on chromosomal short arm and 5'-terminus of this base sequence : 111376639
  Distance between 3'-terminus of neighbour sequence of sequence listing upward to telomere on chrosomal short arm and 5'-terminus of this base sequence : 110357
actgttatcaaatgtctgagtcacaagagtttattgacattctgaagcctattttcacattcctagagttttggatgccaaataatgaacactaattttttttaaaactcagaagaatatatctatatatagtgtgtgtatgtatatacactcatatcagaatatatatatatatacacacatatatctacacacatacacacatgccacacacacacacacacacacacgtcctgatactttctatttgctgagatagaagtttagcaacaattatttagtgttggaagatggtggattcagtctcagagacaagagcaatgtcaaagctaggctgatcatgaatgcagttagtaatgagg

SEQ ID NO: 15551 - DNA, 224 bp, Homo sapiens
  chr9.fa.O7frz.120910464
  Located on chromosome 9
  Distance between a terminus base of telomere on chromosomal short arm and 5'-terminus of this base sequence : 111485626
  Distance between 3'-terminus of neighbour sequence of sequence listing upward to telomere on chrosomal short arm and 5'-terminus of this base sequence : 108625
tgtagaaataacagccagacttaggatgaaaaataaaatcatatgaaattcaatgacctaattgacaactgttctctctttctctcaaacacacacacacaaacatacacacacacacacacacacacaccacatgcaccatgagctttttctttatttccttataaaagcaatggagattttttcttttttaaaaaaatctaatctagtttgcgttagaattg

SEQ ID NO: 15552 - DNA, 263 bp, Homo sapiens
  AL158831.6_119269
  Located on chromosome 9
  Distance between a terminus base of telomere on chromosomal short arm and 5'-terminus of this base sequence : 111642971
  Distance between 3'-terminus of neighbour sequence of sequence listing upward to telomere on chrosomal short arm and 5'-terminus of this base sequence : 157121
attgacacagttctaactgcagccaaattggaaaaactcctttctctctttttcagcgatcaattgatcagtcaacccttattgaatattcactgtgtgctagatgatgtggacatagcaatgagcaacacaagactgataccaccattccctgtcccctcacacacacacacacacacacacatacacacgcacacacacacacacacagagaaagagagagacagagagagagagatctttcctggagtttaaagtctaat

SEQ ID NO: 15553 - DNA, 320 bp, Homo sapiens
  chr9.fa.O7frz.121124150
  Located on chromosome 9
  Distance between a terminus base of telomere on chromosomal short arm and 5'-terminus of this base sequence : 111681444
  Distance between 3'-terminus of neighbour sequence of sequence listing upward to telomere on chrosomal short arm and 5'-terminus of this base sequence : 38210
gaacaagtttagtggtcatgagtgactgacatactgcaagggaggatgagagaaaggggtttgagaaagggagttagacaacttagagaatgcttttagaaaattttgcagtgaaaggtagcagaggaaaagacaaaaggagtctctgtctttctctctctatgtatatagaagatatatatatatatatatatatgtatcttcaaatattttaactaagcaggaactagtgggcaagtagaggggttggctttagacaggaacatagacagcaaaagaaatactggggaataatgttaaggttctggatatcaatttag

SEQ ID NO: 15554 - DNA, 427 bp, Homo sapiens
  chr9.fa.O7frz.121264833
  Located on chromosome 9
  Distance between a terminus base of telomere on chromosomal short arm and 5'-terminus of this base sequence : 111762265
  Distance between 3'-terminus of neighbour sequence of sequence listing upward to telomere on chrosomal short arm and 5'-terminus of this base sequence : 80501
gtgactacctgaaggaatctattactttgcctaaaaaaatactcttgctagattaagctttcttgtgacttctatacagtgatcctaattgtgtttcttggattcagcagaaatactcccaccactatgaccagctaattttgtgtgtgtgtgtgtgtgtgtgtgtgtgtgtgtgtgtgtgtgtgtacttttagtagagacggggttttaccatgttggacaggctggcctcgaactcctgatctcttgattcgcccgccttggcctctcaaagtgctgggattacaggtgagatggagttatttctttatgttatttactctgtctacagccagaaaacattgcaaaatttaatcaaattgtctaactcagtagatattaaatgaaattatggcagaaatctatgtgaagtaggctcctttttaat

SEQ ID NO: 15555 - DNA, 419 bp, Homo sapiens
  AL355592.6_21261
  Located on chromosome 9
  Distance between a terminus base of telomere on chromosomal short arm and 5'-terminus of this base sequence : 112024639
  Distance between 3'-terminus of neighbour sequence of sequence listing upward to telomere on chrosomal short arm and 5'-terminus of this base sequence : 261947
gacttgataatgacaactgcttacttttctttagtcctttttctttaaatttgtaataaatttcaaaaatgatttcaaaccatttcttctgtcataaggttggaaaatattttatatttctcccagtctaatgttagctacttactgtgtgtgtgcatgtgtgtatatatatatatatatataatattctataattaacaacacacactatatatacatatgtaatattctaattttttattaaacaaatacgtttgtttttatttcctccctttactttcttgattatgaaggttttccctatgcttaaaatgtcttgtgatacttttatttagttaatcatttatttttgtatttaagtttctaaaccatctggaatttattttatctatgatgtgaaacagactcaaacttaattt

SEQ ID NO: 15556 - DNA, 471 bp, Homo sapiens
  chr9.fa.O7frz.121517882
  Located on chromosome 9
  Distance between a terminus base of telomere on chromosomal short arm and 5'-terminus of this base sequence : 112137046
  Distance between 3'-terminus of neighbour sequence of sequence listing upward to telomere on chrosomal short arm and 5'-terminus of this base sequence : 111988
caatgctaagagattatgcctagtccttttgattttttcttaaatgaagaaaaactgaggatcagagacaaatgattggctcaaaggaacagaaacagaagtgagagaaactggttattatgctaagtccctgaaatttggaactgtccagaaaagatttgaatccaggcattatccatagaattaggtaaccttgaacaagttgtgtgtgtgtgcatgtgtgtgtgtgtgtgtgtgtgtgtgtgcatgtacatttagcaaattcctttttttccccccaaggcttatagttttgtgttttttaatttttctactttatcttaggttcagggggtaatgtgcaggcttattacatgggtaaattgcatgatgctgacacttcgtgtatatgaataatctcaccaccacacctgcctcctaccccctactttgtttattgttcccatgtttatgtccacgtgtatttaacct

SEQ ID NO: 15557 - DNA, 198 bp, Homo sapiens
  D9S275
  Located on chromosome 9
  Distance between a terminus base of telomere on chromosomal short arm and 5'-terminus of this base sequence : 112238793
  Distance between 3'-terminus of neighbour sequence of sequence listing upward to telomere on chrosomal short arm and 5'-terminus of this base sequence : 101276
caggaacttgtccattctctaagagtaagagcaagagggccagtgtggccttaactgaaatactgatggggaggagagtaggacatagagtcttggagttatggtaaatatatatatacatatatatatatatacacacacacacacacacacacacacacacatttatttatttactgtgagtaaggcaataataga

SEQ ID NO: 15558 - DNA, 171 bp, Homo sapiens
  D9S1848
  Located on chromosome 9
  Distance between a terminus base of telomere on chromosomal short arm and 5'-terminus of this base sequence : 112389363
  Distance between 3'-terminus of neighbour sequence of sequence listing upward to telomere on chrosomal short arm and 5'-terminus of this base sequence : 150372
taataagttcaggagacctattgcatagcatggtggctacggttaataagaatgtgttatatacttgaaattttctaagagagtagatgttaagtattcttactacacacacacacacacacacacacacacacacacacagattatttgtgtgaggctagctagcttgat

SEQ ID NO: 15559 - DNA, 243 bp, Homo sapiens
  AC006239.5_171081
  Located on chromosome 9
  Distance between a terminus base of telomere on chromosomal short arm and 5'-terminus of this base sequence : 112441849
  Distance between 3'-terminus of neighbour sequence of sequence listing upward to telomere on chrosomal short arm and 5'-terminus of this base sequence : 52315
gaatgctctaagcaagaacaatctgttttctttcctcttggcaaagaacacaaaagacagagcagctcatagaaactggggcaggagagaaaacttaactctctctctctctgacacacacacacacacacacacacacacacacacacacacacccctcctccacagattcccacaactccagcatccaaaataccacagcagagcttgggaagtggcctcatttcctaaccagtctctgta

SEQ ID NO: 15560 - DNA, 106 bp, Homo sapiens
  D9S1872
  Located on chromosome 9
  Distance between a terminus base of telomere on chromosomal short arm and 5'-terminus of this base sequence : 112441918
  Distance between 3'-terminus of neighbour sequence of sequence listing upward to telomere on chrosomal short arm and 5'-terminus of this base sequence : -174
tagaaactggggcaggagagaaaacttaactctctctctctctgacacacacacacacacacacacacacacacacacacacacacccctcctccacagattccca

SEQ ID NO: 15561 - DNA, 341 bp, Homo sapiens
  AC006239.5_166493
  Located on chromosome 9
  Distance between a terminus base of telomere on chromosomal short arm and 5'-terminus of this base sequence : 112446491
  Distance between 3'-terminus of neighbour sequence of sequence listing upward to telomere on chrosomal short arm and 5'-terminus of this base sequence : 4467
attggtagccaggttcttatttacaggcaatagagccaaactcagaatagggaggcagggtggaagcaggagagagagagagagagagagagagagagagacagagagagagagacagagagagacagagagagagagaatgaatgaatatatatgtatttttttcttttaaagaagggcctagattcagaagttcaaacacagtcattaagactgagtccctgtttatttctgggttctaattattgtcaagtttttattctgttattacagtattgggtcctttacccatctctgaactaaccaatgatgattatagtcagattgatacaatgctctga

SEQ ID NO: 15562 - DNA, 348 bp, Homo sapiens
  AC006239.5_116819
  Located on chromosome 9
  Distance between a terminus base of telomere on chromosomal short arm and 5'-terminus of this base sequence : 112496077
  Distance between 3'-terminus of neighbour sequence of sequence listing upward to telomere on chrosomal short arm and 5'-terminus of this base sequence : 49245
agtgacattccagaattatgctactgttaatagcataataggatttggaacacagatcttgtccctgtatcccaacaagatgagatatgaagttattattttatggtatctgtgtctcatcttccaacagaactttaagcttctcaggataattgcaatctctctctctctctctctctctctctctctgtctcatattagaatacacataataaaccaaataaagagaagaaacagtagagaaatatataagaaaaagacatttactgatgaaaagcaggtgactgaattgggaagagcatgaatatttattaagtttatattacgtgactggtgctatatttgagc

SEQ ID NO: 15563 - DNA, 427 bp, Homo sapiens
  AC006239.5_52099
  Located on chromosome 9
  Distance between a terminus base of telomere on chromosomal short arm and 5'-terminus of this base sequence : 112560385
  Distance between 3'-terminus of neighbour sequence of sequence listing upward to telomere on chrosomal short arm and 5'-terminus of this base sequence : 63960
tgtctacattgcttcactgtctactagcattaactgttgcctagaaaaaaaaaaaaaaaacagcagaaactagtctattcctcattcccctctccaaaggggagtgtgtgtgtgtgtgtgtgtgtgtgtgtgtgtgtgtgtgtgtgtgtttgaatgcctttaggagtcattttttatcttagaaacaataacttatacagctatgtctcacatttgatatgtttctctttagatgtttttctgctaaatcaaatttttgaagactttgtacacactttcactttgtgtatgtatttttttaattcagtgtttttctgttacattataaatattgttttctacccaatttgttctctttttcagaaacattaatcatttatatggctgttttcttctataatcctagctaaattttctggatcacttt

SEQ ID NO: 15564 - DNA, 297 bp, Homo sapiens
  AC006239.5_17393
  Located on chromosome 9
  Distance between a terminus base of telomere on chromosomal short arm and 5'-terminus of this base sequence : 112595040
  Distance between 3'-terminus of neighbour sequence of sequence listing upward to telomere on chrosomal short arm and 5'-terminus of this base sequence : 34228
ccaagtaattctgtgactccacaaaatgtgtattccacagaccacagactaaactgagaagacaaacagttgtttttttaggtttctgatgatgcgctgttctttagttgtgctgtgtgtgactctctctgtgcatgtgtgtgtgtgtgtgtgtgtgtgtgtgtgtgtgtgttaaagaagtggtatttataagagatgaatacgtcaagtcagtggtgtcagaatacttgagattccgctgaaaacagcctcagaaatgctatggatgtgctagtatgaattataactggccatcag

SEQ ID NO: 15565 - DNA, 253 bp, Homo sapiens
  Z67423
  Located on chromosome 9
  Distance between a terminus base of telomere on chromosomal short arm and 5'-terminus of this base sequence : 112717917
  Distance between 3'-terminus of neighbour sequence of sequence listing upward to telomere on chrosomal short arm and 5'-terminus of this base sequence : 122580
gaacaataaacctgcaatttgaggaaaagcaaagttacctacaccccccacccccaccacacacacacagacacacacacacacacacacacacacacacacagcctgccttgaaatgctgctgattgccatggatgttcttgggtgagaagcaatccctgagggacaaatgtcccctgagcattacacatcaaagacaacctggcgagcacggtgcagtaggaactagaagacgagatgtcacagactgttc

SEQ ID NO: 15566 - DNA, 200 bp, Homo sapiens
  D9S195
  Located on chromosome 9
  Distance between a terminus base of telomere on chromosomal short arm and 5'-terminus of this base sequence : 112781832
  Distance between 3'-terminus of neighbour sequence of sequence listing upward to telomere on chrosomal short arm and 5'-terminus of this base sequence : 63662
agggcaggttcctacaaatacatgtttgcttttatctctccccagaatatgaacacatgtgtgtgtgtgtgtgtgtgtgtgattgatatatatatatatatatatatcttcctagaatatatgtgtacattttttaggccaaatatatttctacttttttcccctaagagggcttttcagcggcccctccgtgctgagct

SEQ ID NO: 15567 - DNA, 404 bp, Homo sapiens
  chr9.fa.O7frz.122227871
  Located on chromosome 9
  Distance between a terminus base of telomere on chromosomal short arm and 5'-terminus of this base sequence : 112871163
  Distance between 3'-terminus of neighbour sequence of sequence listing upward to telomere on chrosomal short arm and 5'-terminus of this base sequence : 89131
cctcaaacgatatctaaattgtacatattgggtacatatgtacgttgtttcagataattcataactttcatcagactttcaaaggtatcagtggatcacagaattcgaaataacccctagtttagggcaaagttactttttgtttaattattacatatatatattcatataaatatatatacatatatatataaatatgtatatatatttgcactttgtctattggggatctgcatcactgattcaatgtctgtcttctccactagatggcaagctccaggagggcagggtctacattactcgttattgtatactgaaacagtgcacataaaaagtatttttccctaatttccttcagaccatcagttctctttcttgggcttcagtgacttcatctataatgg

SEQ ID NO: 15568 - DNA, 337 bp, Homo sapiens
  AC006288.1_121452
  Located on chromosome 9
  Distance between a terminus base of telomere on chromosomal short arm and 5'-terminus of this base sequence : 112976666
  Distance between 3'-terminus of neighbour sequence of sequence listing upward to telomere on chrosomal short arm and 5'-terminus of this base sequence : 105099
attcaagacatactgcctacaaattattataaggaaattgatttttgtttctgcatagttcagtgtatttttgtccacagataaacagaaacatcatttcaaggtaaagagcagtttgtgtgtatgtgtgtgtgtgtgtgtgtgtgcatgtgtgtgagagcaagtgtatatgtgtgaatgtgtctgggtgcatgtgtgtatgtctgtgtgtacgtgtgtgtgtgtgtgtgtgtgtgtgtgtgtgtgtgtgatgatctgatggctcccaggaaagcaagggaaaaaaggagaaaacacaaatcagattcattcgctcattcactccatcaagaagtat

SEQ ID NO: 15569 - DNA, 309 bp, Homo sapiens
  AC006288.1_3254
  Located on chromosome 9
  Distance between a terminus base of telomere on chromosomal short arm and 5'-terminus of this base sequence : 113094817
  Distance between 3'-terminus of neighbour sequence of sequence listing upward to telomere on chrosomal short arm and 5'-terminus of this base sequence : 117814
tcaatctcttaaggaagtcaacacaaaataagcctagttgagagataaagagagattctgatgatattttggaggcaactgtactagccacatgagaaaatgtttaacttctggatgtttcaattagtcatcccctcgattttttgtgctttcacacacacacacacacacacacacacacacacacacacacgtaagaggcccagagggggaagtatcttgctgcagcaccacacactattaaaggagagctccaatagcctgcctctcatggccatgtttttcttctatgcctcatagattgcattc

SEQ ID NO: 15570 - DNA, 144 bp, Homo sapiens
  Z67421
  Located on chromosome 9
  Distance between a terminus base of telomere on chromosomal short arm and 5'-terminus of this base sequence : 113094920
  Distance between 3'-terminus of neighbour sequence of sequence listing upward to telomere on chrosomal short arm and 5'-terminus of this base sequence : -206
ttaacttctggatgtttcaattagtcatcccctcgattttttgtgctttcacacacacacacacacacacacacacacacacacacacacgtaagaggcccagagggggaagtatcttgctgcagcaccacacactattaaagg

SEQ ID NO: 15571 - DNA, 366 bp, Homo sapiens
  G09950
  Located on chromosome 9
  Distance between a terminus base of telomere on chromosomal short arm and 5'-terminus of this base sequence : 113311351
  Distance between 3'-terminus of neighbour sequence of sequence listing upward to telomere on chrosomal short arm and 5'-terminus of this base sequence : 216287
aatattgatttggaagtaaaagcgttatgttctacacacagcaaggaaggagggaaggaaggatgaagggagataaagagaaaggaagggaaggaaggtggtaaggaaggaaagaaggagaaaaggagggaaggagggagggatggaaggaagggaagggaagggagggaagaaggaaggaaggaagggagggaggaaggaaggaagtaaagaaggaaagaaagaaggaaggaaggaaggaaggaagtttgaaaaccactgatctagcccattctacagatagaaagcctgaaatccaagcactgaacaagagtggaccaaggccttacagaaagttaacatagctgagatttgaactcaattctc

SEQ ID NO: 15572 - DNA, 379 bp, Homo sapiens
  AL354931.6_61504
  Located on chromosome 9
  Distance between a terminus base of telomere on chromosomal short arm and 5'-terminus of this base sequence : 113323989
  Distance between 3'-terminus of neighbour sequence of sequence listing upward to telomere on chrosomal short arm and 5'-terminus of this base sequence : 12272
ttacaggcttctaaataatgacacacttacatttctaagatagataggtagatgacagagatagaaagatagatagatagataatagatagatagatgatggatggatagatagatagatagatagatagatagatagatagatagagagacagacagcagaaatggatggatggatggatggatggatggatggatggatggatggatggatggatagatggatggatggatggatggacatacagactatgaaagtttaatttcatttattccaaagtctacatgcgtattccaaagtctacacacacatacacacacaaaataagtttgctctttggtagtcattgtgatatgtaaattggtcatataatggaatg

SEQ ID NO: 15573 - DNA, 444 bp, Homo sapiens
  AL354931.6_175119
  Located on chromosome 9
  Distance between a terminus base of telomere on chromosomal short arm and 5'-terminus of this base sequence : 113367076
  Distance between 3'-terminus of neighbour sequence of sequence listing upward to telomere on chrosomal short arm and 5'-terminus of this base sequence : 42708
cctttcaaatcttgatacaactagcctcatccttttttgtgacccccctcctccaatgtcacaacatgctaccggactctaacctttaaagctcctcttgatgtaagagactaagcattattgattcttctatacaaggaaggaaggaaagaaggaaggaaggaaggaaggaaggaaggaaggaaggaaggaaggaaggaaggaaggaaggaaggcaggcaggcaggcaggcaggcaggcaggcaagccggcccaggacctgagatcctcagggataggttgttgattttttagtcctctcaggaactcaactggtctcttgcaggtgtttccaccatcctcaagaggattttccagggcacaagacatttttgtctcatttctctccttgcccagacaggaagatccaggaatccattcaaatatgacataattagctgtggc

SEQ ID NO: 15574 - DNA, 229 bp, Homo sapiens
  chr9.fa.O7frz.122763218
  Located on chromosome 9
  Distance between a terminus base of telomere on chromosomal short arm and 5'-terminus of this base sequence : 113448605
  Distance between 3'-terminus of neighbour sequence of sequence listing upward to telomere on chrosomal short arm and 5'-terminus of this base sequence : 81085
tgaaatgattaccacaatcaacctaattaacatatccatcacctcacatatttgtgtgtgtgtgtgtgtgtgtgtgtgtgtgtgtgtgtgtgtgtgtgttgagaacatttaagatctattctctattttcggataaagacaatgtgggtcaggcgtggtggctcatgcctgtaatcccagcactttgggaggccgaggcaggcggatcacctgacgtcaggagttcaag

SEQ ID NO: 15575 - DNA, 213 bp, Homo sapiens
  AC006952.6_24582
  Located on chromosome 9
  Distance between a terminus base of telomere on chromosomal short arm and 5'-terminus of this base sequence : 113568381
  Distance between 3'-terminus of neighbour sequence of sequence listing upward to telomere on chrosomal short arm and 5'-terminus of this base sequence : 119547
aatcacatacctacgacaaggtaggcaaagatttgaatttgtatttctcttcttcctcctgctttatctcgtcacagtcctctatgcctccctttctcccctccatacacatatgcaagcatgtaaacacacatgcatgtgtgcacatacacacacacacacacacacacacacacacacactcccacgctcctaagctttgactacacctta

SEQ ID NO: 15576 - DNA, 216 bp, Homo sapiens
  AC006952.6_34848
  Located on chromosome 9
  Distance between a terminus base of telomere on chromosomal short arm and 5'-terminus of this base sequence : 113578712
  Distance between 3'-terminus of neighbour sequence of sequence listing upward to telomere on chrosomal short arm and 5'-terminus of this base sequence : 10118
agtgaactgactcagtggaaacagaaactcagagctagagatgcccttgagtgaacccctccccatgaaacatacacacacatacacacacacacacacacacacacacacacatgcccatatatatacatacacacactgccccggaaatacagaaaccatgaggagggttttggactttctataaatcctgaaggatccaaattgatcttatct

SEQ ID NO: 15577 - DNA, 244 bp, Homo sapiens
  AC006952.6_61738
  Located on chromosome 9
  Distance between a terminus base of telomere on chromosomal short arm and 5'-terminus of this base sequence : 113605536
  Distance between 3'-terminus of neighbour sequence of sequence listing upward to telomere on chrosomal short arm and 5'-terminus of this base sequence : 26608
gagtgatcactcaggaaatgttagccaaataaataaacaaattattctcaaaagtcgtgagaccagaacactttccagaatacctcatgtctcagaattttaacgtcacatgtctcaaatcttttgcctttttccttcacattttaagtacacacacacacacacacacacacacacacacaaagaaatccaaagtaaagttgtatgaaatctcactctagttgaccttatcttgacagtgagt

SEQ ID NO: 15578 - DNA, 368 bp, Homo sapiens
  AC006952.6_86140
  Located on chromosome 9
  Distance between a terminus base of telomere on chromosomal short arm and 5'-terminus of this base sequence : 113629879
  Distance between 3'-terminus of neighbour sequence of sequence listing upward to telomere on chrosomal short arm and 5'-terminus of this base sequence : 24099
aacagtatggagattccttaagaactaaaactagaactactatttgatccagcaatcccactactgggtatctacccaaaggaaaagaagtcattatatgaaaaagacacatgcacacgcatatttatagcgtccaatttgcaattgcaaagatatggaaccaatctaagtgcccatcaaccagcgagtgaataaagaaaatgcgatgtatatatatatatatatatatatatatatatatatatatatatatatatatatataccatgaaatactactcagccataaaaaggaacgaaataatatctcttgcagcaacttagatggagctggaggccattattctaagtgaagtaactcaggaatgg

SEQ ID NO: 15579 - DNA, 406 bp, Homo sapiens
  G10045
  Located on chromosome 9
  Distance between a terminus base of telomere on chromosomal short arm and 5'-terminus of this base sequence : 113644847
  Distance between 3'-terminus of neighbour sequence of sequence listing upward to telomere on chrosomal short arm and 5'-terminus of this base sequence : 14600
tgcatgattttctgagatggtgaacaattcttgataaaattttgaacaaaacaaattacagtcttttctttttctacccagtagtttcattcctggaaagttaaatgaattttaaaactctgcagaaaatactttctttatatacattcactgatagatagactgattagatagatagatagatacaaataggtagatagacagacagacagatagatagatacaaacaggtaagtagatagatgacagattagatagatagatagatagatagatagatagatagatagatagatagatagacagatagacagatagacagatagataaagacagagaaagttctaagcatatataaatggatttttcacttacacacatgtccggtaagacatgtgaaagtgtc

SEQ ID NO: 15580 - DNA, 254 bp, Homo sapiens
  AC006952.6_116046
  Located on chromosome 9
  Distance between a terminus base of telomere on chromosomal short arm and 5'-terminus of this base sequence : 113659954
  Distance between 3'-terminus of neighbour sequence of sequence listing upward to telomere on chrosomal short arm and 5'-terminus of this base sequence : 14701
cagcaaccacctcataactattaggatggctactattaaaacacacacacacacacacacacagaaaaaaatagtgaatcagaacccttgcccacttttgatgggaatagaaaatggtgcagccactatggaaaacagtacagccattcctcaaaaaattaaacatagaattaaaatatgatccagcaattgcacttctaggtatatgcccaaaagaattgaaagcacagacctggacatgtaaatccacgtac

SEQ ID NO: 15581 - DNA, 387 bp, Homo sapiens
  chr9.fa.O7frz.123084812
  Located on chromosome 9
  Distance between a terminus base of telomere on chromosomal short arm and 5'-terminus of this base sequence : 113769915
  Distance between 3'-terminus of neighbour sequence of sequence listing upward to telomere on chrosomal short arm and 5'-terminus of this base sequence : 109707
gttcagcttactcagaacataaacatcatcatttttgttgtcctttacctaaaatttttccttagtcttttttttcatcccaaaagcaatatatgttcagtgtaaaaattcaaacaatctggaagcattgaatcccactactcatagttccgtgcataatcttgcagacatttctctataaacaggaataaacattgctttcatttcatacacacacgcacacacacacacacacacacacacacacatacaattacattgtacattacggtttatgctgaaacttactccttttttccacttaatctatcatggacaccctttcgtgccagcatattgatctgttgacctacaggctaaaaagtattccattaaacaagtgtacca

SEQ ID NO: 15582 - DNA, 333 bp, Homo sapiens
  AL353736.6_128419
  Located on chromosome 9
  Distance between a terminus base of telomere on chromosomal short arm and 5'-terminus of this base sequence : 113849952
  Distance between 3'-terminus of neighbour sequence of sequence listing upward to telomere on chrosomal short arm and 5'-terminus of this base sequence : 79650
ggtggagtaattctggaactatgtgtatatattacagaactgagtaaatcagcagatatggtgatgttgtcagagccagggttcttagtgttggagaagggaagtaaaaatgtggaagcgggaaaaacaggaaagaacccagtgagtctggactggaattaaaggcaccattgtgaagtaatgatttttttaaaaaataaattacacatttacacacacacacacacacacacacacacacacgcctgctaaagggcctagacacaatgataccctcgtagcaatgaacacacctagcaccaaatcttggtggttaaatatcattcctcacta

SEQ ID NO: 15583 - DNA, 479 bp, Homo sapiens
  chr9.fa.O7frz.123184045
  Located on chromosome 9
  Distance between a terminus base of telomere on chromosomal short arm and 5'-terminus of this base sequence : 113866745
  Distance between 3'-terminus of neighbour sequence of sequence listing upward to telomere on chrosomal short arm and 5'-terminus of this base sequence : 16460
tttcctgaacacagaataacatctctcacacaatgaaaaattcaaacaaaaaaaacaaacaaacaaaagacacctagttttcctgatatacaggtacaaattgaaggagctggggcagatgagagcatttctattatagccaaattgcacaaatttgcatttctagtaccgttaatataatggcagtctctctctctctctctctctctctctctctctggtctctactgatatctttagaaaactcttttctagaaattacagttttggtgcataatttaaaacaatcaaaagcaattttgctaatgatatatctaactctcttttgtatgcgcaaaagcagtaatttagtggtcagaaaataaacttaattctccattctgatgctataaagcagtgtgtacagttgatttctcaaatacaaaacacccatcagaaacaagaatatcaacagccttcactgaaccactattagaaac

SEQ ID NO: 15584 - DNA, 223 bp, Homo sapiens
  D9S1850
  Located on chromosome 9
  Distance between a terminus base of telomere on chromosomal short arm and 5'-terminus of this base sequence : 114102677
  Distance between 3'-terminus of neighbour sequence of sequence listing upward to telomere on chrosomal short arm and 5'-terminus of this base sequence : 235453
tccccattggttagcatttctcataaacaaatatcatcgtactcaaacttgtactatagaaataatcatctatttgtcctatctaggttttaaaagaacaagttttgcatctgacttatctctgaatgcatcatctcctctccgcaacacacacacacacacacacacacacacacacacacacacgcacgcacacacaacttctcttagggcttcagagatc

SEQ ID NO: 15585 - DNA, 452 bp, Homo sapiens
  chr9.fa.O7frz.123486657
  Located on chromosome 9
  Distance between a terminus base of telomere on chromosomal short arm and 5'-terminus of this base sequence : 114126173
  Distance between 3'-terminus of neighbour sequence of sequence listing upward to telomere on chrosomal short arm and 5'-terminus of this base sequence : 23273
gatctgacaaattgctaacagtagtaacctctagggactgactgaaactaggaggcagtgaaggagtgactttccctttttcctttgtggacttctggttgtttatatttttttgccagtaggggttacctttggggttgaaaaataacaacacaaaaatagtaaaagtaaaataacatgaattacacagatttatttatcagatactaaccaaagtaagtgatctttctacttaaatgctactgtatgcttaaaactccagagaatctaattcattctttttctattatattttactaaaacaaataaaaatcaccccaagtccctactagttttctcaaatgctttctatacatacatacatacacacacacacacacacacacacacacccacaggcctggtcataagcatagctaacacacacggtgcttattctacactaggaactg

SEQ ID NO: 15586 - DNA, 385 bp, Homo sapiens
  AL354981.6_12191
  Located on chromosome 9
  Distance between a terminus base of telomere on chromosomal short arm and 5'-terminus of this base sequence : 114288331
  Distance between 3'-terminus of neighbour sequence of sequence listing upward to telomere on chrosomal short arm and 5'-terminus of this base sequence : 161706
caagcacctgtaattccagctacttgggaggctgaggcaagagaatcgcttgaacctggcagatggaggctgcagtgagctaagatagtgccactgcactccagcctgggtgacagagcaagactctgtctaaataacaacaacaacaacaaaacaaaaacagtatccctaaaaacaatgtcatgatattcttgaggctgctaaggaccttaaaggaaaaaaaaccctggcccttcatccaatgtttggatttctttcagaacatcctccacaggttattgttcaaattttgcttgcattcatctaatgatggggaactcactgtggaagcagacaagaactctgacactcagaattgtcttgcttatgctgacctgtaatatgc

SEQ ID NO: 15587 - DNA, 371 bp, Homo sapiens
  chr9.fa.O7frz.119998959
  Located on chromosome 9
  Distance between a terminus base of telomere on chromosomal short arm and 5'-terminus of this base sequence : 114317430
  Distance between 3'-terminus of neighbour sequence of sequence listing upward to telomere on chrosomal short arm and 5'-terminus of this base sequence : 28714
caactaggtttcattgtcttgttacttgagcatatcctgtgaattttgtaaaaaatatctatctatctatctatctgtctatctatctatctatctatataccgatacatttatttatgctaggaatacatattggggttaaattatatacctgacagctttttctattatgtaatttacatatgtcatatgtgtgtctgtgcatgtgcacacatctagatttatatgtacaaaatattcatctatacatgtatctatacctacatatacccaaatgatactggtgattttctctgaatattgagatattcttcttatcttttttcctttttgtgagaaaataaatatagattgcttatggaattaaagct

SEQ ID NO: 15588 - DNA, 128 bp, Homo sapiens
  D9S1811
  Located on chromosome 9
  Distance between a terminus base of telomere on chromosomal short arm and 5'-terminus of this base sequence : 114670094
  Distance between 3'-terminus of neighbour sequence of sequence listing upward to telomere on chrosomal short arm and 5'-terminus of this base sequence : 352293
gtaggaggctgaaacacaaaaagcatgttaggtaaaaactaatacaatttgaatagtgtgtgtgtgtgtgtgtgtgtgtgtgtgtgtgtgtgtgttaatgagtaatagcatcttaacattatttcatg

SEQ ID NO: 15589 - DNA, 306 bp, Homo sapiens
  chr9.fa.O7frz.120400990
  Located on chromosome 9
  Distance between a terminus base of telomere on chromosomal short arm and 5'-terminus of this base sequence : 114770629
  Distance between 3'-terminus of neighbour sequence of sequence listing upward to telomere on chrosomal short arm and 5'-terminus of this base sequence : 100407
tacaaagcttgctcagtttaatctattcatgtgcaatagaatcagtccccaataaaactaagccccaggtatggcagccctttgttttaatcaaagttatacaaatttgttaccaaactttatttttgttcatcccagttttgatttgtcttgagtgtatttatttatttatttattgagacagagtcttgctctgtcacccaggctggagggcagtggcgtgatcttggctcactgcagtctccacctcccatgttcaagtcattctcctgcctcagcctcccgagtagctggaattacaggtgt

SEQ ID NO: 15590 - DNA, 415 bp, Homo sapiens
  AL161630.12_109007
  Located on chromosome 9
  Distance between a terminus base of telomere on chromosomal short arm and 5'-terminus of this base sequence : 114811908
  Distance between 3'-terminus of neighbour sequence of sequence listing upward to telomere on chrosomal short arm and 5'-terminus of this base sequence : 40973
aataaggactgtaatggcaaacacagacacaacatcatactctgtgaagaaaagttaaaaacttttcctctaagatctggaacaaggcaaaggtgcctgctttccccatttttattcaacatgtcaggggaagtccttacagatgatttaggaaagataaagaaataaagggcatccagactggaaagaaggaggtcaaattttccctgttttcagatgccatatctaatatgtagaaaatcctaaaagctatacacgcacacacacacacacacacacaccctcttagaactgataaacaaattcagtaaaattgcaggatttaaaataatcatacaaaatttagcagtgtttctgcacaccaacaatgaactagtggaaaaataaatcaagaaagcaatcctatttacatctg

SEQ ID NO: 15591 - DNA, 321 bp, Homo sapiens
  chr9.fa.O7frz.120527179
  Located on chromosome 9
  Distance between a terminus base of telomere on chromosomal short arm and 5'-terminus of this base sequence : 114896890
  Distance between 3'-terminus of neighbour sequence of sequence listing upward to telomere on chrosomal short arm and 5'-terminus of this base sequence : 84567
acagcatttgaactaatccttcaaggatacggaggatttttatgtgttgaggaaaaaggggaaaagcatgtatatatatgtgtgtgtgtgtgtgtgtgtgtgtgtgtatatgtatatatgtgtatacacacatatatatattttgcaagaactcaagatgacctttgggaaactcagcacatgaacaatgaaatagttgggtgatgttggaaggtaagtcactgtttgatgaaaggccagtgtgagggtatcaacatatgtcagttgcttctcactgaccaaacaccaatttcttttgacttaatttgcgtcaattatgac

SEQ ID NO: 15592 - DNA, 270 bp, Homo sapiens
  D9S1864
  Located on chromosome 9
  Distance between a terminus base of telomere on chromosomal short arm and 5'-terminus of this base sequence : 114935391
  Distance between 3'-terminus of neighbour sequence of sequence listing upward to telomere on chrosomal short arm and 5'-terminus of this base sequence : 38180
tggcagttcagtacacggaaataaagttctcactttcttttttctccttgagagtgttctttattttactcatctggccatctaatatttatgaagaagctactctgtggttgaaaaggcacatgaagctgcagaagtaaatgaccaagaagtgccctcaaagttacggagttcagattcattttggcaagagaggcatgtcaatacacacacacacacacacacacacacacacacacacacacacacaatgttatgccaaaatgcagg

SEQ ID NO: 15593 - DNA, 440 bp, Homo sapiens
  chr9.fa.O7frz.124659443
  Located on chromosome 9
  Distance between a terminus base of telomere on chromosomal short arm and 5'-terminus of this base sequence : 115015874
  Distance between 3'-terminus of neighbour sequence of sequence listing upward to telomere on chrosomal short arm and 5'-terminus of this base sequence : 80213
gtcaaggcgtattaaggaaaaaagcaaccccaaagttggaactaaggcaagaggaaggcaggctgtcattccagcatatatatatacatatatatatatacacacacacatatatatgtgtatatatatatatatatgtatatatatattttttcatgcgcgtccgtgtgaagagaccaccaaacaggctttgtgtgagcaacatggctgtttatttcacctgggtgcaggcgggctgagtccgaaaagagagtcagcgaagggagataagggtggggccgttttataggatttgggtaggtaaaggaaaattacagtcaaagggggtttgttctctggcgggcaggagtggggtcgcaaggtgctcagtgggggtgctttttgagccaagatgagccaggaaaaggactttcacaaggtaatgtcatcagttaaggcaa

SEQ ID NO: 15594 - DNA, 369 bp, Homo sapiens
  chr9.fa.O7frz.124542076
  Located on chromosome 9
  Distance between a terminus base of telomere on chromosomal short arm and 5'-terminus of this base sequence : 115133148
  Distance between 3'-terminus of neighbour sequence of sequence listing upward to telomere on chrosomal short arm and 5'-terminus of this base sequence : 116834
gcatgccagaataactgatgagtgaatgaatggatgaacaaaccatccaacatccacctgacctacagacctgagctccgtggagaaaggaatgtgtctatgtcatcgctgcgtttctggtgcctggcacagccctggagagaggtacacacagtaatgctcctgaacgagggagtgaagggacccagaactctggtgtgtgtgtgtgtgtgtgtgtgtgtgtgtgtgtgtgtgtacatgcacaaatgcagaagggtatgaacagtcagacgttaagggtcattgggttctgtttccataaagttgtttaggtttgtaatttttaaaaagtctgtgtgcttgtggggaccactcagttcaatagctatg

SEQ ID NO: 15595 - DNA, 339 bp, Homo sapiens
  AL353609.3_87837
  Located on chromosome 9
  Distance between a terminus base of telomere on chromosomal short arm and 5'-terminus of this base sequence : 115224037
  Distance between 3'-terminus of neighbour sequence of sequence listing upward to telomere on chrosomal short arm and 5'-terminus of this base sequence : 90520
agctcaggatgactctgaaggggcatcccagctccaggtgtagggtgggctgaggcttgcactgactgcatggaaactcagttcctcctcctgcccagtcctgctcccttctctttccttcccttcccttcccttcccttcccttcccttcccttcccttcccttcccttcccttcccttccctcttccccattcccccttcccccttcccttcccccttcacccttcccccttcccccttcacccttcccctttcccccttcccttcccttcccttccacaggtgttgagccagagagcagcccttgatggatctcctatgcatgaatacctctcaga

SEQ ID NO: 15596 - DNA, 269 bp, Homo sapiens
  D9S323
  Located on chromosome 9
  Distance between a terminus base of telomere on chromosomal short arm and 5'-terminus of this base sequence : 115487864
  Distance between 3'-terminus of neighbour sequence of sequence listing upward to telomere on chrosomal short arm and 5'-terminus of this base sequence : 263488
tcttgtcaatttcactcactgcatctgtcatagccattggtgtgcctgtgtgttgaatgtctactaccacccaagacagcaaagtccactagggcagggacagtgtgtctgtgtgtccatggctacagatgcagtgtggaacacatggaagccctaaataaatacctgttccatggatggatggatggatggatggatggatggatggatggatggacagacagacagatggacaaacgaatggatggatgagagtcagacagatgagt

SEQ ID NO: 15597 - DNA, 441 bp, Homo sapiens
  AC006558.1_174345
  Located on chromosome 9
  Distance between a terminus base of telomere on chromosomal short arm and 5'-terminus of this base sequence : 115594741
  Distance between 3'-terminus of neighbour sequence of sequence listing upward to telomere on chrosomal short arm and 5'-terminus of this base sequence : 106608
gcttagtcatagctaaactgtgagtcagggcatgaggtagactggacacatacataaaaagaatgaataagatcaggatatgcaaaacaatatggacaatttgatcgtacttatgtaaaagagaaaacacacaccaaagttatatctttatgtatgtacccttatatacgcaaaagcttgaaacagacctggtagcagtattaacggttgggtagaaaagagcagagaaaggagggcttgttttgtttgaggttataataataataataataataataataataataataatacatttctatattatttgaaatatttaaaaatttaattaaatttaaaaaatttaaagaaatggctgttgtgggctgaattgtgccactcagccacatcccaattgaattgaagtcctaacccccagtacctcagaatgtgactgtattt

SEQ ID NO: 15598 - DNA, 367 bp, Homo sapiens
  AC006430.22_139502
  Located on chromosome 9
  Distance between a terminus base of telomere on chromosomal short arm and 5'-terminus of this base sequence : 115787256
  Distance between 3'-terminus of neighbour sequence of sequence listing upward to telomere on chrosomal short arm and 5'-terminus of this base sequence : 192074
taaatggaattgctcaagtcacatttgattctgaaacagcagtcaaagaactgtcatactacagtttagaagatttaaacaacaagtacctttatattgctgtaacagtcatagagtctacaggtaagtgtgtgtgtgtgtgtgtgtgtgtgtgtgtatactttcttttgaaaaatatttagacagaatattaaagatataaataatttccaatttctataattatttcacattgtattttctttcatagttaaatataattataagaagtagacttttatatagttataaaaaggcagtagggctctgcttctttttagtcattggacaagccattgggtccctattacctccacttctactgcaa

SEQ ID NO: 15599 - DNA, 471 bp, Homo sapiens
  AC006430.22_123010
  Located on chromosome 9
  Distance between a terminus base of telomere on chromosomal short arm and 5'-terminus of this base sequence : 115803773
  Distance between 3'-terminus of neighbour sequence of sequence listing upward to telomere on chrosomal short arm and 5'-terminus of this base sequence : 16150
caggaatactaaacatttagcaatttaagaaaaaaatcattaaagatatttaatgctttgttttgccaatgctattagtggaaaaatcctaaggcctttatagtttgtttgtttgtttgtttgtttgtttgtgacagagtctctctctgttacccaggctggagtgcagtggtgcaatctcggctcactgcaacctctacctcccaggttcaagtgattcttgtgcctcagcctcctgagtagctgggactatagacacccgccaccatgcccagctaatttttgtgtttttagtagagacggggtttcaacatgttggccaggctgatctcgaattcctgacctcaggtgatctgcccacctcggcctcccaaagtgctgggattacaggcatgagccactgcaccctgcctataattctattttggaagcattaaacaaaatgttttatttacctttcagaaaatgctt

SEQ ID NO: 15600 - DNA, 412 bp, Homo sapiens
  AC006430.22_79604
  Located on chromosome 9
  Distance between a terminus base of telomere on chromosomal short arm and 5'-terminus of this base sequence : 115847218
  Distance between 3'-terminus of neighbour sequence of sequence listing upward to telomere on chrosomal short arm and 5'-terminus of this base sequence : 42974
tttctttattgtggcaaatattacatctatgacttctaatggggactgcttttatttatttatttatttatttatttatttatttatttatttttgaggcagagtcttgctcagttgcccagactagagtgcagtggtgcgatctcagctcactgcaacctctgcctcccagcctcaagccattctcgtgcctcagcctcttaagtagctgggattacaggtgtgagctaccacagccagctaatttttgtatttttagtagagaagtggtttcaccatgttggccaggctggtctcgaactcctggcttcagctgatctgactcagcctctcaaagtgctgggatgacaggtgtgagccaccgcacccagctgggactgcattatatatgctctatgaggtgtcattgagg

SEQ ID NO: 15601 - DNA, 305 bp, Homo sapiens
  AC006430.22_59163
  Located on chromosome 9
  Distance between a terminus base of telomere on chromosomal short arm and 5'-terminus of this base sequence : 115867594
  Distance between 3'-terminus of neighbour sequence of sequence listing upward to telomere on chrosomal short arm and 5'-terminus of this base sequence : 19964
ctaatagaaacattgcctgcaggggcaagcagagacccgagcctggtggtgagggccagggctaacatgtctaacagatgagttgggagcaatcagagggttttggtgttgttgttgttaggctggaggggtgtgtgtgtgtgtgtgtgtgtgtgtgttggtgttggaagggtggtcggtgggaggggggttgaaactgaatgagacaagagaaattggagttaaggaaaggattgtttggcttaataatatattttccaaataaagaacctttaggaaattagagccaggactagactgtaatt

SEQ ID NO: 15602 - DNA, 107 bp, Homo sapiens
  D9S1823
  Located on chromosome 9
  Distance between a terminus base of telomere on chromosomal short arm and 5'-terminus of this base sequence : 115874640
  Distance between 3'-terminus of neighbour sequence of sequence listing upward to telomere on chrosomal short arm and 5'-terminus of this base sequence : 6741
aactaccattgacattattatgtgcatgcatacacacacacacacacacacacacacacacacacacacactcatacccatataggagaatccaagatgaatccaac

SEQ ID NO: 15603 - DNA, 360 bp, Homo sapiens
  AC006430.22_1736
  Located on chromosome 9
  Distance between a terminus base of telomere on chromosomal short arm and 5'-terminus of this base sequence : 115924976
  Distance between 3'-terminus of neighbour sequence of sequence listing upward to telomere on chrosomal short arm and 5'-terminus of this base sequence : 50229
tatgtatacagatgcttgtccacttacgatggggcttctccaataccgtaagtggaagatgcatttaatatacctaacctaccaaatatcatagtatgatttctactgaatgcatatagcttttgcaccatcgtaaagccaaaaaatcataaggcataccatcatcattcagggaccatctgtgtgtgtgtgtgtgtgtgtgtctgtgtgtgtgtgtgtgtgtgtgtgtgtgtgtttgttcataaacagatgtatttaagaaattaatttgcatgattgtgggagctggcaagtccaaaatctatagggcaggccagcaggctggcgactcagcaggaattgatgcttgagtcttcagac

SEQ ID NO: 15604 - DNA, 323 bp, Homo sapiens
  AC006430.22_1704
  Located on chromosome 9
  Distance between a terminus base of telomere on chromosomal short arm and 5'-terminus of this base sequence : 115925013
  Distance between 3'-terminus of neighbour sequence of sequence listing upward to telomere on chrosomal short arm and 5'-terminus of this base sequence : -323
ctccaataccgtaagtggaagatgcatttaatatacctaacctaccaaatatcatagtatgatttctactgaatgcatatagcttttgcaccatcgtaaagccaaaaaatcataaggcataccatcatcattcagggaccatctgtgtgtgtgtgtgtgtgtgtgtctgtgtgtgtgtgtgtgtgtgtgtgtgtgtgtttgttcataaacagatgtatttaagaaattaatttgcatgattgtgggagctggcaagtccaaaatctatagggcaggccagcaggctggcgactcagcaggaattgatgcttgagtcttcagac

SEQ ID NO: 15605 - DNA, 359 bp, Homo sapiens
  chr9.fa.O7frz.124953055
  Located on chromosome 9
  Distance between a terminus base of telomere on chromosomal short arm and 5'-terminus of this base sequence : 116216527
  Distance between 3'-terminus of neighbour sequence of sequence listing upward to telomere on chrosomal short arm and 5'-terminus of this base sequence : 291191
gcaggttagatttcaggactaggattacttccaaaaaatacacaaatgtgaaaataaagttctccgggagttctctccttttccttcccagcactcaccatagtttacagttggagtgttacttgtttgtttacttgttatagcctgtcttgccagccagagtctgggtgccagaatataaagggtgtgttgttcttgctgaccacaatatcctagtgcctagttcagtgcctggcacagagtaggcattctggaactgttgaatgaatgaatgaatgaatgaatgaatgaatgaatgaaaaattagactgcccagatagtcaacaattaaaaaatggttaagtgaatgatagcaaacg

SEQ ID NO: 15606 - DNA, 304 bp, Homo sapiens
  AL353767.13_116557
  Located on chromosome 9
  Distance between a terminus base of telomere on chromosomal short arm and 5'-terminus of this base sequence : 116515507
  Distance between 3'-terminus of neighbour sequence of sequence listing upward to telomere on chrosomal short arm and 5'-terminus of this base sequence : 298621
cacgtttacctgtgtaacaaacctgcacatcctacacgtgtaaccaatatatgtatattattattcaagttccaataatcaaataatacacaaaccactgtattatttgattattggaaatcaaataataataataataataataataataataatatacatatattctgttggttctaattctctggagaaccccgactaatacaatgggtgattcattcaggactctcaatgcaaacaacagaacattctctagcctgtataagcaggaaggaatttattataggacattacatagctcatg

SEQ ID NO: 15607 - DNA, 443 bp, Homo sapiens
  AL162254.6_55171
  Located on chromosome 9
  Distance between a terminus base of telomere on chromosomal short arm and 5'-terminus of this base sequence : 116668859
  Distance between 3'-terminus of neighbour sequence of sequence listing upward to telomere on chrosomal short arm and 5'-terminus of this base sequence : 153048
gataggaattgcattgaatctatagattgctttgggcagcatggtaattttaacaatattgattcttccaatccatgatcatgggatgtttttccatttattcgtgtcatctaaaatttctttcttcagtgttttgtagtttttcttgtagacattttttacctccttggttacatataatcctaggtatcatcagagactactataaacaactatgaattcacaaatgagaaaaccttgaggaaatggataaattcttgaaatataaaatctccgaagattgtgccaggaacaagtagaaatgctaaataaaccaatactgagtagtgagattgaatcatacaatctcccaacaacaacaacaaaaagcccaggatcagtttaattcacagctgaatttcaccaaacatacaaagaactggtaccagtcttcctgaaactct

SEQ ID NO: 15608 - DNA, 372 bp, Homo sapiens
  AC006313.1_50404
  Located on chromosome 9
  Distance between a terminus base of telomere on chromosomal short arm and 5'-terminus of this base sequence : 116781791
  Distance between 3'-terminus of neighbour sequence of sequence listing upward to telomere on chrosomal short arm and 5'-terminus of this base sequence : 112489
ataatgcctacaaactaagttggatcactgtaatctcctgagtatccctattcatgcagctgggttttcttgtatagtaatgtaaagctgcttgaatgtctttgagctactctgtgtgtgtgtgcgtgcgtgtgtgcatgtgtgtgtgtgtgtgtgtgtgtgtgtcgcttcatcatattagcccaggggctcctcaataacgaggtctctctctttctcccattataaatgtcagaactgtgactccttcctctgcatttcctcaaagattaaagcctggcttctatagttgtcatagtctcaacaaataaaatcatcccactagataactcttagtgaatcagtgccaggtcaggttcctaagagtatggc

SEQ ID NO: 15609 - DNA, 312 bp, Homo sapiens
  AC006313.1_63558
  Located on chromosome 9
  Distance between a terminus base of telomere on chromosomal short arm and 5'-terminus of this base sequence : 116794910
  Distance between 3'-terminus of neighbour sequence of sequence listing upward to telomere on chrosomal short arm and 5'-terminus of this base sequence : 12747
ccgaatagcaacaatcaactacactgtgttgacatcagtgttgaacccatttatctacagtttaagaaacaaagacatgaaacggggcttacagaaattgataaacaagattaagtctcaaatgagtaggttctctacaaagaccaataaaatctgtggaccctgattacaaggtgtgtgtgtgtgtgtgtgtgtgtgtgttagcacctgatgccactcttttcttgaaaaaacgttccttcatcttcaccatttgtagcttcacctcgtggttttccaccctgtggtctctgtcatcgtatgattgaacaa

SEQ ID NO: 15610 - DNA, 261 bp, Homo sapiens
  Z67422
  Located on chromosome 9
  Distance between a terminus base of telomere on chromosomal short arm and 5'-terminus of this base sequence : 116794910
  Distance between 3'-terminus of neighbour sequence of sequence listing upward to telomere on chrosomal short arm and 5'-terminus of this base sequence : -312
ccgaatagcaacaatcaactacactgtgttgacatcagtgttgaacccatttatctacagtttaagaaacaaagacatgaaacggggcttacagaaattgataaacaagattaagtctcaaatgagtaggttctctacaaagaccaataaaatctgtggaccctgattacaaggtgtgtgtgtgtgtgtgtgtgtgtgtgttagcacctgatgccactcttttcttgaaaaaacgttccttcatcttcaccatttgtagct

SEQ ID NO: 15611 - DNA, 445 bp, Homo sapiens
  chr9.fa.O7frz.125634176
  Located on chromosome 9
  Distance between a terminus base of telomere on chromosomal short arm and 5'-terminus of this base sequence : 116891291
  Distance between 3'-terminus of neighbour sequence of sequence listing upward to telomere on chrosomal short arm and 5'-terminus of this base sequence : 96120
ctaacaatgtcaaagctgagagccaaatcaagagcacaatcccattcacaatcaccacacacacacacacacacacgcacacacacaaaatacctaggagcacagctgaccagggaggtgaaaaatctctacaatgagaattacaaaacactactgaaagaaatcagagatgacacaaacaaatggaaaaacattccatgttcatggatagaaaaaaaatcaatattgttaaaatggccatactgcccaaagcaatttatagactcaatgttacttctatcaaatggccaatgacatttttcacataattagaaaaaaactattctaaattcatatagaataaaaaagagcccgaatagacagagcaattctaaacaaaaagaacaattctggagacatcacactacctgacttcaaactatactacaagcctacagtaaccaaa

SEQ ID NO: 15612 - DNA, 324 bp, Homo sapiens
  AC007066.4_96752
  Located on chromosome 9
  Distance between a terminus base of telomere on chromosomal short arm and 5'-terminus of this base sequence : 117066816
  Distance between 3'-terminus of neighbour sequence of sequence listing upward to telomere on chrosomal short arm and 5'-terminus of this base sequence : 175080
aacaaagacatctattgtttagcagttagtagtggtggaaaggaatttatttttataaagaagggatggtgttccattgagttttgtttgatttgtcccaccctttccagggataggctgtgtgaaattcatgtgaaaaccagtgcagtgaaacaaagttcagagccaggaaaacacacacacacacacacacacacacacacacacacacacaaactgaaactaatgcaatgtgattttttatagcttctttgtaccctgcttgtttaattttaaagagctacaaacccacaggaattatcctgctacagcatctttcagact

SEQ ID NO: 15613 - DNA, 426 bp, Homo sapiens
  AL365338.4_12189
  Located on chromosome 9
  Distance between a terminus base of telomere on chromosomal short arm and 5'-terminus of this base sequence : 117196407
  Distance between 3'-terminus of neighbour sequence of sequence listing upward to telomere on chrosomal short arm and 5'-terminus of this base sequence : 129267
aacatttgttctggtcagaagttccctaaaacaaagctaataatacatgaagaaaactcagttttatcacttcaagtggcatttgtgattcgcacaatttttttaaaagtaaaaaggtataggatcttcttgtgttcatgttatcataacattgtattgtattgtattgtattgtattgtattgtattgtattgtattgtattgtattgtattgtattgtattgtattgtatttattttctgtggggctttttttgagacagggtctcactcttgttacccaggctggagtgcagtggtgcagtcacagctcactgtagcctcaacctccctggactcacttatttagggctcagtttctgcttttgtaaaataatattttacttctcattctggttatgtgtcagactgagctaactcagattac

SEQ ID NO: 15614 - DNA, 405 bp, Homo sapiens
  AC007172.6_107761
  Located on chromosome 9
  Distance between a terminus base of telomere on chromosomal short arm and 5'-terminus of this base sequence : 117222342
  Distance between 3'-terminus of neighbour sequence of sequence listing upward to telomere on chrosomal short arm and 5'-terminus of this base sequence : 25509
ctgatactaacaggcctgctagctcagccgacgctctggacactctagaaatcactcctcagtgtgacctcccaggcctcttccccgtgtacgtcaacacctcacccagcctaaaggctgagtttacatgatcagagttaggggatccttcagtctgttgattttttttctaaaccttttttttttaatatacatatatatatatatatatatatatatatatatatatatatatatatatagtgggggtggggcaagggatcagaaattcaaataattcttttctgcttcaatgccagcagaaggtcccccaggtagacatggagaagcactttgttttaaataggagggtttcatagttgcatctgaagccacctggttctgttaaactgtatggtgcaggtt

SEQ ID NO: 15615 - DNA, 372 bp, Homo sapiens
  AC007172.6_107408
  Located on chromosome 9
  Distance between a terminus base of telomere on chromosomal short arm and 5'-terminus of this base sequence : 117222691
  Distance between 3'-terminus of neighbour sequence of sequence listing upward to telomere on chrosomal short arm and 5'-terminus of this base sequence : -56
ggtttcatagttgcatctgaagccacctggttctgttaaactgtatggtgcaggttttgggtttggcattattcatgtttctgatcaattctatgcaactctcatagttcctgttactttttagcattagctgccaaatgacttcaaaaggctggggtgggtgacttgactgtgagactggattataacatggacaaatcttattttgcttaatgtgtttgtgtgtgtgtgtgtgtgtgtgtgtgtgtgtgtatgtatatatatatataaatatctttcccaatatgccccgttgacagtgtttaaattccagactaggactgctgatctgcacaatttaattatgtggttattcgagcacttaatttcact

SEQ ID NO: 15616 - DNA, 321 bp, Homo sapiens
  AC007172.6_89433
  Located on chromosome 9
  Distance between a terminus base of telomere on chromosomal short arm and 5'-terminus of this base sequence : 117240727
  Distance between 3'-terminus of neighbour sequence of sequence listing upward to telomere on chrosomal short arm and 5'-terminus of this base sequence : 17664
tcctaccagcactattaccaaccttgctgcttaggaaattccactgctttggccaaaagagtgccctgtcattaaaatcttcttagatgaactgttcctatcactgaattcttacatttaaacaggtatgtgtgtgtaatttacatacgtgttatatcctaagtttctacacacacacacacacacacacacacttagtgtaagtgaaatgtctgtcttgagtaaaaagcagttacaagggtattaaaacaaatgttgaaaaataactattttacatttagaccatacaatttttaaaggtaatgcgatgacatatgacct

SEQ ID NO: 15617 - DNA, 356 bp, Homo sapiens
  chr9.fa.O7frz.126170577
  Located on chromosome 9
  Distance between a terminus base of telomere on chromosomal short arm and 5'-terminus of this base sequence : 117429867
  Distance between 3'-terminus of neighbour sequence of sequence listing upward to telomere on chrosomal short arm and 5'-terminus of this base sequence : 188819
cacttactcaaagttaccagctagaactcaaacggactgtccctttaacctaaatgtgtttgatttccaactcagagctctttcaactatatcacacacacacacacacacacacacacacgcactcacatgcatgtaaattcattcacacatacacacaccagcaccagtcaacaaacgctcctttgagccctttgctttgtccagagtgcaaaagttcaagagaggcaaacagaagtggcacgatgctgagagagataaatgaggcttccaaagaataaataagtcagaacattgatttgaatattaccaagggatagaccagaaacatttaacggattataaagaggttagtg

SEQ ID NO: 15618 - DNA, 208 bp, Homo sapiens
  Z67556
  Located on chromosome 9
  Distance between a terminus base of telomere on chromosomal short arm and 5'-terminus of this base sequence : 117632959
  Distance between 3'-terminus of neighbour sequence of sequence listing upward to telomere on chrosomal short arm and 5'-terminus of this base sequence : 202736
cccaagtccaaaagtcactggaaaggttgggcaaggtagggttctattttgaggtgtgtgtgtgtgtgtgtgtgtgtgtgtgtgtatgtgtgtgtgtctgtgtgtgtgtccatgacacccagcatggggtgtctcagcctaaggtgggtgactaaggtatctgtttgggtcatggacccaacatgcttatcagaccttgaatggtgca

SEQ ID NO: 15619 - DNA, 438 bp, Homo sapiens
  AC010741.4_44568
  Located on chromosome 9
  Distance between a terminus base of telomere on chromosomal short arm and 5'-terminus of this base sequence : 117670845
  Distance between 3'-terminus of neighbour sequence of sequence listing upward to telomere on chrosomal short arm and 5'-terminus of this base sequence : 37678
ggatctggtaaagaaaacaaagctcaggagtcccccagccagctgcattctgaattttttcattaggaaagagagagagagcgagagagagcgagagagagcgagagcgagagagagagagagagagacagagagagagagagagagagagagagagaggccaaggtggtaaaaatctcaagggagctctgagccagggaaaagttcttcagacgtgactgcagaggaggagatgcccacctctgcttctcaggccagagctcgacccctccttacagagccaggcaggccacggactggagctgtcccccaacgggctccagactggcagggtcctcctcagagggaggaggtgggcgagggcagggttctgcccatcttcccagggccgtcaggacaggcaccgtgctgggcttatttaagcctcactacactcct

SEQ ID NO: 15620 - DNA, 467 bp, Homo sapiens
  chr9.fa.O7frz.126433038
  Located on chromosome 9
  Distance between a terminus base of telomere on chromosomal short arm and 5'-terminus of this base sequence : 117793111
  Distance between 3'-terminus of neighbour sequence of sequence listing upward to telomere on chrosomal short arm and 5'-terminus of this base sequence : 121828
tagatcctatttgagttctgacatcccatgctgagcctctaccaccatgctcccacataaacatccttctctccctcaggctccgacaccctgaggcaggctgctccctggctcagatgcctgccttgccctgccatcccttccacaagggtgcccattcaaggtctgatgagcatgatgggtccatggcccaaacagatatcccagttactcacaccttggtctcccacaccccatgcttagccatcacaatctctctgtctctgtctctgtctctctctcacacacacacacacacacacacacacacacacacacacacacacacacacaatagaagcctatcttgcttcccaaccttcccaatgacttttggatgagagaaggtttcagccctggggcaggaggtagattctatttctttaaataaaaaatctcttcctgttctaatctggtgactaaaacct

SEQ ID NO: 15621 - DNA, 464 bp, Homo sapiens
  AL158208.5_68386
  Located on chromosome 9
  Distance between a terminus base of telomere on chromosomal short arm and 5'-terminus of this base sequence : 117937503
  Distance between 3'-terminus of neighbour sequence of sequence listing upward to telomere on chrosomal short arm and 5'-terminus of this base sequence : 143925
tcagaagtgattcagatttcagatttttttggattttggaatattggcatatatatacatacatatacacacacacacacacacacacacacacacacacacacacacacacacatatatatatatatataaaatgagatcttggaatggcacccaagtctaaacacaaaattcatttacatttcgtacataccttacacacatagcctgaaggtaatttcatatatttttaataattttgcacatgaaacaaagtttgtgttaagtactcatgtgtggaatcgtccatttgtggcatcatgtcagcaccacaaggcttcagattctgcagcattttggagcattttggatttcaaatttttagattagggatgttcaacctgtaataacaaaactatttagactactaagtgtcttataagggactgattaaacgaattatgatgcatttatgtgataaacca

SEQ ID NO: 15622 - DNA, 412 bp, Homo sapiens
  AC006450.13_147738
  Located on chromosome 9
  Distance between a terminus base of telomere on chromosomal short arm and 5'-terminus of this base sequence : 118021622
  Distance between 3'-terminus of neighbour sequence of sequence listing upward to telomere on chrosomal short arm and 5'-terminus of this base sequence : 83655
ccaaagacaataaccacttcactattctacattattcaattgcttttttgccaagaacagtctttccaggctttttcacttgacaaactcaggcacttcctcttctctaggaagtattattgttcaacaaccctcccatctcccacctgacctgcgagcgcgcgcgcacacacacacacacacacacacacacacacactcactctctctctcacacacacacacacagacgcacgcacacagcctagactgggttaagtgccccacctttatgctcccaagcaccctgtacttcccactctccaggctctcaccatatccaaccctggtacaattacaattacctggggggcttttaaaaatcctgatgcccagtctatatcgcagaccaattaaatcagaatctccaggc

SEQ ID NO: 15623 - DNA, 232 bp, Homo sapiens
  AC006450.13_130561
  Located on chromosome 9
  Distance between a terminus base of telomere on chromosomal short arm and 5'-terminus of this base sequence : 118038818
  Distance between 3'-terminus of neighbour sequence of sequence listing upward to telomere on chrosomal short arm and 5'-terminus of this base sequence : 16784
ataaaggcgatgtcatgtaaagcaaaagaaaatatccaaatatcggccctcatgacctctcttctataataacaggttcatttgtcttccaccttcagtcattttacccttcagtcctggttatactcatgggtcacacacacacatacacacacacacacacacacacacacacacacatacacacacacgtagagacagagagagactaataaacaggcagagctaccta

SEQ ID NO: 15624 - DNA, 326 bp, Homo sapiens
  AC006450.13_100885
  Located on chromosome 9
  Distance between a terminus base of telomere on chromosomal short arm and 5'-terminus of this base sequence : 118068461
  Distance between 3'-terminus of neighbour sequence of sequence listing upward to telomere on chrosomal short arm and 5'-terminus of this base sequence : 29411
aaggaacagttgctatcaagatcttccctggaatgggagccagttcaaaagctctgagcaggagactataaataaaacaaagttattggtggagggcaaagctggctgcttttcaaaggaggttgtagccatcctggccacaaatatgtctgggtgcctgctgggtggggtgtgtgtgtgtgtgtgtgtgtgtgtgtgtgtgtgtgtgtgtgttggagagggaggtagaaggtggggattatgtgtctgctcaggtggcctcagagacagcagggtggtctgaggagagagcactggactgggagttaggaacgtggcttctaatt

SEQ ID NO: 15625 - DNA, 371 bp, Homo sapiens
  chr9.fa.O7frz.126953155
  Located on chromosome 9
  Distance between a terminus base of telomere on chromosomal short arm and 5'-terminus of this base sequence : 118260541
  Distance between 3'-terminus of neighbour sequence of sequence listing upward to telomere on chrosomal short arm and 5'-terminus of this base sequence : 191754
aagaatggactaatacagccacctaagccacacttccccttaagcatccaggcacaaccactggagagaagcgagacaagggagctatctggggagatcaggaactacaagaaggaccagtttagatgattggactggacaaatggaatccacacataggggaaagtgtcctattgttcccactggccaatggttgtggggctcaagaagacaaaataaagaaacaacatttatccacatttccaagttgtaatgtgaataacatttgtgatcttgcgagctacacacacacacacacacacacacacacaaacacatgcacatgtaaatagaaaacatctgaaaggatctatgatcaattgataacagtg

SEQ ID NO: 15626 - DNA, 374 bp, Homo sapiens
  AL158052.7_142332
  Located on chromosome 9
  Distance between a terminus base of telomere on chromosomal short arm and 5'-terminus of this base sequence : 118260541
  Distance between 3'-terminus of neighbour sequence of sequence listing upward to telomere on chrosomal short arm and 5'-terminus of this base sequence : -371
aagaatggactaatacagccacctaagccacacttccccttaagcatccaggcacaaccactggagagaagcgagacaagggagctatctggggagatcaggaactacaagaaggaccagtttagatgattggactggacaaatggaatccacacataggggaaagtgtcctattgttcccactggccaatggttgtggggctcaagaagacaaaataaagaaacaacatttatccacatttccaagttgtaatgtgaataacatttgtgatcttgcgagctacacacacacacacacacacacacacacaaacacatgcacatgtaaatagaaaacatctgaaaggatctatgatcaattgataacagtgatt

SEQ ID NO: 15627 - DNA, 406 bp, Homo sapiens
  AL445284.2_147715
  Located on chromosome 9
  Distance between a terminus base of telomere on chromosomal short arm and 5'-terminus of this base sequence : 118271941
  Distance between 3'-terminus of neighbour sequence of sequence listing upward to telomere on chrosomal short arm and 5'-terminus of this base sequence : 11026
tcctgaatcaatattaataccactaccaaaaaagccagaccttttaaaaatgaggggtctactcttagttcataattctgggattattagggggtgtgaaagccttttcagtgtgttagggaagaatggctataagagtgaagaaggccgtgcacctgctgctttcttccgagtgctccaagtgtctttttctttcttttcttttttccttccttccttccttccttctttccttccttccttccttcctttctttctttcttttcttttttctttgacactgagtctcactctgtcgcccaggctggagcacagtggggcgatcttggctcactgcaacctcttgacggagcttgcaatcctcctgcctcagcctccaggacagatggacagatagagtagctcg

SEQ ID NO: 15628 - DNA, 230 bp, Homo sapiens
  D9S1881
  Located on chromosome 9
  Distance between a terminus base of telomere on chromosomal short arm and 5'-terminus of this base sequence : 118353990
  Distance between 3'-terminus of neighbour sequence of sequence listing upward to telomere on chrosomal short arm and 5'-terminus of this base sequence : 81643
ggcccaacaccaatgtcacctcttctgggaagccttccctgaccacccaccacacacacacacacacacacacacacacacacacacacacacagagagagagagagagagagagagaggcaggacaagacagccacagaccttcatcatgaatagtggcattcactgtgacagtggcgttcatccagtgcttcatgtttatgaactgctctgcatggatgatctcattg

SEQ ID NO: 15629 - DNA, 444 bp, Homo sapiens
  chr9.fa.O7frz.127217987
  Located on chromosome 9
  Distance between a terminus base of telomere on chromosomal short arm and 5'-terminus of this base sequence : 118487155
  Distance between 3'-terminus of neighbour sequence of sequence listing upward to telomere on chrosomal short arm and 5'-terminus of this base sequence : 132935
gtctttcatgagcacaataaaggggccgggggtgggcagactgcagccctgctgcatgttaatgcgtttattatgatcaataagcccttgccttgagttttgtcctctggtttgggcatctgcgtgactgacagcagacacacacacacacacacacacacacacacaatttgcccaatggtgtggacagctacaagttcaaaataatttggaggttaaccattcttagggtctcaaagcacagcctttgggactagacaggcctgggaggggtactggctagcccttgggagccatgcggctgcgcaccccttacttgccccagctaaacaccgttcttcagctctaacggggacaacgggaccatctagttgctctgaggatgaagtgccttcatgcagacagactgtggagtgcggagcctcagtaagactgctttcttga

SEQ ID NO: 15630 - DNA, 199 bp, Homo sapiens
  HUMUT7968
  Located on chromosome 9
  Distance between a terminus base of telomere on chromosomal short arm and 5'-terminus of this base sequence : 118570977
  Distance between 3'-terminus of neighbour sequence of sequence listing upward to telomere on chrosomal short arm and 5'-terminus of this base sequence : 83378
agatcgcgccattgtactccagcccaggcaacactgcgagactccatctcaaaagaaagagagagagagagagagaaagaaagaaagaaagaaagaaagaaagaaagaaagaaagaaagaaagaaagaaagaaagaaagaaggaaagaaagaaattaggttccctttaaacactggtctttcacagaatgccctgagct

SEQ ID NO: 15631 - DNA, 112 bp, Homo sapiens
  D9S1840
  Located on chromosome 9
  Distance between a terminus base of telomere on chromosomal short arm and 5'-terminus of this base sequence : 118662030
  Distance between 3'-terminus of neighbour sequence of sequence listing upward to telomere on chrosomal short arm and 5'-terminus of this base sequence : 90854
accaatcagaaaccttgccaatacctacacattcatgcttgtaaaacacacacacacacacacacacacacacacacacacacagcaccctcctatgcgcttctgttcttaa

SEQ ID NO: 15632 - DNA, 187 bp, Homo sapiens
  Z67401
  Located on chromosome 9
  Distance between a terminus base of telomere on chromosomal short arm and 5'-terminus of this base sequence : 118842668
  Distance between 3'-terminus of neighbour sequence of sequence listing upward to telomere on chrosomal short arm and 5'-terminus of this base sequence : 180526
tccaaaacagacaagattatagggtgattatttatatctcaaaaggaaattatgagttatacattatatgtaattatacatacagtcaaatgtgtttatgtgtctgtgtgtatgtatgtgtgtgtgtgtgtgtgtgtgtgtgtgtgtttatgtatgtatatgtaaatcgtgatgtgtgacattgaaa

SEQ ID NO: 15633 - DNA, 450 bp, Homo sapiens
  AL158075.4_53385
  Located on chromosome 9
  Distance between a terminus base of telomere on chromosomal short arm and 5'-terminus of this base sequence : 118950126
  Distance between 3'-terminus of neighbour sequence of sequence listing upward to telomere on chrosomal short arm and 5'-terminus of this base sequence : 107271
ttatcacctattccagtgtcttatattttacccaaaccaattcatccattggcacctagctatactttacattttgtggcagtgggttgtttttattttattttattttattttattttattttattttattttatttatttcttgaaacagagtctcgctctgtcacccaggctggagtgcagtggcacgatctcggcttgctgcaacctccgtccccgggttcaagcgattctcctgcctcaacctcctgagtggctgggattacagacgtgcaccaccacacctagttaacttttgtatttttagtagatacagggtttcaccatgtttcccaggctggtcttgaactcctgacctcaagtgaactgcctgcctcggcctcccaaagtgctgggattagaagcatgagccaccgtgcccggccttctctgagttcttaaaccatact

SEQ ID NO: 15634 - DNA, 318 bp, Homo sapiens
  chr9.fa.O7frz.127779976
  Located on chromosome 9
  Distance between a terminus base of telomere on chromosomal short arm and 5'-terminus of this base sequence : 119037201
  Distance between 3'-terminus of neighbour sequence of sequence listing upward to telomere on chrosomal short arm and 5'-terminus of this base sequence : 86625
catagcgagactttgtctgtattaaaaaataaaaaaaataattagctgggcatggtggcatgtgcctgtagccctaactgaggtgggaggattgcttgagcctgggagaggctgcagtgagctgagattgcaccactgcactctagctcaggcaacagagcgagaccctgcccctccctccctctctccctcttttctcttctctctctctctctctctcagagttgatacttgtcctagtaaactacttactcccccaaaataagtagggtaacttgttggcataaataaaagatactttgaaatttaaatccacaa

SEQ ID NO: 15635 - DNA, 321 bp, Homo sapiens
  AC015880.4_98309
  Located on chromosome 9
  Distance between a terminus base of telomere on chromosomal short arm and 5'-terminus of this base sequence : 119195935
  Distance between 3'-terminus of neighbour sequence of sequence listing upward to telomere on chrosomal short arm and 5'-terminus of this base sequence : 158416
catattggaaggcttgagtagccaggaaatgcttcacaaagagaaagatttggataggcaaaagagaaagaagagattaagagattatcagagacagagataaataaaatatataagagaagcaacgacaattataagttaataacactttgtagcacaagtaggaaaacagcctgaattaaataaatgatgtattatgggaactagtagaaaataaggtataacaacaacaacaacaacaacaacaacaaaaggtacaacaggtaggctggagtcagtttatacagttcaagagcataaagtctttctggtctttctatg

SEQ ID NO: 15636 - DNA, 131 bp, Homo sapiens
  D9S1825
  Located on chromosome 9
  Distance between a terminus base of telomere on chromosomal short arm and 5'-terminus of this base sequence : 119288546
  Distance between 3'-terminus of neighbour sequence of sequence listing upward to telomere on chrosomal short arm and 5'-terminus of this base sequence : 92290
agctgcttccaaaacacacacacatattctctctctcatgcatgcgtgcgtacacgtacacacacacacacacacacacacacacacacacacacacattctctctctttgtccatcagaaacctatacag

SEQ ID NO: 15637 - DNA, 202 bp, Homo sapiens
  D9S1789
  Located on chromosome 9
  Distance between a terminus base of telomere on chromosomal short arm and 5'-terminus of this base sequence : 119288996
  Distance between 3'-terminus of neighbour sequence of sequence listing upward to telomere on chrosomal short arm and 5'-terminus of this base sequence : 319
ggtggctgtcttcacaacatggcaagtgccttccctctatgcagtgctgcctcataccatggagttagcctcccccaaagtgagttgggggtgtgtgtgtgtgtgtgtgtgtgtgtgtgtgagagagagagagaacacacatgcaaggcagaagtcagagagagagagacagaacacacatgcaaggcagaagccagttttt

SEQ ID NO: 15638 - DNA, 354 bp, Homo sapiens
  chr9.fa.O7frz.128319809
  Located on chromosome 9
  Distance between a terminus base of telomere on chromosomal short arm and 5'-terminus of this base sequence : 119592296
  Distance between 3'-terminus of neighbour sequence of sequence listing upward to telomere on chrosomal short arm and 5'-terminus of this base sequence : 303098
gaggtcaggagttccagaccggctgggcaacatggtgaaaccctgtctctactaaaaatatgaaaaaaagttagccaggcgtccgcgtgcctgtaattccagctactcaggagactgaggcaggagaatcgcttgaacctgggaggcagaggttgcagtgagccgagatcacgccactgcactccagcctgggcgataagagtgaaactctgtctcaaaataaataaataaataaataaataaataatcttaaaaaaaataaaaagaaaactagagaatgatgacttctgtttaccatgtgcctggtttcctgtcctgtctgtgatcctgttgctgtttgctgtcaactgttcc

SEQ ID NO: 15639 - DNA, 176 bp, Homo sapiens
  G10164
  Located on chromosome 9
  Distance between a terminus base of telomere on chromosomal short arm and 5'-terminus of this base sequence : 119716303
  Distance between 3'-terminus of neighbour sequence of sequence listing upward to telomere on chrosomal short arm and 5'-terminus of this base sequence : 123653
tcagcatgattacttattcttccataaggaggaataattttctgcagaatttactgctttttgacaaagatcacttaaacagttctattttccatttattcattcattcattcattcagtgtttattcttttaaggattatctgctacagcataaggaaatcacaaatttgtgtcc

SEQ ID NO: 15640 - DNA, 310 bp, Homo sapiens
  chr9.fa.O7frz.128706154
  Located on chromosome 9
  Distance between a terminus base of telomere on chromosomal short arm and 5'-terminus of this base sequence : 119922553
  Distance between 3'-terminus of neighbour sequence of sequence listing upward to telomere on chrosomal short arm and 5'-terminus of this base sequence : 206074
gacctagatgaggaaactaacagaggtggatggagaacaaacagtgcaagactatctagtatggtagtaggttatgtattacaggcaacatatactgagggagtttatttatttatttatttatttatttatttatttatgagacagagtctcactctgttgcccaggctggagtgtaatgaggcgatctcactgcaatcttctgagggagtttagaggagacaaagatcagagaagacaggcatcacagaaaagcttcggagaggtgggacccaatgtggctttgaagaatggtctgactgtccttaat

SEQ ID NO: 15641 - DNA, 392 bp, Homo sapiens
  chr9.fa.O7frz.129293341
  Located on chromosome 9
  Distance between a terminus base of telomere on chromosomal short arm and 5'-terminus of this base sequence : 120009319
  Distance between 3'-terminus of neighbour sequence of sequence listing upward to telomere on chrosomal short arm and 5'-terminus of this base sequence : 86456
ggataatgaggatttataaccattttgccatatgaaaacctgcctttagacagagtgaaataggctgttttggttattgaacgttcttaactgtaggggatgtgtgtgtgtgtgtgtgtgttagttttacagcaataagtgtttacattggggattgtgctggtttattctatatgttggcctgtgttaaatattaaaatattaaatgataccatttaggtttggcccatgtaaatgtttacatttctttgtacatgggatttctctgtattgaaatgtaactaaacagaaagtctttgttcttgtttataaaaataatgttaatagtgactgctaggtatccctggggccctgagtctttgcaactttgctcatgtaagttgtactggagg

SEQ ID NO: 15642 - DNA, 240 bp, Homo sapiens
  Z23697.1_114
  Located on chromosome 9
  Distance between a terminus base of telomere on chromosomal short arm and 5'-terminus of this base sequence : 120093716
  Distance between 3'-terminus of neighbour sequence of sequence listing upward to telomere on chrosomal short arm and 5'-terminus of this base sequence : 84005
caggcctccagtatgaggtcccgtcttggggggaggtgaccagggaaatcgtccctgcttgtggctttcctgcccatgcctcagttgcctgggccacctgagtatgggtgtctggtgggggtggtgtgtgtgtatgtatgtgtgtgtgtgtgtgtgtgtgtgtgtgtgtgtgtgtgtgtgtggcatgtgtcacagactgtgtgtatgtgtgggggggtgctatctgtgtccacggatcat

SEQ ID NO: 15643 - DNA, 216 bp, Homo sapiens
  D9S1829
  Located on chromosome 9
  Distance between a terminus base of telomere on chromosomal short arm and 5'-terminus of this base sequence : 120135985
  Distance between 3'-terminus of neighbour sequence of sequence listing upward to telomere on chrosomal short arm and 5'-terminus of this base sequence : 42029
gcgaacttcagaaaaacatcaatagggcaataccatttgtgtgtgtgtgtgtgtgtgtgtgtgtgtgtgtgtgtgtgtgtgttgttgttgtttctttgtgttcttgttttgttttgttttattttttggagatggggtcttgctgcattgcccaggcattgcggcctcgaacttctgggctcgactgttcctcctgccttagcctcctgagtagct

SEQ ID NO: 15644 - DNA, 389 bp, Homo sapiens
  AC007674.3_117441
  Located on chromosome 9
  Distance between a terminus base of telomere on chromosomal short arm and 5'-terminus of this base sequence : 120215160
  Distance between 3'-terminus of neighbour sequence of sequence listing upward to telomere on chrosomal short arm and 5'-terminus of this base sequence : 78959
ggtgatctcaatgcagtaaaggtgctgaggacttgggccagagaccagaattaagctggtgggaaaatgcaggctgaaggagcctgtgagagtgggcagaagaattggagggacatgtttgtgtttgtgtgtgtgtgtgcgtgcgtgtgtgtgtgtgtgtgtgtctgtgtagcaagaagatttggggcaggggtttaatgatcacctgagctctgggaggccctggactctgctggctctcagggctggggggatgccccttctccccggggagaagagtgtggcttttcaccactagtcctggaggtaagaaggcgactgaagaagggaacagtggagtcagatggtcttcattctccgccacagtggagtgcagtagcgtcacatct

SEQ ID NO: 15645 - DNA, 478 bp, Homo sapiens
  AC006443.1_185190
  Located on chromosome 9
  Distance between a terminus base of telomere on chromosomal short arm and 5'-terminus of this base sequence : 120448150
  Distance between 3'-terminus of neighbour sequence of sequence listing upward to telomere on chrosomal short arm and 5'-terminus of this base sequence : 232601
gaggccagaagtcttattctaatggaagtccctctatatggaaaagaaggcttctcccttcaataccataagacagggtaaggaagaaaaaaaagaataataataataataataataagaagaagaagaagaagaagaagaagaagaagaaggaaggagaaggcttctcccttaacatttaggaaaaccattgattttggtgtttatcttataactgaccaccttaccaaagtctctatgatttttagttgattttttttatttttactttttgggaaacacttaaatcataagcaaataatgacaattttatctcttcccttctaatatttatatttcttatttatttttcttatcttattgcattggctttattctatagccattatagcaggcatccttttgactgacttaaatgagaatacctttagtgtttcaccattaaatatgtttgttgatggcttctgataaactttgt

SEQ ID NO: 15646 - DNA, 353 bp, Homo sapiens
  AC006443.1_175849
  Located on chromosome 9
  Distance between a terminus base of telomere on chromosomal short arm and 5'-terminus of this base sequence : 120457547
  Distance between 3'-terminus of neighbour sequence of sequence listing upward to telomere on chrosomal short arm and 5'-terminus of this base sequence : 8919
ctccatggaagattacctttaggttcattccatccatccatccatccatccattcgttcatcaaatacctgatgaatacctgctctcttgtacttaaattttggactgtagaccagctgttttagtgtcagctgggagctgttacaaatgcatgttcttagaccagctcaggcctactgcatcagtatctcagggggtggggttcaggaatgtccgttttaacgacctcttctggtgatttttgcacatgctaaagttggataactcccactccagaatgtggactttccgtctcattactgtagcctcagtgcttagcccaagtggctccgtagtcatctgtggactcactg

SEQ ID NO: 15647 - DNA, 218 bp, Homo sapiens
  AC006443.1_99564
  Located on chromosome 9
  Distance between a terminus base of telomere on chromosomal short arm and 5'-terminus of this base sequence : 120533812
  Distance between 3'-terminus of neighbour sequence of sequence listing upward to telomere on chrosomal short arm and 5'-terminus of this base sequence : 75912
cacgtactttatgcatttaggaacttggggagtttggaattgtgatttccttcatcttccagtggcagcttttttttccccttgtccaatgcacagtgatttggttttgtgtgtgtgtgtgtgtgtgtgtgtgtgtgtgcacgcatgcacgcgcatgcatgcatgtgtgtatgtgttgcccatgaggaaaacccattctacagtcagcctggtaggtt

SEQ ID NO: 15648 - DNA, 241 bp, Homo sapiens
  D9S1798
  Located on chromosome 9
  Distance between a terminus base of telomere on chromosomal short arm and 5'-terminus of this base sequence : 120533894
  Distance between 3'-terminus of neighbour sequence of sequence listing upward to telomere on chrosomal short arm and 5'-terminus of this base sequence : -136
tgtccaatgcacagtgatttggttttgtgtgtgtgtgtgtgtgtgtgtgtgtgtgtgcacgcatgcacgcgcatgcatgcatgtgtgtatgtgttgcccatgaggaaaacccattctacagtcagcctggtaggttggagttgcattggtcgtggcaaatgggcttcctgaatggaaaatgaacaggtctgtgtttgcacttactttgtgccctgtgtcatctcagtaaagcaacatggca

SEQ ID NO: 15649 - DNA, 213 bp, Homo sapiens
  chr9.fa.O7frz.130439346
  Located on chromosome 9
  Distance between a terminus base of telomere on chromosomal short arm and 5'-terminus of this base sequence : 120786552
  Distance between 3'-terminus of neighbour sequence of sequence listing upward to telomere on chrosomal short arm and 5'-terminus of this base sequence : 252417
actagtaccactagctttgttcagcatttatgtgaagacgtggcagttatttgtattattgtattattatgtgtgtgtgtgtgtgtgtgtgtgtgtgtgtgtgcttgtgtctgtgtgttcattagggttggggaacagagctttgtttgctttttttgaattggctgacttccattctttttctgttttgttctaatgtggtatgatccatta

SEQ ID NO: 15650 - DNA, 237 bp, Homo sapiens
  DISD22_0006668
  Located on chromosome 9
  Distance between a terminus base of telomere on chromosomal short arm and 5'-terminus of this base sequence : 120867720
  Distance between 3'-terminus of neighbour sequence of sequence listing upward to telomere on chrosomal short arm and 5'-terminus of this base sequence : 80955
cctcagaccaagaaatgaggggcatggagattgagagcatagcctcttaaatcagacacctgggttgagccctgggcttacctcttacaatgaggattaaatgagtaaatacatgaaaaaatgtttagaactatgcctgactcatattgaggggttggtaagtattacctgttgttgttgttgttgttgttgttgttgttgttattaatattttcaactcttcttgactattctcga

SEQ ID NO: 15651 - DNA, 270 bp, Homo sapiens
  DISD22_0006678
  Located on chromosome 9
  Distance between a terminus base of telomere on chromosomal short arm and 5'-terminus of this base sequence : 121168576
  Distance between 3'-terminus of neighbour sequence of sequence listing upward to telomere on chrosomal short arm and 5'-terminus of this base sequence : 300619
caaccaccatacattatttgttatcattttaaagtaccaatagaatgaactacttattactttttattttttttaagagagagagagagagagagagacagggtctagctctgtcccaggctggagtgcagtggtgcaatcatagttcaattctccctcgttggcctaccaaagcactagaattacaggcgtgagccaccatgcccagccagaactacttattgttaatcaaacttatgaaataaagatttaatgcctatgtcctacaac

SEQ ID NO: 15652 - DNA, 227 bp, Homo sapiens
  D9S1819
  Located on chromosome 9
  Distance between a terminus base of telomere on chromosomal short arm and 5'-terminus of this base sequence : 121246467
  Distance between 3'-terminus of neighbour sequence of sequence listing upward to telomere on chrosomal short arm and 5'-terminus of this base sequence : 77621
ggcgactaagcgagactctgtcacaaaaaaaaagaaaaagaaagactgtagcagtggctatgggagttatgagccaggaactgtgggtgaaatacacacacacacacacacacacacaacgcgcacacacacacatatacacgtatatctcatatctcggtgaatatgaaagacacataatccctgcttgccatgcattaactacatggattccaggcacaccactg

SEQ ID NO: 15653 - DNA, 353 bp, Homo sapiens
  chr9.fa.O7frz.130916307
  Located on chromosome 9
  Distance between a terminus base of telomere on chromosomal short arm and 5'-terminus of this base sequence : 121373202
  Distance between 3'-terminus of neighbour sequence of sequence listing upward to telomere on chrosomal short arm and 5'-terminus of this base sequence : 126508
gaagttcacacctgtaatcctagcactttgggaggccaaggctcccaaaggaggattggttgagcccaggagttcaagaccaacctgggcaacatagggagaccctgtctctctctctctctctcacacacacacacacacacacacacacacacacaaattagcacggcatggtggcgcatgcctgtagtcccagctacttgggaggctgaggtgggaggatcacttgagcccaggaggtcgaggctgcaattagctatgatgatgccactgcactccagcctgggtgacagagcaagaccttgtctcaaaaaaaaaaagatattactccaaggttgcaggcattatactgg

SEQ ID NO: 15654 - DNA, 283 bp, Homo sapiens
  AC007430.18_94899
  Located on chromosome 9
  Distance between a terminus base of telomere on chromosomal short arm and 5'-terminus of this base sequence : 121501137
  Distance between 3'-terminus of neighbour sequence of sequence listing upward to telomere on chrosomal short arm and 5'-terminus of this base sequence : 127582
acatacttgtctgttaggcagatcctctcccattctacagatgaggaagctgaggctcagagagatgcagaaattcagaaagctcactcccctgacacccattgttctgtcttgttgttgttgttgttgttgttgttgttgttgttgttgttttgagactgggtctcactcccttgcccaggctggagtgcaatggcctaatcacggctcactgcagccttgacctcccgagctcaggttatcctcccacctcagcctcccgagtaactggaaccacagaacc

SEQ ID NO: 15655 - DNA, 457 bp, Homo sapiens
  AC007430.18_96075
  Located on chromosome 9
  Distance between a terminus base of telomere on chromosomal short arm and 5'-terminus of this base sequence : 121502328
  Distance between 3'-terminus of neighbour sequence of sequence listing upward to telomere on chrosomal short arm and 5'-terminus of this base sequence : 908
catgatcctgacaggtgactttgttccctcctgtagtgcccgtggaggcgggaagctgagcccggctcccaggaagcacagtgagggctcagccattgatgatgatgatgatgatgatgatgatgatgatgatgatggtgatgatgatgatgctgctgctgttgacgatgagtccaagccaagcctggggagaaaagaataaatagtctcataaatttaaaaaagcccaatgctcatcaagaagagaacagataaactgtgtattcacccaatggtgagtttaaagcagttaaaaatgcatgacacacagttgcatatgtcaacatgaatagatctcagacacttaacaatgagtgaaaagagcacattatgggaggacacagacaggatagtgcatttatataaagcttcaatgttgcaggctgaaagagtgagggtcgtgatcaactcagtatcc

SEQ ID NO: 15656 - DNA, 401 bp, Homo sapiens
  AL162586.7_116830
  Located on chromosome 9
  Distance between a terminus base of telomere on chromosomal short arm and 5'-terminus of this base sequence : 121686283
  Distance between 3'-terminus of neighbour sequence of sequence listing upward to telomere on chrosomal short arm and 5'-terminus of this base sequence : 183498
cataatggtcactcctgttaaccccaccacttcaggaggacgaggtgggaggatcacttgagctcacttgagcccaggaattctaacaccagcctgggaaacataacgagatcccgtctctaaaaataaaacacacacacacacacacacacacacacacacacagtcttcaaatgcgcccttctactttaagaaatttgtttcaaggaaacatgtgggcacaaatttgcataggaaagttttaaagtgccagcagggactcactgggatgatggcacagccacggtgggtgaggagttagcaactttcccatagggtctgagtgagaaaggaagtccaagttgtttgtggttaatgggacaagaggcttcagacacccatagcattggtaagaaataggc

SEQ ID NO: 15657 - DNA, 331 bp, Homo sapiens
  AL157935.6_74493
  Located on chromosome 9
  Distance between a terminus base of telomere on chromosomal short arm and 5'-terminus of this base sequence : 121709814
  Distance between 3'-terminus of neighbour sequence of sequence listing upward to telomere on chrosomal short arm and 5'-terminus of this base sequence : 23130
gtgttaatagtggttatttctggaatgatgggatctggggctgctttttttcttttggtttaactgtatttttccaaaaattttaagataatggtcacattattattattattattattattattattattattattttgagacagactttcactgtgttgcccaggctggagtgcaatggcgcgatctcggctcactgcaacctctgcctcctgggttcaagtgattctcctgcttcagcctcctgagtagctgggactacaggcgtgtgctaccacgctcggctaattttgtatttttagtagaaacgaggtttcaccatgttggtcag

SEQ ID NO: 15658 - DNA, 266 bp, Homo sapiens
  chr9.fa.O7frz.130189968
  Located on chromosome 9
  Distance between a terminus base of telomere on chromosomal short arm and 5'-terminus of this base sequence : 121943335
  Distance between 3'-terminus of neighbour sequence of sequence listing upward to telomere on chrosomal short arm and 5'-terminus of this base sequence : 233190
acagtaaagatgaaaaggatcataagggactactttgttgttgtttttgtggggtgtgtgtgtgtgtgtgtgtgtgtgtgtgtgtttttgagatggggtcttgctctgttgcccaggctggagtgtaatggcacaatcttggctcactgcaacctccacttcccgggttcaagtgattctcctgcctcagcctccctagtagctgggattacaggtctgagccaccacgctgggcccataagggactactttgactctttgccaag

SEQ ID NO: 15659 - DNA, 180 bp, Homo sapiens
  chr9.fa.O7frz.130059758
  Located on chromosome 9
  Distance between a terminus base of telomere on chromosomal short arm and 5'-terminus of this base sequence : 122062140
  Distance between 3'-terminus of neighbour sequence of sequence listing upward to telomere on chrosomal short arm and 5'-terminus of this base sequence : 118539
tctgtcagctttgcgtatctgtgcttatctccggggttctgaatgcttctgtgtgctcgcgtgtctcctagcgtgtgtgtgtgtgtgtgtgtttgtgtgtggtggggggctttgtgccttcgtgtatttctaggcgcctttgtgtggctaggtcggggagagtggacagtcaatgtggag

SEQ ID NO: 15660 - DNA, 172 bp, Homo sapiens
  D9S1821
  Located on chromosome 9
  Distance between a terminus base of telomere on chromosomal short arm and 5'-terminus of this base sequence : 122106820
  Distance between 3'-terminus of neighbour sequence of sequence listing upward to telomere on chrosomal short arm and 5'-terminus of this base sequence : 44500
caccaggaaactgacttgatacaagccacagggtttattcagattcccctgttttacttgtactcgttcgtgtgtgtgtgtgtgtgtgtgtgtgtgtgagagagagagagagagagagagagactgagagttctgtgtgtctcatgtgtaggttcgtgtatccatcacagtt

SEQ ID NO: 15661 - DNA, 362 bp, Homo sapiens
  chr9.fa.O7frz.131379591
  Located on chromosome 9
  Distance between a terminus base of telomere on chromosomal short arm and 5'-terminus of this base sequence : 122281735
  Distance between 3'-terminus of neighbour sequence of sequence listing upward to telomere on chrosomal short arm and 5'-terminus of this base sequence : 174743
tttgatcattgtctaagctgagtgggcattcattctattttttaatatgtcttaagtttttttaataatgaaaaactttgatttttaaaaattattattattattattattattattattattattatattttttgagacagtctcgctctgtcacccaggctagagtacagtggtatgatctcagctcactgcaacctccctcactgggttcaagcaattctacagcctcagcctccctagtagctgggattattacaggcatgcgctatcaccccaggctaatttttgtatttttagtagagacgaggtttcatcatgttggccaggctggtctcacactcctcacctcatgtgatctgc

SEQ ID NO: 15662 - DNA, 411 bp, Homo sapiens
  AC006312.8_206606
  Located on chromosome 9
  Distance between a terminus base of telomere on chromosomal short arm and 5'-terminus of this base sequence : 122415119
  Distance between 3'-terminus of neighbour sequence of sequence listing upward to telomere on chrosomal short arm and 5'-terminus of this base sequence : 133022
atactgatttacacttccatcaacaatatatgagagagctcatttcccaacacttgtgtcatgctgatcatttaaaaagcctctgtttgtttgtttgtttgtttgtttgtttgtttgtgacagagtttcgctcttgttgcccaggctggagtgcaatggcacaatctcggctcactgcaatctccacctcctgagttcaagtgattcccctgcctcagcctcccaagtagctgggattacaggcatgtgccaccatgcccatctaattttgtatttttagtagagacgggatttctccatgttggtcaggctggtctcgaactcctgacctcaggtgatccgcccacttcggcctcccaaagtgctgggattacaggcatgagccactgcgcctggctaaaagcctcattt

SEQ ID NO: 15663 - DNA, 251 bp, Homo sapiens
  AC006312.8_205234
  Located on chromosome 9
  Distance between a terminus base of telomere on chromosomal short arm and 5'-terminus of this base sequence : 122416452
  Distance between 3'-terminus of neighbour sequence of sequence listing upward to telomere on chrosomal short arm and 5'-terminus of this base sequence : 922
cgatatcgagctggcttacatgaacaccaaccatgaggacttcataggctttgccaagtgagtgctcccccaggcaaaaagtgagtgctccctgggcagagaaggtaacgtgtgtgtgtgtgtgtgtgtgtgtgtgtgtgtgtgtgtgtgtgtgtgtgtagagcccaggtctgctaggttaaccctctgggtcctgtgcccactaagcagtgggcagtagagctgggcctcttgagaagttctgagactcc

SEQ ID NO: 15664 - DNA, 201 bp, Homo sapiens
  D9S1827
  Located on chromosome 9
  Distance between a terminus base of telomere on chromosomal short arm and 5'-terminus of this base sequence : 122416463
  Distance between 3'-terminus of neighbour sequence of sequence listing upward to telomere on chrosomal short arm and 5'-terminus of this base sequence : -240
tggcttacatgaacaccaaccatgaggacttcataggctttgccaagtgagtgctcccccaggcaaaaagtgagtgctccctgggcagagaaggtaacgtgtgtgtgtgtgtgtgtgtgtgtgtgtgtgtgtgtgtgtgtgtgtgtgtagagcccaggtctgctaggttaaccctctgggtcctgtgcccactaagcagtg

SEQ ID NO: 15665 - DNA, 402 bp, Homo sapiens
  AC006312.8_180407
  Located on chromosome 9
  Distance between a terminus base of telomere on chromosomal short arm and 5'-terminus of this base sequence : 122441347
  Distance between 3'-terminus of neighbour sequence of sequence listing upward to telomere on chrosomal short arm and 5'-terminus of this base sequence : 24683
gctcctgagtacctaggattacaggcatgcgccatcatgcctggctaatttttgttattatttatttatttatttatttatttatttattttcagacagagtctccctctgtcacccaggctggagggcagtggcacgatctcagctcaccgcaacttccgcccccgggttcaagcaattctcctgcctcagcctcccaagtagctgcaattacaggggcacgccaccacacctggctaattttttgcatttttagtagacacagggttttgctatgttggtcaggctggtctcgaactcctgacctcagttgacccacctgcctcggcctcccaaagtgctgggattacaggcatgagccaccacacctggccaagatcgaatttacagctggctaacaga

SEQ ID NO: 15666 - DNA, 194 bp, Homo sapiens
  G09266
  Located on chromosome 9
  Distance between a terminus base of telomere on chromosomal short arm and 5'-terminus of this base sequence : 122462179
  Distance between 3'-terminus of neighbour sequence of sequence listing upward to telomere on chrosomal short arm and 5'-terminus of this base sequence : 20430
gggagagagagaggagaggaaagaaaaaggaaggaaggaaagaaaggaagggaaagaaggaaaggggggaaggaaagggaaggaaggaagggaaaggaaggaaggaaggaaaggaaggaaggaagaaagaaaggaaggactatgcttctggattcaggacatagcagcagcctctcaggtagggagatgctcag

SEQ ID NO: 15667 - DNA, 386 bp, Homo sapiens
  AC006312.8_27985
  Located on chromosome 9
  Distance between a terminus base of telomere on chromosomal short arm and 5'-terminus of this base sequence : 122593560
  Distance between 3'-terminus of neighbour sequence of sequence listing upward to telomere on chrosomal short arm and 5'-terminus of this base sequence : 131187
tagaagcaagacagaatcagttaggtctgatttgttccgctgtcataatttcctgagttacaaatttgcaaaggcggtttcacaggggccgttctgttgaggaggggtgtgcctcctgaggctggctgagggcagaggtggaaggtttggaggctagaaatgagagttcccaggtaatggcttctattttctccaaaaagtagtagagagatctttgctgggggagaggggcggtggaatgggggcttgagaagactggaggctttgttttgttttgttttgttttgttttgttgagacagaatctcactctgtcacccaggctgtagtgcagtggcgtgatctcaggtcactgcaactcccacctcctaggttcaagtgattctt

SEQ ID NO: 15668 - DNA, 292 bp, Homo sapiens
  chr9.fa.O7frz.131798729
  Located on chromosome 9
  Distance between a terminus base of telomere on chromosomal short arm and 5'-terminus of this base sequence : 122827336
  Distance between 3'-terminus of neighbour sequence of sequence listing upward to telomere on chrosomal short arm and 5'-terminus of this base sequence : 233390
agtatcctaacaatcgcacttcacagaagagagactgcgttactagtccagggccaagccactgataaaaaggatctgcaccctcaaactcagatcgaaaattaaggtccaggacactgtccctctaaacagatagggacgtggcaagaaaagtcaagtcaggccaaagaccatatatatatatatatatatatgccaccacgcccggctaattttgtatttttagtagagacagggtttctccatgtcggtcaggctggtcttcaactcccagtcgacctcagttgatctg

SEQ ID NO: 15669 - DNA, 162 bp, Homo sapiens
  DISD22_0006681
  Located on chromosome 9
  Distance between a terminus base of telomere on chromosomal short arm and 5'-terminus of this base sequence : 122959563
  Distance between 3'-terminus of neighbour sequence of sequence listing upward to telomere on chrosomal short arm and 5'-terminus of this base sequence : 131935
tcactgtggacagagaagtaggaatgagagagagagagagagagagagtgtgtgtgtgtgtgtgtgtgtgtgtgtgtgtgtgtgtgtgtgtatgtgtatacatacactaatatattaatcattctttatgatcgttacaaaagttcattcctgacgagacac

SEQ ID NO: 15670 - DNA, 440 bp, Homo sapiens
  AL161785.5_987
  Located on chromosome 9
  Distance between a terminus base of telomere on chromosomal short arm and 5'-terminus of this base sequence : 123204937
  Distance between 3'-terminus of neighbour sequence of sequence listing upward to telomere on chrosomal short arm and 5'-terminus of this base sequence : 245212
tggaaagctctattaaattacaatctgtaaaaagagaggaacccccctcctccttcctgagaaaatccctggttttccctccagcagaactctgtgtagggtgatcgacactttccatcccactacctccacatccatccacccatctgtcatccatccatccacccaaatatccacccatccatcaatccactaatacttccttcttttcacccatccgtccattccttcccacacacctattcatccatccactcacctatccatccttccatacaatctctcacccattcatccatatatccactcacacatctatccatccatccatccatccatccatccatccatccatccatccatcctcccatccatccacctacccacccatccattcattcattcatccatctgtcctctcatttatcctctaatccttc

SEQ ID NO: 15671 - DNA, 306 bp, Homo sapiens
  AL161785.5_182477
  Located on chromosome 9
  Distance between a terminus base of telomere on chromosomal short arm and 5'-terminus of this base sequence : 123272721
  Distance between 3'-terminus of neighbour sequence of sequence listing upward to telomere on chrosomal short arm and 5'-terminus of this base sequence : 67344
tttctcagtttcttgaaactacaggattgtatcttttgccaaatttaggaagttttcattcattatttcttctaatccttttttagtcacattctcactctcctttccttctggaaatctattggcacaaaagttattttctctttctttctttccttccttccttccttccttccttccttccttccttccttccctccctccctccctccttccctccctcccttccttcctttcttcttcccctccctccctccctctctctctctctttctttctttctttctgacagagtctcactccatc

SEQ ID NO: 15672 - DNA, 104 bp, Homo sapiens
  DISO7_10002788
  Located on chromosome 9
  Distance between a terminus base of telomere on chromosomal short arm and 5'-terminus of this base sequence : 123406986
  Distance between 3'-terminus of neighbour sequence of sequence listing upward to telomere on chrosomal short arm and 5'-terminus of this base sequence : 133959
gtatgcttgcttgcatgcctgcatccatgcacatgtacacacacacacacacacacacacacacacacacacacgtgcgcaagcgcgcacgcacctgtatcctt

SEQ ID NO: 15673 - DNA, 294 bp, Homo sapiens
  DISO7_10002789
  Located on chromosome 9
  Distance between a terminus base of telomere on chromosomal short arm and 5'-terminus of this base sequence : 123431357
  Distance between 3'-terminus of neighbour sequence of sequence listing upward to telomere on chrosomal short arm and 5'-terminus of this base sequence : 24267
tttccttcttacgacaattacgttaatcttccctacttactggggtaataatgaagattaaatgaaataatatctgtaaagcacaaaatacttagcattcgtagcttagtttatattccacaaatatgtatggaatatcttctatgtgcagtgctctgtgctatgcactgggaataatagatgtggtttttgtccttctggggcttacccagtagtaggggttacagacgttaagaaaatacaccatatatatatatatatatataataattccacttatgacagatgctatga

SEQ ID NO: 15674 - DNA, 295 bp, Homo sapiens
  DISD22_0006699
  Located on chromosome 9
  Distance between a terminus base of telomere on chromosomal short arm and 5'-terminus of this base sequence : 123671893
  Distance between 3'-terminus of neighbour sequence of sequence listing upward to telomere on chrosomal short arm and 5'-terminus of this base sequence : 240242
ggctactccctcactgtccccagcctcctatgctgggcaagcacatcacacacacacacacacacacacacacacacacacacacacacacacatttccctgtgctacaaacaacaaattcatccttttttatttttttgtagagacaggggtctcactatgttgcccaggctggtctcaaactcctggcctcaagccatcctactgccttggcctcccagagtgctgggattgcaggcatgagccaatgtgcccggcctacaaacgtgcttttcatagactggcatttcatgtc

SEQ ID NO: 15675 - DNA, 352 bp, Homo sapiens
  AL353803.2_71829
  Located on chromosome 9
  Distance between a terminus base of telomere on chromosomal short arm and 5'-terminus of this base sequence : 123774872
  Distance between 3'-terminus of neighbour sequence of sequence listing upward to telomere on chrosomal short arm and 5'-terminus of this base sequence : 102684
atagacagatggttgaatggatggatggtggatgaatgatggatgggtgggtggtgtgagtggatgcatgtctggatggatgggtgcatagataggtgaatggatgggtggatatgtggatggatgagtggatggatggatggatggatagatgggtgagtggagggtggatgactatatgggtgggtggtgagtggatgaatgtgtggatgggtaggtatatgaatggatggatggatggatgagtagatgggtggatggatggatggatgggtgagtggatggatgggtggatgaatggatgagtagatggatggatggatgagtgggagggtatatggatggacggatg

SEQ ID NO: 15676 - DNA, 172 bp, Homo sapiens
  Z67329
  Located on chromosome 9
  Distance between a terminus base of telomere on chromosomal short arm and 5'-terminus of this base sequence : 123803817
  Distance between 3'-terminus of neighbour sequence of sequence listing upward to telomere on chrosomal short arm and 5'-terminus of this base sequence : 28593
cgtcaggatgtactgcatgaacttttacaatgcttcctttaaaaaaaatggttttgtgtttttttgtctgtgtgtgtgtgtgtgtgtgtgtgtgtgtgtgtgtgtgtgtttgccctgtataggtatgactattctaacaaaagaagggaggacattttcaaaagacagaggg

SEQ ID NO: 15677 - DNA, 136 bp, Homo sapiens
  D9S1795
  Located on chromosome 9
  Distance between a terminus base of telomere on chromosomal short arm and 5'-terminus of this base sequence : 123862147
  Distance between 3'-terminus of neighbour sequence of sequence listing upward to telomere on chrosomal short arm and 5'-terminus of this base sequence : 58158
cctgggcgacaaagtgagactcagcctcaaaacacacacacacacacacacacacacacaaaaacaagagaaaccctaaataaatcaatggccattaaagaaaagaaatcagcattttaaaaaatcacgctttggc

SEQ ID NO: 15678 - DNA, 401 bp, Homo sapiens
  AC007779.3_93493
  Located on chromosome 9
  Distance between a terminus base of telomere on chromosomal short arm and 5'-terminus of this base sequence : 123869381
  Distance between 3'-terminus of neighbour sequence of sequence listing upward to telomere on chrosomal short arm and 5'-terminus of this base sequence : 7098
gttacagtgagctgagatcaagccactgcattccagcctggacgacagagcaagactgtgtttcaaacaaacaaacaaacagaacaccacagccccagtgatgcctcccatgcaccttactaatctatgcagcacttatttattgaagacctactatgctccaagtgcattctaagccctagggctgcagctaggaactctagacaaggacctcacaggagacaaaggggtcatgacaggtgctctggggctgggaaggaactggggagaggcatgaaaaggaatgacaggtgggcttcacccagggctgaggtgtggggtgtctctgaggacttcacaggggcactggcacctacctggcctgcccccagcctccccacttccagaacttaccttaggag

SEQ ID NO: 15679 - DNA, 299 bp, Homo sapiens
  D9S159
  Located on chromosome 9
  Distance between a terminus base of telomere on chromosomal short arm and 5'-terminus of this base sequence : 123925349
  Distance between 3'-terminus of neighbour sequence of sequence listing upward to telomere on chrosomal short arm and 5'-terminus of this base sequence : 55567
agctggaatgagtgctgggcagccccacacggctgggagccagggtgtgtggtgtgtggtgtggtgtgtgtgtgtgtgtgtgtgtgtgtgtgtgtgtgtgtgtctatcttggctaggcgaacaccagcccttccctctgcctgctcaacagccctcccatgtctgtttcctcccctggtccatgctgagaattgcatcaccagccttcctgtgggaccggaaaggcagtagcagtcacttgcctttccctgtgtgcctctgtgttctgaccacgcccccacctggctgccgtcagaaag

SEQ ID NO: 15680 - DNA, 456 bp, Homo sapiens
  AC007779.3_48583
  Located on chromosome 9
  Distance between a terminus base of telomere on chromosomal short arm and 5'-terminus of this base sequence : 124041490
  Distance between 3'-terminus of neighbour sequence of sequence listing upward to telomere on chrosomal short arm and 5'-terminus of this base sequence : 115842
tctcgatggagtcaatgagctgggccagttctccagtatcccgccctgcccatgcagggtcaccatgcccctaaagtgccagccatggggctccacacatgagtagtctgcacggggacaacctactttctttttctttctttctttctttctttctttctttctttatctatctattctatttttttgagacggagtgttgctctgtcgcacaggctagagtgcagcagcacgatctcagctcactgcaacctccgcctccaggggttcaagcaattctcctgcctcagcctcccaagtagctgggattacaggcgtccgctgctacgcccagctaattttttgtatttttagtagagatggggtttcgccatgttggccaggctggtcttgaactcctgacctcaggtgatccacccacctcagcctccaaaagtactaggattacaggcgtga

SEQ ID NO: 15681 - DNA, 245 bp, Homo sapiens
  AC007936.2_31251
  Located on chromosome 9
  Distance between a terminus base of telomere on chromosomal short arm and 5'-terminus of this base sequence : 124083678
  Distance between 3'-terminus of neighbour sequence of sequence listing upward to telomere on chrosomal short arm and 5'-terminus of this base sequence : 41732
gtgtcaaggaaatgcagatagatagagagatagagagataaatagatagatagatagatagatagatagatagatagatagatagatagatttactatgccatataattggctcatgtgattacggcagctgagaagtaccattaactgctgtccgcccgctggagacccaggagagctggtggggcagttcagagtccagaggcctgagaaccaggaagccaatggtataaatttcagtgcaag

SEQ ID NO: 15682 - DNA, 153 bp, Homo sapiens
  chr9.fa.O7frz.133103152
  Located on chromosome 9
  Distance between a terminus base of telomere on chromosomal short arm and 5'-terminus of this base sequence : 124232440
  Distance between 3'-terminus of neighbour sequence of sequence listing upward to telomere on chrosomal short arm and 5'-terminus of this base sequence : 148517
gtccattaccaaatactaagtcatgttgaaaaaattatgtatatacatacatatgtctatatatatatatatatatatatatatatatatatatctcaccataaaatactatcctaggttatcaatagtgtgcttatagtgctgatcttactc

SEQ ID NO: 15683 - DNA, 291 bp, Homo sapiens
  DISO7_10002791
  Located on chromosome 9
  Distance between a terminus base of telomere on chromosomal short arm and 5'-terminus of this base sequence : 124328771
  Distance between 3'-terminus of neighbour sequence of sequence listing upward to telomere on chrosomal short arm and 5'-terminus of this base sequence : 96178
cagagatggaaggaaggtggaaaagcaagagacagttaggtgggcgtggtggcaggcacctgtagtcccagctactcgggaggctgaggcgggagaacagcgtgaacccaggaggcggagcttgcagtgagctgagatggtgccattgcactccagcctgggtgacagagtgagactccatctcaaaaaaaaaaaaaaaaaaaaaaaaaaaaatatatatatatatatatatatataaaatatatataacattattacttataacagcatgaagaattacaagtagacaga

SEQ ID NO: 15684 - DNA, 101 bp, Homo sapiens
  DISO7_10002790
  Located on chromosome 9
  Distance between a terminus base of telomere on chromosomal short arm and 5'-terminus of this base sequence : 124384099
  Distance between 3'-terminus of neighbour sequence of sequence listing upward to telomere on chrosomal short arm and 5'-terminus of this base sequence : 55037
tcccattgattattatgattgcgcattgatgatgatgatggtgatgatgacgacgatgatgatgattgtgcctcatctcgggcccattgattattagctgc

SEQ ID NO: 15685 - DNA, 406 bp, Homo sapiens
  AC006241.1_163202
  Located on chromosome 9
  Distance between a terminus base of telomere on chromosomal short arm and 5'-terminus of this base sequence : 124497517
  Distance between 3'-terminus of neighbour sequence of sequence listing upward to telomere on chrosomal short arm and 5'-terminus of this base sequence : 113317
tcctagtatctttcagctggaggagactcttggggccaagtagttcaatgccctcattttacaagtaggcaaattaagcgccagaaaggtgaagcatcttccccaaggtcacacagcaaatatgtggcaggaactgctttgttcctgtcagggcacctcccactgtgccaaggtgagttggctgttggggttcagatagggatgtcttgccttctttttatctatctatctatctatctatctatctatctatctatctatctatctatctatcgagatggaatctcacttccgtcacccaggctagagtgcagtggcgcgatctcggctcactataatcgccacctcccgggttcaagctgttctcctgcctcagcctcctgagtagctcgtattagaatgtgca

SEQ ID NO: 15686 - DNA, 182 bp, Homo sapiens
  D9S1861
  Located on chromosome 9
  Distance between a terminus base of telomere on chromosomal short arm and 5'-terminus of this base sequence : 124844070
  Distance between 3'-terminus of neighbour sequence of sequence listing upward to telomere on chrosomal short arm and 5'-terminus of this base sequence : 346147
gattgcttgagcccaggagttcaagaccagcctaggcaacatagaaagaccttgtctcaaaaaaatatatatacacacacacatacatatatatatatatatacacatacatatacacacacacacacacacacacacacacatatatatataaaataattggggttgtgaagaagctcctt

SEQ ID NO: 15687 - DNA, 247 bp, Homo sapiens
  D9S1863
  Located on chromosome 9
  Distance between a terminus base of telomere on chromosomal short arm and 5'-terminus of this base sequence : 124973169
  Distance between 3'-terminus of neighbour sequence of sequence listing upward to telomere on chrosomal short arm and 5'-terminus of this base sequence : 128917
ctagagacccaggcaattcttaagattagacaagtttataaaacggccactaaatcaagctcgttcagcctgtgggctgcacgcagcccaggaacagcattgaatgcagcccaacacaaattcataaactttcttaaaatgttacaagattttgtgtgtgtgtgtgtgtgtgtgtgtgtgtgtgtgtgtgtgtgtttttaagctcatcagctatcattaatgttagtgtattttatgggtggcccaa

SEQ ID NO: 15688 - DNA, 224 bp, Homo sapiens
  U07562.1_57677
  Located on chromosome 9
  Distance between a terminus base of telomere on chromosomal short arm and 5'-terminus of this base sequence : 125138099
  Distance between 3'-terminus of neighbour sequence of sequence listing upward to telomere on chrosomal short arm and 5'-terminus of this base sequence : 164683
caagttggaaatcttgatttagagtggacctaggtttttaccatccctgggtgcttgacaaaagcaagtttaagtcttccctaactcagagtttccatagatcattgcagccaatatgaacacaccaaaaaaggacatacacacacacacacacacacaccctgaaacaagatatcatgcgcaagagtcagtagaaacaatagttgttcctgacaatttcagat

SEQ ID NO: 15689 - DNA, 329 bp, Homo sapiens
  U07563.1_11803
  Located on chromosome 9
  Distance between a terminus base of telomere on chromosomal short arm and 5'-terminus of this base sequence : 125157886
  Distance between 3'-terminus of neighbour sequence of sequence listing upward to telomere on chrosomal short arm and 5'-terminus of this base sequence : 19563
agtattcggttgagtactgatcagtgcacccatgtgaggaaaccccttagttcagggaaggagccactcaaaaggattagagagaaccatttacggagttcacacagggccagaaatagttcctgttcccagtagcagagtagaacatttcatgattcaggggtattgattggagtactaagaagagttgtattagtgaaggttcttgagagagagagagagagagagagagagagagagagagtgtgtgtgtgtgtgtgtgtgtgtgtgcacgtgtgaagaaatttattgtaaggaattgccacgtgattatggaggctgataagtcc

SEQ ID NO: 15690 - DNA, 434 bp, Homo sapiens
  U07563.1_30280
  Located on chromosome 9
  Distance between a terminus base of telomere on chromosomal short arm and 5'-terminus of this base sequence : 125176277
  Distance between 3'-terminus of neighbour sequence of sequence listing upward to telomere on chrosomal short arm and 5'-terminus of this base sequence : 18062
ataaagacaatgcagtcaacagaggaagagtttaaaagaactattcagcttgggcaccatgactcacgcctgtaatcccaacactttgggaggctgaggtggacagttcacctgcggtcaggagtttgagaccagcttggccaacatagtgaaaccccatctccactaaaaatacaaaaattaactgaacatggtggcaggcacctgtaatcccagctattgggaggctgaggcaggagaattgcttgaacctgggaggcatagcttgcagtgagccaagattgcaccaccgcattccagcctgggtgacagagtgagactctgtctcaaaaataataaataaataaataaataaataaataaataaataaagctatgcatttcccacaaatactgcttaaaaaaaaaagaactattctttgctatccttggag

SEQ ID NO: 15691 - DNA, 106 bp, Homo sapiens
  DISD22_0006719
  Located on chromosome 9
  Distance between a terminus base of telomere on chromosomal short arm and 5'-terminus of this base sequence : 125292585
  Distance between 3'-terminus of neighbour sequence of sequence listing upward to telomere on chrosomal short arm and 5'-terminus of this base sequence : 115874
gatgacagacgagaggccgtgatcaaaggcgagaattagcacggagagaatgtgtgtgagtgtgtgtgtgtgtgtgtgtgcagcctgtgtgtcaattcatgggtgc

SEQ ID NO: 15692 - DNA, 101 bp, Homo sapiens
  DISD22_0006723
  Located on chromosome 9
  Distance between a terminus base of telomere on chromosomal short arm and 5'-terminus of this base sequence : 125376040
  Distance between 3'-terminus of neighbour sequence of sequence listing upward to telomere on chrosomal short arm and 5'-terminus of this base sequence : 83349
agcctccacactgtgaatgtagagagcgaacacacacacacatacacacacacacacacacacacacacacactccctgctgtgtcttatcccggtgagca

SEQ ID NO: 15693 - DNA, 402 bp, Homo sapiens
  AL157938.21_123886
  Located on chromosome 9
  Distance between a terminus base of telomere on chromosomal short arm and 5'-terminus of this base sequence : 125592061
  Distance between 3'-terminus of neighbour sequence of sequence listing upward to telomere on chrosomal short arm and 5'-terminus of this base sequence : 215920
agctaagcagtcaaataccttccacatgcatgcattcattgttaggttttctaactttccatggcagtttactagttatcagggccaatgctgttaggactgaattggattcctagtttttaaaagctgtgactcaccattaaatggttgtagtgaattggtactgttgttgttgttgttgttgttgttgttgttgttgttaagaaatttaaagggggaaaaaaaagagactaggaagtacattaagtatgttaccctaagacagaaattagcttgttgtatttgaggcacagaagatatgtgtgactgccctgagtgagggggaggatgataaaagatgatgtcagagcagtggaaaagggacagatcatgttgggccttctagaattggtagacaggagt

SEQ ID NO: 15694 - DNA, 275 bp, Homo sapiens
  chr9.fa.O7frz.135216788
  Located on chromosome 9
  Distance between a terminus base of telomere on chromosomal short arm and 5'-terminus of this base sequence : 125983140
  Distance between 3'-terminus of neighbour sequence of sequence listing upward to telomere on chrosomal short arm and 5'-terminus of this base sequence : 390677
aatcagattcctagtttgatagaactttgtatagaagagtcagttctgttctggaaacacatgggctcccattgcaccttgtgaccctcagtagctgtcagctcagccatgctgccagcaggtgtgcgctggcagcccccaactgctagtaaaggggaggcagtgtctttcaggaacgtgaaaccgctttttaaaaaacgtgcagccccatgtgcaggggtgtgtgtgtgtgtgtgtgtgtgtgtgtgcacgctgagttctcaccgagtcagtga

SEQ ID NO: 15695 - DNA, 412 bp, Homo sapiens
  chr9.fa.O7frz.135421131
  Located on chromosome 9
  Distance between a terminus base of telomere on chromosomal short arm and 5'-terminus of this base sequence : 126179674
  Distance between 3'-terminus of neighbour sequence of sequence listing upward to telomere on chrosomal short arm and 5'-terminus of this base sequence : 196259
acagtgaatcttagacacctcttacctcttggctgctttgctttgtcaggtggttggataacatcagattgcccaggaagccaaactgacccacaggatgggtttctgtgtatgtgtgtgtgtgtgtgtgtgtatgtgtgtacatgtgtgcgtgtgtaggggggtgaggggtgcacatgcatgcctatacatttctgcattccttctcaattggaaatatatcaatgctgacaaggaacaagggtagaagcatgatataatcacaaggttgctggaacatgggtgcatggtggggaaaataagtgaaaatcaattttcccctggatctgtgtgtgtgcgtgcatgtgtgtgtgtgtataaaactccagccagtgagacaatgttcactcctctgaacagcactcaacgctaa

SEQ ID NO: 15696 - DNA, 131 bp, Homo sapiens
  DISD22_0006734
  Located on chromosome 9
  Distance between a terminus base of telomere on chromosomal short arm and 5'-terminus of this base sequence : 126495580
  Distance between 3'-terminus of neighbour sequence of sequence listing upward to telomere on chrosomal short arm and 5'-terminus of this base sequence : 315494
tcgaagataatgtctaagaagaggaaattacacacacacacacacacacacacacacacacacacacacagacacacaccttttacatgcataataaaaggttctaagaaactatttgccagccattaaca

SEQ ID NO: 15697 - DNA, 463 bp, Homo sapiens
  AL353631.7_146815
  Located on chromosome 9
  Distance between a terminus base of telomere on chromosomal short arm and 5'-terminus of this base sequence : 126599332
  Distance between 3'-terminus of neighbour sequence of sequence listing upward to telomere on chrosomal short arm and 5'-terminus of this base sequence : 103621
aagacaatcctattcaggagagagacagagagagagagagaggagagagagagagaggggagtgtgcaatagcaagaactagaaggaaatgcacttttattattattattattattattttaagacagagtctcgctctgtcacccaggctggagtgcaatggtgcgattatggctcactaggtagcctcgaacccctgggctcaagtgatcctcccacctcagcctcttgagtagctggaaccacaggcgccggccaccatgcccagctatttatttttatttttattttttgtagagatgaggttttgctacattgcccaaggctggttgcaaactcctggcctcaagccatcctcccaccttggcctcccaaagttctgggattacaggtgcaagccgctttgtctggccaaatttgattttaaatatgccaattagcatcgatgctgatcctattaatc

SEQ ID NO: 15698 - DNA, 409 bp, Homo sapiens
  AL353701.14_92974
  Located on chromosome 9
  Distance between a terminus base of telomere on chromosomal short arm and 5'-terminus of this base sequence : 126861909
  Distance between 3'-terminus of neighbour sequence of sequence listing upward to telomere on chrosomal short arm and 5'-terminus of this base sequence : 262114
tgactacctgcattaaggttaggtcgttgcttttgttcaagtagttagtagtgagccaacttcttcctactgaagtgtaaagtgagggcgtatggagttattctccatggtgagttagtgtgtggtgcccacgctgagcaatatgtacacacacacacacacacacacacacacacatacatgcatatgcatttgtgtatgcacccatataacataccgtttacatctatcatatatacatgtatgcatatgtataatatacatgtacatatgtgtaaaatgtatgtacatatatgtaaatttcccccttcttttcctttttccttttgcttcccccgccccacccagctatatcgaggacaacatttggcctctggatggcactagctaaacagcttctaggaccaat

SEQ ID NO: 15699 - DNA, 388 bp, Homo sapiens
  chr9.fa.O7frz.136047708
  Located on chromosome 9
  Distance between a terminus base of telomere on chromosomal short arm and 5'-terminus of this base sequence : 126864595
  Distance between 3'-terminus of neighbour sequence of sequence listing upward to telomere on chrosomal short arm and 5'-terminus of this base sequence : 2277
acgtttataactgtgcagatagagatgaatgcgaagaggcaggcagcttagcacagcacctgctgtaaggaaagctcttgggaaatgttagctcttattcacacacacacacacacacacacacacacacacacacacacgcaggtatgcacaaataagacaggcattgtgatgggtccccacccccgtaagttttcaagtgagctgcattgcccggaagagttcagatttgcaggaagggagttctgggcaggtctcagggacctggaaccagaccttgaaaagtgaaaaagcagagttgggaaagtcattcagctccattccgccctcctcggctcctaaatgcttgtaggttttcaccccaacttgagtcctagtttacaagacc

SEQ ID NO: 15700 - DNA, 247 bp, Homo sapiens
  HUMUT6781
  Located on chromosome 9
  Distance between a terminus base of telomere on chromosomal short arm and 5'-terminus of this base sequence : 127034178
  Distance between 3'-terminus of neighbour sequence of sequence listing upward to telomere on chrosomal short arm and 5'-terminus of this base sequence : 169195
aaccagccttttctcccgctacactggggttgttgcccctccacttttctttttacctctatgaatcttcgttgttgtttgttccattttcatcccatcgtaaccaaggagatgagatcagggttaaaaggaaagggagaaggaaggaaggaaggaaggaaggaaggaaggaaggaaggaaggaagggaaagggaagaagaaaaaaaaagaattccctaattttgtttctgacccccagtcactacc

SEQ ID NO: 15701 - DNA, 339 bp, Homo sapiens
  AL161726.7_147606
  Located on chromosome 9
  Distance between a terminus base of telomere on chromosomal short arm and 5'-terminus of this base sequence : 127165963
  Distance between 3'-terminus of neighbour sequence of sequence listing upward to telomere on chrosomal short arm and 5'-terminus of this base sequence : 131538
cttgatggagacagctttaataatgaccttggtctcctccggttagaagtggacaagggaccctttattattattattattattattattattttatttttatttatttatttttctttttggagatggagtctcactgtgtccccaggctggagtgcggtggcgcaatcttggctcactgcaacctctgcctcccaggtgcaagcgattctcctgcctcagcctcctgagtagtgggaattacaggcatccaccaccatgccgggctaatttgttgtatttttagtagagacatgggtctcactatgttggctaggctagtctccaactcctgacctc

SEQ ID NO: 15702 - DNA, 195 bp, Homo sapiens
  AC000392.1_19411
  Located on chromosome 9
  Distance between a terminus base of telomere on chromosomal short arm and 5'-terminus of this base sequence : 127256238
  Distance between 3'-terminus of neighbour sequence of sequence listing upward to telomere on chrosomal short arm and 5'-terminus of this base sequence : 89936
cgaaggaaatccacatagaataagagtaaattaatgtgtttattacttactgcttggcgtgtgtgtgtgtgtgtgtgtgtgtgtagaaaaatgaaagaaaaatgtagagttttttcaataataaaaagggagttgcactgcggggcccctaaagcttgtgaaaaattaaactcgacggattcaaactgtcctatt

SEQ ID NO: 15703 - DNA, 312 bp, Homo sapiens
  AC004589.1_34924
  Located on chromosome 9
  Distance between a terminus base of telomere on chromosomal short arm and 5'-terminus of this base sequence : 127290490
  Distance between 3'-terminus of neighbour sequence of sequence listing upward to telomere on chrosomal short arm and 5'-terminus of this base sequence : 34057
agtgaaccgagcatctcacgtgcttggcttcttgcattacgctcgcgtttggcaacattttgaaccattcctaacctccagagtggtgggactcaatcccaagtggacactcacacacacacacacacacacacacacacacacacacacacaaggcaagtgaacaggcatgaggaaggcagtctgcagctggctcggaaatttcactgatttttttcctcaggcactacactgaaaagactgctcactctcattcatccaggtatggggatataatagaactcacttgagtggtggtttcaaaagtgcacc

SEQ ID NO: 15704 - DNA, 113 bp, Homo sapiens
  D9S1830
  Located on chromosome 9
  Distance between a terminus base of telomere on chromosomal short arm and 5'-terminus of this base sequence : 127290568
  Distance between 3'-terminus of neighbour sequence of sequence listing upward to telomere on chrosomal short arm and 5'-terminus of this base sequence : -234
cagagtggtgggactcaatcccaagtggacactcacacacacacacacacacacacacacacacacacacacacaaggcaagtgaacaggcatgaggaaggcagtctgcagct

SEQ ID NO: 15705 - DNA, 278 bp, Homo sapiens
  AC002096.1_13766
  Located on chromosome 9
  Distance between a terminus base of telomere on chromosomal short arm and 5'-terminus of this base sequence : 127337304
  Distance between 3'-terminus of neighbour sequence of sequence listing upward to telomere on chrosomal short arm and 5'-terminus of this base sequence : 46623
aaccgatccattaatttcatatcatatctatccatccatccatccatccatccatccatccatccatccatctatagagagagagataccactatatagagtggtctgtaccttaaaatgcttaagcgttacttgcgtctcccccatgagtcatgtagggtgggagggagtagggtgggtgcttctggacatttgcaccataagccagccaggacccgggttggcatgtccccagctcatgtggcggcggcccttgcaggtgcagagctacatggaac

SEQ ID NO: 15706 - DNA, 366 bp, Homo sapiens
  AC000393.1_41314
  Located on chromosome 9
  Distance between a terminus base of telomere on chromosomal short arm and 5'-terminus of this base sequence : 127405902
  Distance between 3'-terminus of neighbour sequence of sequence listing upward to telomere on chrosomal short arm and 5'-terminus of this base sequence : 68320
taacataaacggattggttgattgatttgaaatcatcctgagtgtattagtaagagttctccagagaagcagaaccaacgtgatgtgtgtgtgtgtgtgcatgtgtgtgtgtgtgtgtgtgtgtgtgtgtgtgtttaaggaattgatgcacatgatttttgagtctggcatgtccaaaatctgcaggatgggttgccaggaacagagaagaaccactgttgcagtccaagtccaaaggctgtctgttggcagaattccctcttgcttgtgggaggtcagtcttttgatctactcaggccttgaattgattggatgaggcccacccacatagtggaaggcaatctgctttactgaaagtccacttat

SEQ ID NO: 15707 - DNA, 220 bp, Homo sapiens
  AC002120.1_3497
  Located on chromosome 9
  Distance between a terminus base of telomere on chromosomal short arm and 5'-terminus of this base sequence : 127448755
  Distance between 3'-terminus of neighbour sequence of sequence listing upward to telomere on chrosomal short arm and 5'-terminus of this base sequence : 42487
tgtattgatagaggaagctattgatatcttaagtgaaaatgaggtttaaaaaatcagtatacaacccatgattcatgttgttaattacatacacacacacacacacacacacacggaaggaagtgtgcaaggataaacggcagtgtcttttttcttcttattttttagtgtgtatgttttatttttctgtattgggcgtgcatgataacattatcactgg

SEQ ID NO: 15708 - DNA, 195 bp, Homo sapiens
  D9S164
  Located on chromosome 9
  Distance between a terminus base of telomere on chromosomal short arm and 5'-terminus of this base sequence : 128029626
  Distance between 3'-terminus of neighbour sequence of sequence listing upward to telomere on chrosomal short arm and 5'-terminus of this base sequence : 580651
ctatgatcgtgccactgcacttcagcctgggcaaccctgacttaaaacacacacacacacacacacacacacacacacacacacacacacacacaccacgcagaccatacgtacaaagggaatgctcacattccacatccagtgttcatgtcactagacgtcgcacaatggccaaaaatcaatccccaggcaaac

SEQ ID NO: 15709 - DNA, 101 bp, Homo sapiens
  DID22N_0034101
  Located on chromosome 9
  Distance between a terminus base of telomere on chromosomal short arm and 5'-terminus of this base sequence : 128140632
  Distance between 3'-terminus of neighbour sequence of sequence listing upward to telomere on chrosomal short arm and 5'-terminus of this base sequence : 110811
ctgactggtagaagcagctcaataaatggtggatggatggatggatggatggatggatggattcactaattactgactcacttgttgggtgtggtagagca

SEQ ID NO: 15710 - DNA, 262 bp, Homo sapiens
  AC000387.1_25938
  Located on chromosome 9
  Distance between a terminus base of telomere on chromosomal short arm and 5'-terminus of this base sequence : 128549470
  Distance between 3'-terminus of neighbour sequence of sequence listing upward to telomere on chrosomal short arm and 5'-terminus of this base sequence : 408737
acgtgaaggttctctgaaataagtcggggaatgcgaatgagactgtgtgtgtgtgtgtgtgtgtgtgtgtgtgtgtgtgtgtgagagagagagagagagagagagagaggcagacagagagagagaggcatgaagatcctgtcttcctaagaggcttcggacagaacaggaagtaggtgtcaggagacagaaggtgaaagaggaggcggggtcctgccagctgcctctcgttcctggggcgtctgttcctattcctctttgc

SEQ ID NO: 15711 - DNA, 311 bp, Homo sapiens
  AC000404.1_28851
  Located on chromosome 9
  Distance between a terminus base of telomere on chromosomal short arm and 5'-terminus of this base sequence : 128644707
  Distance between 3'-terminus of neighbour sequence of sequence listing upward to telomere on chrosomal short arm and 5'-terminus of this base sequence : 94975
cataggcctagacagccagccagccagcagagagagaggagagaggagagagaggagagagaggagagagaggagagagggagagggagagagggagagggagagaggagagagagaggagagagagagagagagagagagggagagagagagaaccaataacgaggcaaggaagggagggcaggcaccctctctggtgacacctccacactgtaccgaatgccaaatgcaggtggtgtgagcagggcgcactaacctgcctaaaaataaagcaccaggggaggggaaggtaagaaacgaaccagtctgaa

SEQ ID NO: 15712 - DNA, 195 bp, Homo sapiens
  AC000388.1_41200
  Located on chromosome 9
  Distance between a terminus base of telomere on chromosomal short arm and 5'-terminus of this base sequence : 128677440
  Distance between 3'-terminus of neighbour sequence of sequence listing upward to telomere on chrosomal short arm and 5'-terminus of this base sequence : 32422
gatggaatcctcagctctattcagacagacaccctacctcacctcccccaacacacacacacacacacacacacacacacacacacacacacacacggccactctcaggcccctggctcctgagtggcccccccagtctgcagccatcccaggcctctcccaggagggcatgggagctactgaggccaactggtg

SEQ ID NO: 15713 - DNA, 320 bp, Homo sapiens
  AC000388.1_9831
  Located on chromosome 9
  Distance between a terminus base of telomere on chromosomal short arm and 5'-terminus of this base sequence : 128708895
  Distance between 3'-terminus of neighbour sequence of sequence listing upward to telomere on chrosomal short arm and 5'-terminus of this base sequence : 31260
tcctatttgcagataacaaggtcttgtatatacaaaatcctaaggaaaccactaaaaaactactagcgctctctctctctctctctctctctctctctctctctttctctctttctttctgacagagtcctgctctatcgcccaggctagagtgcagtggtgccatctcaactcactgcaacctgcacctcctgggttcaagtgattctcctgcctcagcctaccgagtagctgggaccatgcctgactaatttttgtgtttttagtagagacagggtttcaccatgttggccaggctggtcttgaactcctgacctcaa

SEQ ID NO: 15714 - DNA, 236 bp, Homo sapiens
  AC002297.1_24287
  Located on chromosome 9
  Distance between a terminus base of telomere on chromosomal short arm and 5'-terminus of this base sequence : 128752946
  Distance between 3'-terminus of neighbour sequence of sequence listing upward to telomere on chrosomal short arm and 5'-terminus of this base sequence : 43731
ggatagcattaggagacatacctaatgtaaattaggttagttaatgggtgcagcacaccaacatggcacatgtatacatatgtaacaaacctgcacattgtgcacatgtaccctagaacttaaagtataaataaatatatatatatatatatatatatatatcccaaaaacaaaaaaacaaaaacaatgtcttctaaggtttgaatatatatagaattaagatacatgagaacgct

SEQ ID NO: 15715 - DNA, 303 bp, Homo sapiens
  AC002111.1_11192
  Located on chromosome 9
  Distance between a terminus base of telomere on chromosomal short arm and 5'-terminus of this base sequence : 128788506
  Distance between 3'-terminus of neighbour sequence of sequence listing upward to telomere on chrosomal short arm and 5'-terminus of this base sequence : 35324
aaagtttacaggccttaattctaaccacatttactactgttaagaaaaaggagccaaaacttggaataacacacacgggcacacatgtatgcacacacacacacatgcatgtgcacacaaacacacaagcacgcgtgtacacacacacacacacacacacacacacacacgacttcatgcattcctggtctggttggagcacctcccaggggcagcctccccctcccccgccccactccggctgactcctcccctggagaaagttgttcaggcgcaaatgatttctgtcctgatagaggacat

SEQ ID NO: 15716 - DNA, 182 bp, Homo sapiens
  D9S1793
  Located on chromosome 9
  Distance between a terminus base of telomere on chromosomal short arm and 5'-terminus of this base sequence : 129110548
  Distance between 3'-terminus of neighbour sequence of sequence listing upward to telomere on chrosomal short arm and 5'-terminus of this base sequence : 321739
ggtgtggaaccaggactaaccctaaccctaacccaggcccacactgccccctggggtcgctgtgctgaatcacagacatggtggcacctgtcacccagcacacacacacacacacacacacacacacacacaggcacacacacacccagtccctctcacatgaccggattacactcgctctg

SEQ ID NO: 15717 - DNA, 153 bp, Homo sapiens
  D9S1818
  Located on chromosome 9
  Distance between a terminus base of telomere on chromosomal short arm and 5'-terminus of this base sequence : 129283715
  Distance between 3'-terminus of neighbour sequence of sequence listing upward to telomere on chrosomal short arm and 5'-terminus of this base sequence : 172985
tgatctatgctggctacttcataacagccagaagcaatagtcattaagtggtattttaattaactatattggcattttatatatatatatatacacacacacacacacacacacacatacgcacactatgttcagcactacagagtccaaata

SEQ ID NO: 15718 - DNA, 101 bp, Homo sapiens
  DISO7_10002793
  Located on chromosome 9
  Distance between a terminus base of telomere on chromosomal short arm and 5'-terminus of this base sequence : 129534223
  Distance between 3'-terminus of neighbour sequence of sequence listing upward to telomere on chrosomal short arm and 5'-terminus of this base sequence : 250355
tgttcagctaagcttgatagttgaatcatttactataaagtcatgtgtgtgtgtgtgtgtgtgtgtgtgtgtgtaacagtgacaagactggaattaggcaa

SEQ ID NO: 15719 - DNA, 222 bp, Homo sapiens
  chr9.fa.O7frz.139316008
  Located on chromosome 9
  Distance between a terminus base of telomere on chromosomal short arm and 5'-terminus of this base sequence : 129916555
  Distance between 3'-terminus of neighbour sequence of sequence listing upward to telomere on chrosomal short arm and 5'-terminus of this base sequence : 382231
gtggtaagaactcattctttacacacgtgcacgaacgcacacatgagtgcacacacacacacacacacacacaacctggtctgtcttctcccctgcagagccccatgggtcctgcttggtgttatgtctcgtgctccattcacagcacaccagggacacaggtagcagagctcaagcctgcttgaacaaacaggccaggtattcatagagttctggtagcaa

SEQ ID NO: 15720 - DNA, 425 bp, Homo sapiens
  chr9.fa.O7frz.139399874
  Located on chromosome 9
  Distance between a terminus base of telomere on chromosomal short arm and 5'-terminus of this base sequence : 129988473
  Distance between 3'-terminus of neighbour sequence of sequence listing upward to telomere on chrosomal short arm and 5'-terminus of this base sequence : 71696
tggataaatgtttgctttagatagctgactggatgggtggatgagtgaatggatggatgggtgggtgggtgggtggatggatggatggatggatggatggatgaatggatgagtggatggatggatgagtggatggatggacaagtggatggatggatggatggatggatattttggtaaatgaatggataaatgagtgaataatggatggagggatggatggatggatgaattaatagacattttgtaaataaatgaatggatagatgaatgaatgggtggatggagggatggatgggtgggtggatggatgaatggatgggtggagaagtgggtggatggatgggtggatatataagtagatgatagatagatagatagatagatagatagatagatagatagtaagtcacgagacctgacta

SEQ ID NO: 15721 - DNA, 279 bp, Homo sapiens
  AL159992.6_99997
  Located on chromosome 9
  Distance between a terminus base of telomere on chromosomal short arm and 5'-terminus of this base sequence : 130090805
  Distance between 3'-terminus of neighbour sequence of sequence listing upward to telomere on chrosomal short arm and 5'-terminus of this base sequence : 101907
ggcctctatgctaatccagagctgtagatcatgggccagggagtgacatgaggttgatggtatcccatgacatggctgtagaccccttcaaggcctcctccccggcccggtgggctgggctgggctgggctgggctgggctgggctgggctggtgccccaagtccatttctctggagccgaaacccagccctgacttttccggtccttgcatctgcttcaggaagagaattcattaggcctttcttgttttaatgacatctcatttgtatttcatttgc

SEQ ID NO: 15722 - DNA, 403 bp, Homo sapiens
  HUMUT7972
  Located on chromosome 9
  Distance between a terminus base of telomere on chromosomal short arm and 5'-terminus of this base sequence : 130108213
  Distance between 3'-terminus of neighbour sequence of sequence listing upward to telomere on chrosomal short arm and 5'-terminus of this base sequence : 17129
tgggcaagacagcaagcaagcaagcaaacaagcgagagagagagaggaaggaaggaaggaaggaaggaaggaaggaaggaaggaaggaaggaaggaaggaaggaaagaaggaaggaaggaaggaaggaaggggcaggggaagggaagaaaggaaggaaggaaggaaggaaggaagaaagaaagaaagaaagagaaaggaagaaaagaaagaagaaagaaagaaaaaggaaagaaagaaaaaggaaagaaagaaagaagaaagaaagaaagaaacaaagaaagaaagaaagaaagaaagaaagaaagaaaggaaggaaggaaggaaggaagaaagaaaggaagtggtggcttggagcagataatacctggatgccacgcccccggcaacccttggacctcaccg

SEQ ID NO: 15723 - DNA, 432 bp, Homo sapiens
  chr9.fa.O7frz.139696897
  Located on chromosome 9
  Distance between a terminus base of telomere on chromosomal short arm and 5'-terminus of this base sequence : 130291307
  Distance between 3'-terminus of neighbour sequence of sequence listing upward to telomere on chrosomal short arm and 5'-terminus of this base sequence : 182691
cagtgagctaagatggcaccactgcacaccagtctgggtgacaaagcaagaccctgtcaaaaaaaaagaaagaaagaaagaagaaagaaaaagaaaaagaaagaaagaaagaaagaaagaaagaaagaaagaaagaaagaaagaaggaaagaaagaaagagaaagagaaagagaaacaaaaaaaggtgtaggaattaaagcctggaggatcccagtggagccggagtgcctgaacccaggcaggtgctcagagctgaatgcccagtggccctcagcagtggggctccaggctgctgcagctgaacaggctctcagaaagcatttctcctccctccaactcccagaagccaaacatctgtgtggcctcggctccagggtttccagaggcctaagcctgggtctccacccctgaataaagcaggtttctgactc

SEQ ID NO: 15724 - DNA, 438 bp, Homo sapiens
  AL353615.6_21739
  Located on chromosome 9
  Distance between a terminus base of telomere on chromosomal short arm and 5'-terminus of this base sequence : 130318807
  Distance between 3'-terminus of neighbour sequence of sequence listing upward to telomere on chrosomal short arm and 5'-terminus of this base sequence : 27068
gaattagcatttgaatcagtagactcagtaaaggtctgccctcacccatgtgggcaggaaccatccaatctgttgacggcccagatagaactagaacaaaaaggtggaggaagggcaactgactctctctctctctctctctctctctctctctctctctctctctctctgcttaggctgaaacatccatcttctcctgccctcagacatgggagcacctggttctcaggcctttggacttggactgaattaagccaccagctttcctgggtctccagcttgcagaccgcaaatgggacttcttggtctccataatagtgcgagtcaacttccatgatacatctcctcttctgtataccctaatatgccagcattgccctcatatgcaaaccagacaaagagagcacaagaaaactacagtccagtgtttctcataag

SEQ ID NO: 15725 - DNA, 246 bp, Homo sapiens
  chr9.fa.O7frz.139770161
  Located on chromosome 9
  Distance between a terminus base of telomere on chromosomal short arm and 5'-terminus of this base sequence : 130342036
  Distance between 3'-terminus of neighbour sequence of sequence listing upward to telomere on chrosomal short arm and 5'-terminus of this base sequence : 22791
cgtaatcctggtgaataatttatcattcgttcttgagcaaggggaggaaatataaatctcctgttctatgagcatggcaagcaacgcgcctgtgtgtgtgtgtgtgtgtgtgtgtgtgtgtgtgtgtgtgtgtctttaaccgcataaactgctcgtctgatctcatctggaataaattacccataatgaaggtgatgggttgcttgcaaacaacactttgaatcctgctatctctgctcataacaa

SEQ ID NO: 15726 - DNA, 135 bp, Homo sapiens
  D9S1826
  Located on chromosome 9
  Distance between a terminus base of telomere on chromosomal short arm and 5'-terminus of this base sequence : 130541961
  Distance between 3'-terminus of neighbour sequence of sequence listing upward to telomere on chrosomal short arm and 5'-terminus of this base sequence : 199679
tgcagaaccaggtcttattcgtatttcaccagttttctattcatttgtgtgtgtgtgtgtgtgtgtgtgtgtgtgtgtggttctatgcaattttttacatgtgtagatgtgtgtaaccactgcggcaatcaacat

SEQ ID NO: 15727 - DNA, 378 bp, Homo sapiens
  chr9.fa.O7frz.140216563
  Located on chromosome 9
  Distance between a terminus base of telomere on chromosomal short arm and 5'-terminus of this base sequence : 130818540
  Distance between 3'-terminus of neighbour sequence of sequence listing upward to telomere on chrosomal short arm and 5'-terminus of this base sequence : 276444
acatggtgaaactccatgtctaccgaaaaaacaaaaattagccaggcgtggtggcggatacctgtagtcccagctactcaggaggctgaggcaggagaatcacttgaacccgtgaggcggaggttgcagcgagctgagattgtgccactgcactccagcctgggcgacagagcgagactctgtcataaataaataaataaataaataaataaataaataaataacaataagttatgttaacaattacataaatagttatgtatggtggcattaactgcacatcatgtagaggagggaggtaaaagctgagaggtcttgcatataagtgaaggtgagttgtcatcatcttaaaacagacaactgtatcttatgtaagcc

SEQ ID NO: 15728 - DNA, 429 bp, Homo sapiens
  AC069002.2_121480
  Located on chromosome 9
  Distance between a terminus base of telomere on chromosomal short arm and 5'-terminus of this base sequence : 131022589
  Distance between 3'-terminus of neighbour sequence of sequence listing upward to telomere on chrosomal short arm and 5'-terminus of this base sequence : 203671
tattgctttggagagtatcagtatgaacccacaattcttaatatataaacagaaggatgtaccacgcccatggattggaagacccaatacggtaaaaatgtcaggtcaccccgcatcagtcaaaagaatcaatgcaatcccaatcaaattccagcaggtgtgtgtgtgtgtgtgtgtgtgtgtgtgtgtgtgtgtgtgtgtgtgagatatttggcaatctacttctgaaaagcatatgaaaatgcaaaaaatagccaacgcaaggcaaatcataaggaactcaaacctgaaagagttagagaaaatatttagaaagattcagaaaaaatttttaaaaacatgtactgccatagggaaaaacagagagatcaagggtatagaacagagttcaattacaaacacatataatttacagactcctgatacaca

SEQ ID NO: 15729 - DNA, 228 bp, Homo sapiens
  chr9.fa.O7frz.140416029
  Located on chromosome 9
  Distance between a terminus base of telomere on chromosomal short arm and 5'-terminus of this base sequence : 131022589
  Distance between 3'-terminus of neighbour sequence of sequence listing upward to telomere on chrosomal short arm and 5'-terminus of this base sequence : -429
tattgctttggagagtatcagtatgaacccacaattcttaatatataaacagaaggatgtaccacgcccatggattggaagacccaatacggtaaaaatgtcaggtcaccccgcatcagtcaaaagaatcaatgcaatcccaatcaaattccagcaggtgtgtgtgtgtgtgtgtgtgtgtgtgtgtgtgtgtgtgtgtgtgtgagatatttggcaatctacttctga

SEQ ID NO: 15730 - DNA, 223 bp, Homo sapiens
  D9S158
  Located on chromosome 9
  Distance between a terminus base of telomere on chromosomal short arm and 5'-terminus of this base sequence : 131243799
  Distance between 3'-terminus of neighbour sequence of sequence listing upward to telomere on chrosomal short arm and 5'-terminus of this base sequence : 220982
tctcaagcgacaacaatcacatcaatattacatggtcttatgaatacatccatgtcatcaacttgttagtaaacacatgattatacaacataaagtaggcaaagcggaaaaaatatctacaaccgtcaaagtctctctctctctcatacacacacacacacacacacacacacacacacacacacgggcacacaaatacatctgagcctattttagccaaatc

SEQ ID NO: 15731 - DNA, 214 bp, Homo sapiens
  DISO7_11675116
  Located on chromosome 9
  Distance between a terminus base of telomere on chromosomal short arm and 5'-terminus of this base sequence : 131500048
  Distance between 3'-terminus of neighbour sequence of sequence listing upward to telomere on chrosomal short arm and 5'-terminus of this base sequence : 256026
ctgagcctcacacctgtgcacccatcaatgtgggcagccccagtgtctcccgcccggccctggactgcagccatcgggaaggatgggtctgcagcaccaggctgtcctggggccctgatccatcccatcgcagagtgggttgggtggatgtgtgttgaatgaatgaatgaatgaatgaatgaatgaatgaatggagtggctcacctattgttcc

SEQ ID NO: 15732 - DNA, 397 bp, Homo sapiens
  AL354671.7_136
  Located on chromosome 9
  Distance between a terminus base of telomere on chromosomal short arm and 5'-terminus of this base sequence : 132025461
  Distance between 3'-terminus of neighbour sequence of sequence listing upward to telomere on chrosomal short arm and 5'-terminus of this base sequence : 525199
tagcagttcctcaaacaataaataaatggcccaggcgggtggctcacacctgcaatcccagcactttgggaggctgaggcgggcggatcacctgaggtcaggagttcaagaccagcctggccaacgtggtgaaaccccgtctctactaaaaatacaaaaaattagctgggagtgatggtggccacctgtaatcctagctattcgagagtctgaggcagagaattgcttgaacccagacatggaggttgcagtgagccaagatcatgccactgcactccagcctgggtgacagagcgagactccgcctcaaaaaaaaaaaaaaatatatatatatatataaaataaataaataaataagcccagtgtggtggctcacacctgtaatcctagtgctttg

SEQ ID NO: 15733 - DNA, 148 bp, Homo sapiens
  DISD22_0006763
  Located on chromosome 9
  Distance between a terminus base of telomere on chromosomal short arm and 5'-terminus of this base sequence : 132770293
  Distance between 3'-terminus of neighbour sequence of sequence listing upward to telomere on chrosomal short arm and 5'-terminus of this base sequence : 744435
cgtgtcgaatgagtctgtgtgtgtccacgaatgcatcgtgcacgtggtgcgaatgcgggcacactggtgtgtgtgtgtgtgtgtgtgtgtttgcatgtctgtgtctagcgccaggtgcccagctctgggcgtcattctggaagccgac

SEQ ID NO: 15734 - DNA, 322 bp, Homo sapiens
  AC020707.4_73497
  Located on chromosome 9
  Distance between a terminus base of telomere on chromosomal short arm and 5'-terminus of this base sequence : 132910993
  Distance between 3'-terminus of neighbour sequence of sequence listing upward to telomere on chrosomal short arm and 5'-terminus of this base sequence : 140552
gagaaggcatgaatcagaaatgggataaggaaggaggagaaaaggatgatcctcagcctgtgcaacacagcgaacccccatctctaaaaaatatacaaaaactagtatggaggagtggtgcctgcaatcccagcactttgggaggccgaggcaggaggatcacttgagcctgggaggtggaggctgcagtgagccgtgactgcaccactgcactccagcctgggtgacacagtgagaccctatataaataaataaataaataaataaataaataaataaataaataaataaaataagatgatttctaaggtttcggcttaag

SEQ ID NO: 15735 - DNA, 171 bp, Homo sapiens
  chr10.fa.O7frz.82238
  Located on chromosome 10
  Distance between a terminus base of telomere on chromosomal short arm and 5'-terminus of this base sequence : 14703
  Distance between 3'-terminus of neighbour sequence of sequence listing upward to telomere on chrosomal short arm and 5'-terminus of this base sequence : 0
tacaactagctcaatttctcattattcatcaccaacttgaaacaaaatcccaaccttgggaaaacacacattcactcacatacacacacacacacacacacacacacacacacacccctgctgggaggtgggtggcatagggtttttcttaaacaactaaacagtagcagg

SEQ ID NO: 15736 - DNA, 118 bp, Homo sapiens
  D10S249
  Located on chromosome 10
  Distance between a terminus base of telomere on chromosomal short arm and 5'-terminus of this base sequence : 174256
  Distance between 3'-terminus of neighbour sequence of sequence listing upward to telomere on chrosomal short arm and 5'-terminus of this base sequence : 159382
gaggtgcccgctagtatttcgcaaatgtgtgtgtgtgtgtgtgtgtgtgtgtgaaaagcactggggatcttgttaaaaaggagagtggttttaagtgttctcactacaaaaaccagtt

SEQ ID NO: 15737 - DNA, 184 bp, Homo sapiens
  DISO7_10002795
  Located on chromosome 10
  Distance between a terminus base of telomere on chromosomal short arm and 5'-terminus of this base sequence : 515165
  Distance between 3'-terminus of neighbour sequence of sequence listing upward to telomere on chrosomal short arm and 5'-terminus of this base sequence : 340791
aaagagcatcgaacagcccctcgggagggcagtcagcaggagccgcggaggccaccgggatggagggagggagggagggagggaggcaggcaggcaggcagtgaggccagaggtgatgtggccaggagggagggagggaggcaggcaggcaggcaggcaggcagcgaggacagaggtgatgtgg

SEQ ID NO: 15738 - DNA, 279 bp, Homo sapiens
  HUMUT5009B
  Located on chromosome 10
  Distance between a terminus base of telomere on chromosomal short arm and 5'-terminus of this base sequence : 812501
  Distance between 3'-terminus of neighbour sequence of sequence listing upward to telomere on chrosomal short arm and 5'-terminus of this base sequence : 297152
aagtccaccaggcaaggccagcccaagacgggaggcaggagcagaaggtgcttccgtcaagctctcaccacaagtcgtactttcgttcgttctttccttccttccttccttccttccttccttccttccttccttccttccttccttccttctttctttctttctttctttctttctttctttctttctttctttctttctttctttcttttttttttgagacagagtcttgctctgttgcccaggctggagtgcagtggtgctcagctcactgcaacc

SEQ ID NO: 15739 - DNA, 434 bp, Homo sapiens
  chr10.fa.O7frz.665437
  Located on chromosome 10
  Distance between a terminus base of telomere on chromosomal short arm and 5'-terminus of this base sequence : 835008
  Distance between 3'-terminus of neighbour sequence of sequence listing upward to telomere on chrosomal short arm and 5'-terminus of this base sequence : 22228
tatcataagaacagcgtaggaaaaagccacccctatgatttaattacccccactgcgtccctcccatgacacatggggattgtgggagctacaattcaagatgagatttgggtggggacacagccaaaccatgtcggcctctgagatctattcaaaatgaacatcaccaaggcatatagtcaacagacagcccaaggtcaacacacacacacacacacacacacacacacacacacacacacacaaatcttaaaggctgctagagaaaaagttcagattatgtacaaagggaaccccataaggctaacagcagatgtctcagcagaaatcttacaagccaagagagactggcggcctactatcagcattcttaaggaaaagaaattccaaccaagaatttctttcccaccgaactaagcttcataagtgatgga

SEQ ID NO: 15740 - DNA, 379 bp, Homo sapiens
  AL359878.2_169465
  Located on chromosome 10
  Distance between a terminus base of telomere on chromosomal short arm and 5'-terminus of this base sequence : 958836
  Distance between 3'-terminus of neighbour sequence of sequence listing upward to telomere on chrosomal short arm and 5'-terminus of this base sequence : 123394
actagcaatttagcctggtaacaactgtcaatggagcaaggcacaggggctcacactcatattcccagcaacctgggaggctgaggctggaggatcacttgaggccaggagactgaggccagcctgggtgacatggcaagacctcatgtctcaaaaaattattatttaaatagccaggaggatcactggagctcagaaattggaggctgcagtgagcagtggccacaccactacactccactcctgcagcctgggcaacagaacgagaccccgtctgttaaataaataaataaataaataaataaataaataaataaataacaagtatcactggaggtatggatattaaccacagaggaatatggaacatagaacttaa

SEQ ID NO: 15741 - DNA, 122 bp, Homo sapiens
  DISO7_10002797
  Located on chromosome 10
  Distance between a terminus base of telomere on chromosomal short arm and 5'-terminus of this base sequence : 1002990
  Distance between 3'-terminus of neighbour sequence of sequence listing upward to telomere on chrosomal short arm and 5'-terminus of this base sequence : 43775
cacagtgggttcttgtatgtgtgggttttgtgtgtgtgtgtgtgtgtgtgtgtgtgtatgagattttattttgtttctatctaaaaatctctctaaaaagacagtagaggcaaggaagatag

SEQ ID NO: 15742 - DNA, 235 bp, Homo sapiens
  chr10.fa.O7frz.949473
  Located on chromosome 10
  Distance between a terminus base of telomere on chromosomal short arm and 5'-terminus of this base sequence : 1082748
  Distance between 3'-terminus of neighbour sequence of sequence listing upward to telomere on chrosomal short arm and 5'-terminus of this base sequence : 79636
aagcatactgcagaatgtacacaaagtgtttaaacagctacttaatacaaagttctagacccacatagggtctgggtgtgtgtgtgtgtgtgtgtgtgtgtgtgaatgcgtgtgtcaggagtcagtgatgatggagatattgatatctaatacaaaaaatctgaaataaggttaatgattaaaacaaatcaagagggaaaataatgtgaaaaggaagtcaacttcagagttagcc

SEQ ID NO: 15743 - DNA, 403 bp, Homo sapiens
  chr10.fa.O7frz.1170418
  Located on chromosome 10
  Distance between a terminus base of telomere on chromosomal short arm and 5'-terminus of this base sequence : 1293371
  Distance between 3'-terminus of neighbour sequence of sequence listing upward to telomere on chrosomal short arm and 5'-terminus of this base sequence : 210388
gatgttattctcacaaatgcagaggccgcagagtgcagagagctcagtcccctccaccgagacctttgctgggggccagaggagctcatctgaaaccgaaggagactctgcacagaggtttcagtcttctcgagtgctctctgcctctggccccttctggacctgccatgtctcctctcaccagcacagtgcttggtcctggtcacttgagctcatcccttcctcagtctcccctttggcctgcatcgagcgattgtgcatctccacagtggccacgcctgctagcccctctctcaactgtgccagacttctccctttctcacacatatatacccacacacacacacacacacacacgtaagcacatgtgcacaaaaacatacataagtacatgtacacgcac

SEQ ID NO: 15744 - DNA, 98 bp, Homo sapiens
  DISO7_10002799
  Located on chromosome 10
  Distance between a terminus base of telomere on chromosomal short arm and 5'-terminus of this base sequence : 1393349
  Distance between 3'-terminus of neighbour sequence of sequence listing upward to telomere on chrosomal short arm and 5'-terminus of this base sequence : 99575
cctaagtcagcagacgggccctgccctccctggtctgcccctgcagccagtccttcctcctcctcctcctcctcctcctggtccacctcttccttccc

SEQ ID NO: 15745 - DNA, 187 bp, Homo sapiens
  DISO7_10002800
  Located on chromosome 10
  Distance between a terminus base of telomere on chromosomal short arm and 5'-terminus of this base sequence : 1415948
  Distance between 3'-terminus of neighbour sequence of sequence listing upward to telomere on chrosomal short arm and 5'-terminus of this base sequence : 22501
caggagattaatggactgggttattttataactaatccaaataaagatttttcccttttttacttaaagatttctgtgtgtgtgtgtgtgtgtgtgtgtgtgtgttttagatataaccaagaatgaacttttccaaaggtcacttaattactaggggaaaatagaaagtggtccagatagtgcatgt

SEQ ID NO: 15746 - DNA, 418 bp, Homo sapiens
  AC067885.2_164778
  Located on chromosome 10
  Distance between a terminus base of telomere on chromosomal short arm and 5'-terminus of this base sequence : 1654703
  Distance between 3'-terminus of neighbour sequence of sequence listing upward to telomere on chrosomal short arm and 5'-terminus of this base sequence : 238568
ctgatctgtctactcaatatccacccatgcatccatccatccatccatccatctactcattcattcacctattcattttttaattaagcatttcattaatttattcagcacttactatattctagacagtatcctggggatatgaagatagatagatagatagatagatagatagatagatagatagattagagagagagagaatagatgataggtagataattctttgtcactatctttaaggtacacaaaattttgtaggagagtctgagacatacaaacttcttataatacaatgaatgtatttggtgcaatagagcaaaaatagggtcaggactttatgactactaagcctcacaggtgttttgatgcctatggaatcaccacatataagtcccactaattcagtcgccatttg

SEQ ID NO: 15747 - DNA, 197 bp, Homo sapiens
  HUMUT1699
  Located on chromosome 10
  Distance between a terminus base of telomere on chromosomal short arm and 5'-terminus of this base sequence : 1867502
  Distance between 3'-terminus of neighbour sequence of sequence listing upward to telomere on chrosomal short arm and 5'-terminus of this base sequence : 212381
gtgcactagccagggttctccagagaaacagaaccagtatgatagatggatggatagatagattacatagagggatagatagatagatagatagatagatagatagatagatagatagatagatagatagatagatgatagatagacagacagacagacagactcactcattgagtatcccttacctgagatgttca

SEQ ID NO: 15748 - DNA, 431 bp, Homo sapiens
  AL355597.7_16809
  Located on chromosome 10
  Distance between a terminus base of telomere on chromosomal short arm and 5'-terminus of this base sequence : 2099753
  Distance between 3'-terminus of neighbour sequence of sequence listing upward to telomere on chrosomal short arm and 5'-terminus of this base sequence : 232054
ggagcacaggtagaatttaaagaagtaaacattgtcaaagtaatcaatacagcaaaagatatacttttagaattaatagcttccctggactatttttcaaatacataattcttacccttaacgttcatctatttttctctttggctttatttttttttgagaaaaagtcatttcaaaaactgatatttcctttttccaaaattattctttatctatctgtctatctatctattatctatctatctatctatctatctatctatctatctatctatcatctatctatctatctatcatctatctatccatttatccacatatttatctatcatctatataattagtaaaactgtttactgaattttaaaagtggtagtattaaaagtattgatcaagctgggcactgtggcttacacctgtaatcacagcac

SEQ ID NO: 15749 - DNA, 248 bp, Homo sapiens
  D10S1716
  Located on chromosome 10
  Distance between a terminus base of telomere on chromosomal short arm and 5'-terminus of this base sequence : 2121009
  Distance between 3'-terminus of neighbour sequence of sequence listing upward to telomere on chrosomal short arm and 5'-terminus of this base sequence : 20825
gccttgaagacattttgtgatatgattgacacttgcatccatggacttcaagcaaagcagattattcttcacaatgtgtccttctctaaatagctgcagttcttgagtgcagactgagctctcctgggaaggaaggactttgtctccctagacctctcttcgtgtgtgtgtgtgtgtgtgtgtgtgtgtgcatgtgtgtgtacgttctggggcccagaacaatcagaaagtctgtagcaaatccagct

SEQ ID NO: 15750 - DNA, 319 bp, Homo sapiens
  AL354747.5_35389
  Located on chromosome 10
  Distance between a terminus base of telomere on chromosomal short arm and 5'-terminus of this base sequence : 2373587
  Distance between 3'-terminus of neighbour sequence of sequence listing upward to telomere on chrosomal short arm and 5'-terminus of this base sequence : 252330
tgtaagttttagcgtaaataccagatcccaatgattttgtgcatatctgtaatacaatacttcaaaatacattatcattaattgtctataaatatatctttcttactatagtgccctccttaaaggtactcctacttcgtatgtatgtatgtatgtatgtatgtatgtatgtattccatagcccagcaccttgcaacatagctgataatcaacacattaaatgttgctcagttggggattgtcttagaaagcactctggaagagataaaatacactgcttatttcacatcattaataaatatgttcactctgcttaaca

SEQ ID NO: 15751 - DNA, 258 bp, Homo sapiens
  G08819
  Located on chromosome 10
  Distance between a terminus base of telomere on chromosomal short arm and 5'-terminus of this base sequence : 2386573
  Distance between 3'-terminus of neighbour sequence of sequence listing upward to telomere on chrosomal short arm and 5'-terminus of this base sequence : 12667
ttgggtttcctgacttgtgtggtgctgtgtttgttataatgcattgagttttattctgtttatctatctatctatctatctatctatctatctatctatctatctggctatctgtctatctctttatttttgagacagggtctggctatgacccaaggtggagtgcagtggtgcaatcttggctcactgcagcctcgacctccccaggctcgggacctcccaggctcaggtcattctcccaccttagcatcccaagta

SEQ ID NO: 15752 - DNA, 239 bp, Homo sapiens
  D10S602
  Located on chromosome 10
  Distance between a terminus base of telomere on chromosomal short arm and 5'-terminus of this base sequence : 2407115
  Distance between 3'-terminus of neighbour sequence of sequence listing upward to telomere on chrosomal short arm and 5'-terminus of this base sequence : 20284
cagtgtgccgtgagcatagcatagatcaggactgtaaaggttcatatgccatgaacctgtcttcaaggtgctcactaaggggggagagaagcgtgtgtgtgtgtgtatgtgtgtgtgtgtgtgtgtgtgtgtgtgtgtgtgtgttaccactagagggtagtttccaaactcataattgttaaagtaatgcatgttatcccaacttccatttctaatctcctctcaacccacaggtcagg

SEQ ID NO: 15753 - DNA, 449 bp, Homo sapiens
  AL139818.4_170487
  Located on chromosome 10
  Distance between a terminus base of telomere on chromosomal short arm and 5'-terminus of this base sequence : 2420740
  Distance between 3'-terminus of neighbour sequence of sequence listing upward to telomere on chrosomal short arm and 5'-terminus of this base sequence : 13386
taggtactcaagtaatggcaaagctctgaacaatggatattaaatatatcaaagatacaaaggataaaacaaaatagtcataaaagaataaaaaccatctccacccacataacacagacaagaagaagggaacaaaaccaaatctatctatctatctatctatctatctatctatctatctatattaggttggtgcaaaagtaattgtggtttctgccatttgaaagcaattgcaaaacctgcaattacttttacacaaaccacatacatatgtatatatatgtatatagtaatcaaaggagcttaaatttgaagctgcagttaatttattttccctgctgcattatatttcattacatacacataccagaaaatgtcatccattctggagttgataaaaattgggtaattaaaaacacccaacacagtagaagcctcaaatagcagtt

SEQ ID NO: 15754 - DNA, 423 bp, Homo sapiens
  chr10.fa.O7frz.2200504
  Located on chromosome 10
  Distance between a terminus base of telomere on chromosomal short arm and 5'-terminus of this base sequence : 2490753
  Distance between 3'-terminus of neighbour sequence of sequence listing upward to telomere on chrosomal short arm and 5'-terminus of this base sequence : 69564
tattgtctagcaaatattctggacattagaacatttacaaagccatttaaacaaataattaaatgactcaatctccaaaaagtcagggatgccacagaaagagggatgcacgcatgcatatatgtgtgtgtgtgtgcgtatgtgtagtgtgtgtgtatgtgcgtgtgtgtatgtgtgtatctgtatatgtgtgtatgtatgtgtatgtgtagcgtgcatgtgtgtgttgtgtatgtgcatgcgtatgtgtctgaatgtgtttgtatatatgtgtgtacacgtgcatgtgtgtgtgtgtgtgtgtgtgtgtgtgaagtactactccttctgggaaaggtgagaagcctggcatgactgggtaattttattcaaagaggtggtggggtctagggtgctttggttgcttacctatggctgtgacct

SEQ ID NO: 15755 - DNA, 153 bp, Homo sapiens
  chr10.fa.O7frz.2527408
  Located on chromosome 10
  Distance between a terminus base of telomere on chromosomal short arm and 5'-terminus of this base sequence : 2678829
  Distance between 3'-terminus of neighbour sequence of sequence listing upward to telomere on chrosomal short arm and 5'-terminus of this base sequence : 187653
gcaggaaatagatgtaaccttagaaagacaaacatacccacggtgcaattattttccataagtacgtgtgtgtgtgtgtgtgtgtgtgtgtgtgtgtgtgtgtaaacctccaaagaaatttatcattagctgtcacttgtttactttccatga

SEQ ID NO: 15756 - DNA, 165 bp, Homo sapiens
  D10S1745
  Located on chromosome 10
  Distance between a terminus base of telomere on chromosomal short arm and 5'-terminus of this base sequence : 2702845
  Distance between 3'-terminus of neighbour sequence of sequence listing upward to telomere on chrosomal short arm and 5'-terminus of this base sequence : 23863
cccacatggcaggattcccttcttttttaaagctgaataatattccattgcatacacacacacacacacacacacacacacacacacacacacacacacactgcattttcttcatccatcaatggacacttaagttgtttccgtatcttggctattatggattat

SEQ ID NO: 15757 - DNA, 165 bp, Homo sapiens
  chr10.fa.O7frz.2642387
  Located on chromosome 10
  Distance between a terminus base of telomere on chromosomal short arm and 5'-terminus of this base sequence : 2828221
  Distance between 3'-terminus of neighbour sequence of sequence listing upward to telomere on chrosomal short arm and 5'-terminus of this base sequence : 125211
ccaatgtaaagtttacctattcttttatataacaggaatatataaatgcatttattacagtaatatatatgtgctcacacacacacacacacacacacacatatatctacgtacaaagggtacatatatctatgtaccaaactgtacaaatcactagctatcctg

SEQ ID NO: 15758 - DNA, 349 bp, Homo sapiens
  HUMUT734B
  Located on chromosome 10
  Distance between a terminus base of telomere on chromosomal short arm and 5'-terminus of this base sequence : 2842404
  Distance between 3'-terminus of neighbour sequence of sequence listing upward to telomere on chrosomal short arm and 5'-terminus of this base sequence : 14018
atttgctgttttggaataagccctttttcacgtgtcgctagagggggttgtcttattttctttctttcctttctttcttttctttctttctttctttctttctttctttctttctttctttctttctttctttcctttctttctttctttctttcttccttccttcctttcttccttccttcctttcttcctttcttcctatctttcttcctttttctttttctttcttctttctctttctctctctttctttctctctttctttctttctttctttctttctttctttctttctttctttctttctttctttctttcatcttttttgagacagagtctcactctgtcg

SEQ ID NO: 15759 - DNA, 378 bp, Homo sapiens
  HUMUT733
  Located on chromosome 10
  Distance between a terminus base of telomere on chromosomal short arm and 5'-terminus of this base sequence : 2842406
  Distance between 3'-terminus of neighbour sequence of sequence listing upward to telomere on chrosomal short arm and 5'-terminus of this base sequence : -347
ttgctgttttggaataagccctttttcacgtgtcgctagagggggttgtcttattttctttctttcctttctttcttttctttctttctttctttctttctttctttctttctttctttctttctttctttcctttctttctttctttctttcttccttccttcctttcttccttccttcctttcttcctttcttcctatctttcttcctttttctttttctttcttctttctctttctctctctttctttctctctttctttctttctttctttctttctttctttctttctttctttctttctttctttctttcatcttttttgagacagagtctcactctgtcgcccaggttggactgcagtggcacaatctcgg

SEQ ID NO: 15760 - DNA, 361 bp, Homo sapiens
  HUMUT1468
  Located on chromosome 10
  Distance between a terminus base of telomere on chromosomal short arm and 5'-terminus of this base sequence : 2842422
  Distance between 3'-terminus of neighbour sequence of sequence listing upward to telomere on chrosomal short arm and 5'-terminus of this base sequence : -362
agccctttttcacgtgtcgctagagggggttgtcttattttctttctttcctttctttcttttctttctttctttctttctttctttctttctttctttctttctttctttctttcctttctttctttctttctttcttccttccttcctttcttccttccttcctttcttcctttcttcctatctttcttcctttttctttttctttcttctttctctttctctctctttctttctctctttctttctttctttctttctttctttctttctttctttctttctttctttctttctttcatcttttttgagacagagtctcactctgtcgcccaggttggactgcagtggcacaatctcg

SEQ ID NO: 15761 - DNA, 112 bp, Homo sapiens
  D10S533
  Located on chromosome 10
  Distance between a terminus base of telomere on chromosomal short arm and 5'-terminus of this base sequence : 2871998
  Distance between 3'-terminus of neighbour sequence of sequence listing upward to telomere on chrosomal short arm and 5'-terminus of this base sequence : 29215
tgaggcacacagtagaggtttaaagttgttagtttatttctcattacacacacacacacacacacacactgcacatgccacctatttaaacagaaagtgaataatctcccaa

SEQ ID NO: 15762 - DNA, 164 bp, Homo sapiens
  DISD22_0000020
  Located on chromosome 10
  Distance between a terminus base of telomere on chromosomal short arm and 5'-terminus of this base sequence : 3128157
  Distance between 3'-terminus of neighbour sequence of sequence listing upward to telomere on chrosomal short arm and 5'-terminus of this base sequence : 256047
tccaacatatttaggtatctctgtgacctaaactttcatcaggactccccacacttctttctttttacattgctctgtgtgagtgtgtgtgtgtgtgtgtgtgtgtgtgtgtttatgaattcaacagaaatctacaaaaaaacgctattgctagaataatgctg

SEQ ID NO: 15763 - DNA, 350 bp, Homo sapiens
  HUMUT1422
  Located on chromosome 10
  Distance between a terminus base of telomere on chromosomal short arm and 5'-terminus of this base sequence : 3334445
  Distance between 3'-terminus of neighbour sequence of sequence listing upward to telomere on chrosomal short arm and 5'-terminus of this base sequence : 206124
ttttaacacagatgcaaaggcatttgatagaataaggatagtcatttcaacaaatggttctagaacatggcagcatgtgcattgcatatagaaagaaagaaaaagaaagaaagaaagaaaagaaagaaagaaagaaaaagaaagaaagaaagaaagaaagaaagaaagaaagaaagaaaagaaagaaagaaaagaaaggaaggaaggaagaaagaaaggaaggaaggaaggaaggaagaaagaaagaaagaaagaaagaaagaaagaaagaaagaaagaaagaaagaaagaaagaaagaaagaaagaaaggaagcaagctgggcgtggtggctcatgcctgtaatcccag

SEQ ID NO: 15764 - DNA, 237 bp, Homo sapiens
  chr10.fa.O7frz.3184483
  Located on chromosome 10
  Distance between a terminus base of telomere on chromosomal short arm and 5'-terminus of this base sequence : 3525025
  Distance between 3'-terminus of neighbour sequence of sequence listing upward to telomere on chrosomal short arm and 5'-terminus of this base sequence : 190230
atctactcatccgtccatctacatatctatccatctcttcatccatttatccatccgattatctatctgtctgtctgtctatctatctatctatctatctatctatctatctatctatctatcttcccagctttactgaggtttaccagacagaaaaattgtgtatatttaaggtgtacaatgtgatgttcttgtatacatatacattgtgaaatgattgccagaataaagctaatt

SEQ ID NO: 15765 - DNA, 467 bp, Homo sapiens
  AL139280.4_74193
  Located on chromosome 10
  Distance between a terminus base of telomere on chromosomal short arm and 5'-terminus of this base sequence : 3603438
  Distance between 3'-terminus of neighbour sequence of sequence listing upward to telomere on chrosomal short arm and 5'-terminus of this base sequence : 78176
atcaaactgtcattcctctagaccaggggcagtggctcacccctgtaatctcagcactttgggaggccagtggatctcttgagcccaggagttcaaaccagcctgggcaacatagcaagatcccatctctacaacaacaacaacaacaacaacaacaacaaaacatacaaaaaaaaattagccaggcatggtggcacacacctgcagtcccatctttttgagaggctgaggtgggagcatggaatgggcctggcaggttgaggctgcagtgagctgtgattgtgccactgtactccagtctgagcaatagagtgagaccctgtctcaaaaaaaaaaaaaaaagtcattcttccagacagcagaggtggaaatgggaaataagactgttcagaaatgcagcagacaattcttattcagcctccctgtaaagatttgaaatggattgtaacattgtaacatcgtaggtg

SEQ ID NO: 15766 - DNA, 386 bp, Homo sapiens
  AL356433.4_59449
  Located on chromosome 10
  Distance between a terminus base of telomere on chromosomal short arm and 5'-terminus of this base sequence : 3696966
  Distance between 3'-terminus of neighbour sequence of sequence listing upward to telomere on chrosomal short arm and 5'-terminus of this base sequence : 93061
atcagatgagttgcctaacttcttaaaacctcattttcctcatttttaagatggaattaacaacagcgtccactgtgttcatggtaatgtgtccataaatgttagaagggaggaaaggaggaaggaaggaaggaaggaaggaaggaaggaaggaaggaaggaaggaaggaaggaaagaaagaaagaaaaaattttaaaaaaggaaagaaaaggaaagaaaaaggagagggtaggggaggaggggagggaagggaagggaaaggagaaaggaaaggagaggataaaaggaaagaagagtagagaagaggttcatttgtggcctccattttgggccaccctcagctagcagtgagcatccctgggttaaatgcaataggttaaagaca

SEQ ID NO: 15767 - DNA, 463 bp, Homo sapiens
  chr10.fa.O7frz.3471475
  Located on chromosome 10
  Distance between a terminus base of telomere on chromosomal short arm and 5'-terminus of this base sequence : 3813066
  Distance between 3'-terminus of neighbour sequence of sequence listing upward to telomere on chrosomal short arm and 5'-terminus of this base sequence : 115714
gcagtattgtggtcagtagaagaaaggcccgctgaacacttctttacggctgatgggactgtaaactaatacagctgctatggaaaacagtgtggaaattccttaaagaactagaagtagaactaccatttgatccagcaatcccactactgggtatctacccagaggaaaaaaagtcattctaaaaaaaggatacttgcacatgcatgtttatagcagcacaatttgcaattgcaaaaatatggaaccagcccaaatgcccatcctttaatgagtggataaagaaaatgtggtacacacacactctcacactctctctctctcacacacacacacacacacacacacacacacacacacacaccatggaatactactcagccataaaaaagaatgaaataatggcatttggagcaacctggatggaattgagaccattattctaagtgatgtaactcaggaa

SEQ ID NO: 15768 - DNA, 315 bp, Homo sapiens
  DISO7_00002525
  Located on chromosome 10
  Distance between a terminus base of telomere on chromosomal short arm and 5'-terminus of this base sequence : 3946747
  Distance between 3'-terminus of neighbour sequence of sequence listing upward to telomere on chrosomal short arm and 5'-terminus of this base sequence : 133218
acctggcattgggattaaagggagccacttggcacggggagtttgagtgattctgctgttggggatcctctgattggaaagaagaagcagcacgtccgtcattaccgggaactgcagagcagccttcagtaatcggagataatccattagcttaagcagattcagatttgtgtgtgtgtgtgtgtgtgtgtgtgtgtgagggcagcctacaattcttctggaggacatccctgactccagggccaggctgacctctaaccagtctgtgggctcctagatagacctctccgtctctcagacttgcactgtagtttg

SEQ ID NO: 15769 - DNA, 195 bp, Homo sapiens
  DISO7_10002810
  Located on chromosome 10
  Distance between a terminus base of telomere on chromosomal short arm and 5'-terminus of this base sequence : 3954811
  Distance between 3'-terminus of neighbour sequence of sequence listing upward to telomere on chrosomal short arm and 5'-terminus of this base sequence : 7749
gcagtgtgacagagaaatgggacctttttaaggttttctaatatagtttttctaaattttacaaactaacctttttccattttctgttttatccaaacccatcctgcccctaaattaattataccattttacacacatacacacacacacacacacactagatttttttttccttccaaattaatgactatgact

SEQ ID NO: 15770 - DNA, 181 bp, Homo sapiens
  DISO7_10002811
  Located on chromosome 10
  Distance between a terminus base of telomere on chromosomal short arm and 5'-terminus of this base sequence : 3956413
  Distance between 3'-terminus of neighbour sequence of sequence listing upward to telomere on chrosomal short arm and 5'-terminus of this base sequence : 1407
tgcctagagtatactcaattgggtatagatggggttgtgagaaatttcatcacaaataatgatttaactctgaagctaaacaatttgcaggtatctatctatctgtttatctatccagagagagagagagagagagagagagagagagagagagaagagacagacaatcacctaatcacaa

SEQ ID NO: 15771 - DNA, 168 bp, Homo sapiens
  DISO7_10002809
  Located on chromosome 10
  Distance between a terminus base of telomere on chromosomal short arm and 5'-terminus of this base sequence : 4066271
  Distance between 3'-terminus of neighbour sequence of sequence listing upward to telomere on chrosomal short arm and 5'-terminus of this base sequence : 109677
aaggctaattgtggccagcgttttattcttcaaggtgcagaaaaacatacatttccttccttccttccttccttccctccctccttccttccctctctacttccttccttccttcttctctctttctctctctttcttgctttctttagcctgtgcaggagtcagact

SEQ ID NO: 15772 - DNA, 145 bp, Homo sapiens
  DISO7_10002812
  Located on chromosome 10
  Distance between a terminus base of telomere on chromosomal short arm and 5'-terminus of this base sequence : 4191668
  Distance between 3'-terminus of neighbour sequence of sequence listing upward to telomere on chrosomal short arm and 5'-terminus of this base sequence : 125229
caagaacagagcccgatcttttccatcacttgtttattattattattattattattattattattattattattattattattattattttgtaaagggggctgtgggcgctccactccagctgcgcgggaagaaggaagcaatg

SEQ ID NO: 15773 - DNA, 330 bp, Homo sapiens
  chr10.fa.O7frz.4011773
  Located on chromosome 10
  Distance between a terminus base of telomere on chromosomal short arm and 5'-terminus of this base sequence : 4304855
  Distance between 3'-terminus of neighbour sequence of sequence listing upward to telomere on chrosomal short arm and 5'-terminus of this base sequence : 113042
ggctttaatttccaattctaacttttcagtgttggtatacagaaaacaattgatttgatttttgtgtgtgtatatatatatatatatatatatatatatatatatatatatatatttcaccactatgccaggctaatttttgtatttttagtagagatggggtttcaccatgttggctaggctggtctcaaactcctgacctcaggtgatccacccgcctcagcctcccaaagtgctgtgattacaggcataagctactgtgcctagactgattttagtatattaatcttgcattctgaaaccttgctgtaatcatttattagttccacg

SEQ ID NO: 15774 - DNA, 452 bp, Homo sapiens
  chr10.fa.O7frz.4131546
  Located on chromosome 10
  Distance between a terminus base of telomere on chromosomal short arm and 5'-terminus of this base sequence : 4424266
  Distance between 3'-terminus of neighbour sequence of sequence listing upward to telomere on chrosomal short arm and 5'-terminus of this base sequence : 119081
tcttgatcaccagatctatcacaatagtagccaggcaaagcataaatcctgttttttccccacattgaatatacattgccacatagatttcagattaaaagtttcttggtcttcagaaagataaaggaacatcagcaaacaaatctaatctctacctttctcttgggcttacaaagaattttaaaaagagattgattagatagataaatatagatagaatatatatatatatatatatatatatatatatatatatatatagtgtgtgtgtgtgtgagtgtgtgttctcacaagaaaataaaataatactttcccaggggaaaggtgttttgagacttgtggtcaaattctgtgttttcctaattacctgtgcaagactgggtgagagtcttagtttcctcttggggaggagatgaagggcttgggcagctttctaagtagactcggtggta

SEQ ID NO: 15775 - DNA, 340 bp, Homo sapiens
  chr10.fa.O7frz.4247464
  Located on chromosome 10
  Distance between a terminus base of telomere on chromosomal short arm and 5'-terminus of this base sequence : 4762023
  Distance between 3'-terminus of neighbour sequence of sequence listing upward to telomere on chrosomal short arm and 5'-terminus of this base sequence : 337305
gttgaagttaaagacataagcaacttttgaaaattatggcagaagaaataatgggtctttctttctttctttctttctttctttctttctttctttctttctttctctctctctctttctctttctttctttcttctttctttctttctttctttctttctttctttctttctttctttctttctttctttcttctttctttctttctttccttccttccttccttctttctttctttccctctttctttctttcttttttttttttttttgttttttgagatggagtctcactcttttgcccaggctggagtgcggtggcatgatctccgctcactgta

SEQ ID NO: 15776 - DNA, 212 bp, Homo sapiens
  D10S591
  Located on chromosome 10
  Distance between a terminus base of telomere on chromosomal short arm and 5'-terminus of this base sequence : 4867272
  Distance between 3'-terminus of neighbour sequence of sequence listing upward to telomere on chrosomal short arm and 5'-terminus of this base sequence : 104909
ggctttatggatcatattaatccacagaattagagatgaattagaaaccataataaattatgatgtaaaaaataaatcacttttaaaataaaatttaacaatttctgtgtgtgtgtgtgttttcaacctcctccatgtacctcaaaccaccttaatcttatccctaatgagagttacattttgatgtcatatggagaacagaccttcgaggt

SEQ ID NO: 15777 - DNA, 330 bp, Homo sapiens
  chr10.fa.O7frz.4782817
  Located on chromosome 10
  Distance between a terminus base of telomere on chromosomal short arm and 5'-terminus of this base sequence : 5162588
  Distance between 3'-terminus of neighbour sequence of sequence listing upward to telomere on chrosomal short arm and 5'-terminus of this base sequence : 295104
gattggctttatccttaacatagattgttaagtcccacagccttacaaaacaaatttcaatcacaatctcaacggcattgagtaagtttatatatatatatatatatacaagtatacatatatatacacacacacacacgtaaaatacacatggagttttgaaaacttagtgcaacaatttaaaaaggtgaagtacctcaattgctttttcttattgactacttgttgaaatgctatgtttttgatagatttggttaaataaacattaccattataattaatctcccctatttctctttttttatttcttcatacggctagtagaacatt

SEQ ID NO: 15778 - DNA, 85 bp, Homo sapiens
  D10S552
  Located on chromosome 10
  Distance between a terminus base of telomere on chromosomal short arm and 5'-terminus of this base sequence : 5289271
  Distance between 3'-terminus of neighbour sequence of sequence listing upward to telomere on chrosomal short arm and 5'-terminus of this base sequence : 126353
gtcctttaatctgggctttccttcttatttaatatcacacacacacacacacacacacacacacctgcataagcccccacctatt

SEQ ID NO: 15779 - DNA, 183 bp, Homo sapiens
  D10S1729
  Located on chromosome 10
  Distance between a terminus base of telomere on chromosomal short arm and 5'-terminus of this base sequence : 5356534
  Distance between 3'-terminus of neighbour sequence of sequence listing upward to telomere on chrosomal short arm and 5'-terminus of this base sequence : 67178
tcagacactcttaggattacctcatccaaaatatttgttttaaatgaaaagacttgatttgtgagggggatgtgtatatatgtgtgtgtgtgtgtgtgtgtgtgtgtgtgtatgtagcagaaaaagaggggaggataaggtccttttctatgcaactctctgagcaaaaacaatgcagtcctt

SEQ ID NO: 15780 - DNA, 101 bp, Homo sapiens
  DISD22_0000054
  Located on chromosome 10
  Distance between a terminus base of telomere on chromosomal short arm and 5'-terminus of this base sequence : 5427753
  Distance between 3'-terminus of neighbour sequence of sequence listing upward to telomere on chrosomal short arm and 5'-terminus of this base sequence : 71036
aaagatatcggtatgagtgtggggtgtgtgtgtgtgtgtgtgtgtgtgtgtgtgtgtgtctgtgtgtctgtgtgtattggggaagggattgcagataccag

SEQ ID NO: 15781 - DNA, 132 bp, Homo sapiens
  DISD22_0000057
  Located on chromosome 10
  Distance between a terminus base of telomere on chromosomal short arm and 5'-terminus of this base sequence : 5577183
  Distance between 3'-terminus of neighbour sequence of sequence listing upward to telomere on chrosomal short arm and 5'-terminus of this base sequence : 149329
ctcatgagtctttgatcacattcttctttcatatatattatatatatataatatatatatatatgctgagtagatgtgagcattaaaaaatgagtaaaataaattaaaaatcataacacaagaatccgtgag

SEQ ID NO: 15782 - DNA, 198 bp, Homo sapiens
  DISD22_0000060
  Located on chromosome 10
  Distance between a terminus base of telomere on chromosomal short arm and 5'-terminus of this base sequence : 5688326
  Distance between 3'-terminus of neighbour sequence of sequence listing upward to telomere on chrosomal short arm and 5'-terminus of this base sequence : 111011
agtccataggccagaaagacaataaatttttatcattttgaaataattgaatgttttctcaaagattctttacctactctgttctgtagtgtgtgttttcttctggctcagaagtgtgtgtgtgtgtgtgtgtgtgtgtgtgtgctttcttctggctcaacagggctaaaaactgtgtgatttgcctgtaagttagga

SEQ ID NO: 15783 - DNA, 249 bp, Homo sapiens
  D10S1713
  Located on chromosome 10
  Distance between a terminus base of telomere on chromosomal short arm and 5'-terminus of this base sequence : 5867063
  Distance between 3'-terminus of neighbour sequence of sequence listing upward to telomere on chrosomal short arm and 5'-terminus of this base sequence : 178539
gacagcaactaacctcctgtaagcttctactcccaaataaattagtggaattggcttcaccctggagcatggaaaaatcacatctcattccatatgaatcaattgtacaagaataaccaacgggaaaacttctgatactgggagaatttttctaaggcactcaataggaaggacaggtcaatcgacacacacacacacacacacacacacacactacatacatattacagctgacccttgaataacaca

SEQ ID NO: 15784 - DNA, 396 bp, Homo sapiens
  DISO7_00023418
  Located on chromosome 10
  Distance between a terminus base of telomere on chromosomal short arm and 5'-terminus of this base sequence : 5961515
  Distance between 3'-terminus of neighbour sequence of sequence listing upward to telomere on chrosomal short arm and 5'-terminus of this base sequence : 94203
catagctccctgcattgacaagacagaaagaaagaaagaaggaaagcaagaaagcaagaaagaaagagaaggaaggaaggaaggaaggaaggaaggaaggaaggaaggaaggaaggaaggaaggaaggaaggaaagaaaaagttagtttgggcccagcaaaaggagtaggtttgagaagtagttggtggggggaaggggctttcctgaaagagccaccttttctttgaaaaaggagaaacagtagctctggaaggaccgcctctggagtcagacttgagtccaaatacactcttgaggacacatcgagtgtaggaaaacgaaagacaggtgcaggctcggggccagctctgcacagcgtcccgggtgggtgggatcacaccagtatgggatccaag

SEQ ID NO: 15785 - DNA, 194 bp, Homo sapiens
  DISD22_0000066
  Located on chromosome 10
  Distance between a terminus base of telomere on chromosomal short arm and 5'-terminus of this base sequence : 6064326
  Distance between 3'-terminus of neighbour sequence of sequence listing upward to telomere on chrosomal short arm and 5'-terminus of this base sequence : 102415
tggaattaccataatgatcttagagtaattaagattctcattctctttctctctctctctctctctgtctccccccccaaccccacacacacacatactcactctccctcactcattttcacacacacacacacacacacacacacacacacacacacacacacacacttcttctgaaccatgggataacctga

SEQ ID NO: 15786 - DNA, 334 bp, Homo sapiens
  chr10.fa.O7frz.6210610
  Located on chromosome 10
  Distance between a terminus base of telomere on chromosomal short arm and 5'-terminus of this base sequence : 6377572
  Distance between 3'-terminus of neighbour sequence of sequence listing upward to telomere on chrosomal short arm and 5'-terminus of this base sequence : 313052
tgtcgtgatactaataagatttcagaaggaagacagcaggagacctcgacatcggtgggctgagcatttgcatgagtatgtgtgtgtgtgtgtgtgtgtgcgcgcatgtgcactgagtaagtcccgactctgcacattttatgtttatttttacaagctcagctggggaatggcacaaggggaaggaacatgctgaccgtggagggctgttcagatcatgcatttacacgatcaccagtaagaggaaaaatgtgtgagtgggaaactggacttgcccttggagccagaggaggccttggtggcttagagaagtagtggacttaggaccaactac

SEQ ID NO: 15787 - DNA, 479 bp, Homo sapiens
  AL157395.5_158145
  Located on chromosome 10
  Distance between a terminus base of telomere on chromosomal short arm and 5'-terminus of this base sequence : 6437648
  Distance between 3'-terminus of neighbour sequence of sequence listing upward to telomere on chrosomal short arm and 5'-terminus of this base sequence : 59742
gtgaaatagaagccatagtcatagccaccagagcagattaacacagcctcaggtagcttgtgtgcagcattacgatttggccaagtttatttatttatttatttatttatttatgagacagagttttgctctcgttgcctgggctggagtgcaatggtgtgatctcggctcaccacaacctgtctcccaggttcaagtgattctcctgcctcaacctctcaagtagctgggattaaggcatgcaccaccatgccccactaattttttatttttagtagagatggggtttcaccacattggtcaggctggtcttgaactcctgacgtcaggtgatccacccgccttggcctcccaaagttctgggattacaggcatgagccaccatgcccggctatttattttttaaccataaaagagaatcagaaatagctgcaagggggaacaatatacattcacagttttatcctaggcctacgtta

SEQ ID NO: 15788 - DNA, 376 bp, Homo sapiens
  U15177.1_12803
  Located on chromosome 10
  Distance between a terminus base of telomere on chromosomal short arm and 5'-terminus of this base sequence : 6548662
  Distance between 3'-terminus of neighbour sequence of sequence listing upward to telomere on chrosomal short arm and 5'-terminus of this base sequence : 110535
agtttatgaagaccaaattggatatgagcaaaagcactcttggtaaaattgtattcaatcaatccctagatgagtattttttttaactatccaggcccaccccagatgtctgaatagatttcttctgatcttggctactctgtgatttggccttcactccttgatttacccagcagagtcaatgacattccccaatacacacacacacacacacacacacacacacacacacacacacacagctttctgaggaggagtacacagaagggaacacgatccagtctcaacactggcgatgacagaccgtcccattctctcatatgaaccctacacattgatccagcccagcctggaggtttcctaacatctcgtcagc

SEQ ID NO: 15789 - DNA, 167 bp, Homo sapiens
  AL137145.13_11474
  Located on chromosome 10
  Distance between a terminus base of telomere on chromosomal short arm and 5'-terminus of this base sequence : 6690178
  Distance between 3'-terminus of neighbour sequence of sequence listing upward to telomere on chrosomal short arm and 5'-terminus of this base sequence : 141140
ccatgagccagttcattataataaaccacacacacacatgcatgcatgcagacacacacacatgcatgcgtactacacacacacacacacacacacacacacacacacacactcaccctactggttctgtttctctggagaacgcaatcaggatgtagatggctacc

SEQ ID NO: 15790 - DNA, 384 bp, Homo sapiens
  AL359960.16_51032
  Located on chromosome 10
  Distance between a terminus base of telomere on chromosomal short arm and 5'-terminus of this base sequence : 6690360
  Distance between 3'-terminus of neighbour sequence of sequence listing upward to telomere on chrosomal short arm and 5'-terminus of this base sequence : 15
gaaaggaacatttctatgtactgagaatgaattaggactatagactgtagtttaaaatatctccttctctttttccttccttccttccttccttccttccttccttccttccttccttccttccttccttcctccttctctccctcccccaccctttctccctttccttctttctttctgccacaatgccatacttgccccactgtggcatgatggttgtctgtattgtcccgattgagaatctgaggctccaccgtctggtgccacagcctgaggtgatgaaaatccttgcagatgcatccagtgggaaaggtattgaggagtgccggggtttgaatgggtcacccaaagttcatgtgttggaaacttagtccttaatgcagc

SEQ ID NO: 15791 - DNA, 378 bp, Homo sapiens
  AL137145.13_56543
  Located on chromosome 10
  Distance between a terminus base of telomere on chromosomal short arm and 5'-terminus of this base sequence : 6735254
  Distance between 3'-terminus of neighbour sequence of sequence listing upward to telomere on chrosomal short arm and 5'-terminus of this base sequence : 44510
atcaatgttagtgctcaaactaagaagacttttgagaaattatcagaggtaaatacaaatatacatttccatccatccatccatccatccatccatccatccatccatccatccatccatccctgttgagctccaactatgtgtcaggcacttctggggggttgagggtattgtgatcagtaagacaaactctctgcctttatagtgtttacattctaggagaaaaatattcatcttagagagattataaaaaacaaatcttccgaaatagtatctgttacgtccaaaatagaggaatgtataaataaatgttaatatgatggactaacacgcagccattacaaaaatcctgttttgaaggctattaaatgtcatggt

SEQ ID NO: 15792 - DNA, 177 bp, Homo sapiens
  AL137145.13_108398
  Located on chromosome 10
  Distance between a terminus base of telomere on chromosomal short arm and 5'-terminus of this base sequence : 6787066
  Distance between 3'-terminus of neighbour sequence of sequence listing upward to telomere on chrosomal short arm and 5'-terminus of this base sequence : 51434
ctttccttgccaagattagataagggcaaaaatcctttaatggcattaaagagaaagagaaaagaaaaaactagagagagagagagagagaaagggagagaagggggggggagagagagagagagagagagagagagagagattgcatggccagaggtctaactcaaatacttgcaa

SEQ ID NO: 15793 - DNA, 253 bp, Homo sapiens
  AL137145.13_119548
  Located on chromosome 10
  Distance between a terminus base of telomere on chromosomal short arm and 5'-terminus of this base sequence : 6798181
  Distance between 3'-terminus of neighbour sequence of sequence listing upward to telomere on chrosomal short arm and 5'-terminus of this base sequence : 10938
cctgatgaagactttaaatccacaccacccaataagctcaatgaaccccaagcacaagaaaccaaagaaaacgataccaacacatattgtaatcaaatttcttaaacctagtgataaagagaaaatcttaagcccaagaaaatacatatatatatatatatatatatatatatatatatatatatatatatatatacacttactcaaaatttacaggaaatttcagctcattcatgaacttcaggttaagaac

SEQ ID NO: 15794 - DNA, 416 bp, Homo sapiens
  AL137145.13_171532
  Located on chromosome 10
  Distance between a terminus base of telomere on chromosomal short arm and 5'-terminus of this base sequence : 6850016
  Distance between 3'-terminus of neighbour sequence of sequence listing upward to telomere on chrosomal short arm and 5'-terminus of this base sequence : 51582
tgtccttctaggaagcaatttaaaagccaggaaagacaaaaccaaaaccaatccaaaaaccagcaaatacttcccagaagaagcaaatgaacagttctctggccgatggctctcgaaagaaagaagaaaacagaattagattccctcctgggctgccgtttaggttctggccacctgctgagagaggataccaagcaggctgagagagagagagagagagagagacagagagagacagacagagagagagagagagagagacagagagagagagagagacagagagagacagacagagagagagagagagagagagagagagagagagagagagagatggtggggagggagggagggagagaatgtggcctgtgttgggttaattgtaaatgtcacttactagtctagacctcacg

SEQ ID NO: 15795 - DNA, 182 bp, Homo sapiens
  D10S189
  Located on chromosome 10
  Distance between a terminus base of telomere on chromosomal short arm and 5'-terminus of this base sequence : 7062868
  Distance between 3'-terminus of neighbour sequence of sequence listing upward to telomere on chrosomal short arm and 5'-terminus of this base sequence : 212436
ttgatagaagaagcgatagatcgataactgtgtgtgtgtgtgtgtgtgtgtggagagagagagaaatagtgaaagtttaatgacaaatactttcatctggatctttcttttaaagaacacatttttacctttaacctgccaagaaaatgttctaactcctaggggctcaatggttacttttg

SEQ ID NO: 15796 - DNA, 312 bp, Homo sapiens
  DISO7_00023430
  Located on chromosome 10
  Distance between a terminus base of telomere on chromosomal short arm and 5'-terminus of this base sequence : 7175827
  Distance between 3'-terminus of neighbour sequence of sequence listing upward to telomere on chrosomal short arm and 5'-terminus of this base sequence : 112777
gagtggtcctttgcacctgccggctcagtctctctcagccaccctgtgtctccttgaggcagggggagactcaggcgcagtcataaccctctgaagtgctaggactccatgctgccatgtaaaatacacatttctctattttttgggctcccaaaatagaactaaggttgggatggggtagtatctgtactatgtttcaaacacacacacatacacacacacacacacacacacacacacacacacacacacacggaggaagtttctccctcaaagacccaaaactagcaagaggtaccagtgatgggtctt

SEQ ID NO: 15797 - DNA, 456 bp, Homo sapiens
  chr10.fa.O7frz.7121097
  Located on chromosome 10
  Distance between a terminus base of telomere on chromosomal short arm and 5'-terminus of this base sequence : 7393483
  Distance between 3'-terminus of neighbour sequence of sequence listing upward to telomere on chrosomal short arm and 5'-terminus of this base sequence : 217344
ggataactccaagatttctgacctgggcaagtgaaagaacagaattaagaattgttcttaactgggtcaaagaagagtggagcatgcacaaatttaagatagaagattgacatattatttaaggttctccagagagacagaaacaattgtgtgtgtgtgtgtgtgtgtgtgtgtgtgtgtgtgtgtgtgtgtctacagagaaagctctttattttgaaggaagtggcttgattatggagactggcaagtccaaaatctgcagggtgagcctgcaggcagagaccctgcaagaggcatgctgcaggtcaagtctgaaggccatctgctgcagaattccttcttgctcagggaaggtcgggttttgttctcgtcaggccttcaactgattggatgaggctctcccacagtaggggagggtaatccacttttctcagtctgcctatttacatgttaatc

SEQ ID NO: 15798 - DNA, 247 bp, Homo sapiens
  D10S1751
  Located on chromosome 10
  Distance between a terminus base of telomere on chromosomal short arm and 5'-terminus of this base sequence : 7536717
  Distance between 3'-terminus of neighbour sequence of sequence listing upward to telomere on chrosomal short arm and 5'-terminus of this base sequence : 142778
ggcttcttgtatagctggacagataatgttggcacctggatgaagggaaaaagaccacatatgcaatgctaaggtataatgaaagcaaggattccaagatagatgactcactactaatggctcaacagtctcttcctggcatagcactagtatatgacagtaagtacagcagtgtgtgtgtgtgtgtgtgtgtgtgtatgtgtgtgtgttggacagataaatcaactgtggcatatccctacaatag

SEQ ID NO: 15799 - DNA, 274 bp, Homo sapiens
  D10S1691
  Located on chromosome 10
  Distance between a terminus base of telomere on chromosomal short arm and 5'-terminus of this base sequence : 7652572
  Distance between 3'-terminus of neighbour sequence of sequence listing upward to telomere on chrosomal short arm and 5'-terminus of this base sequence : 115608
tgcctgctgagaaacagtgatgatcaacagtgataacagagaaaaaaagcaagtaagtgtgtgcgtgtgtgtgtgtgtgtgtgtgtgtgtgtgtgtgtgtgtgtgtgtctctttttggatcctgcacaaagaatactgcttgctagaacttctaaaaacttgagagaagatttctctttttttttttttaaataaatgaagcaactgctaagacagttggatcctcatcccatgcatccataccatttctctgaacattaccttcgtgtaagca

SEQ ID NO: 15800 - DNA, 440 bp, Homo sapiens
  chr10.fa.O7frz.7603434
  Located on chromosome 10
  Distance between a terminus base of telomere on chromosomal short arm and 5'-terminus of this base sequence : 7758461
  Distance between 3'-terminus of neighbour sequence of sequence listing upward to telomere on chrosomal short arm and 5'-terminus of this base sequence : 105615
cctaagatttagaaattagttccaccatgagtatattcattggaagcatctgtgcaaacaactcagaaaggaaccgtggccacctgcctagaatctgagctcacaactgcagagccaccccacaggcagggacagtcctcacggcacaaaggtcctcctgactcatccaactacccgatggccagagttactctaggagaaaagaaaaaaccacacacacacacacacacacacacacacacacacacacacacacacacaaatcacctagccaggggaagccacagctattcaaaggagggttaaggaaaaaagggaataccattgagtcacacaggaccagttcccagcgtgaagagtgaggcctgaatttttctaagaaaaatgttgattcctttccttcccaaatagaagagcctgtggttctccagttaatacca

SEQ ID NO: 15801 - DNA, 421 bp, Homo sapiens
  chr10.fa.O7frz.7709492
  Located on chromosome 10
  Distance between a terminus base of telomere on chromosomal short arm and 5'-terminus of this base sequence : 7846587
  Distance between 3'-terminus of neighbour sequence of sequence listing upward to telomere on chrosomal short arm and 5'-terminus of this base sequence : 87686
attcctttcagacatgaatgtatgagaaattcttaaacatatttttcacatctctcctttctttctttctctctctctctcccttccttcctaccttccttccttccttccttccttccttccttccttcttttctctctctctctgtctctgtctctctctttctttctttctttttggcagagtttcactcttgtaacccaggccggagtgcagtggtgtgatctcggctcactgcaacctcagcctcctgggttcaagcaattctcctgcctcagcctcccaagtagctgggattacaggcacccgccaccatgcctgacctcaggtgatgcacatgctttatcctcccaaagtgctgggattacaagcatgtgagccactgtgcccagctacatctctcctttcaagaactcattca

SEQ ID NO: 15802 - DNA, 439 bp, Homo sapiens
  chr10.fa.O7frz.7781196
  Located on chromosome 10
  Distance between a terminus base of telomere on chromosomal short arm and 5'-terminus of this base sequence : 8073038
  Distance between 3'-terminus of neighbour sequence of sequence listing upward to telomere on chrosomal short arm and 5'-terminus of this base sequence : 226030
ggcatgtcaatgaacttagtacatgtgattttcaacttatataaccagaaattcccaggaagccatcagaacactgggtcttctcttgcacaaacacagctgttgttctgaggacatagtatgattaacagagaattttcaggaagaacactgtgtcaataaaaattaatttgggttggcttcctatgaaatataccatatatatatatgtatatatatatatatatatgtgtgtgtgtatatatatatatatatatatatatatatatatatatatatatattagagagaggcattttttcacctttatttgcaatgtccaaaatagaaaaggatggtgctggaatgtctccttccttttggctcccagatccccaacctcaaatatctataatataaatatagtcactttgaagatagaaagtttgctttaactcct

SEQ ID NO: 15803 - DNA, 460 bp, Homo sapiens
  AL355374.5_140822
  Located on chromosome 10
  Distance between a terminus base of telomere on chromosomal short arm and 5'-terminus of this base sequence : 8190338
  Distance between 3'-terminus of neighbour sequence of sequence listing upward to telomere on chrosomal short arm and 5'-terminus of this base sequence : 116861
aaacagccagtatcatgtaattagggaagaaagagcaaagtgcaggctgactttagtgtaagaaagaaagaaaataagaaagcatatttatatttgcttgcaagttttgccataaagaaattctaggaaacataaaccatgaagaaaagtatttgcagggacggggtggtaagaggatgggaacacgacagatttgatctcaggaagggatgggttttgttttgttactgtattacatatttactgtattattttagtatttgattctttattgttgaccacagtgaatgtactacgtattcagggttaataaattaatttaaaactacagccaaaagaagaggaggaggaggaggaggaggaggaggaggaggagaagaatagctgacccctcaggtctctcttattgaagactttatctctcctgggtttgctgggtagatacaaaactcagtggctc

SEQ ID NO: 15804 - DNA, 460 bp, Homo sapiens; identical to SEQ ID NO: 15803
  AL158044.7_22311
  Located on chromosome 10
  Distance between a terminus base of telomere on chromosomal short arm and 5'-terminus of this base sequence : 8190338
  Distance between 3'-terminus of neighbour sequence of sequence listing upward to telomere on chrosomal short arm and 5'-terminus of this base sequence : -460

SEQ ID NO: 15805 - DNA, 405 bp, Homo sapiens
  chr10.fa.O7frz.8097503
  Located on chromosome 10
  Distance between a terminus base of telomere on chromosomal short arm and 5'-terminus of this base sequence : 8377561
  Distance between 3'-terminus of neighbour sequence of sequence listing upward to telomere on chrosomal short arm and 5'-terminus of this base sequence : 186763
gatcttgcagtgagctgagatcatgccattgcactccagcctgggcgacagagtgagactccatctcaataaataaataaataaataaataaataaataaataaataaataaataaataaataaaagagaagtgtgatgcctcttctacatatacacatcctgccttcagatcctgccatgtggattctgagtttcaggagggcagcggggatttctgaaatcatctgacatgggccttttcttcagtccattccagattgggggagaatagtagggacccatattccaacatcgccagttcctgaagtcaagtctgagatagggctgtccactgggcactggccgggtttcacctcctccattcctacctcatgtctttgctgttgataaagaaccttagacgc

SEQ ID NO: 15806 - DNA, 452 bp, Homo sapiens
  AL159172.9_86078
  Located on chromosome 10
  Distance between a terminus base of telomere on chromosomal short arm and 5'-terminus of this base sequence : 8501993
  Distance between 3'-terminus of neighbour sequence of sequence listing upward to telomere on chrosomal short arm and 5'-terminus of this base sequence : 124027
ttaacttgctacagaaactgaaacatttcataggtattttgcctacgttaaaagctaaacatcatgagctggacgtagtggcgtgcacctatactcccagctacttgggaggctgaggcaagaggattgattgagcctgggaactcaaggctacagtgagctgtcattgcactgctgcactccagcctgggggacagagtgagaccctgtctctaaaacaataaataaataaataaataaataaatttttaaaaagcaaaataacaacaatgacaaaaagaattttaagaatgactggtgaagttcacaagtgacatttaacatttttaaatgactgtatttaaaattttcaaatgacctatttttaatgctagggaaagatgctaacattaccagtgaaattcctaggctctgaacaactgcaacaaaggttgtgagtttgatacgtcatt

SEQ ID NO: 15807 - DNA, 356 bp, Homo sapiens
  chr10.fa.O7frz.8337078
  Located on chromosome 10
  Distance between a terminus base of telomere on chromosomal short arm and 5'-terminus of this base sequence : 8616670
  Distance between 3'-terminus of neighbour sequence of sequence listing upward to telomere on chrosomal short arm and 5'-terminus of this base sequence : 114225
cagatgttctacaatgagcatatattgctttagtaatcagagaaagaaaactctagcatgacattagccttctgtgtgctcaccagatccctctctttggggaaaacgaagaaaatggcttcctttctcctctgtgtgcaccatatctcacttcacacccagcgcaattcctggttctgtaatttttccttacagctcccacttaaaaccaaccaaccaaccaaccaaccaaccaaccatgccagcaaacaaatctgataatcgatctaaagtatttattggactcctatgatgggcttaatctctcaaactcctggatttttttttccttttctagacaggatcttgctctgttg

SEQ ID NO: 15808 - DNA, 265 bp, Homo sapiens
  D10S1779
  Located on chromosome 10
  Distance between a terminus base of telomere on chromosomal short arm and 5'-terminus of this base sequence : 8688285
  Distance between 3'-terminus of neighbour sequence of sequence listing upward to telomere on chrosomal short arm and 5'-terminus of this base sequence : 71259
gcatatctgtcccactcgatacatatataactttatatatgtatatataatatgtatataaataactttatatatgtatatactatatgtgtgtgtgtgtgtgtgtgtgtgtgtgtaattttgccctggatacaatgagatgtgattctatagatttcaacacgtagtgagtattgatgaagagttcagttctgaaaatatttattgatacttagtcctcgtgagtaaagcactgtacttgtgactggggtgtgctgaagacaga

SEQ ID NO: 15809 - DNA, 292 bp, Homo sapiens
  chr10.fa.O7frz.8506283
  Located on chromosome 10
  Distance between a terminus base of telomere on chromosomal short arm and 5'-terminus of this base sequence : 8781178
  Distance between 3'-terminus of neighbour sequence of sequence listing upward to telomere on chrosomal short arm and 5'-terminus of this base sequence : 92628
gcatgtgtactccttgaatttaaaataaatattgaaattatatacatatatacacacatacatgtatatatgtatatgcatgagtatatataaatatatataaatttttatataaatatataaatatatatatataaattatgtgtatatacacacatacatatgtatatatgtatgtgtgtgtgtgtatatatatatatatatatatataaaattcagaccagtaaaaaaagagaatatgttataaaaacaagttaatggcactgccaagacagaacagtctccttgaagt

SEQ ID NO: 15810 - DNA, 158 bp, Homo sapiens
  G08813
  Located on chromosome 10
  Distance between a terminus base of telomere on chromosomal short arm and 5'-terminus of this base sequence : 8897879
  Distance between 3'-terminus of neighbour sequence of sequence listing upward to telomere on chrosomal short arm and 5'-terminus of this base sequence : 116409
agcccaggactaaaacgttttagctgatagatagatagatagatagatagatagatagatagatagatagatagatatacatagatatatatatgatatatacatatatatatgacaaaagctagataaataaattcatgctgagaaaatgaagtccc

SEQ ID NO: 15811 - DNA, 186 bp, Homo sapiens
  D10S1712
  Located on chromosome 10
  Distance between a terminus base of telomere on chromosomal short arm and 5'-terminus of this base sequence : 9286229
  Distance between 3'-terminus of neighbour sequence of sequence listing upward to telomere on chrosomal short arm and 5'-terminus of this base sequence : 388192
gttcccatattaaagattggctgtgggccttccgaatgccaatgtatgcggatggatggcctaaggtccttaaccacaaatgttaatgctaagaatcatgatgatgatgtgtgtgtgcgtgtgtgtgtgtgtgtgtgtgtgtgtgatgagatacactgaaactgaaaacagcaggaaggtctaaac

SEQ ID NO: 15812 - DNA, 160 bp, Homo sapiens
  D10S226
  Located on chromosome 10
  Distance between a terminus base of telomere on chromosomal short arm and 5'-terminus of this base sequence : 9397892
  Distance between 3'-terminus of neighbour sequence of sequence listing upward to telomere on chrosomal short arm and 5'-terminus of this base sequence : 111477
tgtctcagtccagcaaacaccccaaaaaccacacacacacacacacacacacacacacggatacacacatgggaagaaatggacctgcatgaaagataaatggaaataaaatatgaaaggctttcattgctacattttttttaatgccacgaaggtcatg

SEQ ID NO: 15813 - DNA, 161 bp, Homo sapiens
  HUMUT459
  Located on chromosome 10
  Distance between a terminus base of telomere on chromosomal short arm and 5'-terminus of this base sequence : 9397895
  Distance between 3'-terminus of neighbour sequence of sequence listing upward to telomere on chrosomal short arm and 5'-terminus of this base sequence : -157
ctcagtccagcaaacaccccaaaaaccacacacacacacacacacacacacacacggatacacacatgggaagaaatggacctgcatgaaagataaatggaaataaaatatgaaaggctttcattgctacattttttttaatgccacgaaggtcatgcatt

SEQ ID NO: 15814 - DNA, 468 bp, Homo sapiens
  AL365269.14_108640
  Located on chromosome 10
  Distance between a terminus base of telomere on chromosomal short arm and 5'-terminus of this base sequence : 9474149
  Distance between 3'-terminus of neighbour sequence of sequence listing upward to telomere on chrosomal short arm and 5'-terminus of this base sequence : 76093
attgatgttactcttgaaatgaattttgacgtgtgaatttgggttcaactggtgcctctgccctccgttttggcctctgcatgccaattcccattgcagcatgtatcacattgtacttttggaacagaaatttatgtttgatcttccccggtaggccatggggcaccgtgtgtgttcaatacatagtttgatattgaatagattatgactttcctttttattaaaattatggatgttgtaatatatgttgatcttgtaatatctctatgtccttcccacaaatgtgtacacacacatgcatagacacaattttattgtatctatctgtctatctatctatctatctatctatcatcttcattctgaatattccagacatttcagggtgtatctgtaacctacctatgagtctggttttatgtctaatctatataaaataaaggaattaattctatttcaggccttgta

SEQ ID NO: 15815 - DNA, 185 bp, Homo sapiens
  D10S1720
  Located on chromosome 10
  Distance between a terminus base of telomere on chromosomal short arm and 5'-terminus of this base sequence : 9569387
  Distance between 3'-terminus of neighbour sequence of sequence listing upward to telomere on chrosomal short arm and 5'-terminus of this base sequence : 94770
acagcatgagggactacagttaagaatactgtattatatactgaaaatttgctgagagagtagatttcaggtgctatcaccacacacacacacacacacacacacacacacacacacacaaaggtaactatgtgagagatatggtaacttgattggctaaagtataataatttcacacatgcaaa

SEQ ID NO: 15816 - DNA, 178 bp, Homo sapiens
  Z66681
  Located on chromosome 10
  Distance between a terminus base of telomere on chromosomal short arm and 5'-terminus of this base sequence : 9609174
  Distance between 3'-terminus of neighbour sequence of sequence listing upward to telomere on chrosomal short arm and 5'-terminus of this base sequence : 39602
ctgggacattttcctgttctagttctcatttatatcttcttttttttttttcttttagggcagtgtgtgtgtgtgtgtgtgtgtgtgtgtgttgctactaaaaaaaaaataaaaagtggagtcctcagggaatatgtcacccttgtatgcatgcccaaccccactgaatgttgctata

SEQ ID NO: 15817 - DNA, 323 bp, Homo sapiens
  AL136453.3_54788
  Located on chromosome 10
  Distance between a terminus base of telomere on chromosomal short arm and 5'-terminus of this base sequence : 9609525
  Distance between 3'-terminus of neighbour sequence of sequence listing upward to telomere on chrosomal short arm and 5'-terminus of this base sequence : 173
ttctgtcatttaattccttacaactttagctctgtcatccttaaactatgaataatttctaactcatatggatactctaaaaacatgatgacaaggggttggaggagcaaagcaagtgcctctcactaggtagtgcataaagagtacttgtttcatgccacaggggagaggtaaatttttgtaccaaatgattgcagatcttttcttatctatatatctgtctatttttctatcatctatctttttctattatctatctatctatctatctatctatctatctatctatctatctatttttgttatccttaaggtggacaaat

SEQ ID NO: 15818 - DNA, 189 bp, Homo sapiens
  AL138770.3_17433
  Located on chromosome 10
  Distance between a terminus base of telomere on chromosomal short arm and 5'-terminus of this base sequence : 9670633
  Distance between 3'-terminus of neighbour sequence of sequence listing upward to telomere on chrosomal short arm and 5'-terminus of this base sequence : 60785
atcaggattacaggcttgaaccactgcacccaccctgcaaagtaaaatttttatttgtgtgtgtgtgtgtgtgtgtgtgtttgtattttacttaataccgacagattttgtactaaaaatatcatacattggaataaattttaattttctcccattaaacatatagtatttagctgtagaggaaacacg

SEQ ID NO: 15819 - DNA, 260 bp, Homo sapiens
  AL138770.3_20827
  Located on chromosome 10
  Distance between a terminus base of telomere on chromosomal short arm and 5'-terminus of this base sequence : 9673938
  Distance between 3'-terminus of neighbour sequence of sequence listing upward to telomere on chrosomal short arm and 5'-terminus of this base sequence : 3116
atgaccaagttgtaaatgaggttatttcttctgagacctctctcctttggtttgtcattttttccctgtgtcttcatatcattttccttctctctctctctgtctctctctctgtctctctctctctctgtctctctctctctctgtgtgtgtgtgtgtgtgtgtgtgtgtgtgtgtgtgtgtgtgtgtgtatgtcctgatgtctgcttataatgacaccagttatactggattttgttccatactaaggacctcattct

SEQ ID NO: 15820 - DNA, 148 bp, Homo sapiens
  G08780
  Located on chromosome 10
  Distance between a terminus base of telomere on chromosomal short arm and 5'-terminus of this base sequence : 9759094
  Distance between 3'-terminus of neighbour sequence of sequence listing upward to telomere on chrosomal short arm and 5'-terminus of this base sequence : 84896
agctcctgcgtactgagatactcaaatttccttgggtctcttattcctgatttgtacgttaaacacataataataataataataatatgttgggaacaaatattttgtttctttagtatcataggaccatggagggagaagaactgtg

SEQ ID NO: 15821 - DNA, 418 bp, Homo sapiens
  AL139127.3_118768
  Located on chromosome 10
  Distance between a terminus base of telomere on chromosomal short arm and 5'-terminus of this base sequence : 9759099
  Distance between 3'-terminus of neighbour sequence of sequence listing upward to telomere on chrosomal short arm and 5'-terminus of this base sequence : -143
ctgcgtactgagatactcaaatttccttgggtctcttattcctgatttgtacgttaaacacataataataataataataatatgttgggaacaaatattttgtttctttagtatcataggaccatggagggagaagaactgtgccctaggaatggtacttcacacatcatacccagaaggctaaactgttgctataacaggagacttgggaaaggtgagtgcatttttcaagaggacatggatcttgtagtccagagggtagactgtgggagacagaattctaaaatggccccccaaattcccaacacctggtgtctatgccctgtataatccctttcccttgagtgtgtttgggaaggacacatcatagctgtggctatgatggcatctctctgtaattaggttacattgtatggca

SEQ ID NO: 15822 - DNA, 361 bp, Homo sapiens
  AL138773.4_100150
  Located on chromosome 10
  Distance between a terminus base of telomere on chromosomal short arm and 5'-terminus of this base sequence : 9812276
  Distance between 3'-terminus of neighbour sequence of sequence listing upward to telomere on chrosomal short arm and 5'-terminus of this base sequence : 52759
acaatctttaagctgactatcaagtttccaaatccatttatctattggaaattatcccaattaattaactaaagagttggcagattaagaagaaaagctactcaatgttagctggagctgttttcttggaaagcagttaaactgtttctatctaatgaagggaatcgtcttgatcttaaccatatcattttttccctcggtctctcttagagtttcacacttgttctccagctatcttttatggtccaaggtcaagggccaattttcaggacaatgttccatgtcatgacccatcaaccaccaccaccaccaccaccttctcctgaaatcagagtagttcaggtagtcctagttaattgat

SEQ ID NO: 15823 - DNA, 447 bp, Homo sapiens
  AL138773.4_98759
  Located on chromosome 10
  Distance between a terminus base of telomere on chromosomal short arm and 5'-terminus of this base sequence : 9813812
  Distance between 3'-terminus of neighbour sequence of sequence listing upward to telomere on chrosomal short arm and 5'-terminus of this base sequence : 1175
aggacatgtgctaactttcactagaaccacatggacactgatattaataatgtgtccatagtcacaaatccacattggtaatagggctgtgggcaaaacctatttccaagggactccacgactaattaatatatatgtgtgtgtgtgtgtgtgtgtgtgtgtgtgtgtgtgtatttgagatggagtctcactcttgtcgcaaaggctggagtgtagcggcgtgatctcggcactctgcaacctccacctcctgtgttcaagtgattcttcttcctcagcctcttgagtagctgggattacaggcatgcaccaccacacctggcaaatttttgtatttttagtagagacagggttttgccatgttggacaggctgatcttgaactcctgacctcaggtgatccactcacgtcggcctcccaaagtgctaggattacaggcgttagtca

SEQ ID NO: 15824 - DNA, 355 bp, Homo sapiens
  AL138773.4_95861
  Located on chromosome 10
  Distance between a terminus base of telomere on chromosomal short arm and 5'-terminus of this base sequence : 9816660
  Distance between 3'-terminus of neighbour sequence of sequence listing upward to telomere on chrosomal short arm and 5'-terminus of this base sequence : 2401
caacatggtgaaatccaatctctactaaaaatacaaaaattagctgggcatggtgccacatgcctgaatcccagctacttgggaggctgaggcaggagaatcacttgaacctaggaggcagagtttgcagtgagccaagatcatgccactgcactccagcctgggcaacagagcaagactccatctcaaatgataataataacaataataataataataatatctaagcagctaagaagttttaatttatttttgttgtttatttctgatatctggaattttattcagattatgtgggtggtacgtctgtacatttttagaatgtattgaagttatctttgaacctaagcctatg

SEQ ID NO: 15825 - DNA, 369 bp, Homo sapiens
  AL139127.3_60230
  Located on chromosome 10
  Distance between a terminus base of telomere on chromosomal short arm and 5'-terminus of this base sequence : 9816996
  Distance between 3'-terminus of neighbour sequence of sequence listing upward to telomere on chrosomal short arm and 5'-terminus of this base sequence : -19
ctttgaacctaagcctatgaacaactcttgcaaatcttccattgctctaaaaaaatacaaactccttctttggttttaagttttatatgtaaatatttattatatcaagcttgttggtgatattatttaaatcttatttgaccttacttatgtttttaaatctgtttattaataaagaaacacattgaagcttcttcttctagtattattattattattattattattattattattattattattttctttaatttttactttaaggatacacatgcaggatgtgcgggtttgttacacaggtaaatgtgagccatggtggtttactgcacagatcatcccatcacctaggtattaagcctagcatcc

SEQ ID NO: 15826 - DNA, 379 bp, Homo sapiens
  AL138773.4_35929
  Located on chromosome 10
  Distance between a terminus base of telomere on chromosomal short arm and 5'-terminus of this base sequence : 9876613
  Distance between 3'-terminus of neighbour sequence of sequence listing upward to telomere on chrosomal short arm and 5'-terminus of this base sequence : 59248
tgttgactccttgatcttagatagtccagcctccagaactatgagaaataaagttctgttgtttataagatacctagtttatggtattttgttatagtagcctaaatagattaagacagatgggtagagaaatagaaatagagatatagaacaatgatagatagatagatagatagatagatagatagatagatagatagacagacaaacatagagagagagagacacagagagattgatagatattgaaagaaattggcttacatgattgtgagagttgcctaggcgagtccaaaatttatatagcaggcaattaccatggataagacagagacacttggggaggagatgaagctattatccactaatggaattcctt

SEQ ID NO: 15827 - DNA, 352 bp, Homo sapiens
  AL138773.4_11298
  Located on chromosome 10
  Distance between a terminus base of telomere on chromosomal short arm and 5'-terminus of this base sequence : 9901189
  Distance between 3'-terminus of neighbour sequence of sequence listing upward to telomere on chrosomal short arm and 5'-terminus of this base sequence : 24197
catcgtatgatcctcgaatctcacagtatctatgtatctataatcagatacatccctagactttccaggtatgagaatcaatcgtttattcttctttttcattaagttgttttgatttgatgtctttctttttcattaaggtgttttgatttgatgtcttgtcacctgcaactcctaaaaccctgagtaatacataaacctactgctgctatgctgctatctgaagttttaatttattattattattattattattgagacagggtctctctctgtcacccaggctggagtgcagtggcggatcacggctcactgcaactgctgcctctgggttcaaaggattcttatgcct

SEQ ID NO: 15828 - DNA, 140 bp, Homo sapiens
  D10S1649
  Located on chromosome 10
  Distance between a terminus base of telomere on chromosomal short arm and 5'-terminus of this base sequence : 9915314
  Distance between 3'-terminus of neighbour sequence of sequence listing upward to telomere on chrosomal short arm and 5'-terminus of this base sequence : 13773
cttctgcccactaaacaaataaataaagtaagcaaacaccaacaacaatgaatattaacaaacaatgcacgtgtgtgtgtgtgtgtgtgtgtgtgtgtgtgtgtgtgtgtgtgtgtttgcccaaagtatgcttcaagagc

SEQ ID NO: 15829 - DNA, 458 bp, Homo sapiens
  AL355591.3_103637
  Located on chromosome 10
  Distance between a terminus base of telomere on chromosomal short arm and 5'-terminus of this base sequence : 9980124
  Distance between 3'-terminus of neighbour sequence of sequence listing upward to telomere on chrosomal short arm and 5'-terminus of this base sequence : 64670
aaccatacaatgtaccagacaggaaaactccattttaaagcaattgccctagtatgcaatattcccttcttactcaactctattctcatcacttgaggtcaggggttccagaccagcctggccaacatggagaaaccccatctctactaaaaattagctgggcatggtggtgcaagcctgtaatcccagctacatgagaggcaaaggcaggagaatcgcttaaactcaggaggcagaggttgcaatgagccgagattgcgctactgcactccagcctgggtgaaagagcaagactccaactcaaaaataaaataaaataaaataaaataaaataaaataaaaggaatctaggcccctgcctccagcttctttatcatggacactcagctgtcttttctctggtatttgcccattcttcattaccctccacacatatcttgactggtcctagtatgtca

SEQ ID NO: 15830 - DNA, 315 bp, Homo sapiens
  chr10.fa.O7frz.9802162
  Located on chromosome 10
  Distance between a terminus base of telomere on chromosomal short arm and 5'-terminus of this base sequence : 10095202
  Distance between 3'-terminus of neighbour sequence of sequence listing upward to telomere on chrosomal short arm and 5'-terminus of this base sequence : 114620
tcatgttaaatcattaagccagtggctgagaggttaaagatatttttagaaatacaaggaaaagatttaacctttaacagaatttttcaataaaataaggtgagtaattaaagaaaaagaatgacaagggaagcagaacatatatatatatatatatatgtcatatcaagcaatgcagtatttcagatggacagatgaagaaaggagcttcagaagacaggttttcagaagacagtatttaactgaatatcaggtaaactggaacatttggagcaaaacaaacttaaccttataagtaggttgtagctagttcca

SEQ ID NO: 15831 - DNA, 473 bp, Homo sapiens
  chr10.fa.O7frz.9904907
  Located on chromosome 10
  Distance between a terminus base of telomere on chromosomal short arm and 5'-terminus of this base sequence : 10198003
  Distance between 3'-terminus of neighbour sequence of sequence listing upward to telomere on chrosomal short arm and 5'-terminus of this base sequence : 102486
aacctagatggtagagcctaatacactcctagactatatggtagagccttgtgtacctagactagaaatgtgtacagcatgtgactctgctgaatgctgtaggcaactgtaacataatggtatttgtgtatctaaacataaaaaggaacagtaaaaacatgatataaaagataaaaattgtatacctgtatagggcatttaccgtgaatggagcatgtcagattagaagctgccctggaggagtcatatatgtggttcattgttgaccagagtgccattatgccatgcatgactacatatatacatgaatatatatatctacacacacgtatacacaggtgtgtgtgtgtgtgtgtgtgtgtgtgtaatctccctctcaacacttcatttagctccatgcctctgtacaacttgggctacacagtacacagagacaaatgaggctttgacaatcatgcatttacagaatcaat

SEQ ID NO: 15832 - DNA, 365 bp, Homo sapiens
  chr10.fa.O7frz.10024615
  Located on chromosome 10
  Distance between a terminus base of telomere on chromosomal short arm and 5'-terminus of this base sequence : 10313355
  Distance between 3'-terminus of neighbour sequence of sequence listing upward to telomere on chrosomal short arm and 5'-terminus of this base sequence : 114879
attgaaatcaattgagaacattacaaaaaaaaagtacagatcaatacccctcacaaacacacacacacacacacacacacacacacacacacgtcttaacaaaattttgggaaattgaaaaaaatatatgaataaggcgatttaaacatctaagtagtgtttatcccaggaattcatggtttgtttaacattagaaaataaataatgtatcatatgagcagaataaaaagaaaaaatagccagatcatatcaatatatgcagaaaagaaattgacaatatctaacatctatttctaatatttaaaacaaacaaacaacatctcttagtaaactaagatcatgtagaatttccttaaattggtaca

SEQ ID NO: 15833 - DNA, 408 bp, Homo sapiens
  chr10.fa.O7frz.10117836
  Located on chromosome 10
  Distance between a terminus base of telomere on chromosomal short arm and 5'-terminus of this base sequence : 10414333
  Distance between 3'-terminus of neighbour sequence of sequence listing upward to telomere on chrosomal short arm and 5'-terminus of this base sequence : 100613
tgtccgtttatcaaatggtaccactaaaaaagtaaacaaaggccgggcgcggtggctcacgcctgttatcccagcattatgggaggccgaggcgggtggatcacctgaggtcaggagttctagaccagcctggccaatatggcgaaacaccgtctctactaaaaatacaaaaattagccaggcgtggtggcgggtgcctgtagttccagctactcgggaggctgaggtaggagaatggcttgaacccgggaggtggaagttgcagtgagctgaaatcgcgccactgctctccagcctgggcgacagagtgagacttcgtctcaataataataataataataataataataataagctgcagaatggaagacgatagagtaagtcctcacttatgtactaggttcttgg

SEQ ID NO: 15834 - DNA, 368 bp, Homo sapiens
  AL138775.6_26019
  Located on chromosome 10
  Distance between a terminus base of telomere on chromosomal short arm and 5'-terminus of this base sequence : 10603150
  Distance between 3'-terminus of neighbour sequence of sequence listing upward to telomere on chrosomal short arm and 5'-terminus of this base sequence : 188409
tacattaaactttggaagatggagtggaaaacataaaataattttccatgatgaatttttttaagaggtggcatctcactctgttacctatgctggggtgcagtggcatgatcatggctcactgcagcctagaactcctgagctcaagcatcctcctgcttcagcctcctgagcagctgagactataggtatgcgacaccatgcccagctaatttgtgtgtgtgtgtgtgtgtgtgtgtgtgtgtgtgtgtgtgtgtagatggagtcttgctatgttgcccaggctggtctcaaactcctgatctcaagttatcctcctgccatggcttcccaaagtgctgagataatagacacgagcatcactctag

SEQ ID NO: 15835 - DNA, 255 bp, Homo sapiens
  AL136318.13_23227
  Located on chromosome 10
  Distance between a terminus base of telomere on chromosomal short arm and 5'-terminus of this base sequence : 10715716
  Distance between 3'-terminus of neighbour sequence of sequence listing upward to telomere on chrosomal short arm and 5'-terminus of this base sequence : 112198
aatagtggctgagctgtaacagacttgtgaatttaatcaaccttaaaattagtatgagcatgtgtgtgtgtgtgtgtgtgtgtgtgtgtgcacgtgttgatatatctatttagagagtctccggtctcatacttttctcagattttcatccaccaagcagctttgtgaaacagatgctgtttatcatgtctttgccttctccaagttgatgttaattttagaagtcaatgagaaacatggaaagcttaaattctt

SEQ ID NO: 15836 - DNA, 295 bp, Homo sapiens
  AL136318.13_35980
  Located on chromosome 10
  Distance between a terminus base of telomere on chromosomal short arm and 5'-terminus of this base sequence : 10728301
  Distance between 3'-terminus of neighbour sequence of sequence listing upward to telomere on chrosomal short arm and 5'-terminus of this base sequence : 12330
aacagagttccagaattaggagaaagaaattagtgtatgatggtgtcatagaaccgggaataacagcatatagcctgctattcacaatacatgcatacctgtacatgtatatccatgtatgcatgcatgcctatatataaacacatacatatatatgtacctctcatatatatgtatgcatataggggtgtttttatttgtgtgtgtgtatagatagataggtaggtagatggatggatggatggatggatggatggatgaatgggtggtagggaggctttatgtcaatgtttct

SEQ ID NO: 15837 - DNA, 393 bp, Homo sapiens
  AL136318.13_51156
  Located on chromosome 10
  Distance between a terminus base of telomere on chromosomal short arm and 5'-terminus of this base sequence : 10743504
  Distance between 3'-terminus of neighbour sequence of sequence listing upward to telomere on chrosomal short arm and 5'-terminus of this base sequence : 14908
tttccaaggtttccttaagatatcattccaattttttaaagtcatactttttttgtaaatgtcttaattctcagggaagaccttatgagactataaatttaagttagcatataatcatgaaatctattaatcagtctttctgatgcagtaaaaagaaaaatatcttaaccttcatgctgcaagaaatgaaagattctttggacacacacacacacacacacacaccatatatatatatatatatatatatatatatatatatatatatatatatatatatggtgtgtgtgtgtgtgtgtatatgtatatatatatatatatacatatacacacacaactatagcacaatcacagacaagcagtctataacttctttggagaatttaggaactt

SEQ ID NO: 15838 - DNA, 403 bp, Homo sapiens
  chr10.fa.O7frz.10565679
  Located on chromosome 10
  Distance between a terminus base of telomere on chromosomal short arm and 5'-terminus of this base sequence : 10761214
  Distance between 3'-terminus of neighbour sequence of sequence listing upward to telomere on chrosomal short arm and 5'-terminus of this base sequence : 17317
aacctataagtcatgctccattgccactgtattttataatcttgtgcaatgatatttttattctaagccgtgacagcatggctgaatctgaaaccaacagggttatattgcaaatgttgccatttttcaaaatagctgtagtataaaagagaagttgatgagatagaaaaagggacatttaattttttaaaaaaagggctgtgtataatttgtattttataaactgtaattcaaacaatttactataaaattatctttgatttccaggtttctttgttttctttgggataaagtcaaagaaataggatataggggtgtgtgtgtgtgtgtgtgtgtgtgtgtgtgtgtgtacgtgtctaggaaataggttatgtttttgcagtaatctgatctcagaatgcaa

SEQ ID NO: 15839 - DNA, 246 bp, Homo sapiens
  D10S547
  Located on chromosome 10
  Distance between a terminus base of telomere on chromosomal short arm and 5'-terminus of this base sequence : 11045766
  Distance between 3'-terminus of neighbour sequence of sequence listing upward to telomere on chrosomal short arm and 5'-terminus of this base sequence : 284149
cccaatagtccacagggagaaatgtcagttaggcatactggttgtgtgtatgtcttattgatcagattttcaatacttccctcacccagatttcttaaacagatgtgtgtgtgtgtgtgtgtgtgtgtgtgtgtgtgtgtgtgtgtgtatatttttttttttgagatggagtctcgctctgtcacccaggctggaatgcaatggcgtgatctcggctcactgcaacctccgcctccgcctttcaag

SEQ ID NO: 15840 - DNA, 393 bp, Homo sapiens
  chr10.fa.O7frz.10883171
  Located on chromosome 10
  Distance between a terminus base of telomere on chromosomal short arm and 5'-terminus of this base sequence : 11114282
  Distance between 3'-terminus of neighbour sequence of sequence listing upward to telomere on chrosomal short arm and 5'-terminus of this base sequence : 68270
ttgtatcttgagaaagtccataagcaaagactaagatagaggccctgaagcaagaagcaaactgcattgcgcccagagtaaatgatgagaatatctcaggacacacagaaataaatctagactggacaagagctgttgacagagcctgcatggcaatgggttatttgttccttagtagggaggaatcaaaggttgataaatcacttgatcacctcttcagttcctgacaggactgaaaatctgtatgttcttattgtggaatttgggtccagttgttctcaacaaatctttttattattattattattattattattattatactttaagttttagggtacatgtgcacaatgtgcaggtttgttacatatgtatacctgtgccattaactca

SEQ ID NO: 15841 - DNA, 184 bp, Homo sapiens
  HUMUT5635
  Located on chromosome 10
  Distance between a terminus base of telomere on chromosomal short arm and 5'-terminus of this base sequence : 11217254
  Distance between 3'-terminus of neighbour sequence of sequence listing upward to telomere on chrosomal short arm and 5'-terminus of this base sequence : 102579
caccaccagatcaagaatcattagcattctcgaatcaacatgctatccactccccaaaacatgcacaaaactcgggtagcatgatttgtatgtatgtacgtatgtatgtatgtatgtatgtatgtatgtatgtgcgtatgtgtataaacaaataaaaaaatgtatatacactgcagagtttggg

SEQ ID NO: 15842 - DNA, 220 bp, Homo sapiens
  AL136319.8_95041
  Located on chromosome 10
  Distance between a terminus base of telomere on chromosomal short arm and 5'-terminus of this base sequence : 11268343
  Distance between 3'-terminus of neighbour sequence of sequence listing upward to telomere on chrosomal short arm and 5'-terminus of this base sequence : 50905
tgattgaacattaaatattgcagtagtccacatctgaggcttttcctccagtcgaatcactttttccaaattggatttatatgttaaggaagcaaagatcctgcagaaaacacacacacacacacacacacacacacacaccctcaaagtaattttattcattgcccatttagccaatatagaaaaacatggcttgctgtgactagttggattaccatgg

SEQ ID NO: 15843 - DNA, 270 bp, Homo sapiens
  AL136319.8_117097
  Located on chromosome 10
  Distance between a terminus base of telomere on chromosomal short arm and 5'-terminus of this base sequence : 11290404
  Distance between 3'-terminus of neighbour sequence of sequence listing upward to telomere on chrosomal short arm and 5'-terminus of this base sequence : 21841
cacaatttaaggccattatcatagaaagtttatgtctctttaattatcaagggtcacattttaaaaactttttctctaaaaatgaattccaatttccaaagctctgtgtgtgtgtgtgtgtgtgtgtgtgtgtgttaagatcaagagtgcatatgggattttgcttctctatttgtgcgtgtgtgtaactctgcaacagagtgattcacaaaaaaatatatactttagctcaaagttgcaagcattccaccattacttccaatccactta

SEQ ID NO: 15844 - DNA, 467 bp, Homo sapiens
  chr10.fa.O7frz.11108835
  Located on chromosome 10
  Distance between a terminus base of telomere on chromosomal short arm and 5'-terminus of this base sequence : 11370119
  Distance between 3'-terminus of neighbour sequence of sequence listing upward to telomere on chrosomal short arm and 5'-terminus of this base sequence : 79445
tatccaagaatcaccttaggacagcgttttagagctctgaatgccaggtgtactcaccgacaatttttgaagtttttgagcctcctacagacacagaaaactctgtgtgtgtgtgtgtgtgtgtgtgtgtgtgtgtgtgtgtatttttaaagtcagctctgtgaagaaaaaaatttagcaaaaagaaagatgtcatttcttacctttcatacttttgaggattcattctcatgcataaaacttttgtgataacgccttgtgtttacggcttatcttctctccaaagagctttaagccctgttagcattatggcacatagcccattctcatcaacctggttaatgtaaacgaagcaatagcagattcagttcaaaaccacagataatgttcaaaggcacctatgcttgatttgggaatgtacctggtatttttccttaccaactgtgttcattaaactgatgctgaag

SEQ ID NO: 15845 - DNA, 472 bp, Homo sapiens
  AL162408.4_122118
  Located on chromosome 10
  Distance between a terminus base of telomere on chromosomal short arm and 5'-terminus of this base sequence : 11500162
  Distance between 3'-terminus of neighbour sequence of sequence listing upward to telomere on chrosomal short arm and 5'-terminus of this base sequence : 129576
atcttggtaagtcaaatggattgtatttccccataaggaaattctgttttgttttgttttgttttgttttgttttgttttgttttgttttgttttgttttgttttgtgatgcagtcttgctctgttgcccaggctggagtgcagtgtcatgatctcggctcactgcagccttcgcctcctgggttcaagcaactctcctgcctcagcctcctgcctcagcctcccgagtagctgggattacaggcacacgccaccacgttcagctaatttttgtattttttagtagagatgaggtttcaccatgttggccaggctggtcttgaactcctgacctcaagtgatccacccacgttggcctcccaaagtgctgggattacagacatgagccaccgtgcccagccaggaaatagttttattcaaccctgaaaaaaatcttctcttatatttcacacttgaggctgtcatctttaac

SEQ ID NO: 15846 - DNA, 219 bp, Homo sapiens
  AL138769.7_17798
  Located on chromosome 10
  Distance between a terminus base of telomere on chromosomal short arm and 5'-terminus of this base sequence : 11591585
  Distance between 3'-terminus of neighbour sequence of sequence listing upward to telomere on chrosomal short arm and 5'-terminus of this base sequence : 90951
gaggaacatatgtaaggtgctaagattttattttggcaaggatatttttaaaaaatctatcatcagttttcatcataattttttaaagaagaaaacaactgtgtatgtgtgtttgtgtgtgtgtgtgtgtgtgtgtgtgtgtgtgttaataggaccgtcttttaacttaatgtcaatttatgaagaattgaccttgtctttatctcatttcatagtggc

SEQ ID NO: 15847 - DNA, 101 bp, Homo sapiens
  DISO7_10002814
  Located on chromosome 10
  Distance between a terminus base of telomere on chromosomal short arm and 5'-terminus of this base sequence : 11686007
  Distance between 3'-terminus of neighbour sequence of sequence listing upward to telomere on chrosomal short arm and 5'-terminus of this base sequence : 94203
ccaagctagttgcccttgttgttatcgattattatcttaaaccaaacacacacacacacacacacacacacacacaaagcaagcccagtagcctgtcagta

SEQ ID NO: 15848 - DNA, 172 bp, Homo sapiens
  DISO7_10002815
  Located on chromosome 10
  Distance between a terminus base of telomere on chromosomal short arm and 5'-terminus of this base sequence : 11739886
  Distance between 3'-terminus of neighbour sequence of sequence listing upward to telomere on chrosomal short arm and 5'-terminus of this base sequence : 53778
tggtctaccacatgcctgccttcccacccccatcctcatctctctctctctctctctctctctctctctctctctctctctctctctctgtgtgtgtgtgtgtgtgtgtaatccaaacaggcattggccctacagtccaaagggctaaaaagactcagaaatccatcctcat

SEQ ID NO: 15849 - DNA, 221 bp, Homo sapiens
  DISO7_10002817
  Located on chromosome 10
  Distance between a terminus base of telomere on chromosomal short arm and 5'-terminus of this base sequence : 11748808
  Distance between 3'-terminus of neighbour sequence of sequence listing upward to telomere on chrosomal short arm and 5'-terminus of this base sequence : 8750
aaagtctttcagtacagttgagtgtttctttatgattttaaacacactactgtgtgtgagtgagtgagagtgtgtgtgtatgtgtgtgagagagagagagagagagagagtgtgtgtgtgtgtgtgtgtgtgtgtgtgtgtgtgtgtgtgtaactaccattggcctttggggctttatctttggaaacagcaaaaatctcataccagtgtctcaaattatc

SEQ ID NO: 15850 - DNA, 161 bp, Homo sapiens
  DISO7_10002818
  Located on chromosome 10
  Distance between a terminus base of telomere on chromosomal short arm and 5'-terminus of this base sequence : 11764532
  Distance between 3'-terminus of neighbour sequence of sequence listing upward to telomere on chrosomal short arm and 5'-terminus of this base sequence : 15503
ctagaagtcagctgggcaggcagtggccacacacacacacacacacacacacacacacacacacacacacgagctggccctgccacagcaggggcatcggggcacctggcagcggctgtgcccaaggtgggaagccatgttcccttgcacaggtcctgaaa

SEQ ID NO: 15851 - DNA, 325 bp, Homo sapiens
  chr10.fa.O7frz.5469547
  Located on chromosome 10
  Distance between a terminus base of telomere on chromosomal short arm and 5'-terminus of this base sequence : 11824023
  Distance between 3'-terminus of neighbour sequence of sequence listing upward to telomere on chrosomal short arm and 5'-terminus of this base sequence : 59330
acagtggattagttaatgattgagaggaaacagccaatatttgatgctgttgtaaataccaaagaactaataaataatggggaaaactaaaaccttggctagctctgtacagacaatactcttcagagcaatttatgtaaatgtcaaacttgtctgttaccctgtttgtttgtcttacatagatttgctcatcacctactatatatattggtgtgtgtgtgtgtgtgtgtgtgtgtgtgtgtgtgtgtgtgtgtgtgtgtgtttttacatggacttgaaaatgagtaagacataatttttgtcctaaaggaacttggtatctggt

SEQ ID NO: 15852 - DNA, 140 bp, Homo sapiens
  DISO7_10000053
  Located on chromosome 10
  Distance between a terminus base of telomere on chromosomal short arm and 5'-terminus of this base sequence : 11854064
  Distance between 3'-terminus of neighbour sequence of sequence listing upward to telomere on chrosomal short arm and 5'-terminus of this base sequence : 29716
aaatgatgccaggcagagcaaaaataataataataataataataataataataataataatgaattccagattttctactccacagttcagtccgaggttgcgagacctggtgtgttttttccccagacaggaagtgagc

SEQ ID NO: 15853 - DNA, 443 bp, Homo sapiens
  AC026887.4_12044
  Located on chromosome 10
  Distance between a terminus base of telomere on chromosomal short arm and 5'-terminus of this base sequence : 11864491
  Distance between 3'-terminus of neighbour sequence of sequence listing upward to telomere on chrosomal short arm and 5'-terminus of this base sequence : 10287
caggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataac

SEQ ID NO: 15854 - DNA, 272 bp, Homo sapiens
  DISO7_10002819
  Located on chromosome 10
  Distance between a terminus base of telomere on chromosomal short arm and 5'-terminus of this base sequence : 11990420
  Distance between 3'-terminus of neighbour sequence of sequence listing upward to telomere on chrosomal short arm and 5'-terminus of this base sequence : 125486
agccttcaaagcatcagggggtgcaccatttttgccgtatgaaaaaaatgcacataaaagacacaaaatatacttattacttttagcatgttaaaaaacaatcacatcaaaaaagtatacagataaaaaatgtcataaatgacataagaaaatagtgcttgtgtgtatatatatattttttgcatatatatatatatatatatatatatatataaaaatctacagtatttaccactgttgatatatatattttggagcagctcagatactgc

SEQ ID NO: 15855 - DNA, 354 bp, Homo sapiens
  AC024984.3_133862
  Located on chromosome 10
  Distance between a terminus base of telomere on chromosomal short arm and 5'-terminus of this base sequence : 12110671
  Distance between 3'-terminus of neighbour sequence of sequence listing upward to telomere on chrosomal short arm and 5'-terminus of this base sequence : 119979
cctaaatgatcctaaccttcagccatggttcagaaccaccattctagaagaatgacataggaaaagctaactataaatgactatgtaaacatgaaaggtataaaatatcatgatttcactcgttggatggatggattgatggaggaatgaatggatgaatgacgaacggatagatgatggatggatggatggatggatggatggatggatggatgggggaggcacacaaaggaaaaatatcaaaatcttgtttggccctaaatataaaaagtacaagagtactggtataattctaaagcaaaattatactattattcagagcaaataatgttataagtaattcaaaccaacacc

SEQ ID NO: 15856 - DNA, 412 bp, Homo sapiens
  AC024984.3_67925
  Located on chromosome 10
  Distance between a terminus base of telomere on chromosomal short arm and 5'-terminus of this base sequence : 12158241
  Distance between 3'-terminus of neighbour sequence of sequence listing upward to telomere on chrosomal short arm and 5'-terminus of this base sequence : 47216
gttagattcagctggtaaagaatatatgaacagattgttattatcaaacgtggttgttatctaagtacagagctcggagccttgttgtaagtagctacgctcaggaccctagtccccctcttctctcgccacacctaaactctaaccccaagggattgacgtatgcctggcagcacccagggtctttccttcccaattcctgatctagctccgatgaaggaccacatttaccactccccacccgctaggagctcctgctcgtccagcttcacactatggaaagaaagcaattgcccccttgtcttccaactcctctcccctgccccctccacttatctcattattattattattattattattattattattattattattattatttttgagatggaatttcactcttgtt

SEQ ID NO: 15857 - DNA, 101 bp, Homo sapiens
  DISO7_10002822
  Located on chromosome 10
  Distance between a terminus base of telomere on chromosomal short arm and 5'-terminus of this base sequence : 12432254
  Distance between 3'-terminus of neighbour sequence of sequence listing upward to telomere on chrosomal short arm and 5'-terminus of this base sequence : 273601
atgtcacctcccacttgccctaatctcactgtatgtgtgcgcgcgcgtgcgcgcgcacacacacacacacacacacacacagatgtactgctgcctttcct

SEQ ID NO: 15858 - DNA, 168 bp, Homo sapiens
  Z67393
  Located on chromosome 10
  Distance between a terminus base of telomere on chromosomal short arm and 5'-terminus of this base sequence : 12671118
  Distance between 3'-terminus of neighbour sequence of sequence listing upward to telomere on chrosomal short arm and 5'-terminus of this base sequence : 238763
aattgcactgtgggactccagcctaggcaacagaggaggacctgtcacatacatacacacacacacacacacacacacacacacacacacagattgagatgtacaacgaagttgggggaaaaacacaccccaaggacctattcacttatcatgaaggctgcctgacct

SEQ ID NO: 15859 - DNA, 182 bp, Homo sapiens
  chr10.fa.O7frz.12581615
  Located on chromosome 10
  Distance between a terminus base of telomere on chromosomal short arm and 5'-terminus of this base sequence : 12842564
  Distance between 3'-terminus of neighbour sequence of sequence listing upward to telomere on chrosomal short arm and 5'-terminus of this base sequence : 171278
tgtaggaaagtgatactcttcaagtaattcaaatgaaaaaagttgcaagtagaatcctttgtatcattttctcctgtctgtgtgtatttaaaatacacacacacacacacacacacacacacacacacacactctctgtctctttatagatacttacatattcataggataaatctggaaag

SEQ ID NO: 15860 - DNA, 481 bp, Homo sapiens
  AL158079.11_95168
  Located on chromosome 10
  Distance between a terminus base of telomere on chromosomal short arm and 5'-terminus of this base sequence : 13151024
  Distance between 3'-terminus of neighbour sequence of sequence listing upward to telomere on chrosomal short arm and 5'-terminus of this base sequence : 308278
tgattctgatctggaacaataggtctaaaaggcacctgtctgtttcctagacggtctcaagccaagtaccactgacttcactttttgctgtgttttatcttccttccttccttccttccttccttccttccttccttccttcctttttttttttcaggtctctctttgtcaccctggctggagtgcagcggtgcaatcacagcttactgcagcctcagccacccagcccaagtgatcctcccacctcagcttcgtgagtagctgggacaataggcatgcaccaccatggcaggataatttttgaatttttttctggtagagatggggttttacctttttggccaggctggtctggaactcctggtcttaagtgatcctcctgccttggcctcccaaagtgctgggattacaggcatgagccatggaaccccagcttttcagtgttttaaaaccagcctttaatattgtgctgacgtgacac

SEQ ID NO: 15861 - DNA, 202 bp, Homo sapiens
  D10S1705
  Located on chromosome 10
  Distance between a terminus base of telomere on chromosomal short arm and 5'-terminus of this base sequence : 13156825
  Distance between 3'-terminus of neighbour sequence of sequence listing upward to telomere on chrosomal short arm and 5'-terminus of this base sequence : 5320
tttgtcccttggaatgtatgttcttgggttgggggaagtctttataggttttcagatcattttccttgctttagtgtttcctgtcacgaggacaccccccccccaaccctgcactctctctctctctttctctctctcacacacacacacacacaccactgtgttatgtaattacatagaaagtgctcaaactgttcattcg

SEQ ID NO: 15862 - DNA, 146 bp, Homo sapiens
  G08815
  Located on chromosome 10
  Distance between a terminus base of telomere on chromosomal short arm and 5'-terminus of this base sequence : 13323090
  Distance between 3'-terminus of neighbour sequence of sequence listing upward to telomere on chrosomal short arm and 5'-terminus of this base sequence : 166063
cagactccagaaaacagaaccaataggatcaatctaccctatatctatgtatctatgtatctacctatgtatctatctatctatctatctatctatctatctatctatctatcgagagatttattttaaggaattggtccactcca

SEQ ID NO: 15863 - DNA, 466 bp, Homo sapiens
  chr10.fa.O7frz.13342691
  Located on chromosome 10
  Distance between a terminus base of telomere on chromosomal short arm and 5'-terminus of this base sequence : 13501608
  Distance between 3'-terminus of neighbour sequence of sequence listing upward to telomere on chrosomal short arm and 5'-terminus of this base sequence : 178372
agaagctggatttgacttagagtcagagatgcagaccataatgacaacactgctgggttttggcttttttattttatttatttatttatttatttatttgagacggagtctcactctgtcgccaggctggagtgcagtggcacaatcttggcttactgcaacctccgcctcccaggttaaagcaattctcctgcctcagcctcctgagtagctgggactacaggcacgtgccaccactcccagctaattttgttgtatttttagtagggacagggtttcaccatgttggccaggatggtctggatctcttgacttcatgatctggccacctcggcctccccaagtgctgggattgcaagcgtgagcaaagtgctgggattacaggcatgagccactgcccctggcctggctttttgatttttaaagttaggccagcccctcatcctgatgaataactccaggaagt

SEQ ID NO: 15864 - DNA, 161 bp, Homo sapiens
  Z66637
  Located on chromosome 10
  Distance between a terminus base of telomere on chromosomal short arm and 5'-terminus of this base sequence : 13541176
  Distance between 3'-terminus of neighbour sequence of sequence listing upward to telomere on chrosomal short arm and 5'-terminus of this base sequence : 39102
gatgtggaaactaaggctcaaagagataaagtgacttgtccaagatcccaggtaaagtttccaaagaaatcagaactaacatctagttcttctgatatgtatgtgtgtgtgtgtgtgtgtgtgtgtgtgtgtgtgtgtgtttctactgcaatttgctgttc

SEQ ID NO: 15865 - DNA, 291 bp, Homo sapiens
  D10S570
  Located on chromosome 10
  Distance between a terminus base of telomere on chromosomal short arm and 5'-terminus of this base sequence : 13546242
  Distance between 3'-terminus of neighbour sequence of sequence listing upward to telomere on chrosomal short arm and 5'-terminus of this base sequence : 4905
gcattcatccaacaagcatataatgagcacattctgtgagtcaggcactgttgttggtaggcagggcagatgcaccattctgggaagtagagcaggaaaccaaacagaagggggacaggaggccaaggtggaggaattgcttgaggctaggagttcgagaccagcctgggcaacaaagtgagaccctgtctctattaacacacacacacacacacacacacacacacacacacacacgtttgtatgtatatacataaaacagacagggactctgtgcccatggaactaatt

SEQ ID NO: 15866 - DNA, 253 bp, Homo sapiens
  HUMUT1729
  Located on chromosome 10
  Distance between a terminus base of telomere on chromosomal short arm and 5'-terminus of this base sequence : 13551972
  Distance between 3'-terminus of neighbour sequence of sequence listing upward to telomere on chrosomal short arm and 5'-terminus of this base sequence : 5439
ggggccatactggaaagcaagatagatgtgaagatgatagtaggatggatgggtgggtgggtagacggacggacggacggacggacggacggacagatagatagatagatagatagatagatagacagacagatagatagattttaaatttactcatggagaaaccagtgcagagaagctaagtcatctctaggcatcacagcgaaagcacttccgaggaagaagaataaaagtcagcattgtcctttagcct

SEQ ID NO: 15867 - DNA, 434 bp, Homo sapiens
  AL353586.6_57266
  Located on chromosome 10
  Distance between a terminus base of telomere on chromosomal short arm and 5'-terminus of this base sequence : 13551976
  Distance between 3'-terminus of neighbour sequence of sequence listing upward to telomere on chrosomal short arm and 5'-terminus of this base sequence : -249
ccatactggaaagcaagatagatgtgaagatgatagtaggatggatgggtgggtgggtagacggacggacggacggacggacggacggacagatagatagatagatagatagatagatagacagacagatagatagattttaaatttactcatggagaaaccagtgcagagaagctaagtcatctctaggcatcacagcgaaagcacttccgaggaagaagaataaaagtcagcattgtcctttagcctctcacagcaatggccttctccttatgaaacattctttgtcactgtaaatttccccactgagcccgggtagccagcagagagggtgctatgacctgcctgtttgggtccccctaaaatgcccatgttgaagctctaccctgcaatgtgatggcatcagaggtaattatgaaggtaactgagtcatg

SEQ ID NO: 15868 - DNA, 447 bp, Homo sapiens
  AC013446.3_80754
  Located on chromosome 10
  Distance between a terminus base of telomere on chromosomal short arm and 5'-terminus of this base sequence : 13635501
  Distance between 3'-terminus of neighbour sequence of sequence listing upward to telomere on chrosomal short arm and 5'-terminus of this base sequence : 83091
aaagtcacctagaaactccaagtcatattccagaagcttttaaaatgagaaattgggccaggcacgatggcatatgcctgtaataccagcactttgggaggccaaaggcaggcaaatcacctgaggttaggagttcaagaccagcctgaccaacatggtgaaaccccgtctctactaaaaattcaaaacttagctcagcgtggtggtgggtacctgtaaccccagctactcaggaggctgagacatgagaatctcttgaacccgggaggcagaggttgcagtgagccgagatcacaccaccgcactccagcctgggtaaaagaatgagactctgtctcaaaaataaataaaataaaataaaataaggaatggcataaaccagtttggtgtggtttctcattcaggagaactgcagtgatgtagtagaaagaactccaactttgaatc

SEQ ID NO: 15869 - DNA, 476 bp, Homo sapiens
  chr10.fa.O7frz.13512213
  Located on chromosome 10
  Distance between a terminus base of telomere on chromosomal short arm and 5'-terminus of this base sequence : 13766491
  Distance between 3'-terminus of neighbour sequence of sequence listing upward to telomere on chrosomal short arm and 5'-terminus of this base sequence : 130543
acattatgactttctgaccactagagccatcccacagtggaacagacagtgcctgctaaggtcactgcactcgtgctctgtcattgaaatactcaagcctgctctataggatcatgtgccatcgaaaccagacaagacattcttgcattgaatatattggtctggatcatttctaaggccaactcagcaatcagatgtatgctcgtgtttacaaggtcaggtcattactagaattacttgatctctggaatttaaatgtatatacacacacatgcacacacacacacacacacacacacaatcaggaattgagatagcagatctgggaataaaatctaggggacttgcttttggccatccatctactaggcagtcctcagtcttcctcattggtggaatcttgacaaatcctgtgctcaattaattcatccttccatcattaaatatcacttttgcctagaaataacatacttcac

SEQ ID NO: 15870 - DNA, 446 bp, Homo sapiens
  AL138764.8_116541
  Located on chromosome 10
  Distance between a terminus base of telomere on chromosomal short arm and 5'-terminus of this base sequence : 13823063
  Distance between 3'-terminus of neighbour sequence of sequence listing upward to telomere on chrosomal short arm and 5'-terminus of this base sequence : 56096
gtactgatcagaattagtcaaggaatttctgcataatggctaagaataaatctatgacgaatcttttttttttaataactagatgtagtgatgcatttatttatttatttatttatttatttatttatttatttagacagagtctggctctgtcgccaggctggagtgcagtggcgagatctcggctcatcactgcaatcgccacctcccaggttcaagcgattctccgcctcagcctcccaagtagctgggattacagacgcgcaccactacgcccagctaatttttgtgttgtgtgtgtttttagtagagatggggtttcaccatgttggccaggctggtctcgaactcctaacctcgtgatccacccacctcggcctcccaaagtgctgggattacaggggtgagccaccgtgcccggccttagtgccgtatgtttaaaagta

SEQ ID NO: 15871 - DNA, 419 bp, Homo sapiens
  chr10.fa.O7frz.13852297
  Located on chromosome 10
  Distance between a terminus base of telomere on chromosomal short arm and 5'-terminus of this base sequence : 14043486
  Distance between 3'-terminus of neighbour sequence of sequence listing upward to telomere on chrosomal short arm and 5'-terminus of this base sequence : 219977
cataaattaccttgatcagcttcctttctgagagcaaacattaactgggaggagaaagtaaattcttccgggcacggtggctcacgcctgtaatcccagcactttggcgagcggatcaactgaggtcgggagttcgagaccagcctgaccaacatggagaaacctcgtctctactaaaaatgcaaaattagccaggcgtggtggcgcatgcctgtaatcccagctactcaggaggctgaggcaggagaatcacttgaacccaggaggcggaatttgcagtgagccgagattacaccattgcactccattatgggcaacaagagcaaaactccatctcaaaaagaaagaaagaaagaaagaaaatatagatgagtgaagcctctgcatggtctggattcatgtttgaggcatgtcctaca

SEQ ID NO: 15872 - DNA, 415 bp, Homo sapiens
  AL359172.13_63870
  Located on chromosome 10
  Distance between a terminus base of telomere on chromosomal short arm and 5'-terminus of this base sequence : 14218812
  Distance between 3'-terminus of neighbour sequence of sequence listing upward to telomere on chrosomal short arm and 5'-terminus of this base sequence : 174907
aagtaagctcacggcctagctcactgtggcatgttttaaaggatggaacacatcctttaaaggatggcacagtggctcacacctgtaatcccagcactttgggaggctgacgtgggtggatcacccgagatctggaatttgagaccagcctggccaacatggtgaaagcctgtctctactaaaaacacaaaagttagctgggcgtggcagcgcgcgcctgtagttccagctactcggaggctgaggcaggagaatcacttgaacctgggaggcggaggttgcagtgagccaaggttgtgccactgcactccagcctgggcaacagggtgagactccatctcaaaacaaacaaacaaacaaacaaacaacaactaaaaggatggaacacagaaaactgcagtaactgcagaagtct

SEQ ID NO: 15873 - DNA, 127 bp, Homo sapiens
  D10S1725
  Located on chromosome 10
  Distance between a terminus base of telomere on chromosomal short arm and 5'-terminus of this base sequence : 14274907
  Distance between 3'-terminus of neighbour sequence of sequence listing upward to telomere on chrosomal short arm and 5'-terminus of this base sequence : 55680
cttatgggaccactgttgtgtatgtggtccactgttgactgaaacaccatgatgttgcacatgactctgtgtgtttgtgtgtgtgtgtgtgtgtgtgtgttcccagagaaacctgactaatacaatg

SEQ ID NO: 15874 - DNA, 288 bp, Homo sapiens
  AL365495.4_107067
  Located on chromosome 10
  Distance between a terminus base of telomere on chromosomal short arm and 5'-terminus of this base sequence : 14479893
  Distance between 3'-terminus of neighbour sequence of sequence listing upward to telomere on chrosomal short arm and 5'-terminus of this base sequence : 204859
gctgtaatcatgccactacactccagcctggtgacagagagaccctgcctcaaataaacaaacaaacaaacaaacaaacaaaacctaacaacaacaaactcactaaccatgaggacatgacctaccttcttaataaacttctaagtcttctaagtgcacaacactctctcattatacatagctcacatgttaaagacaaagagaagcctggagtccatcagcatgccagaataatacacaatttaattgatatcctatgtctggtgtcaagcttaagcacaaatatcc

SEQ ID NO: 15875 - DNA, 182 bp, Homo sapiens
  D10S1707
  Located on chromosome 10
  Distance between a terminus base of telomere on chromosomal short arm and 5'-terminus of this base sequence : 14505133
  Distance between 3'-terminus of neighbour sequence of sequence listing upward to telomere on chrosomal short arm and 5'-terminus of this base sequence : 24952
aagccttatagcactaaacaatggtttgcagttcaaggtgctcttggtcatatattgaccgctgctggctgcttataatgtgtgtgtgtgtgtgtgtgtgtgtgtgtgtgtgttgtgtggtgaggggagtgggaagaggtgaggctggacagttaagcagaagtcacatcatgcaagtcacg

SEQ ID NO: 15876 - DNA, 467 bp, Homo sapiens
  AL365495.4_47022
  Located on chromosome 10
  Distance between a terminus base of telomere on chromosomal short arm and 5'-terminus of this base sequence : 14571315
  Distance between 3'-terminus of neighbour sequence of sequence listing upward to telomere on chrosomal short arm and 5'-terminus of this base sequence : 66000
agatttaagctgcctttcattcagtagttttaattttgtttctccaagttttgctaaagcccattctgcaattaatttagaacctttccatatatataaatataaatatatatatgtatttagcttaccacacacaaatactatctatctatctatctatctatctatctatctatctatctatctatgtatacatagatacacgcactatcaatgcctagataaatagtgcgtgtatctatctatgtataggtagtgtgtatatctctcagtgtgtagatagattgtgtgtgtatctatgtataggtagatagtgtgtgtatctatagatggattttgtgcaagtgtgtgtgtgtgtgtgtgtgtgtgtgtgtgtgtgtgtgtgtgttaagctaaatcctctgtgaagcaactggtactctggcaagaagtctttgggggaagtcatgtcaagacatcttaggttt

SEQ ID NO: 15877 - DNA, 387 bp, Homo sapiens
  AL157896.2_78544
  Located on chromosome 10
  Distance between a terminus base of telomere on chromosomal short arm and 5'-terminus of this base sequence : 14903304
  Distance between 3'-terminus of neighbour sequence of sequence listing upward to telomere on chrosomal short arm and 5'-terminus of this base sequence : 331522
agctttctggtctaggtaacagacagagtgagaccccatctcaaaaataaataaaaaaaaagaaagaggagaaggaggaggagaaggggggcaagaaagaggaggaggaggaagagaagtaggaagaggaagaggagtaggaggaagaggaggatgaagaagaggaaaaggaggaggaggtggaagaggatgaggaagaagaggaagaggagcaggaggaagaagagaagaaggaagagaaggaagaagagggaggaggagaaagaggaggaggaggaggaggaggaggaggaggaggaggtagccttctattccagaaaaatacccaccatgtggatgaagaggaaaaaacaaatacatgatatcttgaagaaaggaagtaacagg

SEQ ID NO: 15878 - DNA, 327 bp, Homo sapiens
  AL157896.2_62849
  Located on chromosome 10
  Distance between a terminus base of telomere on chromosomal short arm and 5'-terminus of this base sequence : 14919106
  Distance between 3'-terminus of neighbour sequence of sequence listing upward to telomere on chrosomal short arm and 5'-terminus of this base sequence : 15415
tcttaggtaacgcatttgaaccaagaacagtgatctgtaacaacccacagggcagctcatccagggcaggaggcgaggggggctgagccggagcatccagccgctttgggctctgtagcttgttctctccagagctgagagcactgttgcgtttgttcgttcattcattcattcattcattcattcattcgttcatcattccttcctctcttaagaagtgggactcccacaggaatggatctagttgacaccattactgagctgcttttctggtctgtgtacagaaagctgaaaaagaaatcccactgcgtggagtacttctaaata

SEQ ID NO: 15879 - DNA, 188 bp, Homo sapiens
  D10S1664
  Located on chromosome 10
  Distance between a terminus base of telomere on chromosomal short arm and 5'-terminus of this base sequence : 15006601
  Distance between 3'-terminus of neighbour sequence of sequence listing upward to telomere on chrosomal short arm and 5'-terminus of this base sequence : 87168
aaacgtaataacttaggtgctccaacccagcctctgttatttcaatgtgactccatttctcaccacaccaaacacacacacacacacacacacacacacacacacacacacacacacctcattttccctagttcccctctctctgcttctctgtctccctctccacctctctttacctgtcttcagca

SEQ ID NO: 15880 - DNA, 163 bp, Homo sapiens
  D10S1209
  Located on chromosome 10
  Distance between a terminus base of telomere on chromosomal short arm and 5'-terminus of this base sequence : 15147171
  Distance between 3'-terminus of neighbour sequence of sequence listing upward to telomere on chrosomal short arm and 5'-terminus of this base sequence : 140382
aggctctcgatcagtgtttgttgaatgaatgaatgaatgaatggagaatgaatgaatgagggtctaccttctttaccagtcacaatccatgtttctttttgatccgttgaatgataactctttctagtctcatttatctctttctaccacttgtgcccctcta

SEQ ID NO: 15881 - DNA, 140 bp, Homo sapiens
  D10S191
  Located on chromosome 10
  Distance between a terminus base of telomere on chromosomal short arm and 5'-terminus of this base sequence : 15262393
  Distance between 3'-terminus of neighbour sequence of sequence listing upward to telomere on chrosomal short arm and 5'-terminus of this base sequence : 115059
ctttaattgccctgtcttctttcaaatctattaccactactgtaaaacacacacacacacacacacacacacacacacacacacacacagagagagagagagagagaaagagagagagattggggaagtggtcgaattaa

SEQ ID NO: 15882 - DNA, 279 bp, Homo sapiens
  AL157706.6_26527
  Located on chromosome 10
  Distance between a terminus base of telomere on chromosomal short arm and 5'-terminus of this base sequence : 15321142
  Distance between 3'-terminus of neighbour sequence of sequence listing upward to telomere on chrosomal short arm and 5'-terminus of this base sequence : 58609
agctattcagaagtctgaggtaggcgaatcatttgaacccgggaggcggaggctgcagtgagggaagatcacgcaattgcactccagcctaggcaacagtgcaagactacatctcaaaaacaacaacaacaacaacaacaaaaagccactgagttagaaagcagtgaacagtgggaaaactctcacaaaattatggctttctgtactatgtgatattagtaaaactggcacaattggaaccaaacatttacagtagtattctgtggcattagaattcta

SEQ ID NO: 15883 - DNA, 385 bp, Homo sapiens
  chr10.fa.O7frz.15151962
  Located on chromosome 10
  Distance between a terminus base of telomere on chromosomal short arm and 5'-terminus of this base sequence : 15496076
  Distance between 3'-terminus of neighbour sequence of sequence listing upward to telomere on chrosomal short arm and 5'-terminus of this base sequence : 174655
tgtggtagtgcattcctataatcccagctactctggaagctgaggcaggaggattacttgagcctggagaggtcgaggctgcagtgagctgagcttgcaccacagcactccagcctgggtgacagactctgcctcaaaaaaagaaatagaaagaaaaaaagaagaaagaaagacaaaaggaaggaaggaaggaagggagggagggagggagggagggagagagacacctgtcatctcagatccagcacatgtatccaatatcctccatgtgacccatccttctcctcctgcctattgattgatcacaccaatgggtaatgggttcccttgccctctggcttctcactggattcagtcgatggagatcactagcagatctaagtga

SEQ ID NO: 15884 - DNA, 397 bp, Homo sapiens
  chr10.fa.O7frz.15336316
  Located on chromosome 10
  Distance between a terminus base of telomere on chromosomal short arm and 5'-terminus of this base sequence : 15674409
  Distance between 3'-terminus of neighbour sequence of sequence listing upward to telomere on chrosomal short arm and 5'-terminus of this base sequence : 177948
cctaccttggtagttaggtaagtggaatgggagaattatattttttggttcatgctaaatgcacattattgtgtacgttttacagatgattaagaagttggcctgtgatagcaaataccctttattttcttggtcaagctagggtttctcctcacgttggtttcatttctgagcccatgacatgctcttcccattgtgccatgctgcctctgagacaagataggtttgcttttttaaaataccgcgtgcatatcttatactatgtgaccctctgtatgctttacagagagtgaagtagagccacgttatttacttagaaacatgtctgagaaatgcagttgcattcacacacacacacacacacacacacggactgcagaacagtatttgtattaca

SEQ ID NO: 15885 - DNA, 287 bp, Homo sapiens
  HUMUT7460
  Located on chromosome 10
  Distance between a terminus base of telomere on chromosomal short arm and 5'-terminus of this base sequence : 15997420
  Distance between 3'-terminus of neighbour sequence of sequence listing upward to telomere on chrosomal short arm and 5'-terminus of this base sequence : 322614
actggctctccttgctcctcagactgcagatggcctattgtgggaccttatgatcatgtgaattaatacttaataaactcccctctatctatctatctatctatctatctatctatctatctatctatccatccatccatcccattagttctgtccctctagagaaccctgaccaatacacctaccatataatgccaagagttcgccactgcctggcttggctctagtttctcataagtgaccagagagaggggaaaggctcacagtcactagaggtggaagggatg

SEQ ID NO: 15886 - DNA, 395 bp, Homo sapiens
  AL157391.6_85004
  Located on chromosome 10
  Distance between a terminus base of telomere on chromosomal short arm and 5'-terminus of this base sequence : 15997463
  Distance between 3'-terminus of neighbour sequence of sequence listing upward to telomere on chrosomal short arm and 5'-terminus of this base sequence : -244
gaccttatgatcatgtgaattaatacttaataaactcccctctatctatctatctatctatctatctatctatctatctatctatccatccatccatcccattagttctgtccctctagagaaccctgaccaatacacctaccatataatgccaagagttcgccactgcctggcttggctctagtttctcataagtgaccagagagaggggaaaggctcacagtcactagaggtggaagggatgggcagagaccaatggtgatgctgaaagcaacaggagatgtccacgctgcaggtcagggatgccacgtttatctgatgaagcgacatttagaaacgggaagagtgttttgcaagcttatggtggtatcctctatgagttaccttggaaagct

SEQ ID NO: 15887 - DNA, 245 bp, Homo sapiens
  AL157391.6_162513
  Located on chromosome 10
  Distance between a terminus base of telomere on chromosomal short arm and 5'-terminus of this base sequence : 16017527
  Distance between 3'-terminus of neighbour sequence of sequence listing upward to telomere on chrosomal short arm and 5'-terminus of this base sequence : 19669
gaggttagaaagacagatggaccttgggtacttgactttctataatgtttaattctaataaagtccagccatactttattttcagataacctattgtatatttaaataaaacctccttaaaatatttatttatttatttatttatttatttattgagacagagtctcactgtcgcccaggctcactggagtacagtggcacaatctcggctcactgcagtatgtgcttataaagtgatctccatc

SEQ ID NO: 15888 - DNA, 243 bp, Homo sapiens
  DISO7_00002489
  Located on chromosome 10
  Distance between a terminus base of telomere on chromosomal short arm and 5'-terminus of this base sequence : 16280327
  Distance between 3'-terminus of neighbour sequence of sequence listing upward to telomere on chrosomal short arm and 5'-terminus of this base sequence : 262555
catacatcgctttcactcctcatctctctctctctctctgtctctctctctctcacacacacacacacacacacacacacacacacacacacactgcatacttcatggagataacttatcccatgggggactgacctagttctgcctgctcccagcgcccctccctcactttcttgcaccatgtgctctggtccgggctgtcctcagagcattcactctggtctcctggattctaatcttcca

SEQ ID NO: 15889 - DNA, 438 bp, Homo sapiens
  chr10.fa.O7frz.16095240
  Located on chromosome 10
  Distance between a terminus base of telomere on chromosomal short arm and 5'-terminus of this base sequence : 16406770
  Distance between 3'-terminus of neighbour sequence of sequence listing upward to telomere on chrosomal short arm and 5'-terminus of this base sequence : 126200
gcagctcattacagcagagtgatcctcctgctttagcctcccaaatagctaggactacaggcacatcctgctgcacctgctgaatttcatttttgtaaagacagcatcttgctatgttgccaaggctggtcctgaacacctgggctcaagtgatcctcctgcctcagcctcccaaaacattgagattacaggtgtaagtcactgtgcctggccaagtctccttatctgttggctatatatatatatatatatatatatgtatatatatatatatatatgtatgtaaaatgtttatggatgtggaaaaataagttaatgcataaataaatggaaaaataacagtaaacaggtggtaacactattatttaaaatgctcttctttatgtttttacatgttgcttgatatattcttatgatagcatttagcgttcttaacat

SEQ ID NO: 15890 - DNA, 203 bp, Homo sapiens
  D10S1653
  Located on chromosome 10
  Distance between a terminus base of telomere on chromosomal short arm and 5'-terminus of this base sequence : 16481655
  Distance between 3'-terminus of neighbour sequence of sequence listing upward to telomere on chrosomal short arm and 5'-terminus of this base sequence : 74447
cctttggataaagcctccttccatgcgcaggttctgtgttacttgtttgcttatactacacacacacacacacacacacacacacacacacacacagagcactcattgaaaagataatgggttattttatttcattgagtgtaattgtctgaaatggcttcatgatataattatatagtaggggcccggatgagacaatgata

SEQ ID NO: 15891 - DNA, 275 bp, Homo sapiens
  D10S1763
  Located on chromosome 10
  Distance between a terminus base of telomere on chromosomal short arm and 5'-terminus of this base sequence : 16798172
  Distance between 3'-terminus of neighbour sequence of sequence listing upward to telomere on chrosomal short arm and 5'-terminus of this base sequence : 316314
cgaaagtcacttgattggctttcctttggttcttattgctgtgtgtgtgtgtgtgtgtgtgtgtgtgtgtgtgtgtgtgttgcccctaagtctgagaaacaggttctaaaaaagttgcccttcccttccattttcttagcatgtagcaatttttaaaattcatgtatttatttgaagcacacttcaatttcatgtagatgtagatttgtaacagaaaaaaagattggtgaaattatagaaataatttaaaactatgcagaacagcataggggttt

SEQ ID NO: 15892 - DNA, 312 bp, Homo sapiens
  chr10.fa.O7frz.16837665
  Located on chromosome 10
  Distance between a terminus base of telomere on chromosomal short arm and 5'-terminus of this base sequence : 17164308
  Distance between 3'-terminus of neighbour sequence of sequence listing upward to telomere on chrosomal short arm and 5'-terminus of this base sequence : 365861
tcttccatgtgttaggcactgtgctaaacactgtaagtcagaaatcctcactcttcttgtgtgtgtgtgtgtgtgtgttagggctggggggttggtggtagagaaggaacatgacaatatttatggatgtctcttcagagctatagatcttttactttttggtgccatgaacttgatgtgtcagcaagggctctacccttacaatgatccccaaagggaatcaaatacaacttctcccataaaaccttccctcaatatttcaagcagaagcaatcacttctgtacgcttattacgcctcttatttactcatt

SEQ ID NO: 15893 - DNA, 233 bp, Homo sapiens
  D10S674
  Located on chromosome 10
  Distance between a terminus base of telomere on chromosomal short arm and 5'-terminus of this base sequence : 17322989
  Distance between 3'-terminus of neighbour sequence of sequence listing upward to telomere on chrosomal short arm and 5'-terminus of this base sequence : 158369
gctgggcctagagttttcttttaaactttgaaggatgtgaactggaaattcattctgtctttcgatagatagatagatagatagatagatagatagatagatagatggatgtctgtctgtctgcacatgcatgtaaaatacacattttattttattttttttttagagatggggtttcaccatgttggccaggctagtattgaactcctgacctcaaatgattcacccacctc

SEQ ID NO: 15894 - DNA, 142 bp, Homo sapiens
  D10S1477
  Located on chromosome 10
  Distance between a terminus base of telomere on chromosomal short arm and 5'-terminus of this base sequence : 17385853
  Distance between 3'-terminus of neighbour sequence of sequence listing upward to telomere on chrosomal short arm and 5'-terminus of this base sequence : 62631
agttccaagatgctcagtcggaaatgctgaacgaagatctttctgtgaagaagggcgttcagagtgtgcgtgtgtgtgtgtgtgtgtgtgtgtgtgtgtgtgtgtgtgtgtgtttacagcaacactgttcaagcggaaaata

SEQ ID NO: 15895 - DNA, 467 bp, Homo sapiens
  AC073367.1_37237
  Located on chromosome 10
  Distance between a terminus base of telomere on chromosomal short arm and 5'-terminus of this base sequence : 17494256
  Distance between 3'-terminus of neighbour sequence of sequence listing upward to telomere on chrosomal short arm and 5'-terminus of this base sequence : 108261
gataggtcaaagtttgctacgagcctccacatttgagagagaggaggagaagctgtagtctacagttagccaagtctatggcttgtttgaaagggcaggaaggggacaacagtgaagaagggagatgaacagatggctaaagtaaacaatgggaattcattttttttctaaaatcaaatgggaaattcaattattcactattctacttgaaagcactgctttccagaaaattaaatgtacctggactatattcagaagatttagaacaaagagctgccagctttcacagtttattgttgaaaaccaagatactttaaataaataaataaataaataaataaataaataaatagctttgctttactattaagaacaggaaaccgtgggctgtaaaatgttaaacagtttacccaagtcacaactataaaagcattagtataaaagtcattagcagatgactttaggat

SEQ ID NO: 15896 - DNA, 260 bp, Homo sapiens
  D10S1661
  Located on chromosome 10
  Distance between a terminus base of telomere on chromosomal short arm and 5'-terminus of this base sequence : 17507040
  Distance between 3'-terminus of neighbour sequence of sequence listing upward to telomere on chrosomal short arm and 5'-terminus of this base sequence : 12317
attgcttccctgagagtgtatgtgtgatatgtagagagtgcgtgtgtgtgtgtgtgtgtgtgtgtgtgtgtgtgtgtgtgtgtaagtatttatgatgacttcatatcagttgaatctgtaggaatccttaggacacgattttgttaatgctttgctccagatttatgcttatctctaccaaatgccacagagttccaccaatttggaaacaaattatctacattttttaaatgtagtttccatgacctggcaagtagcgt

SEQ ID NO: 15897 - DNA, 254 bp, Homo sapiens
  D10S1476
  Located on chromosome 10
  Distance between a terminus base of telomere on chromosomal short arm and 5'-terminus of this base sequence : 17528145
  Distance between 3'-terminus of neighbour sequence of sequence listing upward to telomere on chrosomal short arm and 5'-terminus of this base sequence : 20845
tgactaaacagacccagacttgggagtgtcctgatatcccgatatctggaaaacaaaggcattcctaattttgctttaaagataatattgattcttgcaaaatatagtaattaagaaaattaatcctttatcagaaacccttgtagcagaacacatctctccatggtcttttaaaatcattcatacacacacacacacacacacacacacacacacacacatgcatgcatgttacctagggtggacatgcgttc

SEQ ID NO: 15898 - DNA, 114 bp, Homo sapiens
  DISO7_10002824
  Located on chromosome 10
  Distance between a terminus base of telomere on chromosomal short arm and 5'-terminus of this base sequence : 17645262
  Distance between 3'-terminus of neighbour sequence of sequence listing upward to telomere on chrosomal short arm and 5'-terminus of this base sequence : 116863
gccagagactgagtggtaaactaatttgagagattaaaaacaacaacaacaacaacaaaaacaacaacaagttcctgggggcccggtcttaaggggtctcctgtactttgctga

SEQ ID NO: 15899 - DNA, 458 bp, Homo sapiens
  chr10.fa.O7frz.17666414
  Located on chromosome 10
  Distance between a terminus base of telomere on chromosomal short arm and 5'-terminus of this base sequence : 17707749
  Distance between 3'-terminus of neighbour sequence of sequence listing upward to telomere on chrosomal short arm and 5'-terminus of this base sequence : 62373
ctgaccaacatggtgaaagcccgtctccactaaaaatacaaaacttagccaggcgtggttgcatgcgcgggtaatcccagctactcaaggggctgaggcaggagaattgcttgaacctgggagaaggaggttgcagtgagcggagatcacgccattgcactccagcctggcaacagagtgagactccgtctctctctctctctctcacacacacacacacacacacacacacacacacatcacatccctgggtatttttatcaattgccacagaggcaatgaaggcttactaagaaaatcaggagtttgggggacagtcaaactcatgttcaaagcctggctttacctcttacaaaccctttggaccacagacaaattacttaatctcttaaatttttctttcttcctttgtaaaatggggtaattcctgtctcatctggtagctctgaggattagat

SEQ ID NO: 15900 - DNA, 377 bp, Homo sapiens
  chr10.fa.O7frz.17747047
  Located on chromosome 10
  Distance between a terminus base of telomere on chromosomal short arm and 5'-terminus of this base sequence : 17788388
  Distance between 3'-terminus of neighbour sequence of sequence listing upward to telomere on chrosomal short arm and 5'-terminus of this base sequence : 80181
agaaattagaactcttacgcattactaacgggaatgtaaaatagtccatccctataaaaaagtttggtggttcctcaaaaagttaaacatagtattatcatatgaaccagcaatttcacttctaggtttataccccaatgaaatgaaagcatgaacaaacaggaaaggggaaagggtaaaggaaaaagggaagggaagggaagggaaaaggaagggaagggaagggaaaaggaagggaagggggaaggggaaggggaagggaaaggaagggaagggaagggaggggaacggaaggcaaggggaaggggaaggggaaaggaaaggaaaaatgtacttctctgtcatgtgtatctttctgttaatgctcaacattatcc

SEQ ID NO: 15901 - DNA, 427 bp, Homo sapiens
  chr10.fa.O7frz.18069330
  Located on chromosome 10
  Distance between a terminus base of telomere on chromosomal short arm and 5'-terminus of this base sequence : 17990679
  Distance between 3'-terminus of neighbour sequence of sequence listing upward to telomere on chrosomal short arm and 5'-terminus of this base sequence : 201914
ctcatgcaaactgaaactaaagaacatgtgcaagatgcttaatgcctttttaaaaaacatgcaaagggaggctgggcgtggtggctcatgcctgtaaaacccagcacttagggaagccaaggtgggtggattaacttgaggtcaggtgttcgagaccagcctggccaacatggtgaaacccgatctctactaatacaaaaattagctaggtgtggtggcatgcgcctgtaatcccagctactagggaggctgaggcaggaaaatcactttaacccaggagggggagattgcagtgagccgagatcacgccactgcactccagcctaggcaacagagcgagactcagtctcaaaaacaaaacaaaacaaaacaaaacaaaacaaaaaaaacagcaaagggaaactctcaaatgaaaggcataactaga

SEQ ID NO: 15902 - DNA, 207 bp, Homo sapiens
  Z66839
  Located on chromosome 10
  Distance between a terminus base of telomere on chromosomal short arm and 5'-terminus of this base sequence : 18119163
  Distance between 3'-terminus of neighbour sequence of sequence listing upward to telomere on chrosomal short arm and 5'-terminus of this base sequence : 128057
gccttgtagaggtttaggccaggctgtgctgctgaagaagaaaggtcctctgggtctcctcatcactgacacctttctcacacacacacacacacacacacacacactcttccccaaacccttaattcaggcttctctagggaagcagttttcactttgttttttcagcaggtattcatgatagatgtgagtcatgtctaccacaca

SEQ ID NO: 15903 - DNA, 384 bp, Homo sapiens
  HUMUT463
  Located on chromosome 10
  Distance between a terminus base of telomere on chromosomal short arm and 5'-terminus of this base sequence : 18129548
  Distance between 3'-terminus of neighbour sequence of sequence listing upward to telomere on chrosomal short arm and 5'-terminus of this base sequence : 10178
tcaggtatttcttcatagcagtgtgagaaacaactaatagagatagagaaagagagatggtagagataaatggatagataggatgatagatgatagagacagatagatgatttgatagacagataaatgagatagaaagaagaaggaaggaaggagagagacagaaagaaagaaacagagagaaagaaagaaagagagaaagaaaaagaaagaaagaaagaaagaaaagaaaagaaagaaagaaagaaagaaagaaagaaagaaagaaagaaaaagaaagaaagaaagaaagaaaaagattaattatgaggggaattgcctcacaagactatggaggctgcaaagtctcacaatgggttatctgcaagctgcagagcaagggaa

SEQ ID NO: 15904 - DNA, 346 bp, Homo sapiens
  chr10.fa.O7frz.18390510
  Located on chromosome 10
  Distance between a terminus base of telomere on chromosomal short arm and 5'-terminus of this base sequence : 18170205
  Distance between 3'-terminus of neighbour sequence of sequence listing upward to telomere on chrosomal short arm and 5'-terminus of this base sequence : 40273
aatcataggtactaggccataaaggtgatctcagtagtgggcctcccacaacatatgtcctttccagaacagtctcatattcttctgaataatcaaaagtgatttctagtagaatatcataggagactccatagggaagggtattttatagaggaaatacaataagttttggcttaaaacttaaaagaaaaatatctcagaatatatttaattcatgagtctaaaatgcctgtgtttctagattctacttttgctgatgccaggtattttcctgaatatagagtatacacacacacacacacacacacacacacacaaacagtagtataggtcatggtatgtacca

SEQ ID NO: 15905 - DNA, 183 bp, Homo sapiens
  DISD22_0000092
  Located on chromosome 10
  Distance between a terminus base of telomere on chromosomal short arm and 5'-terminus of this base sequence : 18487914
  Distance between 3'-terminus of neighbour sequence of sequence listing upward to telomere on chrosomal short arm and 5'-terminus of this base sequence : 317363
gctgacttggcattaagactctaaaatagtgtgatcaaactgatatatatatatattatatatataataagaaggtgtttgtttgcagaaataacatttacaaactgtctatacagtacacagtactagtacatagaaaatagattctaactttatgatcccctttgtgtaaggcaagactga

SEQ ID NO: 15906 - DNA, 149 bp, Homo sapiens
  DISD22_0000093
  Located on chromosome 10
  Distance between a terminus base of telomere on chromosomal short arm and 5'-terminus of this base sequence : 18559956
  Distance between 3'-terminus of neighbour sequence of sequence listing upward to telomere on chrosomal short arm and 5'-terminus of this base sequence : 71859
ttaaggcagactttaatgataagcatatatagtcattcatatatatatatatatatatatacacacacatataggcacacatatatacgtgtgtgtatacacttagaataccttttacagtatacagtgtacagagttgctttatatgg

SEQ ID NO: 15907 - DNA, 443 bp, Homo sapiens
  chr10.fa.O7frz.19799419
  Located on chromosome 10
  Distance between a terminus base of telomere on chromosomal short arm and 5'-terminus of this base sequence : 18653198
  Distance between 3'-terminus of neighbour sequence of sequence listing upward to telomere on chrosomal short arm and 5'-terminus of this base sequence : 93093
gagtgctagaattacaggcatgagccaccgtaccttgccctaaaatatttttaagttagaaaataccactgcctggtgcagcagctcatgcctgtaatcgcaacactttgggaggataagggagacgggtcacttgaacccaaatgttcaaggccagcctgggcaacatagtgagaccttgcttgtctctacaaaaaataaaaataataacaatgaaaaagaaaataccacagagtgacaagaaacagcgcttgaacagccagaaaaggttgtgtgtgtatgtctgtgtgtgtgtgtgtgtgtgtgtgtacgtgcctactgtaaaatactgaggtagtagcttgtttttctagtcatttaataaaactttttatttcaaaataattttaaacattcagaagaattgcaaagttagtaccgggaattccagtttatcctttacg

SEQ ID NO: 15908 - DNA, 101 bp, Homo sapiens
  DISO7_10002828
  Located on chromosome 10
  Distance between a terminus base of telomere on chromosomal short arm and 5'-terminus of this base sequence : 18957156
  Distance between 3'-terminus of neighbour sequence of sequence listing upward to telomere on chrosomal short arm and 5'-terminus of this base sequence : 303515
gatgcttgttctgttgcttcaaactttttatttatttatttatttatttatttatttatttatttatttatttatttattactttaagcaggccttgaatt

SEQ ID NO: 15909 - DNA, 281 bp, Homo sapiens
  HUMUT921
  Located on chromosome 10
  Distance between a terminus base of telomere on chromosomal short arm and 5'-terminus of this base sequence : 19070088
  Distance between 3'-terminus of neighbour sequence of sequence listing upward to telomere on chrosomal short arm and 5'-terminus of this base sequence : 112831
gaagtgctgagattacaggtttgagccatcatgcccggccaagtcggccagctctttctttctctttctttctttctttctttctttccttccttccttccttccttccttccttccttctttctttctttctttctttctttctttctttctttctttctttctttctttctttccttccttccttccttccttccatccatgcttccttccttccttctttctttctttctttctctctttcaacactgctctgttgtcaatgagtttcttcctcttgc

SEQ ID NO: 15910 - DNA, 226 bp, Homo sapiens
  G08807
  Located on chromosome 10
  Distance between a terminus base of telomere on chromosomal short arm and 5'-terminus of this base sequence : 19093856
  Distance between 3'-terminus of neighbour sequence of sequence listing upward to telomere on chrosomal short arm and 5'-terminus of this base sequence : 23487
ggcagcctaataattccgatatctaagaaagtggagttctagttcattttgttcttagagccttaaacatatagattgcagcttttaaatctgtctatctgtccatctatctatctatctatctatctatctatctatctatctatctatctaactagctgagacagagtctcacttagttgctcaggctggagtgcagtggtgtgatccatgctcactgcaaact

SEQ ID NO: 15911 - DNA, 101 bp, Homo sapiens
  DISD22_0000104
  Located on chromosome 10
  Distance between a terminus base of telomere on chromosomal short arm and 5'-terminus of this base sequence : 19240321
  Distance between 3'-terminus of neighbour sequence of sequence listing upward to telomere on chrosomal short arm and 5'-terminus of this base sequence : 146239
atgccttgcccaagtatgttttgggtgtgtgtgtgtgtgtgtgtgtgtcctgtttgtgcccttggcttggtttgaagtgtgcagtcagaagataatagatg

SEQ ID NO: 15912 - DNA, 129 bp, Homo sapiens
  DISD22_0000111
  Located on chromosome 10
  Distance between a terminus base of telomere on chromosomal short arm and 5'-terminus of this base sequence : 19321463
  Distance between 3'-terminus of neighbour sequence of sequence listing upward to telomere on chrosomal short arm and 5'-terminus of this base sequence : 81041
tctcagtcttgctcatgctctgtgtgtgtgtgtgtgtgtgtgtgtgtgtgtgtctgtgtatgtgtgtgtgtgtgtgtgtgttcctaacagagaaactttttaaaaagtgattatgtagtcaattcccaa

SEQ ID NO: 15913 - DNA, 352 bp, Homo sapiens
  AL157895.3_99467
  Located on chromosome 10
  Distance between a terminus base of telomere on chromosomal short arm and 5'-terminus of this base sequence : 19614155
  Distance between 3'-terminus of neighbour sequence of sequence listing upward to telomere on chrosomal short arm and 5'-terminus of this base sequence : 292563
ctatctgacaaatgtgacaacttaaaaatgtcatggttaataaaaagcatttcatcgaaataaaggccaggttcagtggctcaccctcaccctcatagtctcagtactttgggagactgaggcaggaggattgattgagcctgggaggtagaggctgcaatgagtcgtgatcgtgccagactgagtgacagagtaagttcctgtctcaataataataataaataataataataatatattgtttatattttgtggcagaaaaagattaataatataatcaaagaccttaaagtatgaaatagattaggataaaatatgtcaagaagagaaatcaaagtgttagtttaaggag

SEQ ID NO: 15914 - DNA, 410 bp, Homo sapiens
  AL353147.5_69968
  Located on chromosome 10
  Distance between a terminus base of telomere on chromosomal short arm and 5'-terminus of this base sequence : 19693315
  Distance between 3'-terminus of neighbour sequence of sequence listing upward to telomere on chrosomal short arm and 5'-terminus of this base sequence : 78808
gcatgttcttaccataagtgagagttgaacaatgagaacacatggacacagggaggggatatcacacaccggggcctgttggggggtgagggacaaggggagggagagcattaggacaaatacctaatgcctgcaaggcttaaaacctagatgacgggttgatgggtgcagcaaaccaccatggcacatgtatacctgtgtaaaaaacctgcacgttctgcagatgtatcccagaacttaaagtataataataataataataataataaagaccatggtgtaatatgtacctgggaagggagaaaattgtactgtggagaaaggagggaaaggagggaaaggagggaaaggagggaaaggagggaaaggtaggagggaggaaattgtactatgtctcagttatgcagatc

SEQ ID NO: 15915 - DNA, 410 bp, Homo sapiens; identical to SEQ ID NO: 15914
  AL157895.3_20342
  Located on chromosome 10
  Distance between a terminus base of telomere on chromosomal short arm and 5'-terminus of this base sequence : 19693315
  Distance between 3'-terminus of neighbour sequence of sequence listing upward to telomere on chrosomal short arm and 5'-terminus of this base sequence : -410

SEQ ID NO: 15916 - DNA, 414 bp, Homo sapiens
  chr10.fa.O7frz.20953287
  Located on chromosome 10
  Distance between a terminus base of telomere on chromosomal short arm and 5'-terminus of this base sequence : 19750052
  Distance between 3'-terminus of neighbour sequence of sequence listing upward to telomere on chrosomal short arm and 5'-terminus of this base sequence : 56327
ctttgtagtgatggtagaacaaagtactgataaaagcatagcattctcaagaacaatatagagagatagaaatagagatagagatacatgtctatgtgtatgtatatatatatagcgagaggagcgagagagagagagagagagagagagagagattggttccggtctgtgtcaaatcatgaaattgaggcttaagtcctttcttttgctaccctctttagtctactccagtctaattgtggccatgatggaaagaagtcacgtctctgcacctgcccaggcaagccaagtgtctcagtgcgcctggtaggaaattcttaggtcacgccctctctatgcctgcacagttcttgggtcccgggagctctgtttcttgggaagaatcccgtgtgatagtctggaggcagatctttc

SEQ ID NO: 15917 - DNA, 389 bp, Homo sapiens
  AL157397.10_85796
  Located on chromosome 10
  Distance between a terminus base of telomere on chromosomal short arm and 5'-terminus of this base sequence : 19909996
  Distance between 3'-terminus of neighbour sequence of sequence listing upward to telomere on chrosomal short arm and 5'-terminus of this base sequence : 159530
aatcaggtcactaagtcgtttcttccatcttgaggtccctagaaactctgtcttctccgtctctaccttttggaatcttctgctgcttggttcatttgatttatccaaggttttaggtatgataagagggtggactaaggcaaaatatgcttgccccatccttctggaactggaagtcctccctatacttttaaaaatttattcatgttaaaccaaaaaaaaagaagaagaagaagaagaagaaaaaaaacagctgctgtagcctctgcaacttgctgagagcttgtttaggaatagagagcttatttttcccttccctctatctcagctcaagcctaacagccaggtggtgctttcatgtgtacctctcttgcatcctagaaagtaca

SEQ ID NO: 15918 - DNA, 421 bp, Homo sapiens
  AC069549.2_107304
  Located on chromosome 10
  Distance between a terminus base of telomere on chromosomal short arm and 5'-terminus of this base sequence : 20076985
  Distance between 3'-terminus of neighbour sequence of sequence listing upward to telomere on chrosomal short arm and 5'-terminus of this base sequence : 166600
atgacaatgtatcgttatccactaaaatataaaatgtataactaacactgtgatttctactcgtaaaaatgtatcttgtaggtgtatttgtttgtgaacaatgtgtataaggatatccactgctaaagactgaaaaccacctaacgcccatcactgaggatgttcaggttttggacaggttaaataaactactgggaacccatagagtagaatactatgtggcctttaaacagaatgagatatttaatgtatgcctatttaaaaaaacagaacaccacaggatgcagataaatgttacttacatatatatgtacatatatgtatgtatgtatgtatgtatgtgtacagacagatgtatttatacatgtataagctatctctaaaataatttggaagaaaagtagatatgcttccaagtgag

SEQ ID NO: 15919 - DNA, 463 bp, Homo sapiens
  chr10.fa.O7frz.21342059
  Located on chromosome 10
  Distance between a terminus base of telomere on chromosomal short arm and 5'-terminus of this base sequence : 20176067
  Distance between 3'-terminus of neighbour sequence of sequence listing upward to telomere on chrosomal short arm and 5'-terminus of this base sequence : 98661
gagtgacatcagataagctcagaaagctacccaagtgctgggacacagatgactctgtaagctagggagagttttatcctcagaataatggaaagcatttagactttataacttatgcgaagaagggatgtgattttaccatattaaaaaaatggaactttggctgcttcatggagaacagagtttttgttggtttgtttatttgtttgtttggggagtggtttagaatgaaaaggaagaggctggtagtgagcttgtgcaatagtgcacaggaggtatgatagtaacttggacgaggatgatgattctgaggatcaggagagatgaatgaatgcaaggtgtttgggaaggaaaccggttatttgtgtgtgtgtgtgtgtgtgtgtgtgtgtgaatgaagtttattgaagtataatttacatataataaaatacacacattttaaatgtatgaggcagcttta

SEQ ID NO: 15920 - DNA, 233 bp, Homo sapiens
  chr10.fa.O7frz.21420381
  Located on chromosome 10
  Distance between a terminus base of telomere on chromosomal short arm and 5'-terminus of this base sequence : 20265427
  Distance between 3'-terminus of neighbour sequence of sequence listing upward to telomere on chrosomal short arm and 5'-terminus of this base sequence : 88897
ttaggacgtgttgacagttaatgttgatgaatcagaaaaggggaccgtttaagacaaaaaacagacacacacacacacacacacacacacacacacaaacagagcaagatgcaagaaaatataccatcctagaaagccacaaaacggaaagcgtcaagattgaagagacaggcagcagtgtaaagtgctctagaggagtcacagaagatgttgacagctaagtcattgataac

SEQ ID NO: 15921 - DNA, 195 bp, Homo sapiens
  D10S595
  Located on chromosome 10
  Distance between a terminus base of telomere on chromosomal short arm and 5'-terminus of this base sequence : 20342303
  Distance between 3'-terminus of neighbour sequence of sequence listing upward to telomere on chrosomal short arm and 5'-terminus of this base sequence : 76643
actctgggaggctcaggttaggagattgcttaagtccaggagttcaagacctggctgggcaacacagtaagaccctgtccccctgccccctcccccaccacacacacacacacacacacacacacacacacacacacacacacacacatattagccaggcacggtgggtaacacctgtggttccagttacttaaa

SEQ ID NO: 15922 - DNA, 478 bp, Homo sapiens
  AL353790.5_45232
  Located on chromosome 10
  Distance between a terminus base of telomere on chromosomal short arm and 5'-terminus of this base sequence : 20361558
  Distance between 3'-terminus of neighbour sequence of sequence listing upward to telomere on chrosomal short arm and 5'-terminus of this base sequence : 19060
tcttcctgatttaagctaggagggttacatttttctaggaatttatctatcttttctaggttttttagtttctgtgtgtaaaggtgttcatagtagccttgaatgatcttttgtatttctgtgctgtcagttgtaatatctcccatttcatttcttattgaggtcatttggattttctctcttcttttcttggttaatcttgctaatgatctatcaatttcatttatcttttcaaagaaccagcttttttattcatttacattttgtattttgttgttgttgttgttgtttcaatttcattgagttctgctctgaacttggttatttcctttcttctgctgggtttaggtttgctttgttcttgtttctctagttccttgaggtgtgacctcagaatgtcagtttgtgctctttcagtttttttgatgtaggcatttagggctatgaactttcctcttagcaccaactttgatgtatc

SEQ ID NO: 15923 - DNA, 427 bp, Homo sapiens
  chr10.fa.O7frz.21630772
  Located on chromosome 10
  Distance between a terminus base of telomere on chromosomal short arm and 5'-terminus of this base sequence : 20527980
  Distance between 3'-terminus of neighbour sequence of sequence listing upward to telomere on chrosomal short arm and 5'-terminus of this base sequence : 165944
ctaagaccaatgtcaaggaacattttacctacgatttttttctaggagttttatgattttaggtcctatgtttaagtctttaatcatttttcagttgatttgtgtgtgtgtgtgtgtgtgcaatacgatatatattttttttgcatacagatatcaagttttcccaacattctttgaaaagactatacttccaccattttgtattcttgggacccttggtgcggatcaattgatcttctgtgtgtgggtttatgtctgggctctctctgctgttccatttgtctatgtgtcagtttttatgttagtaccatgcttttttgggtactatagctttgtaatataatttgaatccagaagtgtgatgtctccatctttttttaaatcaagattgcttttgaagtttttgtggttccatatgaacattaga

SEQ ID NO: 15924 - DNA, 325 bp, Homo sapiens
  AL139236.6_127168
  Located on chromosome 10
  Distance between a terminus base of telomere on chromosomal short arm and 5'-terminus of this base sequence : 20813748
  Distance between 3'-terminus of neighbour sequence of sequence listing upward to telomere on chrosomal short arm and 5'-terminus of this base sequence : 285341
ggcttctaatcctacatctgacaaggatttgaagagcaggaagaggaaaaatgttaagataaataaaagatttttttttctattacagttggcagcactttttaaaatttagaaataaaactctacacactgcactccagcccaggtgacagtccaagactccatttcaaataataataataataataataataataataataataatactctatataaatgcatggaaagttactcaaaaagctgtgagatcactgaagatatcatcctgggaatatcattaagaaaatattttatagctctaattctactgagttcagtttgg

SEQ ID NO: 15925 - DNA, 112 bp, Homo sapiens
  DISO7_10002829
  Located on chromosome 10
  Distance between a terminus base of telomere on chromosomal short arm and 5'-terminus of this base sequence : 21046003
  Distance between 3'-terminus of neighbour sequence of sequence listing upward to telomere on chrosomal short arm and 5'-terminus of this base sequence : 231930
ttacaaatcacagccattgacatttttactgagaaatcacacacacacacacacacacacacacacacacacagtgtcaggagacaaaagggtaatagtgtaggaagcagat

SEQ ID NO: 15926 - DNA, 445 bp, Homo sapiens
  AL158160.3_127775
  Located on chromosome 10
  Distance between a terminus base of telomere on chromosomal short arm and 5'-terminus of this base sequence : 21220214
  Distance between 3'-terminus of neighbour sequence of sequence listing upward to telomere on chrosomal short arm and 5'-terminus of this base sequence : 174099
aaattcctttcaatactaagcttttctaaaactttgaaagcaaaacgctatcaaaatttgatataccaatattaaggaagttaacaggtaatgtacatacaaatacattttcaggccaaggaatgtggggatttctcctggttgttgttgttgttgttgttgttgttgttgttgttgttttgagacacagtctctttctatcacccagactggaatgcagtggcacgatctcggctcactgaaacctccacctcccaggttcaagcaattatcctgcctcagcctgccaagtagctgggattacaggcacctaccaccatgcctggctagtttttgtatttttaatagagacagggtttcaccatgttggccaggctggtctcaaactcctgacttcaggtgattcgcccacctcagcctcccaaagtactggaattacaggcat

SEQ ID NO: 15927 - DNA, 417 bp, Homo sapiens
  AL158209.11_103346
  Located on chromosome 10
  Distance between a terminus base of telomere on chromosomal short arm and 5'-terminus of this base sequence : 21602192
  Distance between 3'-terminus of neighbour sequence of sequence listing upward to telomere on chrosomal short arm and 5'-terminus of this base sequence : 381533
gactcacatctgtagtccgagctactcaggaggctgaggtgggaggattacttgagcccaggaggtcgatgctgcagtgaaccatgattgtgccactgcacttcagtttgagtaacagagtgagactctatttaaataaataaataaataaataaataaataaataaatcatttctttttctattggtgaggtatttagaggtaaagagtaggacctctgggcaggatgagaatcctagcttgccattttccagctacaggatcttgagccagttacttaatagtactgtgcctcagtttctccataagtaaaaaggcgataacaccatctacctcaaaagctcgctgggatcataaaatgagataaatatcatgccagatatacagcaacattatcactaaggcttattcgttagt

SEQ ID NO: 15928 - DNA, 413 bp, Homo sapiens
  AL358780.7_93342
  Located on chromosome 10
  Distance between a terminus base of telomere on chromosomal short arm and 5'-terminus of this base sequence : 21727532
  Distance between 3'-terminus of neighbour sequence of sequence listing upward to telomere on chrosomal short arm and 5'-terminus of this base sequence : 124923
atttgttacagttaaactgcgttttgtttaattacttatttgctgaaagataatctcagttatttccacttgtaggttattaagaataaaactgttataaacattacatgggttttcatgtgagcataagtcttcatttagtaattttgataggcgggtagtgatatctcactgtgtgtattattattattattattattattattattattattttgagacagagtcttgctttgtcgcccaggctggagtgtggtggcgcgatctaggctcactgcgggctccacctcccaggttcacaccattctcctgcctcagcctcccgagtagctgggactacaggctcctgccaccacgactggctaattttttgtatttttagtagagacggggtttcaccgtcttagccagga

SEQ ID NO: 15929 - DNA, 380 bp, Homo sapiens
  AL161799.17_6703
  Located on chromosome 10
  Distance between a terminus base of telomere on chromosomal short arm and 5'-terminus of this base sequence : 21727588
  Distance between 3'-terminus of neighbour sequence of sequence listing upward to telomere on chrosomal short arm and 5'-terminus of this base sequence : -357
cagttatttccacttgtaggttattaagaataaaactgttataaacattacatgggttttcatgtgagcataagtcttcatttagtaattttgataggcgggtagtgatatctcactgtgtgtattattattattattattattattattattattattttgagacagagtcttgctttgtcgcccaggctggagtgtggtggcgcgatctaggctcactgcgggctccacctcccaggttcacaccattctcctgcctcagcctcccgagtagctgggactacaggctcctgccaccacgactggctaattttttgtatttttagtagagacggggtttcaccgtcttagccaggatggtctcgatctcctaacctcgt

SEQ ID NO: 15930 - DNA, 202 bp, Homo sapiens
  D10S211
  Located on chromosome 10
  Distance between a terminus base of telomere on chromosomal short arm and 5'-terminus of this base sequence : 21782876
  Distance between 3'-terminus of neighbour sequence of sequence listing upward to telomere on chrosomal short arm and 5'-terminus of this base sequence : 54908
ctcctggtctcatgcgattcggcctcccaaagtgctgtgattacaggcgtgagccaccgtgcctggtgacatacacacacacacacacacacacacacacacacacacacactttttttagatctcaggcagcaagtaaacatgtatatcttgatttctttttgaggtggttttgttataaagtgacggtagtaggagcctg

SEQ ID NO: 15931 - DNA, 344 bp, Homo sapiens
  AL161799.17_93951
  Located on chromosome 10
  Distance between a terminus base of telomere on chromosomal short arm and 5'-terminus of this base sequence : 21814877
  Distance between 3'-terminus of neighbour sequence of sequence listing upward to telomere on chrosomal short arm and 5'-terminus of this base sequence : 31799
ctggtactgttcagatgtgaagtgctatgtaaactttaaagtactattttaaaatgttcacaaaagtatttggtggttgtgttgttttgttttgttttgttttgttttgttttgttttgttttgttttgttgagacggagtctcacactgttgcccaggctcgggtgcagtggaacgatcttggctcaccacaacctccgcctcctgggttcaagcgattctcctgcctcagcatcctgagtagctgggattacaggtgcacaccaccatgcccggctaatttttgtatttttagtagagatggggtttcaccgtgttggtcaggctgatcctaaactcctggc

SEQ ID NO: 15932 - DNA, 179 bp, Homo sapiens
  D10S1734
  Located on chromosome 10
  Distance between a terminus base of telomere on chromosomal short arm and 5'-terminus of this base sequence : 22047139
  Distance between 3'-terminus of neighbour sequence of sequence listing upward to telomere on chrosomal short arm and 5'-terminus of this base sequence : 231918
gcctgggtgacagagtgagattctatctcaaacacacacacacacacacacacacacacacacacacacacacaccattttaactggagacttgacattgagaagcaactccattcttaattactatagtcaaactcagcctcataagagtattttcaccaccccatgtgtacgtgtgt

SEQ ID NO: 15933 - DNA, 468 bp, Homo sapiens
  chr10.fa.O7frz.23458758
  Located on chromosome 10
  Distance between a terminus base of telomere on chromosomal short arm and 5'-terminus of this base sequence : 22354902
  Distance between 3'-terminus of neighbour sequence of sequence listing upward to telomere on chrosomal short arm and 5'-terminus of this base sequence : 307584
agttcagtgctaaagatgtttaacttagcatcaggacatccaacttcacctatagtgggaaatgcagaactggtgctcgagaggataacgtgaggacttaaccaaggtggagcaagccacctgagtagagatcattgatgctgtgaaaggcactagctaggtctgaagaaaatgtctgatctccatccctcagcaaattatagcaattgcacaggccccagcagattcctctcccctactgtgcttagagatgttatcatcaggactccttctcaaaccacacacacacacacacacacacacacacacacatatcacacacacacacacatacacacacacacccccaacatacacactccacacacacaccccacacactcacacctgccccctccccacccacatacactgcattccagggttctcaaggctttaggaaaagaagtcttggtcataaaatgttta

SEQ ID NO: 15934 - DNA, 361 bp, Homo sapiens
  chr10.fa.O7frz.24611193
  Located on chromosome 10
  Distance between a terminus base of telomere on chromosomal short arm and 5'-terminus of this base sequence : 22657535
  Distance between 3'-terminus of neighbour sequence of sequence listing upward to telomere on chrosomal short arm and 5'-terminus of this base sequence : 302165
acttaaatttacctggagtgaattcatgttctgatagctgatcttgcttttgtcttgcctagcattctgtcctttgtttattttggaacttaggtttgcatgcttacgtctctctctctctctctctctctctctctctctctctctctctctcaatacaatatttcctgaatatagttctgtgactgcttcttgtgcctctctcactcccagtttacagccagttcttataagtttggggctgcctactttgctgtgacatgaagggtcctaaagactccaagccagcaggtggtctagctcagttcctctgcatgaagtgagtttgtgacctctaaccttcctaggctcatagcttact

SEQ ID NO: 15935 - DNA, 173 bp, Homo sapiens
  D10S1660
  Located on chromosome 10
  Distance between a terminus base of telomere on chromosomal short arm and 5'-terminus of this base sequence : 22765130
  Distance between 3'-terminus of neighbour sequence of sequence listing upward to telomere on chrosomal short arm and 5'-terminus of this base sequence : 107234
gtattcgggtgacagacaccctaaataccctgactcgattactatgcattatatatgtgtaacaaattttctcaagtaccccagaaacttgtatacacacacacacacacacacacacacacacagacacacagagagagagagataaatgtagcactgtaaaaagtggtgtt

SEQ ID NO: 15936 - DNA, 325 bp, Homo sapiens
  AL365507.4_24921
  Located on chromosome 10
  Distance between a terminus base of telomere on chromosomal short arm and 5'-terminus of this base sequence : 22845997
  Distance between 3'-terminus of neighbour sequence of sequence listing upward to telomere on chrosomal short arm and 5'-terminus of this base sequence : 80694
ctcatgaggaaatggatagtctactgcatggaggtatctatctatctgtctatctatctatctatctatctatctatgtggcattcctctttcttcctaatccttccagattctttcaccattttctttctgtttgaagaacattctttagccaatctgttaggataggcctgctaactgtaagttgtttagttttcctttacctgagaagggctttatttgtcttcttcattgctgaagaatggtttcaccagatacttgtggttgacagttcttttctttcagcacttgaaaaacatgccacttccacctggcttctatagtt

SEQ ID NO: 15937 - DNA, 397 bp, Homo sapiens
  AL365507.4_167292
  Located on chromosome 10
  Distance between a terminus base of telomere on chromosomal short arm and 5'-terminus of this base sequence : 22867609
  Distance between 3'-terminus of neighbour sequence of sequence listing upward to telomere on chrosomal short arm and 5'-terminus of this base sequence : 21287
cttatgcctgtaattctagcactttgggaggctgaggcgggcagatcacttgaggtcaggagttcgagaccagcctggccaacacggcaaaaccttgtttgtattaaaaatacaaaaaagtaatcccagctactcagaaggctgagacaggagaattgcgaacccagggggcagaggttgcagtgagctgagattgcaccactgcactttagcctgggcaacagagcgagactctgccaaaaaaaaaaagaaagaaaaaaagaaaagaaagaaaaagaaagaaagaaagaaagaaagaaagaaagaaagagaaaagaaatgaaacttaaaaccctattagctgatgtgttaaaggcaacaaactcatctgcttttggtcaacagaactgattggtga

SEQ ID NO: 15938 - DNA, 215 bp, Homo sapiens
  D10S553
  Located on chromosome 10
  Distance between a terminus base of telomere on chromosomal short arm and 5'-terminus of this base sequence : 23198568
  Distance between 3'-terminus of neighbour sequence of sequence listing upward to telomere on chrosomal short arm and 5'-terminus of this base sequence : 330562
gggtgctagtccagacattttttgtgtttcttagtggtaatgggcctgtctacttcatgaaagaacaacagcgtctctgcatttcgctagaaaaatattcttggaggagagtcctagaccacgtgtgtgtgtgtgtgtgtgtgtgtgtgtgtattttccaagtaaatcagaaaattcaggcaattaatagtgaaaactgtcttctcagtaacctt

SEQ ID NO: 15939 - DNA, 264 bp, Homo sapiens
  chr10.fa.O7frz.23734171
  Located on chromosome 10
  Distance between a terminus base of telomere on chromosomal short arm and 5'-terminus of this base sequence : 23443468
  Distance between 3'-terminus of neighbour sequence of sequence listing upward to telomere on chrosomal short arm and 5'-terminus of this base sequence : 244685
ccattaatgatttagctaccaactcccaaccactgtctctctgcgcaaatctaaaattcctgggagaatctgattggcacatatacacatgcactcacacacacacacacacacacacacacacacacgcacagtatgtattcaagctcaagctgttaaataaactcagaaaatcatcctacaatgtggctcattccttctaaactggtctttttgctaccattttaaagttctaagaagaactacctcagataccgttaacct

SEQ ID NO: 15940 - DNA, 139 bp, Homo sapiens
  D10S1789
  Located on chromosome 10
  Distance between a terminus base of telomere on chromosomal short arm and 5'-terminus of this base sequence : 23693119
  Distance between 3'-terminus of neighbour sequence of sequence listing upward to telomere on chrosomal short arm and 5'-terminus of this base sequence : 249387
tcatagatagagaccattagtttcactagggtatggatgtctgtgtgtgtgtgtgtgtgtgtgtgtgtgtgtgtgtgtgcgcgcgcgcgcgcgcgcgcacagagaatggccccatgagatttagcactggagtgggaaa

SEQ ID NO: 15941 - DNA, 213 bp, Homo sapiens
  chr10.fa.O7frz.25090762
  Located on chromosome 10
  Distance between a terminus base of telomere on chromosomal short arm and 5'-terminus of this base sequence : 23938781
  Distance between 3'-terminus of neighbour sequence of sequence listing upward to telomere on chrosomal short arm and 5'-terminus of this base sequence : 245523
atgttacaccatgaagattcaggttgggcatttttgtaagtaatctcttccttgactccttgctagtttacttaacagaacaggagaatacacacacacacacacacacacacacacacacacacacacacaaatatattgtattttgttgtgtatgatacatatataaaacatacttatataatcactctactgaacagacaatatcgaatc

SEQ ID NO: 15942 - DNA, 274 bp, Homo sapiens
  chr10.fa.O7frz.25164435
  Located on chromosome 10
  Distance between a terminus base of telomere on chromosomal short arm and 5'-terminus of this base sequence : 24012406
  Distance between 3'-terminus of neighbour sequence of sequence listing upward to telomere on chrosomal short arm and 5'-terminus of this base sequence : 73412
acagtaaaccaaaggatgagtctgatccctcaagattcttccccaaaggacactggtaacagtgtagtttataacttaattccttttaaagtaatttagtcaatgttaaataaatgaactttggagagctattggaaatatatatatatatatatatttacaatttttcatctatgatgaagataatgatatccctatgcctaattcattattgctttattcacccatttatctcatatatttattcataatattctcctatgtcaagctgtgc

SEQ ID NO: 15943 - DNA, 374 bp, Homo sapiens
  chr10.fa.O7frz.25250686
  Located on chromosome 10
  Distance between a terminus base of telomere on chromosomal short arm and 5'-terminus of this base sequence : 24100179
  Distance between 3'-terminus of neighbour sequence of sequence listing upward to telomere on chrosomal short arm and 5'-terminus of this base sequence : 87499
aggaataaatgcaatggtttaccttgtgcctgcatacagtatattaaatgctttccatacatgattattgagtactcacaaaaaccttgtaaagtagttattattattattattattattattattattcctactttacagaaaaggcaaccaaaacagaggaattacataaaaggtcacactcaaataagcagtagagctgggatttgagcccagatacacctgatgtgaaagcccaggcttttacactatgctcttattgtgccctgaaatgaacttaccttgacaaattctcttaaaatttttcttacttgtatatcttatgcctgtgataactgtccgttttgcacaggacaagttaatgttccttagcc

SEQ ID NO: 15944 - DNA, 245 bp, Homo sapiens
  D10S550
  Located on chromosome 10
  Distance between a terminus base of telomere on chromosomal short arm and 5'-terminus of this base sequence : 24100535
  Distance between 3'-terminus of neighbour sequence of sequence listing upward to telomere on chrosomal short arm and 5'-terminus of this base sequence : -18
agttaatgttccttagcctggtatgaaagacccttcagtatcttctctcaattgatccctgtaaaatttagtttatgtccttgtttttatttaatttttatatacttgcagttttactgtactttcttttatattatatttctaatttattctagattttttccattctcctcttcctcagtacacacaccaacacacacacacacacacacacacacacatgaatacccacagtactttcagct

SEQ ID NO: 15945 - DNA, 280 bp, Homo sapiens
  chr10.fa.O7frz.25341744
  Located on chromosome 10
  Distance between a terminus base of telomere on chromosomal short arm and 5'-terminus of this base sequence : 24244199
  Distance between 3'-terminus of neighbour sequence of sequence listing upward to telomere on chrosomal short arm and 5'-terminus of this base sequence : 143419
tcagcctaaattctgttcataaatccaccagttcaatattttatgctaataaaaactattaacgtttttcattttctcccattacaaagttttcatacagccctcaacattctgcctgcaagatgtaaaattttggtatttaatccataggaaggtaggaaattagatagatagatagatagatagatagatagatagatagatagatagattatttatcttgtctcaataccgtcttcattcaacttggtgtttggtttagtgagctgtataaatcagc

SEQ ID NO: 15946 - DNA, 311 bp, Homo sapiens
  chr10.fa.O7frz.25456715
  Located on chromosome 10
  Distance between a terminus base of telomere on chromosomal short arm and 5'-terminus of this base sequence : 24359255
  Distance between 3'-terminus of neighbour sequence of sequence listing upward to telomere on chrosomal short arm and 5'-terminus of this base sequence : 114776
ctttccaagataattatcatcctaaaattgctacataactttcccatgtgtattttggtatcttggcatttttactgtgtgtttgtgtgtgtgtgtgtgtgtgtgtgtgtgataacaggcatattcatgtctgtatgttgttgttatctatttgtggttatactactgtttattttaaaattttaaaatacataaagcatagtccatattcttttgtaactttgtttacattcaacattattttgggcatgtatttatattgatacctatatataggtccatttattgtaattgcaggatagtatcatgtt

SEQ ID NO: 15947 - DNA, 132 bp, Homo sapiens
  D10S582
  Located on chromosome 10
  Distance between a terminus base of telomere on chromosomal short arm and 5'-terminus of this base sequence : 24478227
  Distance between 3'-terminus of neighbour sequence of sequence listing upward to telomere on chrosomal short arm and 5'-terminus of this base sequence : 118661
cctggcctattttaaattatctccaaatgaagaaaccaaagtacatgaacatgcacgtgactgctttgtgtgtgtgtgtgtgtgtgtgtgtgtgtgtgtgtgtgtgtgtgtagaaaacgctgcagatggagt

SEQ ID NO: 15948 - DNA, 198 bp, Homo sapiens
  D10S1673
  Located on chromosome 10
  Distance between a terminus base of telomere on chromosomal short arm and 5'-terminus of this base sequence : 24489532
  Distance between 3'-terminus of neighbour sequence of sequence listing upward to telomere on chrosomal short arm and 5'-terminus of this base sequence : 11173
cttacccccaaccaaaggaccaacataaatacaatccatgcaaagagactcattgactcaaatcacttcataacaaaacaaaatgaagacaaacaaacaaacaaagccatcataatctccttggagaacacagtctgtgtgtgtgtgtgtgtgtgtgtgtgtgtgtgtgatggagtcttgctctgtcatccaggttgg

SEQ ID NO: 15949 - DNA, 470 bp, Homo sapiens
  AL359532.3_65209
  Located on chromosome 10
  Distance between a terminus base of telomere on chromosomal short arm and 5'-terminus of this base sequence : 24693287
  Distance between 3'-terminus of neighbour sequence of sequence listing upward to telomere on chrosomal short arm and 5'-terminus of this base sequence : 203557
aacagaggaaagatggattaactctgccctggagacttggggagggactcccagaggaggtggcattcaagggggacctggaggcctgtgcacagagtcagcagcacaggtgatggcacagaggtggaccatgctgatgacacgagctgtgggggctctgggtgtgtgtgcaggggagacaggctgagctgggtcccaccttatccttggggtcatggagagcatgggggatttttttttttaagtagaatgtcaggatttgtttggtgttttgttaatttgttttattattattattattattattattattattattattattattttattattattatcttagagacagggtcttgctgtgtagcccaggctgaagtgcaattgcatgatcacagctcactgaagcctccaactcttgggctcaaaccatgctcctacctcagcctcctaaatagttgagacaacgg

SEQ ID NO: 15950 - DNA, 374 bp, Homo sapiens
  AL359532.3_55010
  Located on chromosome 10
  Distance between a terminus base of telomere on chromosomal short arm and 5'-terminus of this base sequence : 24703732
  Distance between 3'-terminus of neighbour sequence of sequence listing upward to telomere on chrosomal short arm and 5'-terminus of this base sequence : 9975
cagtttatcctcataggtctacaggggtgggagatgaccatgatgatgatggtggtggtggtgatgatgatgatgatgatgatagtggtggtggtggtggcgattatggtaccagtacccattaaatgcctggatgggccagaagcacttagaatcacaaggtacctggtaagagcttttattcccgagtcagtgggagctagcttcatccaagggcttcacttcaaggaatgcacaaaggaaaatctgggtctatcaaacagataaaataggagtaatagagagtcaccataggtgatttgcaaataatcccacacttaaagtgtgatggaaagaaagaatgcaacttaaactttctgatttacattgtcacg

SEQ ID NO: 15951 - DNA, 154 bp, Homo sapiens
  HUMUT539
  Located on chromosome 10
  Distance between a terminus base of telomere on chromosomal short arm and 5'-terminus of this base sequence : 24721916
  Distance between 3'-terminus of neighbour sequence of sequence listing upward to telomere on chrosomal short arm and 5'-terminus of this base sequence : 17810
gggtaataagagcaaatctctgtctcaaaataaataaataaataaataaataaataaataaataaataaataaagcagtttgagaatggacaaatacaccaaccagccatcctcaccccgaccacccatatattccttattgctttagtgaagg

SEQ ID NO: 15952 - DNA, 310 bp, Homo sapiens
  AL359532.3_35815
  Located on chromosome 10
  Distance between a terminus base of telomere on chromosomal short arm and 5'-terminus of this base sequence : 24722783
  Distance between 3'-terminus of neighbour sequence of sequence listing upward to telomere on chrosomal short arm and 5'-terminus of this base sequence : 713
gaggctgcagtaagctctaattgcaccagtgcaatctagcccaggccacaaagaaagaccccgtctcaaaaaataaataaataaataaataaataaataaataaataaataaaaataaataaaagaagaataagaagtcttcctggcagtgtgaggactggctcaggtgtctttactaggaattgaacgcaaatcatgaatgacatccccaagtcactacattcacttcttttttgacatttacgccacatactcagtccagtgtcattaagagcttctcctatacctgttcctcatattcctgctagat

SEQ ID NO: 15953 - DNA, 197 bp, Homo sapiens
  D10S1243
  Located on chromosome 10
  Distance between a terminus base of telomere on chromosomal short arm and 5'-terminus of this base sequence : 24740204
  Distance between 3'-terminus of neighbour sequence of sequence listing upward to telomere on chrosomal short arm and 5'-terminus of this base sequence : 17111
gacaaccaatttctttccccttgttaactgaaaatatcatactttgaaacagtccaatctaggctggcaaaaacatatatatatatatatatatatatatatatataaaacatattatctatctatctatctatctatctatctatctatctatctatctaaatatatttgagacagtgtctcagtgtccacattgc

SEQ ID NO: 15954 - DNA, 316 bp, Homo sapiens
  chr10.fa.O7frz.34127973
  Located on chromosome 10
  Distance between a terminus base of telomere on chromosomal short arm and 5'-terminus of this base sequence : 24775326
  Distance between 3'-terminus of neighbour sequence of sequence listing upward to telomere on chrosomal short arm and 5'-terminus of this base sequence : 34925
ccacttctgacttcaagtatgtagaaatcaaaataaaatatagagatgaatctctaaacatcttatttgggaatcacagaattggaatttgggatatatatatatatatatatatatatatatatatgcacatacaggtggtctttggtatgctcaaagaacaaaaagaaggttggtagtttattagaaggagaaatgttatgttttgttttaaaagaaagctcactgctactggagaagctttggggagctggcaaactctgattgctgaagacagcagtaggtaacactagtctatgagtcacagtaggtcatt

SEQ ID NO: 15955 - DNA, 376 bp, Homo sapiens
  chr10.fa.O7frz.34031809
  Located on chromosome 10
  Distance between a terminus base of telomere on chromosomal short arm and 5'-terminus of this base sequence : 24902719
  Distance between 3'-terminus of neighbour sequence of sequence listing upward to telomere on chrosomal short arm and 5'-terminus of this base sequence : 127077
gtgagcgtgttaaattgataacaaaccaaactacttgatagctaaagcagattgtttcgggtggggagaaaaagccctaaatcagaatgtttatatttgcctaaagatgtccttaataatacagtatgctttagatcttgcttatttagtgattgtataccaggaaaacaattagactcaaatcagtgatgttcttgttcttggtgttcatgaacatatatcaaagattaaaattgtcctgtgtttcttgtttcaaggtacgtgtgtgtgtgtgtgtgtgtgtgtgtgtgtgtgtgaagtcttaaatgttttattagtctacagctaatcagtttattgtaatattgtatgtacagtgagattaatgtcttgcgtt

SEQ ID NO: 15956 - DNA, 258 bp, Homo sapiens
  chr10.fa.O7frz.33848271
  Located on chromosome 10
  Distance between a terminus base of telomere on chromosomal short arm and 5'-terminus of this base sequence : 25072152
  Distance between 3'-terminus of neighbour sequence of sequence listing upward to telomere on chrosomal short arm and 5'-terminus of this base sequence : 169057
gactgatacaaggtcctactgtaggcttctgtgactccttgccttagagcttcctctaggttttttttgtgtgtgtacctttatgtgtgtccctgtgtatgtcttcgtgtgtgtgtgtgtgtgtgtgtgtgcacgtgcacacgtgcacacggcactcactccatctctcatctctttccttgcaccagttatccttcaaccctctgcacctccattcactagtttgtaaaacaagataattcagttgtactgtctcca

SEQ ID NO: 15957 - DNA, 414 bp, Homo sapiens
  AF225898.1_167611
  Located on chromosome 10
  Distance between a terminus base of telomere on chromosomal short arm and 5'-terminus of this base sequence : 25177867
  Distance between 3'-terminus of neighbour sequence of sequence listing upward to telomere on chrosomal short arm and 5'-terminus of this base sequence : 105457
gagatgtgatacaggctaggtaagagcatggatttcgggctgaacatagtggctaaagcctataatcccagcactttgggaggccaaggcaggaggattcctccagccgaggagttcaagaccagcctgggaaacagtgagactccctgactctccaacaaaaacaaacaaacaaacaaacaaacagccaggtgtggtggtgtatgcctgttgtcctagctactcaggaggctgaggtgggagaatcacttgagcccaggaggtttgaggctgcagtgagccatgttcacaccaccatacttcagcccaggcaatagagcaagaccctgcctcaaaaaaataaaaaagaagaagcatggatttggactcagataagcctatgttcatatcctcattctgctacttaagacgtat

SEQ ID NO: 15958 - DNA, 243 bp, Homo sapiens
  AC005877.3_92949
  Located on chromosome 10
  Distance between a terminus base of telomere on chromosomal short arm and 5'-terminus of this base sequence : 25181115
  Distance between 3'-terminus of neighbour sequence of sequence listing upward to telomere on chrosomal short arm and 5'-terminus of this base sequence : 2834
gcatgttacaaacttgttcctaactttgaaaactgcatgaaaaattactaggtctgaggttcaggcacacccggatttattttgtgtgtgtgtgtgtgtgtgtgtgtgtgtgtgtgtgtgtgttttgtattttgtatttttttagtttttactttacacagtagtgaacaggaatcacagcatacaggttactgtgtttccatgaaaagcaaggataatattgaacgaaattcattatcaatt

SEQ ID NO: 15959 - DNA, 243 bp, Homo sapiens; identical to SEQ ID NO: 15958
  AF225898.1_164426
  Located on chromosome 10
  Distance between a terminus base of telomere on chromosomal short arm and 5'-terminus of this base sequence : 25181115
  Distance between 3'-terminus of neighbour sequence of sequence listing upward to telomere on chrosomal short arm and 5'-terminus of this base sequence : -243

SEQ ID NO: 15960 - DNA, 358 bp, Homo sapiens
  AC005877.3_160520
  Located on chromosome 10
  Distance between a terminus base of telomere on chromosomal short arm and 5'-terminus of this base sequence : 25248672
  Distance between 3'-terminus of neighbour sequence of sequence listing upward to telomere on chrosomal short arm and 5'-terminus of this base sequence : 67314
tatcagttattctttccactgcttccttaaattttccaacaattcttgaaaaataatcacctaaatgcttaaataatatgtatacatatccctctacacacacacacacacacacacacacacacacacacacacacacacacacactcctgagaacacgaaggaagaaatacaattgaaaatatgggtagatatttaaaggtgaaaacaaataaccaaaactccaaaacagcttttatagactttaggaagactcttgtccaaaagagtaccagaggtcaccactgtgctcacatattaggagttcttcaatatcttgtgtcagaagaaaaacgtcaagttttgttatgccattaat

SEQ ID NO: 15961 - DNA, 313 bp, Homo sapiens
  AF225898.1_95357
  Located on chromosome 10
  Distance between a terminus base of telomere on chromosomal short arm and 5'-terminus of this base sequence : 25250222
  Distance between 3'-terminus of neighbour sequence of sequence listing upward to telomere on chrosomal short arm and 5'-terminus of this base sequence : 1192
gcttaagtttcctgactgtaagagtttcctgatgggcctttaactcatagtaagaggcaaatacacacacacacacacacacacacacacaacacacacacacacacacacacacggaatggagatgcttactggcaaatgatgcacaatgctattaactttcatttttactttcagtacttattagcaacctacttgataaagtcattttaagttggcatttatatatgacaagctaaaattagaacatggtaagtatttgctgaggattaatcaattctatactccactaagatctggctatcatgtaagg

SEQ ID NO: 15962 - DNA, 313 bp, Homo sapiens; identical to SEQ ID NO: 15961
  AC005877.3_162059
  Located on chromosome 10
  Distance between a terminus base of telomere on chromosomal short arm and 5'-terminus of this base sequence : 25250222
  Distance between 3'-terminus of neighbour sequence of sequence listing upward to telomere on chrosomal short arm and 5'-terminus of this base sequence : -313

SEQ ID NO: 15963 - DNA, 118 bp, Homo sapiens
  D10S565
  Located on chromosome 10
  Distance between a terminus base of telomere on chromosomal short arm and 5'-terminus of this base sequence : 25250239
  Distance between 3'-terminus of neighbour sequence of sequence listing upward to telomere on chrosomal short arm and 5'-terminus of this base sequence : -296
gtaagagtttcctgatgggcctttaactcatagtaagaggcaaatacacacacacacacacacacacacacacaacacacacacacacacacacacacggaatggagatgcttactgg

SEQ ID NO: 15964 - DNA, 450 bp, Homo sapiens
  AL117340.3_145833
  Located on chromosome 10
  Distance between a terminus base of telomere on chromosomal short arm and 5'-terminus of this base sequence : 25317168
  Distance between 3'-terminus of neighbour sequence of sequence listing upward to telomere on chrosomal short arm and 5'-terminus of this base sequence : 66811
acattcacagctttcaaatgacagtaaattgtctccctcatcccaactccaccatcaccaccaactccaataccttccttcttagagtgaggaagaaaaatatataccgaaagctatatttgagacctttcaggtgactgttttgggggaggggcaatattttcaaattctgaaatttcttatttagaaataattattggatctcacacacacacacacacacacacacacacacacacacacacacacaaacttacctgtggttcttgttctctgaaggaaatgcagtaattgaaaacatccccacactcttgggtacattctcctaagtgtgaatggatttggaatgcaccatagcttaactttggaacgctaacttatgccaccctgcactggcagttggcatccacctgcctacataaataataatgtaagcctgtcatcttgagt

SEQ ID NO: 15965 - DNA, 180 bp, Homo sapiens
  D10S208
  Located on chromosome 10
  Distance between a terminus base of telomere on chromosomal short arm and 5'-terminus of this base sequence : 25317299
  Distance between 3'-terminus of neighbour sequence of sequence listing upward to telomere on chrosomal short arm and 5'-terminus of this base sequence : -319
aggtgactgttttgggggaggggcaatattttcaaattctgaaatttcttatttagaaataattattggatctcacacacacacacacacacacacacacacacacacacacacacacaaacttacctgtggttcttgttctctgaaggaaatgcagtaattgaaaacatccccacactc

SEQ ID NO: 15966 - DNA, 323 bp, Homo sapiens
  AL117340.3_129648
  Located on chromosome 10
  Distance between a terminus base of telomere on chromosomal short arm and 5'-terminus of this base sequence : 25333413
  Distance between 3'-terminus of neighbour sequence of sequence listing upward to telomere on chrosomal short arm and 5'-terminus of this base sequence : 15934
tacttgaactcaggttggtgactttgagtatatccagaaaaaaactaaatttagaagtcactgcggagatgaagcataaacattcagacatccaaatgctctttggattttattttccaaaacgtaatcaacatgtatgcttctctgtgtgtgtgtgtgtgtgtgtgtgtgtgtgtgtgtgtgtgtgtgtatgaaaaacataaatgtcacattcccttctttaaaaagataaaaagatataaagttgacttgattaaggaaaatcatactacctttaaaaatgtctgcatgtaacaattttaaattcagttgaggaaatcagt

SEQ ID NO: 15967 - DNA, 220 bp, Homo sapiens
  AL356258.5_146765
  Located on chromosome 10
  Distance between a terminus base of telomere on chromosomal short arm and 5'-terminus of this base sequence : 25434564
  Distance between 3'-terminus of neighbour sequence of sequence listing upward to telomere on chrosomal short arm and 5'-terminus of this base sequence : 100828
aaactcatttcaaatcagtaacacataattttttaaaaaatgatttatttgctgccttaaatatttcccttcccattgctttatttatttatttatttatttatttatttatttatttatgagacagagtctcactctgtcacccaggatagagtacagtggcgcgatctcagctcactgcaacctctgcctctgggtttaagcaattctgactctgtag

SEQ ID NO: 15968 - DNA, 244 bp, Homo sapiens
  AL359546.7_35544
  Located on chromosome 10
  Distance between a terminus base of telomere on chromosomal short arm and 5'-terminus of this base sequence : 25616640
  Distance between 3'-terminus of neighbour sequence of sequence listing upward to telomere on chrosomal short arm and 5'-terminus of this base sequence : 181856
gtacgaggtttcagtgagctatgatagcaccactgcactccagcctaggtgaaacagcaagaccctgtctccaataaataaataaataaataaataaataaataaataaataaatatataaataaacaaataaataaataaaatattaatcacctaatagttacttatagcaatagtgctaggtatagggaatagaatcataagcaagaaagatatggtcccactccttctggagttgacagtc

SEQ ID NO: 15969 - DNA, 416 bp, Homo sapiens
  chr10.fa.O7frz.33031219
  Located on chromosome 10
  Distance between a terminus base of telomere on chromosomal short arm and 5'-terminus of this base sequence : 25738237
  Distance between 3'-terminus of neighbour sequence of sequence listing upward to telomere on chrosomal short arm and 5'-terminus of this base sequence : 121353
cataaagtacgttagacattgctaagtgttttataaatgtgctagtattaggtggtgttcttactgttttcattaacataactgttgtcaaaagcttctacagttcacctctataccaaagacttaacctacttgcttctatcctttattacttgagaaaggttactatattagggttctgttattttcagaatagtaaaagaggacctatcacctcttttaacatttaacaaatattgaaggcctaatatatgtgtgtgtgtgtatatgtgtgtgtgtgtgtgtgtgtgtgtgtgtgtgtgtgtgtatcagccagcatttcttctggctgaatgctagtaaagaaaggatcatttatattaatagtaactctggaggagagaagaaggtcccagtaaatatcatttgccaaaggt

SEQ ID NO: 15970 - DNA, 222 bp, Homo sapiens
  AL359532.3_190293
  Located on chromosome 10
  Distance between a terminus base of telomere on chromosomal short arm and 5'-terminus of this base sequence : 25764650
  Distance between 3'-terminus of neighbour sequence of sequence listing upward to telomere on chrosomal short arm and 5'-terminus of this base sequence : 25997
accttatgctctattgtgaacaagttattagaactttgatcttctctcataactcttttcccttcacttccctagaaatttaaacctggcattcaaaggccgcaatttgtttgtttgtttgtttgtttgtttgtttgttttaccatctcaagaaaaagcatggcatttaaaaaatctaggttttaaaggaggcttgatgtgtacctttgctcaccagtatca

SEQ ID NO: 15971 - DNA, 121 bp, Homo sapiens
  D10S1747
  Located on chromosome 10
  Distance between a terminus base of telomere on chromosomal short arm and 5'-terminus of this base sequence : 26050591
  Distance between 3'-terminus of neighbour sequence of sequence listing upward to telomere on chrosomal short arm and 5'-terminus of this base sequence : 285719
tgtagaccagtagaccatgacaaataggcgcgcgcacgcgcgcgcgcacacacacacacacacacacacacacacgggcttccatgttcttacaaatgttgcacactatatctgactgtgg

SEQ ID NO: 15972 - DNA, 204 bp, Homo sapiens
  D10S1749
  Located on chromosome 10
  Distance between a terminus base of telomere on chromosomal short arm and 5'-terminus of this base sequence : 26064939
  Distance between 3'-terminus of neighbour sequence of sequence listing upward to telomere on chrosomal short arm and 5'-terminus of this base sequence : 14227
gccattgtaaaaaccagctgggtaggaaggaagaagatattgattgaatgtttttcactggaagaaaaatttgtgtagcaatgagactgccctagattcaaatggaatttgaagacaatgcccatgttttctcttcgtgtgtgtgtgtgtgtgtgtgtgtgtgtgtgtgtgtgtgtgtgtttgactaacttagggtggtttttt

SEQ ID NO: 15973 - DNA, 247 bp, Homo sapiens
  Z66959
  Located on chromosome 10
  Distance between a terminus base of telomere on chromosomal short arm and 5'-terminus of this base sequence : 26147518
  Distance between 3'-terminus of neighbour sequence of sequence listing upward to telomere on chrosomal short arm and 5'-terminus of this base sequence : 82375
atttttgacattgtcccatatggatgagaaaagaaaaagtggtattttgaagatcaaagaaaaccacaaatctatggatgtcctatatgtaaatcttgtttctgtttctcctgatgctaaaatgttgaattctaaatatgcaaaggtacattcacacacaaacacacacacacacacacacacacacaccatacaggatgaacacacacattgctaatgggtcctagaaaaaggtgctagggcttag

SEQ ID NO: 15974 - DNA, 130 bp, Homo sapiens
  D10S586
  Located on chromosome 10
  Distance between a terminus base of telomere on chromosomal short arm and 5'-terminus of this base sequence : 26148509
  Distance between 3'-terminus of neighbour sequence of sequence listing upward to telomere on chrosomal short arm and 5'-terminus of this base sequence : 744
ggagactatttactttgtgtccttgatgaagatacgtgtgtgtgtgtgtgtgtgtgtgtgtgtgcgtgcgtgtgcgtgcgcgtgcgcatgtgatgaagtctcactctgttgccccggctggagtataata

SEQ ID NO: 15975 - DNA, 378 bp, Homo sapiens
  chr10.fa.O7frz.26193661
  Located on chromosome 10
  Distance between a terminus base of telomere on chromosomal short arm and 5'-terminus of this base sequence : 26498449
  Distance between 3'-terminus of neighbour sequence of sequence listing upward to telomere on chrosomal short arm and 5'-terminus of this base sequence : 349810
aaaacaatagcctatgccttaccttctcttaattctttcccctacaatttcactaagactgcttttgctaaaaagactaaacatcttttttaaattttattctatttttgaaactaaagatcttgtgtgtgtgtgtgtgtgtgtgtgtgtgtgtgtatttgagacatggtctcactctgtcacccatgctggagtgcagtggcatgatcttggctcactgcaacctccacctctcgggctcaagtgcttcttgcgcctcagcctcccaaatagccaggattacaaaaacggaccactaagcctggctaatttttgtatttttagtagagatggggtttcaccatgttgtccatggtagtgtctaactcctgtcctcaa

SEQ ID NO: 15976 - DNA, 446 bp, Homo sapiens
  AL157385.8_42815
  Located on chromosome 10
  Distance between a terminus base of telomere on chromosomal short arm and 5'-terminus of this base sequence : 26675400
  Distance between 3'-terminus of neighbour sequence of sequence listing upward to telomere on chrosomal short arm and 5'-terminus of this base sequence : 176573
cttctaattgcttcaaaatagaaacaacccaaatatccttcagctgatgaatggagtaacaaactgcactctatctatataatcaaattctactggacacaaagaagaagaagaagaagaagaagaagaagaaggagaagaagaagaagaagaagaagaagaactgatacgaagaagaagaagaactgatactgtaaaccaaaaataaaattctaagccccccagctgtggggaatgaacccctcctctcagccaagggcattccaaagttaacctgaaaaactcgttcaggccacgatgggaagaagaagccagacatgcctcgtgatcccctcctccctttaggaattgctgatagaatagaccccttaggtctgataagaaacatttacaatctattctctctgaagcctgctacctgaaggcttcatctgcatgattaaacc

SEQ ID NO: 15977 - DNA, 373 bp, Homo sapiens
  chr10.fa.O7frz.26464705
  Located on chromosome 10
  Distance between a terminus base of telomere on chromosomal short arm and 5'-terminus of this base sequence : 26795700
  Distance between 3'-terminus of neighbour sequence of sequence listing upward to telomere on chrosomal short arm and 5'-terminus of this base sequence : 119854
ctccgtctcaaataaacaaataaatagaatggtgttttttctcttttctttctttctttctttctttctttctttctttctttctttctttctttctttcctttctttctttctttcctttctttctttctttcctttctttctttctttcttccttctttcttttctttcttcctttctttcttctttttgtgctttttcatacagaaggtgctctcttatttctcacctcatttaattccatagcatttctatgatgtgggcgattaatttttttttttttttctgagacagggtctcactctgtcacccaggctggagtgcagtggtgcaatcatggctcactgcagcctcgacctactagactcaggtc

SEQ ID NO: 15978 - DNA, 103 bp, Homo sapiens
  DISO7_10002831
  Located on chromosome 10
  Distance between a terminus base of telomere on chromosomal short arm and 5'-terminus of this base sequence : 27026327
  Distance between 3'-terminus of neighbour sequence of sequence listing upward to telomere on chrosomal short arm and 5'-terminus of this base sequence : 230254
cttactgcatttccagttctattcattgtgtgtgtgtgtgtgtgtgtgtgtatgcatgtgcataaatctacattactatctagcatgatattatttctgcctg

SEQ ID NO: 15979 - DNA, 134 bp, Homo sapiens
  DISO7_10002834
  Located on chromosome 10
  Distance between a terminus base of telomere on chromosomal short arm and 5'-terminus of this base sequence : 27056103
  Distance between 3'-terminus of neighbour sequence of sequence listing upward to telomere on chrosomal short arm and 5'-terminus of this base sequence : 29673
aagcctttagtcatacatatacacgtatatacatacacacactgtcatatatatatatatatatatatatgactaatgagtttacacatacacacacacacacacacacacacagttcaggaggaaggacattt

SEQ ID NO: 15980 - DNA, 215 bp, Homo sapiens
  chr10.fa.O7frz.26880349
  Located on chromosome 10
  Distance between a terminus base of telomere on chromosomal short arm and 5'-terminus of this base sequence : 27207987
  Distance between 3'-terminus of neighbour sequence of sequence listing upward to telomere on chrosomal short arm and 5'-terminus of this base sequence : 151750
tctgctcctatactttccagtaagtaacagaattttgtttttaaagtagaaatttattttatgttgcatactataaagttactgtttacacacacacacacacacatacacacaccctggtgttactaggaagtgtggaggttttggctcttgtcttacttgaaagaaagactttggccaagagacaattagtaaagtaagcaaaggtttattga

SEQ ID NO: 15981 - DNA, 476 bp, Homo sapiens
  chr10.fa.O7frz.27054787
  Located on chromosome 10
  Distance between a terminus base of telomere on chromosomal short arm and 5'-terminus of this base sequence : 27281828
  Distance between 3'-terminus of neighbour sequence of sequence listing upward to telomere on chrosomal short arm and 5'-terminus of this base sequence : 73626
caaatgtccaacaatgatagactggattaagaaaatgtggcacatatacaccatggaatactatgcagccataaaaaaggatgagttcatgtcctttgtagggacatggatgaagctggaaaccatcattctcagcaaactatcacaaggacaaaaaaccaaacaccacatgttctcactcataggtgggaattgaacaatgagaacacttggacacaggaaggggaacatcacacaccggggcctgtcgtggggtggggggagtggggagggatagcattaagagatatacctaatataaatgacgagttaatgggtgcagcacaccaacatggcacatgtatacatatgtaacaaacctgcacattgtgtacatgtaccctagaacttaaagtataataaaaatatatatatatatatatatatatatatatataaagtttatctaaaacctacacctacatgaaatagctagg

SEQ ID NO: 15982 - DNA, 472 bp, Homo sapiens
  chr10.fa.O7frz.27182795
  Located on chromosome 10
  Distance between a terminus base of telomere on chromosomal short arm and 5'-terminus of this base sequence : 27454549
  Distance between 3'-terminus of neighbour sequence of sequence listing upward to telomere on chrosomal short arm and 5'-terminus of this base sequence : 172245
tgaagtctagtttgaagatgtctactattctgaatgtttaataactgatttcttacgggcatacaatcaattgaaatatgaaaaggcctgtctagatggaaaaagtatcttttaaagctgtggggacatcttgtggccaattttattaaagtttttttattattttatttatttatttatttatttatttatttatttatttatttattgagacggagtctaactcttgttgcccaggctggagtgcagtggcacaatctcagctcactgcaacctctgcctcccaggttcaagcgattctcctgcctcagcctcccaagtagctgggattacaggtacatgccaccatgcccggctgattttgtatttttagtagagatggggtttcaccatgttgtccaggctgttcttgaactcctgacctccagtaatccacccactttggcctcccacagtgctgtgattataggcg

SEQ ID NO: 15983 - DNA, 229 bp, Homo sapiens
  chr10.fa.O7frz.27310923
  Located on chromosome 10
  Distance between a terminus base of telomere on chromosomal short arm and 5'-terminus of this base sequence : 27578131
  Distance between 3'-terminus of neighbour sequence of sequence listing upward to telomere on chrosomal short arm and 5'-terminus of this base sequence : 123110
gaaatcattatgtggctatttaactttggactcctttcaatagaatctggttatctcattaaaagctaggcctgaaggcttctggagcatgtgtgtgtgtgtgtctgtgtgtgtgtgtgtgtgtgtctgtgtgtgtgtgtgtgtgtaataatgtcttttataaatgaaaactctatacatatatgaaaataatgtcactagtgttcttaacttatgccaagattcatag

SEQ ID NO: 15984 - DNA, 479 bp, Homo sapiens
  chr10.fa.O7frz.27381567
  Located on chromosome 10
  Distance between a terminus base of telomere on chromosomal short arm and 5'-terminus of this base sequence : 27625127
  Distance between 3'-terminus of neighbour sequence of sequence listing upward to telomere on chrosomal short arm and 5'-terminus of this base sequence : 46767
ttagtgtctttcaattctgcacaaatgtcttgtcccttcctgaccctctggaagatagatagatagatagatagatagatagatagatagatagatagatagatattataaataatatgtaaataaatatataaatatatatatttcagaaaagaacatcattgtaagtgacaattcccattgtcccccaggaatcctttatgtgactctttggggcctacattctgtcttcccaggcacactgccgatcaaatcatccctgatgattgtctcatggcaccatcgtgcttctgccgtcttgttcctgcaccaccacagacactcaggagctctcaaggggcctggactgtatagtgttctgtggcacaacaggcacctcaatctcatgcaagtacagttaaagagcatcagatctgcgctgccctcatggaaatgctcagcttctggtacaacagctgtttaattgcttcacatacagc

SEQ ID NO: 15985 - DNA, 189 bp, Homo sapiens
  HUMUT5774
  Located on chromosome 10
  Distance between a terminus base of telomere on chromosomal short arm and 5'-terminus of this base sequence : 27763805
  Distance between 3'-terminus of neighbour sequence of sequence listing upward to telomere on chrosomal short arm and 5'-terminus of this base sequence : 138199
aaagtgacagaagtcccacattagcatgtgataacaatcagcctgcaaaatttgattactagtgttatgacacttattgtacccctaacttgtatgggtggcattagatagatagatagatagatagatagatagatagatagatagatagataatgttcattatgtatgtatgaaaacatgcacacat

SEQ ID NO: 15986 - DNA, 222 bp, Homo sapiens
  D10S1775
  Located on chromosome 10
  Distance between a terminus base of telomere on chromosomal short arm and 5'-terminus of this base sequence : 27823332
  Distance between 3'-terminus of neighbour sequence of sequence listing upward to telomere on chrosomal short arm and 5'-terminus of this base sequence : 59338
ctcccctagttaatggatgtatacatagtccaatattccatatttatttacctagtcccagagtcttgtttatagatacacacacacacacacacacacacacacacccatgcagatgttgacacatgcatatatatggtgagatgatcattgttttattaatatgggattatattacacacacttttctatatctgatttttctcactcagcaatacctgt

SEQ ID NO: 15987 - DNA, 171 bp, Homo sapiens
  D10S197
  Located on chromosome 10
  Distance between a terminus base of telomere on chromosomal short arm and 5'-terminus of this base sequence : 27956506
  Distance between 3'-terminus of neighbour sequence of sequence listing upward to telomere on chrosomal short arm and 5'-terminus of this base sequence : 132952
accactgcacttcaggtgacagggcgagactccatcacacagacacacacacacacacacacacacacacacacacacacacacaagaaaagaaagggattgacatgaattttgttcgaagatttcacaatgccacttgaggtaaggagggagacctgaggacagtatcac

SEQ ID NO: 15988 - DNA, 359 bp, Homo sapiens
  AL355798.4_64610
  Located on chromosome 10
  Distance between a terminus base of telomere on chromosomal short arm and 5'-terminus of this base sequence : 28127321
  Distance between 3'-terminus of neighbour sequence of sequence listing upward to telomere on chrosomal short arm and 5'-terminus of this base sequence : 170644
ctcacagctataatctgagcactctgagaggctgaagtgggcagatcacttgaggccaggagtttgagaccagcttggccaaaattgtgaaactctgtctttactaaaaatacaaaaattagccgggcaaggtggtgtgtgcctgtgatcccagctacttgggaggctgaggcaggagaatcacctgaacctgggaggtagagcctgcagtgagccgagaccacatcactgccctccagcctgggtgacagagtgagactccagcttaaataaataaataaataaataaataaataaataaataaatttttacaaaaataataaaagctcagaattcgttctgaaattgacaaaagaca

SEQ ID NO: 15989 - DNA, 103 bp, Homo sapiens
  G10204
  Located on chromosome 10
  Distance between a terminus base of telomere on chromosomal short arm and 5'-terminus of this base sequence : 28191132
  Distance between 3'-terminus of neighbour sequence of sequence listing upward to telomere on chrosomal short arm and 5'-terminus of this base sequence : 63452
gagaacattcagtatcctcatcgtgtttgtttcattcattcattcattcattcattcattcattcattcacattttcttttggacatgagagatgatgcatta

SEQ ID NO: 15990 - DNA, 433 bp, Homo sapiens
  chr10.fa.O7frz.30126849
  Located on chromosome 10
  Distance between a terminus base of telomere on chromosomal short arm and 5'-terminus of this base sequence : 28259519
  Distance between 3'-terminus of neighbour sequence of sequence listing upward to telomere on chrosomal short arm and 5'-terminus of this base sequence : 68284
ttgcactgaggagttcaagaccagcctgggcaacatacctagacccagtctctacaaaaaaaaaaaatacatatatatatatatatataatcatatgtgtaattattaccccaggtgtggtggcatgtgcctgtaatcccagctactggggggctgtggtgggaggatcacttgagtccaggagattaaggctgcagtgagccatgatcgcaccactgcactccagcctggatgacagagtgagactctgtctcaaaaaaaagaaaaaaatctatctatacacacacacacacacacacacacacacatacacacatatatatatgcacagaggagggcagaggataacaatctatttcttattttaatgacagggtatcacacgcttgcagcaaccagaacgtgacttctcctgagtactgaagtatttcac

SEQ ID NO: 15991 - DNA, 310 bp, Homo sapiens
  AL358234.9_55041
  Located on chromosome 10
  Distance between a terminus base of telomere on chromosomal short arm and 5'-terminus of this base sequence : 28315598
  Distance between 3'-terminus of neighbour sequence of sequence listing upward to telomere on chrosomal short arm and 5'-terminus of this base sequence : 55646
gagcaagactctgtcagaaagaaagaaagagagagagaaagaaaaaagaaagaaagaaagagagagggaggaagaaagaaagaaggaaagaaagagaaagaaagaaagaaagaaagaaagaaagaaagaaagaaagaaagaaagaaagaaagaaagaaagaaagaaagaaggaaagaaagaaagagagagagactggaagaggtgtgaatgcaggcatgtggctgggtcttcgttccagctggaaagccaactcttcccctgctcaagcgtgagaggtcgagtgtcagctgagttgtcattggaaagtta

SEQ ID NO: 15992 - DNA, 258 bp, Homo sapiens
  D10S1639
  Located on chromosome 10
  Distance between a terminus base of telomere on chromosomal short arm and 5'-terminus of this base sequence : 28378499
  Distance between 3'-terminus of neighbour sequence of sequence listing upward to telomere on chrosomal short arm and 5'-terminus of this base sequence : 62591
tattggagcgaatgctgtaggatctgaaattgtttttcagaaacagttaatgttttgagaattgatgtcattttagacttaaatgcttttatgtttcctgtctacttgtgtgtgtgtgtgtgtgtgtgtgtgtgtgtgtgtttctttttttttttttttttcctgagatggagtctcgctctgttgcctaggctggagtgcagtggcacgatctcggctcactgcaacctttgcctcctgagttcaaatgattctcct

SEQ ID NO: 15993 - DNA, 428 bp, Homo sapiens
  AL390996.9_106533
  Located on chromosome 10
  Distance between a terminus base of telomere on chromosomal short arm and 5'-terminus of this base sequence : 28497403
  Distance between 3'-terminus of neighbour sequence of sequence listing upward to telomere on chrosomal short arm and 5'-terminus of this base sequence : 118646
tggcaaacatctgtaatcctagccactcaggagggtgaggcacgagaattgcttgaacctgggaggtggaggctgcagtgagctcgctccactgcacttcagcctgggcaatggagcaagactctatctcaaaaataataataataataataataataataaaataaacaaccagcttgggcaacatggcgagaccctgtctctacaaaatatttaaaaattagcagggtgcggtggcatgcacctgtagtcctagctactggggagtctgaggtgaggggatcacttgagccatggtggtggaggctgcagtgagctgagattgtgccagtgcactccagcctgggtgacagagccaggccgtctcaaaaaacacacaaacaaaacattgagtaatggagtgtggatacaaatgcaggacttcagtt

SEQ ID NO: 15994 - DNA, 291 bp, Homo sapiens
  AL355376.4_143688
  Located on chromosome 10
  Distance between a terminus base of telomere on chromosomal short arm and 5'-terminus of this base sequence : 28544690
  Distance between 3'-terminus of neighbour sequence of sequence listing upward to telomere on chrosomal short arm and 5'-terminus of this base sequence : 46859
ttctagctgttattgcacctaccacattgtgttgtcattgtctatttacatgttcacctctccaattggactctgagttctttgagctcacagccagtgtcttattcacttttttccctatttttctttctttccttccttccttccttccttccttccttccttccttccttccttccttccttccttccttccttccctccttccttcctccctccctcccttcctccctccctccctctcttctttctttcttttctttttttgtcaaggtcactgttgcctaagctg

SEQ ID NO: 15995 - DNA, 426 bp, Homo sapiens
  AL390248.5_58198
  Located on chromosome 10
  Distance between a terminus base of telomere on chromosomal short arm and 5'-terminus of this base sequence : 28653181
  Distance between 3'-terminus of neighbour sequence of sequence listing upward to telomere on chrosomal short arm and 5'-terminus of this base sequence : 108200
tacaaagcatgagaaatttcacacactcacagttgtatcaggcagggtctctacaggaaataggtggcaactccaacgcagttgaatgactgcaaaggtctgggcggggcgaagggataccagcgaagatgatcaaacccccgggcaagtaacagccagggaccctcaggcctgggaggcaagaatgggaagcagaagctggagcgaatttcagctttagctggagctgcaagcgggaggtgtttgtttcaggagaagagcacagtcactgcctaccggctgcctggtagagaaggtgctgggaagtaagacccaattcactctttttatttatttatttatttatttatttatttatttatttatttagactttgtctctccctctttcacccaggctggagttcagtggctcaatcttagctca

SEQ ID NO: 15996 - DNA, 454 bp, Homo sapiens
  chr10.fa.O7frz.31448157
  Located on chromosome 10
  Distance between a terminus base of telomere on chromosomal short arm and 5'-terminus of this base sequence : 28720288
  Distance between 3'-terminus of neighbour sequence of sequence listing upward to telomere on chrosomal short arm and 5'-terminus of this base sequence : 66681
gttatgctatccagtacagcagccactagtgtcatgtggctattcaaatgtaaatgtcttaaaattaaatataattaaaaatacgtttcttcagccgggcacggtggctcacacatgtaatcccagcactttggaggccaaggtgggcagatcacctgaggtcaggtgtttgagaccaacctggccaacatgctgaaaccctgtcgctactaaaaatacaaaaaattagccaggcatagtggcaggcgcctgtaatcacagctactcgggaggctgaggtgggagaattgcttgaacctgggagacggagattgtagtgagccaagatcatggcactgcactctagcccgggcaacagaaaaaatttatatatattttatatatatatatatatatatacacacacacacacacacacacacatttcttcatttgtactagctacatttcaggt

SEQ ID NO: 15997 - DNA, 169 bp, Homo sapiens
  D10S1732
  Located on chromosome 10
  Distance between a terminus base of telomere on chromosomal short arm and 5'-terminus of this base sequence : 28819023
  Distance between 3'-terminus of neighbour sequence of sequence listing upward to telomere on chrosomal short arm and 5'-terminus of this base sequence : 98281
ggaacctaaggcatgttgatattgaagctaagaaggccacaacttcagggccttctcatttgcatggtccccttctgaggccatatcacatgtgcatataacacacacacacacacacacacacacacacacacacacacacacatatttttttcagacagggtcttgg

SEQ ID NO: 15998 - DNA, 283 bp, Homo sapiens
  D10S1695
  Located on chromosome 10
  Distance between a terminus base of telomere on chromosomal short arm and 5'-terminus of this base sequence : 28884331
  Distance between 3'-terminus of neighbour sequence of sequence listing upward to telomere on chrosomal short arm and 5'-terminus of this base sequence : 65139
ctagtaagacctagtaagaccaccccctcccccactccatacacacacacacacacacacacacacacacacacacacacacatatatatatatatgacattggaaaaggacaatgggaaagaataatcccattggctcaggttgtggcaccattttcagcaacagcaaaaccatatttgtacacacacctttgaaatattctgttgtcaaaggacctcagtaaaatgcactatggaaaactcaaaataaatatgctatgatacgactaagtctcaaagtgta

SEQ ID NO: 15999 - DNA, 362 bp, Homo sapiens
  AL359697.15_198974
  Located on chromosome 10
  Distance between a terminus base of telomere on chromosomal short arm and 5'-terminus of this base sequence : 28952433
  Distance between 3'-terminus of neighbour sequence of sequence listing upward to telomere on chrosomal short arm and 5'-terminus of this base sequence : 67819
caagcgattgtattcactatctattgctgcataaaatattgccccaaaacttttttgaaaaatatttattttttcttttctttctttctttctttctttctttctttctttctttctttctttctttctttctttctttcttctttctttcttttttttttaagacaggggtctccctctgttgcccaggctggagtgcaatgggacaatcatagctcactgcaacctcaatctctcaagctcaagcgatcctcccaagtagctggtgctataggcgcgtgccacgacccccagctaattttttaaatttttagtagaaatgaggtctctctgtgcttcccagactggtcttcaattcctga

SEQ ID NO: 16000 - DNA, 318 bp, Homo sapiens
  D10S1214
  Located on chromosome 10
  Distance between a terminus base of telomere on chromosomal short arm and 5'-terminus of this base sequence : 28952470
  Distance between 3'-terminus of neighbour sequence of sequence listing upward to telomere on chrosomal short arm and 5'-terminus of this base sequence : -325
attgccccaaaacttttttgaaaaatatttattttttcttttctttctttctttctttctttctttctttctttctttctttctttctttctttctttctttcttctttctttcttttttttttaagacaggggtctccctctgttgcccaggctggagtgcaatgggacaatcatagctcactgcaacctcaatctctcaagctcaagcgatcctcccaagtagctggtgctataggcgcgtgccacgacccccagctaattttttaaatttttagtagaaatgaggtctctctgtgcttcccagactggtcttcaa

SEQ ID NO: 16001 - DNA, 313 bp, Homo sapiens
  AC005878.3_106241
  Located on chromosome 10
  Distance between a terminus base of telomere on chromosomal short arm and 5'-terminus of this base sequence : 29010957
  Distance between 3'-terminus of neighbour sequence of sequence listing upward to telomere on chrosomal short arm and 5'-terminus of this base sequence : 58169
caaatgtagctttctgttggacacaggcagatctgacaccatctattgcaatcaggggacaacatcaatagtgggactttgcaaacaataatggatgaaggcaatgatttctgaataacgtgtgtgtgtgtgtgtgtgtgtgtgtgtgtgtgtgtttctgtgtgtgtgtcccaggcaacagtcaacaggaagacacattttttcttagttagatttggagccgtcagagacatgttggagacatttcagtgtcctcagactcttttatagagaggctttacaggcatctgactgatggcatgagtaggtacat

SEQ ID NO: 16002 - DNA, 177 bp, Homo sapiens
  D10S213
  Located on chromosome 10
  Distance between a terminus base of telomere on chromosomal short arm and 5'-terminus of this base sequence : 29011016
  Distance between 3'-terminus of neighbour sequence of sequence listing upward to telomere on chrosomal short arm and 5'-terminus of this base sequence : -254
caacatcaatagtgggactttgcaaacaataatggatgaaggcaatgatttctgaataacgtgtgtgtgtgtgtgtgtgtgtgtgtgtgtgtgtgtttctgtgtgtgtgtcccaggcaacagtcaacaggaagacacattttttcttagttagatttggagccgtcagagacatgtt

SEQ ID NO: 16003 - DNA, 164 bp, Homo sapiens
  Z16875.1_150
  Located on chromosome 10
  Distance between a terminus base of telomere on chromosomal short arm and 5'-terminus of this base sequence : 29011053
  Distance between 3'-terminus of neighbour sequence of sequence listing upward to telomere on chrosomal short arm and 5'-terminus of this base sequence : -140
gaaggcaatgatttctgaataacgtgtgtgtgtgtgtgtgtgtgtgtgtgtgtgtgtgtttctgtgtgtgtgtcccaggcaacagtcaacaggaagacacattttttcttagttagatttggagccgtcagagacatgttggagacatttcagtgtcctcagac

SEQ ID NO: 16004 - DNA, 326 bp, Homo sapiens
  AC005878.3_31868
  Located on chromosome 10
  Distance between a terminus base of telomere on chromosomal short arm and 5'-terminus of this base sequence : 29085227
  Distance between 3'-terminus of neighbour sequence of sequence listing upward to telomere on chrosomal short arm and 5'-terminus of this base sequence : 74010
ttagagctttacctcatggtttacaccaaaagaaattccagatggactaaaaaaaaaaaataaggatttaaaataaaatcatcaaaggagaaaatttagttgtttgtatagctgttttacgagaagagaaggttttctaagcacgacacaagaggtagaaaccatactagaaaaaaacgaccagtgggggatgcaaaacaaaccttctctacatcacacacacacacacacacacacacacacacacacacacacacagagagagaggagagagagagagagagagaacaatgtgtaaaggaggtgaacatgcagttcataagaga

SEQ ID NO: 16005 - DNA, 220 bp, Homo sapiens
  D10S601
  Located on chromosome 10
  Distance between a terminus base of telomere on chromosomal short arm and 5'-terminus of this base sequence : 29085413
  Distance between 3'-terminus of neighbour sequence of sequence listing upward to telomere on chrosomal short arm and 5'-terminus of this base sequence : -140
ggggatgcaaaacaaaccttctctacatcacacacacacacacacacacacacacacacacacacacacacagagagagaggagagagagagagagagagaacaatgtgtaaaggaggtgaacatgcagttcataagagaaggcatacacacagaagataaaaccacgaaaaacctcactaataatcaaagaagggaaaattaaagccatctgttatgcc

SEQ ID NO: 16006 - DNA, 231 bp, Homo sapiens
  AL365180.11_148472
  Located on chromosome 10
  Distance between a terminus base of telomere on chromosomal short arm and 5'-terminus of this base sequence : 29123089
  Distance between 3'-terminus of neighbour sequence of sequence listing upward to telomere on chrosomal short arm and 5'-terminus of this base sequence : 37456
tggtgactaacttagtgattaaagacatctgaatcctaaatcagcagagagaaagctgagaagcaaacacagaaccaacaacaacaacaacaacaaaaagctctgaaatcagtagcattagctacttctggaagttagaatgaagacagattacaaacaggaagacacatttaaagttcacttaaggagtagttagaacatccagtcccttcctgaggcattcacctactg

SEQ ID NO: 16007 - DNA, 127 bp, Homo sapiens
  D10S224
  Located on chromosome 10
  Distance between a terminus base of telomere on chromosomal short arm and 5'-terminus of this base sequence : 29156445
  Distance between 3'-terminus of neighbour sequence of sequence listing upward to telomere on chrosomal short arm and 5'-terminus of this base sequence : 33125
ggtcaacatggcttgctgatttatgtgttgatctctctctctctctgtgtgtgtgtgtgtgtgcgtgtgtgtgtgtgtgtgtgtgtgtgaagagagagaaggggatttggcagtgatgggaggccac

SEQ ID NO: 16008 - DNA, 299 bp, Homo sapiens
  D10S204
  Located on chromosome 10
  Distance between a terminus base of telomere on chromosomal short arm and 5'-terminus of this base sequence : 29266589
  Distance between 3'-terminus of neighbour sequence of sequence listing upward to telomere on chrosomal short arm and 5'-terminus of this base sequence : 110017
tgaatccttcccaaactctgtttgtcagtatagccacacacacacacacacacacacacacacaaacacacacacgtgcacccacagtgcatctggatcactatatatatatatatatatatatatgattatgattgtcagttttacacatcaacttggctagggtacagtttccatcgttcaatcaacactaacctaggtgtgttgctgtaaaagcatttttgtagatgtgattaaaatctatattctgttgactttgagtaagggagacgatcctagataatctggatgggcctgaa

SEQ ID NO: 16009 - DNA, 472 bp, Homo sapiens
  AL157390.4_100902
  Located on chromosome 10
  Distance between a terminus base of telomere on chromosomal short arm and 5'-terminus of this base sequence : 29301252
  Distance between 3'-terminus of neighbour sequence of sequence listing upward to telomere on chrosomal short arm and 5'-terminus of this base sequence : 34364
aatttaaagaaattagcctggtgtggtgttgcacacctgtagtcccagctacttgggagactgaggcaggaggatcacttgagcccaggagtttgagaccgcagttagccatgattgtgtcactgcactccagcctgggtgacagagtgagactctcttacaaataaataaataaataaataaataaataaataaataaataaataaataaagtatttggtgaccgccagagcaggactaagggctcacacagacacaaactcattttccatattacaccactctttggcaaaagaatagctggtagagaaaaaatgttaaaaacaatagcagggccagctttaagcacaaaggaaaaaatgcaggctgttaaaactattctagtaaaaaatacaactttgaagttttcaagttctgtcagaaaggaggagataggttgctgacatatcacttgagcataaactaatctgga

SEQ ID NO: 16010 - DNA, 99 bp, Homo sapiens
  DISO7_10002838
  Located on chromosome 10
  Distance between a terminus base of telomere on chromosomal short arm and 5'-terminus of this base sequence : 29489544
  Distance between 3'-terminus of neighbour sequence of sequence listing upward to telomere on chrosomal short arm and 5'-terminus of this base sequence : 187820
aagtgggaagctggcattagaagacagggcagcagggatgtatgtgcgcgcgtacacacacacacacacacacacggaacacttggacgaaggacaaat

SEQ ID NO: 16011 - DNA, 110 bp, Homo sapiens
  DISO7_10002844
  Located on chromosome 10
  Distance between a terminus base of telomere on chromosomal short arm and 5'-terminus of this base sequence : 29540057
  Distance between 3'-terminus of neighbour sequence of sequence listing upward to telomere on chrosomal short arm and 5'-terminus of this base sequence : 50414
aaactaagaagttgtacatgcctctgtgtgtgtgtgtgtgtgtgtgtgtgtgcatgtgaacgtggtctatcaaacagaggcaacccaaagcacatacatcagaaacggct

SEQ ID NO: 16012 - DNA, 191 bp, Homo sapiens
  DISO7_10002843
  Located on chromosome 10
  Distance between a terminus base of telomere on chromosomal short arm and 5'-terminus of this base sequence : 29551140
  Distance between 3'-terminus of neighbour sequence of sequence listing upward to telomere on chrosomal short arm and 5'-terminus of this base sequence : 10973
aagagccatgcaatgaaagcttttcattctttttttatgaggatttaaaacacacacacacacacacacacacacatacacacagatgttgggtttatacaaataatcaaccaaaacatcttccaaccatgtaattttcttctcaagcatataatatgatttttctttttcctggaaactcagtgtcagga

SEQ ID NO: 16013 - DNA, 103 bp, Homo sapiens
  DISO7_10002842
  Located on chromosome 10
  Distance between a terminus base of telomere on chromosomal short arm and 5'-terminus of this base sequence : 29556250
  Distance between 3'-terminus of neighbour sequence of sequence listing upward to telomere on chrosomal short arm and 5'-terminus of this base sequence : 4919
ggcctctgtgtttatggaggtgtgtgtgtgtgtgtgtgtgtgtgtgtgtgtgtgtgtgtgtgtgtatgtatgtggtgtgtgtagcaagacagagggatgtatg

SEQ ID NO: 16014 - DNA, 106 bp, Homo sapiens
  DISO7_10002840
  Located on chromosome 10
  Distance between a terminus base of telomere on chromosomal short arm and 5'-terminus of this base sequence : 29580926
  Distance between 3'-terminus of neighbour sequence of sequence listing upward to telomere on chrosomal short arm and 5'-terminus of this base sequence : 24573
gcttagagatcagggtcagacttctttctttttttctttcttttttttttctttcttctttctttctttcctcacttcccagctttgggaaccactattccaagac

SEQ ID NO: 16015 - DNA, 140 bp, Homo sapiens
  DISO7_10002839
  Located on chromosome 10
  Distance between a terminus base of telomere on chromosomal short arm and 5'-terminus of this base sequence : 29599745
  Distance between 3'-terminus of neighbour sequence of sequence listing upward to telomere on chrosomal short arm and 5'-terminus of this base sequence : 18713
gtaagtagaggtgcttgggagaaagagagagagagagggagtgagagagagagagagagagagagagagagagagagagagagaagtgagcaaatctcaagaagtttgtgtcccaaacaatcattaactctcatttcctg

SEQ ID NO: 16016 - DNA, 295 bp, Homo sapiens
  DISO7_10002845
  Located on chromosome 10
  Distance between a terminus base of telomere on chromosomal short arm and 5'-terminus of this base sequence : 29633950
  Distance between 3'-terminus of neighbour sequence of sequence listing upward to telomere on chrosomal short arm and 5'-terminus of this base sequence : 34065
tggcttatgtgagacagagacagagagagagagagagagagagagagaaaggagaagagttatagagagagagaaagagaaagaaagagagagagaggaagaaagagagaggaggagagagaaaagagaagaggtagaagggaggagagataaagagataaagatagagagaagagagagagagaaaggagaagagagaaaagagatggagagagagaaaggagaagagatagagacagatagagaatgagagagagagggagagagagatttctccttcataaaccatgttgag

SEQ ID NO: 16017 - DNA, 307 bp, Homo sapiens
  chr10.fa.O7frz.31792180
  Located on chromosome 10
  Distance between a terminus base of telomere on chromosomal short arm and 5'-terminus of this base sequence : 29705603
  Distance between 3'-terminus of neighbour sequence of sequence listing upward to telomere on chrosomal short arm and 5'-terminus of this base sequence : 71358
agcattgctaggtattaacataagacacaccaggaattacgtgcatcaagtcccagtcctcagggagcttcaagtttaagcagaggaatgagatcggccaataataataataataataataataataataataaataataataaataaataagttatgttttcagctagctcaggctagaggccagtgcaattcagggagacagtgtttgttgtaggagctgaagactggcagatgtatgtggctggcttatcagcaaaaggtccaggagccaggatgggaagaacttgagcttgatcttaaggaat

SEQ ID NO: 16018 - DNA, 417 bp, Homo sapiens
  chr10.fa.O7frz.31946246
  Located on chromosome 10
  Distance between a terminus base of telomere on chromosomal short arm and 5'-terminus of this base sequence : 29826215
  Distance between 3'-terminus of neighbour sequence of sequence listing upward to telomere on chrosomal short arm and 5'-terminus of this base sequence : 120305
ttacattcactttctgtacgaagtctgggtgtattctacgttcacagcatgtctcaattcggaccgcctgcactccctgcgctcaattgccacctgtggccggggcttgcagtattgaacagccatccaactagagttttcaggccttgcagggtgttagaatcacctgggtggcgggggagtggctatgaaaaaatttcttgtgcccaaaacaacaaacaaatgcagtgctcgggccctactatattaattctagtctgtctgagagcctgaggctgtcacccaaataccaaatgtcagcctagcccatttgctttcccttttccagtgtgcacctccttccttcacatcacatcacacacacacacacacacacacacacacacacacacacagtttggagtctgaaattaggag

SEQ ID NO: 16019 - DNA, 477 bp, Homo sapiens
  chr10.fa.O7frz.32021410
  Located on chromosome 10
  Distance between a terminus base of telomere on chromosomal short arm and 5'-terminus of this base sequence : 29900332
  Distance between 3'-terminus of neighbour sequence of sequence listing upward to telomere on chrosomal short arm and 5'-terminus of this base sequence : 73700
gagaacatggaaggatactatttctatattcatttactttttgtgggaaaaatattacagagatggaaggtgattaagaaattttagaaagaccattccatttagcatttacaatggacaggatagcaagattgtccttccttccttccttccttccttccttccttgcttccttccttccttccttccttccttctttccttctttccttccttccttccctccctccctctctccctcccttccttcctgaatagtactgcaaatcgtatgtgccttttcaggttgaaacaaagcatttagacttcttaaaactattgaaacacacaaagtgtttagtcaagatttcctaaaaggcaggatatttagagctacttccattctgccagggaacccagatagcacaagactgcgagataacactttaatgagaagattcttatgtaatgggaaatgtgagcttaatctgagcatatg

SEQ ID NO: 16020 - DNA, 355 bp, Homo sapiens
  AL360172.12_39792
  Located on chromosome 10
  Distance between a terminus base of telomere on chromosomal short arm and 5'-terminus of this base sequence : 29941491
  Distance between 3'-terminus of neighbour sequence of sequence listing upward to telomere on chrosomal short arm and 5'-terminus of this base sequence : 40682
gaccatagttactggtatttgaagaaaatgttaacacattttgcgctagatttaagacaagtctctaatgatgtatcacttagaaagtcatgagtttaaaaaatatgaaaatatgagataatagaactgtatttcacaaaaattttaaagccgaatagatagatagatagatagatagatagatgatagatacataatagatgatagatagatagaaatataaacagataaaaacagtggcacctgattacttgaagagcagccacaaggaaggagaaccagtttagttttattcaataagaacatatgatgctaagatagtgctgggaaccgcttctgtatgagctggtcacgt

SEQ ID NO: 16021 - DNA, 355 bp, Homo sapiens; identical to SEQ ID NO: 16020
  AL158036.6_77880
  Located on chromosome 10
  Distance between a terminus base of telomere on chromosomal short arm and 5'-terminus of this base sequence : 29941491
  Distance between 3'-terminus of neighbour sequence of sequence listing upward to telomere on chrosomal short arm and 5'-terminus of this base sequence : -355

SEQ ID NO: 16022 - DNA, 158 bp, Homo sapiens
  G08812
  Located on chromosome 10
  Distance between a terminus base of telomere on chromosomal short arm and 5'-terminus of this base sequence : 30033673
  Distance between 3'-terminus of neighbour sequence of sequence listing upward to telomere on chrosomal short arm and 5'-terminus of this base sequence : 91827
ctcttaactgatttggccgatcctgaagcaatagcaactgatgaaataaatggatagatagatagatagatagatagatagatagatagatagataaaaataaaaaattaactgatttggcccagttctcaagtcatgaaagaggatgacaccaccaa

SEQ ID NO: 16023 - DNA, 466 bp, Homo sapiens
  AL360172.12_165505
  Located on chromosome 10
  Distance between a terminus base of telomere on chromosomal short arm and 5'-terminus of this base sequence : 30067366
  Distance between 3'-terminus of neighbour sequence of sequence listing upward to telomere on chrosomal short arm and 5'-terminus of this base sequence : 33535
tgtctaacatggtgaaacctcatctctactaaaagtacagaaattaacccagtgtggtggtgggcacctgtagtcccagctacttgggaggctgagataggagaatcacttgaatctgggaggcagaggttgcagtgagccaagatcatgccactgcactccagcctgggtgacagagcaagactccatctcaaaaaaaaaaaaaaaagaaaagaagaaagaaggaagaaggagagggagaagaagaaggaagaggaggaggaaaggaagaaagaaagaaagaaagaaagaaagaaagaaagaaagaaagaaagaagaaaaagaaaggaaggaaaggaaggaaggaaggaaaggaagaaaggaaggaaaagaacgaaagaaagaaagaaagaaggaaaagatgatcatccccaggcccagtaggaagcttctttgtttctggggcttcctggtctaataccacatt

SEQ ID NO: 16024 - DNA, 466 bp, Homo sapiens; identical to SEQ ID NO: 16023
  AL353796.7_147611
  Located on chromosome 10
  Distance between a terminus base of telomere on chromosomal short arm and 5'-terminus of this base sequence : 30067366
  Distance between 3'-terminus of neighbour sequence of sequence listing upward to telomere on chrosomal short arm and 5'-terminus of this base sequence : -466

SEQ ID NO: 16025 - DNA, 227 bp, Homo sapiens
  D10S193
  Located on chromosome 10
  Distance between a terminus base of telomere on chromosomal short arm and 5'-terminus of this base sequence : 30111258
  Distance between 3'-terminus of neighbour sequence of sequence listing upward to telomere on chrosomal short arm and 5'-terminus of this base sequence : 43426
attgggctgtgcctacacttggggcacaacgggagaggacacaacaggaggggacagtagccttgagaagtggcaccagttcactcctgggctttacatttgatggcgtcatagaatggaggaaatcattgtgtgtgtgtgtgtgtgtgtgtgtgtgtgtgtgtgtgtgtgtgtgtgtggtgtatacatagcaaatgtctcgaaggtcccatcccaaactgcatata

SEQ ID NO: 16026 - DNA, 298 bp, Homo sapiens
  chr10.fa.O7frz.32387241
  Located on chromosome 10
  Distance between a terminus base of telomere on chromosomal short arm and 5'-terminus of this base sequence : 30185967
  Distance between 3'-terminus of neighbour sequence of sequence listing upward to telomere on chrosomal short arm and 5'-terminus of this base sequence : 74482
cagctactcacaggctgaggcaggagaattgcttgaacccgagaggcagaggttgcactgagccaagatcgtgccactgcactccagcctgggcaacagagcgagactccggctcaaaaaaaaaaaaaaaaaaaaagaaagaaagaaaaaagaaaaaatctgtaaatactcgtatgcatatatatatttatagataacacacacacacacacacacacacacacacacacacacacccccatacctggccaactgcctcacctgtagtgctgggaatcagtcactgtgctgtccttgt

SEQ ID NO: 16027 - DNA, 448 bp, Homo sapiens
  chr10.fa.O7frz.32468298
  Located on chromosome 10
  Distance between a terminus base of telomere on chromosomal short arm and 5'-terminus of this base sequence : 30259664
  Distance between 3'-terminus of neighbour sequence of sequence listing upward to telomere on chrosomal short arm and 5'-terminus of this base sequence : 73399
aggcaatctagaaactgcagagggagcacggacctgggcactgggaagaatagggcgtggacttggagtgtgaccgcgtttgaatctgggttgtgcctgggacaccccacctcctgggccgtaggtggggggggagagagagagagagagagagagagagagaggatgtcgaccttacatggctcctagctctccgcgctctagccgaatgcctggttcctagtgggtgcttgatacgtgggaaatgtagggggagggggtggcggggcattgggaatgtcccgcagagtggatttcgggagagtggcgcttttctctagaactctcttccggttacacctggagtaaaagcttgacactctagaaggaaaaccccagatgagcagctaggactgagggttagcggtaggcgggagcggggagatagtacaagtacgcttcctaatga

SEQ ID NO: 16028 - DNA, 191 bp, Homo sapiens
  D10S1674
  Located on chromosome 10
  Distance between a terminus base of telomere on chromosomal short arm and 5'-terminus of this base sequence : 30354688
  Distance between 3'-terminus of neighbour sequence of sequence listing upward to telomere on chrosomal short arm and 5'-terminus of this base sequence : 94576
actagaggcgcccaccaccacttctggctaatttttacatttttagcagagacagggtttcaagggtgagccaccacacccagccagtgaggtagaatttttctcacttcaccgtttcctgggtctgggcgctgtgtgtgtgtgtgtgtgtgtgtttgggatgaggagtgttcattgatttgacttctgtt

SEQ ID NO: 16029 - DNA, 451 bp, Homo sapiens
  chr10.fa.O7frz.32784551
  Located on chromosome 10
  Distance between a terminus base of telomere on chromosomal short arm and 5'-terminus of this base sequence : 30370873
  Distance between 3'-terminus of neighbour sequence of sequence listing upward to telomere on chrosomal short arm and 5'-terminus of this base sequence : 15994
agtattgaagcatttctagagctttcatggtttagaaatatatgcacttgtttctctctctctctctctctctctctctctctctccctgtctctctctgtttttgttttgttttgttttgttttttttgagatggagacttgctttttcgccaggctggagtgcagtggcatgatcttggctcagtgcaacctaccccctcctgggttcaagcgattctcctgccttagtctcccgagtagctgggactacaggcacgcaccaccatgcctgactaatttttgtatttttagtagagacggggtttcaccatgttgaccaggctggtctcaaactcctgacctcaagtgtggaggccttccaaagtgctgggattacaggaatgagccaccatgcctggccatacttgtttctcttactacagaagtaatgcacatttatactcaacatt

SEQ ID NO: 16030 - DNA, 359 bp, Homo sapiens
  AC025346.1_64542
  Located on chromosome 10
  Distance between a terminus base of telomere on chromosomal short arm and 5'-terminus of this base sequence : 30465175
  Distance between 3'-terminus of neighbour sequence of sequence listing upward to telomere on chrosomal short arm and 5'-terminus of this base sequence : 93851
agaagtcatacagcattgtcacctccgccctcagctccattgcccctggctgagctgaggttccaaaacaacccccaccctctccaggtactgcttctccttgcctccatcgatatgcacaggagctttcgtacgcagtcaagggagaatttattttattttattttattttattttattttattttattttttgttagagatagggtctcactatgttgcccaggctggactgaaactcctgggcctaaggaaccctcctgcctcagcctcccaagtggctaggactgcaggcacatgttcacacagttgcagtgtttatatacaaaatttttgctaagatacgttattgcatcagtt

SEQ ID NO: 16031 - DNA, 451 bp, Homo sapiens
  AL365218.2_56844
  Located on chromosome 10
  Distance between a terminus base of telomere on chromosomal short arm and 5'-terminus of this base sequence : 30661197
  Distance between 3'-terminus of neighbour sequence of sequence listing upward to telomere on chrosomal short arm and 5'-terminus of this base sequence : 195663
caatacatatcagatgaatggatagattaatggatgggtggatggacagatgggtgggtggatggatggatggatggatggatggatggatggatggaatacagatcaaagccccttgtaccattgtgtccttcaaaacatggttcagggcaggcacagtggctcatgcctgtaatcccagcactttgggaggccaaggcagaaggatcgcttgagcccaggagctcgagaccagcctgagcaacatatcaagaccccatctctacagaaaaactttttaaatcagcagggtgtggtagcatgcacctatagttcccactactcagaagtctgaggcaggaggatcccttgagcccacattcaaggttgcagtgagttatgatcacactactgcactccagccggggcaacagagtgagactctgtctctaaagaaatgcttaattagctg

SEQ ID NO: 16032 - DNA, 441 bp, Homo sapiens
  AL160287.6_22602
  Located on chromosome 10
  Distance between a terminus base of telomere on chromosomal short arm and 5'-terminus of this base sequence : 30671904
  Distance between 3'-terminus of neighbour sequence of sequence listing upward to telomere on chrosomal short arm and 5'-terminus of this base sequence : 10256
atcacttgagcttcagtttgagaccagactgggcaatatagcgagagcttgtctctactagaaaaaaaaaattagccaggcatggtggcatgcacctgtagtcccagctactggggaggctgaggtgtttgacttgcttgagcccaggaggttaaggcggcagtgatctgtgattgcgccactgcattccagcctgggcgacagagtaagatccagtcttaaaataaataaataaataaataaataaatagaaaatgcagttccaacaactgagaagttactacaatttaatttagttgattgcttgatatttgtaatcttaaagttacatatgctagaatcaaaagttaaaaccagctatcatcacactgcttaggaaaaatgtaagcatttcctttaaactctggagttaattagctatgtttactttgaccaaagtgg

SEQ ID NO: 16033 - DNA, 372 bp, Homo sapiens
  AL160287.6_110579
  Located on chromosome 10
  Distance between a terminus base of telomere on chromosomal short arm and 5'-terminus of this base sequence : 30797622
  Distance between 3'-terminus of neighbour sequence of sequence listing upward to telomere on chrosomal short arm and 5'-terminus of this base sequence : 125277
caggactcatccacagtactaatctggatatttattttcatgtgtctttttttgagcaataaaatgtagtcactttgaaaaagcatataagcttaatctattattctaaatgtttacttcatgaacagccactgaatcacattcctcaatattaacactgaaagacacagggggttctagtctaacctcattttattttattttattttattttattttattttttgagacagagtcttactctcccgaccaggttggagggcagtggcatgatcgtagctcactgcagccttgatctccaggctcaagggatcctcccacctcagcctcccaagtagctgggactacaggtatgcactaccacgtctagct

SEQ ID NO: 16034 - DNA, 224 bp, Homo sapiens
  AL138896.5_59714
  Located on chromosome 10
  Distance between a terminus base of telomere on chromosomal short arm and 5'-terminus of this base sequence : 30797764
  Distance between 3'-terminus of neighbour sequence of sequence listing upward to telomere on chrosomal short arm and 5'-terminus of this base sequence : -230
tcctcaatattaacactgaaagacacagggggttctagtctaacctcattttattttattttattttattttattttattttttgagacagagtcttactctcccgaccaggttggagggcagtggcatgatcgtagctcactgcagccttgatctccaggctcaagggatcctcccacctcagcctcccaagtagctgggactacaggtatgcactaccacgt

SEQ ID NO: 16035 - DNA, 447 bp, Homo sapiens
  chr10.fa.O7frz.28266504
  Located on chromosome 10
  Distance between a terminus base of telomere on chromosomal short arm and 5'-terminus of this base sequence : 30870822
  Distance between 3'-terminus of neighbour sequence of sequence listing upward to telomere on chrosomal short arm and 5'-terminus of this base sequence : 72834
atacagctcaagaaatcgaatattaacaagatcactgaggcttcctgtgtgctcctctcctggattccaacccccacaaggtgtatgttaaacattctctttcttctgtaaatagtttttgtcatatatatatatatatatatatatatatatatatatatatatatacacacacacatacacatatataaccttaaacaatacacacagtttttacaaatttataaacttttgtaatggaatcaatctgtacatattgttgaattgctctttttccttgataatattttcaaaaattcatccatgtggctatgcatatcaatgtcattcatttttgctattttatttgtatgtaaatatatcataatttatttatccattctactactattagacattttggtttgagatttgtgctatcaatactactgctacgaacattcctaa

SEQ ID NO: 16036 - DNA, 136 bp, Homo sapiens
  D10S593
  Located on chromosome 10
  Distance between a terminus base of telomere on chromosomal short arm and 5'-terminus of this base sequence : 30943809
  Distance between 3'-terminus of neighbour sequence of sequence listing upward to telomere on chrosomal short arm and 5'-terminus of this base sequence : 72540
aaaaacaaataatccaaaaggaaaatggcaaaagatctggacagatacttctcaagacatacaaaacacacacacacacacacacacacacacacacacacacacacacacaaaagaagacatacgaatggcaaac

SEQ ID NO: 16037 - DNA, 400 bp, Homo sapiens
  AL365501.8_31521
  Located on chromosome 10
  Distance between a terminus base of telomere on chromosomal short arm and 5'-terminus of this base sequence : 31044304
  Distance between 3'-terminus of neighbour sequence of sequence listing upward to telomere on chrosomal short arm and 5'-terminus of this base sequence : 100359
atgtttgaacattgttctcaacaaagagtatattaagctgagtgcggtgcctcacgcctctaatccccgcactttgagaggctgaggcaggcagatcacgaggtcaggagctcgagaccatcctggccaacgtggtgaaaccctgtatctactaaaaatacaaaaattagctgggcgtggtggcacatgcctgtagtcccagctactcagtaggctgaggcacaagtgtcgctgaacctgggaggcggaggttgtagcgagccgagatcacgcaactgctctccagcctggtgacagggtgagactcagtctcaacaacagcaacaacaacaacaacaacaacgaaagagtacattggacacagaaacaatggaaataatctggaattagatgtgagttt

SEQ ID NO: 16038 - DNA, 171 bp, Homo sapiens
  DISO7_10002836
  Located on chromosome 10
  Distance between a terminus base of telomere on chromosomal short arm and 5'-terminus of this base sequence : 31101729
  Distance between 3'-terminus of neighbour sequence of sequence listing upward to telomere on chrosomal short arm and 5'-terminus of this base sequence : 57025
cctaaggtcatgtttcatggagataaaatatgatacgtaaaaaagaaagataaaatacacacacgtacacacacacacacacacacacacacacacacacacacagagagaaaaagagagagactttcccagatttacagcaaaatggaaagcaaacctagaagctggttc

SEQ ID NO: 16039 - DNA, 160 bp, Homo sapiens
  DISO7_10002835
  Located on chromosome 10
  Distance between a terminus base of telomere on chromosomal short arm and 5'-terminus of this base sequence : 31133235
  Distance between 3'-terminus of neighbour sequence of sequence listing upward to telomere on chrosomal short arm and 5'-terminus of this base sequence : 31335
tgtatacctcaggtatacatgggggatatccatgggaaatgagtaaattttcatgatatattttattactacacacacacacacacacacacacacacaaagaggcagaaagaaagcataagctaaatcaagataatttttgatgcttccaaaggatgac

SEQ ID NO: 16040 - DNA, 130 bp, Homo sapiens
  DISO7_10002837
  Located on chromosome 10
  Distance between a terminus base of telomere on chromosomal short arm and 5'-terminus of this base sequence : 31250855
  Distance between 3'-terminus of neighbour sequence of sequence listing upward to telomere on chrosomal short arm and 5'-terminus of this base sequence : 117460
ccacagacagatgtccctcgacacacacacacacacacacacacacacacacacacacacacacacagacgtcttattagaaaggtgttttttgctaatttatctaaaggttaaaggccatatctgcact

SEQ ID NO: 16041 - DNA, 201 bp, Homo sapiens
  D10S1733
  Located on chromosome 10
  Distance between a terminus base of telomere on chromosomal short arm and 5'-terminus of this base sequence : 31352260
  Distance between 3'-terminus of neighbour sequence of sequence listing upward to telomere on chrosomal short arm and 5'-terminus of this base sequence : 101275
atctgaatcaggcagggaggatgagcactgcccaggaggaaaaagcgaaaaggaaagtgtgctgagcaggtgccttggcgggggagagaggaaaaggaaatgacttcacacacacacacacacacacgcgcacacacacacagagagaatgaagtttctttctgtctcttaagtgatgtgtgagtggatggacagattgcc

SEQ ID NO: 16042 - DNA, 128 bp, Homo sapiens
  Z67193
  Located on chromosome 10
  Distance between a terminus base of telomere on chromosomal short arm and 5'-terminus of this base sequence : 31404010
  Distance between 3'-terminus of neighbour sequence of sequence listing upward to telomere on chrosomal short arm and 5'-terminus of this base sequence : 51549
gggctcagttccttaatgatcttacgtaaactgattaaacacacacacacacataaatacatacacatacacacacacacacacacacacacacacccctgggcttaaagcgtgctttcgagtggtaa

SEQ ID NO: 16043 - DNA, 458 bp, Homo sapiens
  AL354859.3_43891
  Located on chromosome 10
  Distance between a terminus base of telomere on chromosomal short arm and 5'-terminus of this base sequence : 31435953
  Distance between 3'-terminus of neighbour sequence of sequence listing upward to telomere on chrosomal short arm and 5'-terminus of this base sequence : 31815
gtaggctaagaggcaaagtaatacaagccattaggaggactttaagggtcacctgtgacaaacttgaagcacaatttctttttcttttcaacttataagttcaggggtatgtgtgcagtatgtgcaggtttgtttaaacgtgtgccttggtagtttaccacacagatcacaccatcacccagttatttatttatttatttatttatttatttatttatttatttatttttgagatggagccttgctctgttacccaagctggagtgcagtggcacgatctcagctcactgcaacctccgtctcttgggttcaagcaattctcctgcctcagcctctcaagtagctgggattacaggcgtgtgccaccacgcctgccttttttttttttttttaatttttagtacagatggggtttcaccatgtttgtcagactggtatctaactcctgatctcaagtg

SEQ ID NO: 16044 - DNA, 458 bp, Homo sapiens; identical to SEQ ID NO: 16043
  AL390916.8_88554
  Located on chromosome 10
  Distance between a terminus base of telomere on chromosomal short arm and 5'-terminus of this base sequence : 31435953
  Distance between 3'-terminus of neighbour sequence of sequence listing upward to telomere on chrosomal short arm and 5'-terminus of this base sequence : -458

SEQ ID NO: 16045 - DNA, 390 bp, Homo sapiens
  AL138920.6_118968
  Located on chromosome 10
  Distance between a terminus base of telomere on chromosomal short arm and 5'-terminus of this base sequence : 31571675
  Distance between 3'-terminus of neighbour sequence of sequence listing upward to telomere on chrosomal short arm and 5'-terminus of this base sequence : 135264
gattatggagataacaattcaagatgagatttgggtggggacacagagccaaaccatatcagtaatttattaaatatatactatggactcttataaaacaatgtagcttctggaagatgtgggggatagctgggcctcaaggacacctggaaccaagccttgtttgcccacaagattcttatggtttatctgtttgtttgtttgtttgtttttctgcctgtcttggcttccttctttttgaaaacaggtgaatttttctccaaaagtctgctaggagaccggagtttgaatcgttaagcgtttcacaagtccagttgtaaaattctaggaaaaggacactgattggcttagcatggaccatgtgcctgcttaaagaccagtcaactgatg

SEQ ID NO: 16046 - DNA, 369 bp, Homo sapiens
  chr10.fa.O7frz.29324052
  Located on chromosome 10
  Distance between a terminus base of telomere on chromosomal short arm and 5'-terminus of this base sequence : 31799227
  Distance between 3'-terminus of neighbour sequence of sequence listing upward to telomere on chrosomal short arm and 5'-terminus of this base sequence : 227162
tcaggagttgaagatcagactcaccaacatggtgaaaccccgtctctactaaaaatagaaaaattagctgggcatggtggcatgcacctgtaatcccagctactcaggaggctgaggccagagattcatttgagcccggaggcggaggttgcagtgagccgagatggcaccactgcactccagcctgggcgacagagtgagactccatctcaaaaaacaaaacaaaacaaaacaaaacaaaaacctaacaagttcatcttttgggaggaaaataaaaaacatttcatagatccaaaaccacctgcttatacagtatttgtctgaggcactggatttgtgggaacatagtggactcactaagtacgtgac

SEQ ID NO: 16047 - DNA, 163 bp, Homo sapiens
  chr10.fa.O7frz.29396680
  Located on chromosome 10
  Distance between a terminus base of telomere on chromosomal short arm and 5'-terminus of this base sequence : 31883034
  Distance between 3'-terminus of neighbour sequence of sequence listing upward to telomere on chrosomal short arm and 5'-terminus of this base sequence : 83438
atatgtaatcctgatgctgtttagttaggaaggactgtatataatccaaatacaaagagtatgtgtgtgtggagtgagtgtgtgtgtgtgtgtgtgtgtgtgtagagggattgttcatatgaataggtcttagtatattgtctcatctgaggaaatctagact

SEQ ID NO: 16048 - DNA, 391 bp, Homo sapiens
  AL390866.11_97513
  Located on chromosome 10
  Distance between a terminus base of telomere on chromosomal short arm and 5'-terminus of this base sequence : 32082129
  Distance between 3'-terminus of neighbour sequence of sequence listing upward to telomere on chrosomal short arm and 5'-terminus of this base sequence : 198932
cattggaattgaactagaaattagtaaaagaaagttctacagaaactcctcatatatattgaataaaaatatcatatatcaaatatctgtgtaacatagtttatacaatgctcataaagaaatttgcagcatgaactctcatggtcaaaataatacatacatacatacatacatacatacatacatacatacatacgctgagacagccagatcacttgaagccaggagttcaacaccagcctggccaacatggcaaaaccccatctgtaccaaaaataaaatagtttattttgggttcaggggtacatgtgcaggcttgttatataggtaaactcatgtcacaggtgtttgctgtacagatgatttcatcattcaggtactaagcctagta

SEQ ID NO: 16049 - DNA, 258 bp, Homo sapiens
  chr10.fa.O7frz.29672618
  Located on chromosome 10
  Distance between a terminus base of telomere on chromosomal short arm and 5'-terminus of this base sequence : 32088363
  Distance between 3'-terminus of neighbour sequence of sequence listing upward to telomere on chrosomal short arm and 5'-terminus of this base sequence : 5843
aacatagtccaggaagtcctagccacagtaattagtcaagaaaaagaaattgcaaaagagtctaaattggaaaggaagaagtaaaactatttgtatgcagatggcatgatcttgtatgcagaaaaacctaagaatacacacacacacccatacacacacacacacacacacacacacagagttaaatgaattcagtgaagttgcgaaattcaatcttgattttaacactcaaaaattagatctgatttgatcactcaa

SEQ ID NO: 16050 - DNA, 200 bp, Homo sapiens
  D10S1771
  Located on chromosome 10
  Distance between a terminus base of telomere on chromosomal short arm and 5'-terminus of this base sequence : 32088367
  Distance between 3'-terminus of neighbour sequence of sequence listing upward to telomere on chrosomal short arm and 5'-terminus of this base sequence : -254
tagtccaggaagtcctagccacagtaattagtcaagaaaaagaaattgcaaaagagtctaaattggaaaggaagaagtaaaactatttgtatgcagatggcatgatcttgtatgcagaaaaacctaagaatacacacacacacccatacacacacacacacacacacacacacagagttaaatgaattcagtgaagttgc

SEQ ID NO: 16051 - DNA, 142 bp, Homo sapiens
  D10S588
  Located on chromosome 10
  Distance between a terminus base of telomere on chromosomal short arm and 5'-terminus of this base sequence : 32308906
  Distance between 3'-terminus of neighbour sequence of sequence listing upward to telomere on chrosomal short arm and 5'-terminus of this base sequence : 220339
cctcggattacaggtgtgaaccactgcactcagcccatttaaacacacacacacacacacacacacacgatcacacgataacaactatgaaaattctgtactagaataaaatcaagttttgtgttcactcagttctaaacca

SEQ ID NO: 16052 - DNA, 177 bp, Homo sapiens
  D10S600
  Located on chromosome 10
  Distance between a terminus base of telomere on chromosomal short arm and 5'-terminus of this base sequence : 32480283
  Distance between 3'-terminus of neighbour sequence of sequence listing upward to telomere on chrosomal short arm and 5'-terminus of this base sequence : 171235
aagtcagcaatgcagcaccgtcaaagggttctctctccctctctgtcacacacacacacacacacacacacacacacacacacactcacccctgctttcatcatcaggttgcctcctctgactcagaccctctgcctccctcttataagaacccttgagatgacaccgagtctgcct

SEQ ID NO: 16053 - DNA, 267 bp, Homo sapiens
  AC006101.3_79774
  Located on chromosome 10
  Distance between a terminus base of telomere on chromosomal short arm and 5'-terminus of this base sequence : 32591561
  Distance between 3'-terminus of neighbour sequence of sequence listing upward to telomere on chrosomal short arm and 5'-terminus of this base sequence : 111101
tggtatgcacctgtagtcctacctacttggagggctgagatgggagaattgcctgagcctggggaggttaagactacagtgagctgtgattgcacgactgcactccagcctgggcaacagagaaagatcctgtctgaaacaaacaaaaaaatgtcttcgatgtgctgatcccaccctatggggggtgtgtgtgtgtgtgtgtgtgtgtgtgtgtgtgtgtgtgtaaaactctctggattttaattctccaaatggatgttttacatg

SEQ ID NO: 16054 - DNA, 465 bp, Homo sapiens
  chr10.fa.O7frz.34408042
  Located on chromosome 10
  Distance between a terminus base of telomere on chromosomal short arm and 5'-terminus of this base sequence : 32704528
  Distance between 3'-terminus of neighbour sequence of sequence listing upward to telomere on chrosomal short arm and 5'-terminus of this base sequence : 112700
tgaatcacaaggtcaggagaccgagaccatcctggacaacatggtgaaaccccgtctctactgaaaatacaaaaattagctgggtatagtggcgcgtacctgtaattccagctactcgggaggctaaggcaggagaatcgcttgaaccagggagtcggaagttgcagtgagccgagatcataccactgcactccagcctggcgacagagcgagactctgtctcaaaaaacaaacaaacaaacaaacaaacaaacaaacaaatgctctccaagcaggaaccatggacttgttctggggagcaactcagatttgggtggaggtaactcaggaggttcaagtcacacccactccctgctactgtccccagagtaggagtccccaagtcaggctccatggtatccccaatgaagagggtaaagccaagaccaggcttctgtaattaactgtagctactcaatgcttcac

SEQ ID NO: 16055 - DNA, 466 bp, Homo sapiens
  AL158834.13_123299
  Located on chromosome 10
  Distance between a terminus base of telomere on chromosomal short arm and 5'-terminus of this base sequence : 32758406
  Distance between 3'-terminus of neighbour sequence of sequence listing upward to telomere on chrosomal short arm and 5'-terminus of this base sequence : 53413
aaggacagcttaaaagttagaaacaagatggagtcggttcagcagagttagaccccatcttcatcatcattattattattattattattattattactattatttccagatggagtttcactcttgttgcccaggctggagtccaatggtgtaatctcggctcaccgtaatctctgcctcccagttcaagtgattctcctgcctcagcctcctgaatagctgagattacaggcgcataccaccatgctcagctaatttttgtatttttagtagagatggggttttgccatgttggccagactagtctccaactccagacctcaggtgatccgcccacctcggcctcccaaagtgctgggattacaggaatgagccaccacatccggccagattaatgattttagatctttcttcttttctaatataagcgtttaatgttacaaggtttcctgtaagcatagctgta

SEQ ID NO: 16056 - DNA, 271 bp, Homo sapiens
  chr10.fa.O7frz.34794788
  Located on chromosome 10
  Distance between a terminus base of telomere on chromosomal short arm and 5'-terminus of this base sequence : 33060534
  Distance between 3'-terminus of neighbour sequence of sequence listing upward to telomere on chrosomal short arm and 5'-terminus of this base sequence : 301662
tgatgtggttactattaggcttacaaagaacattgtatagatataacaagttgttttaaagagatgataatttatctttaatcccaaataaaagaatagaaacaaaggaaacacacacacacacacacacacacacacacacaattctacactttaacttctcccccacattttgactaagttgtctcaatttatgtattttatattaccaatctcttaacaggttgctgtaatatttttatttttgatagacttgtctttggacttcata

SEQ ID NO: 16057 - DNA, 293 bp, Homo sapiens
  Z66641
  Located on chromosome 10
  Distance between a terminus base of telomere on chromosomal short arm and 5'-terminus of this base sequence : 33160569
  Distance between 3'-terminus of neighbour sequence of sequence listing upward to telomere on chrosomal short arm and 5'-terminus of this base sequence : 99764
ttgcacatacacacagggctcctcagtttgcgcgcgtgcacgcacacacacacacacacacacacattcatacacacatgttcttatgtacacaaacatgcatatacatgcaaataaacatatttagaaatgaggaattctcatggacatcttcaattccagtttatcctctcaggtcttattcttgccttccttcattttgtatgtatttgttttcttttccacagtgtaaacctgactgaacattaacaacacatgtactcatttgctttatcccctaatgctcctcaatt

SEQ ID NO: 16058 - DNA, 147 bp, Homo sapiens
  DISO7_10002846
  Located on chromosome 10
  Distance between a terminus base of telomere on chromosomal short arm and 5'-terminus of this base sequence : 33238495
  Distance between 3'-terminus of neighbour sequence of sequence listing upward to telomere on chrosomal short arm and 5'-terminus of this base sequence : 77633
attataccattgtttctggtgtgtgtgtgtatatatatataaatatatatatacatacacacatatacatgtatatatgcatgtgtgtatatatatacatataactgtgtgtgtgtgtatatatatatgttcattcagccagtctcc

SEQ ID NO: 16059 - DNA, 114 bp, Homo sapiens
  DISO7_10004896
  Located on chromosome 10
  Distance between a terminus base of telomere on chromosomal short arm and 5'-terminus of this base sequence : 33332257
  Distance between 3'-terminus of neighbour sequence of sequence listing upward to telomere on chrosomal short arm and 5'-terminus of this base sequence : 93615
ttagtgatttggcaattcagacattttgctataacttttattcattaataacaaaggctgattaatttaatacacacacacacacacacacacccctcacattcctatgtaagg

SEQ ID NO: 16060 - DNA, 474 bp, Homo sapiens
  chr10.fa.O7frz.138157119
  Located on chromosome 10
  Distance between a terminus base of telomere on chromosomal short arm and 5'-terminus of this base sequence : 33735579
  Distance between 3'-terminus of neighbour sequence of sequence listing upward to telomere on chrosomal short arm and 5'-terminus of this base sequence : 403208
tttattgactgaggtaatttgaagccaaataatggttatgaggaggatggaagcttttggaaaatgtgaacttgaggcactcttctgatgctaaaaatctctaaggaaaatagtacatcaccagtgtcaccagtgtggttctaaggcagctggtggcccagaatgtgaggacgtgaaatacaaaactttctcatttccaccatcatattatttgctggattcaggaaaatctgaaggaaggtctttttatgcaacacacacacacacacacacacacacgcatgcacacgcgcgcaagcgcacgcacacacactcagcccaggaagtagacatttgattaaaccaaaaagtcagtccaaagcccaatttataccaagggaacatgcagatttcacaaacactgactcagaaaccagattttctccactgcttttttttccccaaagggggttgaagatatgtattcaactgaaa

SEQ ID NO: 16061 - DNA, 339 bp, Homo sapiens
  chr10.fa.O7frz.138082090
  Located on chromosome 10
  Distance between a terminus base of telomere on chromosomal short arm and 5'-terminus of this base sequence : 33803322
  Distance between 3'-terminus of neighbour sequence of sequence listing upward to telomere on chrosomal short arm and 5'-terminus of this base sequence : 67269
gccaggcatatatattaacacattggcaattattattattattattattattattattattattatttgagaccgaatctcgctctatcacccaggctggaatgaaatggcgcaatctcggctcactgcaacctccacacattgacaattatcaatctatctatctgctaacttagccctttcaaagaagctgtgtgagataagtagtggtagaggtgggattggaacagaaataacaggtcactggttctccgctctttcttacctactgggccaaccatgttgccatttggaagaaattggagtggttttcttgtcataactcaagtcataactcgt

SEQ ID NO: 16062 - DNA, 351 bp, Homo sapiens
  chr10.fa.O7frz.137953402
  Located on chromosome 10
  Distance between a terminus base of telomere on chromosomal short arm and 5'-terminus of this base sequence : 33913173
  Distance between 3'-terminus of neighbour sequence of sequence listing upward to telomere on chrosomal short arm and 5'-terminus of this base sequence : 109512
ctgagttacctcacttagaatgacagtctccaattccattcaggttgctgcaaataccttaattcattcctttttatggctgagtgtttatatatatatatatatatatatatcacagtttcttcatccacttgattgatgggcatttgggctgtttctatatttttgtaattgcaaattgtgctgctataaaaatgggtgtgcaagtatctttttcatataatgacttcttttcctctgggtagatacccagtagtgggattgctggatcaaatggtagatctacttttagttctttaaggaatctccacactgttctccacagtggttgtacaagtttacattaccacc

SEQ ID NO: 16063 - DNA, 417 bp, Homo sapiens
  chr10.fa.O7frz.18639858
  Located on chromosome 10
  Distance between a terminus base of telomere on chromosomal short arm and 5'-terminus of this base sequence : 34025166
  Distance between 3'-terminus of neighbour sequence of sequence listing upward to telomere on chrosomal short arm and 5'-terminus of this base sequence : 111642
ttataggagtttgtgaaacaagacattgggatttatttatttatttatttatttatgtatttatttatttatttatggagacagagtttcgctcttgctgcccaggctggagtgcaatagcatgatctcagctcactgcaacctctgcctcccgggttgaagtgattctcctgcctcagcctcccaagtagctgggattacaggcatacgcctccatgcccggctaatttttgtatttttagtagagacggggtttcaccatgttggccaggctggtctcgaactcctgactgacctcaagtgatctacccacttcggcctcccaaagtgctaggattacaggcatgagccaccacaccctgcctggattttaaaaaccagattaatatggctgtgatctcatacatgaagactgat

SEQ ID NO: 16064 - DNA, 424 bp, Homo sapiens
  chr10.fa.O7frz.18710535
  Located on chromosome 10
  Distance between a terminus base of telomere on chromosomal short arm and 5'-terminus of this base sequence : 34059037
  Distance between 3'-terminus of neighbour sequence of sequence listing upward to telomere on chrosomal short arm and 5'-terminus of this base sequence : 33454
ggtagttagcagtgcattgtagagggtttctgcatttgaaagttaagtttgaaaaccattaaaccaggtattattgttattattattattattattatttttgagacggaggcttgctctgtcacccaggctggagtgcagtggcatgatctcagctcactgcaagctccacctcccaggttcacgccattctcctgcctcagcctcccaggtagctgggactacatgcgcccaccaccaagcctggctaattttttgtatttttagtagagatggggtttcactgtgttagccaggatggtctctatctcctgacctcgtgatccgcccacctcggcctcccaaagtgctgggattacaggcgtgggtcaccgcgcccggctaaaccaggtattatttaaggtcaatgtgttactatgacttt

SEQ ID NO: 16065 - DNA, 462 bp, Homo sapiens
  chr10.fa.O7frz.18843035
  Located on chromosome 10
  Distance between a terminus base of telomere on chromosomal short arm and 5'-terminus of this base sequence : 34173389
  Distance between 3'-terminus of neighbour sequence of sequence listing upward to telomere on chrosomal short arm and 5'-terminus of this base sequence : 113928
agaaggtttcataggattcactagattctccgaagtttcatcgcacaaaaatgattcagaaacattattctagttgctggaaataaagtagcaaacaagtcagatacggtccgggcttccacagaacttacctcgggggatgaggaaagaggaagatgacaaacaataaacaaagaatcagcagatttctaggtagtcatagggctatgtatacaactcatgtgtgtgtgtgtgtgtgtgtgtgtgtgtgtgtgcctgtatgtgtttcctatactatatatgagagtaggagcaataagagagaaaccatatcatgtacagcatgtagactagggtaataagtttcagttttcttctaattacattgtgtgttcatcaaagatttttttaaattgtgataaaatacatataatgtgaaatttaccatcttaatcattttaagggtacagttcggtggcatta

SEQ ID NO: 16066 - DNA, 327 bp, Homo sapiens
  chr10.fa.O7frz.19049372
  Located on chromosome 10
  Distance between a terminus base of telomere on chromosomal short arm and 5'-terminus of this base sequence : 34258275
  Distance between 3'-terminus of neighbour sequence of sequence listing upward to telomere on chrosomal short arm and 5'-terminus of this base sequence : 84424
atactcatattgtttctatggcactatatatgtacatggccatatatatagtgccatattataatggtgtatatatatatccaccaaagctctcatctgaccaattaagccatatatatgattatgcatgtatatataaaaagttattataagccatatatatgattacaagagatgtaaaaagagatatatatgtatgtgtgtgtgtgtgtgtgtgtgtgtgtgtatatatatatatatgtaaaaagagattgtagccccgtatatatgtgagagatatatatacaccaagtagatgcagatctacttacagctacggtggattag

SEQ ID NO: 16067 - DNA, 434 bp, Homo sapiens
  chr10.fa.O7frz.19228413
  Located on chromosome 10
  Distance between a terminus base of telomere on chromosomal short arm and 5'-terminus of this base sequence : 34443241
  Distance between 3'-terminus of neighbour sequence of sequence listing upward to telomere on chrosomal short arm and 5'-terminus of this base sequence : 184639
agcaggtttataaactaaggctagtgagaaaaataatggattggacaattgttttaaaaatttgggacaattttgtaatcccagcactttgggaggccaaggtgggcagattacctgaggtcaggagttcaagaccagcctggctaacatggtgaaacccagtctctactaaaaacacaaaatatgccaggtgtggtggtgtgtgcctgtaatcccagctacttcagaggctgaggcaggagaattgcttgaacctgggaggtggggaggttgcagtgagctgagatcatgccactgcactccagcctgggccacaagagtgaaactctgtctcaaaaataaataaataaataaataaataaataaaaataactgggacatgttttggatttagtcaaaacagaaacagcttgaaattctgctataatttacaa

SEQ ID NO: 16068 - DNA, 208 bp, Homo sapiens
  chr10.fa.O7frz.19344221
  Located on chromosome 10
  Distance between a terminus base of telomere on chromosomal short arm and 5'-terminus of this base sequence : 34541913
  Distance between 3'-terminus of neighbour sequence of sequence listing upward to telomere on chrosomal short arm and 5'-terminus of this base sequence : 98238
catgctataagaaactggacagacatcatgagaaaacactcagtttcaccaaacctggtgtttttttttaaataatgtttcttcttttgttttctccttccttccttccttccttccttccttccttccttccttccttcctccctccctccctcccttctttccttcatttattaattggcttttaagtgctaactagcaagactgt

SEQ ID NO: 16069 - DNA, 335 bp, Homo sapiens
  chr10.fa.O7frz.19426492
  Located on chromosome 10
  Distance between a terminus base of telomere on chromosomal short arm and 5'-terminus of this base sequence : 34627076
  Distance between 3'-terminus of neighbour sequence of sequence listing upward to telomere on chrosomal short arm and 5'-terminus of this base sequence : 84955
gatccaacctctagattgaaacagcagcctacactggaatatgttaaatgaccacatgccgaggcagaacccagattgtgtgaaattctgtaggacaaatgaccagttttcttttatgaccccattgctaaggggacaatgggaagaaatggggaatctgcagaggaaagaaacataagacccagcaaccagttgcaatgtttagaccttatttggatcctgatttaaacaaatgattgaaaacacacacacatacacacacacacacacacacacaaattctgtgagaccctctgcgaaataagaacacagactggatgtttgctgatattaaa

SEQ ID NO: 16070 - DNA, 311 bp, Homo sapiens
  X91622.1_210
  Located on chromosome 10
  Distance between a terminus base of telomere on chromosomal short arm and 5'-terminus of this base sequence : 34740525
  Distance between 3'-terminus of neighbour sequence of sequence listing upward to telomere on chrosomal short arm and 5'-terminus of this base sequence : 113114
taagtccatcacttcctgtcttacatgaacctcaattattcttttttctgggtttcaatcttaggtctgtttctcactgatgcatacattttttccttagtttttcctcattagtttttctctatatgttcttaccaaggacctcaacaaaatatctctcagtcttgtttgacagcaagaaaacacacacacacacacacacacacacacacacacacacacatacacacacagttatttagtagtagaaaatttacagaagcttggaaaggcattgaaattcctatatgttccatttagaatttccatcc

SEQ ID NO: 16071 - DNA, 146 bp, Homo sapiens
  D10S548
  Located on chromosome 10
  Distance between a terminus base of telomere on chromosomal short arm and 5'-terminus of this base sequence : 34837285
  Distance between 3'-terminus of neighbour sequence of sequence listing upward to telomere on chrosomal short arm and 5'-terminus of this base sequence : 96449
ttggttgtggtaatggtttcacagataatcacataagttaaaacttaacacaaattgcactctgtggagggatggatgtgtgtgtctctgtgtgtgtgtgtgtgtgtgtgtgtgtgtgtccctgtccctatacctcaatactactg

SEQ ID NO: 16072 - DNA, 366 bp, Homo sapiens
  chr10.fa.O7frz.35407225
  Located on chromosome 10
  Distance between a terminus base of telomere on chromosomal short arm and 5'-terminus of this base sequence : 35036029
  Distance between 3'-terminus of neighbour sequence of sequence listing upward to telomere on chrosomal short arm and 5'-terminus of this base sequence : 198598
ttagctgccacttataagtgagaacatgtggtatttggtttccgattcgaattacttcacttagaataatggcctccagttccatccaagttgctgcaaaagacattatttcattactttttatggctgagtagtattccatgcatgtgtgtatgtatatatatatatacatacacacacacacatacacacatatgtatgtgcatatataaataaaacttttatatatatacacacacaccaacatatctacacacacacacacacacacacacacacacatatatacacacatatatatactcaccacattttctttatccactcatcattgcttttggggtcttagtcataaattctttgcct

SEQ ID NO: 16073 - DNA, 468 bp, Homo sapiens
  AL365203.9_130223
  Located on chromosome 10
  Distance between a terminus base of telomere on chromosomal short arm and 5'-terminus of this base sequence : 35139481
  Distance between 3'-terminus of neighbour sequence of sequence listing upward to telomere on chrosomal short arm and 5'-terminus of this base sequence : 103086
cctgatctttcactgtagacagcttgagaaacaggggcttaaacctttaatgatgagtccaagttccacatcaagcacattccagaaccaagatttacatcctatcctggcttcaaacccttgctctttagcataccactctattacctacttgataacagtgatgataagtcaagaaagaaataaaacagcaatttgatgactatcattatcctctaaagattcaggaactcaaacttcaaaatttgggagactaaaataagaagagagtttatacctaagtcaagattctggcctacaaccatcatcattatttatttatttatttatttatttatttatttatttatttaaattatactttaagttctagggtacatgtgcacaatgtgcagttttgttatataggtatactgtgctatgttggtttgctgtacccattaactcgtcatctacattaggtatttc

SEQ ID NO: 16074 - DNA, 392 bp, Homo sapiens
  AL133333.9_189168
  Located on chromosome 10
  Distance between a terminus base of telomere on chromosomal short arm and 5'-terminus of this base sequence : 35139557
  Distance between 3'-terminus of neighbour sequence of sequence listing upward to telomere on chrosomal short arm and 5'-terminus of this base sequence : -392
acattccagaaccaagatttacatcctatcctggcttcaaacccttgctctttagcataccactctattacctacttgataacagtgatgataagtcaagaaagaaataaaacagcaatttgatgactatcattatcctctaaagattcaggaactcaaacttcaaaatttgggagactaaaataagaagagagtttatacctaagtcaagattctggcctacaaccatcatcattatttatttatttatttatttatttatttatttatttatttaaattatactttaagttctagggtacatgtgcacaatgtgcagttttgttatataggtatactgtgctatgttggtttgctgtacccattaactcgtcatctacattaggtatttc

SEQ ID NO: 16075 - DNA, 413 bp, Homo sapiens
  AL133333.9_84281
  Located on chromosome 10
  Distance between a terminus base of telomere on chromosomal short arm and 5'-terminus of this base sequence : 35206752
  Distance between 3'-terminus of neighbour sequence of sequence listing upward to telomere on chrosomal short arm and 5'-terminus of this base sequence : 66803
tggtatgtgcttgtagtcctagttactggggaggctgagacaggagcatcctttgagcccaagagttcaaggctacagtgagctatgatcatgtcactgcactccagcctgggtgacagagtgagactgtctcaataataataataataataatgataatattcaaatcacacttgaccctggctgccaatcccacctacactccaatccccctgagaaaatacattgggtagcagccttggttcatttggggcattaagagaatttgagcaatcagaagactcactcccatgtttctttgccattttccacattcttatcattttcttgtaattgtgtaattgattggatttttaattgtgggatggtaaatttttaatcaggagaaaatagtcatggatagaagtaggtga

SEQ ID NO: 16076 - DNA, 423 bp, Homo sapiens
  AL121748.6_109777
  Located on chromosome 10
  Distance between a terminus base of telomere on chromosomal short arm and 5'-terminus of this base sequence : 35307374
  Distance between 3'-terminus of neighbour sequence of sequence listing upward to telomere on chrosomal short arm and 5'-terminus of this base sequence : 100209
acattttctgccactccatagccctttttgggatagccacttttgttgcaaattcatatcctgtgagagctccagggccaacactccattaaaaacacaagagctgtcaggttggccctgtgacatttctctctctctctctctctctctctctctctgtctctctctctcatctactttttggagacaatgtttaaggagagatgttcaacccaagacaatgcctccaggactttgctttctcaccaccaaccacctgaccccagagagaaatgcccttctgacccctactggttatgatggggcatacaccaagtgcagagaattctttccaagctgatttcagaatattctccaaaacactctccaacaatgattggacaagaaggttaaacatagagaacgttgactcagtcctgatta

SEQ ID NO: 16077 - DNA, 456 bp, Homo sapiens
  AL121748.6_43118
  Located on chromosome 10
  Distance between a terminus base of telomere on chromosomal short arm and 5'-terminus of this base sequence : 35373958
  Distance between 3'-terminus of neighbour sequence of sequence listing upward to telomere on chrosomal short arm and 5'-terminus of this base sequence : 66161
tacagtactaggtcaaatagcgttctcccctttgacttcattccttgatggaagatcttgtccctcacactaatgcgtgactttaatccttttttgattattggtaaaattatgttttagtggtcaaagtcaaaactgagttataaattatttttaactaaaaatcagtttttccagggcttgtgcgtcaagatttatttatttatttatttatttatttatttatttatttaagatggagtctcgctctgttagccaggctggagtgcagtgatgcgatctcggctcactgcggcctccgcctcccgggttcaagcaattctcctgcctcagcctcctgagtagctaggattacaggtgcccacagccacacccagctaatttttgtatttttggtagagatggggtttcaccatgttggttggccaggctggtgttgaattccttacttcaagt

SEQ ID NO: 16078 - DNA, 223 bp, Homo sapiens
  AL121748.6_35019
  Located on chromosome 10
  Distance between a terminus base of telomere on chromosomal short arm and 5'-terminus of this base sequence : 35382159
  Distance between 3'-terminus of neighbour sequence of sequence listing upward to telomere on chrosomal short arm and 5'-terminus of this base sequence : 7745
acagcaacatttatcagtggagactgagataaaatttgcataaacacatcttactaaaataactcctattttccattagtttctcatatatgtgtgtgtgtgtgtgtgtgtgtgtgtgtgtgtgtgtgtgtatgtatctcctagtcactttcctacaacttatccgccctagaagcccaaaccctctttcttttctcaagtcacttatccacaacttatcacc

SEQ ID NO: 16079 - DNA, 312 bp, Homo sapiens
  AL121748.6_26725
  Located on chromosome 10
  Distance between a terminus base of telomere on chromosomal short arm and 5'-terminus of this base sequence : 35390352
  Distance between 3'-terminus of neighbour sequence of sequence listing upward to telomere on chrosomal short arm and 5'-terminus of this base sequence : 7970
cctggataatgttaagcaagttacttagtccattcaagtcttagtttcctctactctcaaacagaaatgccaatgcttacctcatttagtcattctgcatggctactatgaagatcacgatgatgcatatgtacacatattaaccatgagaatgtgacctaatatttttttacttagtcttttgggtaattggagtgggtgcctctgtgtgtgtgtgtgtgtgtgtgtgtgtatgtgtgcgcatagttttgccagtagtacctagattataattcctttgaaggagagagagagtctccttcactttaggcc

SEQ ID NO: 16080 - DNA, 122 bp, Homo sapiens
  DISD22_0000148
  Located on chromosome 10
  Distance between a terminus base of telomere on chromosomal short arm and 5'-terminus of this base sequence : 35484468
  Distance between 3'-terminus of neighbour sequence of sequence listing upward to telomere on chrosomal short arm and 5'-terminus of this base sequence : 93804
aagctcaacaactaaagccagattttcagcattccccagatttctgctaagaaaactaagaagtgtgtgtgtgtgtgtgtgtactgcatatatatttgtgtagttcacaacctaaagtctga

SEQ ID NO: 16081 - DNA, 101 bp, Homo sapiens
  DISD22_0000151
  Located on chromosome 10
  Distance between a terminus base of telomere on chromosomal short arm and 5'-terminus of this base sequence : 35593190
  Distance between 3'-terminus of neighbour sequence of sequence listing upward to telomere on chrosomal short arm and 5'-terminus of this base sequence : 108600
aatgccaacacatcttgctgtaaatatctcagtgtgtgtgtgtgtgtgtgtgtgtgtgtgttgtgtgttgtgtgtgtattcctaggtctgggttcttggtg

SEQ ID NO: 16082 - DNA, 463 bp, Homo sapiens
  chr10.fa.O7frz.36091029
  Located on chromosome 10
  Distance between a terminus base of telomere on chromosomal short arm and 5'-terminus of this base sequence : 35816192
  Distance between 3'-terminus of neighbour sequence of sequence listing upward to telomere on chrosomal short arm and 5'-terminus of this base sequence : 222901
attcagcaactgatgtagtcagggatgtgctggtaaatgtctcacaactggctttccaggaccggtttgcagcatttgctgattttcatggtgtagacccttccctcatggctgacatcaagctaccaatgggttggcatctggcttgcacaactgctggaaatttagcaatcaactcgagcacgctggcacaagttgctccagccccagtaccggacatgacttaaagagtgagggggtggaaaattacagtcaaagggggtccactacctacccaaatcctataaaacggccccacccctatctccctgcgctgactcctttttcggactcagcccacctgcacccaggtgaaataaacagccttgttgctcacacacacacacacacacacacacacacacacacacacaaagagtaaggggtgaaatggctttgcttgtaactggattccaagagaatc

SEQ ID NO: 16083 - DNA, 294 bp, Homo sapiens
  AC018978.8_839
  Located on chromosome 10
  Distance between a terminus base of telomere on chromosomal short arm and 5'-terminus of this base sequence : 35904917
  Distance between 3'-terminus of neighbour sequence of sequence listing upward to telomere on chrosomal short arm and 5'-terminus of this base sequence : 88262
ccaagtatccttctctttcaaggcttgtttcagccaaaataaaagactcagccactctctcccttcaatatttctaagcaagagattcttcgtggattgggtagttcagaaagatcgagcaaatttcaaagcatgcctccttcattctcatcaatgatagaaaagtctatctatctatctatctatctatctatctatctatctatctatctatttgaactgtaacaatctaattcaagtttgacattttttgattgggaaactgagtacctcatatctaatgcaaggattaga

SEQ ID NO: 16084 - DNA, 324 bp, Homo sapiens
  HUMUT8114B
  Located on chromosome 10
  Distance between a terminus base of telomere on chromosomal short arm and 5'-terminus of this base sequence : 35913647
  Distance between 3'-terminus of neighbour sequence of sequence listing upward to telomere on chrosomal short arm and 5'-terminus of this base sequence : 8436
agcctgggcaacagagtaagccctgtctgaaagaaagaaagaaaaaaagaaagaaagaaaaaaagaaagaaagaaagaaagaaagaaagagagagagaaagaagaaagaaagaaagaaagaaagaaagaaagaaagaaagaaagaaagaaagaaagaaagaaagaaagaaagaaagaaggaagggaaggaaatactggaaccctgagaaaatgagggatggtgggaaggagagggaggaagagagagagagagtgagagagagataactgattagaaaggacagcctaacaggagctgtgacttctgacaagagtagcaggcag

SEQ ID NO: 16085 - DNA, 255 bp, Homo sapiens
  AL117338.15_9685
  Located on chromosome 10
  Distance between a terminus base of telomere on chromosomal short arm and 5'-terminus of this base sequence : 36147989
  Distance between 3'-terminus of neighbour sequence of sequence listing upward to telomere on chrosomal short arm and 5'-terminus of this base sequence : 234018
agtattccacgattctccagtatatttgtaaaaaagaaaaaaaaaacactgaaatgtatttaccctcctacaaaagaaggtttgaactctttataaaaatatgcaagcaattgattctgcatttgacagatctgaatcttaaattcacacacacacacacacacacacacacacacacacacacacacaccacttatcaagggcttcccatcagacttttaaagacctgaactctttagtttaaccaacaaggcc

SEQ ID NO: 16086 - DNA, 364 bp, Homo sapiens
  AL117338.15_111419
  Located on chromosome 10
  Distance between a terminus base of telomere on chromosomal short arm and 5'-terminus of this base sequence : 36249679
  Distance between 3'-terminus of neighbour sequence of sequence listing upward to telomere on chrosomal short arm and 5'-terminus of this base sequence : 101435
agaagtggtctcatagaaggagaaatacggcccagattctaacagaacctgttctcctacccaaactaaactcagcattctcaccaattccaactaagaagaaattgaatcaatctttctttctttctttctttccttttctttctttctttctttccttttctttctttctttcttccttctttctttcttccttccttccttccttccttccttccttccttccttccttcctttcttcctttctttcttctttctttcttttgccaaactcctgataaatggtgctaccaggattggaacgcagataaattcatttgttgcctagatgacattttaaccatatggaaactacatgcaattc

SEQ ID NO: 16087 - DNA, 116 bp, Homo sapiens
  D10S675
  Located on chromosome 10
  Distance between a terminus base of telomere on chromosomal short arm and 5'-terminus of this base sequence : 36282391
  Distance between 3'-terminus of neighbour sequence of sequence listing upward to telomere on chrosomal short arm and 5'-terminus of this base sequence : 32348
ggcaacatgacaaaaccctgtctctattatttttatatatatgtatatatatatatagatagatagatagatagatagatagatagatagatagatagatatctcgtgtgtgtggc

SEQ ID NO: 16088 - DNA, 182 bp, Homo sapiens
  AL117338.15_163493
  Located on chromosome 10
  Distance between a terminus base of telomere on chromosomal short arm and 5'-terminus of this base sequence : 36301924
  Distance between 3'-terminus of neighbour sequence of sequence listing upward to telomere on chrosomal short arm and 5'-terminus of this base sequence : 19417
actcaggtaagttgccatacacacacacacacacacacacacacacacatatccatatccacacatttttacttattggtatcctaagccaaaatatgactcagttatatagcttgacaagaacacaaatggggaacatggaaacagaatattcctgcatgtcactatctggcaatgctaat

SEQ ID NO: 16089 - DNA, 339 bp, Homo sapiens
  HUMUT8138B
  Located on chromosome 10
  Distance between a terminus base of telomere on chromosomal short arm and 5'-terminus of this base sequence : 36369619
  Distance between 3'-terminus of neighbour sequence of sequence listing upward to telomere on chrosomal short arm and 5'-terminus of this base sequence : 67513
cagcaaagtgagactgtcaaaaaaagaaaggaaagaaagaaagaaagaaagaaagaaagaaagaaagaaagaaagaaagaaagaaagaaagaaagaaagaaagaaagaaagaaggaaggaaagaaagaagagagaaagaaagaaagaagaaaggaaagaaagaaagaaagaaagaaagaaagaaagaaagaaagaaagaaagaaagaaaaagaaagaaagaaaaagggaaagagagagtaagaaaggagggaggaagggaaagagagagagagagaaagaaagagaaaggaaagaaaggaaaaagaaaattatgaatactccattaggcacaaggtctt

SEQ ID NO: 16090 - DNA, 261 bp, Homo sapiens
  chr10.fa.O7frz.36849950
  Located on chromosome 10
  Distance between a terminus base of telomere on chromosomal short arm and 5'-terminus of this base sequence : 36481544
  Distance between 3'-terminus of neighbour sequence of sequence listing upward to telomere on chrosomal short arm and 5'-terminus of this base sequence : 111586
acataatgctggtgattatgagtttcacatttttgtctttttttctgtaaacagtcaacattcacttagtgactcagcaaaagacagatttatcatatttcactaagttccaacctgggtaccaattttaactaaagttaattaaaaatccataagaatgcctatctgaaatcactaattggtgtgtgtgtgtgtgtgtgtgtgtgtgtgtgtgtatgtgtgtgtgtgtctgtgaagagataactggaaggatgatcctag

SEQ ID NO: 16091 - DNA, 308 bp, Homo sapiens
  chr10.fa.O7frz.37046070
  Located on chromosome 10
  Distance between a terminus base of telomere on chromosomal short arm and 5'-terminus of this base sequence : 36658106
  Distance between 3'-terminus of neighbour sequence of sequence listing upward to telomere on chrosomal short arm and 5'-terminus of this base sequence : 176301
gcatatcagaaatctttcatctactctaaatttacacaccagttcccttgggtggaaggcgtcttcctggcgaaagaccagaaggctcacagttccttccatcttggtgcttctcaacagcgaaacaacttcctcttgggatttgcccactaaatctactccatttacctaaaacaaaacaaaagttttcagctgtaatcctgtggaaacaacaggaaaacacacacacacacacacacacacacacacacacacacacactctaggactagccatatctgctatggaacataactcatttcatgcac

SEQ ID NO: 16092 - DNA, 180 bp, Homo sapiens
  G08808
  Located on chromosome 10
  Distance between a terminus base of telomere on chromosomal short arm and 5'-terminus of this base sequence : 36694934
  Distance between 3'-terminus of neighbour sequence of sequence listing upward to telomere on chrosomal short arm and 5'-terminus of this base sequence : 36520
tcataatcacatgagccaattccttatagtaaatgttatatgtgtgtatatatctaaagacatacatatctagatagatagatagatagatagatagatagatagatagatagatagacagaatctccattctaccagttctgtttctctgaaaaaccctaatacaatcatatttgtgga

SEQ ID NO: 16093 - DNA, 236 bp, Homo sapiens
  chr10.fa.O7frz.37165799
  Located on chromosome 10
  Distance between a terminus base of telomere on chromosomal short arm and 5'-terminus of this base sequence : 36715461
  Distance between 3'-terminus of neighbour sequence of sequence listing upward to telomere on chrosomal short arm and 5'-terminus of this base sequence : 20347
ggaagactaagcaaataggaaaacgcagaattgattttaaaaacaaacagatggagagggagacaaatattacataggtctagtcaaaaggaatatggctgaaatgagaacaggtgctgtgaaaatagaaagatatacacgtgcacatacacacacacacacacacacacacacacacacacacacagaggagtaaaggtataatatatagtacctggcactaggtaagacataaa

SEQ ID NO: 16094 - DNA, 208 bp, Homo sapiens
  chr10.fa.O7frz.37401679
  Located on chromosome 10
  Distance between a terminus base of telomere on chromosomal short arm and 5'-terminus of this base sequence : 36923001
  Distance between 3'-terminus of neighbour sequence of sequence listing upward to telomere on chrosomal short arm and 5'-terminus of this base sequence : 207304
catgcttgtacctgtagtcccagctacttgggaggctgaggtgggagaactgcttgaggccaggagatcaaggctgcagtgagctataattgcaacactgcactccagcctcggtaacagagtaagacacacacacacacacacaccacacacacacagtaaaagagcagatacctcgcagagtgttatgagaatccatttatgtgaa

SEQ ID NO: 16095 - DNA, 354 bp, Homo sapiens
  AL138768.10_93605
  Located on chromosome 10
  Distance between a terminus base of telomere on chromosomal short arm and 5'-terminus of this base sequence : 36984487
  Distance between 3'-terminus of neighbour sequence of sequence listing upward to telomere on chrosomal short arm and 5'-terminus of this base sequence : 61278
gattcagaacgctgtgaacacaaagataaaaatgaaagggtaaaaacatcatatcaaaaagacacacttatttttatttcctactgaaagcccactgaaaccacaatacacgcggggatgttgttgttgttgttgttgttgttgttgttgttgttgttgtttccaagcataatcgcacaaagacaaagagaacagagggaaatgagggaaacacagtttttggaagctgagaagcagatggcccagaggcgacacattttgcagaaccaagaaagggaaccccaaggtaactgtggggaaagccaagaagcagcaagacttccccaacagagccggtaagaggctctggaatgg

SEQ ID NO: 16096 - DNA, 218 bp, Homo sapiens
  chr10.fa.O7frz.37540230
  Located on chromosome 10
  Distance between a terminus base of telomere on chromosomal short arm and 5'-terminus of this base sequence : 37252011
  Distance between 3'-terminus of neighbour sequence of sequence listing upward to telomere on chrosomal short arm and 5'-terminus of this base sequence : 267170
tctgctattctcacttaaatcaaggtctttcagtcttgatctagtgctccatcttttattattattattattattattattattattattattattattttagagacagggtctcactgtgttgcccaagctggagtgcagccatttctcttaccgtctcctgtctctgaagagcaggaggaagtaaaagttgaaaaacaatagcaatgaagtcagtg

SEQ ID NO: 16097 - DNA, 402 bp, Homo sapiens
  chr10.fa.O7frz.37691165
  Located on chromosome 10
  Distance between a terminus base of telomere on chromosomal short arm and 5'-terminus of this base sequence : 37402599
  Distance between 3'-terminus of neighbour sequence of sequence listing upward to telomere on chrosomal short arm and 5'-terminus of this base sequence : 150370
aaagaattctaaaggtccaactctctatttctgtggatctccatttgcactgtggagttgcttgagccatataattttaccatgtttatctctggtggatgtcagttaatattaagtgggttatggactaattttagctctctgtgaaaatcaacacacccagattttaaaacaaatattttggtactcatatctaggtatactataatttttagggaggttttaaaattaattttatttatttatttatttatttatttatttatttatttatttatttatagagacagggtctcactctgttatccaggttacagtccagtggtgcaaactcctagacccaagggatcctcctgcctcagccttccgcctagctgggactacagacatgctaccacatct

SEQ ID NO: 16098 - DNA, 393 bp, Homo sapiens
  AL157783.6_106488
  Located on chromosome 10
  Distance between a terminus base of telomere on chromosomal short arm and 5'-terminus of this base sequence : 37474256
  Distance between 3'-terminus of neighbour sequence of sequence listing upward to telomere on chrosomal short arm and 5'-terminus of this base sequence : 71255
agctgaagtcttcataatgttaagttgacctatcccaaaccatagaaagtcttgtttattcagatctcattttacttcttttaacagttgaacatttttctttttatttatttatttatttattatactttaagttttagggaacagttgaacatttttcttcacggagatcttgcatattctttctttagttggttcctaagtactttatgggttttgttgccattacaatggtaccttattttgtattgtattttctaattgttgctggtgtagagaaatacggattattttaagtcgatcttttatctattaactttgctgaactctaattacttctaataatttactgattctttgtgattcggtctgtgatcctatgtgaatgtttat

SEQ ID NO: 16099 - DNA, 179 bp, Homo sapiens
  HUMUT5962
  Located on chromosome 10
  Distance between a terminus base of telomere on chromosomal short arm and 5'-terminus of this base sequence : 37552479
  Distance between 3'-terminus of neighbour sequence of sequence listing upward to telomere on chrosomal short arm and 5'-terminus of this base sequence : 77830
gttaaaagcagccatgcggcacactgaacactgcttagagattttctttgccaaataatctacttccttccttccttccttccttccttccttccttcctgctttcttgctttcttttttgttttttgagacagagtctcactctgttgcccaggctggagtgcagtggcaaaatcttg

SEQ ID NO: 16100 - DNA, 309 bp, Homo sapiens
  AL117336.22_104122
  Located on chromosome 10
  Distance between a terminus base of telomere on chromosomal short arm and 5'-terminus of this base sequence : 37594146
  Distance between 3'-terminus of neighbour sequence of sequence listing upward to telomere on chrosomal short arm and 5'-terminus of this base sequence : 41488
tcacgcctgtaatcctagtactttgggaggccaaggtgggaggattgcgtgagtccaggagttcaagaccagcctgggcaacatggtgaaaccctgtctcaacaaaacaaaacaaaacaaaacaaaacaaaacaaaacaaaacaaaacaagaggattggaaggcacagtgactcatgcctatcatcccaacactttgggaggctgaggcaggaggattgcttgaggccaggagttggaaaccaggctggtcaacatagccagatcctgtctctacaaaagcaaaataattaaagttagctagacacggt

SEQ ID NO: 16101 - DNA, 101 bp, Homo sapiens
  DID22N_0003540
  Located on chromosome 10
  Distance between a terminus base of telomere on chromosomal short arm and 5'-terminus of this base sequence : 37699412
  Distance between 3'-terminus of neighbour sequence of sequence listing upward to telomere on chrosomal short arm and 5'-terminus of this base sequence : 104957
tctggaaacttgtggcacccgtgtgtgtgtgtgtgtgtgtgtgtgtgtgtgtgtccttgtagggtgctacttctctccttgcctacctaccgtgtactttg

SEQ ID NO: 16102 - DNA, 107 bp, Homo sapiens
  DID22N_0003551
  Located on chromosome 10
  Distance between a terminus base of telomere on chromosomal short arm and 5'-terminus of this base sequence : 37869985
  Distance between 3'-terminus of neighbour sequence of sequence listing upward to telomere on chrosomal short arm and 5'-terminus of this base sequence : 170472
ggctcctgcatgtacctacgtgtgtgtgtgtgtgtgtgtgtgtgtgtgtgtgtgtggtcagctctgggttaaatggaaagaccacggtcctggaagaggcagctctg

SEQ ID NO: 16103 - DNA, 237 bp, Homo sapiens
  Z67402
  Located on chromosome 10
  Distance between a terminus base of telomere on chromosomal short arm and 5'-terminus of this base sequence : 37988177
  Distance between 3'-terminus of neighbour sequence of sequence listing upward to telomere on chrosomal short arm and 5'-terminus of this base sequence : 118085
ttgttaattgctatgctcagataatttattttgctaataggtgtctctgtccatgtgtagtgtctgtgtgtatggcatgtgtatgtatgtatttgtggtgtgtgcatgtgtgtatgtgtgcatgtttgtgcatatgtatacatgcactgtgcctgtctgtgcatgcgtgtgtgtgcttttgtgtgtgtgtgtgtgtgtgtgtgtgtgtgtgttgtgaagccagcagcaatgtgagtt

SEQ ID NO: 16104 - DNA, 373 bp, Homo sapiens
  chr10.fa.O7frz.38347312
  Located on chromosome 10
  Distance between a terminus base of telomere on chromosomal short arm and 5'-terminus of this base sequence : 37998908
  Distance between 3'-terminus of neighbour sequence of sequence listing upward to telomere on chrosomal short arm and 5'-terminus of this base sequence : 10494
ggttaggagcgaagtgtattagtcagggttcaccaaagaaacagaataaacacacagacacacagatacacacacacacacacacacacatacacacacagagagagggagggagagaatgctacagagaaagagaggggagagccccagagatacagagacagagggatagagagacacagagacacagagagagagagagagagaaagagagagaatgttggagagaaagagaggggagatccccggagatacagagacagacagacagatagacagacacacacacgcacacacacacacacacacacacagaggtaaagagagagagagagagaaatttattataaggtaatagctcacttgattagtc

SEQ ID NO: 16105 - DNA, 178 bp, Homo sapiens
  D10S1217
  Located on chromosome 10
  Distance between a terminus base of telomere on chromosomal short arm and 5'-terminus of this base sequence : 38155354
  Distance between 3'-terminus of neighbour sequence of sequence listing upward to telomere on chrosomal short arm and 5'-terminus of this base sequence : 156073
gggttaaatttgggagcacttggtaaaatgaggagagacccaacttttttcccttgaaatctggtgactggttcagtaacagggaagggaagaaggaaggaaggaaggaaggaaggaaggaaggaaggaaggaaggaaggaaggaaggaaggaaaatgatatgcgaataatcagccca

SEQ ID NO: 16106 - DNA, 177 bp, Homo sapiens
  D10S1768
  Located on chromosome 10
  Distance between a terminus base of telomere on chromosomal short arm and 5'-terminus of this base sequence : 38183844
  Distance between 3'-terminus of neighbour sequence of sequence listing upward to telomere on chrosomal short arm and 5'-terminus of this base sequence : 28312
cccagggacttagggtgaatttctccaaagacgtgtgtgtgtgtgtgtgtgtgtgtgtgtgtgtgtgtgtgtacatgttctccccagggtactgaccccagatagcccacagtgctgtgggcacctcagcatggcttgggcaataacagaaaaaacaggagggcagacacggcttct

SEQ ID NO: 16107 - DNA, 466 bp, Homo sapiens
  chr10.fa.O7frz.38634384
  Located on chromosome 10
  Distance between a terminus base of telomere on chromosomal short arm and 5'-terminus of this base sequence : 38285097
  Distance between 3'-terminus of neighbour sequence of sequence listing upward to telomere on chrosomal short arm and 5'-terminus of this base sequence : 101076
taagttggcagactgagtaaagctggttaccttccataatgtgaatgggcctcacccaatcaattgaagactttacgagagaaagctgaggtccctcaaagaggaaggaattctgcctccagattgctttcctttgggcttgagttgcaacattaactttttccttagtctcttgccggctgacctgccctgcatatttaggacttgccagcccctacaatcacatgggccaattccttaaaataattctctctctctgtctccctctgtgtgtgtgtgtgtgtgtgtgtgtgtgtgtgtgtgtacacacacaccagattctccggagaatcctgacttatatgggttgtggtttacttatttggaatctaagtttactgggaagttattcctaaagaacacaacttaatttttcctaattggttaaaagatgtgcaaatctcttaaggacttgtcattagatcac

SEQ ID NO: 16108 - DNA, 136 bp, Homo sapiens
  DISO7_10002848
  Located on chromosome 10
  Distance between a terminus base of telomere on chromosomal short arm and 5'-terminus of this base sequence : 38354047
  Distance between 3'-terminus of neighbour sequence of sequence listing upward to telomere on chrosomal short arm and 5'-terminus of this base sequence : 68484
gtcctggcctgtactgatcttttgatcagtgactctgtgtgtgtatctgcgtgtgtgtgtgtgtgtgtgtgtgtgtgtgtgtatcgtgtgtgtctttccattttatctgaaggggctaaataatagtgctgtggtt

SEQ ID NO: 16109 - DNA, 234 bp, Homo sapiens
  chr10.fa.O7frz.39044494
  Located on chromosome 10
  Distance between a terminus base of telomere on chromosomal short arm and 5'-terminus of this base sequence : 38609634
  Distance between 3'-terminus of neighbour sequence of sequence listing upward to telomere on chrosomal short arm and 5'-terminus of this base sequence : 255451
ctttgtaacttagcgttatcctagatacgggatcgtggtaatcacagattctgattttcaagaagagctctgtgtttgcatagcctttctctccctctctctctctctctctctctctcgtgtagattatccactagatcacttgttccagaaaacaaagttgttctgagcccaatacaaacgaccccagagatacaacagtcatttcccctgtaagtctaaactaccgtcaga

SEQ ID NO: 16110 - DNA, 376 bp, Homo sapiens
  chr10.fa.O7frz.39149350
  Located on chromosome 10
  Distance between a terminus base of telomere on chromosomal short arm and 5'-terminus of this base sequence : 38706135
  Distance between 3'-terminus of neighbour sequence of sequence listing upward to telomere on chrosomal short arm and 5'-terminus of this base sequence : 96267
gatgccagtggttacatagtagcaagggttttagactacactctcagggaaatgttccaaaccatccaaggtgacctcttgcgcgcgcgcgcgcacacacacacacacacacacacacacacacacacggtagaagctaacatttggcactctatctttttctttgtttgtttacggcctaacataccccaaggtgttccagatactcatgctgctaccaggtaaccaggccaccacactgccatctgttttagctccaccctaacttaacagtgcttttgtgttccagaatttcccctacctccttccactcctgcatctccagattcatttctttctgttcctttactttctgatcaaacttatagaactgagg

SEQ ID NO: 16111 - DNA, 368 bp, Homo sapiens
  chr10.fa.O7frz.39278095
  Located on chromosome 10
  Distance between a terminus base of telomere on chromosomal short arm and 5'-terminus of this base sequence : 38841523
  Distance between 3'-terminus of neighbour sequence of sequence listing upward to telomere on chrosomal short arm and 5'-terminus of this base sequence : 135012
attgttcctaatggagtagattaactatcaaaaaggtacaaaagtctagttttcacaccagaaacatcactctgacagatttttcattagtgtctgtgttttattaacatatatatataaagtgtgtggtgtgtgtgtgtgtatgtgtgtgtgtgtgtgtccaaattatcatttgaaatttccacccaatgatttggtgtcacacagacatgaccttaaatgctttgtcttttaaattgtgaaaatcttcctgagatttataacatttcctaatttttgaccagggtttgataatttcacttaaagaagaaatagaaactcatagggtttttgctgcattataccttgatccttcattaaagtgtatg

SEQ ID NO: 16112 - DNA, 390 bp, Homo sapiens
  chr10.fa.O7frz.39463609
  Located on chromosome 10
  Distance between a terminus base of telomere on chromosomal short arm and 5'-terminus of this base sequence : 39012100
  Distance between 3'-terminus of neighbour sequence of sequence listing upward to telomere on chrosomal short arm and 5'-terminus of this base sequence : 170209
acagacatatttgtccaaacacgttcttcataccagtgcttccaaaattcccataagcctctctttcccaaggggaatcttagaaaaggaaggttaatgagcccatgctatagcgattggtctcagaactgcctttgaatgcccagttgtgagaggggaacagagaaagagagagtataggagtggggagagtgtgtgtgtgtatcagtgtgtgtatgtgtgtgtgtgtgtgtgtgtgtgtgtgagagagagagagagagaaagattatctctgcttcttttgtggaaaagcagccctacctcctcctgctaatcagggtgtattcatcctgctggatggtgatgtatttcttgtcttttggttgctggacctaaggaatctaaagcatg

SEQ ID NO: 16113 - DNA, 209 bp, Homo sapiens
  D10S1791
  Located on chromosome 10
  Distance between a terminus base of telomere on chromosomal short arm and 5'-terminus of this base sequence : 39095899
  Distance between 3'-terminus of neighbour sequence of sequence listing upward to telomere on chrosomal short arm and 5'-terminus of this base sequence : 83409
atgcaacataacttgggcaacataatttgaacattggaagcacatggtattctagacattatgatctcaccacattaaagaaagaataacctattccaaacaatttctccatttagtgtattttagtgtatttagtgtgtgtgtgtgtgtgtgtgtgtgtgtgtgtgtgtgtgtgtttagacggagtctcactctgttgctaggctgga

SEQ ID NO: 16114 - DNA, 101 bp, Homo sapiens
  DISO7_10000054
  Located on chromosome 10
  Distance between a terminus base of telomere on chromosomal short arm and 5'-terminus of this base sequence : 39163921
  Distance between 3'-terminus of neighbour sequence of sequence listing upward to telomere on chrosomal short arm and 5'-terminus of this base sequence : 67813
gattggcaggtttgtaaggacggtgttcagactgcagttttgttttgttttgttttgttttttttaaagattaagtgatcctgaaattggcattccatgtc

SEQ ID NO: 16115 - DNA, 359 bp, Homo sapiens
  chr10.fa.O7frz.40299893
  Located on chromosome 10
  Distance between a terminus base of telomere on chromosomal short arm and 5'-terminus of this base sequence : 39419919
  Distance between 3'-terminus of neighbour sequence of sequence listing upward to telomere on chrosomal short arm and 5'-terminus of this base sequence : 255897
gtgctatcataagattatggaagtgttgatcacaaaaaggtaattcaaaaagcaatgtgtaaatagcatgtgtttacatatatacatatatgtgggtgtgggtgtgtgtatgtgtgtgtgtgtgtgtgtgtgtatatatatatatatatatatagctttgatttgattttttggtttataattcagaattagttaagaatttagttgtaggcagtttataatctcaaaaaatgttacctgaaaaaatatttgtttaattatggtccctaaatcctatataatacttttgtataaataacgcaagttttaagtttgtatattttatgtttcctcaactgtcctaacaacttaggcttgtt

SEQ ID NO: 16116 - DNA, 236 bp, Homo sapiens
  DISO7_10000061
  Located on chromosome 10
  Distance between a terminus base of telomere on chromosomal short arm and 5'-terminus of this base sequence : 39565743
  Distance between 3'-terminus of neighbour sequence of sequence listing upward to telomere on chrosomal short arm and 5'-terminus of this base sequence : 145465
ccacttactaatctctttggttatgagacatttaatttggctttaggggtggaattttcttgatgcctatgaaaaagaagttaaaagacaatgccaacaacaaatggaaactttcacctctctctgtctttctctctctctctctctctctctcacacacacacacacacacacacacacaaattagtcatctttttttcctccacctgtttcacacagatattctagggcactgt

SEQ ID NO: 16117 - DNA, 270 bp, Homo sapiens
  Z66966
  Located on chromosome 10
  Distance between a terminus base of telomere on chromosomal short arm and 5'-terminus of this base sequence : 39717717
  Distance between 3'-terminus of neighbour sequence of sequence listing upward to telomere on chrosomal short arm and 5'-terminus of this base sequence : 151738
cccaatcgttgaagatgttaagagagaaaactgagatccctcaaagaggaaggaattctgcctccaaattgctttcctttgggcttgagttgcaacattaactttttccttagtatctggcctgctgacctgccctgcatatttaggacttgccagcccctacaatcacatgggccaattccttaaaataattatctctctctgtctccctctgtgtgtgtgtgtgtgtgtgtgtgtgtgtgtgtgtgtgtgcgcgcacgtagggttttc

SEQ ID NO: 16118 - DNA, 186 bp, Homo sapiens
  HUMUT540
  Located on chromosome 10
  Distance between a terminus base of telomere on chromosomal short arm and 5'-terminus of this base sequence : 39752139
  Distance between 3'-terminus of neighbour sequence of sequence listing upward to telomere on chrosomal short arm and 5'-terminus of this base sequence : 34152
gggggtgagggaattgcataacatttaagggagcatcaacccttccccccatgcatgggcttcttccggaaagggcccatcagaaccaccaccccccaccagggaaggggtgttatttatttatttatttatttatttatttatttatttatttgagatgaagtctcgctgttgtcatccaggctg

SEQ ID NO: 16119 - DNA, 299 bp, Homo sapiens
  chr10.fa.O7frz.40745687
  Located on chromosome 10
  Distance between a terminus base of telomere on chromosomal short arm and 5'-terminus of this base sequence : 39836294
  Distance between 3'-terminus of neighbour sequence of sequence listing upward to telomere on chrosomal short arm and 5'-terminus of this base sequence : 83969
tgtagtgagccgagatcatcacaccactgcactccagtctggcaacagagcaagactccatctcaataaataaataaataaataaataaataaataaataaataagaaagaaatataggcacaggcaggtggtctttcaggtatgtagtctttttacgtttggatatatatctaacccatacacttcaactttatattctaaatcaatttagattctgttacaagtgactttgaaggattttattgttttcttttgtaaaaattaaattgtgaatgtaacttagctccaagttatggat

SEQ ID NO: 16120 - DNA, 351 bp, Homo sapiens
  AL132657.33_4112
  Located on chromosome 10
  Distance between a terminus base of telomere on chromosomal short arm and 5'-terminus of this base sequence : 39908832
  Distance between 3'-terminus of neighbour sequence of sequence listing upward to telomere on chrosomal short arm and 5'-terminus of this base sequence : 72239
caagttggtatctatagcggatagttgttacctatctgaacttaggagaactggagtcttgtaactgattttaaggtgattctgaggcagtatgcatggaatggcagtgaggaagggtcagagagcgagctggcctagaagccaatgctcaggaccctgcaagcttggtttattttcctttctctccctcccttatttcttaattaattttataaaacctatagggatggattcgataagattaaactcatctattcaaaacacggattctcaggctgtatatatatgtgtgtgtgtgtgtgtgtgtgtgtgtttaaagcaagctatctgctatgacatgttaacagaaag

SEQ ID NO: 16121 - DNA, 449 bp, Homo sapiens
  AL132657.33_140457
  Located on chromosome 10
  Distance between a terminus base of telomere on chromosomal short arm and 5'-terminus of this base sequence : 40045217
  Distance between 3'-terminus of neighbour sequence of sequence listing upward to telomere on chrosomal short arm and 5'-terminus of this base sequence : 136034
gacaccagttagactggatcacagcccatgctaatggtctcattttaacctaattatctctgtaaaggccctatctccaatacagtcacattctgaggcattgagggggttagggcttcagaaaaggaattatgcctcaagactgcagcattaacgtctgcctagctcccagcctgctggcctgccctacaaattttacattcgaccagcccctataatcacataaaccaatttctgaaaatgaatacacacacacacacacacacacaggcacatgcacccatatcctatcagttgtttctctggagaacagtgattgacacagggcttagggcatgttatttttcttcatcttaaagtttttcctccattccatttccctccttctctcctgacagccaccagaagaaatggggagtagtctactctagatctgtcaacaggagcat

SEQ ID NO: 16122 - DNA, 352 bp, Homo sapiens
  AF205588.1_26725
  Located on chromosome 10
  Distance between a terminus base of telomere on chromosomal short arm and 5'-terminus of this base sequence : 40108085
  Distance between 3'-terminus of neighbour sequence of sequence listing upward to telomere on chrosomal short arm and 5'-terminus of this base sequence : 62419
tctaacctactgccaaacagactataccgtcattcttcgtcctcctttcctgtgtgaattctcttcacagcacttaccatgacccaacacagtgtgtgtgtacctatatacacacacatatgcacatgggtgtgtacatatatacaaacacacagacatgtacacacacacacacacacacacacacacacacacgcatttttttgtcctttattttaatacacacactaagataccagggacattattctgttaattacctaaaacataacagacatagtgagtgctcatcatatgttgttaaatgaatatatagaaggattgcatgaatacctgtcagctaacaaaaggt

SEQ ID NO: 16123 - DNA, 298 bp, Homo sapiens
  AF205588.1_29448
  Located on chromosome 10
  Distance between a terminus base of telomere on chromosomal short arm and 5'-terminus of this base sequence : 40110779
  Distance between 3'-terminus of neighbour sequence of sequence listing upward to telomere on chrosomal short arm and 5'-terminus of this base sequence : 2342
ctttgtatcctttcactacaataaatcatagccataagtatgactatgggtctacaagaaacaatacatcagtaacaactgacacacctagcaccctaatttttgtttctaacgccatgctccaatatatgctgagtcatcctaggacatcattaataacctgggggtggtctcaagacacctcttatacatgtatacacaaacacacacacacacacacacatgcacacacacatacataaaatggacattctagatctgaaaagtacaatatctgaaattaagagcttattggatg

SEQ ID NO: 16124 - DNA, 338 bp, Homo sapiens
  AF205588.1_161698
  Located on chromosome 10
  Distance between a terminus base of telomere on chromosomal short arm and 5'-terminus of this base sequence : 40242851
  Distance between 3'-terminus of neighbour sequence of sequence listing upward to telomere on chrosomal short arm and 5'-terminus of this base sequence : 131774
aaggcagtaacctatttagcatggttttcatgccaccagtgcaagtatcaacagtgtaaaaggcaatctacatcttagcactctgagtctcaacctcatagatcccttgagagggtcttggagctcccagggatctgcagaccacattttgagaattgctgttttattcaaacggtattttgcctgtaggtgatttttaactatttctacgtttctaatttagtatatgggctctcgttcataaaactcattaaacacacacacacacacacacacacacacacacacacacacacagtgaaacaaagttagggctaagtaaatgactcacctggaac

SEQ ID NO: 16125 - DNA, 435 bp, Homo sapiens
  AL117339.10_12812
  Located on chromosome 10
  Distance between a terminus base of telomere on chromosomal short arm and 5'-terminus of this base sequence : 40354631
  Distance between 3'-terminus of neighbour sequence of sequence listing upward to telomere on chrosomal short arm and 5'-terminus of this base sequence : 111442
agtacaaatttccatcactgctgattcattacaagtttctagaactattttatcaaatgggtcactgatgagataaaaactgcattaatatagatgttgccattttttcagggattatttaattgaaggggtagttgacagtgtttgggaaggaacgtgtaatatttcctcactctgagtatagaattttaatggttaatagctagatagaaaaatgtgtgtgtgtgtgtgtgtgtgtccccatcacaaacatacatatacatgtccagtgactcaggaatttcaccactgcctgtttcatatgaaatttaagatttagtgctgaaacggaagaaaaactagaaaacagtgttacatctctgaatgctcaattaggggagaaaataaaaagtatttgggaatatatcaagaaaatagaaccatctgattgaagga

SEQ ID NO: 16126 - DNA, 270 bp, Homo sapiens
  AL117339.10_94355
  Located on chromosome 10
  Distance between a terminus base of telomere on chromosomal short arm and 5'-terminus of this base sequence : 40436241
  Distance between 3'-terminus of neighbour sequence of sequence listing upward to telomere on chrosomal short arm and 5'-terminus of this base sequence : 81175
aggataagacaatgctgtcctagggctggccatctgataaagcttcccagaaagtgcagtaatggacccctgggaggctttctgctctcctgtctgcgggttcctggtgagaggacctattggccactaaggtgtctgaatatgtgtctgtgtgtgtgtgtgtgtgtgtgtgtgtgtgtgtgtcagagtgatgtgtgtgttcttggcttgatttctttcagcatgaagcccactgttttgctgaatgtatctgtttcctgaaactcagtg

SEQ ID NO: 16127 - DNA, 467 bp, Homo sapiens
  AL117339.10_130055
  Located on chromosome 10
  Distance between a terminus base of telomere on chromosomal short arm and 5'-terminus of this base sequence : 40471885
  Distance between 3'-terminus of neighbour sequence of sequence listing upward to telomere on chrosomal short arm and 5'-terminus of this base sequence : 35374
gactagagcatgaatctgacatagagctacagaatgaagagcaacagaagctgtttaaataccaagaaagtgtgtagaatgaaattggacaagccgggcatggtggtttcacacctttagtcctagatacttgggaggctgaggtgggggaattacttgagcccagcagtttaagtccagtctgggccagctaatgagaccctgtatttatttatttatttatttatttatttatttatttatttatttagagacagagtctcactgtgtcacccaggctgcagtgcagtggcgtgatctctgcgcactgcaagctccgcctcccaggttcatgccattctcctgcctcagcctcccgagtagctgggactacaggcgcccgccacaacacccggctaattttttgtatttttagtagagatggggtttcaccgtgttagccaggatggtttcaatctcctaacttc

SEQ ID NO: 16128 - DNA, 359 bp, Homo sapiens
  AL117339.10_158013
  Located on chromosome 10
  Distance between a terminus base of telomere on chromosomal short arm and 5'-terminus of this base sequence : 40499929
  Distance between 3'-terminus of neighbour sequence of sequence listing upward to telomere on chrosomal short arm and 5'-terminus of this base sequence : 27577
tttatggacagtagctcagaagtatagatgggatcgctggaacccaggaggcaaaggttgcagtgaactgagatcgcactattgcactccagggtgacagagtgagactctgtcttaaaaataaataaataaataaataaataaataaataaataaaatattttaaataaaatcttgttttaaccaattatttttggtattcatgtaattttgttaatatcaaagacccacctctagaaagactattataattttcttcttaattatacccagctaaagtatacaacctcattttctaaaaaaaaccacaaagtttctattaactaacctttctacaacctatgtagataatgcacagc

SEQ ID NO: 16129 - DNA, 221 bp, Homo sapiens
  AL117339.10_175632
  Located on chromosome 10
  Distance between a terminus base of telomere on chromosomal short arm and 5'-terminus of this base sequence : 40517515
  Distance between 3'-terminus of neighbour sequence of sequence listing upward to telomere on chrosomal short arm and 5'-terminus of this base sequence : 17227
acaaactgtcatttaaggatacctctcgatgacctggactctgagtttgggaggttccttggattcttaggaaatcatgtggctttggtgatcaagtgaagccgggtggtaagaggatgcaaagtcagctggtttcagaaaggctctgaactgtgtgtgtgtgtgtgtgtgtgtacgtgtgtatacatacatttatcactaacagagtgatgtatgcctga

SEQ ID NO: 16130 - DNA, 196 bp, Homo sapiens
  AL117339.10_191712
  Located on chromosome 10
  Distance between a terminus base of telomere on chromosomal short arm and 5'-terminus of this base sequence : 40533671
  Distance between 3'-terminus of neighbour sequence of sequence listing upward to telomere on chrosomal short arm and 5'-terminus of this base sequence : 15935
agcactattcacagtagccaagatatgcaatcaacttaagtgctcatcaatggatgggtaaataaagtaaatatgatatatatatatatatatatatatatgcaatggaatattattcagccataaaaagaatgaaatcctgtaatttcccgcaacatggatggaactggaggtcattatgttaaataagccagct

SEQ ID NO: 16131 - DNA, 387 bp, Homo sapiens
  AL133216.10_126086
  Located on chromosome 10
  Distance between a terminus base of telomere on chromosomal short arm and 5'-terminus of this base sequence : 40760579
  Distance between 3'-terminus of neighbour sequence of sequence listing upward to telomere on chrosomal short arm and 5'-terminus of this base sequence : 226712
aagtaatggaattgaatggaactgaaaggaatggaatgaaatggaatggactcgaatggaatggaatggaatggaatggaatggtatggaatggaatggaatggtatggaatggaatggaatggactcgaatgaagtggaatggaatagaatggaatggaatggactcgagtggaatggaatggaaaggaatcgacttgaaaggaatggaaaggaaaggaatggattcgaatggaatggaatggacccgaatggaattgaatggaatcaaatggaatgaaatggactggaatgcaatggaatgaaattaaatgcgcttgaatggaatagaatttaatgggatggattggactcaaaaggaatggaaagttatagattcgaaacgaat

SEQ ID NO: 16132 - DNA, 374 bp, Homo sapiens
  AL133216.10_143000
  Located on chromosome 10
  Distance between a terminus base of telomere on chromosomal short arm and 5'-terminus of this base sequence : 40777287
  Distance between 3'-terminus of neighbour sequence of sequence listing upward to telomere on chrosomal short arm and 5'-terminus of this base sequence : 16321
tgaaatagaaaggaatggactcgaatggaatagaatggaatggaatggaatgggcatgaatgaaatggaatggaatggactcaaatggtttcgaatggaatgacaccgaatggaaaggaatggactcgaatggaatagaatgcaatggaatggaatggactcaaatggaatggactcaaatggaatcgaatggaatggcatcgaatagaatggagaaaacggaatggacccgaatggaatgcagtggactagaaaggactggaatggaatggaatggaatggaatggaatggaatggactcgaatggaaataatgcaatggaaaggaatagactcgaaaggaatggaaaggagtggacaagaatggaaagatat

SEQ ID NO: 16133 - DNA, 423 bp, Homo sapiens
  AL133216.10_164829
  Located on chromosome 10
  Distance between a terminus base of telomere on chromosomal short arm and 5'-terminus of this base sequence : 40799259
  Distance between 3'-terminus of neighbour sequence of sequence listing upward to telomere on chrosomal short arm and 5'-terminus of this base sequence : 21598
aatgaaatggagtggaatagactcaaatggaatggaactgaaatgacatgatttgtatggaatgtagtggagtaaattggactcgaatggaatggaatggaatcgaatggtctcggatggaatggaatggaatggaatggaatggaatggtttggaatggacagaaatggaagggaatggataggaacagaaaggaatgcaatggaatgcaatggactcgaatggaatgaaatggaatggaacctatttaaatggaatggaatggaatgctcacgaatggaatgaaatggaatggaaaggactcaaatggaatggaatggaatggaatggaatggactcgaatgaaatacaacagaattgaaagaaatggactctaatggaatgaaatgttgtggacttgaatggaataagatggactttact

SEQ ID NO: 16134 - DNA, 382 bp, Homo sapiens
  AL133216.10_165018
  Located on chromosome 10
  Distance between a terminus base of telomere on chromosomal short arm and 5'-terminus of this base sequence : 40799300
  Distance between 3'-terminus of neighbour sequence of sequence listing upward to telomere on chrosomal short arm and 5'-terminus of this base sequence : -382
aatgacatgatttgtatggaatgtagtggagtaaattggactcgaatggaatggaatggaatcgaatggtctcggatggaatggaatggaatggaatggaatggaatggtttggaatggacagaaatggaagggaatggataggaacagaaaggaatgcaatggaatgcaatggactcgaatggaatgaaatggaatggaacctatttaaatggaatggaatggaatgctcacgaatggaatgaaatggaatggaaaggactcaaatggaatggaatggaatggaatggaatggactcgaatgaaatacaacagaattgaaagaaatggactctaatggaatgaaatgttgtggacttgaatggaataagatggactttact

SEQ ID NO: 16135 - DNA, 350 bp, Homo sapiens
  AL133216.10_166391
  Located on chromosome 10
  Distance between a terminus base of telomere on chromosomal short arm and 5'-terminus of this base sequence : 40800709
  Distance between 3'-terminus of neighbour sequence of sequence listing upward to telomere on chrosomal short arm and 5'-terminus of this base sequence : 1027
ctagaaaggaattgaaaggaatggacacgaatggaatagaatgtgatggactcgaatggaatggtgttgaatggaatggactttaatggaatggagtgttaaggactcgaatggattggaattgaatggattcttctggaatggaatggattggaatgaaatggactagaatggaatggaatggaatggaaccgaacagaatgaattggaatggaatggaacggactcgaatggaatggaatggaatggaatggaatgaaatggaatagaacggactgcaatggaatggagtggaatggaacagactccaatggattggaatggaatggattcgaattgaatagaaagga

SEQ ID NO: 16136 - DNA, 445 bp, Homo sapiens
  AC010865.6_63482
  Located on chromosome 10
  Distance between a terminus base of telomere on chromosomal short arm and 5'-terminus of this base sequence : 44033372
  Distance between 3'-terminus of neighbour sequence of sequence listing upward to telomere on chrosomal short arm and 5'-terminus of this base sequence : 3232313
aatcaatagcctttctccatactaacaataaaatataatgcccatataaggaaaaactataaagttatttatttatttatttatttatttatttatttatttatttgagatggagtttcgcactgtcacccaggctagagtgcagtggcgtgatctcggctcactgcaacctccacctcccaggttcaagcaattctcctgcctcagcctcccgagtagctgggattacaggcacctgccaccacgcccagctaattttttgtatttttagtagagacggcatttcaccatgttggccaggctggtctcgaactcctgaccttgtgatttgcctgcctcagcctcccaaagtgttggcattacaggcgtgagctaccgcacccggccaactataaagttattttaaaggatatacaatgaactcttaacagtgatttgatattgg

SEQ ID NO: 16137 - DNA, 219 bp, Homo sapiens
  D10S1669
  Located on chromosome 10
  Distance between a terminus base of telomere on chromosomal short arm and 5'-terminus of this base sequence : 44073616
  Distance between 3'-terminus of neighbour sequence of sequence listing upward to telomere on chrosomal short arm and 5'-terminus of this base sequence : 39799
aaacttccaaacgatgtgtatagagtggtccttttttgtttaaaaagaatgaaataagaaaatatgttcaaattccatggtttgtgtaagtatatatatcaaatagtatatagaaatacacacgaccagtatactgtggtgtgtgtgtgtgtgtgtgtgtgtgtgtgtgtaactttggagtgatgttatttggaatgatgtaacacttgggattttgga

SEQ ID NO: 16138 - DNA, 219 bp, Homo sapiens
  G08786
  Located on chromosome 10
  Distance between a terminus base of telomere on chromosomal short arm and 5'-terminus of this base sequence : 44217538
  Distance between 3'-terminus of neighbour sequence of sequence listing upward to telomere on chrosomal short arm and 5'-terminus of this base sequence : 143703
ttggtctcagtctcaaagggaaaagccaccagctgtttgataaatgtgttcatttgttcattcacttgacatgcctttatggaacacctgctgtgtggccggctgtggtagaagctcaggatgcaaacacgatgatgatgatgatgatgatgatgatgatgatgatgatgatgatcacactgagcacaatgatgatgggtttagatgtgcttgtttcct

SEQ ID NO: 16139 - DNA, 330 bp, Homo sapiens
  DISO7_00026089
  Located on chromosome 10
  Distance between a terminus base of telomere on chromosomal short arm and 5'-terminus of this base sequence : 44313775
  Distance between 3'-terminus of neighbour sequence of sequence listing upward to telomere on chrosomal short arm and 5'-terminus of this base sequence : 96018
ataggatgtttcttacctattggattttactttcaggtcaatgccattgtacacacacacacacacacacacacacacacacacacacacgcgccagacagcgaggccaatttgcataaagggactaacttctacagagccttgtcaaagggctgagaacatgcacctgcctcagggggagggtggtgggtgggtggggtggcttgactcattttgtttttgtcaccctcttacttgaggggtgactgcctccccaggtctatgcctggggaagatgcagttgggagccacggtcacagagagctgctgttgtcagaaacaatcctcagg

SEQ ID NO: 16140 - DNA, 163 bp, Homo sapiens
  D10S1783
  Located on chromosome 10
  Distance between a terminus base of telomere on chromosomal short arm and 5'-terminus of this base sequence : 44388205
  Distance between 3'-terminus of neighbour sequence of sequence listing upward to telomere on chrosomal short arm and 5'-terminus of this base sequence : 74100
tcaaagtaagttagacgacccaaagcatcatgttcagtgtgtgtgtgtgtgtgtgtgtgtgtgtttgtgtgtgtgtgctcccagtgtctgtccctgacccacactgagaaagccattagggaaaaacacactaagtgacctaacaggaggccatctgtgagcc

SEQ ID NO: 16141 - DNA, 441 bp, Homo sapiens
  AL390714.20_257916
  Located on chromosome 10
  Distance between a terminus base of telomere on chromosomal short arm and 5'-terminus of this base sequence : 44478242
  Distance between 3'-terminus of neighbour sequence of sequence listing upward to telomere on chrosomal short arm and 5'-terminus of this base sequence : 89874
cactaagcttagtcatttctagcttttgattgaaagggagagatgtgagacctgacttcatttgaacacttagaggctattgtagggttattaattgtcctaatttagtagtgttgtgtctcaaggaatagggatgcccaaggagagggaaagagatggggaatggctggtcaatggagcagtcaaaacaaatacatttattgatttaagtttttcatcttatatgactgtggttcgtcatgcacccccctaattacaatagtaacatcacagattaatgatcacagatcaccacaatagatataataataataataataaagcttgaaatatggtgagaattaccaaaatgtgacacagagacaggaagtgagcacatgctgttgaaaaaatggtgaccatagacttgtctgacgtgggattgctacaaaccttcaattt

SEQ ID NO: 16142 - DNA, 261 bp, Homo sapiens
  AL137026.21_35724
  Located on chromosome 10
  Distance between a terminus base of telomere on chromosomal short arm and 5'-terminus of this base sequence : 44687482
  Distance between 3'-terminus of neighbour sequence of sequence listing upward to telomere on chrosomal short arm and 5'-terminus of this base sequence : 208799
accaagaccagatttatgagtctgccaccaaactgaaataattagctcaattttctcggccattgcagcagactttcaagctctgctttaggaatggataatttacatgataggaaaacatgaaaactttactatgcatttattaacataccacaagcatctatttcaagactaatggagatgtttctcagttggttaagtaagtaaataaataaataaataaataaataaataaaagcatcaggaaagactctagcaagt

SEQ ID NO: 16143 - DNA, 404 bp, Homo sapiens
  AL355141.5_169752
  Located on chromosome 10
  Distance between a terminus base of telomere on chromosomal short arm and 5'-terminus of this base sequence : 44693468
  Distance between 3'-terminus of neighbour sequence of sequence listing upward to telomere on chrosomal short arm and 5'-terminus of this base sequence : 5725
tcctattcagtcatcttgctagccacccccagaaaaaaattttaaaaagtgtatcattttagatagcaaattgtagagcagtacatacaatatagaggtagatagatagatagatagatagagagagagatagatagatagatattatgactgaatatgtaattatgtctgtaaaggtacaatccacttacaactgtacctaactttaggaaataattttttaaaactccatatgactttatactgtgtttattaataactcatatttaattgaaaattctttacaaagcaatcatttggagctcaagatgcacttatccttgaagccatcatttatctatatattcattcatccaatcagtcaacaaatattgcacaccaggaactattctagataccaggat

SEQ ID NO: 16144 - DNA, 183 bp, Homo sapiens
  D10S604
  Located on chromosome 10
  Distance between a terminus base of telomere on chromosomal short arm and 5'-terminus of this base sequence : 44784586
  Distance between 3'-terminus of neighbour sequence of sequence listing upward to telomere on chrosomal short arm and 5'-terminus of this base sequence : 90714
gggacgtgacctggacacttcagccttcatctcctctaataatctctcttgagactctctcctgggcccctatcgattactgtttcttaaactgaactaatagggtgtgtgtgtgtgtgtgtgtgtgtgtgtgtgtgtgtgtgtgtgtacagagagatctaccttaaggaatccactcccaca

SEQ ID NO: 16145 - DNA, 223 bp, Homo sapiens
  AL390792.8_19372
  Located on chromosome 10
  Distance between a terminus base of telomere on chromosomal short arm and 5'-terminus of this base sequence : 44794310
  Distance between 3'-terminus of neighbour sequence of sequence listing upward to telomere on chrosomal short arm and 5'-terminus of this base sequence : 9541
gtcactaggagcaggtagctactagcggtgtggtctcacctccaaaaggtgtttctttcctttctttctctctctctctttctttctctttttctttctctttctctctttctctctctttctctttctttctttctttctttctttctttctttttctttctttctctttctttccttctttctttctttctttcttttctagacaaagtatccaaaaggtg

SEQ ID NO: 16146 - DNA, 393 bp, Homo sapiens
  AL137026.21_146944
  Located on chromosome 10
  Distance between a terminus base of telomere on chromosomal short arm and 5'-terminus of this base sequence : 44798640
  Distance between 3'-terminus of neighbour sequence of sequence listing upward to telomere on chrosomal short arm and 5'-terminus of this base sequence : 4107
tagtatggcaaggaattgagagagtagaacacagtctttgttgcatacacagagaataccatgaatccaatgagagtaatggaaacgtgaaagaggggcagggaggtggcagcacagaggctgggtccccagagatgggctgagaagcggagaggaagataagccagcatccccacccaggctgcagggctgggtccccacatgctgcttctggaaacgctcacctccactaactggctccctgctggctccatacacacatgtgtacacacacacacacacacacacacacaaagtgcatagaaagctccctgtgcagccaggggaggtggcaggagagggcaggtgtgatcacacatggaggcccagagagctctaggaagctattggagt

SEQ ID NO: 16147 - DNA, 270 bp, Homo sapiens
  AL137026.21_147122
  Located on chromosome 10
  Distance between a terminus base of telomere on chromosomal short arm and 5'-terminus of this base sequence : 44799010
  Distance between 3'-terminus of neighbour sequence of sequence listing upward to telomere on chrosomal short arm and 5'-terminus of this base sequence : -23
gagctctaggaagctattggagtttgagtttgattgaaagccacaatggctttgatgatgggaaggggtgtgtatgtgtgtgtgtgtgtgtgtgtgtgcacgctaggggtggggtggaatcatggcagctccaggtttttggctggtgataccgcaagacaaggaagctgggagttgaatgtgcttaagtgataagggggatgtgagaatcaagctttctcttggtctctgcaaaggttgaaatgcctttgacatccaagtaggtaactg

SEQ ID NO: 16148 - DNA, 244 bp, Homo sapiens
  AL137026.21_153532
  Located on chromosome 10
  Distance between a terminus base of telomere on chromosomal short arm and 5'-terminus of this base sequence : 44805454
  Distance between 3'-terminus of neighbour sequence of sequence listing upward to telomere on chrosomal short arm and 5'-terminus of this base sequence : 6174
ttgaccacaacctatgataaacgttgtattttacatcatgatcatcatcatcatcatcatcaggtgttcaccaacccccacacacacactcaagacttattcttccccacagtagatgtgacacttgccaaaatttctcattttattctcttccttcttttctatttgaaaacacattcttctttcttttctattttgttttttaaaattgctgcttctactagtttatgttaatttcacagcc

SEQ ID NO: 16149 - DNA, 387 bp, Homo sapiens
  DISO7_00026046
  Located on chromosome 10
  Distance between a terminus base of telomere on chromosomal short arm and 5'-terminus of this base sequence : 45014991
  Distance between 3'-terminus of neighbour sequence of sequence listing upward to telomere on chrosomal short arm and 5'-terminus of this base sequence : 209293
cgtaatcagtacagcccatccctctggccacactgactttctcagagatgggcatgactacattcgtttgatgagacttagtcatagctgatgtggtttggatgtttgtcccctctgaatctcatgttgaaatgtgatttccaatgttggaggtgggtgttaggtttagaagggaaggtgacagttaaagaaagacacacacagacacacacgagagagagagagagagagagagagagaaggtggctctacagcaacacaggtatattgcaaaaacctgcagacatgggagaccagcttaatgccagagctcatcaccacttacaggctggggtacttaaaggtatgggtgggcggggtctgggccatatgacttgctgtccagca

SEQ ID NO: 16150 - DNA, 295 bp, Homo sapiens
  DISO7_00026037
  Located on chromosome 10
  Distance between a terminus base of telomere on chromosomal short arm and 5'-terminus of this base sequence : 45207348
  Distance between 3'-terminus of neighbour sequence of sequence listing upward to telomere on chrosomal short arm and 5'-terminus of this base sequence : 191970
aatgttgatggcctcataaatgtaaatgcgctctcttggtgactcttgcgtgcgcttgctctctctctctctctctctctctctctctctctctctctctctctctctctctctctctccaggacagtccaacagcccaacagcattctgagcaaagggtgagggcacagttgtagcttcccaggataattggaagcagacgcagccatagcacactctaaagttgagaaagtggttgtttggagaatggttgagccccaagtgcccttgtatttttgttgagcaatctgagctg

SEQ ID NO: 16151 - DNA, 449 bp, Homo sapiens
  AL353801.3_193795
  Located on chromosome 10
  Distance between a terminus base of telomere on chromosomal short arm and 5'-terminus of this base sequence : 45281993
  Distance between 3'-terminus of neighbour sequence of sequence listing upward to telomere on chrosomal short arm and 5'-terminus of this base sequence : 74350
tgacacttcagacctccaggctgcttgactggcataagtcttgaacccagcttccctgtgcaggaaaacatgctgctgcctcttgtttttctatggatcccatcaggtttacctggatggatggatggatggatggatggatggatggatggacgggcttcacctctggcattggttcttctggatttagacatctcttatccaagagattacacactagtaactaagttctaaccatttgatgtggctttcaactccactagccgattctctagccctcctgtggctttcctggttatcctattgagtgctgctttagatatctcattcatgtcttcccgggtgtgaggacagatcatgcctctaaagacgcatgttaattttccagaaacagagaaaattcgactttcagatccatgtgcatcagttccatttaaatctgtcattag

SEQ ID NO: 16152 - DNA, 148 bp, Homo sapiens
  Z67523
  Located on chromosome 10
  Distance between a terminus base of telomere on chromosomal short arm and 5'-terminus of this base sequence : 45356533
  Distance between 3'-terminus of neighbour sequence of sequence listing upward to telomere on chrosomal short arm and 5'-terminus of this base sequence : 74091
ctcagtcaccggaagagtctgcagcccctgacactcccatgtgcacgcacacacacacacacacacacacacaaacccgtgcgcgcgcacatagggctcgtcttaaccacagcctttatctccgcacagggactgctgttaatgctga

SEQ ID NO: 16153 - DNA, 225 bp, Homo sapiens
  DISO7_00026025
  Located on chromosome 10
  Distance between a terminus base of telomere on chromosomal short arm and 5'-terminus of this base sequence : 45439892
  Distance between 3'-terminus of neighbour sequence of sequence listing upward to telomere on chrosomal short arm and 5'-terminus of this base sequence : 83211
gatccatgttgccaaacacagacccaaggcagcagtgctccctgctgagacagcgtgtgtgtgtgtgtgtgtgtgtgtgtgtgtgtgtgtctgtgtgtgtgtgcgcaagccagtggtgtgcaggggacaaagacataggaaaatgaaactgtcttgccaggatttttctcaccccagaagactctttttcctggaatgaacccttcaaataccactgggctcagg

SEQ ID NO: 16154 - DNA, 128 bp, Homo sapiens
  DISD22_0000167
  Located on chromosome 10
  Distance between a terminus base of telomere on chromosomal short arm and 5'-terminus of this base sequence : 45733242
  Distance between 3'-terminus of neighbour sequence of sequence listing upward to telomere on chrosomal short arm and 5'-terminus of this base sequence : 293125
aggatataatgtatcctcatgggaaaaagaaattacagacttaatttgcatagtagactgatttacacacacacacacacacacacacacacacgaagggagagagatgtcatcagttctgagagtat

SEQ ID NO: 16155 - DNA, 460 bp, Homo sapiens
  AC024014.2_45976
  Located on chromosome 10
  Distance between a terminus base of telomere on chromosomal short arm and 5'-terminus of this base sequence : 46063110
  Distance between 3'-terminus of neighbour sequence of sequence listing upward to telomere on chrosomal short arm and 5'-terminus of this base sequence : 329740
ctacctgtatcaatgaaacgagtttcctatagatagcatataattggttgttttttatttatttttagtttttattttatttatttatttatttatttatttatttatttgagacggagtctcgttctgtcgccaggctggaatgcagtggcacgatatctcggctcactgcaacctctgcctcccgggctcaagcaattctcctgcctcagcatcctgagtagctgggattacaggcatacgtcaccatgcctagctaatttttgtatttttagtagagacggggttttaccgtgttggccaggatggtcttgatcccttgacctcgtgatctgcccgcctcagcctcctgaagtgctgggattacaggtgtgagccaccgtgcccggccataattggttgtttttttaaaaagtcagttctccacatttgtgtcctgtaattgcagtgtttatgtaca

SEQ ID NO: 16156 - DNA, 267 bp, Homo sapiens
  DISO7_10002907
  Located on chromosome 10
  Distance between a terminus base of telomere on chromosomal short arm and 5'-terminus of this base sequence : 46301793
  Distance between 3'-terminus of neighbour sequence of sequence listing upward to telomere on chrosomal short arm and 5'-terminus of this base sequence : 238223
cgatgtaaattcataatcactgtgaaaatgttatcctatcaaaactctgtagaaacatctatgcttttgcaataacagcgtaaaagacctcttctgatgagagagagagagagggagagggagagagaaagaaaaaagaaagaaagaaagaaagaaagaaagaaagagagagagagaaaaagaaagaaaaagaaaagaaagaaagaaagaaagaaagaaagaaagaaagaaaaattagggagttggggtaaccaggtaatttaggcc

SEQ ID NO: 16157 - DNA, 405 bp, Homo sapiens
  chr10.fa.O7frz.48303677
  Located on chromosome 10
  Distance between a terminus base of telomere on chromosomal short arm and 5'-terminus of this base sequence : 46575773
  Distance between 3'-terminus of neighbour sequence of sequence listing upward to telomere on chrosomal short arm and 5'-terminus of this base sequence : 273713
tctatttgcactttcctaatgactaataatgtcaagcatcttttcaggtgctttttgatcatgagtatatcttctttggacaaatatttattcaaatcatttgcccatgttttaattaggttattgtcttttattgctgaattgttagagttcttcatatattctggatacaagtggcttatcaaattttatatatatatatatatatatatatatatatatatgtatgtatatatatatgatttgcaaatacttcttcccattctgtgggttgctttttgactttcttgatggtgtcctttgaagcacaaaagctgtcaattttgataatgccccacttatttttttttgtttggtcacttctgcttttggtattatatctaataatccttttaccaatccaag

SEQ ID NO: 16158 - DNA, 156 bp, Homo sapiens
  DISD22_0008443
  Located on chromosome 10
  Distance between a terminus base of telomere on chromosomal short arm and 5'-terminus of this base sequence : 46838845
  Distance between 3'-terminus of neighbour sequence of sequence listing upward to telomere on chrosomal short arm and 5'-terminus of this base sequence : 262667
gacctgcctagacatgcccaggtaaagcatcacagatttttaaaaaatgattaaatacttaaaaatgattaaatgattttgtgtgtgtgtgtgtgtgtgtgtgtgtgtgtgtgtgtgtgtgtgtttataaaagtgggaccagaaaccattgtaact

SEQ ID NO: 16159 - DNA, 264 bp, Homo sapiens
  AL133173.19_5308
  Located on chromosome 10
  Distance between a terminus base of telomere on chromosomal short arm and 5'-terminus of this base sequence : 46969568
  Distance between 3'-terminus of neighbour sequence of sequence listing upward to telomere on chrosomal short arm and 5'-terminus of this base sequence : 130567
catgcaatgtaatggaatagacacgaatcaaatggaatggagtggacttgaatggaatggaatggaatggatctgaaattaatggaacggaatggaatggaatgaaatggaatggaatggaatggagaggaattgaatggagtggaatggaatggaatggaatggaatggaattgaatggactcgaatggagtggaatggaatggaatggactcgaatggagtggaatggaatggaatggactcaaatagaatgaaatggaatg

SEQ ID NO: 16160 - DNA, 349 bp, Homo sapiens
  AL133173.19_92281
  Located on chromosome 10
  Distance between a terminus base of telomere on chromosomal short arm and 5'-terminus of this base sequence : 47056629
  Distance between 3'-terminus of neighbour sequence of sequence listing upward to telomere on chrosomal short arm and 5'-terminus of this base sequence : 86797
tacctatgtatcaaacctgcacgttgtgcacatgtaccctagaacttaaggtataacaacaacaacaacaacaacaaacgtttcttctaccagatgtcctcagtcatctctctcaatttcaaagttccataaatctgtagggcaggggcaaaatgccaccagtctctttgctaaagcataacaagagtgacctttacttcagttcccaacaagttgttcatctccatctcggacctcctcagcctggacttcactgtccacgtcactatcagcagtttggtcaaaaccattcaacaagtctctaggcagttacaaactttcccacatcttctggtctacttctgagtcc

SEQ ID NO: 16161 - DNA, 304 bp, Homo sapiens
  AL133173.19_112275
  Located on chromosome 10
  Distance between a terminus base of telomere on chromosomal short arm and 5'-terminus of this base sequence : 47076526
  Distance between 3'-terminus of neighbour sequence of sequence listing upward to telomere on chrosomal short arm and 5'-terminus of this base sequence : 19548
tcattgtacaatccactagaacagtagttcagggtcaaaggtgattgaaacttaatccaaaaaaatcaaagagggactaccttcctaacacattctatgaatctagtatcacaattatacccaaatcaggcaaagccatacacacacacaaacacacacacacacacacacactccaccggtcagtatccctgatgaacatagatgcaaaaattctcaactagcaaaatgaattctatagtacatcaaaaagataatatagttaagtgtgttttactccagaaatacaaggatggttaaacatg

SEQ ID NO: 16162 - DNA, 252 bp, Homo sapiens
  AL133173.19_186994
  Located on chromosome 10
  Distance between a terminus base of telomere on chromosomal short arm and 5'-terminus of this base sequence : 47151245
  Distance between 3'-terminus of neighbour sequence of sequence listing upward to telomere on chrosomal short arm and 5'-terminus of this base sequence : 74415
atctacgcaaagtttgaatcaggttttgagtaggatccactcacaggtttaaatctatagcaggctacgattttattttgcacataacaaaaatgaaaaactgaggcacagaattcaagctttgcagaaaaatgtgttggctccctaaccaacacacacacacacacacacacacctactttcccaaattctttcctcctgtatgaaaaaaacttaaggctgggcacagtggttcatgcttgtaatccagct

SEQ ID NO: 16163 - DNA, 235 bp, Homo sapiens
  AL133173.19_187395
  Located on chromosome 10
  Distance between a terminus base of telomere on chromosomal short arm and 5'-terminus of this base sequence : 47151688
  Distance between 3'-terminus of neighbour sequence of sequence listing upward to telomere on chrosomal short arm and 5'-terminus of this base sequence : 191
cgtaatccagccactacactctagcctgaatgacagagcaagactctgtctcaaaaatgaacaaagaaagaaaagaaagaaagagagagagagagggagggaaggagggaggaaggaaggaaggaaggaaggaatgaaggaaggaaagaaggaaggaaaaaaggaaggaaggaagtttacagagttttttgaggtgttagtgttccctaaattgtatggtcttcagaggtttacc

SEQ ID NO: 16164 - DNA, 369 bp, Homo sapiens
  chr15.fa.O7frz.71822215
  Located on chromosome 10
  Distance between a terminus base of telomere on chromosomal short arm and 5'-terminus of this base sequence : 47178573
  Distance between 3'-terminus of neighbour sequence of sequence listing upward to telomere on chrosomal short arm and 5'-terminus of this base sequence : 26650
attcaattccattccattcgactccattccattcgagtccatttcattccattccattacgttccgcatgattccaatccgttccattccatttttttccattccattccatcccagtccattccattctagtccatttaattccattccattccattcaattccactcgtttccagttggttcgattcaattttgttgcagtccattccataactttacattccattcgattccattccactcgattccattccactcgattccattccactcaattccattctactcgaaaccactcagttccattacattgtattccattctattccattccattgcatttgattacattccatttgattccattc

SEQ ID NO: 16165 - DNA, 389 bp, Homo sapiens
  chr4.fa.O7frz.195056177
  Located on chromosome 10
  Distance between a terminus base of telomere on chromosomal short arm and 5'-terminus of this base sequence : 47227479
  Distance between 3'-terminus of neighbour sequence of sequence listing upward to telomere on chrosomal short arm and 5'-terminus of this base sequence : 48537
aattggaatcgagtggaacgaaatggaatggaatggaatggacttgaatgcaatggggtcaaatggaatggaattgaatggaatggaatcaaaaagaatggaattgaatggaatctaaaggtataaaatggaatggagtttaaaggaaagatatcgaatggaatgaaaaggaatgtacttgaatggaatggactggaatggaatggactcgaatggaatggactggagaggaagggtctcgaatggaatggaaacgaatggaatggaatgaaaaggaaaggaatagaatggaatggaatatgatggaatggaatggaatggaatggaatggaatggaatggactcgaatggaatggacactaatggaattgaatacaatgtaatggcat

SEQ ID NO: 16166 - DNA, 124 bp, Homo sapiens
  DISD22_0008452
  Located on chromosome 10
  Distance between a terminus base of telomere on chromosomal short arm and 5'-terminus of this base sequence : 47690194
  Distance between 3'-terminus of neighbour sequence of sequence listing upward to telomere on chrosomal short arm and 5'-terminus of this base sequence : 462326
gctagtgttgggagtcagcagtgtgtgtgtgtgtgtgtgtgtgtgtgtgtctgtatgtctgtgtgtgtgtgtgtctgtgtgaattcagctgccctcaggcaggtggctggaaactggctcacct

SEQ ID NO: 16167 - DNA, 161 bp, Homo sapiens
  DID22N_0003670
  Located on chromosome 10
  Distance between a terminus base of telomere on chromosomal short arm and 5'-terminus of this base sequence : 47753037
  Distance between 3'-terminus of neighbour sequence of sequence listing upward to telomere on chrosomal short arm and 5'-terminus of this base sequence : 62719
atggttgtgggacagaggtgggaccaatgagagagggagacggagagagagacagatggacacagagagaaacaaagaaagaaaaagacacacacagaaagagagacagagaaagagagagagaaagagagagagactcagagacagactcctcagctgtc

SEQ ID NO: 16168 - DNA, 306 bp, Homo sapiens
  chr10.fa.O7frz.48488573
  Located on chromosome 10
  Distance between a terminus base of telomere on chromosomal short arm and 5'-terminus of this base sequence : 48259913
  Distance between 3'-terminus of neighbour sequence of sequence listing upward to telomere on chrosomal short arm and 5'-terminus of this base sequence : 506715
cacagccaaaccatatcagtgtgtatgtgttgtgtgggtgcatgtgcatgtgcatacaggtgtggtatacatgaatgtgcgtgtgtgtgtgtgtgtgtgtgtgtgtgtgtgtgtgtgtgtctatgtctagggtagaggcagaggacagagacctgggtcaggcaccaggatttcagggtgaaacccgatatgtgtttttcctcttgctctgtgtaaatatctccatgtttgaaaatgaacctcatgggcctggtgccaggtataaacagccctggactgggagacctgctaccatagaggtgctag

SEQ ID NO: 16169 - DNA, 131 bp, Homo sapiens
  D10S1754
  Located on chromosome 10
  Distance between a terminus base of telomere on chromosomal short arm and 5'-terminus of this base sequence : 48275038
  Distance between 3'-terminus of neighbour sequence of sequence listing upward to telomere on chrosomal short arm and 5'-terminus of this base sequence : 14819
atctctgtgcaggccaaatttcactgaaatccagtttttaaaattgtgtgtgtgtgtgtgtgtgtgtgtatgtgtgtatacgtatgtgcatggagagagacagagaggagacccctttttggaaaacttag

SEQ ID NO: 16170 - DNA, 341 bp, Homo sapiens
  chr10.fa.O7frz.48816071
  Located on chromosome 10
  Distance between a terminus base of telomere on chromosomal short arm and 5'-terminus of this base sequence : 48378023
  Distance between 3'-terminus of neighbour sequence of sequence listing upward to telomere on chrosomal short arm and 5'-terminus of this base sequence : 102854
tcactgatttatatggagcaatgtaaagtttgtttttgctctgaagtgaagcagtatacaaaataaactgctgttattaccagtcattccaaattgggaattgaatattaccaagttaccaaaattgagtatttgccagaattgttatatatatatatatatatatatatatatatatatatatatatattcagaaatattttatatttttgttctctgggatttttacctgcttttttgctatataatttacatgccatacaatttattcatttaacgtgtaccactcagtgtttattatatttgaagattgtatgctcgttaccacaatcttaacttta

SEQ ID NO: 16171 - DNA, 463 bp, Homo sapiens
  chr10.fa.O7frz.48980780
  Located on chromosome 10
  Distance between a terminus base of telomere on chromosomal short arm and 5'-terminus of this base sequence : 48542749
  Distance between 3'-terminus of neighbour sequence of sequence listing upward to telomere on chrosomal short arm and 5'-terminus of this base sequence : 164385
cctctagtgctgtatcatgaagttttgtgatgtggaggagccaaatgtgacttttaaatgtcacccttaactggaagtttgaatttgagttttggttttctcattaactacagaagtattatgcagtgtatgtgtgtgtgtgtgtgtgtgtgtgtgtgtctgtgtgtgtgtgtttgatcttcgctctctcatgcctgcacactctcctcaatgtcattttgttattaacttgtcttttttgctttagcattattgacagtgattgggtctctgatttcatttttttgaaaaagtttttttttttaaagagaaacaatgagtgttctttgtttatgtcttcctcaaagctatggcattaggagcataaaagttcacagctgctgtcttttctcagtaggttatctatattaggaattatatctctctgttccccttttttcttagcatcttgaatcctacttta

SEQ ID NO: 16172 - DNA, 188 bp, Homo sapiens
  DISO7_10002855
  Located on chromosome 10
  Distance between a terminus base of telomere on chromosomal short arm and 5'-terminus of this base sequence : 48943921
  Distance between 3'-terminus of neighbour sequence of sequence listing upward to telomere on chrosomal short arm and 5'-terminus of this base sequence : 400709
tttcttagatactctgtctcctggtttataaactctattttcattcattcattcattcattcattccccaaataagtattgagcttccaatttgtgtcaggcactttgctggcatggggattcaaggtgaataaagagatctgattttgccctcatgggtctactgggatcacctatttactccaggt

SEQ ID NO: 16173 - DNA, 255 bp, Homo sapiens
  DISO7_00026165
  Located on chromosome 10
  Distance between a terminus base of telomere on chromosomal short arm and 5'-terminus of this base sequence : 48979209
  Distance between 3'-terminus of neighbour sequence of sequence listing upward to telomere on chrosomal short arm and 5'-terminus of this base sequence : 35100
ttctgactatctgtcagccctctgggttaggcgcgcctattgtgttttagagtagcctgtgcttactaggcggctattctgtctaatgtctaaggcagagatgggcactagggaaaccaaggtgaagagtcacgggtcgagcagccacccacggtgttgtgggggtgggagaggagaagagagagagagagagagagagagagagagagaaccagccatagtgtgaaatttaacatgattgaagtatggacagtg

SEQ ID NO: 16174 - DNA, 445 bp, Homo sapiens
  AC022533.4_113051
  Located on chromosome 10
  Distance between a terminus base of telomere on chromosomal short arm and 5'-terminus of this base sequence : 49034079
  Distance between 3'-terminus of neighbour sequence of sequence listing upward to telomere on chrosomal short arm and 5'-terminus of this base sequence : 54615
aaacaagtcacagcttaatgatagttgtgattttattttattttattttattttattttattttattttattttattttattttattttattttattttattttttgagacacagtctcattctgtcacccaggatggagtgcagtggcacaatcttggctcactgcaacctctgcctcacaggttcaagcaattctcctgcctcagcctcccaagtagctgggatttcaggcgcccaccaccatgcctggctaatttttgtatttttagtagagacaggtttcaccacattggccaggctggtcttgaacttctgacctcaggtgatccatctgcctcagcctcccaaagtgctgggattacaagcgtgagtgatagttgtgattttagataagaacgtctctatactgaccaattgacagaggaaatagtggttacagaattt

SEQ ID NO: 16175 - DNA, 171 bp, Homo sapiens
  DISD22_0008484
  Located on chromosome 10
  Distance between a terminus base of telomere on chromosomal short arm and 5'-terminus of this base sequence : 49177961
  Distance between 3'-terminus of neighbour sequence of sequence listing upward to telomere on chrosomal short arm and 5'-terminus of this base sequence : 143437
tggtggaaggtaccttgccctgctggatgctaacccctactaggtgatgatgagaataatgagatgatgatgatgatgatgatgatgatgatgatgatgatgatgataatgatgatgatgatgattcttttgtatagtaatgtattcttttcattgctcttcattccttcc

SEQ ID NO: 16176 - DNA, 305 bp, Homo sapiens
  chr10.fa.O7frz.50400099
  Located on chromosome 10
  Distance between a terminus base of telomere on chromosomal short arm and 5'-terminus of this base sequence : 49421637
  Distance between 3'-terminus of neighbour sequence of sequence listing upward to telomere on chrosomal short arm and 5'-terminus of this base sequence : 243505
gtttgaagtccaaacttacattaccacaagatccaaaatattgaaagttaagaaattaacagaaaaaattggtcccaggctgataataaccatcagatgcaagcacatacaaaaaccatgctggtgagaaagcccctttgaagatgactcacccatctttacacacaaaaacgtcacacacacacacacacacacacacacacaccccccaatttactgtgagggagagccagcagacaccacaaagagcaggatcaacagcaagacctccagccagtgcagtaatctgatggagtctatgaaac

SEQ ID NO: 16177 - DNA, 170 bp, Homo sapiens
  D10S1766
  Located on chromosome 10
  Distance between a terminus base of telomere on chromosomal short arm and 5'-terminus of this base sequence : 49513046
  Distance between 3'-terminus of neighbour sequence of sequence listing upward to telomere on chrosomal short arm and 5'-terminus of this base sequence : 91104
tctcatgggaaaaacagacatttaaaaactatatatatatatatacacatacacacacacacacacacacacacacaaatataattgtggtgactgctgttaagaggaaagtacaaggctttctgacaaaatgagagaaaccaaattgaaattgtggaggtagatgtggg

SEQ ID NO: 16178 - DNA, 355 bp, Homo sapiens
  chr10.fa.O7frz.50028193
  Located on chromosome 10
  Distance between a terminus base of telomere on chromosomal short arm and 5'-terminus of this base sequence : 49614978
  Distance between 3'-terminus of neighbour sequence of sequence listing upward to telomere on chrosomal short arm and 5'-terminus of this base sequence : 101762
agaattctggattgatagttctttttttttcagcacttacaaaatattatggcaattccttctggtcttcatggtttctgataagaaaaaaaaaatctgctgttgtcctagttgcttttctcctatagaatatatatatagtatatatatacacacacacacacacacacacacacacatatgggtgtgtgtgtctatgtatagatacatgtgtatatatgtatatcatttctctcttgctgttttcaagatttttcctttgtctttatttttcaaaagtttgactatgatatgttttggtgtttgcttctttgaatttatcatgtttggggttaacttaccttcctgaatcttt

SEQ ID NO: 16179 - DNA, 239 bp, Homo sapiens
  D10S1724
  Located on chromosome 10
  Distance between a terminus base of telomere on chromosomal short arm and 5'-terminus of this base sequence : 49724861
  Distance between 3'-terminus of neighbour sequence of sequence listing upward to telomere on chrosomal short arm and 5'-terminus of this base sequence : 109528
ggtcatctttgactcattgcaaccattctcgggcatgcgcttttatccctgttttacggaagagcaaagtgaggcttagaaggctgaaggtgctagaacaaaaggaacaggatgtcagaaagacctgggataggagccagtaggtatgggtccacacacacacacacacacacacacacacacacacacacacacacggcagcaggctggagacagcaggagagatagtcctgagggca

SEQ ID NO: 16180 - DNA, 101 bp, Homo sapiens
  DISO7_10002857
  Located on chromosome 10
  Distance between a terminus base of telomere on chromosomal short arm and 5'-terminus of this base sequence : 49935367
  Distance between 3'-terminus of neighbour sequence of sequence listing upward to telomere on chrosomal short arm and 5'-terminus of this base sequence : 210267
cagagatgccatatgtcccatctctctctctctctctctctctcacacacacacacacacatgcacatattcacacacccagacccacattggctgaagtt

SEQ ID NO: 16181 - DNA, 328 bp, Homo sapiens
  AC060234.4_118817
  Located on chromosome 10
  Distance between a terminus base of telomere on chromosomal short arm and 5'-terminus of this base sequence : 50119202
  Distance between 3'-terminus of neighbour sequence of sequence listing upward to telomere on chrosomal short arm and 5'-terminus of this base sequence : 183734
tactctgcttctcattcactagaccccatgaccagtgagtgcaacctcacccacaaccattgatgctgcaataggaacctgcaaatccaatggcactggccagaatcaactgcaatggctctgaggtgactttcattcatccattcatccatccatccacccatccatccatccatccacccgtccatccatccatccatccatccatccatccatccatccatccatccatccatccttccatccatccatccatttacccatccatccagcattctttctcagacatccattcatcaaccgtaggcttagctaatgccgttagctt

SEQ ID NO: 16182 - DNA, 241 bp, Homo sapiens
  D10S1793
  Located on chromosome 10
  Distance between a terminus base of telomere on chromosomal short arm and 5'-terminus of this base sequence : 50170472
  Distance between 3'-terminus of neighbour sequence of sequence listing upward to telomere on chrosomal short arm and 5'-terminus of this base sequence : 50942
aggggtcacggtccataaggacgctaggctgcagggtctgaatagggtttctactgggctggcacctggagtccaggttccccatttggtcagttgtgtggtcccatccatgctgctgcctcctgtgccaacccccaccaacacacacacacacacacacacacacacacacacacacacacacgtcaaaaccaaagcctccaagggccacgcattgccctcccctgaccttgggaagcag

SEQ ID NO: 16183 - DNA, 164 bp, Homo sapiens
  DISD22_0008495
  Located on chromosome 10
  Distance between a terminus base of telomere on chromosomal short arm and 5'-terminus of this base sequence : 50312084
  Distance between 3'-terminus of neighbour sequence of sequence listing upward to telomere on chrosomal short arm and 5'-terminus of this base sequence : 141371
tcttaactggctggctccggccaactctctctccctctctctctctctctctcacacacacacacacacacacacacacacacatacacacacacacacaccactgccctcctcccccaaatcggttcccttcaaattgtcactccccacagtgctgcattcat

SEQ ID NO: 16184 - DNA, 111 bp, Homo sapiens
  DISO7_10002851
  Located on chromosome 10
  Distance between a terminus base of telomere on chromosomal short arm and 5'-terminus of this base sequence : 50421246
  Distance between 3'-terminus of neighbour sequence of sequence listing upward to telomere on chrosomal short arm and 5'-terminus of this base sequence : 108998
ctcagttgcatgcctttggattagggttagggttaggggttaggggttaagggttaggggttagggttaagaaagctggtcccattggaagggcctgatttgtagtcacac

SEQ ID NO: 16185 - DNA, 122 bp, Homo sapiens
  DISD22_0008504
  Located on chromosome 10
  Distance between a terminus base of telomere on chromosomal short arm and 5'-terminus of this base sequence : 50510485
  Distance between 3'-terminus of neighbour sequence of sequence listing upward to telomere on chrosomal short arm and 5'-terminus of this base sequence : 89128
ttctccttctggaaagtatatggggcaacaacaagactgaggaggaagaggaggaggaggaggaggaggaggaggaggaaaaagcccatcatcaatacacacatcaaactcaacttcagaga

SEQ ID NO: 16186 - DNA, 104 bp, Homo sapiens
  DISD22_0008515
  Located on chromosome 10
  Distance between a terminus base of telomere on chromosomal short arm and 5'-terminus of this base sequence : 50729161
  Distance between 3'-terminus of neighbour sequence of sequence listing upward to telomere on chrosomal short arm and 5'-terminus of this base sequence : 218554
ggacctattggccactagggtgtctgcgggtgtgtgtatgtgtgtgtgtgtgtgtgtgtgtgtgtgtgtgtgatgtgtgtttacttggagtgacttctttcagc

SEQ ID NO: 16187 - DNA, 332 bp, Homo sapiens
  chr10.fa.O7frz.52812271
  Located on chromosome 10
  Distance between a terminus base of telomere on chromosomal short arm and 5'-terminus of this base sequence : 51350931
  Distance between 3'-terminus of neighbour sequence of sequence listing upward to telomere on chrosomal short arm and 5'-terminus of this base sequence : 621666
ctcacaataccagttgtctgacttatggtccctgaaataatttctcctgaatttagttatctacacacacacacacacacacacacacacacacacacacacaaagcagtaaaaaacaaaaataaacttcatatgcataatctggggtaaaaggttttgtaactataaaacttatgaattaagaatctatactctattcaaaaaatgtaataattataaatgtctgtgtaacataaactgaaaactcacagaaatgaagaaagaaatacacatttcagtaacaatactgaaattttcaataacccactctcaatcatggatagaacaactag

SEQ ID NO: 16188 - DNA, 272 bp, Homo sapiens
  D10S225
  Located on chromosome 10
  Distance between a terminus base of telomere on chromosomal short arm and 5'-terminus of this base sequence : 51366037
  Distance between 3'-terminus of neighbour sequence of sequence listing upward to telomere on chrosomal short arm and 5'-terminus of this base sequence : 14774
taggtcacacaatggtaagtcaagaagcagagcaatgaattcaggttgtatgtgtgtgtgtgtgtgtgtgtgtgtgtgtatagatagatagatgatagatagatagatagatggatggatagatagatagatagatagatagatagatagatacagatagagatagagatatatgctcttatccactgtggaatcctggttctgtcccttctcttcattcacttgctcattcactacacatttggttaactttgactctgtgccagccacca

SEQ ID NO: 16189 - DNA, 99 bp, Homo sapiens
  D10S196
  Located on chromosome 10
  Distance between a terminus base of telomere on chromosomal short arm and 5'-terminus of this base sequence : 51526976
  Distance between 3'-terminus of neighbour sequence of sequence listing upward to telomere on chrosomal short arm and 5'-terminus of this base sequence : 160667
ttcaaaggtggagacccttcaagaaaacacacacacaaacacacacatacacacacacacacacacacacacaacttccccactccattctgaccaaaa

SEQ ID NO: 16190 - DNA, 192 bp, Homo sapiens
  D10S538
  Located on chromosome 10
  Distance between a terminus base of telomere on chromosomal short arm and 5'-terminus of this base sequence : 51593982
  Distance between 3'-terminus of neighbour sequence of sequence listing upward to telomere on chrosomal short arm and 5'-terminus of this base sequence : 66907
acagcaggctcacccctccactttcttcatgtccttacttagatgttgccttctcaatgaggccttcctggcttctctacaaatagtgtgtgcacgtgtgtgtgtgtgtgtgtgtgtgtacacacatgccccaattagacttacactccccatccacttctcttctttattttttgccatagcctctgatcc

SEQ ID NO: 16191 - DNA, 273 bp, Homo sapiens
  D10S220
  Located on chromosome 10
  Distance between a terminus base of telomere on chromosomal short arm and 5'-terminus of this base sequence : 51732057
  Distance between 3'-terminus of neighbour sequence of sequence listing upward to telomere on chrosomal short arm and 5'-terminus of this base sequence : 137883
gagcaagactgcatctcaaaatatatatgtgtgtgtgtgtgtgtgtgtgtgtgtgtgtgtgtgtgtgtgtgtgtcgttatgtagtaagtcagtaaggcttccagtcaacagtaggctattactagttacattttcagggagacaaaattatacttggattttcaactgcacccctaatccccaaattatttaagagtcaactgtagtgtctaaaaggaagcatgagattgtgttagtcatgctctgtttcttaatctgggtgctggttacatg

SEQ ID NO: 16192 - DNA, 463 bp, Homo sapiens
  chr10.fa.O7frz.53528775
  Located on chromosome 10
  Distance between a terminus base of telomere on chromosomal short arm and 5'-terminus of this base sequence : 52079149
  Distance between 3'-terminus of neighbour sequence of sequence listing upward to telomere on chrosomal short arm and 5'-terminus of this base sequence : 346819
gttaataggcacctgataggtagtttttcaatcctttccctcctctcaccttccagcttcaagtagcccccaatgtctgttcttaccttctttgtgttcatgtgtactcaatgttttgctcccacttataagtgaaaacatgtgacttttttcttctgtgttagtttgcttaggacaatggcctccaactccatccatgttgctgcaaaggacatgatcttattctttttatggctgtgtagtattccatggtgtgtagtgtgtgtgtgtgtgtgtgtgtgtgtgtgtgtgtgtgtgtctgtatcacattttccttatcctatctaccgatttatatttttttgggtatataccatggtgtgtattttgtgtgtgtgtgtgtatcacattttccttatctagtctactgatttatattcctttgggtatatacccaataatgggattgctggatcaaatggta

SEQ ID NO: 16193 - DNA, 356 bp, Homo sapiens
  chr10.fa.O7frz.52269980
  Located on chromosome 10
  Distance between a terminus base of telomere on chromosomal short arm and 5'-terminus of this base sequence : 52246420
  Distance between 3'-terminus of neighbour sequence of sequence listing upward to telomere on chrosomal short arm and 5'-terminus of this base sequence : 166808
agctatcaatgaatcatttatgagaagaaattccctggcactaggataaatagaggttggaaaaccatctttctaggtgctataaaatagaatcctctcatggtgcaagagtccttctatttctagggggtctaggattatttttattattgttgttacctttcccattctggaaaatcttcaagactctgtcttgtaaatgtcaccaacccagtaggttctacagaagcaataaaagaaaaacatacccaaaataagtttcaattttgaaaagattatacacacacacacacacacacacacacacacacatacacacacacactcggtaaaagaataggtctaacattggctat

SEQ ID NO: 16194 - DNA, 124 bp, Homo sapiens
  DISD22_0008533
  Located on chromosome 10
  Distance between a terminus base of telomere on chromosomal short arm and 5'-terminus of this base sequence : 52337133
  Distance between 3'-terminus of neighbour sequence of sequence listing upward to telomere on chrosomal short arm and 5'-terminus of this base sequence : 90357
atacgtgagaatcaaacctcactttttttttaatctattttttcttatactagaaatacgtgtgtgtgtgtgtgtgtgtgtatgtgtgtgtctttaatctgaagtatagcaattatgggtagca

SEQ ID NO: 16195 - DNA, 410 bp, Homo sapiens
  chr10.fa.O7frz.53646150
  Located on chromosome 10
  Distance between a terminus base of telomere on chromosomal short arm and 5'-terminus of this base sequence : 52619886
  Distance between 3'-terminus of neighbour sequence of sequence listing upward to telomere on chrosomal short arm and 5'-terminus of this base sequence : 282629
tacctaagataacagtgtttccatgtttggtctattttttagtttactttatgccactctcaagggcacacacaaataacatatatatatatatatatatatacacacatacatacaaacacacaaacacagataattaaaggagcgacagcaacatatgccatggcttaacatcccatcctatcccacctcccacagaaaaaaaaagcaaatgtgttagctatgatgtgaatgtctcccccaaagttcatatgctggaaacttaatccccagtgcaccaagattgagaggtggaatcttttaagtggtgattctttcaagaaaaaaaagtagttgtataaagacacatattttctagaaaatattcaaagtgacaggaagaaaacatagttatcatggatcttaagcag

SEQ ID NO: 16196 - DNA, 302 bp, Homo sapiens
  chr10.fa.O7frz.53836705
  Located on chromosome 10
  Distance between a terminus base of telomere on chromosomal short arm and 5'-terminus of this base sequence : 52796278
  Distance between 3'-terminus of neighbour sequence of sequence listing upward to telomere on chrosomal short arm and 5'-terminus of this base sequence : 175982
tcatatacttggccatttgtatgtcttcttttgagatatgtttattcagatcacatgcccatgttttaatcaaattattattattattattattattttaagttccttgtattttctgaacatttgtccttcgcttgaagcttgcaaatatttactcccattcttcaggttgcttcttcactctgctgatcatttcctttgctatgaagaagctttttatttattttttgacatagtcccatttgtgtatttttgttgtctatgcttttgaggtcttattcttaagacctttgcctagactc

SEQ ID NO: 16197 - DNA, 460 bp, Homo sapiens
  chr10.fa.O7frz.54057299
  Located on chromosome 10
  Distance between a terminus base of telomere on chromosomal short arm and 5'-terminus of this base sequence : 52983799
  Distance between 3'-terminus of neighbour sequence of sequence listing upward to telomere on chrosomal short arm and 5'-terminus of this base sequence : 187219
actttgtacctgcatcatagtaacagctccataactagtctctcagcttcatttttgccctgcttaaattcatttttaacaaattgcacccagagttatttttcaaacacaccaattgtgtcgctgttcttttaattgattcagacagcatttatgataatgccgaaactctttaataaggccatttatgtctcatctcttgcctctggtcttcttcccatgctggttttattggcttgtaataggagtccactgcccttcctttctttctctctctctttctctctctctctctctctctctctctctctctctctctcactcacacacacatacaaacacacatgcattgaccatctttgcttgggtgtccccttctactactcttcagatcagatctcaactaaaatgtaaattctccaggatatatatattttctccaagtacaaatcagatacct

SEQ ID NO: 16198 - DNA, 333 bp, Homo sapiens
  chr10.fa.O7frz.54135366
  Located on chromosome 10
  Distance between a terminus base of telomere on chromosomal short arm and 5'-terminus of this base sequence : 53062033
  Distance between 3'-terminus of neighbour sequence of sequence listing upward to telomere on chrosomal short arm and 5'-terminus of this base sequence : 77774
ggattctaccaggttaaacttaactatgaaatattttttatttaagggaccaagctgattaaaggagagagagtgagagagagagagagagagagagagagagagagaaagaaagagagaaagaattgttcagaaaattattcagaaaaatgtcaacagggcctcaggaaaaaaggaaggaaaaaacacaaaactcaaaactagctgttaatcttttcagcaacattgtgctgaaaaccacctgcccaaaaccatcctaagggcatagtgtctcacgcctggaatcccagccctttgggaagataaggcaggtagatcatgaggtcaggagtt

SEQ ID NO: 16199 - DNA, 379 bp, Homo sapiens
  chr10.fa.O7frz.54351577
  Located on chromosome 10
  Distance between a terminus base of telomere on chromosomal short arm and 5'-terminus of this base sequence : 53270859
  Distance between 3'-terminus of neighbour sequence of sequence listing upward to telomere on chrosomal short arm and 5'-terminus of this base sequence : 208493
ttcaaagacttatgcattcaactattatgttaaactgattccgtatatgtatgtgtgtgtgtgtgtgtatatgtgtgtatatatatatatatatatatatgactcctatatatgtgtgtgtcataaactgactcctatatgtatgagtcataaactgacatatatgtgtgtgtgtgtatatatatgctgaaattctaccatgcgtgatccacggcattagtttgaagccttttgatgcttcattagctgttccttaaagggcattcagctattatcagactggttacacctgaaggggaatcactttttctttgttggctaggtgagatcagatgaaagagttttgaaattatatgtcaacagttctcaaatttcttag

SEQ ID NO: 16200 - DNA, 445 bp, Homo sapiens
  chr10.fa.O7frz.54627440
  Located on chromosome 10
  Distance between a terminus base of telomere on chromosomal short arm and 5'-terminus of this base sequence : 53549407
  Distance between 3'-terminus of neighbour sequence of sequence listing upward to telomere on chrosomal short arm and 5'-terminus of this base sequence : 278169
atggtgaaatcctcatctctactaaaaatacaaaaaattggccagctcatgcctgtagtcccagctacttaggagactgaggcaggagaatctcttgaacttgggaggcagaggttgcagtgagcccagatcccaccattgcactccagcttgggcgacagcgtgagagtctgtcaaaaaaaagaaaaatgtatatatatatatatatatatatacaaatttctcaatatctaactatctaacttgataaaagactggattctcatattgatatggtttggatgtgtggccccctcccaatctcatattgaaatgcaatccccagtgttggaggtggaactgagtgggttgtgttggatcatgcggttgcatacctcatgagtgggttagtgccatgcccttggtgatgagtgagttctcactctattaattctcatgaaagctg

SEQ ID NO: 16201 - DNA, 151 bp, Homo sapiens
  D10S568
  Located on chromosome 10
  Distance between a terminus base of telomere on chromosomal short arm and 5'-terminus of this base sequence : 53619898
  Distance between 3'-terminus of neighbour sequence of sequence listing upward to telomere on chrosomal short arm and 5'-terminus of this base sequence : 70046
ctgtttgctttatttgcccattctcttcatacacacacacacacacacacacacacacacacacccatatttatttatatatttttctttaattccctgaaccattatgttatatatatcatggcccttgacctcaaaatactacaatgtg

SEQ ID NO: 16202 - DNA, 447 bp, Homo sapiens
  AC027118.4_94611
  Located on chromosome 10
  Distance between a terminus base of telomere on chromosomal short arm and 5'-terminus of this base sequence : 53756426
  Distance between 3'-terminus of neighbour sequence of sequence listing upward to telomere on chrosomal short arm and 5'-terminus of this base sequence : 136377
acagcatgttaagcaagttactagatcatgtactttaggccagcacttcatggttttgtcctccagtgacacaaatcacagatggtcctcatgggaagcattaagacatgcagtataaatgttgagttattccgggaggtggagcttgcagtgagccgagatcgcgccactgcactccagcctgggcagcagagcgagactctgtcccaaaataataataataataataataataataataataataataataaagtaaataaataaaaatgttgagttcttgttcctgattgtttctcccatttattttcaattcaaaaaagcaaattgtaatgacacataatgagagtgcctttattatagtgatatttctcatgtgattctagtttctatatattttcagataaattattctaaagcacccttcagctatggttagtaacaaaa

SEQ ID NO: 16203 - DNA, 477 bp, Homo sapiens
  chr10.fa.O7frz.55159165
  Located on chromosome 10
  Distance between a terminus base of telomere on chromosomal short arm and 5'-terminus of this base sequence : 54042041
  Distance between 3'-terminus of neighbour sequence of sequence listing upward to telomere on chrosomal short arm and 5'-terminus of this base sequence : 285168
ggtaagtactaagaaggcaggtagtaacactcatttttgctcagtagagactgtccctgagaaaggcctggaatttgcccaagtctatttacctaattagagatggagttgggctgtcacacctgctgtaacacagaggtttttcaaaataaagatcacatcagtaggaatgtttttctgggaagagcagcttgacttcttcaggaaaagaatgagggtagtgattcatttccaatgccagagacattatagagacattatgcagaatatgtccaagtctcagaatcttggtctgcacgtgcacacacacacacacacacacacacacacacacacactctctctctctctctctccctctctctctttctctcttacacttcatgatagctggggtaaaacatctttcaaatggagtagagcgatagggaggtaaatttcactttctaccaaatatagcataggaactgtcttgaa

SEQ ID NO: 16204 - DNA, 458 bp, Homo sapiens
  chr10.fa.O7frz.55469193
  Located on chromosome 10
  Distance between a terminus base of telomere on chromosomal short arm and 5'-terminus of this base sequence : 54359313
  Distance between 3'-terminus of neighbour sequence of sequence listing upward to telomere on chrosomal short arm and 5'-terminus of this base sequence : 316795
agctcattaatggagacaaatctttcccttcctttcttcttgatctcaagatttaaaaagtgttagatttggccaggcgtggtggctcatgcctgtaatccagcactttggggggccgaggtgggcaggtcacgagatcaggagtttgagaccagcctggccaacatggtgaaaccccttctctactaaaagtatataaaaaaattagccgggtgtggtggtgtgcacctgtaatcctagctactctggaggctgaggcaggagaatcgtgtgaacctgggaagtggaggtttcagtgagccaagatcgcaccattgcactctagcctgggccacagtgcaagactctgtctcaaaaataaataaataaataaataaataaataaataaataaaagtattagattgattccttcagtactttattactggttgctcagtattgcactgttatggaggt

SEQ ID NO: 16205 - DNA, 478 bp, Homo sapiens
  chr10.fa.O7frz.55577627
  Located on chromosome 10
  Distance between a terminus base of telomere on chromosomal short arm and 5'-terminus of this base sequence : 54387857
  Distance between 3'-terminus of neighbour sequence of sequence listing upward to telomere on chrosomal short arm and 5'-terminus of this base sequence : 28086
aaggtgttcattgttacattatctcccaagtcagaataatataaatgtataaataagggatagttaaattccaaaagaggaataacaatattatgcagccattagaaagtatattcttggccgagcgcagtggttcacacctgtaatcccagcactttgggaagccgaggcgggcggatcacttgaggtcagcagttcaagaccagcctggacaacaatggtgaaaccccgtctgtactaaacataaaaaaattagccgggcgtggtggtgcacacttatagtcccaactacttggaaggcagaggcaccggaatcgcttgaacccaggaggtggaggttacagtgagcccagatcgtagcactgcattccagcctgggtgacagagtgagactagatctctaaataaataaataaataaataaataaataaatagtatattcttaaagattatgtaacaatgcaggaaatagttatt

SEQ ID NO: 16206 - DNA, 360 bp, Homo sapiens
  chr10.fa.O7frz.55693551
  Located on chromosome 10
  Distance between a terminus base of telomere on chromosomal short arm and 5'-terminus of this base sequence : 54577317
  Distance between 3'-terminus of neighbour sequence of sequence listing upward to telomere on chrosomal short arm and 5'-terminus of this base sequence : 188982
cactgatacctcatagactctcagggacacgattgctctttctaactataagaagtactgatgacaactgccaaagctctcccagtatgcttagtttttcttttgcttagttttgtatattttcaaagaaaatctgtgatttttcaccctggcatagaacaatttacaccctgattttgttttacaaattacagagcggatagacataataggcaatccttttgtgtgtgtgtgtgtgtgtgtgtgtgtacagtatttcatgattctttacctatcattcctggtcactctctagaaactgtattatgatcatatagattctggaagcaatcagacgtagacttctagttcaaatgttgc

SEQ ID NO: 16207 - DNA, 347 bp, Homo sapiens
  chr10.fa.O7frz.55805418
  Located on chromosome 10
  Distance between a terminus base of telomere on chromosomal short arm and 5'-terminus of this base sequence : 54690246
  Distance between 3'-terminus of neighbour sequence of sequence listing upward to telomere on chrosomal short arm and 5'-terminus of this base sequence : 112569
ttatttaagttccatcttggttaggaataaattgtgatttcaacactcaactatttagtagttagccaaaagttccacttttttgtggctgggggtggggttgggggtgggcggcacaggatcttgctctgtcgcccaggctgcagtgcagtggcacagtcaggactcactgcagtctcaacctccggggctcaagcaatcctcccacctcagtcccctgagaagctgggactacaggcaggcaccaccatatctgactaagttttattattattattattattattattttagtagtgatgaggtctcattatattgcctaggtagatctcaaacttctgaactca

SEQ ID NO: 16208 - DNA, 311 bp, Homo sapiens
  chr10.fa.O7frz.55906270
  Located on chromosome 10
  Distance between a terminus base of telomere on chromosomal short arm and 5'-terminus of this base sequence : 54791201
  Distance between 3'-terminus of neighbour sequence of sequence listing upward to telomere on chrosomal short arm and 5'-terminus of this base sequence : 100608
agctgtctcctgaaggttatacactatccagaggatcttttggttttccatattcagatgtttggttcaacacagaccaaccctcttctatataataaggagacacatgggttaatgctcatgtatctcatgtgtttctacttatttattttttatttatttatttatttatttatttatttagagaaggagtttcgctcttgttgcccaggctggagtgcaatggcatggtcttagctcactgcaatctccacctcccggattcaagtgattctcttgcctcagcctcctgagtatctggcattacagac

SEQ ID NO: 16209 - DNA, 460 bp, Homo sapiens
  chr10.fa.O7frz.55994762
  Located on chromosome 10
  Distance between a terminus base of telomere on chromosomal short arm and 5'-terminus of this base sequence : 54886847
  Distance between 3'-terminus of neighbour sequence of sequence listing upward to telomere on chrosomal short arm and 5'-terminus of this base sequence : 95335
gatggactttatttcttaaaggtgttacagtctcttttgacttaaaaaaaaagttttaaaagagaagtctgaccttttcctccttcttcaggtggaattcctaatttttcctaattcttcaggtagaatgctgtgtctgagaaagtgtgtgtgtgtgtgtgtgtgtgtgtgtgtgtgtgtgtgcattagtgcataggctaaaatgtggcagggaaagaagccaaaatgacatagctgcttttatcaaaagatataaaatgatcttttatagcttgttgttcttatatgcccttacagtttatattgtgttaaaatcatattaaagatgtatattatatacatatatttattttatgtatgtatacatacataattatatatatacacacacacacacttcacctagtatatatcgcctagtaaatgccaaaatgaaaagttcaggctgtcttaaataaca

SEQ ID NO: 16210 - DNA, 112 bp, Homo sapiens
  D10S539
  Located on chromosome 10
  Distance between a terminus base of telomere on chromosomal short arm and 5'-terminus of this base sequence : 55055971
  Distance between 3'-terminus of neighbour sequence of sequence listing upward to telomere on chrosomal short arm and 5'-terminus of this base sequence : 168664
aggtgtgccaaaacatccagttatttgtgtgtgtgtgtgtgtgtgtgtgtgtgtgtgtgtgtgtgttttattttttgtagagatggggttttgccatattgaccaggctgca

SEQ ID NO: 16211 - DNA, 400 bp, Homo sapiens
  chr10.fa.O7frz.56254678
  Located on chromosome 10
  Distance between a terminus base of telomere on chromosomal short arm and 5'-terminus of this base sequence : 55136343
  Distance between 3'-terminus of neighbour sequence of sequence listing upward to telomere on chrosomal short arm and 5'-terminus of this base sequence : 80260
taatcacaagtaaagaaccttgactttaagtattctgagatgaaaatagcactttttatttgtttttcccagtaaaattttcataaacagctgttacttgctctggtttagacaggttaagattatatatatatatatatatatatatatatatatatatatatatataaaataattattatgtatatattcaacacttctaagtatcttattatgcattaacacaaaaagaaaaaggatgacttagctaatctgagagtcagaaaatctgaaatccatggctttattgcatgtatctttcatggcatattcgatgtaatttttgccacagtgtgccctgatgacttgagaagcatcttcttaagacgacataaaagatcagaatgaggattaactagca

SEQ ID NO: 16212 - DNA, 259 bp, Homo sapiens
  AC026223.4_104525
  Located on chromosome 10
  Distance between a terminus base of telomere on chromosomal short arm and 5'-terminus of this base sequence : 55172018
  Distance between 3'-terminus of neighbour sequence of sequence listing upward to telomere on chrosomal short arm and 5'-terminus of this base sequence : 35275
actgtaggtataggtgcatgataccatggcatatatatatattttttttgtttgtttgtttgtttgtttgttttgttttgtttggtagagatggggtttcataatgttaccgaggctggtcttaaactcctgggctcaagtgttctacccatcctggcctcccaaagtgttaggattgcatgtgtgagccactgcgtttaaaataagttacaaaacccaaaccaaaaaaaagtatctatgatcaagaataggtgacatt

SEQ ID NO: 16213 - DNA, 185 bp, Homo sapiens
  D10S1790
  Located on chromosome 10
  Distance between a terminus base of telomere on chromosomal short arm and 5'-terminus of this base sequence : 55192911
  Distance between 3'-terminus of neighbour sequence of sequence listing upward to telomere on chrosomal short arm and 5'-terminus of this base sequence : 20634
gcctgagatacataaggtgctcaccaaacgtttcctggataaagaattacagggctgtgtgtgtatttgtgtgtgtgtgtgtgtgtgtgtgtgtgtgtgtgtgtgtgtgactaccaagtagaagtaagtgcctcagtctgagcaataagaaaatttaaataactcttggttgtagccatttcact

SEQ ID NO: 16214 - DNA, 210 bp, Homo sapiens
  D10S1762
  Located on chromosome 10
  Distance between a terminus base of telomere on chromosomal short arm and 5'-terminus of this base sequence : 55213854
  Distance between 3'-terminus of neighbour sequence of sequence listing upward to telomere on chrosomal short arm and 5'-terminus of this base sequence : 20758
tgagagcccattggtctgatgtaagttttctatacatctctgggtgaaatgaaactacacacaaatgtgggagataagagagaggcctggtaacaaataaaataaaaccaccaccaccaccaccaacaacaacacacacacacacacacacacacacacaagggagacttcagaaccatttgcaactttaaacgtgttctctaacccaca

SEQ ID NO: 16215 - DNA, 399 bp, Homo sapiens
  chr10.fa.O7frz.56457610
  Located on chromosome 10
  Distance between a terminus base of telomere on chromosomal short arm and 5'-terminus of this base sequence : 55314858
  Distance between 3'-terminus of neighbour sequence of sequence listing upward to telomere on chrosomal short arm and 5'-terminus of this base sequence : 100794
atctaccatttgatccagaatcccattactgggtatctacccaaaggaaaagaaggcattaaatgaaaaagatacatgcacacacatgtttatagcagcacaatttgcaattgcaaaaatatggaaccagaccaaatgtccatcaaccaatgagcagataaagaaaatgtggactagttagatagataggtaaatagatagatagatagatagatagatagataattagataattagatagatagatagatagatagatgatagatagatcatggaatattgctcagctataaaaatgaacaaaataatggcattcacagcaacctggatagagctggagaccattattctaagtgaagtaactcaggaatggaaaaccagacatcctatttactcact

SEQ ID NO: 16216 - DNA, 367 bp, Homo sapiens
  chr10.fa.O7frz.56636553
  Located on chromosome 10
  Distance between a terminus base of telomere on chromosomal short arm and 5'-terminus of this base sequence : 55451048
  Distance between 3'-terminus of neighbour sequence of sequence listing upward to telomere on chrosomal short arm and 5'-terminus of this base sequence : 135791
cagatactctagttgctttcaaactttggcaattatgagcaaagcttctatagacacttgtgtagaggtttctgtgtagatgtcagttttcaattcatttgagtaaataccaaggacaatcattgctggatcttatggtaaaagtatatatatacatgtgtatatatatatgtatatatatacatgtgtatatatatatgtatatgtatatatttaacacacagtgtctaatatatatatacacacagttgaagtatatttcgctttgcaagaaagtaccaaattgcctttaaaagtggttaaaccattttgcatttcagccagcaatgaatggggatccctctttatccacatctccatcagtatt

SEQ ID NO: 16217 - DNA, 160 bp, Homo sapiens
  Z67683
  Located on chromosome 10
  Distance between a terminus base of telomere on chromosomal short arm and 5'-terminus of this base sequence : 55624013
  Distance between 3'-terminus of neighbour sequence of sequence listing upward to telomere on chrosomal short arm and 5'-terminus of this base sequence : 172598
cagaaggatttcaacacaggcaactggactttatccagagcccctgctttaagcaacttatctctaacagacacacacacagacacacacacacacacacacacacagacacacacacattgcctcaaaatgaagtattcatactaacttgggctggcag

SEQ ID NO: 16218 - DNA, 242 bp, Homo sapiens
  D10S609
  Located on chromosome 10
  Distance between a terminus base of telomere on chromosomal short arm and 5'-terminus of this base sequence : 55670084
  Distance between 3'-terminus of neighbour sequence of sequence listing upward to telomere on chrosomal short arm and 5'-terminus of this base sequence : 45911
cgtgtgcatgtgtgtgtatgagtgtatgaaaaaattcaggacatggatatctatcacctatcatctatctatctatctatctatctatctatctatctatctatctatcatctctctacgtgtctatctactgtacagtactaaagtggttatctatttatccaccatacagtactgaagttgttttctttctatctatttatctattcactgtttactactgaagtggttaccattggtgc

SEQ ID NO: 16219 - DNA, 320 bp, Homo sapiens
  chr10.fa.O7frz.56764774
  Located on chromosome 10
  Distance between a terminus base of telomere on chromosomal short arm and 5'-terminus of this base sequence : 55863137
  Distance between 3'-terminus of neighbour sequence of sequence listing upward to telomere on chrosomal short arm and 5'-terminus of this base sequence : 192811
caaatgatacgtgagcaataactatatatctgacactttgctagatgctgttagggaaaagataacacaacagtcaataaaatagaggctctatcattaaaaagattaataacctaaggagagagatgaatgatccaaaaatacatctaatattattattgtaactgtatatatatatatatatatatatttttcttagccatatttccaatagaatgtaagcttcattagagatactaagtcttatccattgttatgcccctattggccaatgcctcacacatggtagatatttagtagcatatttgatagtggatgac

SEQ ID NO: 16220 - DNA, 426 bp, Homo sapiens
  chr10.fa.O7frz.56985550
  Located on chromosome 10
  Distance between a terminus base of telomere on chromosomal short arm and 5'-terminus of this base sequence : 56036693
  Distance between 3'-terminus of neighbour sequence of sequence listing upward to telomere on chrosomal short arm and 5'-terminus of this base sequence : 173236
caattagtcatgtacttcatgctactacttattgtttatacctatgttatagcttctccaccaggatagaaacttctttaaagcgctaatctcaccttgtggatacgtatccccttacagcacttagaacaaatatgtgatatatatttgttaatttaacatacttttcattatctctgtagcacaaaaataatgtttcaggggccatgtgacaaaaaaacagaatcatattagatgtgcctcaaaaataaagggaacagagttgttgaaagtgaaataataacttaaaaagtactagtctgtttggaagttttgtttatatgtaaatgcaagtgtgtgtgtgtgtgtgtgtgtgaatgttaacattagtcaaagagtaagaagaattacaaggggacccacaaaacctttaccaatccatgtaat

SEQ ID NO: 16221 - DNA, 391 bp, Homo sapiens
  AC013737.4_28432
  Located on chromosome 10
  Distance between a terminus base of telomere on chromosomal short arm and 5'-terminus of this base sequence : 56304278
  Distance between 3'-terminus of neighbour sequence of sequence listing upward to telomere on chrosomal short arm and 5'-terminus of this base sequence : 267159
tggctactatgttggacagtacagttacacagtaattccatcatcacaaaaaaatccatctatctgagagcaagcactgttaagggagaaatgaatgaatcaagaattatataacagcaagtaagaaatccaactatcttttacatatagttatgcttataatccaaacacagttgtatttacttgctgttttatatatatgtgtgtgtgtgtgtgtgtatgtatacctgtgtatatatctctatctatctatctatctatctatctatctatctatctatatctgtatgtgtatgtatacctgtgtatatgtctatctatctatctatctatatatatacacaaaacatatgtatacatatttatgcagtgaggatactgtggtagttca

SEQ ID NO: 16222 - DNA, 423 bp, Homo sapiens
  AC013737.4_33352
  Located on chromosome 10
  Distance between a terminus base of telomere on chromosomal short arm and 5'-terminus of this base sequence : 56309213
  Distance between 3'-terminus of neighbour sequence of sequence listing upward to telomere on chrosomal short arm and 5'-terminus of this base sequence : 4544
ccacataggctgtaagttacatacagaacatgggcccagactcaggtctcctgatttttaagaggctacacaggaagattcatcatatgtttctcaaatttacagaatgcaaatgaatatcgaaaagcaagagagatgggacaaattaacagtaggaaaaaatattgagataaatacttctgttaagtaagagttaaaatgttgaatttaaacaacaacaacaacaataataataataataataataataatatactttgctcgttagtgggcccatgcatcaaaactctgatacaattatcttttcttccatacaatataaataagggttctcaaaaatctgaattattctgttcccctgaaatccgtggtggatgaaatgagaaatattttaaaaacacctcagttggaataaggtggtat

SEQ ID NO: 16223 - DNA, 181 bp, Homo sapiens
  AC013737.4_41160
  Located on chromosome 10
  Distance between a terminus base of telomere on chromosomal short arm and 5'-terminus of this base sequence : 56317142
  Distance between 3'-terminus of neighbour sequence of sequence listing upward to telomere on chrosomal short arm and 5'-terminus of this base sequence : 7506
aggccagtacttagaattgttagagacaaaccagtggaaaataaaaacacacggtgttctttctgaagaaacacaaatactgttttgttttgtgtgtgtgtgtatgtgtgtgtgtgtgtgtgtgtgtgtgtgtgttttggtattatttattatttcctagtaatggtagtgttgctcttcg

SEQ ID NO: 16224 - DNA, 375 bp, Homo sapiens
  AC013737.4_67914
  Located on chromosome 10
  Distance between a terminus base of telomere on chromosomal short arm and 5'-terminus of this base sequence : 56343739
  Distance between 3'-terminus of neighbour sequence of sequence listing upward to telomere on chrosomal short arm and 5'-terminus of this base sequence : 26416
cattgatgttcatgacagtagaaccattgaagaggttgacaacagcccttggatgacctcgtcatagacatcagcatccgtatcctcacatatagtaaacagagactgtctataacaaatggaagcaggagaggagtcgtccatgtggtaatttactgttagcttggagaaacacatatattcagaagtatttgtatggatttagggaaaattaagagttttgacaaagtacgtgaagtcagagtcatggatatccccttctgtgtgtgtgtgtgtgtgtgtgtgtgtgtgtgtgtgtgtgtgtgctgtgtctggtttttgtttttgtgtttccatttgtaccagactgatgtgacttaggtaacatgccttatt

SEQ ID NO: 16225 - DNA, 305 bp, Homo sapiens
  AC013737.4_75912
  Located on chromosome 10
  Distance between a terminus base of telomere on chromosomal short arm and 5'-terminus of this base sequence : 56351953
  Distance between 3'-terminus of neighbour sequence of sequence listing upward to telomere on chrosomal short arm and 5'-terminus of this base sequence : 7839
ctcactaccagattgaaaatgaacttttggtctgaattctatttttatatatatatatatatatatatatatatatatatatatatatatatatatatatatacacacacacacatacatacatacacataatcattaataaaaatatattagcaagcaatcccaaaagattaagaagcctttttgtagatttaataaaatctcagctttctggtcatttaggtgttcatatggttatcttgaacaaaaggtatattcaagagaaacactcagatttcagagattggatacattcactgtttagc

SEQ ID NO: 16226 - DNA, 425 bp, Homo sapiens
  AC013737.4_90831
  Located on chromosome 10
  Distance between a terminus base of telomere on chromosomal short arm and 5'-terminus of this base sequence : 56366699
  Distance between 3'-terminus of neighbour sequence of sequence listing upward to telomere on chrosomal short arm and 5'-terminus of this base sequence : 14441
tagttaccaaagaatgctgtcttcttaatagtatgtatcagtgcctgaaattttttgttgaaattttaatttcctgtcttcttacactgaaatgtaagctccctgaagcagtaaaataacaatgtctatatccctagtacataaaacattgtcctgcactaaaagtctttcttgttcatgccttcattcactttctcattctctctctctcgatagattagatagatagatagatagatagatagatagatagatagatactgagatagagatatagtgtgtatgtatctataactgatggactgatttttttaggtaatgttccttgtcaaggagttgaaaatataattgtaaagaaagtttaactaatatatgatacaactaacaattaaaacaatgtatagtatgtggaactcacctactga

SEQ ID NO: 16227 - DNA, 343 bp, Homo sapiens
  AC013737.4_108398
  Located on chromosome 10
  Distance between a terminus base of telomere on chromosomal short arm and 5'-terminus of this base sequence : 56384325
  Distance between 3'-terminus of neighbour sequence of sequence listing upward to telomere on chrosomal short arm and 5'-terminus of this base sequence : 17201
gagttccttcaaggtaaggactgttgtttgttttgtgctccctgatgtattttcagagcctagaacagggcctggaataaaataagcagccaacactatgcgatgaaaattttttggtgggtataaatgcctttgattcgaaacaaaactcagtttaattgtgtgtgtgtgtgtgtgtgtgtgtgtgtgtgtgtgtgtgtctaaagtcaccctaagcacactgttaataaccctagaatgactgacgtgttcgtattatgcaattttttatttttttcatcatattgacagataaaggattctaattcctataccttttcaataatgcagaagccttcataac

SEQ ID NO: 16228 - DNA, 300 bp, Homo sapiens
  AC013737.4_140886
  Located on chromosome 10
  Distance between a terminus base of telomere on chromosomal short arm and 5'-terminus of this base sequence : 56416748
  Distance between 3'-terminus of neighbour sequence of sequence listing upward to telomere on chrosomal short arm and 5'-terminus of this base sequence : 32080
ctcaaccttcagctcctaattcctttaaaaagttaccagtatattctgtgaggccacagtgaatcttctaatagtttacttttatgtaggccagagtcatttggcttgtttgaaattaaatatatatatatatacatatatatatatatgtgtgtgtgtgtatatatatatatatatatatatatatatatatatatatacatatatatatatgtgtgtgtgtgtatatatatatatatatatatatatatatatatatatatatatataaaattgcttcagtcaggctccaggtacttg

SEQ ID NO: 16229 - DNA, 244 bp, Homo sapiens
  AC013737.4_150311
  Located on chromosome 10
  Distance between a terminus base of telomere on chromosomal short arm and 5'-terminus of this base sequence : 56426345
  Distance between 3'-terminus of neighbour sequence of sequence listing upward to telomere on chrosomal short arm and 5'-terminus of this base sequence : 9297
ttaaatggttaaatcctagaccacggaatttttaaaaacagaatatgtgtatacacacacacacacacacacacacacacacacacacacacacacacaaatacaccttttaggggagaaattgatatttttgcctcagcaggatatccatttgccttaaaattcttattcttaggtatgtacatcaatcatctggggaggtccaagctgtgaaatccaaactgacagaaatttatagctccat

SEQ ID NO: 16230 - DNA, 326 bp, Homo sapiens
  AC013737.4_154966
  Located on chromosome 10
  Distance between a terminus base of telomere on chromosomal short arm and 5'-terminus of this base sequence : 56430788
  Distance between 3'-terminus of neighbour sequence of sequence listing upward to telomere on chrosomal short arm and 5'-terminus of this base sequence : 4199
tcattaagtaatctcatcttccatatttctaaagttatattaaagtttaagaactaaaacaaatctttaaatttctaaatatatatatataaactggaagcttctttaataggggtggtaaacttttgttacatttattaatgattttacatttgacatttttctcaataacaaataagttaataaaatgacatatttaatatgtatttgtaaatttacttgtggcactggagttaatatttgaaaatttttttatttataaaatatttatttatttatttatttattttagaaatgagaatctcactacattgcctatactgact

SEQ ID NO: 16231 - DNA, 338 bp, Homo sapiens
  AC013737.4_168464
  Located on chromosome 10
  Distance between a terminus base of telomere on chromosomal short arm and 5'-terminus of this base sequence : 56444341
  Distance between 3'-terminus of neighbour sequence of sequence listing upward to telomere on chrosomal short arm and 5'-terminus of this base sequence : 13227
tgaatcctacagttaaagatgctctagaaatggaatatggggttattagcactatttcttctcagctgatagatttggtcattcatcatttttaggaaagagggaaagactccagcctttcacacctatgttgtaagcattgtttgtaatattctcttttcagctgtgatgactagaaattcagttcaaaagaagataatttctaaagaacacacacacacacacacacacacacacacacgtgtatatatattttctggtgacctaaagacagagacttagtacaaaagtgcctcaatgggcctgtaattgagaagtggcggaaatgtagataatta

SEQ ID NO: 16232 - DNA, 166 bp, Homo sapiens
  chr10.fa.O7frz.57636275
  Located on chromosome 10
  Distance between a terminus base of telomere on chromosomal short arm and 5'-terminus of this base sequence : 56505243
  Distance between 3'-terminus of neighbour sequence of sequence listing upward to telomere on chrosomal short arm and 5'-terminus of this base sequence : 60564
agatgctttcaacttagtgactattattcctgtctatctctatgtgcatgtattacacacacacacacacacacccacattaagaacccactaaatattgttaagttcttggaaaatatgaccttaagtgaaatgacatacaataggtccttgaataacatagtca

SEQ ID NO: 16233 - DNA, 447 bp, Homo sapiens
  chr10.fa.O7frz.57802238
  Located on chromosome 10
  Distance between a terminus base of telomere on chromosomal short arm and 5'-terminus of this base sequence : 56687562
  Distance between 3'-terminus of neighbour sequence of sequence listing upward to telomere on chrosomal short arm and 5'-terminus of this base sequence : 182153
ggaaacaggttagattccttacccagtgtgcccactaatagtccctttataaaaccatctcctggaggcactagtcctccctcagaagaacagtaggtgaaggagttctctggtttctggccttgaggccagttcctgtttaagcctaaataaatgaataaataaataaataaataaataaataaataaataaataaatattcctcttccaagaggcatctggcagttccccttatccctgatgagtccttcttaagaccatgtcgaattaagttaaatgaatcgaaagtaaattaggattaaattgtataacattgattcatacattgccttggatgatttatatacatttggaaagtttaatactttatcacaatggttaagttttaatgcaaaataaaattatctatgtagtgttttaaaatgttgattagcctactccttagc

SEQ ID NO: 16234 - DNA, 410 bp, Homo sapiens
  chr10.fa.O7frz.57879061
  Located on chromosome 10
  Distance between a terminus base of telomere on chromosomal short arm and 5'-terminus of this base sequence : 56765260
  Distance between 3'-terminus of neighbour sequence of sequence listing upward to telomere on chrosomal short arm and 5'-terminus of this base sequence : 77251
agaacatctgagcaccaatactgggatattgtaagttacctcagaaataacatccttgggtaaggggtgtgtgtgtggtggggtgtgtgtgtgtgtgtgtgtgtgtgtgtgtgtgtgtgtgtgtgttttagcagaaagagaatcttctaagtacaatgaaatgggcttctatttatcagtaccttttttcttctctctcttttagttctgttgctttccaggatatacacatggctttaacagagtctattactggaatacggagaagctattgaagtaatccttcaaggcataaggtcagaacttagagaagtcacagagtttgtatttctgaacctgattaccagaaaattcttctaaagcaggaaaagatatatgctttcaaactgttatcctacaaccaaatccat

SEQ ID NO: 16235 - DNA, 366 bp, Homo sapiens
  chr10.fa.O7frz.57980353
  Located on chromosome 10
  Distance between a terminus base of telomere on chromosomal short arm and 5'-terminus of this base sequence : 56866503
  Distance between 3'-terminus of neighbour sequence of sequence listing upward to telomere on chrosomal short arm and 5'-terminus of this base sequence : 100833
ctgtaatggctttgtacagaactccactgcaacccacctgacaaactaggatatgctaaacaaaccagtcatttatgtgagcgtgtgtatgtgtatgtgtctttctgtctgtctgtctgtatgtatgtgaaagagagagagagagagagagagaaactatggatacttcctttataaattctggctttgccttgccttagaacaggacaacagacttcacaatttttctacatatatgcaaataaattctcggcactttaactgtctttgagttacactttgatacatccacagtgcaatttatgtcaataaaaatgaaattcctaagtaggagggagctgtgtcttaacgtgattagtatttgga

SEQ ID NO: 16236 - DNA, 354 bp, Homo sapiens
  AC063963.5_2665
  Located on chromosome 10
  Distance between a terminus base of telomere on chromosomal short arm and 5'-terminus of this base sequence : 56962760
  Distance between 3'-terminus of neighbour sequence of sequence listing upward to telomere on chrosomal short arm and 5'-terminus of this base sequence : 95891
catgaggtcaggagttcaagaccaacttggctaagatggtgaaaccccgtttctactagaaatacaaaaaaattagcagggtgtggtggtaggcgcctgtaatcccagctactcaggaggctgaggcaggagaatcgcttgaacctgggcaacagaggttgcagtgagctgagatcacgccactgcactccagcctgggcaacagactgagactctgtctcaaaaaaataaaataaaataaaataaaataaaataaattaaaataaaagtttattttattttagttaatttggtatacagacagatacataaaaatcttaaaatgccacactatcaatagtattacaggcctgg

SEQ ID NO: 16237 - DNA, 430 bp, Homo sapiens
  chr10.fa.O7frz.58197585
  Located on chromosome 10
  Distance between a terminus base of telomere on chromosomal short arm and 5'-terminus of this base sequence : 57084109
  Distance between 3'-terminus of neighbour sequence of sequence listing upward to telomere on chrosomal short arm and 5'-terminus of this base sequence : 120995
aaagcaaataggctaaatgatcttatactggagactctcatactagccctctctctctctccttccttctctctctctctctctcacacacacacacacacacacacacagacacacacacacatacagacacacacacacacatacagataatataggcacaatggcacagcctaggagactaaagcaaatgtctttccaattaagataatatatggtaatttaacagtctttgacaaaactcagtgaacacaaagaagctaaagaagtattatacaactgagcatactatcctccactaagaaaactccttttacattgatacttcatgtctataaaaaatttaaatatattaatggcaaataatgtaatatacatgatatatgtatgcatataatttagcatactatgcttcactaagaaagctcta

SEQ ID NO: 16238 - DNA, 456 bp, Homo sapiens
  chr10.fa.O7frz.58294365
  Located on chromosome 10
  Distance between a terminus base of telomere on chromosomal short arm and 5'-terminus of this base sequence : 57133638
  Distance between 3'-terminus of neighbour sequence of sequence listing upward to telomere on chrosomal short arm and 5'-terminus of this base sequence : 49099
aaagatgctgtgaaataaactagtatacaaattctagatcgactattaatcttcctcaccacacacacacagacacacacacaagtgtttgctaagatgaaaggcaatatttctgctatttatatctcattatttgaaatggcagacctatttgtttcctgccttcttaaaatctaatttacttactgctacaataaacacaggcttctctgattatttgcatccacacacagtgtctcaaatatcctatatttgtgtctgtgtataactgtgtacacatatacacacatattcatatatatattctttcatatatatatacacacacactcatatatatatgcctatatatatatattccttcctatatatatacatgtatatacacatacatgtatgtgagtgtgtgtctgtatacatctggacctgtgggtctggagtttacatctgaatcag

SEQ ID NO: 16239 - DNA, 418 bp, Homo sapiens
  chr10.fa.O7frz.58597796
  Located on chromosome 10
  Distance between a terminus base of telomere on chromosomal short arm and 5'-terminus of this base sequence : 57460296
  Distance between 3'-terminus of neighbour sequence of sequence listing upward to telomere on chrosomal short arm and 5'-terminus of this base sequence : 326202
aatttatcatgaatgcattcacacacaggtgtgtatatgtaggggtgaatatataccatatataaactcatatatatatatatatatatatatatatatatatatatatacacacacacacacacacatacatacacacacaaacatacatacatatcattatttaaatgatctgagtactaggaagcctcctaggccaccagggaggtaggaaagtgcgaatgggtactttagaataatgactaattttcaaaatcctttttttcttaacctcctcttctaaaagagaggaaagataattcagagcagagggaagatagataaatagattattatgactttatggagagaaatattagaaataaggagaatgaagtgatgaagaaacagaacagtactgacattctagaatttccac

SEQ ID NO: 16240 - DNA, 267 bp, Homo sapiens
  chr10.fa.O7frz.58695338
  Located on chromosome 10
  Distance between a terminus base of telomere on chromosomal short arm and 5'-terminus of this base sequence : 57502981
  Distance between 3'-terminus of neighbour sequence of sequence listing upward to telomere on chrosomal short arm and 5'-terminus of this base sequence : 42267
cctcttacaagtcagacatactctagtgcttttaatgtattagctcatttagtcctctcaacaattaaaattatttttcttatttttgagaaatccatagcatgcagcaagtatcaatctaagaactaaagtgtatgtgtgtgtgtgtgtgtgtgtgtgtgtgtgtgtgtgtatttttgtttttactgaattttaactttttgttttaatgaaagtccaagggcttatgagttcagagatcatcttgaatactgttcttagcatgat

SEQ ID NO: 16241 - DNA, 107 bp, Homo sapiens
  DISD22_0009531
  Located on chromosome 10
  Distance between a terminus base of telomere on chromosomal short arm and 5'-terminus of this base sequence : 57760639
  Distance between 3'-terminus of neighbour sequence of sequence listing upward to telomere on chrosomal short arm and 5'-terminus of this base sequence : 257391
aacaccagcttcagcaaaccctaatatatatatatatatatatatatatatatatatatatatatatatatatatatagtaaacacaagtatgcactaggtcaaggt

SEQ ID NO: 16242 - DNA, 476 bp, Homo sapiens
  chr10.fa.O7frz.59025171
  Located on chromosome 10
  Distance between a terminus base of telomere on chromosomal short arm and 5'-terminus of this base sequence : 57916500
  Distance between 3'-terminus of neighbour sequence of sequence listing upward to telomere on chrosomal short arm and 5'-terminus of this base sequence : 155754
ttgatccatgaataacttagaaatatgatgcttaatttccaaacatttgtacactttcaaagtcttgccatagatttccaggtcaataaaattgttgtacaaaaacactgtcaaagatttcaaatttttggtatttatagattgttgtttggggcctaacctcagcctatatctatctatctatctatctatctatctatctatctatctatctatctatctgttttcctatctatctatcatctctctacctagatagacagagatatctattgacatctacggtaaattttgaaacatgttccaaatacactacaataaatgtgtgttttgctatttttgggtacagtttttatgtcaaagtatttaatcttactgctttaaatttctgtattattattgatattttgtatcctttttgctatcaggtatcaaaaaaggtatattaaagtcttcatgattgaagatgtacctat

SEQ ID NO: 16243 - DNA, 169 bp, Homo sapiens
  DISO7_10017523
  Located on chromosome 10
  Distance between a terminus base of telomere on chromosomal short arm and 5'-terminus of this base sequence : 58105234
  Distance between 3'-terminus of neighbour sequence of sequence listing upward to telomere on chrosomal short arm and 5'-terminus of this base sequence : 188258
gccacctctgtgagtttactcatccctgagtttctccaatgtatataagtgtgtgtgtgtgtgtgtgtatatatatatatacacaaacacacaataagtgtatatatacaatgcatatatgtatatatatatctccaatgtatatatgagatgtacatgttaattggcc

SEQ ID NO: 16244 - DNA, 334 bp, Homo sapiens
  AL022344.2_248207
  Located on chromosome 10
  Distance between a terminus base of telomere on chromosomal short arm and 5'-terminus of this base sequence : 58762256
  Distance between 3'-terminus of neighbour sequence of sequence listing upward to telomere on chrosomal short arm and 5'-terminus of this base sequence : 656853
gctgaaatagaggcacgaccagaggaaaggctaatgcccatttgtgtgtgtgtgtgtgtgtgtgtgtgtgtgtgtgtgtgtgtgtgtgtgttttactaggaggaaggaagatgaagaaggaagactggctaagttctggccgcttcttcgtccgcctctgatatgcgggccatgtatgcaggggttggcgagggggcaggcagcaggtgtgacagagaactggacaggaggagtccgcgccgcatcagggtggccgcggggctgcttctctgcctggagggcgccgtgctgccccttcccggcctaagtccctctgtgattcgcaacttggttt

SEQ ID NO: 16245 - DNA, 476 bp, Homo sapiens
  AL022344.2_13085
  Located on chromosome 10
  Distance between a terminus base of telomere on chromosomal short arm and 5'-terminus of this base sequence : 58997297
  Distance between 3'-terminus of neighbour sequence of sequence listing upward to telomere on chrosomal short arm and 5'-terminus of this base sequence : 234707
accatgtctttacaaattagctaggcatggtggtgtacccctgtggtccttgctactttggaggctgaggtggaagaataatttgaacccagaattcagaggttacagtgagctataatcatgccactgccctccagcctgttgtatctaacaacaacaacaacaacaacaaggaaattatatatatatatatatatatatatatatatatgtatgtgtataggtataggtatgtgcgtgtgtgcacgtgtgtgtgtcacagttcaggtcttgaaaaaaaccttgccatttgcaaccacatggatcatcttgaggtctttaggctaagtgaaataaaccaggcacagaaagatgaacactgcattatttcaatcatatgtggagtctaaaaaagtgtttgaattacagttacagacaatagaatgcaagtgaccaagggctgtgtcttgggggaatcagatattggtcaaatggta

SEQ ID NO: 16246 - DNA, 339 bp, Homo sapiens
  AL023808.3_279898
  Located on chromosome 10
  Distance between a terminus base of telomere on chromosomal short arm and 5'-terminus of this base sequence : 58997297
  Distance between 3'-terminus of neighbour sequence of sequence listing upward to telomere on chrosomal short arm and 5'-terminus of this base sequence : -476
accatgtctttacaaattagctaggcatggtggtgtacccctgtggtccttgctactttggaggctgaggtggaagaataatttgaacccagaattcagaggttacagtgagctataatcatgccactgccctccagcctgttgtatctaacaacaacaacaacaacaacaaggaaattatatatatatatatatatatatatatatatatgtatgtgtataggtataggtatgtgcgtgtgtgcacgtgtgtgtgtcacagttcaggtcttgaaaaaaaccttgccatttgcaaccacatggatcatcttgaggtctttaggctaagtgaaataaacc

SEQ ID NO: 16247 - DNA, 307 bp, Homo sapiens
  AL022345.2_121718
  Located on chromosome 10
  Distance between a terminus base of telomere on chromosomal short arm and 5'-terminus of this base sequence : 59034901
  Distance between 3'-terminus of neighbour sequence of sequence listing upward to telomere on chrosomal short arm and 5'-terminus of this base sequence : 37265
ctcaactttgtaagtaggccagttctctccaaattgacctacagtttaatggcattcctgtcaagattccagtaaggtttttctcagctttaaataagcttattccaaaatttccataaatggtcaaaggaaccatatatatatatatatatatataaaatatgaaacaattttgagaaattttttctcagaagttttgagaaaaagaatagtaggaggaattattgtatccagtgttaaggcttattacattagtctccccttttctgtggttttgctttctgcagtttctgttacctgaggtcaa

SEQ ID NO: 16248 - DNA, 145 bp, Homo sapiens
  D10S1746
  Located on chromosome 10
  Distance between a terminus base of telomere on chromosomal short arm and 5'-terminus of this base sequence : 59136645
  Distance between 3'-terminus of neighbour sequence of sequence listing upward to telomere on chrosomal short arm and 5'-terminus of this base sequence : 101437
cccacgacaggattaaatgaggtgtgtgtgtgtgtgtgtgtgtgtgtgtactgtttggggtatactgtcttcctccttcagggaaacccacccagtttgtcagaagtaatataattctcattcacagggtattgcatcattcaca

SEQ ID NO: 16249 - DNA, 283 bp, Homo sapiens
  AL031601.3_347541
  Located on chromosome 10
  Distance between a terminus base of telomere on chromosomal short arm and 5'-terminus of this base sequence : 59194666
  Distance between 3'-terminus of neighbour sequence of sequence listing upward to telomere on chrosomal short arm and 5'-terminus of this base sequence : 57876
acaggtctagacagcactgtctgaaaatgggctcaaggaagtagctgtgaaaggcccctgggatgttttctgctcccctctctgcaaatgtcctggagggacatcctgtcactttggggtgtgtgtgtgtgtgtgtgtgtgtgtgtgttcatcacttggttttgtttatgtttttgcttttcttcatgaaatctgcagagttgccaaaagtaccttgatgttttctgaaagcagagccaatgaccacactccagggactgagtcctcaaatctgtggtatttg

SEQ ID NO: 16250 - DNA, 98 bp, Homo sapiens
  DISO7_10002850
  Located on chromosome 10
  Distance between a terminus base of telomere on chromosomal short arm and 5'-terminus of this base sequence : 59263539
  Distance between 3'-terminus of neighbour sequence of sequence listing upward to telomere on chrosomal short arm and 5'-terminus of this base sequence : 68590
agaagcccaatatgctggcaaaaagttcaagttttgttgttgttgttgttgttgttttaccagttgggcttttggcttccctctccgtgtgcaaactg

SEQ ID NO: 16251 - DNA, 340 bp, Homo sapiens
  AL031601.3_194183
  Located on chromosome 10
  Distance between a terminus base of telomere on chromosomal short arm and 5'-terminus of this base sequence : 59412765
  Distance between 3'-terminus of neighbour sequence of sequence listing upward to telomere on chrosomal short arm and 5'-terminus of this base sequence : 149128
attctattccattactttcgaatccattccattccattccattcgagtccattccatttcattccattccatttcattccattcgagtccattccatttcattccattccattccattccatttcattccattcgtgtccattacattacattacattacattacattacattacattacattacattacattacattcgggtccaatcgattctgtgccattcttgtcccttccattcgattagagtcccctccattcctttgcattccattcaagtccatttcattgcattccatttcattcgagtccattccttttcactcaattccactcgagtca

SEQ ID NO: 16252 - DNA, 250 bp, Homo sapiens
  AL031601.3_200878
  Located on chromosome 10
  Distance between a terminus base of telomere on chromosomal short arm and 5'-terminus of this base sequence : 59477399
  Distance between 3'-terminus of neighbour sequence of sequence listing upward to telomere on chrosomal short arm and 5'-terminus of this base sequence : 64294
gaatggaaaggactcgaaggcaacagaatgtaacgaactggaatggaatggatttgaatggaagggactagaatggaatttaatggaatggacaggaatggaatggaatgcaatggaatggaatggaatggaatggaatggactcgaaaggaatggaatggaatttaacagaatggactctaatagaatggaatgtaaaatgcactcgaatggaatacaatggattttaatggaattcactctaatggaa

SEQ ID NO: 16253 - DNA, 246 bp, Homo sapiens
  chr10.fa.O7frz.61901311
  Located on chromosome 10
  Distance between a terminus base of telomere on chromosomal short arm and 5'-terminus of this base sequence : 59655690
  Distance between 3'-terminus of neighbour sequence of sequence listing upward to telomere on chrosomal short arm and 5'-terminus of this base sequence : 178041
cttgtccagatgttaaccatacttttctagtctcagtttttaatctgatctcctttatgagaacttcatcatgttagctgtcactgatgactctcacaacggtattcctccagcccttatagtcagcatcagttggtagaatgaggtgtgcgtgtgtgtgtgtgtgtgtgtgtgtgtgtgtgtgtgtgtgtgttcccattgcactgaagctcatttggggcagaaatatttccaactcaatttctt

SEQ ID NO: 16254 - DNA, 111 bp, Homo sapiens
  Z67552
  Located on chromosome 10
  Distance between a terminus base of telomere on chromosomal short arm and 5'-terminus of this base sequence : 59898818
  Distance between 3'-terminus of neighbour sequence of sequence listing upward to telomere on chrosomal short arm and 5'-terminus of this base sequence : 242882
gaataagaacatcataaccaatgaccactcatataaagtcttatttgtgtgtgtgtgtgtgtgtgtgtgcacgtgtgtgtgttagagtctcattatattgctcaggctgga

SEQ ID NO: 16255 - DNA, 405 bp, Homo sapiens
  chr10.fa.O7frz.62250120
  Located on chromosome 10
  Distance between a terminus base of telomere on chromosomal short arm and 5'-terminus of this base sequence : 60006471
  Distance between 3'-terminus of neighbour sequence of sequence listing upward to telomere on chrosomal short arm and 5'-terminus of this base sequence : 107542
agctgtgtaatttgaataagtcactgtctctatatgcctcatttgtacccagggataaatatatgtgtgtgtgtgtctgtgtgtgtgtgtgtgtgtgtgtgtgtgtgtgacagacagagagagagagaaagagagaaagagaaagagaaagagagtggaatgagatcagcagtttgagcccctttgaaaccctgagattatgggaaggagaagatgagctagtgagaattccccatccttcttcaaccagagccactgttactagttttgtgtaacggctttctgcattagagttaatttgaaagacagtttctattttttaaatgtgaaaactacgtgaatccatgagccttaggttccttctacctctaacattttacactacctacatgtaatcagatggtt

SEQ ID NO: 16256 - DNA, 241 bp, Homo sapiens
  chr10.fa.O7frz.62377478
  Located on chromosome 10
  Distance between a terminus base of telomere on chromosomal short arm and 5'-terminus of this base sequence : 60133774
  Distance between 3'-terminus of neighbour sequence of sequence listing upward to telomere on chrosomal short arm and 5'-terminus of this base sequence : 126898
attagattaagatgccttccagacctgtgactccatgacctgaatgtcctaatggagacaaaataggcatttccagcagaaagaaccaactgattgcctttgcaaaggcagaataaaggacagaggagactgtttttttctcatatagcccagaaaacagattaaaggttttacatagatagatagatagatggatagatagatagatagatagatatcacttcatctgagctagttattt

SEQ ID NO: 16257 - DNA, 204 bp, Homo sapiens
  chr10.fa.O7frz.62603109
  Located on chromosome 10
  Distance between a terminus base of telomere on chromosomal short arm and 5'-terminus of this base sequence : 60466069
  Distance between 3'-terminus of neighbour sequence of sequence listing upward to telomere on chrosomal short arm and 5'-terminus of this base sequence : 332054
ccaagagttgataaggctacttacatgttttgtgtgtgtgtgtgtgtgtgtgtgtgtgtgtgtgtgtgtgtgtgtacatgcccagtgtaattcagaaattgtttagactacttactatatgccatctcctgcgcaagctggagagttaaagaagaggtgcctgtgcttttttgtaaatactttaaggactgaactgtctcaagt

SEQ ID NO: 16258 - DNA, 293 bp, Homo sapiens
  AC016398.5_5865
  Located on chromosome 10
  Distance between a terminus base of telomere on chromosomal short arm and 5'-terminus of this base sequence : 60731760
  Distance between 3'-terminus of neighbour sequence of sequence listing upward to telomere on chrosomal short arm and 5'-terminus of this base sequence : 265487
tcaaagtagctcaagccattagaaggctaatggagaggaggggacacacgataaaagaaatcactgaagaatcagttttaggacggggaaagcagagcagccttggagacctggtctagaaggaaggcgttgaaagctgtcacaattctgtctctctctctctctctctctctctctctctctctctctctctctctttctctcatagtctacccagggccgactccaaaagtcctttgcatctctccttcaggagactgctttgtgggatgttccttacaagcacgtttatg

SEQ ID NO: 16259 - DNA, 190 bp, Homo sapiens
  D10S549
  Located on chromosome 10
  Distance between a terminus base of telomere on chromosomal short arm and 5'-terminus of this base sequence : 60735278
  Distance between 3'-terminus of neighbour sequence of sequence listing upward to telomere on chrosomal short arm and 5'-terminus of this base sequence : 3225
ggcctggatggttgataacatcccttctggcactagcatcttattcgaggcacagaaaacttacacgaatttgtattggccctatttgggaggacagaaggcccatggtgtacacacacacacacacacacacacacacacacacacacacacactgacgactgtgaattaggtgagtaagcaggcacag

SEQ ID NO: 16260 - DNA, 186 bp, Homo sapiens
  D10S1244
  Located on chromosome 10
  Distance between a terminus base of telomere on chromosomal short arm and 5'-terminus of this base sequence : 60777818
  Distance between 3'-terminus of neighbour sequence of sequence listing upward to telomere on chrosomal short arm and 5'-terminus of this base sequence : 42350
tattccttgggaaacactgctttagggaaacatttgccaagcaaccatatggcttgagagatatagatagatagatagataatagatagatgatagatagatagatagatgatagatagatgatagatgatagatagatagatagatagatagattagatagatagtaggtgaagacagatggtcc

SEQ ID NO: 16261 - DNA, 255 bp, Homo sapiens
  AC016398.5_56186
  Located on chromosome 10
  Distance between a terminus base of telomere on chromosomal short arm and 5'-terminus of this base sequence : 60782038
  Distance between 3'-terminus of neighbour sequence of sequence listing upward to telomere on chrosomal short arm and 5'-terminus of this base sequence : 4034
acctttggatgaatagtaaaacaagaggctgagaaatcagaacatatatccaaaaaatgaactagtatttaccctgaacccttgtctatgagcagaaatgctctgtgctttttaatttattcttatggcaatttttctctcagtttgcacaacagaacccaaagcagcatggtaagtatgggttaggaatttcatgtgtgtgtgtgtgtgtgtgtgtgtatatgtgtgtgtgttgcctaaatattcatttgctag

SEQ ID NO: 16262 - DNA, 274 bp, Homo sapiens
  AC016398.5_104687
  Located on chromosome 10
  Distance between a terminus base of telomere on chromosomal short arm and 5'-terminus of this base sequence : 60830696
  Distance between 3'-terminus of neighbour sequence of sequence listing upward to telomere on chrosomal short arm and 5'-terminus of this base sequence : 48403
aagcagtctgattccagatctgtgttcttaatctgattatatatatatatatatatatagagagagagagagacagagagagagtgtgtatatatacatataatctgattatatataaatatatattaaatatatacacacattatatatatacataataatttgtatatattgtagaaattatgtatatacccatacataccaatttgtatatatttattttatatacatacatacttaatttgtataataactctgcaagcgagttatctac

SEQ ID NO: 16263 - DNA, 174 bp, Homo sapiens
  AC016398.5_127059
  Located on chromosome 10
  Distance between a terminus base of telomere on chromosomal short arm and 5'-terminus of this base sequence : 60853084
  Distance between 3'-terminus of neighbour sequence of sequence listing upward to telomere on chrosomal short arm and 5'-terminus of this base sequence : 22114
tttcaattaagcaagacagttacacacacacacacacacacacacacacacacacacacacacactacctcatggattgtcttccctaggcatgtgtactttgtttgccaggacctggtccttgcccaggtattactctgaaaatatactgtaaatccagaggtttctattcct

SEQ ID NO: 16264 - DNA, 110 bp, Homo sapiens
  D10S207
  Located on chromosome 10
  Distance between a terminus base of telomere on chromosomal short arm and 5'-terminus of this base sequence : 60990357
  Distance between 3'-terminus of neighbour sequence of sequence listing upward to telomere on chrosomal short arm and 5'-terminus of this base sequence : 137099
ctctgtgtgtatgtgtatgtcactatacataatgtgtgtgtgtgtgtgtgtgtgtgtgtgtagtatttaatgtaaatcttgaaaaggaatacctcattgacaaataacta

SEQ ID NO: 16265 - DNA, 391 bp, Homo sapiens
  chr10.fa.O7frz.63234349
  Located on chromosome 10
  Distance between a terminus base of telomere on chromosomal short arm and 5'-terminus of this base sequence : 61105376
  Distance between 3'-terminus of neighbour sequence of sequence listing upward to telomere on chrosomal short arm and 5'-terminus of this base sequence : 114909
aatactcaaatccgtctttgtcaaaataacttcagacatttaccaaggcccaaggaagagaaacttagataatagattagttttgtgcagaggaagggagcaaggaagtggagcaaagtttttgagcagaaagtgtcacccagtgagagagccaccatgtccataggacccgtgtgtgtgtgtgtgtgtgtatgagagagacagagagacagagggggaaagagagagagagaaagggaggaaggaaggaaggaaggaaggaaggaaggaaggaaggaaggaaggaagaggagaggaggagaggagatgcttggcttttgagaggtaggggtaaatgtacactagaagggggcttgagaagagctgctggaagacaatttctgcctatttc

SEQ ID NO: 16266 - DNA, 445 bp, Homo sapiens
  chr10.fa.O7frz.63332520
  Located on chromosome 10
  Distance between a terminus base of telomere on chromosomal short arm and 5'-terminus of this base sequence : 61195257
  Distance between 3'-terminus of neighbour sequence of sequence listing upward to telomere on chrosomal short arm and 5'-terminus of this base sequence : 89490
aagtgatagtatttggaggtgagatctttgggagatcattaggtttagatgagggtaggggccccatgatgagatcagtgtccttatagaaagagaaacagaccggagctcacttgtttccactccctctcccccgtctctctttctctctctctttctctttctctctctctctctctctgtcatgtaaggacacagtgacaagatagtcatctgccaaccaaggagagagtcctcaccagacaatgaccatgctggaaacttgatcttaaacttcacaacctctagaaccaggagaaataaatgtctgttgtttaagccatgtagtctgtggtatttcattatagcagccaaagctgcctaagataccgagctaatacacttctttatgtgtaataataatttaagcagttgatattttcactggatcatagctgaagtaaga

SEQ ID NO: 16267 - DNA, 226 bp, Homo sapiens
  chr10.fa.O7frz.63453020
  Located on chromosome 10
  Distance between a terminus base of telomere on chromosomal short arm and 5'-terminus of this base sequence : 61279430
  Distance between 3'-terminus of neighbour sequence of sequence listing upward to telomere on chrosomal short arm and 5'-terminus of this base sequence : 83728
tcaacttccacttatgagtgacaatatgcagtgtttggttttctgttcctgtcttagtttcacataaatatttctttctgctgtgcatgtgtgtgtgtgtgtgtgtgtgtgtaaagcttttgctaaaactactttggatattgaggataaagattcgacactttcagtacgcaaatctctgacattctatatgagaatgtaactgaaagtatgctacaaagtcatt

SEQ ID NO: 16268 - DNA, 187 bp, Homo sapiens
  D10S589
  Located on chromosome 10
  Distance between a terminus base of telomere on chromosomal short arm and 5'-terminus of this base sequence : 61379781
  Distance between 3'-terminus of neighbour sequence of sequence listing upward to telomere on chrosomal short arm and 5'-terminus of this base sequence : 100125
gctgcacttccatgttccttgcagcattattcaccatagccaagatatggaatcaacctaaatgtctataagtggatgaatggatgaagaaatgtgatacacacacacacacacacacacacacacacacacacaataggagactaattcagacttgaaaaagaaggaaatcagtcaggcgtggtgg

SEQ ID NO: 16269 - DNA, 319 bp, Homo sapiens
  chr10.fa.O7frz.79251679
  Located on chromosome 10
  Distance between a terminus base of telomere on chromosomal short arm and 5'-terminus of this base sequence : 61383436
  Distance between 3'-terminus of neighbour sequence of sequence listing upward to telomere on chrosomal short arm and 5'-terminus of this base sequence : 3468
gtctacaaatgaatgcgagtcttccttggtctccctggctcccggggccgctggcgccctcctggccggagctgtatgctcagctggcagtggtcccggagaaacgggcaccagaactttgtggagtccgtgatcctgggaagtgaggagtgaggatgccaagtacagtcctttgtgacagctccgcgggaaaggagggcgtcttgcggtgcacacacacacacacacacacacacacacacacacacacacaggctgcttctaaggacgttcagtctgtcctgcagttgaactgcactaacaatactaccattggcaa

SEQ ID NO: 16270 - DNA, 164 bp, Homo sapiens
  DISO7_10006099
  Located on chromosome 10
  Distance between a terminus base of telomere on chromosomal short arm and 5'-terminus of this base sequence : 61470824
  Distance between 3'-terminus of neighbour sequence of sequence listing upward to telomere on chrosomal short arm and 5'-terminus of this base sequence : 87069
caatgaactgaacctcctagcaaaaaaaaaaaaaaaaaaaaaaaaaaaaaatcaacaagaagaagacagggagagtgtgggcatgagtgagtgagagagagagagagtgagagtgttgtgtgtgtgtgtgtgtgtgtgtgtgtctcagccataacagcaaacaa

SEQ ID NO: 16271 - DNA, 421 bp, Homo sapiens
  chr10.fa.O7frz.64069961
  Located on chromosome 10
  Distance between a terminus base of telomere on chromosomal short arm and 5'-terminus of this base sequence : 61762490
  Distance between 3'-terminus of neighbour sequence of sequence listing upward to telomere on chrosomal short arm and 5'-terminus of this base sequence : 291502
ctccatagtcctaactctaggaagggtttacaatctgctcattccttcactctaatagttatgactcaacttccttaacaaatggtcaaagtccaagtccagttgattctcttttggacgtggctcaccctcctgtcacccgggtgttcaggccctgttttagtttgcctaattgctaagaccacctcccaaccaactcacctctctcactccagtccatccaggttgtgtgtgtgtgtgtgtgtgtgtgtgtgtgtgtgtgtgtgtgtgtgtgtatgtatgtgtgtttcaaagccaaattttatgcataattctggtgggcttcattggaataaatgattaaaaatttttatggcataataagtgtttgagattagcaagagtattttggaaaagtaggtttgtgacggagaatttatct

SEQ ID NO: 16272 - DNA, 455 bp, Homo sapiens
  chr10.fa.O7frz.64406895
  Located on chromosome 10
  Distance between a terminus base of telomere on chromosomal short arm and 5'-terminus of this base sequence : 62063903
  Distance between 3'-terminus of neighbour sequence of sequence listing upward to telomere on chrosomal short arm and 5'-terminus of this base sequence : 300992
agtattcacagtaagcgctttagcaagaaactgctgaaatgtcaggctgggcctaaaacatatgagacctagtaaaaaaaagaacacacacacacacacacacacacacacacacacacaaacaacaatttcaccaagaaaatgagtcagaaaaaaaaaaaagatgttctgatgaaaatactttgttagcatgtgtgcttccgatacaaaagtccataactttggcggtcggtgcatttgactttgtagggctgaaagtgtaggtgtgtaaaggacacagcaccaagtccaatgcatcatgtgaggatttggttggggttctctggagctgttgtttgtctgcttcacaaagagtgccaagtgtgagttcctgcaaacaacttttactcaccatacttctagatttggggttcaaaggtctttcctcttttcctcttgtaggacgctttatagtc

SEQ ID NO: 16273 - DNA, 106 bp, Homo sapiens
  D10S1794
  Located on chromosome 10
  Distance between a terminus base of telomere on chromosomal short arm and 5'-terminus of this base sequence : 62222345
  Distance between 3'-terminus of neighbour sequence of sequence listing upward to telomere on chrosomal short arm and 5'-terminus of this base sequence : 157987
caaggtaatcaataattgctacacaaatgagtgagagaagggcatgtttcatacacacacacacacacacacacacacacacacacataccatcatgttgaccagg

SEQ ID NO: 16274 - DNA, 235 bp, Homo sapiens
  AC022390.3_69437
  Located on chromosome 10
  Distance between a terminus base of telomere on chromosomal short arm and 5'-terminus of this base sequence : 62372046
  Distance between 3'-terminus of neighbour sequence of sequence listing upward to telomere on chrosomal short arm and 5'-terminus of this base sequence : 149595
ctaatgctagatgacgagctagtgggtgcagtgcaccagcatggcacatgtatacatatgtaactaacgtgcacattgtgcacatgtaccctaaaacttaaagtataataataataataataataataaagaaaaataaataaataaataaaacagactttggagtgaattaaagacattcacagtgacctggatgagattggagactataattctaagtgaagtaactcaggaa

SEQ ID NO: 16275 - DNA, 123 bp, Homo sapiens
  DISO7_10002873
  Located on chromosome 10
  Distance between a terminus base of telomere on chromosomal short arm and 5'-terminus of this base sequence : 62572211
  Distance between 3'-terminus of neighbour sequence of sequence listing upward to telomere on chrosomal short arm and 5'-terminus of this base sequence : 199930
cctgatgtcaatttctgtgctttgcctaataaaagtcctaccagcttttttcagagagtcaatcagggaactctctctctctctctctctctctctctctctctcgctgcttcccttatgtcc

SEQ ID NO: 16276 - DNA, 420 bp, Homo sapiens
  chr10.fa.O7frz.61211169
  Located on chromosome 10
  Distance between a terminus base of telomere on chromosomal short arm and 5'-terminus of this base sequence : 62645222
  Distance between 3'-terminus of neighbour sequence of sequence listing upward to telomere on chrosomal short arm and 5'-terminus of this base sequence : 72888
acaagccttacaatgtacattaagaggtaaaaatagttctaataggtgaaaattaaatagatagatattaaatagatagattagattgatagatagatagatagtacataggtagatacatagtagatagatagcaaataggtgataaacagatacattgattgatagagagacagacagatagatagatagatagatagatagatagatagatagatagatagatagtacataggtagatacatagtagatagcaaataggtgattgattggtagagagacagataaacagatacatagatatggatggatagatagatagatagatagatagatagatagatagattcatacaacataaagtgtgttttcttgcagccaaaggtagatgggtcagattaaataagcaccaatagtgaa

SEQ ID NO: 16277 - DNA, 120 bp, Homo sapiens
  DID22N_0003948
  Located on chromosome 10
  Distance between a terminus base of telomere on chromosomal short arm and 5'-terminus of this base sequence : 62712476
  Distance between 3'-terminus of neighbour sequence of sequence listing upward to telomere on chrosomal short arm and 5'-terminus of this base sequence : 66834
cctgatatcccaatatgcagtttatttaaaaagaaacaagacatacacacacacaaacacgtatacacacacacacacacacacaatgttatttagcttacttagcaaattagaactgaa

SEQ ID NO: 16278 - DNA, 447 bp, Homo sapiens
  chr10.fa.O7frz.65012843
  Located on chromosome 10
  Distance between a terminus base of telomere on chromosomal short arm and 5'-terminus of this base sequence : 63055144
  Distance between 3'-terminus of neighbour sequence of sequence listing upward to telomere on chrosomal short arm and 5'-terminus of this base sequence : 342548
cagttctgaattaataggtttgagattgcacccacacaactgcattttgacaaatatctttggtgatttctcaatcaaatggtccgaagatctcattttgagatccaatcacaattttgatatctttttaatttccccagattcttcctaagaggatatttttaaaaaagatatttcgggaggaactcagtgtgtttgaatccagctaatagcagagatgattaaaattgtttgctaggtatgatgacatttgtttcattgtagcaaaagctgtgtgtgtgtgtgtgtgtgtgtgtgtgtgtgtgtgtgtgtacataaccatgctgtggctactagacttgatattggctcaaatcaagcatgttcaaaaatgtttctattggaccacaaaaataaattgataagtagtaataagagttgagtgttaagtttcatgaggaaatagtg

SEQ ID NO: 16279 - DNA, 230 bp, Homo sapiens
  DISD22_0009559
  Located on chromosome 10
  Distance between a terminus base of telomere on chromosomal short arm and 5'-terminus of this base sequence : 63267203
  Distance between 3'-terminus of neighbour sequence of sequence listing upward to telomere on chrosomal short arm and 5'-terminus of this base sequence : 211612
ttccacctaattccagcccctcacccctctaggtaattgattcagttatttatttattctccttgtgtgtgtatgtctgtatatatgtattttttctttttgtttacacaaaagagctctctctctctctttctctctctctctctctctctctctctatatatatatatatatatattcctttgaatatttcttttttttaataacataagctggaaatcactccattc

SEQ ID NO: 16280 - DNA, 126 bp, Homo sapiens
  DISO7_10002870
  Located on chromosome 10
  Distance between a terminus base of telomere on chromosomal short arm and 5'-terminus of this base sequence : 63367245
  Distance between 3'-terminus of neighbour sequence of sequence listing upward to telomere on chrosomal short arm and 5'-terminus of this base sequence : 99812
tcacaagctcaatgccacaaaagccagtcatttaataaaggtgtgaagacaacagtgtgtgtgtgtgtgtgtgtgtgtgtgtgtgtgtgtgtgaggcatgaattttacagatgtttgagtgcacgt

SEQ ID NO: 16281 - DNA, 193 bp, Homo sapiens
  D10S1659
  Located on chromosome 10
  Distance between a terminus base of telomere on chromosomal short arm and 5'-terminus of this base sequence : 63367249
  Distance between 3'-terminus of neighbour sequence of sequence listing upward to telomere on chrosomal short arm and 5'-terminus of this base sequence : -122
aagctcaatgccacaaaagccagtcatttaataaaggtgtgaagacaacagtgtgtgtgtgtgtgtgtgtgtgtgtgtgtgtgtgtgtgaggcatgaattttacagatgtttgagtgcacgtgtgcatgtgcttttgaagcagggatttatttctcaggtactaccaattgttgctagaactaattgcaggct

SEQ ID NO: 16282 - DNA, 190 bp, Homo sapiens
  Z67066
  Located on chromosome 10
  Distance between a terminus base of telomere on chromosomal short arm and 5'-terminus of this base sequence : 63455771
  Distance between 3'-terminus of neighbour sequence of sequence listing upward to telomere on chrosomal short arm and 5'-terminus of this base sequence : 88329
ccacagtttgttttccgagattaaacaacaacaacaacaacaacgacaacaacaccagatacctctttaatattggaattgaaaacccaagttacaattttgttcatgtaaaggtagtgtgtgtgtgtgtgtgtgtgtgtgcgatttatgtgtatttgaatgcttatgtgttagcatatcatcttttgaa

SEQ ID NO: 16283 - DNA, 380 bp, Homo sapiens
  HUMUT1466
  Located on chromosome 10
  Distance between a terminus base of telomere on chromosomal short arm and 5'-terminus of this base sequence : 63541876
  Distance between 3'-terminus of neighbour sequence of sequence listing upward to telomere on chrosomal short arm and 5'-terminus of this base sequence : 85915
gtggatgttgcagtgaaccaaggcaacagagtgagacccccatctaagaaagagagagagagagatgaaagaaagaaagaaagaaagatggaaggaaggaaggaaggaaggaaggaaccaaggcaaggaaggaaggaaggaaggaaggaaagaaagaaagaaagaaagaaagaaagaaagaaagaaagaaagaaagaaagaaagacagaaagaaagaaagagaaagaaagatggaaggaaggaaggaaggatggaaggaaaaagaaaataaattttataaatgttgtaagtgctgtggtaaagatacgttaatagcacacaaagaagcataatttaatttagctctgaatttcagagggaaccttctggaggagatagca

SEQ ID NO: 16284 - DNA, 416 bp, Homo sapiens
  chr10.fa.O7frz.60635353
  Located on chromosome 10
  Distance between a terminus base of telomere on chromosomal short arm and 5'-terminus of this base sequence : 63632128
  Distance between 3'-terminus of neighbour sequence of sequence listing upward to telomere on chrosomal short arm and 5'-terminus of this base sequence : 89872
gtggtcattctgaagttaatgtatctttttggagcagaaaatagttttatcccaacaatatgcaaagttatgctttacccagcacattaaaattctattactatttttaaatttcaaaaatgtttatttatcctttaatctttccttatgagccaaataaactgatcttaaatatgattatctatataatcacatacaatcattatatatatatatatgtatatgtatatatatgctgtacccctggtttggtatttactctcatgacttgagtccattattagcacacctgttaacatgcatttgtaatctcattaattattatatatttctaacaaatgtttacctctgtagtctgtatttaaataactaattgtgtgctctggaccactgttaacaggctcacatctagttaa

SEQ ID NO: 16285 - DNA, 272 bp, Homo sapiens
  D10S596
  Located on chromosome 10
  Distance between a terminus base of telomere on chromosomal short arm and 5'-terminus of this base sequence : 63803177
  Distance between 3'-terminus of neighbour sequence of sequence listing upward to telomere on chrosomal short arm and 5'-terminus of this base sequence : 170633
tctgtaacatggttttcagagttatttttaaataactgtcctgtaactcttacattcagataaatttgaatgcatttcaatgtgtttttattatttgtttctatctctctctttctctctctctctctgtgtgtgtgtgtgtgtgtgtgtgtgtgtgtgtgtttggggagaggctgtgtgtgtatgtttgtatgtgtaatattacatcagagaggaattaatttttttatcaggaaataatgtattcagagacctgcttaactcatttgaat

SEQ ID NO: 16286 - DNA, 353 bp, Homo sapiens
  chr10.fa.O7frz.59209649
  Located on chromosome 10
  Distance between a terminus base of telomere on chromosomal short arm and 5'-terminus of this base sequence : 63804057
  Distance between 3'-terminus of neighbour sequence of sequence listing upward to telomere on chrosomal short arm and 5'-terminus of this base sequence : 608
ataagagataaacctcagttggagcatatatatataaatatatatatataccgacacacacacacacacacacacacacacacacacacacacacacacacatatatatacttttgagacagggttttattcagttgttcaggctggagtgcagtggcatgatcatggcttactgcaggcttggccccctaggtttaagggatcctcccacctcagcctcctattttttttattttaatttttttttttgtagggacagagtcttactatgttgcccaggctggtcttgaactcctgggctcaagcaatcttcttgcttcagccttccaaagtgctcagactatagtcgtgag

SEQ ID NO: 16287 - DNA, 302 bp, Homo sapiens
  chr10.fa.O7frz.59339699
  Located on chromosome 10
  Distance between a terminus base of telomere on chromosomal short arm and 5'-terminus of this base sequence : 63842203
  Distance between 3'-terminus of neighbour sequence of sequence listing upward to telomere on chrosomal short arm and 5'-terminus of this base sequence : 37793
tagtgatggaattggataatttaggtgaagatatttctaagcaaagtggtgaaagaacagtttgatttcttccgattgcttataatagcatgcaaaaagagagaattgaattggagatatatatatatatgtatatatatattatatatatatgaagtaaaaatgaacttaaggattcataaaattttcggcatgttcatattacaaaaaatgagatagtatgtttggaacagaacactaagggtgtggaaaactaacctactgaaagattagtgtgggtgtgaaccatagaataaattagc

SEQ ID NO: 16288 - DNA, 440 bp, Homo sapiens
  chr10.fa.O7frz.59421584
  Located on chromosome 10
  Distance between a terminus base of telomere on chromosomal short arm and 5'-terminus of this base sequence : 63919232
  Distance between 3'-terminus of neighbour sequence of sequence listing upward to telomere on chrosomal short arm and 5'-terminus of this base sequence : 76727
gtatgttagcataagcaaggttacatttggttgtggttagaaatgtgattaatgtaactggagaaaataaagaatccttaggaaagtaccccattgcctttcaaatggcaatttccagaagtttttcagttctggttctggttatgtcagtaacagtgggcaaattagattactgttctggacctaggtgtgtccacaagcataaaatttaaagtgatgattaacaggattaaggggatttatataattataaattatagaattgagtgtatgtgtgtgtgtgtgtgtgtgtgtgtgtgtttgcatgaatatactcagtcatgtatgtaagttaagggttatattgtaaaagatatcttagaattttaatcattgaacttctgtgactgcagttgaacaaaactgtaaatgatagagtttaactggcaagttactcatac

SEQ ID NO: 16289 - DNA, 170 bp, Homo sapiens
  D10S1764
  Located on chromosome 10
  Distance between a terminus base of telomere on chromosomal short arm and 5'-terminus of this base sequence : 64009557
  Distance between 3'-terminus of neighbour sequence of sequence listing upward to telomere on chrosomal short arm and 5'-terminus of this base sequence : 89885
aagaatgcaaaaactaatgaatctacttgtaattctttatcattaacatgtgctcttttctaacttatcccataagaatctcgcgtgtgtgtgtgtgtgtgtgtgtgtgtgtgtgtgtgggtgtgggtgtgtgtgtgcatctgaatgtcagagacattcattattcaatt

SEQ ID NO: 16290 - DNA, 252 bp, Homo sapiens
  D10S1788
  Located on chromosome 10
  Distance between a terminus base of telomere on chromosomal short arm and 5'-terminus of this base sequence : 64117881
  Distance between 3'-terminus of neighbour sequence of sequence listing upward to telomere on chrosomal short arm and 5'-terminus of this base sequence : 108154
atcaaatcaatggtcaaaactaagtatttcctcccaaaatgtgtgcgtgtgtgtgtgtgtgtgtgtgtgtgtgtgtgtgtgtgtgtgtgttttgaaagacaagggtcagcatggtaaaatagccatcaaaccaatgtggctgttgctttttttgaagaatagaaagcattttggaaaaaaaaatagatgtcaattaaagatattaggttgtgtcatttcttatttattatttgccacttttgttacctgtca

SEQ ID NO: 16291 - DNA, 471 bp, Homo sapiens
  chr10.fa.O7frz.59886146
  Located on chromosome 10
  Distance between a terminus base of telomere on chromosomal short arm and 5'-terminus of this base sequence : 64355465
  Distance between 3'-terminus of neighbour sequence of sequence listing upward to telomere on chrosomal short arm and 5'-terminus of this base sequence : 237332
atactctggcataattatgtcaacactatcatgataacaatatgttatttaattatatatataattatatataacaatttatatatatatctaaatcattcatatatatatatatatatatatatatatatatatatatatatataaaatatacagaaaaagagatattccaggactctgtaattttctccttttgtaccatttggcttacaaaaacttaataaaatatttattgaatccacaacataattgatgtatacattaattcatatacaaataattgtctaataattaaaagcaaactgtctcctaacagcacatctctgttagttatatactgctgttttcaaaagttccacagaacttagagctgtaaaacaaacatttactttctcatagtttctttggatcaggcatctggaaatgtatggatcttcttccttaggatttctcacatgcttaaattgaggt

SEQ ID NO: 16292 - DNA, 330 bp, Homo sapiens
  chr10.fa.O7frz.59966448
  Located on chromosome 10
  Distance between a terminus base of telomere on chromosomal short arm and 5'-terminus of this base sequence : 64406076
  Distance between 3'-terminus of neighbour sequence of sequence listing upward to telomere on chrosomal short arm and 5'-terminus of this base sequence : 50140
ttcatgatttgcaccaataaaaatcctacctaaaccagattggccaagtgtttttaaaattaagcttgagacaagcatgagatgaatttgagggtcagactggatctaacaggggcccaggatctgtctccacctcctcggcttttgagatcatagaaacaattacaaattcctaaaggagacaagcttgcttgtacatacacacacacacacacacacacacacaaaaacacacacacacacagtaatgcctaaacttcctttacaaaaagaaaagtatttcacccaatcagagattagtcaagatattaatgaagttaacgtcttgtg

SEQ ID NO: 16293 - DNA, 261 bp, Homo sapiens
  D10S1767
  Located on chromosome 10
  Distance between a terminus base of telomere on chromosomal short arm and 5'-terminus of this base sequence : 64447974
  Distance between 3'-terminus of neighbour sequence of sequence listing upward to telomere on chrosomal short arm and 5'-terminus of this base sequence : 41568
tgaccaaagtatgtctatgacttatgaaatgtttggtatagtgaaatgttggcagaagatgctgatggaatgataatttaatatattttattctcatttggacaaaataaatatgtgtgtgtgtgtgtgtgtgtgtgtgtgtgtgtgtgtgtgtgtatgaactcaacaaaccacctttctctgtctctcttttcttcccttctccaccttgatacctttctctgagtttatattgtagagaaaatgctgaaacctctgaaa

SEQ ID NO: 16294 - DNA, 252 bp, Homo sapiens
  G09153
  Located on chromosome 10
  Distance between a terminus base of telomere on chromosomal short arm and 5'-terminus of this base sequence : 64497095
  Distance between 3'-terminus of neighbour sequence of sequence listing upward to telomere on chrosomal short arm and 5'-terminus of this base sequence : 48860
acaagtgaggattacagatgaggatcccatatatcataaaaggttcaaaatatcaaacagaactactttcttaaaagaatttgagagataggcaagtttcaatatattttcaaattttcactcttcttttacacaaaagttgctaataagcccagattttcattttctcttaatttttgatccatttatcttttatctatctatctatctatctatctatctatctatgcaatacaacaggagaaataaaaa

SEQ ID NO: 16295 - DNA, 428 bp, Homo sapiens
  chr10.fa.O7frz.60236898
  Located on chromosome 10
  Distance between a terminus base of telomere on chromosomal short arm and 5'-terminus of this base sequence : 64604306
  Distance between 3'-terminus of neighbour sequence of sequence listing upward to telomere on chrosomal short arm and 5'-terminus of this base sequence : 106959
ctggtctatgttaagtgacagtttaaaaaacttttgtttttattattatttatttttaagcaagtcttttgtttatctttttccgtgaattttaattaagctgtctttggtcatttcaccttggacgtgctgttaagacatcacattcatcatttggctttttttaggagcactacagtcccaaattttcaaatgcatatgtttttcacagttttttttcttttttttgtgtgacaaatagcaaacatgtttcctttagattcggaatagaagacccacctgaaattccacacacacacacacacacacacacacacacacacaatttctagaaacaacaattaaataacaattagttaaaacaattagttaaatgtccattaaataaccattaagaatatatgtaggtgagcttatgataacagtaa

SEQ ID NO: 16296 - DNA, 469 bp, Homo sapiens
  chr10.fa.O7frz.60351213
  Located on chromosome 10
  Distance between a terminus base of telomere on chromosomal short arm and 5'-terminus of this base sequence : 64714082
  Distance between 3'-terminus of neighbour sequence of sequence listing upward to telomere on chrosomal short arm and 5'-terminus of this base sequence : 109348
atttaatgtgctcaccatacacacacacacacacacacacacacacacacaaagataaattggtgaggtgatagatatgttaagtagcttgatttaacctttttataacatatacatatatcaaaacattacattgcaacccatcaatatatacaattacctgtcaattaaaaataaattaaaatacacacacacacacacacacacacacacacacgcacacagagcataccattcctggaaatgtttaggagaaacaagggatcatgtgtctcattcccttgtgttacaattaactcttttattctttcattgaagataataaccatgactcctagagagttatgagtatcatcatttggattttaatgctgaagttagacctttagtgtcatcattaatgactatgcattcagtattttaatactattgaggaaaataattagttacagctgaattaagcagatac

SEQ ID NO: 16297 - DNA, 363 bp, Homo sapiens
  chr10.fa.O7frz.135585308
  Located on chromosome 10
  Distance between a terminus base of telomere on chromosomal short arm and 5'-terminus of this base sequence : 64981369
  Distance between 3'-terminus of neighbour sequence of sequence listing upward to telomere on chrosomal short arm and 5'-terminus of this base sequence : 266818
ttgaagtctgcttaatgacaaggaaaagttctcacacagtttaaaaaaaaatactgtgtcaatgtgtgtttgacagagacagagaaggggtgtgtgtgtgtgtgtgtgtgtgtgtgtgtgtgtgtgtgtgtgttgcgggaggggacagggaacctgaaaaatataataagactttcggttttgttttttaataatgagataatgggtaattttattttagtcttagtactttgtataattttccaattctctgcaataagcaagtatttttataatcagaaaaaaatgttctttttttaaaaaagcaaagtacatttgaaataaagcatttaaaggaaagtatttgaggataaagtatggatg

SEQ ID NO: 16298 - DNA, 117 bp, Homo sapiens
  DISD22_0009563
  Located on chromosome 10
  Distance between a terminus base of telomere on chromosomal short arm and 5'-terminus of this base sequence : 65112324
  Distance between 3'-terminus of neighbour sequence of sequence listing upward to telomere on chrosomal short arm and 5'-terminus of this base sequence : 130592
tccaccaataatgaggatttcctgtgtgtgtgtgtgtgtgtgtgtgtgtgtgtgtgtgtgtgtactatgggcaaacagcaaacaaaagtaatcccccaagattgattacctcttcag

SEQ ID NO: 16299 - DNA, 171 bp, Homo sapiens
  DISO7_10002885
  Located on chromosome 10
  Distance between a terminus base of telomere on chromosomal short arm and 5'-terminus of this base sequence : 65409375
  Distance between 3'-terminus of neighbour sequence of sequence listing upward to telomere on chrosomal short arm and 5'-terminus of this base sequence : 296934
actaaaccatcaactggaagtgaaaaaaatatagtcattgaaattaaaacacacacacacacacacacacacacacacacactaggtgaaacaactttatagatggaacaactctacagaaaaagaattcatgaattggaaaattatagtggggaattcacatagaatgca

SEQ ID NO: 16300 - DNA, 378 bp, Homo sapiens
  chr10.fa.O7frz.66175720
  Located on chromosome 10
  Distance between a terminus base of telomere on chromosomal short arm and 5'-terminus of this base sequence : 65440104
  Distance between 3'-terminus of neighbour sequence of sequence listing upward to telomere on chrosomal short arm and 5'-terminus of this base sequence : 30558
atttaagttggattgaaggtagtctttttgtctccccaaccctgacccatcccttcctttcctccctcccatccttcctccctctcatctttccttccttctttccctctttccttccttccttcctccctccctccctcccttccttctttccttccttccttctttcctttctttcttcccttcttccttccttcctttcttcctttgttgtttcacatttattgatttctcactctgctccagatcctttgtggggtttagggttaattttagtgaaaaatacctaatatcttctcctatggattatacaacatatttcaaaaggaagaaaactaaacaggtaattgcaatttaaagtaagtgctccgaaaggat

SEQ ID NO: 16301 - DNA, 131 bp, Homo sapiens
  DISO7_10002884
  Located on chromosome 10
  Distance between a terminus base of telomere on chromosomal short arm and 5'-terminus of this base sequence : 65544915
  Distance between 3'-terminus of neighbour sequence of sequence listing upward to telomere on chrosomal short arm and 5'-terminus of this base sequence : 104433
tcctattcaggcattacttgtatacataaatgtgtgtgtgtgtgtgtgtgtgtgtgtgtaatacaatgcatgaaaaaacataatatactacaggattgtatatctattccccagaggaatcattcacaatt

SEQ ID NO: 16302 - DNA, 131 bp, Homo sapiens
  DISO7_10002882
  Located on chromosome 10
  Distance between a terminus base of telomere on chromosomal short arm and 5'-terminus of this base sequence : 65671726
  Distance between 3'-terminus of neighbour sequence of sequence listing upward to telomere on chrosomal short arm and 5'-terminus of this base sequence : 126680
ggctgtgttcaacttacagtgagcactatgtatatgtatatgtatatgtatatgtatatgtatatgtatatgtatatgtatatgtatatgtatgtatatgtatatgtatagtaagcattatgggtacagca

SEQ ID NO: 16303 - DNA, 136 bp, Homo sapiens
  DISO7_10002881
  Located on chromosome 10
  Distance between a terminus base of telomere on chromosomal short arm and 5'-terminus of this base sequence : 65711674
  Distance between 3'-terminus of neighbour sequence of sequence listing upward to telomere on chrosomal short arm and 5'-terminus of this base sequence : 39817
gtgaatacattctgtctgtgtttcttctctctctctctcttgtctctctctctctctctctctctctctctctctctctctctctctctctctcactcaccctccctctcgtgtgtgttgtttccgttcacatgtt

SEQ ID NO: 16304 - DNA, 114 bp, Homo sapiens
  DISO7_10002880
  Located on chromosome 10
  Distance between a terminus base of telomere on chromosomal short arm and 5'-terminus of this base sequence : 65716963
  Distance between 3'-terminus of neighbour sequence of sequence listing upward to telomere on chrosomal short arm and 5'-terminus of this base sequence : 5153
tcacgtttcttcatgcttgggctgtgtgggctgtgtgggctgtgtgggctctgtgtgtgtgtgtgtgtgtgtgtgtgtgtgtgtattggagagagaatgtcttccctccttatg

SEQ ID NO: 16305 - DNA, 111 bp, Homo sapiens
  DISO7_10002879
  Located on chromosome 10
  Distance between a terminus base of telomere on chromosomal short arm and 5'-terminus of this base sequence : 65718676
  Distance between 3'-terminus of neighbour sequence of sequence listing upward to telomere on chrosomal short arm and 5'-terminus of this base sequence : 1599
gacagcatctatgcatctataaatgtagatataggagcattttgttaggagaaaatggggtcctgctatatatatatatatatatatatatacttctctgcagcatgcttt

SEQ ID NO: 16306 - DNA, 108 bp, Homo sapiens
  DISO7_10002877
  Located on chromosome 10
  Distance between a terminus base of telomere on chromosomal short arm and 5'-terminus of this base sequence : 65767123
  Distance between 3'-terminus of neighbour sequence of sequence listing upward to telomere on chrosomal short arm and 5'-terminus of this base sequence : 48336
agtcacagagcttagaatgagcttatatctatatctatatctatatctatatctatatctatatctatatctatctatatctatctatctatctgcttaatctcccag

SEQ ID NO: 16307 - DNA, 224 bp, Homo sapiens
  D10S1640
  Located on chromosome 10
  Distance between a terminus base of telomere on chromosomal short arm and 5'-terminus of this base sequence : 65790965
  Distance between 3'-terminus of neighbour sequence of sequence listing upward to telomere on chrosomal short arm and 5'-terminus of this base sequence : 23734
gctcccagagcactgactttggactaagaagaatttagatgggagatgcaacctactttcccttatttcaagatttgcatgcctggtacatacagtatcatataaatgtacaaaggcttgtgaggagacacacacacacacacacacacacacacacacacacacacactctaaacagcaggagcaccaaagaggtagatcatccattattcaaggaatttttt

SEQ ID NO: 16308 - DNA, 153 bp, Homo sapiens
  DISO7_10002878
  Located on chromosome 10
  Distance between a terminus base of telomere on chromosomal short arm and 5'-terminus of this base sequence : 65798082
  Distance between 3'-terminus of neighbour sequence of sequence listing upward to telomere on chrosomal short arm and 5'-terminus of this base sequence : 6893
agacttgacatgctgaattaatgtttgtgtgtgtgagtgtgtgtgtgtgtgtgtgtgtgtgtgtgtgtgtgtgtgtgtagagatataaatatagagataatgatagagacatcattataatagcttctttagggagctcttagagttaactgg

SEQ ID NO: 16309 - DNA, 121 bp, Homo sapiens
  DISO7_10002875
  Located on chromosome 10
  Distance between a terminus base of telomere on chromosomal short arm and 5'-terminus of this base sequence : 65885431
  Distance between 3'-terminus of neighbour sequence of sequence listing upward to telomere on chrosomal short arm and 5'-terminus of this base sequence : 87196
atcgaaggccagaaagagatttctgatgccttcaaagcacgcacatgcactcgcgtgcacacacatgcacttgcgtgcacacacacacacacacacacaccccatgtcaggagctcacatg

SEQ ID NO: 16310 - DNA, 321 bp, Homo sapiens
  chr10.fa.O7frz.65605811
  Located on chromosome 10
  Distance between a terminus base of telomere on chromosomal short arm and 5'-terminus of this base sequence : 65919074
  Distance between 3'-terminus of neighbour sequence of sequence listing upward to telomere on chrosomal short arm and 5'-terminus of this base sequence : 33522
tgaaattcttaggaactattgaacaaggggtcttgcattttcattttgctttgaatcctgaaaactttgtaaccatctctgggtaggggtgtgtgtgtgtgtgtgtgtgtgtgtgtgtgtgtgtgtgtgtgtgtgttcatccagggggtggattgctaatgagtgatgagcagagaaggaatagctcaatttcaaacctgtgagtagaggatagagaagtagctgattcccgttacttgcagtagttagcttctacaaagttgccacacacactgagttagggaatactgagccatggctcctagtggaaatactaggctc

SEQ ID NO: 16311 - DNA, 224 bp, Homo sapiens
  DISO7_10002887
  Located on chromosome 10
  Distance between a terminus base of telomere on chromosomal short arm and 5'-terminus of this base sequence : 66203796
  Distance between 3'-terminus of neighbour sequence of sequence listing upward to telomere on chrosomal short arm and 5'-terminus of this base sequence : 284401
tgctagtatgtgtatttgtgtatgcgtgtgtgtgtctgtgtgtgtatagaaaaaatggtagagtagatgaagtgaatatatatagcaagctattaactggacaacctagggggagaatatacatgatgttgattgtactattcttgtaatttttacgtatgtaaatttcataataaaaagttgattaaaaagcaaacatagttaggaataaatgacaatctgga

SEQ ID NO: 16312 - DNA, 106 bp, Homo sapiens
  DISO7_10002889
  Located on chromosome 10
  Distance between a terminus base of telomere on chromosomal short arm and 5'-terminus of this base sequence : 66405573
  Distance between 3'-terminus of neighbour sequence of sequence listing upward to telomere on chrosomal short arm and 5'-terminus of this base sequence : 201553
agcatccagtccaccatcttgaacacacacacacacacacacacacacacacatatatatataatattgtgtgggtatataaatgtgtgtgtatgtgggtgcatgc

SEQ ID NO: 16313 - DNA, 216 bp, Homo sapiens
  DISO7_10002890
  Located on chromosome 10
  Distance between a terminus base of telomere on chromosomal short arm and 5'-terminus of this base sequence : 66438667
  Distance between 3'-terminus of neighbour sequence of sequence listing upward to telomere on chrosomal short arm and 5'-terminus of this base sequence : 32988
cctgcattggagtggtaactatatatatatatatatatatatgtatgggtatttattgcagtattttgttgttgttgttgttgtttgtttttgttttttaatcctgcttcttttgtatgcagaactattttgaatagcaagagattaaaaactaatcacctatagaaaagggcctggttgagtaatatatattacaacatgcaagtaagcattaca

SEQ ID NO: 16314 - DNA, 432 bp, Homo sapiens
  chr10.fa.O7frz.66697520
  Located on chromosome 10
  Distance between a terminus base of telomere on chromosomal short arm and 5'-terminus of this base sequence : 66496298
  Distance between 3'-terminus of neighbour sequence of sequence listing upward to telomere on chrosomal short arm and 5'-terminus of this base sequence : 57415
gacttaatcctcatagccagtccaagggtaggtgttgttatcatgttttcccagataaagtgaaatctgggaaggttacccatttgactcaaaatcacaaagagatagcgtggggattctaaggagaacttatcaattgcacaatctcctatctgcattcattttgaagataattattcttccactatagcagattgtctatgagtagacaattaagaatgcatatatatatatgtatatatatataatgtataaatacacacattgccttcttttgactgcagtgtctaagaaatggggttaggaggaattgtgacagattggattttctaattacctgagggttaatagtcctctgaaaactttgttgcaactatttctgaaaggaatctactctgtccattggcttagcagaatacagtgactaagaca

SEQ ID NO: 16315 - DNA, 248 bp, Homo sapiens
  D10S1719
  Located on chromosome 10
  Distance between a terminus base of telomere on chromosomal short arm and 5'-terminus of this base sequence : 66718181
  Distance between 3'-terminus of neighbour sequence of sequence listing upward to telomere on chrosomal short arm and 5'-terminus of this base sequence : 221451
tgctgtccagtattgtagccatgagtcatatgcagctatttaaattcaattagaattaaataaaattttaaaactcagctcctcagtcacacacacacacacacacacacacacaaacacacacttgaagtgttcaatagccacatgtagaacagtgcaaatatagagtagttccatcattgcagaaagttctattggaaggtgttgctctagaacccaaggctaattcttggacacagtgaaactga

SEQ ID NO: 16316 - DNA, 241 bp, Homo sapiens
  AL133417.10_55990
  Located on chromosome 10
  Distance between a terminus base of telomere on chromosomal short arm and 5'-terminus of this base sequence : 66718186
  Distance between 3'-terminus of neighbour sequence of sequence listing upward to telomere on chrosomal short arm and 5'-terminus of this base sequence : -243
tccagtattgtagccatgagtcatatgcagctatttaaattcaattagaattaaataaaattttaaaactcagctcctcagtcacacacacacacacacacacacacacaaacacacacttgaagtgttcaatagccacatgtagaacagtgcaaatatagagtagttccatcattgcagaaagttctattggaaggtgttgctctagaacccaaggctaattcttggacacagtgaaact

SEQ ID NO: 16317 - DNA, 327 bp, Homo sapiens
  AL133417.10_69621
  Located on chromosome 10
  Distance between a terminus base of telomere on chromosomal short arm and 5'-terminus of this base sequence : 66731781
  Distance between 3'-terminus of neighbour sequence of sequence listing upward to telomere on chrosomal short arm and 5'-terminus of this base sequence : 13354
ttaacagcaaatggcattagtcacctcccccctgggatgctgacaatttgcttccttgttacacagtttaaaaggaatacctcccatcttgttttttcccccaaaatccaaagactaaacacacacacacacacacacacacacacacacacacacacacacacacacaggttgagtatcccttatccaaaatgcttgggaccagaacagttttggatttcagatttttttttttgttgagcactcctaattcaaaaaaagaaccaccaaaatctgaaatggtccaatgagcatttcctttgagcatcatgtcaacactcagtttca

SEQ ID NO: 16318 - DNA, 271 bp, Homo sapiens
  AL133417.10_70618
  Located on chromosome 10
  Distance between a terminus base of telomere on chromosomal short arm and 5'-terminus of this base sequence : 66732867
  Distance between 3'-terminus of neighbour sequence of sequence listing upward to telomere on chrosomal short arm and 5'-terminus of this base sequence : 759
gaagtaagagtggaaactggacccaaggtgaggaggaggaggaggaggaggaggaagggcaggcacttatatttgcacagcatctcaaagagtaaaataaactcttcctttgatctcatttgaccctgaaaacaacctatgcagtaagtgaggcagacattatcatcacccttatctaatagttaatgaaactgatgctcagaaagattgtgtcccatgcaagttcccatagctaataagtgaaaagctaggacaactacaaatccagata

SEQ ID NO: 16319 - DNA, 164 bp, Homo sapiens
  AL133417.10_71553
  Located on chromosome 10
  Distance between a terminus base of telomere on chromosomal short arm and 5'-terminus of this base sequence : 66733787
  Distance between 3'-terminus of neighbour sequence of sequence listing upward to telomere on chrosomal short arm and 5'-terminus of this base sequence : 649
aatcttaatgattggttcaggagaggtccaagatggcgagtctgtctctctctctctctctctctctctgtctctctctttctctctctctcacacacacacactgtcacacacacagagacagacattttgctttgctttgtatcacatcaaattgttcttgg

SEQ ID NO: 16320 - DNA, 312 bp, Homo sapiens
  AL133417.10_82743
  Located on chromosome 10
  Distance between a terminus base of telomere on chromosomal short arm and 5'-terminus of this base sequence : 66744963
  Distance between 3'-terminus of neighbour sequence of sequence listing upward to telomere on chrosomal short arm and 5'-terminus of this base sequence : 11012
ggctcaagttctaaatgaattcacaattttatttattcatttatttatttatttgttgttattattattattattattattattattttgagatggtatctcgctctgttgcccaggttggagtgcagtggcgcagtctcggctcattgccaagattacccaggaacttgctaaaaatgctgagttctgggcctatcccctgagaatgattttgcaggctgggatggagccccagcaactgctttcttaacccccgtcctccaccctgatcaagcaagactgaaatctatggtttctggaccatacatttga

SEQ ID NO: 16321 - DNA, 449 bp, Homo sapiens
  chr10.fa.O7frz.67054427
  Located on chromosome 10
  Distance between a terminus base of telomere on chromosomal short arm and 5'-terminus of this base sequence : 66863642
  Distance between 3'-terminus of neighbour sequence of sequence listing upward to telomere on chrosomal short arm and 5'-terminus of this base sequence : 118367
gacctaaggtggaggtgagatgaccccacaggaagagatcaggcaaatgaaaggattagggccagatttcagaaacttggatgtggaactggttcttgcagaggctttcaaacatacatctcagaatcctggggttccacagataacctccaggggtttcccaaacaatgaggctgcttctgccaaggagagaagatgagaactgccagagggacctgctcagctgttatctgtcttacacactggggttctgagtaacagttcatttgaaggaaggacccaggacaggaaagagagagagagaaagagagagagagatcattccactaaagcatttgaaagaacatagagttcatggactctctttttctctctctctcacatgaaatgcgacattatataaaaagtaatctggatggaaaaggttctcgatgagtgtattgagattg

SEQ ID NO: 16322 - DNA, 362 bp, Homo sapiens
  chr10.fa.O7frz.66809552
  Located on chromosome 10
  Distance between a terminus base of telomere on chromosomal short arm and 5'-terminus of this base sequence : 66958310
  Distance between 3'-terminus of neighbour sequence of sequence listing upward to telomere on chrosomal short arm and 5'-terminus of this base sequence : 94219
tactcaggatgctaaagtgagaggatcaactgagcccaggaggttgaggctgcagtgagccaagatggcgccactgcactccagtctgggaaacagagtgagatactgctgacgatagagagagagagagaggaaggaaggaaggaaggagggagggagggagggaaggaaggaaggaaggaaggaaggaaggaaggaaggaaggaaggatggaaggaaggaaggaatcaaatgagctgagctgataaacattaagtgtattaaagagttcctgatccatagtaaatgctcaataaatgttagctattatttcaacatatcctattcttgtattcccagtcactagaatactcatgctatcc

SEQ ID NO: 16323 - DNA, 101 bp, Homo sapiens
  DISO7_10003980
  Located on chromosome 10
  Distance between a terminus base of telomere on chromosomal short arm and 5'-terminus of this base sequence : 66976052
  Distance between 3'-terminus of neighbour sequence of sequence listing upward to telomere on chrosomal short arm and 5'-terminus of this base sequence : 17380
cttagctccagagacaacaaactaccacattattattattattattattattattattattattattatattgtattcatgttcactaagcattgaatccg

SEQ ID NO: 16324 - DNA, 327 bp, Homo sapiens
  chr14.fa.O7frz.104441272
  Located on chromosome 10
  Distance between a terminus base of telomere on chromosomal short arm and 5'-terminus of this base sequence : 67078361
  Distance between 3'-terminus of neighbour sequence of sequence listing upward to telomere on chrosomal short arm and 5'-terminus of this base sequence : 102208
agtgcacattctagtttcataaacattttattttattttatttatttatttatttatttatttatttgttgagacagagtctcaccctgttgctcaggttggagtacagtggcaagttctctgctcactgccacctctgcctcctgggctcaagtcccatctcagcctcccgagtagctgggactacaggcttgtgttaccatgcatggctaatttttgtgttttttgtagaggcagggtttcaccatgttgctcaggctggtctcaaacgctggcctcaagcaatctgcctgcctcagccttccaagcactaggattataggcatg

SEQ ID NO: 16325 - DNA, 136 bp, Homo sapiens
  DID22N_0004020
  Located on chromosome 10
  Distance between a terminus base of telomere on chromosomal short arm and 5'-terminus of this base sequence : 67259431
  Distance between 3'-terminus of neighbour sequence of sequence listing upward to telomere on chrosomal short arm and 5'-terminus of this base sequence : 180743
ttctattgccaatttctgagacttttaacagatgtaaactttgacttctctcaaagagccaaaatacactaacataaattatatatatatatatatatataaatatatatatggctagataggtatctttcaacaa

SEQ ID NO: 16326 - DNA, 295 bp, Homo sapiens
  D10S561
  Located on chromosome 10
  Distance between a terminus base of telomere on chromosomal short arm and 5'-terminus of this base sequence : 67321826
  Distance between 3'-terminus of neighbour sequence of sequence listing upward to telomere on chrosomal short arm and 5'-terminus of this base sequence : 62259
ctacactccagcctggatgacatggcaagacgctctgaccctctctctctctctctctctctctctctctctctctggaggcaaggtctgaccctctctctctctctctctggaggcaaggtttgtcagcctcgacttcccaggctcaagagatcctcctacatcagcccccaagtagctgggactacgggcaagcaccaccatgctggcgtgtgtgtgtgtgtgtgtgtgtgtgtgtgtgtgtgtgtgtgtgtgtgtgtgtgttgaaagatctttctcaaagggatattgctat

SEQ ID NO: 16327 - DNA, 211 bp, Homo sapiens
  DID22N_0004024
  Located on chromosome 10
  Distance between a terminus base of telomere on chromosomal short arm and 5'-terminus of this base sequence : 67374182
  Distance between 3'-terminus of neighbour sequence of sequence listing upward to telomere on chrosomal short arm and 5'-terminus of this base sequence : 52061
caacacagataggatgctgtgtttaaaatgtcaaaagacacagacagacagacacacacacacacacacacacacacacacacacacacacagagacaaactccttacataaaaaagcaagcacttttagtacccaaaacagacttcccctgccagcccccaagaactaaataaaaaaaaaaaaaacctctcaaattagaacacatgtaga

SEQ ID NO: 16328 - DNA, 151 bp, Homo sapiens
  DID22N_0004026
  Located on chromosome 10
  Distance between a terminus base of telomere on chromosomal short arm and 5'-terminus of this base sequence : 67640120
  Distance between 3'-terminus of neighbour sequence of sequence listing upward to telomere on chrosomal short arm and 5'-terminus of this base sequence : 265727
aggtcctgcataagatccccctcacatacttcacaatatatatgtgtgtgtgtgtgtgtgtgtgtgtgtgtgtgtgtgtgtgtgtatttggctaaaaaattatactgccaaaattactgattataaatacttgactacactgattgatggg

SEQ ID NO: 16329 - DNA, 230 bp, Homo sapiens
  AC022396.5_136993
  Located on chromosome 10
  Distance between a terminus base of telomere on chromosomal short arm and 5'-terminus of this base sequence : 67700775
  Distance between 3'-terminus of neighbour sequence of sequence listing upward to telomere on chrosomal short arm and 5'-terminus of this base sequence : 60504
gaggctagcagaatacttgaacccaggaatttgagatcagtctgggcaacaaagtgaaaccctgtctctactaaataaataaataaataaataaataaataaataaataaagccaagcatggtggcatgcacccatagtccctgctactcgtgaagctgagctgggaagattgcttgagcccaggaggtccaggctgcagtgagccgtgttcgtgctactgcactctata

SEQ ID NO: 16330 - DNA, 101 bp, Homo sapiens
  DISO7_10000065
  Located on chromosome 10
  Distance between a terminus base of telomere on chromosomal short arm and 5'-terminus of this base sequence : 67877480
  Distance between 3'-terminus of neighbour sequence of sequence listing upward to telomere on chrosomal short arm and 5'-terminus of this base sequence : 176475
ttatggcaacagcaggtgtgtgtgtgtgcatgtgtgtgtgtgtgtgtgtgtgtgtgtgtgtgtagtcatgtgtagatggcaagtattaagtacaacatggc

SEQ ID NO: 16331 - DNA, 433 bp, Homo sapiens
  chr10.fa.O7frz.68268395
  Located on chromosome 10
  Distance between a terminus base of telomere on chromosomal short arm and 5'-terminus of this base sequence : 67995769
  Distance between 3'-terminus of neighbour sequence of sequence listing upward to telomere on chrosomal short arm and 5'-terminus of this base sequence : 118188
ccagtgaatagaagtggaagtgcccatactttatgagtttacatgctgttgtttgaagttggcatttttgaatataagcaatggcaacccaggaggacatgaggtccagaggatggagagaccggcgtcttgctcttgcctcctccctcctggctactctcccatcactctgacctccctgcaggcaagatcatccctgaggcatatttggaaatcacactttacaattttcatcatttaacaatgtttgtgtgtgtgtgtgtgtgtgtgtgtgtgtgtgtgtgtgtgtatttgacaaaaaaatgtagacttagggcaacgtctgagttcattcgggcttctataacaaaataccagagactggctaattttaaaccacaggaatttatttctcacagttacggagactgggaagttcaagatcaaggtgctg

SEQ ID NO: 16332 - DNA, 151 bp, Homo sapiens
  D10S581
  Located on chromosome 10
  Distance between a terminus base of telomere on chromosomal short arm and 5'-terminus of this base sequence : 68105945
  Distance between 3'-terminus of neighbour sequence of sequence listing upward to telomere on chrosomal short arm and 5'-terminus of this base sequence : 109743
gctgtcaaatgcaaccatctacacacacacacacacacacacacacacacacacacacacacacacacacacacacacacacagagtcttaaagttactgatgtgaatatttaatgggtgaccattactgagggttgagtggagaagttgt

SEQ ID NO: 16333 - DNA, 343 bp, Homo sapiens
  AC012558.8_162991
  Located on chromosome 10
  Distance between a terminus base of telomere on chromosomal short arm and 5'-terminus of this base sequence : 68145018
  Distance between 3'-terminus of neighbour sequence of sequence listing upward to telomere on chrosomal short arm and 5'-terminus of this base sequence : 38922
taggcactaaataccattaatgactcccagatagatatatcctgccctgactttgcatctggaccacaaaacttattcatttacttttttcagttctttgcttaatatctcttattggaaaggtcttccatgatcacaatgtccaaaacaaaataacacctctaccctgatactgtcactctctttctccttaacctttatttttcttcaaggtgcttttcattggtatctatctatctatctatctatctatctatctatctatccatccacctatctacctacctacctacctacctacctatctacctacctacctattcactagaaataagctccatga

SEQ ID NO: 16334 - DNA, 172 bp, Homo sapiens
  D10S1715
  Located on chromosome 10
  Distance between a terminus base of telomere on chromosomal short arm and 5'-terminus of this base sequence : 68173806
  Distance between 3'-terminus of neighbour sequence of sequence listing upward to telomere on chrosomal short arm and 5'-terminus of this base sequence : 28445
tgccttgtatattcccagatgggaaacttagtgcctcctctctctctctttctctctctctctctctctctgtctctcagacacacacacacacacacacacacacacacacacacacactcaccccactcatagatgtagcatactttagcaaaagtgtggtggggcttac

SEQ ID NO: 16335 - DNA, 356 bp, Homo sapiens
  chr10.fa.O7frz.68739515
  Located on chromosome 10
  Distance between a terminus base of telomere on chromosomal short arm and 5'-terminus of this base sequence : 68293165
  Distance between 3'-terminus of neighbour sequence of sequence listing upward to telomere on chrosomal short arm and 5'-terminus of this base sequence : 119187
ttctcaatcttagattatggtcaccaccactgtccctatctgcacccccatcccaagtgaagttactgttttctgtagctcttcctgggggttctatcctgatataagaccaaaaacaagataaacaaaggtgataactgatgtcaggatggtaaattataggtaatctttcctaagttccttaacattgttattacttctataaaaagaaacagaaacaaaaacataaaacacacacacacacacacacacacacacacacacacacaactcgacacgtcttgaattttctgcaatacagtagggtgattaaaggcagaggatttgaagtctggttcaaggtggagtcctaaata

SEQ ID NO: 16336 - DNA, 351 bp, Homo sapiens
  chr10.fa.O7frz.68598010
  Located on chromosome 10
  Distance between a terminus base of telomere on chromosomal short arm and 5'-terminus of this base sequence : 68434593
  Distance between 3'-terminus of neighbour sequence of sequence listing upward to telomere on chrosomal short arm and 5'-terminus of this base sequence : 141072
gaatgtgaaagatgtaagttagctgctatatgtattctaaatatgctcagggatttgaagaaaacatgaacataatgagaaaagaaatgaaagatgtaaaaaaaatgagacttgtcaagacaaaatatttattatttaaaaatgaaaaattcatgattaaactataagaagatgaggtactgcaaaacacacacacacacacacacacacacacacacacacacacacacacaaaaacaacaataaaagatctgttaactttaatcaatacagtagtaaaaccacccaaactgaagtataaggagaggcagaaataaacatgaacagatcttcagtgacctgtatgacaat

SEQ ID NO: 16337 - DNA, 425 bp, Homo sapiens
  chr10.fa.O7frz.69001213
  Located on chromosome 10
  Distance between a terminus base of telomere on chromosomal short arm and 5'-terminus of this base sequence : 68574347
  Distance between 3'-terminus of neighbour sequence of sequence listing upward to telomere on chrosomal short arm and 5'-terminus of this base sequence : 139403
atggaaaggagagtcatacaacagagtgtgtctgtggacaagattcagataataagtgtgtgtgtgtgtgtgtgtgtgtgtgtgtgtgtattcttacattgttctctgtatttccagagaacagaaaataaaagtagtaatcaaaattaggaagatttcagttcaatctgtgggagtaatttctaacattatttttcaataatgaaatggaatactgtgtgcttctcctgcatttagtgaggactgtgtgccagacaccctactaggtcatgagaatatagaaatgagaggaatggtctctgcctgaccacatctctttaatccacctgactcatcattcctatttccaccatgtcagcataaagcacaattatctttcattcaccacctggactacccttctacctagattctgtacatgcagt

SEQ ID NO: 16338 - DNA, 423 bp, Homo sapiens
  chr10.fa.O7frz.68930822
  Located on chromosome 10
  Distance between a terminus base of telomere on chromosomal short arm and 5'-terminus of this base sequence : 68644466
  Distance between 3'-terminus of neighbour sequence of sequence listing upward to telomere on chrosomal short arm and 5'-terminus of this base sequence : 69694
tatgcttatttgcttacatcactatacatttgtttacccctttattccctttctctgccaacaaaactaaattttcacaggacaggatctaagatcttatgtgtgtggacacacatactgtgctccctctagaatttctctttatgaagcaatggcttcagagagggctgttcaggcagtatgaatgcagaactcaagtctaaaccctcaatatcatgtcctttggctaccatccaacttgtttcctcatttatttatttgtctttttgacaatattttgccaagttacacagtcctatctgaatttataatttactaggtatttatttatttatttatttatttatttatttatttattttgctactagtaaaccctgattttttactgcctccaatacaatacagtcctgcatcacataat

SEQ ID NO: 16339 - DNA, 345 bp, Homo sapiens
  chr10.fa.O7frz.69117122
  Located on chromosome 10
  Distance between a terminus base of telomere on chromosomal short arm and 5'-terminus of this base sequence : 68736072
  Distance between 3'-terminus of neighbour sequence of sequence listing upward to telomere on chrosomal short arm and 5'-terminus of this base sequence : 91183
ataccaattaggattctccagagagacagatccaacatgatgtacgtgtgtgtgtgtgtgtgtgtgtgtgtgtgtgtgtgtgtgtgtgtgtgtgtttgcgagagagagagcgcaagattttgagggattggtttatgacttgtggaggttaggtaagctcaaaatgggttttgggttaggccagaaggctacagactcaggaaagagttgcagttcaagatcaaggggagtctgctggaagaattttttcttgtccagggaaatttagtctttgttctattaacacattcaagggatcggatgaggcccactcacattatggatggtgatagacgttactcatag

SEQ ID NO: 16340 - DNA, 479 bp, Homo sapiens
  chr10.fa.O7frz.69298779
  Located on chromosome 10
  Distance between a terminus base of telomere on chromosomal short arm and 5'-terminus of this base sequence : 68956087
  Distance between 3'-terminus of neighbour sequence of sequence listing upward to telomere on chrosomal short arm and 5'-terminus of this base sequence : 219670
tgcaatacctgagtgaagtaactgatttttaaaattatgctaaaagaagacgttatctcacaaatatctctacaataaattgcatttatgcttagctggaagttttgaattttattttatatctctagaattaacttagttttcaatgttaaccatatttcacagaattatctctgagttaactttataaaaataattatatatttgtctaaaatattttttcgatttttaaaattctatttctaaaccaactttgtgttcctccaacccatctgaccacctctcctctttcagcagtttgaagagtttgaaatgaaaattttcaatttttaatctaatttccatgcacgcacacacacacacacacacacacacacatctatggaccccagtgtggtctggaatcactattgatcatccttcttgtccttatgtgcataactctcagctgcttcttcatcctgaagagaatactaaag

SEQ ID NO: 16341 - DNA, 144 bp, Homo sapiens
  D10S557
  Located on chromosome 10
  Distance between a terminus base of telomere on chromosomal short arm and 5'-terminus of this base sequence : 68956351
  Distance between 3'-terminus of neighbour sequence of sequence listing upward to telomere on chrosomal short arm and 5'-terminus of this base sequence : -215
caacccatctgaccacctctcctctttcagcagtttgaagagtttgaaatgaaaattttcaatttttaatctaatttccatgcacgcacacacacacacacacacacacacacatctatggaccccagtgtggtctggaatcac

SEQ ID NO: 16342 - DNA, 247 bp, Homo sapiens
  G08814
  Located on chromosome 10
  Distance between a terminus base of telomere on chromosomal short arm and 5'-terminus of this base sequence : 69074056
  Distance between 3'-terminus of neighbour sequence of sequence listing upward to telomere on chrosomal short arm and 5'-terminus of this base sequence : 117561
caccttacaaggtcaatgtggttcttttccctaccacagtcctgtctctccctatcacccaaagttaaccatgacaatgatttagtattattctctagatagatagattagatagatagatagatagatagatagatagatagatagatattatgtataattgtttatttgtacaaatttatggggtacatgtgagattttgttacatgtatataatatacactgatcaagtcagggtttttagggt

SEQ ID NO: 16343 - DNA, 377 bp, Homo sapiens
  chrX.fa.O7frz.20112459
  Located on chromosome 10
  Distance between a terminus base of telomere on chromosomal short arm and 5'-terminus of this base sequence : 69251345
  Distance between 3'-terminus of neighbour sequence of sequence listing upward to telomere on chrosomal short arm and 5'-terminus of this base sequence : 177042
ttaaaggaaactgaagattatgagaagggaatttcaaaggtttcatatggtatagagaggtaagaacagttaaagaatgtgtgtgtgtgtgtgtgtgtgtgtgtctgtgtgtgtgtgtgtggagagagagagagggagagaaagaaatgaagatggccacacatttcttgttactcttaccattaaaaaggtatgggtttgttttccttttttgtgaaattccacaagcctgtgatttgttttgagcaatataatacaacagaatatgtgatcttgggtagcctctgaccttgggctttaaaagatctgaatcttttactttcccctctgatagaaagctccctcttagaagaaataaacaatttaagatgcctgac

SEQ ID NO: 16344 - DNA, 399 bp, Homo sapiens
  chr10.fa.O7frz.69515539
  Located on chromosome 10
  Distance between a terminus base of telomere on chromosomal short arm and 5'-terminus of this base sequence : 69443109
  Distance between 3'-terminus of neighbour sequence of sequence listing upward to telomere on chrosomal short arm and 5'-terminus of this base sequence : 191387
gttgatactagaaatgaaaggctgcttaggattaacgttagaaaatcaatcagtgttgttattattattattattattattattattattattattgagatggaatttggctcttgtcccccaggctggagtgcaatgacatgatcttggctcactgcagcctccacctcccaggttcaagcgattctcctgcctcagcctcccaagtaactgggattacaggcacctgccaccatgtccagctaatttttcttgtatttttagtagagacacggtttcgccacgttggccaggctggtctcaaactcctaaccaaaggtgatctcccctccttggccttccaaagtgctggaattacaggtgtgaaccaccacacctggcctaatcagtgtaatttat

SEQ ID NO: 16345 - DNA, 243 bp, Homo sapiens
  D10S1743
  Located on chromosome 10
  Distance between a terminus base of telomere on chromosomal short arm and 5'-terminus of this base sequence : 69683777
  Distance between 3'-terminus of neighbour sequence of sequence listing upward to telomere on chrosomal short arm and 5'-terminus of this base sequence : 240269
caggtgcaactgacagtgggatacaaacttttatttttttaacattttaaattttattttctttcttttgtgtgtgtgtgtgtgtgtgtgtgtgtgtgtgtgtgtgtgtgtgttagagtcttgctttgtcacccgggctggagtgcagtggcacaatcttggttcattgcaacctccacctcctgctttcaagtgattctcaagcctcagtctcccaaatagctgagattacaggcatctgtt

SEQ ID NO: 16346 - DNA, 213 bp, Homo sapiens
  D10S599
  Located on chromosome 10
  Distance between a terminus base of telomere on chromosomal short arm and 5'-terminus of this base sequence : 69790687
  Distance between 3'-terminus of neighbour sequence of sequence listing upward to telomere on chrosomal short arm and 5'-terminus of this base sequence : 106667
gttcatctatattgtccaatgtctgaatattcttttattttaaaggcaaaatagtattatattgtgattgtgtccacacacacacacacacacacacacaatttctttattgactcatctgtcaactgacacgttgtttctgcatcttgactattgtgggtaacactgcaatgaacatgggagtgcagatatctctacaaggtgctgacttcg

SEQ ID NO: 16347 - DNA, 261 bp, Homo sapiens
  AC018979.6_149488
  Located on chromosome 10
  Distance between a terminus base of telomere on chromosomal short arm and 5'-terminus of this base sequence : 69961158
  Distance between 3'-terminus of neighbour sequence of sequence listing upward to telomere on chrosomal short arm and 5'-terminus of this base sequence : 170258
gcttgtttcatagactccagtaattgcttaaaacacaaaagagaccaaataatgctcaaagaagtatagtaacaaacaagaaaatatctgtctatctatctatctatctatctatctatctatctatctatctatcatctatctatcatctatttatcatctatctataaatatctacacactaggtaagtaacagctaaaggagatgatgtatataaaacatagcaccttacagagattgatttagcaagttagctattc

SEQ ID NO: 16348 - DNA, 458 bp, Homo sapiens
  chr10.fa.O7frz.69852628
  Located on chromosome 10
  Distance between a terminus base of telomere on chromosomal short arm and 5'-terminus of this base sequence : 70060542
  Distance between 3'-terminus of neighbour sequence of sequence listing upward to telomere on chrosomal short arm and 5'-terminus of this base sequence : 99123
cagccaatactcactgttaaacaccagtcaaacacatggcagccagctggcaaactgacgctcctgaaatcttgaatctgccttttctaatattattttgtaggaggcatacctcaagggacatcaagatgttagttaattagggtgtgcctaaaaatgtaataggactatgctgtgtgtgtgtgtgtgtgtgtgtgtgtgtgtgtgtgtgtttgtgtgtgtctgtgtttgagatggagtctcactatgtcacccaagctagagtgcagtggtgcgatattggctcactgcaacctcccctcccaggttcaagcgattctactgactcagcctcccaagtagttgggactataggtgcatgccaccatgcccggctaattgcatctttagtacagacggagtttcgccatgtttgccaggctggcctcaaacttgtgaccttaggtgatctaccgcct

SEQ ID NO: 16349 - DNA, 390 bp, Homo sapiens
  chr10.fa.O7frz.69995079
  Located on chromosome 10
  Distance between a terminus base of telomere on chromosomal short arm and 5'-terminus of this base sequence : 70202919
  Distance between 3'-terminus of neighbour sequence of sequence listing upward to telomere on chrosomal short arm and 5'-terminus of this base sequence : 141919
gcaatggatatgctaattacactgatttgatcattacacaatgtatataggtaccaaaacatcacactgtaccaaatatgtacagttattatgtgtcaattaaaaacaaaataaaatgtgagtgtgtgtgtgtgtgtgtgtgtgagagatagagagagagagatgagtgtgtgttggaaagcttacaattttaaagtaaaaattcaactttggaaaaattcactagtgatgtcagtgttataatttaagtcttaaggagagattaagaagataagtatgcttaaaatgtgtatgcttaaagaaaatcttcatcattttcttaaatacttgatgcttcacattgataattccaactgaattaaattagaaattcatctgcattatcataag

SEQ ID NO: 16350 - DNA, 271 bp, Homo sapiens
  chr10.fa.O7frz.70124096
  Located on chromosome 10
  Distance between a terminus base of telomere on chromosomal short arm and 5'-terminus of this base sequence : 70417587
  Distance between 3'-terminus of neighbour sequence of sequence listing upward to telomere on chrosomal short arm and 5'-terminus of this base sequence : 214278
tcgcttctaacaaactgaatacagcaaaagcgatggtatgccactttagaagttatgttatacaaagatgctggcttgcatcttaggctctctctctctctctctctctctcatctggatcattcacactgaggtgccatgatgtgaaaaaatataggcagcatggagaggtgcccatttagtgaggaactgaagcctcctgccaacaaaaacatatgaataagcttggaagcagattctttagcctcagttgagacttagatgactgcag

SEQ ID NO: 16351 - DNA, 141 bp, Homo sapiens
  DISO7_10006730
  Located on chromosome 10
  Distance between a terminus base of telomere on chromosomal short arm and 5'-terminus of this base sequence : 70595828
  Distance between 3'-terminus of neighbour sequence of sequence listing upward to telomere on chrosomal short arm and 5'-terminus of this base sequence : 177970
tagctaatccttcttgagatgtgtgtgtgtgtatatatatatatatatatatatatatatatatatatatatatttgttcttcagcatttttctttattttattctatctccttttgagctaaatggatgacctatctgcc

SEQ ID NO: 16352 - DNA, 343 bp, Homo sapiens
  chr10.fa.O7frz.70441361
  Located on chromosome 10
  Distance between a terminus base of telomere on chromosomal short arm and 5'-terminus of this base sequence : 70697287
  Distance between 3'-terminus of neighbour sequence of sequence listing upward to telomere on chrosomal short arm and 5'-terminus of this base sequence : 101318
cggaataagagacttggtctctctgtctgtctgtctgtctgtctgtctgtctgtctctctctctctctatatatatatatatataaaataatactttacatatattatatatattttacatatagtatattttacatgtgtattttatattttacatatatatattttgagaccaagtctcttacttgatccaaacccccagatcccccccaaatatgtatatatatatatatgtttatatatatatatacacacatacacaatatattagacactatgtaaatgtctgaaataaattttagttgggttctttattgagataattacaaattcacatgcagtt

SEQ ID NO: 16353 - DNA, 201 bp, Homo sapiens
  Z66607
  Located on chromosome 10
  Distance between a terminus base of telomere on chromosomal short arm and 5'-terminus of this base sequence : 70899482
  Distance between 3'-terminus of neighbour sequence of sequence listing upward to telomere on chrosomal short arm and 5'-terminus of this base sequence : 201852
tttgctaagagaacagattgtaaatgttctcaccacacacacacacacacacacacacacacaaaatgaggggatagatatgtttgattgtacaatcatttcacaatatatacatatatcaaaacatcacattatataccatatgtgtgtgtgtgtgtgtatatatatatacacaaatttcatttgtcagttatacctcag

SEQ ID NO: 16354 - DNA, 219 bp, Homo sapiens
  D10S1646
  Located on chromosome 10
  Distance between a terminus base of telomere on chromosomal short arm and 5'-terminus of this base sequence : 70916127
  Distance between 3'-terminus of neighbour sequence of sequence listing upward to telomere on chrosomal short arm and 5'-terminus of this base sequence : 16444
tcagactggaaggacatcattgactttcttgggactccatcttgctgactcacctgcagttcttgtaaattagcctccataatcacatgagccaattctttacacacacacacacacacacacacacacacgcacacacatatatatatataatacaatatataatatatgtattcatcctattagttctgtttctctgaagaaccctgactaatacag

SEQ ID NO: 16355 - DNA, 403 bp, Homo sapiens
  chr10.fa.O7frz.70943745
  Located on chromosome 10
  Distance between a terminus base of telomere on chromosomal short arm and 5'-terminus of this base sequence : 71030842
  Distance between 3'-terminus of neighbour sequence of sequence listing upward to telomere on chrosomal short arm and 5'-terminus of this base sequence : 114496
ctgtacttccaattgtcactaaagatatgtcatgctttatagcctcctatatgtctggatcacttgtgctttcatttggaaacaatacaaaatagtttataaatgtaagtatccttgtttaatacttatggaaccaaaacatattttaggaaaaatgacacttagtcaaacttttattcctaagtgtggaataatcaaggttgtatatagaaatccatactttagtataacatcatgagtgaaataaatttgcacacacatatatatatatatacacacacacacacacacacacacatgcgatgacgttcctgaaaatatgatcctagataattaagagaatggggagttgctattcaataggtataaaatttcagttatgcaagatgaataagttctagag

SEQ ID NO: 16356 - DNA, 305 bp, Homo sapiens
  D10S1670
  Located on chromosome 10
  Distance between a terminus base of telomere on chromosomal short arm and 5'-terminus of this base sequence : 71167571
  Distance between 3'-terminus of neighbour sequence of sequence listing upward to telomere on chrosomal short arm and 5'-terminus of this base sequence : 136326
tttcctgctgccatcaacttttgttatactataaatatggatgtaactgtacctacataactaccagcacacacctaaaattaaataagaaattttaatccagtagttcttaatttcttttctaatcctaagtacttaaagatataacacactattaataaatcaccatagtgatggttcttaaaggtgtgtgtgtgtgtgtgtgtgtgtgtgtgtgtgtgtagcatgtggggaaggtgtcctggagaggatacaaccttctgtgattttcctctgctaagaatcagccctgaagggtacaattc

SEQ ID NO: 16357 - DNA, 224 bp, Homo sapiens
  chr10.fa.O7frz.71448599
  Located on chromosome 10
  Distance between a terminus base of telomere on chromosomal short arm and 5'-terminus of this base sequence : 71483848
  Distance between 3'-terminus of neighbour sequence of sequence listing upward to telomere on chrosomal short arm and 5'-terminus of this base sequence : 315972
atgagcatgactcaaacataactacacacacacacacacacacacacacacacacaccctcacacatttcgcctaaaaagaaaactgttctccaagtgggcaagaaaatcaccttttgtccccagcctaaagatattatctttagcaaagataaataaatttgtcattcttgctaaattcctctgagtttgtttataattgaaacttcagatagctccttaagt

SEQ ID NO: 16358 - DNA, 162 bp, Homo sapiens
  chr10.fa.O7frz.72019768
  Located on chromosome 10
  Distance between a terminus base of telomere on chromosomal short arm and 5'-terminus of this base sequence : 71523598
  Distance between 3'-terminus of neighbour sequence of sequence listing upward to telomere on chrosomal short arm and 5'-terminus of this base sequence : 39526
ctagacatacagactgccttagacaagtgatgtttccttattcaacagactagaatttgtgttatttggcaagtttgcaacacacacacacacacacacacacaccgcagtgagactataactatgacccaaatctgtgttactttaacacagaattcctca

SEQ ID NO: 16359 - DNA, 380 bp, Homo sapiens
  chr10.fa.O7frz.71939403
  Located on chromosome 10
  Distance between a terminus base of telomere on chromosomal short arm and 5'-terminus of this base sequence : 71684872
  Distance between 3'-terminus of neighbour sequence of sequence listing upward to telomere on chrosomal short arm and 5'-terminus of this base sequence : 161112
ggacattatgctaaatggaataagccagacacagaaaggcaaatactgtatgatctcacttatatgtgaaatctaaaaaagttaaattcaaagaagcagagggtaaaagggtggtttccaggtgctagcgaattggggaaatggggaagattgttgatcaaaggatataaaatttcagttttaagatgaataagttttgggactctactgtgtagcatggtgactatagttaacatattgtattctttacttgaaatttgataagaaagtagattttaagtgtcttagccacacacacacacacacacacacacacacacacacacacagtggtaactatgggtagagatggatgtgttaattcatttgactgtggtaat

SEQ ID NO: 16360 - DNA, 191 bp, Homo sapiens
  chr10.fa.O7frz.73202597
  Located on chromosome 10
  Distance between a terminus base of telomere on chromosomal short arm and 5'-terminus of this base sequence : 71918328
  Distance between 3'-terminus of neighbour sequence of sequence listing upward to telomere on chrosomal short arm and 5'-terminus of this base sequence : 233076
gagtgcttctaaaaggattctaagtgcatgtgtgcttctaaaataattgtgtgtgtgtgtgtgtgtgttttgttttttgggttttttttttttgagatggaatcttgctccgtcgcccaggctggagtgcagtggcccgatctcggctcactgcaaccttcgcctcccaggttcaagcaattctgctttag

SEQ ID NO: 16361 - DNA, 310 bp, Homo sapiens
  AL133551.13_6176
  Located on chromosome 10
  Distance between a terminus base of telomere on chromosomal short arm and 5'-terminus of this base sequence : 71978535
  Distance between 3'-terminus of neighbour sequence of sequence listing upward to telomere on chrosomal short arm and 5'-terminus of this base sequence : 60016
atggcagatcttgagacttctcagcctccttaaccacataaaacaattcctataataaatctcctcatgtgtatatgtatatacacacacacacacacatatatataaatatatatacacacacacacacacacacacacacacacacatatatcttagccactctgtttctctagagaaccctaatacagtcaaggaaaaagacttggttttcctatataatttaatagccccccaaaaaataagaattagtaaaaggaatgacagtatcttgtaaagaaataaaatggtgctataatcataattcctt

SEQ ID NO: 16362 - DNA, 300 bp, Homo sapiens
  AL133551.13_22156
  Located on chromosome 10
  Distance between a terminus base of telomere on chromosomal short arm and 5'-terminus of this base sequence : 71994496
  Distance between 3'-terminus of neighbour sequence of sequence listing upward to telomere on chrosomal short arm and 5'-terminus of this base sequence : 15651
aagacaagttaggctgccttacacactcccacagaacagaatagcaatttctggtcctttcacatattgacatccttggctagaaacttctccagtccttaatggtttcctggaacatacacactcctcaacatgcacacacacacacacacacacactccacacacatgcacacacatagatttaagaacatacacacaaataaatttaaatatatataagcaataactaatttatgtttggtctcattttcaacaaatactccaaggccggccatggtagctcatgcctgtaatccta

SEQ ID NO: 16363 - DNA, 423 bp, Homo sapiens
  AL133551.13_40767
  Located on chromosome 10
  Distance between a terminus base of telomere on chromosomal short arm and 5'-terminus of this base sequence : 72013021
  Distance between 3'-terminus of neighbour sequence of sequence listing upward to telomere on chrosomal short arm and 5'-terminus of this base sequence : 18225
acctgtcttacttcactggaatatcagctccttgagtgcataaacatggcataagcctttttatatgctacacaggccaggtgttgtggctcacacctaaaatcccagcactttgggaagccaaggcagaaggatcacttgaggccaagagtttgagaccagcctgggcaatacagcaagaccccatctctacaaaatatgtgtattgtgtatgatacatatgtgtgtgtgtgtgtgtgtgtgtgtgtgtatcctacacaaatgctagtatatttatcacataatattctcaggaagtatgtgtctcattcagtcagtatcaaatataagagaaaatatcttcatttagagctgctgatcttagaggttaataatcattaagtagaaatatattttcataatgagtttgccgtagcatgaagt

SEQ ID NO: 16364 - DNA, 233 bp, Homo sapiens
  AL133551.13_78463
  Located on chromosome 10
  Distance between a terminus base of telomere on chromosomal short arm and 5'-terminus of this base sequence : 72050811
  Distance between 3'-terminus of neighbour sequence of sequence listing upward to telomere on chrosomal short arm and 5'-terminus of this base sequence : 37367
tgtaatcacagctattcaggaggctgaggcagaagaacggcgtgaacccgggaggcggagcttgcagtgagctgagatcccgccactgcactccagcctgggcgacagagcaagactccgtctcaaaaaataaataaataaataaataaataaataaataaataaataaataaattttttgatacttaatatgtgccaggcacttttctaagcactttacatagaatgtttca

SEQ ID NO: 16365 - DNA, 175 bp, Homo sapiens
  AL133551.13_81291
  Located on chromosome 10
  Distance between a terminus base of telomere on chromosomal short arm and 5'-terminus of this base sequence : 72053718
  Distance between 3'-terminus of neighbour sequence of sequence listing upward to telomere on chrosomal short arm and 5'-terminus of this base sequence : 2674
aagcaggacacctaggtctaaggaaatatcctctctctctccctctccctctctctctctctctctctctgtctctctcaaatttctgtacatgcgcaaccctaaatgttagtgcctccttaaattttgcatcctacacaccctacttgcctcattctagtcctgactctgtcta

SEQ ID NO: 16366 - DNA, 273 bp, Homo sapiens
  AL133551.13_83570
  Located on chromosome 10
  Distance between a terminus base of telomere on chromosomal short arm and 5'-terminus of this base sequence : 72055950
  Distance between 3'-terminus of neighbour sequence of sequence listing upward to telomere on chrosomal short arm and 5'-terminus of this base sequence : 2057
gaggttgcagtgacctgagattgcaccactgcactccagcccggcaacagagtgagactccatctcaaaaaaacaaaaaaaagagagaaaaaatgacacacacacacacacacacacacacacacatatatataaagaagtgacaatattatgacaaacatttcattaaaaataaataattgttatctagatatgatatgccattgacagaccagtaaaatacatccagtaaaaggaatgttgagacaaggaagtatgactccacctggtaac

SEQ ID NO: 16367 - DNA, 477 bp, Homo sapiens
  chr10.fa.O7frz.72467138
  Located on chromosome 10
  Distance between a terminus base of telomere on chromosomal short arm and 5'-terminus of this base sequence : 72242500
  Distance between 3'-terminus of neighbour sequence of sequence listing upward to telomere on chrosomal short arm and 5'-terminus of this base sequence : 186277
aaattgttaagatgtcaatgctacccaaaagaatgtacagactcggccaggtgtgggggctcacgcctgtaatcccaacactttgggaggccgaggtgggcggatcaactgaggtcgggagttcgagaccagcctgaccaacatggagaaaccccatctctactaaaaacacaaaattagtcgggcaaggtggcgcatgcctgtaatcccagtcacttgggaaactgaggcaggagaatcgcttggtcccgggaggcagaggttgcagtgagccaagatcatgccattgcattccagcctgagcaacaagagcaaaactccatctcaaaataaataaataaataaataaataaataaataaataaataaaattcaaatagatcaaagacctaaatgtaaaaggtaaaactataaaactctaagaagcaaacagggaaatgcttcatgacattggatttggcaatgatttcttagata

SEQ ID NO: 16368 - DNA, 357 bp, Homo sapiens
  chr10.fa.O7frz.72568330
  Located on chromosome 10
  Distance between a terminus base of telomere on chromosomal short arm and 5'-terminus of this base sequence : 72343870
  Distance between 3'-terminus of neighbour sequence of sequence listing upward to telomere on chrosomal short arm and 5'-terminus of this base sequence : 100893
gaggtcaggagatcgagaccatcctggctaaaaaggtgaaacccggtctctactaaaaatacaaaaaaaaaaaaaaaattagccaagcatggtggcgggcgcctgtagtcccagctacttgagaggctgaggcaggagactggcgtgaacccgggaggcggaacttgctgtaagccgagcttgcaccactgcactccagcctgggcgacagagcgagactccttcaataaataaataaataaataaataaataaataaataaataagtataattaaaaattcagttatttagttgcacgagccacatttcaagtgcccagtaactgcatgtgtctaatgactacagtattggacagc

SEQ ID NO: 16369 - DNA, 454 bp, Homo sapiens
  chr10.fa.O7frz.72764975
  Located on chromosome 10
  Distance between a terminus base of telomere on chromosomal short arm and 5'-terminus of this base sequence : 72413886
  Distance between 3'-terminus of neighbour sequence of sequence listing upward to telomere on chrosomal short arm and 5'-terminus of this base sequence : 69659
cctgttcttgtacaaagtgaactgtattaggttggtaaatgctgaaaatgtcatatcgttatcactggatgctgaaaaatcacatcagtcagcagattttttggcagtcagctgagagaaggatttacacccagcatgtttgtggcagaggatctctctgctctactttcataaacattagcatagtgttatcatgtatggttaggtaaccaggaaaagtagaggaggacagctgtaaccagcactttatctcctctgtctttgagagatctccttcacacatgcaaaacttaacaggaaatatatagatagatgtgtatgtgcacacacacacacacacacacacacacacacacacacacacatagatatttacattttggctagatgagaaatttagcaagttaatcctagcctcattccatttagtgtaacaaaccatactaacctttca

SEQ ID NO: 16370 - DNA, 124 bp, Homo sapiens
  D10S210
  Located on chromosome 10
  Distance between a terminus base of telomere on chromosomal short arm and 5'-terminus of this base sequence : 72510001
  Distance between 3'-terminus of neighbour sequence of sequence listing upward to telomere on chrosomal short arm and 5'-terminus of this base sequence : 95661
cctcaatgcacaactccttcaagtaggtattctccccacagagaaggagaaagagacttagaaaggccaaagatcacacacacacacacacacacacacacacatatcttgacccaggtctgag

SEQ ID NO: 16371 - DNA, 270 bp, Homo sapiens
  chr10.fa.O7frz.73309049
  Located on chromosome 10
  Distance between a terminus base of telomere on chromosomal short arm and 5'-terminus of this base sequence : 72775221
  Distance between 3'-terminus of neighbour sequence of sequence listing upward to telomere on chrosomal short arm and 5'-terminus of this base sequence : 265096
tggagtagctgtttcttgatacaggaaatactgcatgtatggagtttgtgtgtgtgtgtgtgtgtgtgtgtgtgtgtgtgtgtgtgtgtgtggtggaggggctatagtcagattctgttcaaatgactcagtcatttcagaataaaacaccacattgctcctttagactgggtataagattatcaagacaatgggaatctggaaaaatgagaaaatggagagggcgtaggaactactagacccagacttgatctaaggagttcaacatta

SEQ ID NO: 16372 - DNA, 326 bp, Homo sapiens
  chr10.fa.O7frz.73409259
  Located on chromosome 10
  Distance between a terminus base of telomere on chromosomal short arm and 5'-terminus of this base sequence : 72877338
  Distance between 3'-terminus of neighbour sequence of sequence listing upward to telomere on chrosomal short arm and 5'-terminus of this base sequence : 101847
cttgtaggttcagctgtgatacagtttgaataaatatgaggttttattttatttatttatttatttatttatttatttatttatttatttattttgaggcagaatctccctctgttacccaggctggagtgcaatggcgcagtctcggctcactgcaatctctgcctcctgggttcaagcgattctcctctctcagcctcctgagtagctgggattacaggcgcctgccaccacgcctggctgatttttgtatttttagtagagatagggtttcaccatgctagccaagctggtctcgcctaaggtccagaccttaggtgatctac

SEQ ID NO: 16373 - DNA, 175 bp, Homo sapiens
  D10S1678
  Located on chromosome 10
  Distance between a terminus base of telomere on chromosomal short arm and 5'-terminus of this base sequence : 73063189
  Distance between 3'-terminus of neighbour sequence of sequence listing upward to telomere on chrosomal short arm and 5'-terminus of this base sequence : 185525
aagccccaggcaacacagcaagaacccactctctaaatgaatgaatgaatgaatcattaaacagtctctgtgtctcacacagagatacacacacacacacacacacacacacacacacacttttggaaaaaaaaattattcaaaagttggagacctggaaaccatcactgatacc

SEQ ID NO: 16374 - DNA, 296 bp, Homo sapiens
  chr10.fa.O7frz.73903894
  Located on chromosome 10
  Distance between a terminus base of telomere on chromosomal short arm and 5'-terminus of this base sequence : 73296575
  Distance between 3'-terminus of neighbour sequence of sequence listing upward to telomere on chrosomal short arm and 5'-terminus of this base sequence : 233211
atagtttaggacctgaaaccactgaagcttcccttcagactgacataatttttacacacacacacacacacacacacacacacacacacacacagttttttgtttgtttgagtctcactttgtcgcccaggctggagtgcaatggcgtgatctcggctcactgcaacctctgcctcctgggttcaagggattctcctgcctcagcctcctgagtagctgggattacaggtgcctgccactatgcctggctaatttttgtatttttagtggagacggggtttcaccatgttggtcag

SEQ ID NO: 16375 - DNA, 204 bp, Homo sapiens
  D10S1647
  Located on chromosome 10
  Distance between a terminus base of telomere on chromosomal short arm and 5'-terminus of this base sequence : 73321058
  Distance between 3'-terminus of neighbour sequence of sequence listing upward to telomere on chrosomal short arm and 5'-terminus of this base sequence : 24187
tcctacccggcacaaagtaacagagacccagaaatctgcctgtgatctgaaatataaatacacacacacacacacacacacacacacacacacactgtgtgtgtatgtgtatctcatatttaattgtgggcagatctagtgattctgaaatttcctcattctgtcaaacagttttattagtggaatgctttgttcaggcttgat

SEQ ID NO: 16376 - DNA, 431 bp, Homo sapiens
  AC027617.2_65597
  Located on chromosome 10
  Distance between a terminus base of telomere on chromosomal short arm and 5'-terminus of this base sequence : 73342425
  Distance between 3'-terminus of neighbour sequence of sequence listing upward to telomere on chrosomal short arm and 5'-terminus of this base sequence : 21163
agctcaatcacattaatgacttaggatgccccttaggactgtgatttggaagctgtgctccatggagctcctttagggccagctgctggatggatggatggatggatggatggatgggcgggcatctctccctgctctctctgcatagctccttacttagctcttttatgtattgggcttccactagttgtttgtggccaaaaaaaatagagccactgcctttataagataacttgagaactcatgcttggcctgtcctgcctagcaggtagtgtggtcacatttctaccctttatggctatcctacttggcatttattaaacttagcagagtggaccagactgaatttaacaaaattgtggcattatttaactacaattgatctaaaactgctcttcctctctgaagtattaaccttgcttaggttaagc

SEQ ID NO: 16377 - DNA, 137 bp, Homo sapiens
  D10S1672
  Located on chromosome 10
  Distance between a terminus base of telomere on chromosomal short arm and 5'-terminus of this base sequence : 73400631
  Distance between 3'-terminus of neighbour sequence of sequence listing upward to telomere on chrosomal short arm and 5'-terminus of this base sequence : 57775
gtgaaactccgcctcaaaaagaagagaattacctgtaatcctcccaatgtctgaatagatttccttctgtgtgtgtgtgtgtgtgtgtgtgtgtgtgtgtgtgtgtgtgtgtctttttttaatctgggcaagggcaa

SEQ ID NO: 16378 - DNA, 201 bp, Homo sapiens
  DISD22_0009581
  Located on chromosome 10
  Distance between a terminus base of telomere on chromosomal short arm and 5'-terminus of this base sequence : 73475138
  Distance between 3'-terminus of neighbour sequence of sequence listing upward to telomere on chrosomal short arm and 5'-terminus of this base sequence : 74370
gaggcagcacctaagagaaggggacaggattatggagatgtgagtgtgtgtgtgtgtgtgtgtgtgtgtgtgtaagtacttgtgtgtgtatgtgtgagtgtgtgagagtgtgtgtgtgtgagagattgtgtatgtgagagtgtgtgtgtgtagagagagagggaagaggggaaaaggaaggaggagagtaaagatctggag

SEQ ID NO: 16379 - DNA, 439 bp, Homo sapiens
  chr10.fa.O7frz.74977040
  Located on chromosome 10
  Distance between a terminus base of telomere on chromosomal short arm and 5'-terminus of this base sequence : 73742702
  Distance between 3'-terminus of neighbour sequence of sequence listing upward to telomere on chrosomal short arm and 5'-terminus of this base sequence : 267363
tttggtgacattagatacgaacataaaggaaagctggtcaaagggtatatagaattctgcaatatttaggcaagacttctgtatgtctgaaattatctttaaaaaactacacacacatccatgcaccgagcaggccaaacaaaatatgtctgtgggtctgattcattcattcattcattcattcattcattcattcattcattcattcaacaagcctttgttgcgcgcctacttggcacaaggcactgtttcaggtactggggagactgcatgaacaaaacctcaaagtcctgcccttatggagctgacactaggtcgagagaaagataacaagtgaaataagtgaactatctagtgtgttagattttgagagtgttaaggagaaaacgtaaagccaggaaagggtgtgggcagcaggtgttcatgtctagaagctcag

SEQ ID NO: 16380 - DNA, 149 bp, Homo sapiens
  D10S529
  Located on chromosome 10
  Distance between a terminus base of telomere on chromosomal short arm and 5'-terminus of this base sequence : 73803762
  Distance between 3'-terminus of neighbour sequence of sequence listing upward to telomere on chrosomal short arm and 5'-terminus of this base sequence : 60621
agtgatgccttgcagatgctgccacctctctttgatgcctcctctgccgtgtgtgtgtgtgtgtgtgtgtgtgtgtgtgtgtgtgtgtgcgcgcgcgcgcgcgaaccctcaacgtggccttcaagggccgtcacagtctagcgcctgct

SEQ ID NO: 16381 - DNA, 305 bp, Homo sapiens
  AC024601.4_82776
  Located on chromosome 10
  Distance between a terminus base of telomere on chromosomal short arm and 5'-terminus of this base sequence : 73842048
  Distance between 3'-terminus of neighbour sequence of sequence listing upward to telomere on chrosomal short arm and 5'-terminus of this base sequence : 38137
  misc_feature (1)...(305): n = A,T,G or C
ctcagttattctttgctgtcacataggtttatgcctccatctttttccttccttccttccttctttccttccttccttccttacttacttacttccttccttccttccttccttccttccttccccttantagggctcttggacactttaaggtccactgagatctgttagggctcttggaagatactaagggtcttaaatgttgaatgtatgtgcatttctgttgaaaagatccatcttatgctttgttttggcaggttctcaaagggatttccactacttaaggtagctaatcatttcatctt

SEQ ID NO: 16382 - DNA, 157 bp, Homo sapiens
  D10S1742
  Located on chromosome 10
  Distance between a terminus base of telomere on chromosomal short arm and 5'-terminus of this base sequence : 73937307
  Distance between 3'-terminus of neighbour sequence of sequence listing upward to telomere on chrosomal short arm and 5'-terminus of this base sequence : 94954
gccaatgagatgtgggcagaagtgacacacacacacacacacacacacacacacacacacacaaaacttcacagtctcatctttaaagagggagctgctgactccccacttcctactggagggcagtggcaacaacagggacttccatcttgaatcc

SEQ ID NO: 16383 - DNA, 381 bp, Homo sapiens
  AC016821.5_172444
  Located on chromosome 10
  Distance between a terminus base of telomere on chromosomal short arm and 5'-terminus of this base sequence : 74009042
  Distance between 3'-terminus of neighbour sequence of sequence listing upward to telomere on chrosomal short arm and 5'-terminus of this base sequence : 71578
tcactccttgtcaagttaaagacatccctgattgggagaaagttcttcactaatttcagtttcccccaaatatgggacagtgaaccagacgcctctcttactttcatgacacttccttgaatgtgatgatgatcctattccttttgggacaccatctctcccctctaggtccacccaaatctgttggtgcaataataataataataataataataataataataataataataataataatggcagtggtagggccagctgctgtcctgggtggcttttgtacatcaacttcacttggtcctgagcctcagcttcctcacctacataaggggaataatgacaggagctcttggggcgtcgtcatgaggattaccttgactt

SEQ ID NO: 16384 - DNA, 233 bp, Homo sapiens
  D10S1665
  Located on chromosome 10
  Distance between a terminus base of telomere on chromosomal short arm and 5'-terminus of this base sequence : 74056712
  Distance between 3'-terminus of neighbour sequence of sequence listing upward to telomere on chrosomal short arm and 5'-terminus of this base sequence : 47289
cctcacagcctggagaaagaaggggaggagaagagggggagagggaaggaagaaggggagtgtgtgtgtgtgtgtgtgtgtgtgtgtgtgtgtgtgtgtgtgtgtgtgtagggaggctcccacccagaccaggaaaggaacaaagccctcaggcctccaggacatggcctcctgcatacaggcagggagattggaactggggggcttttaattgatttccagtgggtcagagg

SEQ ID NO: 16385 - DNA, 218 bp, Homo sapiens
  DISO7_10007286
  Located on chromosome 10
  Distance between a terminus base of telomere on chromosomal short arm and 5'-terminus of this base sequence : 74068054
  Distance between 3'-terminus of neighbour sequence of sequence listing upward to telomere on chrosomal short arm and 5'-terminus of this base sequence : 11109
aggaacataggcaaatcagatactaactttgtcatagatgagaaagggaaagcaactaacatatatatatacatatatgtgtatatatatatatatgtatatatgtatatatatatgtatatatgtatatatatatatgtatatatgtatatatatatatgtgtatatatgtatatatatatatatatctggaaagatgtctaccaaatgttaacagc

SEQ ID NO: 16386 - DNA, 399 bp, Homo sapiens
  chr10.fa.O7frz.78576970
  Located on chromosome 10
  Distance between a terminus base of telomere on chromosomal short arm and 5'-terminus of this base sequence : 74139800
  Distance between 3'-terminus of neighbour sequence of sequence listing upward to telomere on chrosomal short arm and 5'-terminus of this base sequence : 71528
catagcctgtactcaagctaatatattacacctaggtgggtttatgtcttaggggacttacatacttacatataaccaagatattgtggggccactccagtcttctgactatgtaaggtgttttctgaggcctccatcaatcctctggtcccccatcatctgtccatggatgagggccatcactgaaccacccttcatacctgtctacctgaccctttcaagtccagcaattttcccactactactactactactactactactactactactactactacttactactcccttgtcattgctggagcacaagaatccttccaccacacctcagacacaatggacccaaggatttccacaaggccatataaggccctacctgtcatactcactatctgg

SEQ ID NO: 16387 - DNA, 195 bp, Homo sapiens
  D10S560
  Located on chromosome 10
  Distance between a terminus base of telomere on chromosomal short arm and 5'-terminus of this base sequence : 74307042
  Distance between 3'-terminus of neighbour sequence of sequence listing upward to telomere on chrosomal short arm and 5'-terminus of this base sequence : 166843
tgaggggcataagggattgtgtgtgtgtgtgcgtgtgtgtgtgtgtgtgtgtgtgtgtgtgtgtgtatggtgggagtggtgttctgtagttgattagtgatgtctgccagtggcatgggaagtattggcatgtgtgtgaaacacgaccagaccataccacttaagaagaatggaaggtcaggtgtttggggttat

SEQ ID NO: 16388 - DNA, 249 bp, Homo sapiens
  DISO7_10007003
  Located on chromosome 10
  Distance between a terminus base of telomere on chromosomal short arm and 5'-terminus of this base sequence : 74323089
  Distance between 3'-terminus of neighbour sequence of sequence listing upward to telomere on chrosomal short arm and 5'-terminus of this base sequence : 15852
cttgtacgggtgatgctggttgcattagaatcgcctggggagctttcaaaacacgccaggccaattgttcccaatacctgctgcagatgtctgtgggtagggcctggctgtaagtgtctaacgagctcctcgggtgatcgtgttctgcggctggacctggcaggccctgagaatgagagagagagagagagagagagagagagagagacagagagtctgtgtggcccagtgcctggagctccctgtaca

SEQ ID NO: 16389 - DNA, 173 bp, Homo sapiens
  DISO7_10002904
  Located on chromosome 10
  Distance between a terminus base of telomere on chromosomal short arm and 5'-terminus of this base sequence : 74390507
  Distance between 3'-terminus of neighbour sequence of sequence listing upward to telomere on chrosomal short arm and 5'-terminus of this base sequence : 67169
ttcctgacttaggtgggatcttgttctcttttctctatctctgtctctctcccattgtctggctttctctctctctctctctgtctctctctctctctctctctctctcacacacacacacacacacacacacacacacacacacacacacacacgtacgtgcctcaagaggg

SEQ ID NO: 16390 - DNA, 240 bp, Homo sapiens
  D10S1648
  Located on chromosome 10
  Distance between a terminus base of telomere on chromosomal short arm and 5'-terminus of this base sequence : 74462784
  Distance between 3'-terminus of neighbour sequence of sequence listing upward to telomere on chrosomal short arm and 5'-terminus of this base sequence : 72104
gtgaggctgcttctgctctctgagatgcccaactttgggggggtggggggtgcacgcatgtttgtgtgtgtgtgtgtgtgcgtgtgtttgtgtgtgcgtgtgtgtgtgtgtgtgcatgtgtttgtgtgtgcgtgtgtgtgtacgtctcacttcctaagtccgtcttgtctcctcacttcttcctcctccactatctcttttggcctcttcctttactgcttctccccccagatatgttca

SEQ ID NO: 16391 - DNA, 185 bp, Homo sapiens
  G08810
  Located on chromosome 10
  Distance between a terminus base of telomere on chromosomal short arm and 5'-terminus of this base sequence : 74652015
  Distance between 3'-terminus of neighbour sequence of sequence listing upward to telomere on chrosomal short arm and 5'-terminus of this base sequence : 188991
gagaacagacccccaaatctctgcaggacaactcataagagtggctttcaatattttttcgtcatgactaagagtaagaaataccatttttcatcatgtcccaggagatagatagatagatagatagatagatagatagatagatagatagatagatctgtgcatgcacatagtaaaactgaaat

SEQ ID NO: 16392 - DNA, 288 bp, Homo sapiens
  G10108
  Located on chromosome 10
  Distance between a terminus base of telomere on chromosomal short arm and 5'-terminus of this base sequence : 74652015
  Distance between 3'-terminus of neighbour sequence of sequence listing upward to telomere on chrosomal short arm and 5'-terminus of this base sequence : -185
gagaacagacccccaaatctctgcaggacaactcataagagtggctttcaatattttttcgtcatgactaagagtaagaaataccatttttcatcatgtcccaggagatagatagatagatagatagatagatagatagatagatagatagatagatctgtgcatgcacatagtaaaactgaaattaaaagttacaacatagtaattaccattttatatgtgatgatgtactctgacattttctattttactgcattaaaaaattgctggtctcaacccactgacttg

SEQ ID NO: 16393 - DNA, 314 bp, Homo sapiens
  AC022532.4_97821
  Located on chromosome 10
  Distance between a terminus base of telomere on chromosomal short arm and 5'-terminus of this base sequence : 74790929
  Distance between 3'-terminus of neighbour sequence of sequence listing upward to telomere on chrosomal short arm and 5'-terminus of this base sequence : 138626
ctggctaacatggtgaaatcccgtctctaatgaaaatacaaaaaaattagccaggcatggtggcgggtgcctgtagtcccagctactcgggaggctgaggcaggagaatagtgtgaacccgggaggtggagctggcagtgagtcgagatcgcgccactgcactctagcctgggcggcagagcgagactccatctcaaataataataataataataataataataataaataaataaataaataaaacctcaattaatttcagtatgactttgtcaagaggcaattatttgctaagcactttatatgctaaccag

SEQ ID NO: 16394 - DNA, 449 bp, Homo sapiens
  AC022532.4_207406
  Located on chromosome 10
  Distance between a terminus base of telomere on chromosomal short arm and 5'-terminus of this base sequence : 74832575
  Distance between 3'-terminus of neighbour sequence of sequence listing upward to telomere on chrosomal short arm and 5'-terminus of this base sequence : 41332
cacctgtaatttcagcacttagggaggatgaggctggcagatacctgagctcaggagttcaagaccagcctggtcaacatggtgaaaccctgtctctacccaaaaatacaaaaatgagccaggcatttttgtggtgtgcgcctgtagtcccagctcctctggaggctgaagtgggaggattgcttgagcctgggaggcaaaggttgcaataagccaagatcgggccactgcactccagtctgggcaaccgagtgagtccctgtctcaaaaaacaaaacaacaacaacaacaacaacaacaaaagaaccataggctgcgacctgagcaggttgttagaaaatggagaaaggcccagcaggctcaactaggagctccaagcctttgtcctctgtcttaggggaggaggctgtcccacatagctggaggcctcatctaagattcaggagacc

SEQ ID NO: 16395 - DNA, 281 bp, Homo sapiens
  D10S1685
  Located on chromosome 10
  Distance between a terminus base of telomere on chromosomal short arm and 5'-terminus of this base sequence : 75178564
  Distance between 3'-terminus of neighbour sequence of sequence listing upward to telomere on chrosomal short arm and 5'-terminus of this base sequence : 345540
acatcaaattgtccactgagaccccctgacctatggtattagttccaattgccacacacaggaattttcaaagcaaacccactgggcagagaatgatgtgctgggaatcttggtgtgagagatatgtggtagtgagcaccctcctgcaaagagagttttatggttcacacaacacttttgctttcgtggacagcatctcactccacaaatacacacacacacacacacacacacacacacacacacacacacacactttttagaggtagggtcttgctttg

SEQ ID NO: 16396 - DNA, 148 bp, Homo sapiens
  D10S537
  Located on chromosome 10
  Distance between a terminus base of telomere on chromosomal short arm and 5'-terminus of this base sequence : 75264058
  Distance between 3'-terminus of neighbour sequence of sequence listing upward to telomere on chrosomal short arm and 5'-terminus of this base sequence : 85213
atttggatgaaacccacggtttaggcctagagttatctttgtaggaatgtgtttgtgtttgtgtgtgtgtgtgtgtgtgtgtgtgtgtgtgtgtgtgtttatttgttttttaaaagattaaattgattttctagccaggcacagtagg

SEQ ID NO: 16397 - DNA, 172 bp, Homo sapiens
  D10S1688
  Located on chromosome 10
  Distance between a terminus base of telomere on chromosomal short arm and 5'-terminus of this base sequence : 75420428
  Distance between 3'-terminus of neighbour sequence of sequence listing upward to telomere on chrosomal short arm and 5'-terminus of this base sequence : 156222
gctatgtgcctgctaacgtcattctgctgtcagagggagtgtggggtaggagagcagggtggtctgaagtctttctctctctctttctctctctctctctctctcacacacacacacacacacacacacacacacacacacacacacacagggcttcatcggctcagagagt

SEQ ID NO: 16398 - DNA, 446 bp, Homo sapiens
  chr10.fa.O7frz.75797618
  Located on chromosome 10
  Distance between a terminus base of telomere on chromosomal short arm and 5'-terminus of this base sequence : 75517567
  Distance between 3'-terminus of neighbour sequence of sequence listing upward to telomere on chrosomal short arm and 5'-terminus of this base sequence : 96967
atggctggtcatagtcctaagttcccagcccagaacgtgctcctggacttcaggcctgtgctatcagctgcccctagacacttttgatgggatgccttgtgggggcactcaaaatgcaacatgtcccaaacaaaactcattctctgtcctttgtcttctaaggttttctaattggcgatgaatgcttccttcattccacccatctttccatccatcttccttccttccttccttcttccttccttccttcttccttccttccttccttccatcgttacatccaccatagtgtaatgttccatccatccatccatccatccatccatccatccatccacacactcacttacccattcatttcacctccttctcctcatgacaacaatgatgataataataacctatgtttattgagggctttcatggtgctagatactgttctaatc

SEQ ID NO: 16399 - DNA, 464 bp, Homo sapiens
  chr10.fa.O7frz.76027475
  Located on chromosome 10
  Distance between a terminus base of telomere on chromosomal short arm and 5'-terminus of this base sequence : 75756565
  Distance between 3'-terminus of neighbour sequence of sequence listing upward to telomere on chrosomal short arm and 5'-terminus of this base sequence : 238552
agcaaccataggaagctaatacagatttgtggctgggcacagtggctcatgcctgtaatcccagcactttgggaggcagaggcagaacgatcacttgagcccaggagtttgagaccaacttggacaacaaagcaagactccatctccacacacacacacacacacacacacacacacacacacaaaatttaaattggccgggcatggtggtgggcacctgtggtcccagctacttggaaggttaaggcaggagaattgcttgatcccaggaggttgagactgcagtgagctgtgtgcaccactgcactcctgcctcagtgacagcctgagaccctgtctctctctcgaaagaagatttgtatagaaaggcaatcactgtgttagatggcatgggagttgttggggaaccaggaggtttggatgtggcgaagaaaggaaaggggagtcaaggatgacacctgagt

SEQ ID NO: 16400 - DNA, 390 bp, Homo sapiens
  chr10.fa.O7frz.76104684
  Located on chromosome 10
  Distance between a terminus base of telomere on chromosomal short arm and 5'-terminus of this base sequence : 75879965
  Distance between 3'-terminus of neighbour sequence of sequence listing upward to telomere on chrosomal short arm and 5'-terminus of this base sequence : 122936
ggtaatgtcagcaagtgactagccagaaaaggccacttcaaaagctctggttggccctggaaatctcctcccaccccacctttcagctcttcctggagcttttaatgagcctttccatggcctctggctgggatggttgagaaggagtcgaggtgtcaagataatacttctttttaaggtgcaattaaaatcagagtttttgtagtgtctctgcttggtgtgtgtgtgtgtgtgtgtgtgtgtgtgctcgcgtgcatgcgcctgtgcacacacaatgatagcctgtccttgtctccctctgcactcactgtagcaaacacccatctcacttaaacaaatggaaaatcaagtgtcttaatgggttttctcattaaagtgaaagtaccactg

SEQ ID NO: 16401 - DNA, 373 bp, Homo sapiens
  AL359183.6_90504
  Located on chromosome 10
  Distance between a terminus base of telomere on chromosomal short arm and 5'-terminus of this base sequence : 76091357
  Distance between 3'-terminus of neighbour sequence of sequence listing upward to telomere on chrosomal short arm and 5'-terminus of this base sequence : 211002
attagctaggcatagtggcacgctcctgtagtcccagctactcggaaggctgaggtgggaggattgcttgagcccaggaggttgaggctgcagtgagctgtgactgcaccactgcactccatccagcctgggcaacagagtgagaccctgtctcaaaaaaaaaaaaaaaagaaagaaggaaggaaggaaggaaagagaaagaaagaaagaaagaaagaaagaaagaaagaaagaaagaaagaaagggaaagaaagaaagagaaagagagaaagaagaaagcaagcaagcccatactttttagctaccctccctccccgttacccccagcccctggcaaccacagatctactttctgcctctaagatttacctc

SEQ ID NO: 16402 - DNA, 192 bp, Homo sapiens
  D10S584
  Located on chromosome 10
  Distance between a terminus base of telomere on chromosomal short arm and 5'-terminus of this base sequence : 76179688
  Distance between 3'-terminus of neighbour sequence of sequence listing upward to telomere on chrosomal short arm and 5'-terminus of this base sequence : 87958
tcaatggcaatggatacctgtctgtttctctctctctctctctctctctctctctctctctctcacacacacacacacacacacacacgcacacatacacattgtacttttctaactagtactggagttcagcctaactcaactctgcctgtcgttcaaagcccacatctcacctaccatgttcggatctgc

SEQ ID NO: 16403 - DNA, 138 bp, Homo sapiens
  D10S1650
  Located on chromosome 10
  Distance between a terminus base of telomere on chromosomal short arm and 5'-terminus of this base sequence : 76197813
  Distance between 3'-terminus of neighbour sequence of sequence listing upward to telomere on chrosomal short arm and 5'-terminus of this base sequence : 17933
gaagcctgtggtctaatgagggagacaagtagaaacccacgcaattgtgaccctaggctggctggacaccacacacacacacacacacacacacacacacacacacacacacactggctggggctgcagaggccagaa

SEQ ID NO: 16404 - DNA, 235 bp, Homo sapiens
  D10S606
  Located on chromosome 10
  Distance between a terminus base of telomere on chromosomal short arm and 5'-terminus of this base sequence : 76274228
  Distance between 3'-terminus of neighbour sequence of sequence listing upward to telomere on chrosomal short arm and 5'-terminus of this base sequence : 76277
catggacattctgctgctatgtaaaactctaccatggaggaatttatctagaactttccagaatgtgtaaggactcccccgtgtgtgtgtgtgtgtgtgtgtgtgtgtgtgtgtgtgtgtgtgtgagagagacagagagacgagagagagagagacggagtctcactctatcacccaggctggagttcagtggcatgatcttggctcactgcaacctccgtctcccaggttcaaa

SEQ ID NO: 16405 - DNA, 355 bp, Homo sapiens
  AC016826.7_171723
  Located on chromosome 10
  Distance between a terminus base of telomere on chromosomal short arm and 5'-terminus of this base sequence : 76288857
  Distance between 3'-terminus of neighbour sequence of sequence listing upward to telomere on chrosomal short arm and 5'-terminus of this base sequence : 14394
ggttcgtatctgtatttagaacagtgccaacccataaaaagcactcttgaagtggggcatggtggcacacacctgtagtcccagctacttgggaggctgaggcaggaggattgcttcagcccaggaggttgaggctgcaatgggctatgattgcacggctgcactccagcctgggtgacagagagagaacctgtctctaaaagaaaagaaaaagcatactttagacattagctattattattattattattattattattattattatcccctgtcctttctatagaggaagaagtcaaggctcagaggagttaagcggcttgcctaaggtcacacagctagttggtctcagaac

SEQ ID NO: 16406 - DNA, 155 bp, Homo sapiens
  D10S1694
  Located on chromosome 10
  Distance between a terminus base of telomere on chromosomal short arm and 5'-terminus of this base sequence : 76331737
  Distance between 3'-terminus of neighbour sequence of sequence listing upward to telomere on chrosomal short arm and 5'-terminus of this base sequence : 42525
agtaggggtgctgcttgaggcagagaaagagagagagagagagagagtgtgtgtgtgtgtgtgtgtgtgtgtgtgtgtgtgtgtgtgtgtgcatgtgtgtgtgaggggtggaggtgtgggagacctctgagtagagtctacctgagccagacagg

SEQ ID NO: 16407 - DNA, 101 bp, Homo sapiens
  DISO7_10007009
  Located on chromosome 10
  Distance between a terminus base of telomere on chromosomal short arm and 5'-terminus of this base sequence : 76657122
  Distance between 3'-terminus of neighbour sequence of sequence listing upward to telomere on chrosomal short arm and 5'-terminus of this base sequence : 325230
gtagattcagagcctgaggcaccctgagtgcatgcgcgcgcgcacacacacacacacacacacacacacacacacacacagaacaggtgcaggactacacg

SEQ ID NO: 16408 - DNA, 239 bp, Homo sapiens
  D10S218
  Located on chromosome 10
  Distance between a terminus base of telomere on chromosomal short arm and 5'-terminus of this base sequence : 76879479
  Distance between 3'-terminus of neighbour sequence of sequence listing upward to telomere on chrosomal short arm and 5'-terminus of this base sequence : 222256
acgttgtgccaagactctctctctttctctccctctctctgtctctctaccaacccccccccaacgtatgtgtctctgcgtgtgtgtgtgtgtgtgtgtgtgcatatgcatgtatacacccacttttttttttataaaatagactgcaactggagatactggtgtgtcctattttttggtgcagcgtcataacataagcatctttctaggcaataaattaactttatgctggccttctt

SEQ ID NO: 16409 - DNA, 171 bp, Homo sapiens
  DISO7_10002901
  Located on chromosome 10
  Distance between a terminus base of telomere on chromosomal short arm and 5'-terminus of this base sequence : 77186414
  Distance between 3'-terminus of neighbour sequence of sequence listing upward to telomere on chrosomal short arm and 5'-terminus of this base sequence : 306696
agccgccgaaattatatgcaaaactctgtgtgtatatgtgtgcgtgtatgtgtgcatgtgtattatgtgtgtgcatgtattgtgtgtgtgtgtacatgtgtatcgtgtgtgtgtatgtgtgtgtgcacatgtgtgcatagttttagggaaaagttctgtagctctcgctgc

SEQ ID NO: 16410 - DNA, 433 bp, Homo sapiens
  chr10.fa.O7frz.77417001
  Located on chromosome 10
  Distance between a terminus base of telomere on chromosomal short arm and 5'-terminus of this base sequence : 77268273
  Distance between 3'-terminus of neighbour sequence of sequence listing upward to telomere on chrosomal short arm and 5'-terminus of this base sequence : 81688
gtatccaacaaatgtaaacttcagccttctctttcatacagttatctttcaagagactctgtccatcccccagagtaaatcctctcctcatacaagttttcagaatgataaattttggggaccaggtgtagtgcctcatgcctgtaatcccagcactttcggaggctgacatgggtggatcgcttgagcccaggagttcaagaccagcttcagcatcatagaccccatctctaaaatatatatatatatatatatatatatatatatatatgaatgataaatttcttgataggcttctgaactgtgcaatgcaagactgcatagtgatctcaagccactgagctgaacacatctgtgtttttgaatctgatagtatgtggcttttgaggtcctaaccatgccactgccactatcaggagtctcagaataactg

SEQ ID NO: 16411 - DNA, 170 bp, Homo sapiens
  DISO7_10002896
  Located on chromosome 10
  Distance between a terminus base of telomere on chromosomal short arm and 5'-terminus of this base sequence : 77402191
  Distance between 3'-terminus of neighbour sequence of sequence listing upward to telomere on chrosomal short arm and 5'-terminus of this base sequence : 133485
accttcttctaacccgacacacacataagaatattctatgattagctaatcgaaaaccactatatatatatatatatatatatatatatatatatatatatatatatttttttttttttttttttacaaaggcaaaagataagtcacaccccaaagtgccagttacagag

SEQ ID NO: 16412 - DNA, 448 bp, Homo sapiens
  chr10.fa.O7frz.78247648
  Located on chromosome 10
  Distance between a terminus base of telomere on chromosomal short arm and 5'-terminus of this base sequence : 77625580
  Distance between 3'-terminus of neighbour sequence of sequence listing upward to telomere on chrosomal short arm and 5'-terminus of this base sequence : 223219
gctactgtataagcgtgttcacgcgtgcctgaagcgggaagggtggtcagcaggcacaggagaagcgaatatggtaagttgttgacagaggcagagatttggtggttgtattaaccagttgttgctgggtttcattggctggcagaaaaagaggatttctgtttgaacactcttgggtgagtgtgtgtgtgtgtgtgtgtgtgtgtgagagagagagagacagagtgtgagagagatttcttttttcaattgcaagagatgaatttggcatggagttcttaacctaacaagtcaggaggtttccttcccttggactttctagacctatatgtgttggtctctggccagctctgagggaaagaatgtaggttttatttgctggggctgagttgtatagtgtgattattggaggatcactgcaaacagcttgataggagaaactacaata

SEQ ID NO: 16413 - DNA, 116 bp, Homo sapiens
  DISO7_10002897
  Located on chromosome 10
  Distance between a terminus base of telomere on chromosomal short arm and 5'-terminus of this base sequence : 77713072
  Distance between 3'-terminus of neighbour sequence of sequence listing upward to telomere on chrosomal short arm and 5'-terminus of this base sequence : 87044
aatgttctgaagtattctttggctaagtgtgtgtgtgtgtgtgtgtgtgtgtgtgtgtgtgtgtgttgggtgaatttggaagagaggaagagagataactgttgtcatcatttgtt

SEQ ID NO: 16414 - DNA, 174 bp, Homo sapiens
  G08816
  Located on chromosome 10
  Distance between a terminus base of telomere on chromosomal short arm and 5'-terminus of this base sequence : 77832224
  Distance between 3'-terminus of neighbour sequence of sequence listing upward to telomere on chrosomal short arm and 5'-terminus of this base sequence : 119036
tagattatctaaatggtggatttccaacttttgagtatggagaacccctttttaagatagatagatgatagatagatagatagatagatagatagatagatagatagatagatagatagatgatagatagataatcagacatccatgtgattggattgtgtttagtgtccactg

SEQ ID NO: 16415 - DNA, 443 bp, Homo sapiens
  AC069548.3_106477
  Located on chromosome 10
  Distance between a terminus base of telomere on chromosomal short arm and 5'-terminus of this base sequence : 77850359
  Distance between 3'-terminus of neighbour sequence of sequence listing upward to telomere on chrosomal short arm and 5'-terminus of this base sequence : 17961
ttgctttaatgtcttctacagaactaggtccttttggtgttttaggagttttttcctgttttttgaaggattcttgtccttttgatcttggtgttgatgatggttttgagtcttttccattctgatttgacttctgtacatttttggctggagtatcttgtatagatttcttcactggtgctttttcttcagcttcctcattatcttcatcattatcatcattatcttcatcatcatcttcatcttcttcatcgtcatcatcatcatcatcatcatcttcctcagcagcaagttttacttttttctgtggaaccttgctaccacctccaggggcagactgctttccagttatacttaagagtttcacatcctcctcctcttcaccttctgactctgcatcttcctccacagctactaagtgctgtccactaatatgcactgtc

SEQ ID NO: 16416 - DNA, 279 bp, Homo sapiens
  D8S1838
  Located on chromosome 10
  Distance between a terminus base of telomere on chromosomal short arm and 5'-terminus of this base sequence : 77859518
  Distance between 3'-terminus of neighbour sequence of sequence listing upward to telomere on chrosomal short arm and 5'-terminus of this base sequence : 8716
tacccatgaagccatcacaataatcaagataatgaacatttttctcactgtaagttttcccctgccccttatatttagtttttgaaaaaataagaatataatcataactcactgagaaaaacgtaacctacaatcttagtagagcttgtgaaacttatttatatatgcattattcagtctcttagtgaaggaccattttattttattttattttatttcctttttgagacagagtctcactctgtagctcaggctggagtgcagtggcgcaatctcagc

SEQ ID NO: 16417 - DNA, 123 bp, Homo sapiens
  D10S188
  Located on chromosome 10
  Distance between a terminus base of telomere on chromosomal short arm and 5'-terminus of this base sequence : 77991474
  Distance between 3'-terminus of neighbour sequence of sequence listing upward to telomere on chrosomal short arm and 5'-terminus of this base sequence : 131677
agcttgactggcatatacctaggcctgtgtgtgtgtgtgtgtgtgtgtgtgtgtgtgtgtgtgtgctcttccgtctaaggcatgaataagaggggaggtcaaaataaagacccaatctgaggc

SEQ ID NO: 16418 - DNA, 296 bp, Homo sapiens
  chr10.fa.O7frz.78742112
  Located on chromosome 10
  Distance between a terminus base of telomere on chromosomal short arm and 5'-terminus of this base sequence : 78338481
  Distance between 3'-terminus of neighbour sequence of sequence listing upward to telomere on chrosomal short arm and 5'-terminus of this base sequence : 346884
ctcttaacctggtgatccacctgcctcagcctcccaaagtgctgggattacaggtgtgagccaccgcgcccagcctgtaatttcttataatggttaaggcctttgaaaacatacagatatacacacacatacacaacacacacacacacacacacacaaggttttatgcaaaatatttctcttttcaaaagagtctggcataaaattaaaatgtggatattaggggtataagcaaagcttattaaatgcttatttcatcattcacaccaatggagtcagtacagcctagaaaggtt

SEQ ID NO: 16419 - DNA, 451 bp, Homo sapiens
  AL353731.4_39177
  Located on chromosome 10
  Distance between a terminus base of telomere on chromosomal short arm and 5'-terminus of this base sequence : 78429026
  Distance between 3'-terminus of neighbour sequence of sequence listing upward to telomere on chrosomal short arm and 5'-terminus of this base sequence : 90249
aataagtaatctggctaggcacggtggctcatgcctataatcccagcattttgggaggccagggtgggtggatcacctgaggtcaggagatcgagaccagcctgaccaacatggagaaatgtcgtctctactaaaaatacaaaattagccgggcgtggtggcacatgcctgtaatcccagctacttgggaggttgaggcaggagaatcgtttgaacccgggaggtggaggttgcagtgagccgagattgcgccattgcactccagtctaggcaagaagagcgaaactccatctcaaaaataaataaataaataaataaataaataaacaaaaagtaatcctcctaaaggaaagctactagaaaacactttagccaaatgacttcagatttataagcagggcaactggcaacagaatccaaatgaattctaacgttgtcaatcagaaatact

SEQ ID NO: 16420 - DNA, 387 bp, Homo sapiens
  AC073389.2_73937
  Located on chromosome 10
  Distance between a terminus base of telomere on chromosomal short arm and 5'-terminus of this base sequence : 78562218
  Distance between 3'-terminus of neighbour sequence of sequence listing upward to telomere on chrosomal short arm and 5'-terminus of this base sequence : 132741
ccactgtttgaattccactagggccagacagtgaggcaccctggtgatgcagtccaagagggagtgggcagagaggagccagtgggtatggaggggaaacagagaaacagaattccagctcactctgtgggatttctgggtctgatagaaacatggcattattattattattattattattattattattattattttgagatggagttttgctcttgttacccaggctgaagtgcagtagcatgatctcggctcactgcaacttctgcctcccgcgttcaagagatcctcctgcctcagcctcccaagtagctgggattaccggcacatgccaccacgccttgctaaattttgtatttttggtagaggtgaggtttcaccatgttg

SEQ ID NO: 16421 - DNA, 339 bp, Homo sapiens
  AC022400.7_86275
  Located on chromosome 10
  Distance between a terminus base of telomere on chromosomal short arm and 5'-terminus of this base sequence : 78628393
  Distance between 3'-terminus of neighbour sequence of sequence listing upward to telomere on chrosomal short arm and 5'-terminus of this base sequence : 65788
cgttaatagccagaatcatttatcaattgtatttctatacatctacaagacacaatctgaaaatgaaattagagaaacaatttcactgggcaacaagagcaaaacttcatctcaaaataataataataataataataatctacaatgtcatttcccatccaagcttgacttctacctttactttctgatgtggttttgccatgtccccacccaaatctcatcatgaattataatccccataatcctgatgtgttgagggaggggcctagggggaggtgatcagatcacgggggcagttatcctcatgctgttcttgtgatattcagtaagtcctcatga

SEQ ID NO: 16422 - DNA, 275 bp, Homo sapiens
  D10S1737
  Located on chromosome 10
  Distance between a terminus base of telomere on chromosomal short arm and 5'-terminus of this base sequence : 78748107
  Distance between 3'-terminus of neighbour sequence of sequence listing upward to telomere on chrosomal short arm and 5'-terminus of this base sequence : 119375
attacaagcgtgagccaccgcacacagccttacagtggccttttaaatatgctcaaatatgatattttacttcgaaaatcatccctcaaaaagaaggagttcccttatattcatatatataatataagtagtggggtgtgtgtgtgtgtgtgtgtgtgtgtgtgtgtgtatatctccttatccctttacccaactaaagtgttactgctttcaggaaggttcctatcttatgtgtctttacaatttccacagtacctagcaacatgccttatagt

SEQ ID NO: 16423 - DNA, 236 bp, Homo sapiens
  chr10.fa.O7frz.79381928
  Located on chromosome 10
  Distance between a terminus base of telomere on chromosomal short arm and 5'-terminus of this base sequence : 78843071
  Distance between 3'-terminus of neighbour sequence of sequence listing upward to telomere on chrosomal short arm and 5'-terminus of this base sequence : 94689
cagaatgtctcattgcttctaggccatctcagtggacagaactagcatgtgcgcgcgcgcatgcacacacacacacacacacacacacacacacacacacacacacacctatatttgttgtcttatctaatcagactctgatactgatacctctaatccctatgcaacactagagggtattttctaggcttcccagtttccatatttgtacctcctttctttgacagtgagaaatg

SEQ ID NO: 16424 - DNA, 274 bp, Homo sapiens
  AC073372.1_201389
  Located on chromosome 10
  Distance between a terminus base of telomere on chromosomal short arm and 5'-terminus of this base sequence : 78848838
  Distance between 3'-terminus of neighbour sequence of sequence listing upward to telomere on chrosomal short arm and 5'-terminus of this base sequence : 5531
gcatgcctgtacttgtaaagatatcactccactgacttcttggttttatcgtttcccatgagaagcctgctgttactcttaccttcttggcttttataattatgtaagccaattctcataagaaacctctctctatatatgtgtacagatatatacctatataataatcatctatctatcatctatctatctatctatctatctatctatctatctatctatcatctcctatttgttctgcttctctagagaactatcactggtacaaatacgc

SEQ ID NO: 16425 - DNA, 134 bp, Homo sapiens
  D10S535
  Located on chromosome 10
  Distance between a terminus base of telomere on chromosomal short arm and 5'-terminus of this base sequence : 79136754
  Distance between 3'-terminus of neighbour sequence of sequence listing upward to telomere on chrosomal short arm and 5'-terminus of this base sequence : 287642
gcttcttcgcatgaatggttatatatacgtgtgtgtgtgtgtgtgtgtgtgtgtgtgtgtgtatttattattgattgactgagatagggtcttgctgtgttgcacaggctggcctcaaaatcctgggctcaagc

SEQ ID NO: 16426 - DNA, 314 bp, Homo sapiens
  chr10.fa.O7frz.80028406
  Located on chromosome 10
  Distance between a terminus base of telomere on chromosomal short arm and 5'-terminus of this base sequence : 79140489
  Distance between 3'-terminus of neighbour sequence of sequence listing upward to telomere on chrosomal short arm and 5'-terminus of this base sequence : 3601
tggctgtcttagaaacaaatacaccatagacaagatttttcacaatggccagtgggaattagcaaggacagccatagaaataatcaatacaggtctcttaagtaaaaaacaaaactaccccacatctacaaagaagtcagagagaaaaatctaacatgcttgaaaaagaaattggccaaatgtacaagttagactacacacacacacacacacacacacacacacacacacacacacagagaaataatacaaaacactaagtggagcatgtagtagatggtgaataaatactaaattgaaagtaggtaccactg

SEQ ID NO: 16427 - DNA, 382 bp, Homo sapiens
  DISO7_00002584
  Located on chromosome 10
  Distance between a terminus base of telomere on chromosomal short arm and 5'-terminus of this base sequence : 79231969
  Distance between 3'-terminus of neighbour sequence of sequence listing upward to telomere on chrosomal short arm and 5'-terminus of this base sequence : 91166
ggtactcccgattgcatttcttttgtgtgtgtgtgtgtgtgtgtgtgtgtgtgtgtgtgtgtgtgagacagagtctcactgtgtcgcccaggctagagtgcagtggcatgatctcacctcactgcaacctccacctcccaggttcaagcaattctcctgcctcagcctcctgagtagctgggattacagtcatgcaccactgtgcccagctcatttttgtatttttgtgtttttaggtttcaccatgttggccaggctggtcttgaactcctaacctcaagtgatctgcctggcttggcctcccaaagttctgggattacaggtgtgagctaccacgcctgtccccagtttgcgtttctgttctttctggtgaccatagtga

SEQ ID NO: 16428 - DNA, 354 bp, Homo sapiens
  chr10.fa.O7frz.79526625
  Located on chromosome 10
  Distance between a terminus base of telomere on chromosomal short arm and 5'-terminus of this base sequence : 79241492
  Distance between 3'-terminus of neighbour sequence of sequence listing upward to telomere on chrosomal short arm and 5'-terminus of this base sequence : 9141
ttacgaagagcaaactattcagacccacttatcttgattcagctattctaattgtaaaaagactactgaaggttaaaaatttcagttgactattttctcctaaagtaggataagctaggcttttaggaaaaaaatagggttgaaataaattgtttagaaaattgatcaaaagtagtagttactcagtactctctctctcagcgctcactctctttctgtctctctctgtctctctgtgtgtgtgtgtgtgtgtgtgtgtgtgtgtgtatttagaaaaagagtagaatggaaagattagaaatagagcatgaaaggctggggaagggaagttgctgtgaataacagaacttctgc

SEQ ID NO: 16429 - DNA, 468 bp, Homo sapiens
  chr10.fa.O7frz.79784740
  Located on chromosome 10
  Distance between a terminus base of telomere on chromosomal short arm and 5'-terminus of this base sequence : 79402219
  Distance between 3'-terminus of neighbour sequence of sequence listing upward to telomere on chrosomal short arm and 5'-terminus of this base sequence : 160373
ttgatgctattgtaagtggaattcttttcttaattttatgttcagattattcattgcagatggcttagagatacaattgtgtgtggtttttgttgttttgtttttgagacaggctcatgctctgttgcccaggctgaagtgcagtggcacaaacatggctcactgcagccacaatctcctaggcccacctgattctcctccctcagcctcccaagtagctgagaccactagacatgcaccaccatgcctggctaatttttaattttttttgtagagacagagtcttgccatgttgcccaggctggtctcgaactcttgggctcaagcaatcctctggccttagcctcccaaagttttgggattataggcatgagccgctgtgcctagctcagtttgtgtgtgtgtgtgtgtgtgtgtgtgtgtgtgtgtgttttaatattgatcttgtatcctacagcctttctgaac

SEQ ID NO: 16430 - DNA, 478 bp, Homo sapiens
  chr10.fa.O7frz.79857067
  Located on chromosome 10
  Distance between a terminus base of telomere on chromosomal short arm and 5'-terminus of this base sequence : 79466270
  Distance between 3'-terminus of neighbour sequence of sequence listing upward to telomere on chrosomal short arm and 5'-terminus of this base sequence : 63583
tcactttggaaattatttaacaataagttttctctttccacctccatctacctttgggactccgattaaaataataataataataataataagaagaagaagaagaagaagaagaagaagaagaagaagaagccacttgtagttgacccatgtctcagtgattctgttttcaatatttttgtttttctatctgttcttcattttgaataattactctctcccctattttgtcttttcttttttatttttatttttattttttgagatggagtcttgctctgtcacccaggctggagtgcagtggtgcaatcttggctcactgcaacccccgcctcctgggttcaagtgattctcctgcctcagcctcctgagtagctgggactacaggcacgcctcaccacacccggctaatttttgtatttttagtagaggtgggttttcaccatattgtttcggctggtcctgaactcctgacctc

SEQ ID NO: 16431 - DNA, 412 bp, Homo sapiens
  chr10.fa.O7frz.79947831
  Located on chromosome 10
  Distance between a terminus base of telomere on chromosomal short arm and 5'-terminus of this base sequence : 79547883
  Distance between 3'-terminus of neighbour sequence of sequence listing upward to telomere on chrosomal short arm and 5'-terminus of this base sequence : 81135
tcttgcctaagatacttaactgagtctaatcataaagttcagacatatcttcactgtggaacatttctacaagacaacggcctggactcttcaaaaatgccactgtcatgaaagacagtaaggagaatggaaggagactttcagattaagggagactaaagagacttaagcaaatgtagtattagatccttgactatatattagataatactacatcactgccacattttgtgcttatataggaaaatctccttggtcagtatgtatcataatagggtcataatgtctgcaacttattttccagtggtttgaggggaaaaaagacgtgtgtgtgtgtgtgtgtgtgtgtgtgtgtgtaaagaatatgttctaattgatacatatacgtaaatagcataggagtgttcatttg

SEQ ID NO: 16432 - DNA, 363 bp, Homo sapiens
  chr10.fa.O7frz.80159742
  Located on chromosome 10
  Distance between a terminus base of telomere on chromosomal short arm and 5'-terminus of this base sequence : 79671646
  Distance between 3'-terminus of neighbour sequence of sequence listing upward to telomere on chrosomal short arm and 5'-terminus of this base sequence : 123351
tccatttaggtcctttgtaatatctttccataaagttctatagttttctttattagaggctggcataacttgcatcgcttttgtatttttaccaaattacatttttaaaactgttgctcttgtatatatatatgtgtgtgtgtgtgtgtgtgtgtgtatgtgtgtatgtgtgtatatatgtatatgtatatatgtatgtatattctatatacaaagctgctctcaatgaaaatattgacaaatttatttcttcttttacaattcctgtgtatgtgtggggtgtgtgtgtgtgtgtgtgtgtgtgtgtgtgtgtgtgtgaagatctcgcactgttgcccaggatagaatgagtacagtggcatg

SEQ ID NO: 16433 - DNA, 313 bp, Homo sapiens
  chr10.fa.O7frz.80246537
  Located on chromosome 10
  Distance between a terminus base of telomere on chromosomal short arm and 5'-terminus of this base sequence : 79716856
  Distance between 3'-terminus of neighbour sequence of sequence listing upward to telomere on chrosomal short arm and 5'-terminus of this base sequence : 44847
aaggtttgagatgtaggacaactggggccttttctcagttcgagtcttctagtttgaacattataatttaatgtgattgttaaggagtaagaatgaaacaattccaatgctacataaaatagagaaataacggaaagtttccagtttacttcacaagctaacataacccttccaccaaaaccagatacatgcacacgtgcgcaaacacacacacacacacacacacacacacctcaagccagacagcttagtctcacttaggctatttatatggaatttataaacacacatcctaaatggaatactagcaaat

SEQ ID NO: 16434 - DNA, 318 bp, Homo sapiens
  chr10.fa.O7frz.80403275
  Located on chromosome 10
  Distance between a terminus base of telomere on chromosomal short arm and 5'-terminus of this base sequence : 79945949
  Distance between 3'-terminus of neighbour sequence of sequence listing upward to telomere on chrosomal short arm and 5'-terminus of this base sequence : 228780
ctatcaagttcagtctgcaaatatcctaatttctaggttgtttgggaatgttaattgattgtctcatgtatgtatgtatgtatgtatgtatggatagacagatagatgaaggttgaaggatggatggatagattaaatggatggatggatagatagatagatagatagatagatagatagatagaaagatagatgaaggttgaagggtagggctggaggaggaattccagctttccagtagattttctatcaagcagtcattcatatatataacttcctatattgttagccaaagttcatccatgtctcttgtattta

SEQ ID NO: 16435 - DNA, 376 bp, Homo sapiens
  chr10.fa.O7frz.80513039
  Located on chromosome 10
  Distance between a terminus base of telomere on chromosomal short arm and 5'-terminus of this base sequence : 80055649
  Distance between 3'-terminus of neighbour sequence of sequence listing upward to telomere on chrosomal short arm and 5'-terminus of this base sequence : 109382
cctgtcaactagagctaacagtaggcaatcacctgcaaaagtacaatcgaaaaataaatatttgcattccccggagagccggccagtcacaggggagcgagggcagctgctggagctgtctaaagagagcagtgaagaagaagaggaggaggaggacgaggaggaggaagaagaggaggaagaagaggaagaggatgaagaggaggaagaagaggaagaagaagaagaagaagaagaaaatattcaaagctctcccccaagattgacgaaaccacagtcagttgccataaagagaaaggtaggtgtctgtttagattttctgtgagtcgcgttcaatcaaatcttatttgtcattgcagacattctgtctattagt

SEQ ID NO: 16436 - DNA, 140 bp, Homo sapiens
  Z67780
  Located on chromosome 10
  Distance between a terminus base of telomere on chromosomal short arm and 5'-terminus of this base sequence : 80314258
  Distance between 3'-terminus of neighbour sequence of sequence listing upward to telomere on chrosomal short arm and 5'-terminus of this base sequence : 258233
gagatgattgtggtgggcttggtatcttggaggggtgtgtatgcgtgtgtgtgtgtgtgtgtgtgtgtgtgtgcatttatgggaaacactgtgttttcattcatccatttattcattcataaaacatacggttatggggc

SEQ ID NO: 16437 - DNA, 101 bp, Homo sapiens
  DISO7_10002899
  Located on chromosome 10
  Distance between a terminus base of telomere on chromosomal short arm and 5'-terminus of this base sequence : 80360307
  Distance between 3'-terminus of neighbour sequence of sequence listing upward to telomere on chrosomal short arm and 5'-terminus of this base sequence : 45909
ctgaatatctgtgatcttaatctggttattttccttctgcctgcagatctttctttctttctttcttttcttgatataagtgtgctggttataaatgcttc

SEQ ID NO: 16438 - DNA, 105 bp, Homo sapiens
  DISO7_10002900
  Located on chromosome 10
  Distance between a terminus base of telomere on chromosomal short arm and 5'-terminus of this base sequence : 80485077
  Distance between 3'-terminus of neighbour sequence of sequence listing upward to telomere on chrosomal short arm and 5'-terminus of this base sequence : 124669
cttctcagctattgctctggtaaaaaaaaaaaaaaagcatttttttggtgtgtgtgtatgtgtgtgttctaagtctccatcggtgaggtggtgctgtgctggata

SEQ ID NO: 16439 - DNA, 191 bp, Homo sapiens
  D10S556
  Located on chromosome 10
  Distance between a terminus base of telomere on chromosomal short arm and 5'-terminus of this base sequence : 80526551
  Distance between 3'-terminus of neighbour sequence of sequence listing upward to telomere on chrosomal short arm and 5'-terminus of this base sequence : 41369
catagagggttgagattgggtgtgtgtgtgtgtgtgtgtgtgtgtgtgtgtgtgtgtgtgaagtccatgaaatcagagtgggaaaatggcatatgggaagccgagggagcccccacagtccttgtgggttgaaggtatgttctctcaatccctggactgacacacaggatgggccaccacgctctgaagct

SEQ ID NO: 16440 - DNA, 431 bp, Homo sapiens
  chr10.fa.O7frz.81430366
  Located on chromosome 10
  Distance between a terminus base of telomere on chromosomal short arm and 5'-terminus of this base sequence : 80651552
  Distance between 3'-terminus of neighbour sequence of sequence listing upward to telomere on chrosomal short arm and 5'-terminus of this base sequence : 124810
tccttatgtagttgtctttaccagactctctctctctctctctctctctctctatatatatatatatatatatatatcagactatatatatatcaactatatatgtataccaactatatatataaactatatatatatcaaccatatatatattaactatatatatatcaaccatatatattatatatatatatatatatttgactcttgaacaatgtgggggtcaggggcactgactcccctgtgtagtcacatctaataaaattaacataaactttgactcaaaacctaactactaatagcctaattttgaccagaagccttaccaataacataaacagtagattaacatatattttgtatatatattatatactgtgttcttataaatagtaagctagaaaaaagaaattaaggaaatcataaggaag

SEQ ID NO: 16441 - DNA, 434 bp, Homo sapiens
  chr10.fa.O7frz.81547334
  Located on chromosome 10
  Distance between a terminus base of telomere on chromosomal short arm and 5'-terminus of this base sequence : 80654237
  Distance between 3'-terminus of neighbour sequence of sequence listing upward to telomere on chrosomal short arm and 5'-terminus of this base sequence : 2254
gtctaatgtatcattcttatgcctttgtgtcctcgtagcttagctcccacatatgagtgagaacatacgatgtttggttttccattcctgagttacttcacttagaataatagtctccaattccatccaggttgctgcaaataccattatttcgttcctttttatggctgagtagtattccattacacacacacacacacacacacacacccacacacccacacacacaccacattttctttatccactcattgattgatgggcatttgggctggttctgtatttttgcagttgcaaattgtgctgcttcctattgctattttgaacttcactttggactttgtggttatccttttccacacatgtgtgtgcctgcctttgtacttctttctccacaaagtctcatgcagtgctcagcacagagtaggtaatca

SEQ ID NO: 16442 - DNA, 244 bp, Homo sapiens
  chr10.fa.O7frz.81672524
  Located on chromosome 10
  Distance between a terminus base of telomere on chromosomal short arm and 5'-terminus of this base sequence : 80769310
  Distance between 3'-terminus of neighbour sequence of sequence listing upward to telomere on chrosomal short arm and 5'-terminus of this base sequence : 114639
acagtgactagaacatttggttagtcctcaataaatgataggaggaatgggaggaaggagagagtgaaagagagaaggtagaagtaaagggagctaagaaaaaaaaaaaaatatatatatatatatatacacacacacacacacacacacataatgtattaatgcatgcatcaggtcaagaccacaaataacttctcagtaattaacaaatcaagagaaggtatgcaagtttctacttctgatt

SEQ ID NO: 16443 - DNA, 328 bp, Homo sapiens
  chr10.fa.O7frz.81638410
  Located on chromosome 10
  Distance between a terminus base of telomere on chromosomal short arm and 5'-terminus of this base sequence : 80807321
  Distance between 3'-terminus of neighbour sequence of sequence listing upward to telomere on chrosomal short arm and 5'-terminus of this base sequence : 37767
caatagtcatgtctgtttccactcatatatttttttctttattttacagaggtcacattattaaactaaagatcatgtgcttgaagagggcagagatgctatgaacacacacacacacacacacacacacacacacacacacacgtgtctcttgcagggagggcaaagagctgactccacagccggacccttgaaggatcccattgtttcctaaaagactggatggacacaatgacaaccagattgctttccaccaccaattttgggaacatgtgaaaaatacggtttgctgcttgctggtatgtggtccgagatgactcataaatct

SEQ ID NO: 16444 - DNA, 178 bp, Homo sapiens
  D10S195
  Located on chromosome 10
  Distance between a terminus base of telomere on chromosomal short arm and 5'-terminus of this base sequence : 80951314
  Distance between 3'-terminus of neighbour sequence of sequence listing upward to telomere on chrosomal short arm and 5'-terminus of this base sequence : 143665
tttttgttgtgaattgcccatgtatattattggttcatgtttctgttggcttgcatgacttttagttattggtttctaggacatctttatatattcagggcatacacacacacacacacacacacacacacacacacacacacacacacatacatctggcctcgatgcctcatacatt

SEQ ID NO: 16445 - DNA, 446 bp, Homo sapiens
  AL136451.9_134517
  Located on chromosome 10
  Distance between a terminus base of telomere on chromosomal short arm and 5'-terminus of this base sequence : 81019599
  Distance between 3'-terminus of neighbour sequence of sequence listing upward to telomere on chrosomal short arm and 5'-terminus of this base sequence : 68107
atttacaaagcaggtctaatgtactggttataattatggattctggagcccagcaggcctgggttcaagtctccatatactaattggtgaccttgggaaagttatttagcctctctgtatctcagtgtcctcattggtggaacagtaataataatgctacctgcctcacagggttgttgtgaaaattaaatgagaaaaagcatgtaaagcagttggcacagcacctgtatgtgataaccactcagtaagttttagtttaacatcatcatcatcatcatcatcatcatcatcatcatcatctatttttaaaattatgatagagaatgtcagagctttgcacggttggctatggagcctgaaatgtggccacctaactcttggggtggggggtgaattcacgcggcagggagctgcaaataaccctttggtggatgctttacaatgga

SEQ ID NO: 16446 - DNA, 220 bp, Homo sapiens
  chr10.fa.O7frz.82109466
  Located on chromosome 10
  Distance between a terminus base of telomere on chromosomal short arm and 5'-terminus of this base sequence : 81122030
  Distance between 3'-terminus of neighbour sequence of sequence listing upward to telomere on chrosomal short arm and 5'-terminus of this base sequence : 101985
gagtactcaataaatgtcagcatccctcactttggtgtttcagaaatcctctcttatgcccaccccaaactgttctcctgaaataaacatggtggacgtgtgtgtgtgtgtgtgtgtgtgtgtgtgtgtgtgtgtgtgtctgtgtgtaaaatctttgtatacatggtaagttatgcatggacttctttctgggctgaagtttggctctattaacgtttct

SEQ ID NO: 16447 - DNA, 465 bp, Homo sapiens
  AC012047.5_100318
  Located on chromosome 10
  Distance between a terminus base of telomere on chromosomal short arm and 5'-terminus of this base sequence : 81139969
  Distance between 3'-terminus of neighbour sequence of sequence listing upward to telomere on chrosomal short arm and 5'-terminus of this base sequence : 17719
agaggaattgtcaggagtttataaagttctcctgtgctgggatctccaagtctcctctgccaccatctacagcccacacaaataggcatgtgaggggctggggctggggctggggcttcctggaatgtcacttctgcaagttccagttaagaggttgtgttgagttcctctaccctgtgtgctacactggggaaattaagactatattgggagtaagtcctttcaggacaaaaccactttaacaacagcagcagcagcagcagcagcagcagcagcagcagcagcagcagcagcagctactcctgtttacgtgttcttatgttctaggcactgtgccaagtgtttcacatccactctccactcattttccagtagtcttgcagtaggtactatttttcatcccattttagtgatgaggcatctgaggctcagattcattaaataactcaagtaacttgcctaagg

SEQ ID NO: 16448 - DNA, 253 bp, Homo sapiens
  AL136451.9_37657
  Located on chromosome 10
  Distance between a terminus base of telomere on chromosomal short arm and 5'-terminus of this base sequence : 81140181
  Distance between 3'-terminus of neighbour sequence of sequence listing upward to telomere on chrosomal short arm and 5'-terminus of this base sequence : -253
gtaagtcctttcaggacaaaaccactttaacaacagcagcagcagcagcagcagcagcagcagcagcagcagcagcagcagcagctactcctgtttacgtgttcttatgttctaggcactgtgccaagtgtttcacatccactctccactcattttccagtagtcttgcagtaggtactatttttcatcccattttagtgatgaggcatctgaggctcagattcattaaataactcaagtaacttgcctaagg

SEQ ID NO: 16449 - DNA, 279 bp, Homo sapiens
  Z66777
  Located on chromosome 10
  Distance between a terminus base of telomere on chromosomal short arm and 5'-terminus of this base sequence : 81360005
  Distance between 3'-terminus of neighbour sequence of sequence listing upward to telomere on chrosomal short arm and 5'-terminus of this base sequence : 219571
agcaacaagactctcagcatcacagaatcttatagattatcaaaaggaaacatagcccaagtccattaacctacaaatgttgactattatttaaaaccaaactttattacaatggagaatacagaattaacataggatacagattttgcactacagatttttctttttgtatggtgtgaaaattaaaacacacacacacacacacacacacacacacataaaaaaaaaaaactatagagaaatataaaaaatgaccaagtgctaactatggttcccagg

SEQ ID NO: 16450 - DNA, 454 bp, Homo sapiens
  AC012048.8_92649
  Located on chromosome 10
  Distance between a terminus base of telomere on chromosomal short arm and 5'-terminus of this base sequence : 81423926
  Distance between 3'-terminus of neighbour sequence of sequence listing upward to telomere on chrosomal short arm and 5'-terminus of this base sequence : 63642
cgttatcttcattctgttattgagacaatctagtgaatctatctatctatctatctatctatctatctatctatctatctctttctttctctctttctttctctctctttctttctttcttttgttaattcttttgttcattctgtctttctttcgttctgtatttctgtttttgctgttgttgttgagaatgggtctcctgttcacccaggctggagtgcagtgatgcaatcgcggctaactgtagccttgaactcttgggcttaaagatcctcctgccttggcctccctagtagctgggtctacaagcatgtgccactatgtccagctaatttttttttttcttttttgcagtgatggggtcttgctctgttgtccagactggtctcaagcccctgggctcaagtgatcctcccaccttggcctctcaaagtgtcaggattacaaacatgag

SEQ ID NO: 16451 - DNA, 93 bp, Homo sapiens
  D10S580
  Located on chromosome 10
  Distance between a terminus base of telomere on chromosomal short arm and 5'-terminus of this base sequence : 81447070
  Distance between 3'-terminus of neighbour sequence of sequence listing upward to telomere on chrosomal short arm and 5'-terminus of this base sequence : 22690
catatacgtcaggaacatctgctgttagagaagagccgtgtgtgtgtgtgtgtgtgtgtgtgtgtgtgcatgcacgcacgcgcaatatgtttt

SEQ ID NO: 16452 - DNA, 233 bp, Homo sapiens
  D10S1699
  Located on chromosome 10
  Distance between a terminus base of telomere on chromosomal short arm and 5'-terminus of this base sequence : 81576914
  Distance between 3'-terminus of neighbour sequence of sequence listing upward to telomere on chrosomal short arm and 5'-terminus of this base sequence : 129751
gctgagaagtggactgaaaccttgctgttagatgaggaaataaccctgccaattatacacacacacacacacaaacacacacacacacacattccccacactggcatgccactgcctttttcaagataggaggaatcccttaactagttatttcatcatgcatgaaaaaccccaaagtaaaaatgttggagaattaacaaaaaaaaaaaagttacagccgccaagccaatgtt

SEQ ID NO: 16453 - DNA, 411 bp, Homo sapiens
  AC024603.4_163873
  Located on chromosome 10
  Distance between a terminus base of telomere on chromosomal short arm and 5'-terminus of this base sequence : 81674815
  Distance between 3'-terminus of neighbour sequence of sequence listing upward to telomere on chrosomal short arm and 5'-terminus of this base sequence : 97668
tacctaatgctagatgacgagttagtgggtgcagcgcaccagcatggcacatgtatacatatgtaacctgcacaatgtgcacgtgtaccctaaaacgtaaagtataataaaataaataaataaataaataaataaataaataaataaataaataaaaatgccctaaattatcaggtctgacaaaaaaaaaaaaaaaaaaagaagaggtggagctgggatttagagctacatttgtctgtttctatcataggtcttctctctaatgccatgtttctttggccaccattttgatgtcatagtgaaggatgatttcatagtgaaggccattcccagttgttccagctcatggtgaatgtgctgtcttctgagggcacttaacagttgggtctgcctctttgataattaagtatg

SEQ ID NO: 16454 - DNA, 301 bp, Homo sapiens
  AC013285.7_195183
  Located on chromosome 10
  Distance between a terminus base of telomere on chromosomal short arm and 5'-terminus of this base sequence : 81693355
  Distance between 3'-terminus of neighbour sequence of sequence listing upward to telomere on chrosomal short arm and 5'-terminus of this base sequence : 18129
tgctcagatttcttcatacaagattctgtcagttttggggaagtccaaagtctttctgtgaaatttttcctgcaagttattttttgattatactccataaatgatggttcagatctattctacatatccaaagaaactgttttcttcttttttcctgttaatgtaattgcacattactaaaatttgaatgtttatggtttttgttttagataaagagctggaacaaccttttattattattattattattattattattattattgttattatttaggtatcattagctttcagactgcta

SEQ ID NO: 16455 - DNA, 211 bp, Homo sapiens
  HUMUT635B
  Located on chromosome 10
  Distance between a terminus base of telomere on chromosomal short arm and 5'-terminus of this base sequence : 81728122
  Distance between 3'-terminus of neighbour sequence of sequence listing upward to telomere on chrosomal short arm and 5'-terminus of this base sequence : 34466
gtggggaaacagacaaaccatatcatacacacacacacacacacacacacacacacacacacacacacttgtatgtatgtatatatttacattcacatataaatgtaaatgtatatatattttaaattgacatatatatgtaaatttaacattctgcagcacagaaggtttgggtggcattttggtggcaaaaagcagagtttcagcccac

SEQ ID NO: 16456 - DNA, 325 bp, Homo sapiens
  AC013738.4_44867
  Located on chromosome 10
  Distance between a terminus base of telomere on chromosomal short arm and 5'-terminus of this base sequence : 81977171
  Distance between 3'-terminus of neighbour sequence of sequence listing upward to telomere on chrosomal short arm and 5'-terminus of this base sequence : 248838
gttatggcaatcctagcaaagtaacacacacacacacacacacacacacacacacacaattattttaaacaaaattaactcagagtatgaagttttgcaattaacttttgcttttcatatttttattactatgaaaatttcacacatttagaaaagtagaaaataatataatgaacacgtatgtacctactatctatatgataagatatagcaaatctgaatgttttgctatttttgctttaagcttttttttttttttttaaaaaaaaggaataaaatactacaggtacatctgaaaccccttcagtacctaacctgaatccta

SEQ ID NO: 16457 - DNA, 85 bp, Homo sapiens
  D10S202
  Located on chromosome 10
  Distance between a terminus base of telomere on chromosomal short arm and 5'-terminus of this base sequence : 81988662
  Distance between 3'-terminus of neighbour sequence of sequence listing upward to telomere on chrosomal short arm and 5'-terminus of this base sequence : 11166
ctatgtgtttgccttggtcaattcacacacacacacacacacacacaccccaaagaaaatcttttggtgatatcttgagccctta

SEQ ID NO: 16458 - DNA, 247 bp, Homo sapiens
  AC013738.4_29876
  Located on chromosome 10
  Distance between a terminus base of telomere on chromosomal short arm and 5'-terminus of this base sequence : 81992143
  Distance between 3'-terminus of neighbour sequence of sequence listing upward to telomere on chrosomal short arm and 5'-terminus of this base sequence : 3396
gtgcatgtaatactgctaacgtatgggattcactgatgtttccttttgatgtgtgtgtgtgtgtgtgtgtgtgtgtgcgtgtgtaaggttatatgagcctttgaaaaactgtattctctatgagtagagtgtgtattcattttctagtgctgccataacaaagaaccacaaactgagtggcttaaaacactataaatgtatcgtttcacagtcccagagaggagaagtcagagatcaagtcatggtc

SEQ ID NO: 16459 - DNA, 283 bp, Homo sapiens
  AC013738.4_25425
  Located on chromosome 10
  Distance between a terminus base of telomere on chromosomal short arm and 5'-terminus of this base sequence : 81996454
  Distance between 3'-terminus of neighbour sequence of sequence listing upward to telomere on chrosomal short arm and 5'-terminus of this base sequence : 4064
ctgctttaatggaatttagactccagatttttggcaagatctggggcagagggcagttttaatcttgcttcagtttcagtcttgcaaaaagcatatttgcccaagcaaaccaataatgttgatgctgcagccattggaagagcaagcacacttcttaccatgcactaggggcttctaaagtgtgtgtgtgtgtgtgtgtgtgtgtgtgtgtgtgtgtaatttaatagtgggccagcctggtgactttgaaacaactcaagtgtctgacatgaaagcaagagac

SEQ ID NO: 16460 - DNA, 194 bp, Homo sapiens
  chr10.fa.O7frz.82985091
  Located on chromosome 10
  Distance between a terminus base of telomere on chromosomal short arm and 5'-terminus of this base sequence : 82115462
  Distance between 3'-terminus of neighbour sequence of sequence listing upward to telomere on chrosomal short arm and 5'-terminus of this base sequence : 118725
gctacggaacttaaataagcaccataattatttattcataaaaatacatcacatcagcacacatcgacacactaacacgctcgcgcacacacacacacacacacacgcacatacacacacatatttagacctaaagagagaagaaatatattccagggaagagacttcctgcctccatgcttcctaatagaatc

SEQ ID NO: 16461 - DNA, 168 bp, Homo sapiens
  DISD22_0009604
  Located on chromosome 10
  Distance between a terminus base of telomere on chromosomal short arm and 5'-terminus of this base sequence : 82188209
  Distance between 3'-terminus of neighbour sequence of sequence listing upward to telomere on chrosomal short arm and 5'-terminus of this base sequence : 72553
ggaatgaggcacaggttagagagacatagtaaaaagaaaatatatatatatatatatatatatatatatatatatatatatatccatctgcatcaaaactctgttgtattttggaaactatctaagaaactatctaagctcactaaaagcaattcaatgctagagctg

SEQ ID NO: 16462 - DNA, 434 bp, Homo sapiens
  chr10.fa.O7frz.90470199
  Located on chromosome 10
  Distance between a terminus base of telomere on chromosomal short arm and 5'-terminus of this base sequence : 82361465
  Distance between 3'-terminus of neighbour sequence of sequence listing upward to telomere on chrosomal short arm and 5'-terminus of this base sequence : 173088
gctagccttaagacctcgttcctcccttctaaactattggccaattctttttttttatacttgaaaatgtgccctttatctaatacttattatagcaaatcatgtcgatctctaatggctctgagcagatgcgccctacttggtgcacttgttccactccttgatgcagagagactgtctctcttattttagccttttgcatttaatgctttatatttgccttctctcccacccctatggtccatggccccagtaagaaggcaatatccatgaattattcttctccagaacacaatactgcacaaataaacattttctgattttcaaaacatttgtgcatatatggatgatctgtgtgtgtgtgtgtgtgtgtgtgcattcaaagcacacagcatgatttctaacatacactatgagtgcataacttggtctat

SEQ ID NO: 16463 - DNA, 399 bp, Homo sapiens
  AL355813.9_54745
  Located on chromosome 10
  Distance between a terminus base of telomere on chromosomal short arm and 5'-terminus of this base sequence : 82434176
  Distance between 3'-terminus of neighbour sequence of sequence listing upward to telomere on chrosomal short arm and 5'-terminus of this base sequence : 72277
tctagtgaaacagattagcagatctatcatctaacatagttactctgtttatctgcttctaggagtcagaaaacatatagttacttttcattcattcattcattcattcattcattcattcataatctactcatttaatgagaattcttagtacaatacaattttattaatcatagttgtcatgttgcacattagatctctagacttgcttaatcctatatatctgtcactttgtgtcctttcctgtatctcccctttccccactcccttgtgcccttaataaccactgttttattctatatctctgtatatttgtcatcttttttttccaaatattccacatataattgagatcatgcaatatgttttctgtctgtgtttggcttatttcacttaaca

SEQ ID NO: 16464 - DNA, 97 bp, Homo sapiens
  DISO7_10002908
  Located on chromosome 10
  Distance between a terminus base of telomere on chromosomal short arm and 5'-terminus of this base sequence : 82494738
  Distance between 3'-terminus of neighbour sequence of sequence listing upward to telomere on chrosomal short arm and 5'-terminus of this base sequence : 60163
acagacagaagaggtatgcatgtaattgtgtgtgtgtgtgtgtgtgtgtgtgtgtgtttctgaacatcacaggcttcattagccgatggatacaaag

SEQ ID NO: 16465 - DNA, 101 bp, Homo sapiens
  DISO7_10002910
  Located on chromosome 10
  Distance between a terminus base of telomere on chromosomal short arm and 5'-terminus of this base sequence : 82595140
  Distance between 3'-terminus of neighbour sequence of sequence listing upward to telomere on chrosomal short arm and 5'-terminus of this base sequence : 100305
ctgggaatctcatccgacagtcaacttgtgttgacagagtgagtaggactgtggcttttatttatttatttatttatttatttgcatctggatcttgggaa

SEQ ID NO: 16466 - DNA, 116 bp, Homo sapiens
  DISO7_10002911
  Located on chromosome 10
  Distance between a terminus base of telomere on chromosomal short arm and 5'-terminus of this base sequence : 82603892
  Distance between 3'-terminus of neighbour sequence of sequence listing upward to telomere on chrosomal short arm and 5'-terminus of this base sequence : 8651
tgcatatcttgagtatgcgggtttccaggtgaaacttttgcttacttatatgacatataggtttgtgtgtgtgtgtgtgtgtgtgtgtgtgtgcttcaacctcacactacttgaag

SEQ ID NO: 16467 - DNA, 145 bp, Homo sapiens
  DISO7_10002912
  Located on chromosome 10
  Distance between a terminus base of telomere on chromosomal short arm and 5'-terminus of this base sequence : 82616699
  Distance between 3'-terminus of neighbour sequence of sequence listing upward to telomere on chrosomal short arm and 5'-terminus of this base sequence : 12691
ccaagcacctaatttatattgctaaaagcaatatagattgtcataaaaccctggcacaagttgtgtgtgtgtgtgtgtgtgtgtgtgtgtgaattcgtggatttccttttccaaaaccttggggagaacagaatatccaaactct

SEQ ID NO: 16468 - DNA, 470 bp, Homo sapiens
  chr10.fa.O7frz.90873074
  Located on chromosome 10
  Distance between a terminus base of telomere on chromosomal short arm and 5'-terminus of this base sequence : 82778628
  Distance between 3'-terminus of neighbour sequence of sequence listing upward to telomere on chrosomal short arm and 5'-terminus of this base sequence : 161784
taaatgaagttattctgacctcagtagagtagtctgaaaaacataaaatggagcttctactcattattttgttttcttaaatctctccctttttaataaaagcaagatgtagcaaaacttactacttaccactacaaatttagttaatcaaaggctcaatgaagattttttttttcttaccagccattattggtctatgccatctccccttctcttaattctatttttattcatgctttggacattgataatgacaaaaaaggaaacatttgtcttcctagcaggcatacccccatcacacacacacacacacacacacacacacacacacacacacaccccttcctccacctcatctaactatttaaaaactatcaattccaactacttgaaattttaaaatatagacacgtatttggtttaacaattgccttttggaagctaaaatacttccaagtatgtcattaacc

SEQ ID NO: 16469 - DNA, 443 bp, Homo sapiens
  chr10.fa.O7frz.90966837
  Located on chromosome 10
  Distance between a terminus base of telomere on chromosomal short arm and 5'-terminus of this base sequence : 82857192
  Distance between 3'-terminus of neighbour sequence of sequence listing upward to telomere on chrosomal short arm and 5'-terminus of this base sequence : 78094
ttccggtacatcgtatactaatacaggaatgttataacccatccatgtgtagaaaacaactttattaactagattacaaggtttatgtgcagtgcattttgactttagttttataaactcctctcatttccaaagttactgaggtcagcaacttcctgcctacctgtatatacctcattcagtgaggttgcttcataattggatagtagagttaggttattttagtacattctccctgattctctaaatatatatatatatatatatatatatatatatttaatttgtgtacatcaaggttcacacttcgtactagaaaattatatggatttttacaaatgcataagattatatattcacaattacagcattatacagaatagcttccttgccctaaaacaaaattcaccatgattcccccactaaatctttattccagctcc

SEQ ID NO: 16470 - DNA, 208 bp, Homo sapiens
  DISD22_0009616
  Located on chromosome 10
  Distance between a terminus base of telomere on chromosomal short arm and 5'-terminus of this base sequence : 83059546
  Distance between 3'-terminus of neighbour sequence of sequence listing upward to telomere on chrosomal short arm and 5'-terminus of this base sequence : 201911
ccattgacaatcctaggtattaagatattatccaccttatttaagaataaaaaatagctgggcatggtggcttgtgcctgtagtcccagctacttgggaggctaggtgagaggattgcctgagcccaggagtttgaggccagcctgggcaacataaagaggtctctctctcactctctctctctctctgtcttcctatttcctaccgc

SEQ ID NO: 16471 - DNA, 152 bp, Homo sapiens
  DISD22_0009624
  Located on chromosome 10
  Distance between a terminus base of telomere on chromosomal short arm and 5'-terminus of this base sequence : 83151851
  Distance between 3'-terminus of neighbour sequence of sequence listing upward to telomere on chrosomal short arm and 5'-terminus of this base sequence : 92097
taccaagtgcttcatgtatctgtacacacacacacacatacacacacacatatatacaaacacacactatttatttgcttcatatttccagagaactaaagtatgtttactcagggaaaaacaaaatgataaaggggaacatgcaactggat

SEQ ID NO: 16472 - DNA, 125 bp, Homo sapiens
  D10S551
  Located on chromosome 10
  Distance between a terminus base of telomere on chromosomal short arm and 5'-terminus of this base sequence : 83297454
  Distance between 3'-terminus of neighbour sequence of sequence listing upward to telomere on chrosomal short arm and 5'-terminus of this base sequence : 145451
aatatgagtgggaacctgtgcagtgtgtgtgtgtgtgtgtgtgtgtgtgtgtgtttcccagcaggtgacttatttattaatactaccagcatattcacaccctggatccacctactcttaggcca

SEQ ID NO: 16473 - DNA, 269 bp, Homo sapiens
  D10S532
  Located on chromosome 10
  Distance between a terminus base of telomere on chromosomal short arm and 5'-terminus of this base sequence : 83304769
  Distance between 3'-terminus of neighbour sequence of sequence listing upward to telomere on chrosomal short arm and 5'-terminus of this base sequence : 7190
aaattgtttgtgggagtcacttattgtacttgtaatatctgtaggatctctaatggtagccccttttttcatttctgatattgataattctgtctttgtctctttctcttcctctctcttctatctctctctttctattgctctctgtgtatgtctaagtgtgtgtgtgtgtgtgtgtgtgtgtgtgtgtgtgcgcagacatgcatgtctctctcttttgattagtcttgctagggttatatcaattgcattaatttttctagagacca

SEQ ID NO: 16474 - DNA, 195 bp, Homo sapiens
  D10S1689
  Located on chromosome 10
  Distance between a terminus base of telomere on chromosomal short arm and 5'-terminus of this base sequence : 83428443
  Distance between 3'-terminus of neighbour sequence of sequence listing upward to telomere on chrosomal short arm and 5'-terminus of this base sequence : 123405
agatgtgtgtgcgtgcgtgcgtgtgtgtgtgtgtgtgtgtgtgtgaatggtacttagagatattaagattgcccaaagtcactgaaataccacagtagggcttcaagcccacatctctctgactctcaagcagaaattcttcaacacaatgcagaagaacatgttactctcctttgtggcttagacagtagtcag

SEQ ID NO: 16475 - DNA, 361 bp, Homo sapiens
  chr10.fa.O7frz.91779952
  Located on chromosome 10
  Distance between a terminus base of telomere on chromosomal short arm and 5'-terminus of this base sequence : 83526628
  Distance between 3'-terminus of neighbour sequence of sequence listing upward to telomere on chrosomal short arm and 5'-terminus of this base sequence : 97990
ataaacagatgttcttatctgcactcactcaatttttcttgtgctgccaatattttatcttattttgttctcttcctttctccattaatattttatatagtttttgtgaaattcccttcttttctcagctgagccaaatgaaaaacagattttttccccacttcacttgaagattctaaaatgaaagcagtgccgcttgccctgctctcctacttaaatacacacacacacacacacacacacacacgacacacacccatcatgatggtggccgtggaagtcagttggaccaacaccaaaagaaagctgagcccctgggaaggcagtcattaccagtgttcaactatccttacctgagagt

SEQ ID NO: 16476 - DNA, 275 bp, Homo sapiens
  G08811
  Located on chromosome 10
  Distance between a terminus base of telomere on chromosomal short arm and 5'-terminus of this base sequence : 83602760
  Distance between 3'-terminus of neighbour sequence of sequence listing upward to telomere on chrosomal short arm and 5'-terminus of this base sequence : 75771
actaagcaaaccttaactggcgacatcataatcagtaaactctttaaaaggcaatataagatagatagatagatagatagatagatagatagatagatagatagatagatgatagagcttaaatgttcatcctctgtgactcagtaaccttgctttcgaaatacatcttgagaataatacaaaatataggtgaaaaaaatacagcagacatttttcaatatggctttatttatggtagtgatgaattagaagcaaactaaatgttctacagtgga

SEQ ID NO: 16477 - DNA, 231 bp, Homo sapiens
  DISD22_0010391
  Located on chromosome 10
  Distance between a terminus base of telomere on chromosomal short arm and 5'-terminus of this base sequence : 83778279
  Distance between 3'-terminus of neighbour sequence of sequence listing upward to telomere on chrosomal short arm and 5'-terminus of this base sequence : 175244
ccagtgattccatgtacctgtatacttatccatccacccaccatccatccatccaaccatctatccatccatccatccatccatccatccatccatccatccatccatccatccaccaatccattgatctatccattcatccatccatccaccaacccattgatctgtccattcattgcatccattcatcagtaggtccatccatccatcatacatctgttcatccaggca

SEQ ID NO: 16478 - DNA, 307 bp, Homo sapiens
  chr10.fa.O7frz.93457364
  Located on chromosome 10
  Distance between a terminus base of telomere on chromosomal short arm and 5'-terminus of this base sequence : 83878742
  Distance between 3'-terminus of neighbour sequence of sequence listing upward to telomere on chrosomal short arm and 5'-terminus of this base sequence : 100232
gagcactaaatgtgaatctagactcttagaatatagcccagactctggctccaatccacagctagcctggaggtgtgtcattttgatgagctatttatctttgctctgtgtgtgtgtgtgtgtgtgtgtgtgtgtgtgtgtgtgtgtgtccaatctctgcagcttagggttcttccattccatattttggggcatactttgggcacactggactcagagtaacttttctttatacttacgttatttttgagggcaaggagatgttttgctctttcttgacttcacaggatttcaatgacctacttct

SEQ ID NO: 16479 - DNA, 420 bp, Homo sapiens
  chr10.fa.O7frz.93544710
  Located on chromosome 10
  Distance between a terminus base of telomere on chromosomal short arm and 5'-terminus of this base sequence : 83947222
  Distance between 3'-terminus of neighbour sequence of sequence listing upward to telomere on chrosomal short arm and 5'-terminus of this base sequence : 68173
ggctcatgtagttctttatacaaggccacaagaccctgctcattgaagacccttgataaggaattaaaggatgaatctattaagaatgcaggtctcagtacaagttaaactgaccctagatgcctctctctctctctctctctctctctctctctctccatatatatgtgtatatatatatatatatatatatatatatatgtatatatgtaaaacactttattaaaggaatctctgtctccatttgttgcatctgcttccttgcaaggcggtatcatgagaggaaaatgtggatttatgtattcatcctgcccaacaactacttgggcagctggtagattcatctcatttacaagccattcccttccagtttcctccatagctattaccacttctttctttcttaatgacagtgtggaa

SEQ ID NO: 16480 - DNA, 333 bp, Homo sapiens
  chr10.fa.O7frz.93302693
  Located on chromosome 10
  Distance between a terminus base of telomere on chromosomal short arm and 5'-terminus of this base sequence : 84010349
  Distance between 3'-terminus of neighbour sequence of sequence listing upward to telomere on chrosomal short arm and 5'-terminus of this base sequence : 62707
tggaagtgctagtaccaattactctctgtctccatgagttcaattgttttgatttttagatcctgcaaataagcaatttgatttgaatgttccttggtgtgtgtgtgtgtgtgtgtgtgtgtgtgtgtgtgtgtgtgtgtgtgtttattctgcttggatgcttggagttctggtgagattgcaggactctcttcatctgtctctcttctctcaacggtcacagttctgccctgcctcttgtccagtgtttgaaaacagtttttttttgtatatttatttctgcttttaagttatttattggtggaagtgctagtaccagttcctctgttatga

SEQ ID NO: 16481 - DNA, 331 bp, Homo sapiens
  chr10.fa.O7frz.92185208
  Located on chromosome 10
  Distance between a terminus base of telomere on chromosomal short arm and 5'-terminus of this base sequence : 84414569
  Distance between 3'-terminus of neighbour sequence of sequence listing upward to telomere on chrosomal short arm and 5'-terminus of this base sequence : 403887
aaactgtgactcaggttacataagaaatgaagaagaaaaatctccccaccccacacacatacacacacacacacacatacacaagtatacacacacagatatacaaacatctgcacttgccagtctaacctataaatcacaaacttttagattagcatgaaatcacacatcttagtaatcaagaagttctgttgggagtgggaagaataaagttatttgtaagtatatgggtgtagccatagaatttggagaaattcctttaaaactgcattaaataattatgcaacaatgatttgtatgcttgtgggtttaatatcaggttctgctactg

SEQ ID NO: 16482 - DNA, 410 bp, Homo sapiens
  chr10.fa.O7frz.92005565
  Located on chromosome 10
  Distance between a terminus base of telomere on chromosomal short arm and 5'-terminus of this base sequence : 84418096
  Distance between 3'-terminus of neighbour sequence of sequence listing upward to telomere on chrosomal short arm and 5'-terminus of this base sequence : 3196
ctagaaaatttggtagaaaccatatttctacgttttcaatatggttgaaatttaatgcgttggaatttttgcacatttaatgcattatgaatttaattttaatcttgattttaaaatagccattatattggagataatattttttcaatgtcttatttcttgaaattttgctagaagttgaagaccagcctgagcaacccgtctctacttactaactagccaaccaaatacacacacacacacacacacagagagagagagagagagagagagacagagagacagagagagacagacagacagcgagggcgatttcacatatattagaagttctcggccgggcatggtggctcacacctgtaatcccagaactttggcaggccaaggcgggtggatcacctgaggtcaga

SEQ ID NO: 16483 - DNA, 268 bp, Homo sapiens
  DISD22_0010414
  Located on chromosome 10
  Distance between a terminus base of telomere on chromosomal short arm and 5'-terminus of this base sequence : 84493383
  Distance between 3'-terminus of neighbour sequence of sequence listing upward to telomere on chrosomal short arm and 5'-terminus of this base sequence : 74877
tgcagtataaatagatccgccccttctattggggaaattagagctactatgtagatttatttgtggattagcatagcaaaaaaaacttattagtgagaaatggccctctgaatttcatgttgtaaagccctttgccaaagtttttgacattttagcccacattatttaaacagtgtgtgtgtgtgtgtgtgtgtgtgtgtgagagagagagagagagagaggagagagataatgcatttgtagcaaatacccctgtatcaggacaggc

SEQ ID NO: 16484 - DNA, 108 bp, Homo sapiens
  DISD22_0010427
  Located on chromosome 10
  Distance between a terminus base of telomere on chromosomal short arm and 5'-terminus of this base sequence : 84812081
  Distance between 3'-terminus of neighbour sequence of sequence listing upward to telomere on chrosomal short arm and 5'-terminus of this base sequence : 318430
caccttggcctactctggctgtgtgtgtgtgtgtgtgtgtgtgtgtgtgtgtgtgtgtatttttgtttaatcttgagctttgagcttcccctgggttatcttggaaca

SEQ ID NO: 16485 - DNA, 211 bp, Homo sapiens
  DISD22_0010429
  Located on chromosome 10
  Distance between a terminus base of telomere on chromosomal short arm and 5'-terminus of this base sequence : 84886617
  Distance between 3'-terminus of neighbour sequence of sequence listing upward to telomere on chrosomal short arm and 5'-terminus of this base sequence : 74428
gcttgttctagagtctttggactagaaaagctatggatatgagccttgcttctgatatagcagctgtttgttcttgggaaagttacttaactttttgagcctgcgttatgcaaaactgcaaaactgggatgtatatagggcctccctcacacagttattttccagattatatatatatatatgtatatatccagcacatagtaaatgctca

SEQ ID NO: 16486 - DNA, 360 bp, Homo sapiens
  chr10.fa.O7frz.92611074
  Located on chromosome 10
  Distance between a terminus base of telomere on chromosomal short arm and 5'-terminus of this base sequence : 85003518
  Distance between 3'-terminus of neighbour sequence of sequence listing upward to telomere on chrosomal short arm and 5'-terminus of this base sequence : 116690
tggaagtttcagtagctagaatagaaaacacaagtatccacaggagaatttgatacagaacagatatgtctgccagcaggtgttattaaatagtcttctctgtggtatgaaatggagtcatttgtctttctcactctgaacacacacacacacacacacacacacacacacacacacacagagagagagagagagatcactaatggtttggataatgggtgtgtttggagatactaaatactcagtgctttatgtgtattgtctctcttcagtcctaaagagggagacattattactttccccattcgtagaatgagtaaactgagttttaagtaggttaaatggtttgtacaggattac

SEQ ID NO: 16487 - DNA, 208 bp, Homo sapiens
  HUMUT1464
  Located on chromosome 10
  Distance between a terminus base of telomere on chromosomal short arm and 5'-terminus of this base sequence : 85227635
  Distance between 3'-terminus of neighbour sequence of sequence listing upward to telomere on chrosomal short arm and 5'-terminus of this base sequence : 223757
tggaggttgtggtgagctgagattgcactactgcactccagcctggtcgacagagggaggccctgtctgaaagaaagaaagaaagaaagaaagaaagaaagaaagaaagaaagaaagaaagaaagaaagaaagaaagaaagaaacagagacggagggagggaaggaagggaaagacaaatgcccagttgcagccgcagtctagaatgg

SEQ ID NO: 16488 - DNA, 452 bp, Homo sapiens
  chr10.fa.O7frz.92763455
  Located on chromosome 10
  Distance between a terminus base of telomere on chromosomal short arm and 5'-terminus of this base sequence : 85389483
  Distance between 3'-terminus of neighbour sequence of sequence listing upward to telomere on chrosomal short arm and 5'-terminus of this base sequence : 161640
ggatttggtacatgaaggactcctcatattccctaattggttctccttgctacacagaggctgactgtgagtctcaatggggatcttcgggctccacattcctaaagcagagatcactggcttcatctcattgctgcgatgagatggggtgcagaatggagcccctgtatagccgctaggccccaatacatggcctcatggcagtggacttctgtcttgatctgtgtgtgtgtgtgtatgtgcatgtgatgtacatgtgtgtgtatatgtgtgtgtgtgtgtatttgtgtgtgtttgtatatttgtgtgtgtgtttgtgtatttgtgtgtatgaatatttatgtgcgtgtgtgcatatttatgtgtgtgtgtgtgtgtgtgtgtgtgtgtgtaaagggctctacctcactattgaatcccaggtttcttgcctagactctggttattggctg

SEQ ID NO: 16489 - DNA, 101 bp, Homo sapiens
  DISO7_10002915
  Located on chromosome 10
  Distance between a terminus base of telomere on chromosomal short arm and 5'-terminus of this base sequence : 85617539
  Distance between 3'-terminus of neighbour sequence of sequence listing upward to telomere on chrosomal short arm and 5'-terminus of this base sequence : 227604
cctcacaggcacactaacaccttgccacacacacacacacacacacacacactcatccctgtgctgcccccccagccactccagtgacttcttggccttcc

SEQ ID NO: 16490 - DNA, 160 bp, Homo sapiens
  D10S1644
  Located on chromosome 10
  Distance between a terminus base of telomere on chromosomal short arm and 5'-terminus of this base sequence : 85629316
  Distance between 3'-terminus of neighbour sequence of sequence listing upward to telomere on chrosomal short arm and 5'-terminus of this base sequence : 11676
ataggtctcctcactctacaacatgaggatattaagatttgctctgggtcctatattttgaaattgtagtctgtgtgtgtgtgtgtgtgtgtgtgagagagagagagagagagagagagagagagagagagagagaggtgccccatcagggctgtgcagg

SEQ ID NO: 16491 - DNA, 101 bp, Homo sapiens
  DISO7_10002914
  Located on chromosome 10
  Distance between a terminus base of telomere on chromosomal short arm and 5'-terminus of this base sequence : 85634338
  Distance between 3'-terminus of neighbour sequence of sequence listing upward to telomere on chrosomal short arm and 5'-terminus of this base sequence : 4862
caaacaggacatgcatggtcaagcttacattcttgtgtgtgtgtgtgtgtgtgtgtgtgtgtgcatatgtgtttacatggcacacagggagtatctgcaca

SEQ ID NO: 16492 - DNA, 195 bp, Homo sapiens
  DID22N_0004258
  Located on chromosome 10
  Distance between a terminus base of telomere on chromosomal short arm and 5'-terminus of this base sequence : 85954931
  Distance between 3'-terminus of neighbour sequence of sequence listing upward to telomere on chrosomal short arm and 5'-terminus of this base sequence : 320492
attacaatagcgtaggagtgtacacacgccacagaaaagtcatcaaactggactagaaagcccagaaacacacacacaaacacacacacacacacacacacacacacacacacacacacacacacacagagtacatatagtgttactattattttaaattactggtgaaatgatgatgttgacaatgacattaat

SEQ ID NO: 16493 - DNA, 247 bp, Homo sapiens
  D10S1730
  Located on chromosome 10
  Distance between a terminus base of telomere on chromosomal short arm and 5'-terminus of this base sequence : 86054210
  Distance between 3'-terminus of neighbour sequence of sequence listing upward to telomere on chrosomal short arm and 5'-terminus of this base sequence : 99084
aagtttgagaaccactggtctatctagaatacatagtgtgcttgttccaaagcaattgtccttaccacgacccaaagagcctcacagaatagatttcggaaagtacgtgtgcgtgtgtgtgtgtgcgtgtgtgtgtgtgtgtgtgtgtgtgtgtgtgtgtgtgtgtgttgaagtttctcaggtattcaggtatgttcctctggtttaagaaccaccactgtgccaggcctctcaacagtggctgcac

SEQ ID NO: 16494 - DNA, 347 bp, Homo sapiens
  chr10.fa.O7frz.83333510
  Located on chromosome 10
  Distance between a terminus base of telomere on chromosomal short arm and 5'-terminus of this base sequence : 86151842
  Distance between 3'-terminus of neighbour sequence of sequence listing upward to telomere on chrosomal short arm and 5'-terminus of this base sequence : 97385
acctttccaggtatgctaataccctgaagagactgcaggctgaagggcattggaagtcagtctcctcagtgtccatctattgacatctctcaggccttggctggtgggtagagaggaatcccaatttatgtaaagactaagcatgatcaagctttgtgtgtgtgtgtgtgtgtgtgtgtgtgtgtgcgggcacgtgtgcctgtgtatgcgcctgtgtatgtatgagagacagaatctctctcttttacacccacccacacacacacacactccctgtattttttatgtgtgccaaagtggctgacagaaaatgaaatctgcatgagatactcatttaaagcattgca

SEQ ID NO: 16495 - DNA, 463 bp, Homo sapiens
  AC021027.5_22216
  Located on chromosome 10
  Distance between a terminus base of telomere on chromosomal short arm and 5'-terminus of this base sequence : 86276214
  Distance between 3'-terminus of neighbour sequence of sequence listing upward to telomere on chrosomal short arm and 5'-terminus of this base sequence : 124025
ctgaggtcaggtattcaagaccagcttggtcaacatggtgaaaccccatctctactaaaaatacaaaaattagccaggagtcgtggcgcatgcctgtaatcccagctactcaggaggctgaggtgggagaatcacttgaacccaagaggcagaggttgtagtgagccgagatcgtgccactgcactccagcctgggtgacagagcaagattccctctcaaaataaataaatacatacatacatacatacatacatacatacatacatacatacatacataaaaatgaaatgcttcccttttcaaatgaggagtgggaacacttagattacagtgctaagttctttttgtctgtgaggtaaggagaagagcctgcgcctaggtgaccttggcctggtcagagatgctgggacagcctggacgtgggaaagaagggatctacgcaggtctgtccacagcacattc

SEQ ID NO: 16496 - DNA, 104 bp, Homo sapiens
  D10S605
  Located on chromosome 10
  Distance between a terminus base of telomere on chromosomal short arm and 5'-terminus of this base sequence : 86392236
  Distance between 3'-terminus of neighbour sequence of sequence listing upward to telomere on chrosomal short arm and 5'-terminus of this base sequence : 115559
gcaaactgtgggcctcaccctggggggaaatgggtttagaagtcatacacacacacacacacacacacacacacacacacacacaccctacatataccaccagg

SEQ ID NO: 16497 - DNA, 266 bp, Homo sapiens
  D10S206
  Located on chromosome 10
  Distance between a terminus base of telomere on chromosomal short arm and 5'-terminus of this base sequence : 86618082
  Distance between 3'-terminus of neighbour sequence of sequence listing upward to telomere on chrosomal short arm and 5'-terminus of this base sequence : 225742
ccaaaacgtggtcacagataggtcaaaaatctgaaagaggagtgagaaacactaatctagtcgaaacctatactaatggtgtgaatcgccaatccattcctcttttgaaacacacacacacacacacacacacacacacacgcacgcacgctctcaaggggcctttacccagtgaaccaaaaaggtttccctttccacatgtgttccatgaggagattccctgcctatcactttcttgccttgccaaggtgcattttcatggatcc

SEQ ID NO: 16498 - DNA, 144 bp, Homo sapiens
  D10S569
  Located on chromosome 10
  Distance between a terminus base of telomere on chromosomal short arm and 5'-terminus of this base sequence : 86621389
  Distance between 3'-terminus of neighbour sequence of sequence listing upward to telomere on chrosomal short arm and 5'-terminus of this base sequence : 3041
aggacttctggcctcctatcttctactagcctattaggttgagagatggaaaaaccaaaactgtgtgtgtgtgtgtgtgtgtgtgtgtgtgtgtgtgagagagagagagagagagagcatttacatttgcagaacattatactt

SEQ ID NO: 16499 - DNA, 236 bp, Homo sapiens
  chr10.fa.O7frz.84077941
  Located on chromosome 10
  Distance between a terminus base of telomere on chromosomal short arm and 5'-terminus of this base sequence : 86714116
  Distance between 3'-terminus of neighbour sequence of sequence listing upward to telomere on chrosomal short arm and 5'-terminus of this base sequence : 92583
tcacatttgatttagctggtatctgcagaaagcagcagtagggatttagaaatgcataaaaatagtgttactttttgggatgaagagtggcatgagactgatatctatatatatatctatatagatatagatatatatttggaggcattgaaacctgcttgatttattctgattatttaatacacactgacgcaactgtgatcccaaagagtgcaaagttaaagccttcaactgca

SEQ ID NO: 16500 - DNA, 180 bp, Homo sapiens
  DISO7_00000310
  Located on chromosome 10
  Distance between a terminus base of telomere on chromosomal short arm and 5'-terminus of this base sequence : 86791076
  Distance between 3'-terminus of neighbour sequence of sequence listing upward to telomere on chrosomal short arm and 5'-terminus of this base sequence : 76724
tcactcaacttaggcaggtctaggagacagtggtagggacacacacacacacacacacacacacgagctgactttgcacacaagcacaccactatcaggggccttgccacatgtgggatggggacctgccccacaagaagcctgtgggtcctgcccctgggaagcatttctggacatgag

SEQ ID NO: 16501 - DNA, 403 bp, Homo sapiens
  chr10.fa.O7frz.84227183
  Located on chromosome 10
  Distance between a terminus base of telomere on chromosomal short arm and 5'-terminus of this base sequence : 86851343
  Distance between 3'-terminus of neighbour sequence of sequence listing upward to telomere on chrosomal short arm and 5'-terminus of this base sequence : 60087
ctcagagtaaacagtatggtaccttctcaaaaaattgaacacagaattaccatatgacccagcaagttcacttctgggtataaacccaaaagaagagaaagcagggactcgaagagatatttgtacacccatggtgtcatagcagcattattcacaatggctaaaaggtgaaaacaacccaaatgtgtccatcaacaggtaaagaaacaaataaaatatagaatatatatatatatatatatatgaatattattcggcctaaaaaaggaattttgacatatactaaaatatggatgaaccttgaggactttatgcttagagaagtaagccagtcacaaaaagacaaatctgtattgacttcacttataaaagatacctaaagtagtcaaattcctagaaacgg

SEQ ID NO: 16502 - DNA, 104 bp, Homo sapiens
  D10S1200
  Located on chromosome 10
  Distance between a terminus base of telomere on chromosomal short arm and 5'-terminus of this base sequence : 86994298
  Distance between 3'-terminus of neighbour sequence of sequence listing upward to telomere on chrosomal short arm and 5'-terminus of this base sequence : 142552
gggtgacaggtactttaagaaatgcttgtgtgtgtgtgtgtgtgtgtgtgtgtgtattacattctgtagatatatgcacctatgcatctaccaggattctccta

SEQ ID NO: 16503 - DNA, 153 bp, Homo sapiens
  Z67495
  Located on chromosome 10
  Distance between a terminus base of telomere on chromosomal short arm and 5'-terminus of this base sequence : 87005734
  Distance between 3'-terminus of neighbour sequence of sequence listing upward to telomere on chrosomal short arm and 5'-terminus of this base sequence : 11332
tcctgatgttggaatcatgtctttactgaataacaaactgtgtgtgtgtgtgtgtgtgtgtgtgtgtgtgtgtgtgtgtgtatgtgtgtgtgagagagagagagttagacaaaaggaggccttggcattaggccttttaatgagcaaagtgac

SEQ ID NO: 16504 - DNA, 250 bp, Homo sapiens
  Z67025
  Located on chromosome 10
  Distance between a terminus base of telomere on chromosomal short arm and 5'-terminus of this base sequence : 87084810
  Distance between 3'-terminus of neighbour sequence of sequence listing upward to telomere on chrosomal short arm and 5'-terminus of this base sequence : 78923
cacatcgtaagccaaggagcatctgtatatatatatgtgtgtgtgtgtgtgtgtgtgtgtgtgtatatgtgtgtgtgtgtgtgtatatgtgtgtgtatatatgtgtgtatatatatgtatatatataaatatatataatttctagtagccaataatatattttattttattttgttttgtttttagagatggagtcttgctatgttacccagtctagtctcgaactccagggctcaagtaatctgactgc

SEQ ID NO: 16505 - DNA, 174 bp, Homo sapiens
  D10S607
  Located on chromosome 10
  Distance between a terminus base of telomere on chromosomal short arm and 5'-terminus of this base sequence : 87243429
  Distance between 3'-terminus of neighbour sequence of sequence listing upward to telomere on chrosomal short arm and 5'-terminus of this base sequence : 158369
caaagttgtggtggttgtggtggtggtggtagtgtgtgtgtgtgtgtgtgtgtgtgtgtgtgtgtgtgtgtacctaaaatgcaacccttcctccttcccctaggaaaggctagcttcaggtaggcctgcttcccccactccaccttcctccaggaagccgtccctgaccacccc

SEQ ID NO: 16506 - DNA, 462 bp, Homo sapiens
  chr10.fa.O7frz.84677283
  Located on chromosome 10
  Distance between a terminus base of telomere on chromosomal short arm and 5'-terminus of this base sequence : 87408426
  Distance between 3'-terminus of neighbour sequence of sequence listing upward to telomere on chrosomal short arm and 5'-terminus of this base sequence : 164823
ccagtacaatgttgaataggactggtaaaactagacatccttgccttgttcctgatcttagaaggaaagcaccctgtcttttaccattaaatatgaagtaaggatgggcatagtggatcacacctataatctcaacacttcaaaaggccaaggcaggtagatctcctgagttcaggagtttgagaccagtctgggcaactgggcaacatgacaaaacctcttctctactaaataaataaataaataaataaataaataaataaataaataagcaagacagccaggtatggtggcatgcacctgtagtccctgctacttggggagctgaggcgggaggttgaggctgcagtgagccatgtttgtgtcactacattccagcttggttgacaaagagagtccctgtctcaaaaaataaatgaagatagctgtgggtttttcatagacactctttgtcagactgag

SEQ ID NO: 16507 - DNA, 276 bp, Homo sapiens
  AC073371.1_243562
  Located on chromosome 10
  Distance between a terminus base of telomere on chromosomal short arm and 5'-terminus of this base sequence : 87556801
  Distance between 3'-terminus of neighbour sequence of sequence listing upward to telomere on chrosomal short arm and 5'-terminus of this base sequence : 147913
gcctgtaatgcaaactactcaggaggctgaggcaggagaagcacttgagtccaggaggcggagattgcagtgagctgagattgtgccactgcactccagcctgggcaacagagcgagactctatctcaaaataaaataaaataaaataaaataaaataaaataaaataaaataaaataaaaaacaataaaataaaaaattaaatatataacctaaaatctcctaaaatatatatccaggtccagatgccttcactggtgaattctaccaaatagtt

SEQ ID NO: 16508 - DNA, 236 bp, Homo sapiens
  Z66635
  Located on chromosome 10
  Distance between a terminus base of telomere on chromosomal short arm and 5'-terminus of this base sequence : 87615918
  Distance between 3'-terminus of neighbour sequence of sequence listing upward to telomere on chrosomal short arm and 5'-terminus of this base sequence : 58841
agctattggtgctgtgcttcctgtacagcctgcagaaccatgaatcaatcaaaccttttttctttataaatttcccagtctcaggtatttctttatagcaatgtgagaatgaactaatacacacacgcacgcacacacacacacacacacacacacactcacatcttcaaattggcccccaggaataatgtacaattaaacttctagtgcagtttagacccaagtgctgatgacag

SEQ ID NO: 16509 - DNA, 255 bp, Homo sapiens
  HUMUT920
  Located on chromosome 10
  Distance between a terminus base of telomere on chromosomal short arm and 5'-terminus of this base sequence : 87812830
  Distance between 3'-terminus of neighbour sequence of sequence listing upward to telomere on chrosomal short arm and 5'-terminus of this base sequence : 196676
ctcacatgttatctcatgtgctgtattgttctctttctattttgcttctctgaactatttgagaattaaattggagttgttgtttgccattcatcttaaatgctgtagtgtgtctttctttcttttctttctctttctttctttctttttctttctttctttttttctttctttcttctttctttcttccatctttctatctctctttcttttttttgacagagttttgctctttcacccaggctggagtgaaat

SEQ ID NO: 16510 - DNA, 217 bp, Homo sapiens
  G10109
  Located on chromosome 10
  Distance between a terminus base of telomere on chromosomal short arm and 5'-terminus of this base sequence : 87851870
  Distance between 3'-terminus of neighbour sequence of sequence listing upward to telomere on chrosomal short arm and 5'-terminus of this base sequence : 38785
aagcaacattaggtacatacaagcacagatagataactagctagctagatagatagatagctagctagctagatagatagatagctagctagctagatagatagatagctagatagatagatagatagatagatagatagatagatagatagatagatagatagacagacagatagatagacatctttatgcaggcatattcacacacatctttcaa

SEQ ID NO: 16511 - DNA, 276 bp, Homo sapiens
  AL358034.6_104691
  Located on chromosome 10
  Distance between a terminus base of telomere on chromosomal short arm and 5'-terminus of this base sequence : 87952862
  Distance between 3'-terminus of neighbour sequence of sequence listing upward to telomere on chrosomal short arm and 5'-terminus of this base sequence : 100775
agatagtaaagttcggtggaagtttttttatttttttaagcagatttttcctattactcaattgtttaagttatcaaagcacacaagttggtatctctggttgtttcatctctgcaagccaagagcatagcttaatgcttgacacagagtaaaggctcagtaaattttgatagaaagaaagaatggatggatggatggatggatggatggatgaatggataaatgaatatatggatggatagatgaacagatggatagatggacattggatgtatg

SEQ ID NO: 16512 - DNA, 95 bp, Homo sapiens
  D10S219
  Located on chromosome 10
  Distance between a terminus base of telomere on chromosomal short arm and 5'-terminus of this base sequence : 88171762
  Distance between 3'-terminus of neighbour sequence of sequence listing upward to telomere on chrosomal short arm and 5'-terminus of this base sequence : 218624
tctttctaccaccccccccacccccaacacacacacacacacacacacacacacacacacacacacatattcaggggatgctttaggttctctgc

SEQ ID NO: 16513 - DNA, 177 bp, Homo sapiens
  D10S1667
  Located on chromosome 10
  Distance between a terminus base of telomere on chromosomal short arm and 5'-terminus of this base sequence : 88183544
  Distance between 3'-terminus of neighbour sequence of sequence listing upward to telomere on chrosomal short arm and 5'-terminus of this base sequence : 11687
gccttgatttcctatcagcattgatgtggttgctgttgttgttgggttgttgttgtggggtgtgtgtgtgtgtgtgtgtgtgtgtgtgtgtgtgtgtgtgtgtcttaactgccatgggttttaaagccatggtggaaagtgaggaaaatagcagatgctagatccaattgccaccaa

SEQ ID NO: 16514 - DNA, 435 bp, Homo sapiens
  AL139242.5_154365
  Located on chromosome 10
  Distance between a terminus base of telomere on chromosomal short arm and 5'-terminus of this base sequence : 88242754
  Distance between 3'-terminus of neighbour sequence of sequence listing upward to telomere on chrosomal short arm and 5'-terminus of this base sequence : 59033
aatcaataccttggtgtcctagacacggctgggggtggggacggtgaacatgcggccttctctccttcttcccagggctggcccactgtcagcaccaacagcggcagcgtggggctccgctcttgaccattggctccctgtatggctttgagaagttgctgcctttccctggactcagctttgccacctgtaaaatgggtgaagggcagctgttaaactgaaaagaacattgaatgaaccattgttcactaccacgtcttagtccctggcacagagcagtggccccattgatattctgttaattgagtgagtgagtgagtgagtgagtgagtgagtgattctcatgcgtctctaggtagctgtcttgagtgaaggaggtggtactggctataggatattgtgactgtagctctgttataatttggagtgacagtc

SEQ ID NO: 16515 - DNA, 285 bp, Homo sapiens
  D10S201
  Located on chromosome 10
  Distance between a terminus base of telomere on chromosomal short arm and 5'-terminus of this base sequence : 88347640
  Distance between 3'-terminus of neighbour sequence of sequence listing upward to telomere on chrosomal short arm and 5'-terminus of this base sequence : 104451
agctcatgggatggaagcatctgaaaatgtatcattcatatttttattggaatcatgaatcccacttgccacctgccagggcatggtttgaggatgagagggccctgcttcaagatgctgctgccattgcttcgcaggcctcttcctgggcccctctgagtgctgccccatccctgggggtctcctgggtctcagaagcacccctcccaacacctccccccaacacacacacacacacacacacacacacacacactttctctgttctccagcagccttttagct

SEQ ID NO: 16516 - DNA, 253 bp, Homo sapiens
  AL133481.7_136736
  Located on chromosome 10
  Distance between a terminus base of telomere on chromosomal short arm and 5'-terminus of this base sequence : 88504261
  Distance between 3'-terminus of neighbour sequence of sequence listing upward to telomere on chrosomal short arm and 5'-terminus of this base sequence : 156336
tggttcatgtctatagttccagctactcaggaggcaggagaatcgcttgaactcgggaagcggaggctgcagtgagctgagatcatgccactgcactgcagcctgggcaacagagcaagtttctatctcaaaataataataataataataataatgacagtaattaacagtcctaagagttactacttgcagtgcaagcaaggtgccaggcactgttataaacacttcagataaaataactcggttaagctca

SEQ ID NO: 16517 - DNA, 397 bp, Homo sapiens
  AL133481.7_71310
  Located on chromosome 10
  Distance between a terminus base of telomere on chromosomal short arm and 5'-terminus of this base sequence : 88568781
  Distance between 3'-terminus of neighbour sequence of sequence listing upward to telomere on chrosomal short arm and 5'-terminus of this base sequence : 64267
atttagatggttagcctctgtaactctacattaaagtagagtttgcttatggatctgtttcttaatttaccaacattagataatgaaaagtaatcatttagttcacataaactcctttttctcttcttctttgattcatctatctatctatctatctatctatctatctatctatctatctatctatcttctaatctgttttctactggctatatttgaacatttaaacaattacttattttctatttcttttttaaaattaattctattcaccatcttgacaaccctgtatgatgataagactattaactcctcccttttcttacgtttttccccccattaatggagcattccattggctacacattgatttttctattgtcaagatagttggcag

SEQ ID NO: 16518 - DNA, 289 bp, Homo sapiens
  chr10.fa.O7frz.86122953
  Located on chromosome 10
  Distance between a terminus base of telomere on chromosomal short arm and 5'-terminus of this base sequence : 88647103
  Distance between 3'-terminus of neighbour sequence of sequence listing upward to telomere on chrosomal short arm and 5'-terminus of this base sequence : 77925
ctttctatgacctagaaatgacaaattttaattttcatcaacacagccctctcacctcactaccctgagcattttgagtcttccaaaccccagagaaacacgtcatgttttattaaggctttgaggtgagggagacagtttttcccattctgcgccttggaggaattgaaactggcagatggcagcaactatctccaatgaaataggctcaggaaaacacacgtgcacatacacacacacacacacacacgcacacacacacactgactttgcatcaataagaccatac

SEQ ID NO: 16519 - DNA, 138 bp, Homo sapiens
  DISO7_10002905
  Located on chromosome 10
  Distance between a terminus base of telomere on chromosomal short arm and 5'-terminus of this base sequence : 88712843
  Distance between 3'-terminus of neighbour sequence of sequence listing upward to telomere on chrosomal short arm and 5'-terminus of this base sequence : 65451
cacatgtgcgtgtttgtgtgcgtgtgtttgtatgtgtgtgtgtgtgtgtgtgtgtgcatgcgtttgtctggtggaaaatctatgcattcttctgaaaataaatatctgaagaaaactacccctgggaacctgtgactc

SEQ ID NO: 16520 - DNA, 243 bp, Homo sapiens
  DISO7_10002906
  Located on chromosome 10
  Distance between a terminus base of telomere on chromosomal short arm and 5'-terminus of this base sequence : 88717064
  Distance between 3'-terminus of neighbour sequence of sequence listing upward to telomere on chrosomal short arm and 5'-terminus of this base sequence : 4083
aaccaagaagagggcaatatacaaatctacacaaatgaattgtttagagtgtggggtgtgtgtgtgtgtgtgtgtatgtgtgtgtccgtgtgtgacagagaggaagaaagaaagagattacatgaaaatggaaatgtggatcttttcatagtaatagaggggtgaaaatgtccaaaaataaatttgctaactcttgagtaaactgaaatgcacatatgaaagctttgtaattcatccatgaac

SEQ ID NO: 16521 - DNA, 405 bp, Homo sapiens
  chr10.fa.O7frz.87200044
  Located on chromosome 10
  Distance between a terminus base of telomere on chromosomal short arm and 5'-terminus of this base sequence : 88972472
  Distance between 3'-terminus of neighbour sequence of sequence listing upward to telomere on chrosomal short arm and 5'-terminus of this base sequence : 255165
cattaactcatcaactttgaatggagtttgactgtaatcctggctcagttactctttttttccccttaactgaaatgagtttttctgtacttttaggagggaggagtggctctaggatgacttcacagccttagaggtcccattttcacagtgatttaaaagaatatatatatatatatatataatgaaaatacatatatatagtgtctccgtatcttgacctttcttcccaatacttatctagatcttctttcttttgtcctattttacccatcctgcccatttggattctaattctagaagtttgtcctcagtgctgggctttgtctcataagcttcaagaggtacacagtgtaaaacccagactgctctaatgcgatcatcagaccttatcatattgcttta

SEQ ID NO: 16522 - DNA, 355 bp, Homo sapiens
  chr10.fa.O7frz.87424440
  Located on chromosome 10
  Distance between a terminus base of telomere on chromosomal short arm and 5'-terminus of this base sequence : 89282386
  Distance between 3'-terminus of neighbour sequence of sequence listing upward to telomere on chrosomal short arm and 5'-terminus of this base sequence : 309509
agattgttcttatacatgctcaagtttgaaaaccacagcccttgagaatgctagggacaacagtccataaggagcctggtgccaagacaatctcatggaacacacacttaacctcgaccctgatttttcaagaaagagtgagagagtgagtgagagagagagagagagagagacggggctcctctcttcattcacaaccaaacctgaaacgtaatacaggtggcgtggggaagatgacgatgagaaacttaacccaacagcaaaaatcaggaaaggaatgcatgcaagtataataagtaataagcaagatgcaaagaataaaatcaagtatatctggtatgtcaacagtcagaat

SEQ ID NO: 16523 - DNA, 423 bp, Homo sapiens
  AC021028.5_204487
  Located on chromosome 10
  Distance between a terminus base of telomere on chromosomal short arm and 5'-terminus of this base sequence : 89513117
  Distance between 3'-terminus of neighbour sequence of sequence listing upward to telomere on chrosomal short arm and 5'-terminus of this base sequence : 230376
cttgttctacgtgctcaagtacatggtctcatgtcttcctcacaaccagtctaggatgttaggcatttttattcccatccacatatacagcagttggcctagagatttaaaataactcagccaaagacacagctaagtggtacaatggaaatgaaacttaggaactcaaatctgtcaaactccagagacccttcccggcccggccctgccctgccccgccccgcccctagcctctcctgccctgccctgcccctagcctctcctgccctgccctgccctgccctgcccctagcctctcctgccctgccctgcccctagcctctcctgcccttccctgcccctagcctctcctgccctgccctgcccctagcctctccttggaggtgtttcccagcgaccacttcctgatgtccttatgcttgg

SEQ ID NO: 16524 - DNA, 387 bp, Homo sapiens
  AC021028.5_79926
  Located on chromosome 10
  Distance between a terminus base of telomere on chromosomal short arm and 5'-terminus of this base sequence : 89596392
  Distance between 3'-terminus of neighbour sequence of sequence listing upward to telomere on chrosomal short arm and 5'-terminus of this base sequence : 82852
gagcagattcctagaactcaacagtgcacgggggctgtgggtacacatcattaactggggaacagtagtggagaattattttctttctttttctctttcttttatttttgagacagggtcttgctgtgtcgcccaggctggagtgtagtggcatgatcttggctcactggaacctctgtctcctgggttcaagcgattctcctgcctcagcctcctgagtagctgggattacaggtgcacgccaccacacccggctaattattttctgtttgttgttgttgttgttgttgttgttgtttggttttattttagagacagtgtctcactctgtcactcaggctggagtgcagtggtgcgatctcagctcactgtacaaccattgcttcc

SEQ ID NO: 16525 - DNA, 387 bp, Homo sapiens; identical to SEQ ID NO: 16524
  AC063966.3_113163
  Located on chromosome 10
  Distance between a terminus base of telomere on chromosomal short arm and 5'-terminus of this base sequence : 89596392
  Distance between 3'-terminus of neighbour sequence of sequence listing upward to telomere on chrosomal short arm and 5'-terminus of this base sequence : -387

SEQ ID NO: 16526 - DNA, 442 bp, Homo sapiens
  chr10.fa.O7frz.90380999
  Located on chromosome 10
  Distance between a terminus base of telomere on chromosomal short arm and 5'-terminus of this base sequence : 89767652
  Distance between 3'-terminus of neighbour sequence of sequence listing upward to telomere on chrosomal short arm and 5'-terminus of this base sequence : 170873
gttactatcatgaaacaaatcgtctcacatagttatctatttttcctctgtggcaggagcagttacaatctagtcatttagcaaaaatcctgaatacaatacactataattaactatagtcttcatgttgtactttgtatctttaaatttgttcatcctacatatctgctacttagtatcttttgacctacatctccccatttcctacccttaatcctgcctctggtagccactattttattctctatctcaaacacacacacactctctcacacacactctctctctcacacacacacacacacacagcccacaagagattaaaaacagagttaccatatgacccagcaattcctcttctgggtatatactcaaagaaaataaaatcaccacctcataaagatatctccatgcccatgttcattgcaacattatttagaat

SEQ ID NO: 16527 - DNA, 480 bp, Homo sapiens
  chr10.fa.O7frz.90263053
  Located on chromosome 10
  Distance between a terminus base of telomere on chromosomal short arm and 5'-terminus of this base sequence : 89886865
  Distance between 3'-terminus of neighbour sequence of sequence listing upward to telomere on chrosomal short arm and 5'-terminus of this base sequence : 118771
caatgtgagtcctagcataattacctcaaatttggcttgctacctctacatctcagtgtaggattgtatttattcttaccaaccctccacctaattctacagacagaaacatacagacacacacacacacacacacacacatgcacacacacacacacacacacacaaacacacacgggggggcggggtgagagagagagagagacaaggagtgaagattagtgattgaaaacacataatgaaatcctgcttaagaagatttcttcctaacattttgaagacacacaagattatatattcctagactaaacccatcagtgactacagccgcaattttagtttaggatcactggatatttaagtaaggcaacatcctttggacagtgttcaaactgaatacttacattcagtaaatcaaacgaataattgtaattacttttcttaaatgacagagaaaactgccatgcttatttaacatac

SEQ ID NO: 16528 - DNA, 349 bp, Homo sapiens
  AL356129.2_109676
  Located on chromosome 10
  Distance between a terminus base of telomere on chromosomal short arm and 5'-terminus of this base sequence : 90122261
  Distance between 3'-terminus of neighbour sequence of sequence listing upward to telomere on chrosomal short arm and 5'-terminus of this base sequence : 234916
ctacactagcataaaggaagtgacttttcaagacacagatccacaactctcactggctcccaatcacatcagtgcaggtgaattggtggcccagaggtcagctaaaccctccagattacaaaataataaataaataaataaataaataaataaataaataaataaatgtaatgttttcaaaattaaaatgtttctttaaaacaatctagttatctgcctcgtatgtgtccacttctagaaaaaatggctagaacaacctcctctagatcagtttcattagactgggcaagcagccttcagctggacacagcccccactatcctgctcctgatttacatttctgcttgac

SEQ ID NO: 16529 - DNA, 389 bp, Homo sapiens
  AL096705.12_95741
  Located on chromosome 10
  Distance between a terminus base of telomere on chromosomal short arm and 5'-terminus of this base sequence : 90227649
  Distance between 3'-terminus of neighbour sequence of sequence listing upward to telomere on chrosomal short arm and 5'-terminus of this base sequence : 105039
tacgatgttgagtaacttgtcctaattggcaagcagcagacctgaaatttggagtcttggagctaggggtggaactgatgttctctctgactccaaaaaccctccgagtgtgtgtgtgtgtttgtgtgtgtgtgtgtgtgtgtgtgtgtgtcttgttttaaaaatcgaggctttgtgttgtcaaatccatgcatctcctgggctactatgtcatttgagctaaggaaaacaaatccaggtcagtagcagtgccaccagctgtgaaacaggtcaaggaaaacagcaatcattgagcccaggaaattaccagggggatcaggggatgccatgttgttgttctcagacagagataaaaataaatcagcttctcctgtagagtgcagaaggta

SEQ ID NO: 16530 - DNA, 351 bp, Homo sapiens
  AL096705.12_92525
  Located on chromosome 10
  Distance between a terminus base of telomere on chromosomal short arm and 5'-terminus of this base sequence : 90230815
  Distance between 3'-terminus of neighbour sequence of sequence listing upward to telomere on chrosomal short arm and 5'-terminus of this base sequence : 2777
atagctaaccagaggtcaggaggccgtggctacatgaatgagtgagggtctatgtttctgagtctctagcacactttggagcatgccttttagttatgtgtacgtaagtgttgatctttgtgttcttgtctggccttgtctctgggtctctcttttcatgcgtgtgtgtgtgtgtgtgtgtgtgtgtgtgtgtgtgtgtgttcacatatgcatacatctctgtgtgtttacatgagggtctctaggtctcttggctcctatggacattagccctcatcttgcttgctcacctgtaattgtcaatcccagctgtgtcattgtgtcatctggtcaatgtccttgtacctgtgt

SEQ ID NO: 16531 - DNA, 257 bp, Homo sapiens
  D10S1786
  Located on chromosome 10
  Distance between a terminus base of telomere on chromosomal short arm and 5'-terminus of this base sequence : 90230837
  Distance between 3'-terminus of neighbour sequence of sequence listing upward to telomere on chrosomal short arm and 5'-terminus of this base sequence : -329
gccgtggctacatgaatgagtgagggtctatgtttctgagtctctagcacactttggagcatgccttttagttatgtgtacgtaagtgttgatctttgtgttcttgtctggccttgtctctgggtctctcttttcatgcgtgtgtgtgtgtgtgtgtgtgtgtgtgtgtgtgtgtgtgttcacatatgcatacatctctgtgtgtttacatgagggtctctaggtctcttggctcctatggacattagccctcatct

SEQ ID NO: 16532 - DNA, 435 bp, Homo sapiens
  AL096705.12_89508
  Located on chromosome 10
  Distance between a terminus base of telomere on chromosomal short arm and 5'-terminus of this base sequence : 90233815
  Distance between 3'-terminus of neighbour sequence of sequence listing upward to telomere on chrosomal short arm and 5'-terminus of this base sequence : 2721
ctcctaccttctgattggaatatcaattgggggtgagaaaaagaaaaatatggaaactcacaatactatcaaaactgaaggctggcaatcgaatggcaattttgaaaaagctgactctatttgtaatgatggccattaacatttaatgatgcttattatatacctatatatatttacatatatatatatatatatatatatatatatatatatatatacaccacaagttttataaacatcatctcattcaattctcacaattattccccattttaaaaatgagaaaattaagctttagtgagacttcgcccaaggtcaaacaactaataaatgaaaaagctgagactcagaatcaggtgttgaatggtgaaccatatggattttcatggagaaaataaatacccaggtttggacaagacgcatattaagttcaag

SEQ ID NO: 16533 - DNA, 412 bp, Homo sapiens
  AL096705.12_72257
  Located on chromosome 10
  Distance between a terminus base of telomere on chromosomal short arm and 5'-terminus of this base sequence : 90251156
  Distance between 3'-terminus of neighbour sequence of sequence listing upward to telomere on chrosomal short arm and 5'-terminus of this base sequence : 16906
gatacctgcactcataattcatttcagcattatacacattagccaaggtataaaagcaatgtaattgcccaccaaatgatcaaaggataaagaaaacacacacacacacacacacacacacacacacaatggaatactatatagccttacacaaaaaagaaattctgtcatttgtgacaacatggatgaaactgaaagacattatgttaagtaaaataaactaagtacagagacaaatactgtatgatttcacttacatgtagaatctaaaaaagtcaaactcatagaagcagagagtacagtggtgtttatcagaggttgatagggagaatggggaaaggtgcaatgttgaccaaaaggtaaaaagtttcagctaaacagtaggaataagttgtaacatagcatggtgacc

SEQ ID NO: 16534 - DNA, 292 bp, Homo sapiens
  AL096705.12_16137
  Located on chromosome 10
  Distance between a terminus base of telomere on chromosomal short arm and 5'-terminus of this base sequence : 90307130
  Distance between 3'-terminus of neighbour sequence of sequence listing upward to telomere on chrosomal short arm and 5'-terminus of this base sequence : 55562
caattccactcctaggtctttacctaagataaatcaaactgtatgttcacccaaaagccatatgctaatgtgcataagagctttatatatatgggtgtgcctatatatatatatcacagatatatataacatatatctgtatctaacatatatattacagatacatatcacatatatatattacagatatatatattacagatatatatatatatatattacagatatatatatatgtatctgggagtgtgtgtgtgtgtgtgtgtgtgtgtgtaaccatctggaaactgaa

SEQ ID NO: 16535 - DNA, 282 bp, Homo sapiens
  AL096864.11_75412
  Located on chromosome 10
  Distance between a terminus base of telomere on chromosomal short arm and 5'-terminus of this base sequence : 90398719
  Distance between 3'-terminus of neighbour sequence of sequence listing upward to telomere on chrosomal short arm and 5'-terminus of this base sequence : 91297
atttagcattacacagctgaagacagacacaacgtacaacctaaaaatttgatctttaagtttgtatgctaaaaaaactcatgtgttttcataaggtgaaataaaatttctcattatactgaaaggtgattcacacacacacacacacacacacacaaaatacacatttcctctatgttaccttaggaattttttgaaatattgtcttattcaccagtgtaagggtagactacttttacttagtaaaagtaatctgaaagaaagcgtacgttagtgaatcag

SEQ ID NO: 16536 - DNA, 415 bp, Homo sapiens
  AL096863.12_16375
  Located on chromosome 10
  Distance between a terminus base of telomere on chromosomal short arm and 5'-terminus of this base sequence : 90434772
  Distance between 3'-terminus of neighbour sequence of sequence listing upward to telomere on chrosomal short arm and 5'-terminus of this base sequence : 35771
agaagcaatatttaaatcggagtctcctctaaaaaatctccttctagcagtaaagatagacagctaaaaaaaaatagtgcaatatcttgtgacaaatgttggaatgaaatctgtatgaagagattgagttaaaacgggcattggaatacaagactctacttttgtaaatacatgcacagatatacacagaagtgcatgtgcacacacacacacacacacacacacacactcaaaatgtccagacatgagagaaatcagcaggtattattaagttgcctcaacctagcaacaggcaaatgtggaatgatttactttttctagtacctgatactatatgtgctttctgaattatcagcaccaggtgaactggtgacgggaaaggtaacttactcttgtcaactacaagtatcaggct

SEQ ID NO: 16537 - DNA, 203 bp, Homo sapiens
  AL096863.12_47535
  Located on chromosome 10
  Distance between a terminus base of telomere on chromosomal short arm and 5'-terminus of this base sequence : 90465975
  Distance between 3'-terminus of neighbour sequence of sequence listing upward to telomere on chrosomal short arm and 5'-terminus of this base sequence : 30788
cagcatagtactggaagtcctaaccagagcaattagacaagaaaaacaactaaaaggcaccaacaggtgaaaaggaagaagtgaaatgatctctgttcacagatggcatgattttataagtagaaaaccttaaaatttttgcatgcatgcatgcatgcacacacacacacacacacacactgtcagaactcataaacgaattc

SEQ ID NO: 16538 - DNA, 353 bp, Homo sapiens
  AL096863.12_50251
  Located on chromosome 10
  Distance between a terminus base of telomere on chromosomal short arm and 5'-terminus of this base sequence : 90468784
  Distance between 3'-terminus of neighbour sequence of sequence listing upward to telomere on chrosomal short arm and 5'-terminus of this base sequence : 2606
ggtaagacaaaccagttccttccccccagagagctgacattttaaccattttaacacaggaaactgtgtgtgtgtgtgtgtgtgtgtgtgtgtgtgtgtgtgtgtgtgtgtgttcaggcactgaaaagtataatgaaaaaaagctgggtaaattgagaagctggacagtgaaagtgactccaaggaggaacaaagggttgtgtaacaaagggttatacaggttggtcaggaaggctcctcagaggaggtggtcctgaagcagggatatgaatactgtgggagaagtctcagagagagtggcccatgcaacagaaacagaaagtgctcaatccttctgtcaaataggcatcaag

SEQ ID NO: 16539 - DNA, 402 bp, Homo sapiens
  AL096863.12_66647
  Located on chromosome 10
  Distance between a terminus base of telomere on chromosomal short arm and 5'-terminus of this base sequence : 90484983
  Distance between 3'-terminus of neighbour sequence of sequence listing upward to telomere on chrosomal short arm and 5'-terminus of this base sequence : 15846
gtgatacctctggacattcatgggtgtctcattttgtcgagtgccttagtgcttcatttgccttggttttggtgtcccaaaatctcctcaatatctaatctcagtttccctcaataatttttgggggaacctgtcatttgccatgtccatgttggcaatgaaattgatacttaataagaattccaccccatctttaatacaaacacacaatctttttatcccttactagactataaattctttgaagcaatggattatatttgatgatgatgatgatgatgaagttaatgaaaataacaccccaggcaatgttatttatgagttcataatacatgctgtaatctctgcacgctgctaccaatcctgacacaacttcaaaataagtattaccattctgccatc

SEQ ID NO: 16540 - DNA, 304 bp, Homo sapiens
  chr10.fa.O7frz.89431976
  Located on chromosome 10
  Distance between a terminus base of telomere on chromosomal short arm and 5'-terminus of this base sequence : 90576908
  Distance between 3'-terminus of neighbour sequence of sequence listing upward to telomere on chrosomal short arm and 5'-terminus of this base sequence : 91523
gtcctaaatgtaaatcagtttcagccactttctgttgcagcagagcaaataaacacataattacctgaaaaacaaagatagttagcttttcactatttaaaataaatctctttccctttctgtctctgtccctttctttctttctcctacacacacacacacacacatgcacatgcatacacacacacacacacacacacacacacacacacagagcaagttgttggttgaaattaatcctcattttaattttccaggtcattgaatatttgtctatagactcctgttacttcatcttgattaa

SEQ ID NO: 16541 - DNA, 257 bp, Homo sapiens
  chr10.fa.O7frz.89159544
  Located on chromosome 10
  Distance between a terminus base of telomere on chromosomal short arm and 5'-terminus of this base sequence : 90849413
  Distance between 3'-terminus of neighbour sequence of sequence listing upward to telomere on chrosomal short arm and 5'-terminus of this base sequence : 272201
gtgctgagattacaggcatgagccaccgtgcccggccctctctttttttctttccttctttctttccttctttctttccttccttccttccttccttccttccttccttcctttctttctttttctctttctttctttctctctctttctttctcttccccttcctttttcttttcttttcttcttttttttttgagacagggacttgccctgttgcccaagctggagttcagtggtgcaattatagcttactgcac

SEQ ID NO: 16542 - DNA, 124 bp, Homo sapiens
  D10S1696
  Located on chromosome 10
  Distance between a terminus base of telomere on chromosomal short arm and 5'-terminus of this base sequence : 90933329
  Distance between 3'-terminus of neighbour sequence of sequence listing upward to telomere on chrosomal short arm and 5'-terminus of this base sequence : 83659
tcctgggtgacagagtgagactccgtcaaaaacacacacacacacacacacacacacagaaaagtttcctgtttattcctctgctagggagtcatttccatagtcataatggaaatgctgtctc

SEQ ID NO: 16543 - DNA, 419 bp, Homo sapiens
  chr10.fa.O7frz.88981417
  Located on chromosome 10
  Distance between a terminus base of telomere on chromosomal short arm and 5'-terminus of this base sequence : 91027896
  Distance between 3'-terminus of neighbour sequence of sequence listing upward to telomere on chrosomal short arm and 5'-terminus of this base sequence : 94443
cttctacacatgacaggaaataaccaacagaataaacagataacctacagaatggtggaatatatttacaaatatgtctccaacaaaacattaatatccagaatctacaagatgctcaaacaagtcaacaagaaaaaaaaactccattataaattggcagattagaaaaacattgcagtggccagattttaaacacacacacacacacacacacacacacacacacacacacaccacacaccatacatatttggcgatttgtttaattattggttgggaaaaatttccagcagaaataaagggcgatatcattttttcataattaaaattttaagatatattgctaatttctttacggaaatgttgtagtttacattccaagtggaagcatatattcctgctagtttattcacatccaa

SEQ ID NO: 16544 - DNA, 395 bp, Homo sapiens
  chr10.fa.O7frz.88870613
  Located on chromosome 10
  Distance between a terminus base of telomere on chromosomal short arm and 5'-terminus of this base sequence : 91116956
  Distance between 3'-terminus of neighbour sequence of sequence listing upward to telomere on chrosomal short arm and 5'-terminus of this base sequence : 88641
ctagtgtggttatttggaggtaagaagacacagctttttgagttgccagaattcttacattgtttgtgtgtgtgtgtgtgtgtgtgtgtgtgtgtttctcatctgtgtgggctaatgatccttcagcctttgaagttgctgttctttggatgggttttatttcatgcttttatcctgttggatgcccttgggggttcgattgttgtacaaggtggtttcagtcaactggctttgattctaatctactcctgaatctaggaggagcccttctgattactgatgctgtgcctatgttcattttgctggatgttctggtccacaggtcttccttatgcaggggctacagttgacagacagggcatatccttgccagctcagtcctattctgctattca

SEQ ID NO: 16545 - DNA, 218 bp, Homo sapiens
  D10S1761
  Located on chromosome 10
  Distance between a terminus base of telomere on chromosomal short arm and 5'-terminus of this base sequence : 91351485
  Distance between 3'-terminus of neighbour sequence of sequence listing upward to telomere on chrosomal short arm and 5'-terminus of this base sequence : 234134
agctcccacatatcggtgagaacatacaatgtttgcttttccattcctgagttacttcacttagaataatagtctccaatctcatccaggttgctgcaaatgccattaacccattcctttttatggctgaatagtattccattatacacacacacacacacacacacacacacacacatctcacagtttctttatccactgcttgattgatgggcatt

SEQ ID NO: 16546 - DNA, 413 bp, Homo sapiens
  chr10.fa.O7frz.88460131
  Located on chromosome 10
  Distance between a terminus base of telomere on chromosomal short arm and 5'-terminus of this base sequence : 91435704
  Distance between 3'-terminus of neighbour sequence of sequence listing upward to telomere on chrosomal short arm and 5'-terminus of this base sequence : 84001
gtacattcagaattctaggtcagtggctggttttctgttttgtgtgtgtgtgtgtgtgtgtttgtgctgtttgttttaaaggtctatttccattgagttctaatttcatccatttcttttgagaaaatagctctgtcttatggatattctttttcaggtaatgtcttctttttctctagaagtttttcagaatttctctttgtccatggttttaaacaattttattataatgtgctgaagtattttttttcttagtattaatacttttcatgcttggagttataaagattcttcaatctgtagcaagatttccttccttttacatttttaggaaagactcagccattgtttcctaaatattgcttttgccctggcatcactttccttcacccttagaatttcaattcacgtca

SEQ ID NO: 16547 - DNA, 391 bp, Homo sapiens
  chr10.fa.O7frz.88189244
  Located on chromosome 10
  Distance between a terminus base of telomere on chromosomal short arm and 5'-terminus of this base sequence : 91620708
  Distance between 3'-terminus of neighbour sequence of sequence listing upward to telomere on chrosomal short arm and 5'-terminus of this base sequence : 184591
taaatactgtcatctttaacggagtacttatttcttaaaatgctgcaaatgaggtgatgatgaggaactgagaggacataaaacaatccaaaccaaataaaacaacgatgtctgccaaagtcagatatttctctctgtctctctctctctctcacacacacacacacacacacgataattactgaatgtaacctgggagtgataaaggttgttaaaaaaattaattgggaggtcattagcctgaaatggctccagcacaaatacacaaataagtatgagtaaaactggataaggaagggcaaacaatatcaatgccaataccctggttgtaatattatacaatagttttgcaaaattgatcaatgggggaaactgagcaacgagtacaagg

SEQ ID NO: 16548 - DNA, 364 bp, Homo sapiens
  AC063966.3_16353
  Located on chromosome 10
  Distance between a terminus base of telomere on chromosomal short arm and 5'-terminus of this base sequence : 91741818
  Distance between 3'-terminus of neighbour sequence of sequence listing upward to telomere on chrosomal short arm and 5'-terminus of this base sequence : 120719
gttgttcttaatccgtccaccgcaccctccttacaggcaggaagctgaacttcccagctttctccctgctgctcaagaggctgccgtgggagatgctgcgggtgccccctgctggccaaacggaatatcacagtatcacaggcctggccgcccctcctttttagatagacatagacagattagatagattagatagatgatagatagatgatagatagatagatagatagataggtagatagatagatagatatagatagataggatagatatagatagatgaatgatagatattgattgattgattgattgattgattgattgattttgggccagtccccagtggttgaagatccttaggtaa

SEQ ID NO: 16549 - DNA, 125 bp, Homo sapiens
  D10S1744
  Located on chromosome 10
  Distance between a terminus base of telomere on chromosomal short arm and 5'-terminus of this base sequence : 92096728
  Distance between 3'-terminus of neighbour sequence of sequence listing upward to telomere on chrosomal short arm and 5'-terminus of this base sequence : 354546
acaatagactgctgctgctgctggtgtgtgtgtgtgtgtgtgtgtgtgtgtgtgtgtgtgagagagagagagagagagagagagagagagacaaggcgcagtaggggtgggagtcagacacgaga

SEQ ID NO: 16550 - DNA, 260 bp, Homo sapiens
  DISD22_0010451
  Located on chromosome 10
  Distance between a terminus base of telomere on chromosomal short arm and 5'-terminus of this base sequence : 92188416
  Distance between 3'-terminus of neighbour sequence of sequence listing upward to telomere on chrosomal short arm and 5'-terminus of this base sequence : 91563
gactgtactgacaggctctaagtcattttctccaaaaactatctattcaattatcaggggctggtcttgaggaaggaaaaaaaaaaaaaaacgttcccagaattcagtttccaaaatctctttttaaagggtttacacacacacacacacacacacacacacacacacacacacacacacacgatcattaaaaagtgtatgctctttaagaagaaaagtaaaatatctcaaaggacggtttcaccaccgtcctttattga

SEQ ID NO: 16551 - DNA, 109 bp, Homo sapiens
  DISD22_0010457
  Located on chromosome 10
  Distance between a terminus base of telomere on chromosomal short arm and 5'-terminus of this base sequence : 92268095
  Distance between 3'-terminus of neighbour sequence of sequence listing upward to telomere on chrosomal short arm and 5'-terminus of this base sequence : 79419
tcatgagcaggtggtaggtgtttttagcagagaagaaaatgctgagttttcaggcaggcaggcaggcaggcaggcaggtagctggacagagagtacagcaccttcctga

SEQ ID NO: 16552 - DNA, 194 bp, Homo sapiens
  D10S1687
  Located on chromosome 10
  Distance between a terminus base of telomere on chromosomal short arm and 5'-terminus of this base sequence : 92363845
  Distance between 3'-terminus of neighbour sequence of sequence listing upward to telomere on chrosomal short arm and 5'-terminus of this base sequence : 95641
ggccctaagatgcgggaagggctgtgcaaactcagagtgtgcttccctgcagggcacacattcaagccctacagccttcctacaaacaaataaagggaaatttggggtgtgtgtgtgtgtgtgtgtgtgtgtgtgtgtttgtgtgtgtgtgtgtgtgtgtgtgtgtttgagacagagtcctactctgccgccca

SEQ ID NO: 16553 - DNA, 418 bp, Homo sapiens
  chr10.fa.O7frz.94320458
  Located on chromosome 10
  Distance between a terminus base of telomere on chromosomal short arm and 5'-terminus of this base sequence : 92454539
  Distance between 3'-terminus of neighbour sequence of sequence listing upward to telomere on chrosomal short arm and 5'-terminus of this base sequence : 90500
cttatgatattgtttctgaagcacagacataatcttttgaccttttaagcaaaaaattaatttttcatttaactttttttgtttgtgtgtgtgtgtgtgtgtgtgtgacagggtcttgccctgttgcccaggctagagtatagtgatgcaatgatggtttactgcagcctcaacttcccaggctcaagtgatcctcccacctcagcctcctgagtaattgggactgcaggcacgtgccaccatacttggctaaattaacatttttttgtggaaatatggtcttgctatgttgcccacactggtcttgaactcacgggctgaagtgatcctcctgcttcagtcacccaaagtactgggattacaggtgtgagccatcgtgcctggcctttcattcaacttgtaattcacaatttccaga

SEQ ID NO: 16554 - DNA, 455 bp, Homo sapiens
  chr10.fa.O7frz.94757589
  Located on chromosome 10
  Distance between a terminus base of telomere on chromosomal short arm and 5'-terminus of this base sequence : 92557432
  Distance between 3'-terminus of neighbour sequence of sequence listing upward to telomere on chrosomal short arm and 5'-terminus of this base sequence : 102475
gttgacctcatctccattaatccataccgtgtgtgtgtgtgtgtgtgtgtgtgtgtgtgtgtgtgtgtgtgtgtgtgtacaggtgcacttccaaacaactccctctaggggctgaccccgcagcactagaagcagggtatgtgccagcagaccaagcctgtgtggcaggggcttcccagcgctccagaataggggagacaccagcagaggtgcaagaaacagccccggacaggaagcggtagagagacccagaaaggcagggtgggtgtgcactggcctccaggtcctgaaggcctactctggagtgggagtatacccagctgggtggggcctgacctacaccccttgtgtgccaggggaatgtatcttgcaagctgttttgctgcacccaaggatgatcttctccactcaggcccaggtccctaagtcccctcctaacagccacaagtcatact

SEQ ID NO: 16555 - DNA, 180 bp, Homo sapiens
  DISO7_00026249
  Located on chromosome 10
  Distance between a terminus base of telomere on chromosomal short arm and 5'-terminus of this base sequence : 92563103
  Distance between 3'-terminus of neighbour sequence of sequence listing upward to telomere on chrosomal short arm and 5'-terminus of this base sequence : 5216
cacccttgcctattgctcttccaaacgtcaggtctcagcggccttgggtgtgccgacacacacacacacacacacacacacacacaatatgcatcaggcccctggtgacacattctcacaccccctgtacctcctttttagagtcacaatgagccttcatgtgtgcttctccatagtggt

SEQ ID NO: 16556 - DNA, 408 bp, Homo sapiens
  AL136982.4_16218
  Located on chromosome 10
  Distance between a terminus base of telomere on chromosomal short arm and 5'-terminus of this base sequence : 92660008
  Distance between 3'-terminus of neighbour sequence of sequence listing upward to telomere on chrosomal short arm and 5'-terminus of this base sequence : 96725
agctgtgatgtaatggatacagggctagtataagataactttgaaatggtcaaggatcgctttttataccctgaccctctccacctcccacctaatctgtaactctatgtcttagcacccttcccttagtcaccttaaaaatctcatgaagtcaatgacgacaacaacaacaacaacaacaacaaaatcttgtgaagtctaatccccactgcacttggaaagattaatgccatattctagcctcatccactgacaaaagggctctctggcgctctccagctcctatttgctcactttccattcctttagtgacatacctctgctggaggtcagcacaactttgtttaaccactccttttctcccaatgtacaaatgacaaattggtcctgaatctttctagaggtaac

SEQ ID NO: 16557 - DNA, 155 bp, Homo sapiens
  DISD22_0010472
  Located on chromosome 10
  Distance between a terminus base of telomere on chromosomal short arm and 5'-terminus of this base sequence : 93135149
  Distance between 3'-terminus of neighbour sequence of sequence listing upward to telomere on chrosomal short arm and 5'-terminus of this base sequence : 474733
cctcctatacctacatgcctatgtttctctctctttctcctctctgtcagtctctctcctctctctgtctctgtctctgtctctctctctgtcacacacacacacacacacacacacacacactttcttactccctcattcagacatatacacat

SEQ ID NO: 16558 - DNA, 261 bp, Homo sapiens
  AL133327.5_67149
  Located on chromosome 10
  Distance between a terminus base of telomere on chromosomal short arm and 5'-terminus of this base sequence : 93244324
  Distance between 3'-terminus of neighbour sequence of sequence listing upward to telomere on chrosomal short arm and 5'-terminus of this base sequence : 109020
acatagttaagacctcaccgttacaaaatatcaaaaaattagctgagcgtggtggtacatgcctgttgtcccagttacttgggaggctgaggtgggaggatcacttgagcccaagaggtcaaggctgcagtgagctgtgactgtattcctgaactctagcctgggcaacagagcaaaactctgtctcaaaaacaaaacaaaacaaaacaaaacaaaacaaaatagaaaataaagcaaatttgtgaactagagtgcagtatt

SEQ ID NO: 16559 - DNA, 268 bp, Homo sapiens
  D10S579
  Located on chromosome 10
  Distance between a terminus base of telomere on chromosomal short arm and 5'-terminus of this base sequence : 93265113
  Distance between 3'-terminus of neighbour sequence of sequence listing upward to telomere on chrosomal short arm and 5'-terminus of this base sequence : 20528
ccgatcaatgaggagtgcctagaaatcatgggattgtaaaaggtatgttccttggtgtttggaagaaaaattagggagcgttgtctccttctaacacataggtaagggaagtccaagtttttcagcaatcctgggctagtgtttcagcgataggtactaggaaggttcatattcccattctcaggagatgattgcataaaaagatggagcacacacacacacacacacacacactcatgctgaggagagcagcattggctgggtgtat

SEQ ID NO: 16560 - DNA, 158 bp, Homo sapiens
  D10S215
  Located on chromosome 10
  Distance between a terminus base of telomere on chromosomal short arm and 5'-terminus of this base sequence : 93300809
  Distance between 3'-terminus of neighbour sequence of sequence listing upward to telomere on chrosomal short arm and 5'-terminus of this base sequence : 35428
gctttacgtttcttcacatggtatatatatatatatatatatatatgtgtgtgtgtgtgtgtgtgtgtgtgtgtgtgtatatatataccctctccctcagagagtggagccccagttacctcatctttttgtctgtctttctccccagaatgatgcca

SEQ ID NO: 16561 - DNA, 177 bp, Homo sapiens
  DISD22_0010477
  Located on chromosome 10
  Distance between a terminus base of telomere on chromosomal short arm and 5'-terminus of this base sequence : 93393310
  Distance between 3'-terminus of neighbour sequence of sequence listing upward to telomere on chrosomal short arm and 5'-terminus of this base sequence : 92343
tgcaagccagtgaatttgtatttatctcatggctaaagttccaaagtaaaagctatagggggtgtgtgtgtgtgtgtgtgtgtgtgtgtgtatttaaaatgcctttataatttccatagctttatgtttaattggcaattaaatccactttaatttccctcttagcacactagacgt

SEQ ID NO: 16562 - DNA, 149 bp, Homo sapiens
  DISD22_0011363
  Located on chromosome 10
  Distance between a terminus base of telomere on chromosomal short arm and 5'-terminus of this base sequence : 93673873
  Distance between 3'-terminus of neighbour sequence of sequence listing upward to telomere on chrosomal short arm and 5'-terminus of this base sequence : 280386
tgtagaaagcatgcagagttctaaaatgctaagtaactgatatatatatatatatatatatataaaatatatatttatatatattatgtatctttttatattgtatatataaatatatatatatatttaggtaaagccaacaattcagg

SEQ ID NO: 16563 - DNA, 101 bp, Homo sapiens
  DISD22_0011368
  Located on chromosome 10
  Distance between a terminus base of telomere on chromosomal short arm and 5'-terminus of this base sequence : 93747092
  Distance between 3'-terminus of neighbour sequence of sequence listing upward to telomere on chrosomal short arm and 5'-terminus of this base sequence : 73070
aatcatgcttcacccaccaccactccagtgatggatgtgccagcgtatgtgtgtgtgtgtgtgtgtgtgtactgctgaactgtcctagtgaagtcccatct

SEQ ID NO: 16564 - DNA, 251 bp, Homo sapiens
  D10S541
  Located on chromosome 10
  Distance between a terminus base of telomere on chromosomal short arm and 5'-terminus of this base sequence : 93826532
  Distance between 3'-terminus of neighbour sequence of sequence listing upward to telomere on chrosomal short arm and 5'-terminus of this base sequence : 79339
ccacaagtaacagaaagcctgtctcaaacagaattaaacaacaaaaaaaattggatgtatttgggcctgccagtgaatagttcagggatgggtacagaaactcaaaagatgtcacaggatttctgtgtgtgtgtgtgtgtgtgtgtgtgtgtctgtctcagatggctgagttccttctattccagttcttcaaaagattccatgtttgtggttgtgagatgtctgtggtggttctaagacttcacttgctt

SEQ ID NO: 16565 - DNA, 242 bp, Homo sapiens
  Z23549.1_121
  Located on chromosome 10
  Distance between a terminus base of telomere on chromosomal short arm and 5'-terminus of this base sequence : 93826539
  Distance between 3'-terminus of neighbour sequence of sequence listing upward to telomere on chrosomal short arm and 5'-terminus of this base sequence : -244
taacagaaagcctgtctcaaacagaattaaacaacaaaaaaaattggatgtatttgggcctgccagtgaatagttcagggatgggtacagaaactcaaaagatgtcacaggatttctgtgtgtgtgtgtgtgtgtgtgtgtgtgtctgtctcagatggctgagttccttctattccagttcttcaaaagattccatgtttgtggttgtgagatgtctgtggtggttctaagacttcacttgc

SEQ ID NO: 16566 - DNA, 234 bp, Homo sapiens
  DISO7_10002923
  Located on chromosome 10
  Distance between a terminus base of telomere on chromosomal short arm and 5'-terminus of this base sequence : 93877066
  Distance between 3'-terminus of neighbour sequence of sequence listing upward to telomere on chrosomal short arm and 5'-terminus of this base sequence : 50285
aataacattacgtgaccctggttggccaagatctgtgccttggtttcctcacttgttaaatgtaaataagaattctctgctctgcttatttcacagaggtgttaggaggatgaaaagtgaaaatacacacacacacacacacacacacacacacacacacacacacacacacgcttggatgagtataaaatgccagaaaaatgtaaaattgaccctgttctcttcagttaacaa

SEQ ID NO: 16567 - DNA, 194 bp, Homo sapiens
  DISO7_10002924
  Located on chromosome 10
  Distance between a terminus base of telomere on chromosomal short arm and 5'-terminus of this base sequence : 93924743
  Distance between 3'-terminus of neighbour sequence of sequence listing upward to telomere on chrosomal short arm and 5'-terminus of this base sequence : 47443
ctattgctcataattgcatggttttctgtctgttttgagatatatatatatatatatataaatataaatatatatacacacactatatatatacacacacacacaattttatattatctctctctatatatatttctttatatatgtttatttataatacatatatatttctattgtgagctcatgctcctagg

SEQ ID NO: 16568 - DNA, 195 bp, Homo sapiens
  DISO7_10002925
  Located on chromosome 10
  Distance between a terminus base of telomere on chromosomal short arm and 5'-terminus of this base sequence : 93960198
  Distance between 3'-terminus of neighbour sequence of sequence listing upward to telomere on chrosomal short arm and 5'-terminus of this base sequence : 35261
catttaattctcagccaataggattatataacacacacacacacacacacacacacacacacacacacacgtacgtatatgtaggatatgttatatattatatataacatatcttacacatacataatataaaatatattttatgactatgagtaaaatggctaaaaattgtagtgaacagagtagttcacatgc

SEQ ID NO: 16569 - DNA, 165 bp, Homo sapiens
  DISO7_10002926
  Located on chromosome 10
  Distance between a terminus base of telomere on chromosomal short arm and 5'-terminus of this base sequence : 93971878
  Distance between 3'-terminus of neighbour sequence of sequence listing upward to telomere on chrosomal short arm and 5'-terminus of this base sequence : 11485
aggtgtattctccacatctctgtgtgtgtgtgtcgcatgcatgcacacacattatctccacatacacacacatatacacacacacacacacacgcacacatccttattgttattttcttctcatcttctaaatgtatttatttgactcccagtagaagacaactg

SEQ ID NO: 16570 - DNA, 140 bp, Homo sapiens
  DISO7_10002927
  Located on chromosome 10
  Distance between a terminus base of telomere on chromosomal short arm and 5'-terminus of this base sequence : 94075468
  Distance between 3'-terminus of neighbour sequence of sequence listing upward to telomere on chrosomal short arm and 5'-terminus of this base sequence : 103425
actgcattagtactgtttattcctgtgtctttgtgtgtgtgtgtgtgtgtgtgtgtgtgtgtgtatgtgttctattacaaatggaatttatatctgtctggtataatattattttacaaagatatgactagtgacaacca

SEQ ID NO: 16571 - DNA, 93 bp, Homo sapiens
  DISO7_10002930
  Located on chromosome 10
  Distance between a terminus base of telomere on chromosomal short arm and 5'-terminus of this base sequence : 94154339
  Distance between 3'-terminus of neighbour sequence of sequence listing upward to telomere on chrosomal short arm and 5'-terminus of this base sequence : 78731
tgaatgtcctccaagacgttttcagattgtttcactcattcattcattcattcattcaatgcagactgagagcctacatatacgaggcactca

SEQ ID NO: 16572 - DNA, 384 bp, Homo sapiens
  chr10.fa.O7frz.96202673
  Located on chromosome 10
  Distance between a terminus base of telomere on chromosomal short arm and 5'-terminus of this base sequence : 94273772
  Distance between 3'-terminus of neighbour sequence of sequence listing upward to telomere on chrosomal short arm and 5'-terminus of this base sequence : 119340
gatgaagctaagtctttccatctgtgtagtggggcctatcacttgctattttgcatatttaaccccatggaaaggccaattgggatataaactgaatcaactcactttcacttcccagggagtggagagcaagggtagtttgggaagcagcagatgaagtcaaccctgagtcaggaatttgggaagaaaagggtatgctctattattattattattattattattattattattattattattgttctgccctcatgtttttgggtcttgaccaccaaataggcaccaactaaccaaactatttttgaaatctctgccacagtgctggaaaccacaggatccagaaacatccccattgatatatcaattaggatgtacaactgc

SEQ ID NO: 16573 - DNA, 175 bp, Homo sapiens
  D10S1735
  Located on chromosome 10
  Distance between a terminus base of telomere on chromosomal short arm and 5'-terminus of this base sequence : 94487004
  Distance between 3'-terminus of neighbour sequence of sequence listing upward to telomere on chrosomal short arm and 5'-terminus of this base sequence : 212848
tgactcagtggggcctagaaatctgtggggtttgtgtatgtgtctgtgtgtgtgcgtgtgcgtgtgtgtgtgtgtgtgtgtgtgtggccagcacacccctcctccaccaagtcattgtaatgcaggcaagttatccaggaaccactcccagagggaacatggcatccaaatcagg

SEQ ID NO: 16574 - DNA, 105 bp, Homo sapiens
  DISO7_10002933
  Located on chromosome 10
  Distance between a terminus base of telomere on chromosomal short arm and 5'-terminus of this base sequence : 94512957
  Distance between 3'-terminus of neighbour sequence of sequence listing upward to telomere on chrosomal short arm and 5'-terminus of this base sequence : 25778
ttgctttatagagaagcactggggaggagcagcatgcacacacacacacacacacacacatacacacacacacacacacatttcctaagcatttggtattatgca

SEQ ID NO: 16575 - DNA, 101 bp, Homo sapiens
  DISO7_10002935
  Located on chromosome 10
  Distance between a terminus base of telomere on chromosomal short arm and 5'-terminus of this base sequence : 94628921
  Distance between 3'-terminus of neighbour sequence of sequence listing upward to telomere on chrosomal short arm and 5'-terminus of this base sequence : 115859
gtactttctgtgcctcatactgtctttcacaaatgtggggtgtgtgtgtgtgtgtgtgtgtatgtgttgtgaagtccctattctgtattctgtttccagct

SEQ ID NO: 16576 - DNA, 237 bp, Homo sapiens
  D10S1739
  Located on chromosome 10
  Distance between a terminus base of telomere on chromosomal short arm and 5'-terminus of this base sequence : 94647070
  Distance between 3'-terminus of neighbour sequence of sequence listing upward to telomere on chrosomal short arm and 5'-terminus of this base sequence : 18048
ctggaaaaacaacagaggtgcaaacacacacacacacacacacacacacacacacaccggtacatccgcacacaccctctctctttctctctttaatttgctccagtgattttttcttcctggaacttccaaaatcatcaagaggtcacatttactttgtttctaattcctttggctcttactgtttagacaaccatcatcttatcatttattatgacattccttgatttagacagc

SEQ ID NO: 16577 - DNA, 101 bp, Homo sapiens
  DISD22_0011378
  Located on chromosome 10
  Distance between a terminus base of telomere on chromosomal short arm and 5'-terminus of this base sequence : 94964306
  Distance between 3'-terminus of neighbour sequence of sequence listing upward to telomere on chrosomal short arm and 5'-terminus of this base sequence : 316999
agcaattatactaataccaatgcccataactctgtgtgcgtgtgtgtgtgtgtgtgtgtgtgtgtgtgtgtgtgtgtttcaataagtggttgtagaaggca

SEQ ID NO: 16578 - DNA, 103 bp, Homo sapiens
  DISO7_10002936
  Located on chromosome 10
  Distance between a terminus base of telomere on chromosomal short arm and 5'-terminus of this base sequence : 95050307
  Distance between 3'-terminus of neighbour sequence of sequence listing upward to telomere on chrosomal short arm and 5'-terminus of this base sequence : 85900
gagtacagggtagtctctggaagttaaaaggtagaggcagggtgcagtgtgtgtgtgtgtgtgtgtgtgtgtgtgtgtgtaacatcattcactcctacattgc

SEQ ID NO: 16579 - DNA, 465 bp, Homo sapiens
  AL353751.9_8428
  Located on chromosome 10
  Distance between a terminus base of telomere on chromosomal short arm and 5'-terminus of this base sequence : 95172598
  Distance between 3'-terminus of neighbour sequence of sequence listing upward to telomere on chrosomal short arm and 5'-terminus of this base sequence : 122188
agtggcactcatctgtgatcccagctactcaggagactgaggtgggaagatcacttgagcctgggagggaggtcaaggcgacagtgagctctgattgcgccactgcactccagcctgggtgacagagcaagactctgtctgaaaagaaaaaagaaaaaaaggaagaaaggaaaggaaatgaaatgaaaggaaaggaaaggaaaggaaaggaaaggaaaggaaaggaaaggaaaggaaaggaatggaaaggaaaaaagaatggggagctattttattaactatatcaatatttttgaagttcatgtggaagaccattttaaacgtgtatttgtgaatgagtacagaagggaatgtcatataggtgggaacacattgttttcaaattacagcccattgtggggatcaagagaacccactgggctacctaagtattcctctaacaagtgcgaatactattgaacagtc

SEQ ID NO: 16580 - DNA, 231 bp, Homo sapiens
  chr10.fa.O7frz.97023556
  Located on chromosome 10
  Distance between a terminus base of telomere on chromosomal short arm and 5'-terminus of this base sequence : 95293980
  Distance between 3'-terminus of neighbour sequence of sequence listing upward to telomere on chrosomal short arm and 5'-terminus of this base sequence : 120917
ggccacatctaacatttgtaagaaaggagagtgctatcaggaaggggcttgacaacaacaacaacaacaaaacaacaacaacaacaaaaaacagaaaaagacggtggcgtgcaccgtatatatgcaggatggggaggaaaagggctcagccccattggggactgtctcccaaggacaatgaaagtctgcttcttcctagcagaagaacagaattaccgaaagatacgtgtt

SEQ ID NO: 16581 - DNA, 364 bp, Homo sapiens
  AL353146.3_28565
  Located on chromosome 10
  Distance between a terminus base of telomere on chromosomal short arm and 5'-terminus of this base sequence : 95364297
  Distance between 3'-terminus of neighbour sequence of sequence listing upward to telomere on chrosomal short arm and 5'-terminus of this base sequence : 70086
gagctattatcaagccactgtactccagcctaggtgacagagtgaaaccttgtctcaaaaaaaaaaaaaaagaaagaaagaaagaaagaaagaaagaaagaaagaaagaaagaaagaaagaaagaaagaaaagaaagaaagaaagaaaagaaagaaaagaaaagaaaaaagaaagaaagaaaaaaagagaaaaacgaaataagtagaaataagtatagaaataaagactaggaaatgaatatcacagaaaaagggatgtcctggataccttgtttttctttttctctcctttgttttccaataaagataactgtgactctttgaggaaaaagttgattttctgcttagtaaatcaaaggttcta

SEQ ID NO: 16582 - DNA, 245 bp, Homo sapiens
  HUMUT1393
  Located on chromosome 10
  Distance between a terminus base of telomere on chromosomal short arm and 5'-terminus of this base sequence : 95431715
  Distance between 3'-terminus of neighbour sequence of sequence listing upward to telomere on chrosomal short arm and 5'-terminus of this base sequence : 67054
cactccagcctgggcaacagagcgagactccatctcaaaaagaaagaaagaaagagagaaagaaagagagaaaggaagaaagaaagaaagaaagaaagaaagaaagaaagaaagaaagaaagaaagaaagaaagaaagaaagaaggaaggaaggaaggaaggaaggaaggaaggaaggaaggaaggaaagaaagaaagaaaatgggaaagttctcaaaaaactccagatttctggcttctcttga

SEQ ID NO: 16583 - DNA, 303 bp, Homo sapiens
  chr10.fa.O7frz.97240515
  Located on chromosome 10
  Distance between a terminus base of telomere on chromosomal short arm and 5'-terminus of this base sequence : 95509577
  Distance between 3'-terminus of neighbour sequence of sequence listing upward to telomere on chrosomal short arm and 5'-terminus of this base sequence : 77617
caattatccacctacaaatgagatgtaacaattttaattgtggttagataactgaatttatctaattgtgcatcataaaacacaatagtctcaactggatataatacactgctaacttttacagcaaataacagattgtgtgtgtgtgtgtgtgtgtttttttttttaaaaagggttcttttcttttggaaataaagacaaaaacatttaatactaaacatatgatttctgaggtctgcttcaatattataaaattggacatgatttgataattatagaagctgagtgataagtacttggcag

SEQ ID NO: 16584 - DNA, 351 bp, Homo sapiens
  chr10.fa.O7frz.97366607
  Located on chromosome 10
  Distance between a terminus base of telomere on chromosomal short arm and 5'-terminus of this base sequence : 95634599
  Distance between 3'-terminus of neighbour sequence of sequence listing upward to telomere on chrosomal short arm and 5'-terminus of this base sequence : 124719
catgtatctggagttagtccactttcatttcagaatatttaagtgtatgaataaaccactgctaattcattttaatgttgaagatatttggattgttttctggttttggctgttatgaataaattttcctataaacatttttatacatttgttttggtgcacatttgcatatatctctgttgtgtgtgtgtgtgtgtgtatatatatatatatatatatatatatatacacacatgacaattgctagatgatagggtatatatatgtgaaattctagtagaatgctgcactgattttcgaagcagttgtacccatttataccccaactagtgttgcagtagctgtatagtc

SEQ ID NO: 16585 - DNA, 469 bp, Homo sapiens
  chr10.fa.O7frz.97600850
  Located on chromosome 10
  Distance between a terminus base of telomere on chromosomal short arm and 5'-terminus of this base sequence : 95879588
  Distance between 3'-terminus of neighbour sequence of sequence listing upward to telomere on chrosomal short arm and 5'-terminus of this base sequence : 244638
ttctatcaaatgatgttcctttagcagaaatgttcccaggtggtttgcatttgggaaactaaaagactttttcgtgcagatcagcaaggcagtcatgaatggatcattgaggaacagatggtaggagcctagttcaatacccttgtcatgtgcgagtactgccttttgtaagaacagtgacaatatcccatctgcttgcctgacagccacaactcaaatgagacccctctcggaaccctgcctgtttggtcaagcacctttctaacaaataagagcaccctctgactcctcagggaaaaaaaaaaagagcgagagagagagagagagagagttgccaaaacatccccccagagtttttaaatttaaaatattttcattttaaaatagcatgttttctctgattataagagtagaacatgttcattattaagagaattagaatatagttgtttaatatcctggtaaacag

SEQ ID NO: 16586 - DNA, 413 bp, Homo sapiens
  chr10.fa.O7frz.97707935
  Located on chromosome 10
  Distance between a terminus base of telomere on chromosomal short arm and 5'-terminus of this base sequence : 95979710
  Distance between 3'-terminus of neighbour sequence of sequence listing upward to telomere on chrosomal short arm and 5'-terminus of this base sequence : 99653
acaggacagcttctgtcataccatccatagctccatagctccaggcagctcagaacagagagagagagagagagagagagagagagagagagattatttgtttgggggaatataagggaagagaacagaagtctctgcttggtaatccagagaaatcttatccaagaccagcaaggtggcatctctatgagtctgcaaaaaccactgcattgctgtccatgaagtgccctctaatgtagatatgacttagatcacaataccaaagttcttttgaaaacctggaaagctttcccaagaaggatagatagaaacaagcccagattgcaaagactacaataaatacctaactctttgatgcacagacaccaatgaacatccacaagcatcaagaactaaataaggcactaggaacc

SEQ ID NO: 16587 - DNA, 265 bp, Homo sapiens
  Z66830
  Located on chromosome 10
  Distance between a terminus base of telomere on chromosomal short arm and 5'-terminus of this base sequence : 96328018
  Distance between 3'-terminus of neighbour sequence of sequence listing upward to telomere on chrosomal short arm and 5'-terminus of this base sequence : 347895
gctaaacacctggcctgtcactagaggaaattgaaccttgcaatttgtttgaacaatttttaaatgtaacagacacacacacacacacacacacaaacaatttatattgattggcttattttgggtattgatggagtcacttgtgtgatttatctgatacatcaatgaagacagttataaatagaagaataacaattttcaatcagttatttgttgtcaaacatggaacatttgaccatttacaatctgagagtaaaactgcaca

SEQ ID NO: 16588 - DNA, 285 bp, Homo sapiens
  HUMUT918
  Located on chromosome 10
  Distance between a terminus base of telomere on chromosomal short arm and 5'-terminus of this base sequence : 96347192
  Distance between 3'-terminus of neighbour sequence of sequence listing upward to telomere on chrosomal short arm and 5'-terminus of this base sequence : 18909
tgcagcattattcacaatagccaagatatgaaaacaacctaaatgtccattgacagatgaataaagaatggacagattagatagatagatagatagatacatagatatatagatagatagatacatagatacatagatagatacatagatggatatgatagatgatagatagatagatagatagatagatagatagatagatagatagatagatagataaatgatagatagatagagcaacactatttagccttaaaaaataagggaatcctatcatatgcgaca

SEQ ID NO: 16589 - DNA, 144 bp, Homo sapiens
  D10S1242
  Located on chromosome 10
  Distance between a terminus base of telomere on chromosomal short arm and 5'-terminus of this base sequence : 96482691
  Distance between 3'-terminus of neighbour sequence of sequence listing upward to telomere on chrosomal short arm and 5'-terminus of this base sequence : 135214
caagcatactgtattagttagggctctctagagagacagaactaataggagatagatagatagatagatagatagatagatagatagatagatagatagatagatagagtttattaagtattaacatacatgatcatggggtcc

SEQ ID NO: 16590 - DNA, 269 bp, Homo sapiens
  D10S1753
  Located on chromosome 10
  Distance between a terminus base of telomere on chromosomal short arm and 5'-terminus of this base sequence : 96530972
  Distance between 3'-terminus of neighbour sequence of sequence listing upward to telomere on chrosomal short arm and 5'-terminus of this base sequence : 48137
ctgctgccaccaacctaattcaaccaccattgtctcttcaactggtttacctacatccactctggccttcttccaatccattctttccacctcagccagagagatgtttgttaagtgaacacaatgccatcaacacacacacacacacacacacacacacacacacgcacacccctcttaacactcttagttggcttcctgtaactctaaagtaaagaccaaaatctttaagtgtctctcagagtcctgtgtcatcgagtctccacttg

SEQ ID NO: 16591 - DNA, 198 bp, Homo sapiens
  Z67290
  Located on chromosome 10
  Distance between a terminus base of telomere on chromosomal short arm and 5'-terminus of this base sequence : 96530974
  Distance between 3'-terminus of neighbour sequence of sequence listing upward to telomere on chrosomal short arm and 5'-terminus of this base sequence : -267
gctgccaccaacctaattcaaccaccattgtctcttcaactggtttacctacatccactctggccttcttccaatccattctttccacctcagccagagagatgtttgttaagtgaacacaatgccatcaacacacacacacacacacacacacacacacacacgcacacccctcttaacactcttagttggcttcct

SEQ ID NO: 16592 - DNA, 288 bp, Homo sapiens
  chr10.fa.O7frz.98397151
  Located on chromosome 10
  Distance between a terminus base of telomere on chromosomal short arm and 5'-terminus of this base sequence : 96639210
  Distance between 3'-terminus of neighbour sequence of sequence listing upward to telomere on chrosomal short arm and 5'-terminus of this base sequence : 108038
actcaagtgtttcagttagtgaaggaggcttctggatctttccaggcatgtagatgtctttaaggatgcaatcaggcctcctcgtcacaagcgtgtggccatctatgggccacatagatgtgttactatgtgaggtaacacatctattacctcacatagttaccattttgtgtgtatgcgtgtgtgtgtgtgtgtgtgtgtgtgtgtgtggtgaggtttactctcttagcaaatttcaagtatacaatacactattgttaactatagtcaccatgctgtacattagat

SEQ ID NO: 16593 - DNA, 254 bp, Homo sapiens
  D10S564
  Located on chromosome 10
  Distance between a terminus base of telomere on chromosomal short arm and 5'-terminus of this base sequence : 96717738
  Distance between 3'-terminus of neighbour sequence of sequence listing upward to telomere on chrosomal short arm and 5'-terminus of this base sequence : 78240
tgggaatgtgtctttatccacttttgtatcctcatagttcttaaatatctagtaggcaagcagtaacagtttgcttattaaataaatctcaccaccaccatcttctctaacttggtttgcatgcaatcatcttttcctctctcctctccatctctccatctgtctgtctctccatctgtttctctctctctctctcacacacacacacacacacacacacacacacacacacatctggcctctctgttagagct

SEQ ID NO: 16594 - DNA, 273 bp, Homo sapiens
  chr10.fa.O7frz.98679211
  Located on chromosome 10
  Distance between a terminus base of telomere on chromosomal short arm and 5'-terminus of this base sequence : 96861513
  Distance between 3'-terminus of neighbour sequence of sequence listing upward to telomere on chrosomal short arm and 5'-terminus of this base sequence : 143521
cctgagaaatgtaaatacctatgaaggtgggtccatgaaggggaggttgatgaggatgggcctatgtaagagtgtgtgtcaaggttgttacttgtatttgtgttaccctgtggatgtgtgtgtgtgtgtgtttgtgtgtgtgagagagagattcagagcaggaagaggaaggcaactcacatggatccatgtttttcgtaacactgtgtgaaactccagttaattgactgtaaaaaaataggaacccacaagtaactgacattagtaccgctg

SEQ ID NO: 16595 - DNA, 134 bp, Homo sapiens
  D10S536
  Located on chromosome 10
  Distance between a terminus base of telomere on chromosomal short arm and 5'-terminus of this base sequence : 97001337
  Distance between 3'-terminus of neighbour sequence of sequence listing upward to telomere on chrosomal short arm and 5'-terminus of this base sequence : 139551
aagttttatctcaagactgttgccttcgaagacgtaggcatgtgtatctatgtgtgtgtgtgtgtgtgtgtgtgtgtgtgtgtgtgtgtgtgtgtagaaagagagagagagaaacaaacaatgataatttgacc

SEQ ID NO: 16596 - DNA, 325 bp, Homo sapiens
  AC026227.3_25391
  Located on chromosome 10
  Distance between a terminus base of telomere on chromosomal short arm and 5'-terminus of this base sequence : 97180704
  Distance between 3'-terminus of neighbour sequence of sequence listing upward to telomere on chrosomal short arm and 5'-terminus of this base sequence : 179233
aaaggaggtacttgaaatgtttagcatctgttggaaatatggaacttgaaatcagcagagatgtgatatatagtcaggcagatagatagatggatagatggatagatagatagatagatagatagatagatagatagatagatagatagatagataatctgcctatatgttagttttgaagccacaaaagcagatgaaatccacaaggaagacagaaaaggtcaaagagttcagagtacaaagcaagggagaatatcagatttaaaagtagctgggaaaaagaaaaatgcttagtaataaagaaagaacagacttgaacattaaa

SEQ ID NO: 16597 - DNA, 305 bp, Homo sapiens
  chr10.fa.O7frz.99628365
  Located on chromosome 10
  Distance between a terminus base of telomere on chromosomal short arm and 5'-terminus of this base sequence : 97234527
  Distance between 3'-terminus of neighbour sequence of sequence listing upward to telomere on chrosomal short arm and 5'-terminus of this base sequence : 53498
gactcttgattcctttggttagaattttttggacttgacactgagcaatctccctatggtgactgaagctggaaggttcagtattagggttctccatagatatgggaccaatagtgtgtgtgtgtgtgtgtgtgtgtgtgtgtgtgtgtgtgtctacagagagagagagagggaagatagaagatagatagatagatagatagatagatagatagataaaaaggaatttattaggggaattggctaagacaggttgtctgcgagctggagaccctgggatgctggtagcatggctcagtctaagt

SEQ ID NO: 16598 - DNA, 378 bp, Homo sapiens
  chr10.fa.O7frz.99910607
  Located on chromosome 10
  Distance between a terminus base of telomere on chromosomal short arm and 5'-terminus of this base sequence : 97361576
  Distance between 3'-terminus of neighbour sequence of sequence listing upward to telomere on chrosomal short arm and 5'-terminus of this base sequence : 126744
cataatgaaatcagtggtagtgtatagttaaactagaggagggagaaagtgaagaaaagagctttgtagctcatgcctgaggcaatgagtgcatccactaaggtggtggccacaggacagagtgtaagggatgggagcatacacaccatgtgggacctaactagacagcagaaatgaaagagaagaaagattaataaaggaaaaggactcaggtttccagatgaggtcaatagcattccaaattagagaaagtgtgtgtgtgtgtgtgtgtgtgtgtgtgtgtgtgtgtacttaacaacaatatgcccagctaggtatttggaacaatcttgtatgaaaaatgttgtgctctttgttcattatgttctaaacaagagg

SEQ ID NO: 16599 - DNA, 453 bp, Homo sapiens
  chr10.fa.O7frz.100121600
  Located on chromosome 10
  Distance between a terminus base of telomere on chromosomal short arm and 5'-terminus of this base sequence : 97555627
  Distance between 3'-terminus of neighbour sequence of sequence listing upward to telomere on chrosomal short arm and 5'-terminus of this base sequence : 193673
ttacatgatagctcaaggacagacaaggtgtccagaaggaactggccggaggaggtgacactgagacagcctggagataagggggtagaaaagggagaagggaggaggtagggggtgtgtgttaaatagaaactcagaaaaagctaaacctgtacatttctctctctctctctctctctctgtctctctgtctctctctctctctctctctctcacacacacacacacacacacacacacacacacacaggcatgcacagaaacacattctttgctttccctccccatctgtaactccccaaggcatttctataaataaacgataggcccctgagcctgcaataggaccattattaactcttgcagtgttctggctataagtgtgtgaacacttttcctcacttcatggtttgcaaagccttttcccatatgtaatctccacctgactcctac

SEQ ID NO: 16600 - DNA, 156 bp, Homo sapiens
  Z67503
  Located on chromosome 10
  Distance between a terminus base of telomere on chromosomal short arm and 5'-terminus of this base sequence : 97640446
  Distance between 3'-terminus of neighbour sequence of sequence listing upward to telomere on chrosomal short arm and 5'-terminus of this base sequence : 84366
aattgcttgagcccaggaggcggaggttgcaggcagtgagcagagatcgcaccattgcactccagcctgggcaacagagcgagactctgttggaaaacacacacacacacacacacacacacacacttcagatctcgagagacttattcaccgtca

SEQ ID NO: 16601 - DNA, 366 bp, Homo sapiens
  AL359198.18_50631
  Located on chromosome 10
  Distance between a terminus base of telomere on chromosomal short arm and 5'-terminus of this base sequence : 97894743
  Distance between 3'-terminus of neighbour sequence of sequence listing upward to telomere on chrosomal short arm and 5'-terminus of this base sequence : 254141
gcattaactcgtcatttacattaagtatttctcctaatgctatccctcccccatccccccaccccacgacaggccccggtgtgcgacgttcctccccctgtgtccaagtgttctcattgttcagttcccacctatgagtgagaacagtattgctttatctttaagttcacttgcattttgtcctgttatcttccattaagctgttaagtctatccagtggtttaaaatttttttttcagatactatatttttcagttttagaactatttatttatttatttatttatttatttatttatttagagacaggatctcactctgttgcccaggctggagttcagtgatatgatcgtagctcagtgcacc

SEQ ID NO: 16602 - DNA, 478 bp, Homo sapiens
  AL365398.9_55640
  Located on chromosome 10
  Distance between a terminus base of telomere on chromosomal short arm and 5'-terminus of this base sequence : 97990709
  Distance between 3'-terminus of neighbour sequence of sequence listing upward to telomere on chrosomal short arm and 5'-terminus of this base sequence : 95600
agataaatttcagttacgtttcagtgaccagcagcactccagcttgtggggacccacttggaaccccagacttgatatgaagatgaagatgatgatgatgatgatgatgatgaagacggagtttagctcttgttgcccaggctgtagtgcaatggcgccatcttggctcactgcaaccttcgccttccgggttcaagcaattctcctgtctcagcctcccaagtagctgggattacaggcgcctgccaccacgcccagctaattttgtatttttagtagagacggggtttcaccatgttggtcaggctggtcttgaactcccgtcctcaagtgatccacccatctcggccttccaaagtgctgggattacaggcatgagccacagcaccggccaaagattattttaaactaaagacatttgagattcaacagatgcaaaagtgagctttttcagagcttcctttatctgaataaaggc

SEQ ID NO: 16603 - DNA, 473 bp, Homo sapiens
  chr10.fa.O7frz.100722172
  Located on chromosome 10
  Distance between a terminus base of telomere on chromosomal short arm and 5'-terminus of this base sequence : 98163629
  Distance between 3'-terminus of neighbour sequence of sequence listing upward to telomere on chrosomal short arm and 5'-terminus of this base sequence : 172442
cctgtagaactaaaggctgttccaagaatgtagggtggagaaagtaaatgctaagactaaaaaaaaaaaaaaaaaaattggctgggcatagtggtatgcgcctgtagtccgagctattcgggaggctgaggcaagagaatcacttgaacctgggaggcggaggttacggtcagccaagatcatgccactgcactccagcctggcgacacagcgagactctgcctcaaaaaaaaaaaaaaaaaaaaaaaaaaaattatatatatatatacacacacacacacacacacacacatatatatatgcacagaataaaattcccaacttgagagccatgcactaatgatataaaccactatggtggcatctaaatttaacatatttaattgatttatcaatatgatgattcacaataaattctgcaactttgactcccagcatgcttttcaagtctctaccatcaatgaatactcaag

SEQ ID NO: 16604 - DNA, 215 bp, Homo sapiens
  D10S583
  Located on chromosome 10
  Distance between a terminus base of telomere on chromosomal short arm and 5'-terminus of this base sequence : 98555814
  Distance between 3'-terminus of neighbour sequence of sequence listing upward to telomere on chrosomal short arm and 5'-terminus of this base sequence : 391712
agagactacagatgtttgatgatccccgtaacaaggtaattcagtctttgagaatgaaatgtctctgaattttaatgtgtgaggctttgagaagtcagagagagagagagagagagagagagagagagagagagtgtgtgtgtgtgtgtgtgtgtgtgtgtgtgtgtgtgtgttttaaccaatctaatggatgttcttttggtattttggtcaga

SEQ ID NO: 16605 - DNA, 315 bp, Homo sapiens
  D10S1755
  Located on chromosome 10
  Distance between a terminus base of telomere on chromosomal short arm and 5'-terminus of this base sequence : 98990532
  Distance between 3'-terminus of neighbour sequence of sequence listing upward to telomere on chrosomal short arm and 5'-terminus of this base sequence : 434503
ccatagtatcaatgtgagggtgaaatggatgatgcccataaggcacttagcagggggcctggcacagagtgagcattgaataaatgtcagttattgtcattattgttgttgttaacattattatggagggccaggtgcggtggttcccacttgtaatcgcagcactttgggaggttgaggtgcaagaattgcttgaggccaggagttcgagaccagcctgggcaacataacaagatcctttttctacacacacacacacacacacacacacacacacacacacacacacacacacctacctgaaaaaattagcca

SEQ ID NO: 16606 - DNA, 104 bp, Homo sapiens
  DISD22_0011396
  Located on chromosome 10
  Distance between a terminus base of telomere on chromosomal short arm and 5'-terminus of this base sequence : 98992152
  Distance between 3'-terminus of neighbour sequence of sequence listing upward to telomere on chrosomal short arm and 5'-terminus of this base sequence : 1305
gagcaattcagaatggtgccaaaacaactgctcaattcaggcttgtgtgtgtgtgtgtgtgtgtgtgtgtgtgtgtgtgtttaacctgtcagtttgttggttga

SEQ ID NO: 16607 - DNA, 154 bp, Homo sapiens
  DISD22_0011398
  Located on chromosome 10
  Distance between a terminus base of telomere on chromosomal short arm and 5'-terminus of this base sequence : 99073587
  Distance between 3'-terminus of neighbour sequence of sequence listing upward to telomere on chrosomal short arm and 5'-terminus of this base sequence : 81331
ccactggagatttctgcccagatttctcaccaccacatatcctaaactcacctcctcaaattcctctctctgggaggttgtgtgtgtgtgtgtgtgtgtgtgtgtgtgtgtgtgtgtgtattttacttgcttttgctaccactgcaaacagttg

SEQ ID NO: 16608 - DNA, 361 bp, Homo sapiens
  chr10.fa.O7frz.101439774
  Located on chromosome 10
  Distance between a terminus base of telomere on chromosomal short arm and 5'-terminus of this base sequence : 99178457
  Distance between 3'-terminus of neighbour sequence of sequence listing upward to telomere on chrosomal short arm and 5'-terminus of this base sequence : 104716
gaatactttcagatgaaaccataggagtaaggaaaataggataggcagagatcagcaaacctgtgggttccccagaagtctagctttaacctaatctcggggaattctagagcttgaatgacatctcagaattagctcaccttgaggtagaggggctgagtttttaccttaacctgcaacaatctttccttcactgcaggctgttctgtctctccgtctgtgtgtgtgtgcacgtttgtgtgcatgtgtgtgtgtgtgtgtgtgtgtgtgtgtgtgtgtgtgtgttggaggcatataacctcccaggcatcaatgttgtgtggagtgcttctcatctgtagacaaggtacaactgtgagtc

SEQ ID NO: 16609 - DNA, 323 bp, Homo sapiens
  AL157705.7_109926
  Located on chromosome 10
  Distance between a terminus base of telomere on chromosomal short arm and 5'-terminus of this base sequence : 99417983
  Distance between 3'-terminus of neighbour sequence of sequence listing upward to telomere on chrosomal short arm and 5'-terminus of this base sequence : 239165
actttcattgcatttcttcattgtcttctggcatccaggttttagtatctgttttaaaatttgaattcttcagcctgggcaatgtggcgaaaccctgtctctacaaaaaatacaaaaaatcagccgggtgtggtggcacacacctgtagtcccagctacttgggaggctaaggtgggaggatcgcttgagcccaggaagtctaggctgcagtgagccatgattgcatcactgcactccagcctgggcaacagagcaagaccttgtctcaaaaacaaaacaaaacaaaacaaaacaaaacctgaattctaagaaacatcaagag

SEQ ID NO: 16610 - DNA, 432 bp, Homo sapiens
  chr10.fa.O7frz.101710970
  Located on chromosome 10
  Distance between a terminus base of telomere on chromosomal short arm and 5'-terminus of this base sequence : 99537617
  Distance between 3'-terminus of neighbour sequence of sequence listing upward to telomere on chrosomal short arm and 5'-terminus of this base sequence : 119311
tgcagtctatcttcacatgatattatatcacttcctatgtagtataataaccttacaacaatatacctcggattcatatttttacctttaggcctttatgctcctgttgctatatatacatatatatatatatatatatatatatatatataaacattttatttggtataagtatacacatttaaacatgttagaaacctcttgatatgttgttattttttaattaaacctgtctattatcaatatatgtatagcatttagtacaatctatagtatacaggatacctctcaggctttgcccaactacccttttcttaagtagactcttccttccataacatcttttgtaattagctattattttaaaaattttgtctttcatcattccaccactggatcatgaaccgggacaaggtcagtcttgttaacata

SEQ ID NO: 16611 - DNA, 101 bp, Homo sapiens
  DISO7_10002945
  Located on chromosome 10
  Distance between a terminus base of telomere on chromosomal short arm and 5'-terminus of this base sequence : 99554024
  Distance between 3'-terminus of neighbour sequence of sequence listing upward to telomere on chrosomal short arm and 5'-terminus of this base sequence : 15975
gattggcgtcatagagcctgaagcatgtgtgtgtgtgtgtgtgtgtgtgtgtgtgtgtgcgcacagtgtatgtgtgtaggggtgaggttggagatgaagct

SEQ ID NO: 16612 - DNA, 157 bp, Homo sapiens
  D10S185
  Located on chromosome 10
  Distance between a terminus base of telomere on chromosomal short arm and 5'-terminus of this base sequence : 99861780
  Distance between 3'-terminus of neighbour sequence of sequence listing upward to telomere on chrosomal short arm and 5'-terminus of this base sequence : 307655
tcctatgctttcatttgccacttttcctacatctggtaaacacacacacacacacacacacacacacacacacacacacacacagtgcattgccctttttccatttttctgttcatcagtgaatactccctcatatactggcacatcgtgtgtcttg

SEQ ID NO: 16613 - DNA, 224 bp, Homo sapiens
  Z16678.1_102
  Located on chromosome 10
  Distance between a terminus base of telomere on chromosomal short arm and 5'-terminus of this base sequence : 99987175
  Distance between 3'-terminus of neighbour sequence of sequence listing upward to telomere on chrosomal short arm and 5'-terminus of this base sequence : 125238
agctaagtctggttatttgtctggggagtcaggagtctaatgaagccaggccagaggcctctaaggctgaacaaaacattagcacaggaggagcaacagttacacacacacacacacacacacacacacacacacccattctggctggattaaacagaaaaaggtataatgtaattcacaggctctccgatgggagggccagagaattgaccgtgaagacttcc

SEQ ID NO: 16614 - DNA, 297 bp, Homo sapiens
  D10S200
  Located on chromosome 10
  Distance between a terminus base of telomere on chromosomal short arm and 5'-terminus of this base sequence : 99987182
  Distance between 3'-terminus of neighbour sequence of sequence listing upward to telomere on chrosomal short arm and 5'-terminus of this base sequence : -217
tctggttatttgtctggggagtcaggagtctaatgaagccaggccagaggcctctaaggctgaacaaaacattagcacaggaggagcaacagttacacacacacacacacacacacacacacacacacccattctggctggattaaacagaaaaaggtataatgtaattcacaggctctccgatgggagggccagagaattgaccgtgaagacttcccagcctggaacgatgtcacatgatgaaggctgctccagtggaacactcagtgtcaccacactacagcacagacaccatgc

SEQ ID NO: 16615 - DNA, 210 bp, Homo sapiens
  AL360229.3_150371
  Located on chromosome 10
  Distance between a terminus base of telomere on chromosomal short arm and 5'-terminus of this base sequence : 99996430
  Distance between 3'-terminus of neighbour sequence of sequence listing upward to telomere on chrosomal short arm and 5'-terminus of this base sequence : 8951
ttcaagactgcagtgagctatgcccatgccactgtacccaacttgggtgacagagtgggaccttgtctccaataataataataataataatatcataactgggactgtcagcaagcagagttgtgtccataatccatatacagtgttgaccacagagtctgacccacagtgtccactcagtgaccactgtgcgaaatgctttacattaag

SEQ ID NO: 16616 - DNA, 419 bp, Homo sapiens
  AL157396.4_62701
  Located on chromosome 10
  Distance between a terminus base of telomere on chromosomal short arm and 5'-terminus of this base sequence : 100146712
  Distance between 3'-terminus of neighbour sequence of sequence listing upward to telomere on chrosomal short arm and 5'-terminus of this base sequence : 150072
atcctacttagcaaaatttctgacaataagcatgctgtcggccagacgtggtggctcgcacctgtaatcccagcgctttgggaggccaaggtgggcggatcacaaggtcaggagtttgagaccagcctgaccaacatagtgaaatcccgtctctactaaaaatacaaaacttagccaggcatggtggcatgcgcctgtaatcccagctactcaggaggctgaggcaggagaaccacttgaacctgggaggtggaggttacagtgagttgagatcacaccattgcactccagcctgggtgacagagggagactccgtctcaaataataataataataataataatgaagaagaagaagaagaagcatgctgtcgtgctgctgctgttgaaaacattctgtgtatgaccagaaccattatg

SEQ ID NO: 16617 - DNA, 402 bp, Homo sapiens
  AL138923.4_44983
  Located on chromosome 10
  Distance between a terminus base of telomere on chromosomal short arm and 5'-terminus of this base sequence : 100269529
  Distance between 3'-terminus of neighbour sequence of sequence listing upward to telomere on chrosomal short arm and 5'-terminus of this base sequence : 122398
atgttagtgcatctggtaacagcccaggtagattattgccttttttaatccattccgcattccttcttcttttttctttcaacagcacacaggtacttttggccccctggggttttgttcaatactactatcaagttattaatgaataaatataaattttaatatttctcccatccttgctcccttctggaacactgattcaaactctgtatcataattttgacctgtcccatccatccatccatccatccatccatccatccatccatccatctatcttgtaatggttaatagcacagactctgaactccaactgcctaggttgaaatagcagcttcttcacttataaagcaaccttggacacattacttaacctctctgaaacttaatttactcattgct

SEQ ID NO: 16618 - DNA, 215 bp, Homo sapiens
  D10S1680
  Located on chromosome 10
  Distance between a terminus base of telomere on chromosomal short arm and 5'-terminus of this base sequence : 100274869
  Distance between 3'-terminus of neighbour sequence of sequence listing upward to telomere on chrosomal short arm and 5'-terminus of this base sequence : 4938
tcccgaagcagagagtacctgtattaatcatgcctttttatttgctctctctgtctcttgtgcactctctgtgtgtgtgtgtgtgtgtgtgtgtgtgtgtgtgtgtgtgtgtgtgtgttttggtttttgtttttttcagcgacaggatcttgctctgttgcccaggctggagtgcagtggagacatcataagagtttcgatatgttgctcaggct

SEQ ID NO: 16619 - DNA, 316 bp, Homo sapiens
  AL138923.4_109415
  Located on chromosome 10
  Distance between a terminus base of telomere on chromosomal short arm and 5'-terminus of this base sequence : 100326513
  Distance between 3'-terminus of neighbour sequence of sequence listing upward to telomere on chrosomal short arm and 5'-terminus of this base sequence : 51429
ccaggtctaattacatcagattacttgaatcttacatctggccaaattaggatatttccatttaagaaaagaaaaccaaagatcaataatgcatgcctactcttgcaaagaatgcaaagaacatataaatgggttctggtcagtcttatagatatattttcctataattacacactaattctttcttaaaaatatttcccaaaacagcaaaattctaccctccttggtaagcagcaaagggacaacacgggaaacaaaacaaaacaaaacaaaacaaaacaaaacataaaaaccctagaccatttaaagacaagca

SEQ ID NO: 16620 - DNA, 448 bp, Homo sapiens
  AL139118.5_123403
  Located on chromosome 10
  Distance between a terminus base of telomere on chromosomal short arm and 5'-terminus of this base sequence : 100482749
  Distance between 3'-terminus of neighbour sequence of sequence listing upward to telomere on chrosomal short arm and 5'-terminus of this base sequence : 155920
atcactgtgccagtaacattaggaagtcctaacaacattttttaagaagtgtctttactattcctggccctttagttaccctgtctgtctgtctgtctgtctgtctctctctctctctcataattattgttgaagtataacacatctacagaaaaatatgcaaatcatataaggtgtacaggtcaatgtatttcacaaagtaaacacagatttagccagcacccaaaccaacaaatggaatattagcaccccagaagcctttgttgtatctcctttcagtgtctctctccctcccacaaaacaaactaatattgtcttctaacaccattcacttggcctatttttgaacattatataaaagaattcatagttggtactattttgtatgtctccttttacccaaccttatatctgtaagattcatccatgtcgctggatgtagttatag

SEQ ID NO: 16621 - DNA, 209 bp, Homo sapiens
  G12432
  Located on chromosome 10
  Distance between a terminus base of telomere on chromosomal short arm and 5'-terminus of this base sequence : 100637923
  Distance between 3'-terminus of neighbour sequence of sequence listing upward to telomere on chrosomal short arm and 5'-terminus of this base sequence : 154726
aagaaagaaagatacacaggaagaaagaaaggaaggaagaaaagaaggaaggaaggaaggaaagaagaagggagggaggaaggaaggaaggaaggaaggaaggaaggaaggaaggaaggaaggaaggaagcaaaataatgtgtgctgtagaaaatgatggtgtcttcaagagcagttttgagggcagaaacattggcaaaagcaatctc

SEQ ID NO: 16622 - DNA, 153 bp, Homo sapiens
  D10S1690
  Located on chromosome 10
  Distance between a terminus base of telomere on chromosomal short arm and 5'-terminus of this base sequence : 100668275
  Distance between 3'-terminus of neighbour sequence of sequence listing upward to telomere on chrosomal short arm and 5'-terminus of this base sequence : 30143
cattcctgccatgatgacagaacctactactgacctttcacacacacacacacacacacacacacacacacacacagagtcatgtacatgccttctccatggagtgggaagactctcctcaaccttcagcctcttctttgtcacctgggagca

SEQ ID NO: 16623 - DNA, 377 bp, Homo sapiens
  chr10.fa.O7frz.102976792
  Located on chromosome 10
  Distance between a terminus base of telomere on chromosomal short arm and 5'-terminus of this base sequence : 100765709
  Distance between 3'-terminus of neighbour sequence of sequence listing upward to telomere on chrosomal short arm and 5'-terminus of this base sequence : 97281
acaaattaaggctgtagcttaatatagcctcaggatatgtgtgtgcctgtgtgtgtgtgtgtgtgtgtgtgtgtgtgtgtgtgtgtgtgtttaaacataagcttacatataagcgtatgtaagttaatgcacaaatatatttcctcaaattcacataggatactcaaatatagatgtataattttgtagtcccactgtgattctccatatgtataacaagaaaattaaaggcataatacagctgtgaaatagctgatgagtttctattttaagctgatttttcaccagaagtatagtttctgctgccaaagtaaagtataaatgtatttgtatatgtgtggaaaataaataatttgtgacatgtattggtcacttgt

SEQ ID NO: 16624 - DNA, 473 bp, Homo sapiens
  chr10.fa.O7frz.103191037
  Located on chromosome 10
  Distance between a terminus base of telomere on chromosomal short arm and 5'-terminus of this base sequence : 100973522
  Distance between 3'-terminus of neighbour sequence of sequence listing upward to telomere on chrosomal short arm and 5'-terminus of this base sequence : 207436
tctgcttaaagtgcctatcacttcggctgggtgtggtggctcttgcctgtaatcccagcactttgggaggccgtggcgggtggatcacctgaggtcgggagtttgagaccagcctcaccaacatggagaaaccccgtttctactaaaaatacaaaattagccaggcttggtggcgtatgcttgtaatcccaggtactcgggaggctgaggcaggagaattgcttgaacccgggaggcggaggttgcggtgagccaagattgcgccattgcactccagcctgggcaacaagagtgaaacttcatcccacacacacacacacacacacacacacacacaaaagtgcctatcacttcttcagacatccaattacccaatctaaaataactatcctgtcactctcatgccaccctattctaatattttgcaatttcccccttttcatcccaactcctggaatgtaagttccatatca

SEQ ID NO: 16625 - DNA, 167 bp, Homo sapiens
  HUMUT925
  Located on chromosome 10
  Distance between a terminus base of telomere on chromosomal short arm and 5'-terminus of this base sequence : 101098119
  Distance between 3'-terminus of neighbour sequence of sequence listing upward to telomere on chrosomal short arm and 5'-terminus of this base sequence : 124124
gtccttgtgagaaactggatgcctcaggtttgtttgtttgtttgtttgtttctttctttctttctttctttctttctttctttctttttctttctttctttcttttttatttctttctttctttcttttcgagacagagtcttgttctgttgcataggctggagtgc

SEQ ID NO: 16626 - DNA, 465 bp, Homo sapiens
  AL133513.5_68737
  Located on chromosome 10
  Distance between a terminus base of telomere on chromosomal short arm and 5'-terminus of this base sequence : 101336431
  Distance between 3'-terminus of neighbour sequence of sequence listing upward to telomere on chrosomal short arm and 5'-terminus of this base sequence : 238145
aaacttgcagtcatggtagaaggcaaagaggaagcaagcatatattttcatggaagagcaggagagagagagcaaagaggaaaggctacacacttttaaacaaccagatctcatgagaactcactcactatcatgagaacagcaagtgagaaatcatcccctatgatgcaatcaccttctaccaggtatctcccccaacactgggaattagaatttgacatgagatttgggtaaggacacagagacaaagcataccagcacacaaataaataaataaataaataaataaataaataaataaataaataaataagaaataagaaattatgattctaggtgacacatgctgtctgtttcttctgccatatcaaaatacccaagactaggcaactgataaataacagaaatttatttctcacagttctgaaggctgtgaattccaagattgaggtgtcagcaagttca

SEQ ID NO: 16627 - DNA, 422 bp, Homo sapiens
  chr10.fa.O7frz.103757301
  Located on chromosome 10
  Distance between a terminus base of telomere on chromosomal short arm and 5'-terminus of this base sequence : 101551041
  Distance between 3'-terminus of neighbour sequence of sequence listing upward to telomere on chrosomal short arm and 5'-terminus of this base sequence : 214145
cataagttaggccaaatctgtaattttacaggtaaagaaattattaaaaaggcttttattcggtgaaggaatctctaaaatgaaattgctgtaaccaagtgactagtgaacataaatggaaagggtgcccaaattcacatctataggtcctaaataagagtgacacgaaatgaaagggttgtgaataaagttggaacattgaacaacaagaaacctgctgagttagctgcttctatgccagactcctttaaacattacagggctctaaagtttcagaaaaactgttgttttagccaagggggtgaaaggtaatttgggaagccttggtgagagagagagagagagagagagagagagagagagtgtgtgtgtgtgtgtgtgtgtgtgtgtgtgtgtgtttctcaggtacaatctgatatcca

SEQ ID NO: 16628 - DNA, 189 bp, Homo sapiens
  D10S571
  Located on chromosome 10
  Distance between a terminus base of telomere on chromosomal short arm and 5'-terminus of this base sequence : 101863932
  Distance between 3'-terminus of neighbour sequence of sequence listing upward to telomere on chrosomal short arm and 5'-terminus of this base sequence : 312469
atgtacactgtgtctgtaatccctcttttaatatctgtccgtcctactacatatatgtgtgtgtgtgtgtgtgtgtgtgtgtatgtatgtatgtatatatttaactgaactgaacttctgtaagagacttagaggaaggtataaaagaatgagtcctgaaaaaggccatttctgacaaagcaaggactg

SEQ ID NO: 16629 - DNA, 432 bp, Homo sapiens
  chr10.fa.O7frz.104031976
  Located on chromosome 10
  Distance between a terminus base of telomere on chromosomal short arm and 5'-terminus of this base sequence : 101965376
  Distance between 3'-terminus of neighbour sequence of sequence listing upward to telomere on chrosomal short arm and 5'-terminus of this base sequence : 101255
acatactaaacatcagtgttgctcaaaagctcggagacgcactttggagaagggaggtgtacaaacaagcatttctagatggccgtcttgtatgccatcttccagggatgggtccagaaaccagcagatatactttggtttgttttttttaactgacacaaaatggttcggagacatgcccactctctctctctctctctctctctctctctctctctctctcaaagattcccttttcaatgctctgttggttcttctgcttgccccaagaaagaaacctccatcgtgcactaccagtcttcaacacatgctaaatcggggcaatgtggagacaggggaggcagtgatggcagccaggaggggacgggctgaagcaaaagacactgaatacttgaaaccacaaatcctgaatctgcaattcctctatttact

SEQ ID NO: 16630 - DNA, 330 bp, Homo sapiens
  chr10.fa.O7frz.104118489
  Located on chromosome 10
  Distance between a terminus base of telomere on chromosomal short arm and 5'-terminus of this base sequence : 101988408
  Distance between 3'-terminus of neighbour sequence of sequence listing upward to telomere on chrosomal short arm and 5'-terminus of this base sequence : 22600
tctaccacttgatatcctaaacacagacagctcctctggaaacttccttttacttttcatctcctgtgctgataaacacttcttgcctctccctcctcctctcctttggcctccattctctcttctcacctacaagtattggccctttcagatgccagtaggtgcttacacacatacacatacacacacaaacacacacacacacacaaacactctgaccatccctacttcctagttctctaattcagcctctactcattgccctgactccatatgaaaaaggcccaggcactaaactaaccaagagaaacttctccttagaaggtagtg

SEQ ID NO: 16631 - DNA, 296 bp, Homo sapiens
  AL356632.3_34922
  Located on chromosome 10
  Distance between a terminus base of telomere on chromosomal short arm and 5'-terminus of this base sequence : 102140562
  Distance between 3'-terminus of neighbour sequence of sequence listing upward to telomere on chrosomal short arm and 5'-terminus of this base sequence : 151824
ggttagcttttaaatagctcatgactactgcttttcccatctggattacaaactttccattgacaatatggcaaaaacgatgaggaacaaggcctttgaagttggtcagatttgggttcgagctctgcacttgctgtgtgtcttgtggagagttacccaatttttctttattattattattattattattattatactttaagttttagggtacatgtgcacaatgtgcaggttagttacatatgtaagagttacccaatttttctaagcctctgtttcctcacttataaatcagg

SEQ ID NO: 16632 - DNA, 374 bp, Homo sapiens
  AL365273.16_16092
  Located on chromosome 10
  Distance between a terminus base of telomere on chromosomal short arm and 5'-terminus of this base sequence : 102413259
  Distance between 3'-terminus of neighbour sequence of sequence listing upward to telomere on chrosomal short arm and 5'-terminus of this base sequence : 272401
tatcctaaggcaagtatcagaaatattggggaaaaagagtttgggcgtaacattcactgcaacattatgtataatagaaacacattggaatatcatgttgctgttaaaaatcacatttctcaaaattattattattattattattattattattatgagacagagtctcactctgtcacccaggctggagtgcagtggcgcaaccttggctcactgcaagctccgcctcccgggttcacgccattctcctgcctcagcctcccgagtagctgggactacaggtgcccaccaccacgcctggctaattgattattatttttttaaatgaggtctcactctgtcacctaggatgtggtgtaatggtgctatcatag

SEQ ID NO: 16633 - DNA, 135 bp, Homo sapiens
  D10S1698
  Located on chromosome 10
  Distance between a terminus base of telomere on chromosomal short arm and 5'-terminus of this base sequence : 102584019
  Distance between 3'-terminus of neighbour sequence of sequence listing upward to telomere on chrosomal short arm and 5'-terminus of this base sequence : 170386
ggggaagtttgaactgggtcttgatggaggagtagggctctgtaaatttcaaattgggagcatcccagtggagggagggtgtgtgtgtgtgtgtgtgtgtgtatgtggaggatgtccaggagtgggcaaagagct

SEQ ID NO: 16634 - DNA, 205 bp, Homo sapiens
  DISO7_10002919
  Located on chromosome 10
  Distance between a terminus base of telomere on chromosomal short arm and 5'-terminus of this base sequence : 102634155
  Distance between 3'-terminus of neighbour sequence of sequence listing upward to telomere on chrosomal short arm and 5'-terminus of this base sequence : 50001
aacaagtcatggcacctgcaccacacacagatgtgaaaatatagccactggcacaaaatagatcttgaataagttctaaaatgctaattcctcctcctcgggaagtgttcattcattcattcattcattcatttaccaatcaagtgctaaacacactccttcttggcccctttgaaactaaaagccacattagtgcagaggacgc

SEQ ID NO: 16635 - DNA, 474 bp, Homo sapiens
  AL356155.7_129473
  Located on chromosome 10
  Distance between a terminus base of telomere on chromosomal short arm and 5'-terminus of this base sequence : 102763178
  Distance between 3'-terminus of neighbour sequence of sequence listing upward to telomere on chrosomal short arm and 5'-terminus of this base sequence : 128818
ttgatgtctacaatatcacctttcttatagattcgcatatacatggccaaaggaacaactccatgttttctaaaaggcctagagaacatacatcaggtgcctttcttcttttcctttgcgttcatcattttggcgaattactggaagatggctgctccagccgaaaggatacttttctctatttttctattgtttcgtctgtctttatttatttataataaataaataaataaataaataaaatgtatttatatatttatctttgaggcggagtcttgctctgtcgcccaggctggagtgcagtggcgcgatctgggctcactgcaagctctgcctcccaggttcgaaccattctcctgcctcagcctcccgagtagctgggactacaggtgcctgccaccacgcccagctaatttatttgtatttttgatagagacagggtttcaccatgttagtcaggatggtattgatctc

SEQ ID NO: 16636 - DNA, 457 bp, Homo sapiens
  chr10.fa.O7frz.104651508
  Located on chromosome 10
  Distance between a terminus base of telomere on chromosomal short arm and 5'-terminus of this base sequence : 102774523
  Distance between 3'-terminus of neighbour sequence of sequence listing upward to telomere on chrosomal short arm and 5'-terminus of this base sequence : 10871
agtgtttactccattgaatgatacgatctatatcaagcacttggcacagggtcttgcacattagtaagcactcagtaactattagctattatgcatttttttgagacagcatctcactgcgttgcccaggctggaatgcagtgggacaatcatggattattgcagcctcagcctcccaagcccaaatgatcctcccacctcatcctcctaagtagctgggaccacaggtgtgcaccaccactcccagctaatatttattatttacctcttacacacacgcacacacacatacacacacacacacacacacacacaatttctcctactgtggacctcagggttgtctttcttgctgttacatattttctctttctggacccaatacaaaatgtaacatgatcttttaacttcttctctgagcctgcattagattttctaagagctttatcgctggtat

SEQ ID NO: 16637 - DNA, 459 bp, Homo sapiens
  AL391057.7_151211
  Located on chromosome 10
  Distance between a terminus base of telomere on chromosomal short arm and 5'-terminus of this base sequence : 102952700
  Distance between 3'-terminus of neighbour sequence of sequence listing upward to telomere on chrosomal short arm and 5'-terminus of this base sequence : 177720
ggctggagtatgtagatttcttcaatggtgctttttcttcagtttcctcatcatcaaaatcatcatcatcatcatcatcatcatcatcatcatcttcatcagcagcaagttttacttttattctctggaatcttgctaccacctccagggacagatcactttccagatatccttaagagtttcacatcctcctcctcttcatcttctgactctgcatcttcctccacagctactaaatgctgtccactaatatgcactggccctgaaccacacttcaaccataaaagcactggtggtgttatttcaaagaccccaagggaaactgttggctgtacagacattttcaaaggtgccagtgttatttaattggactgccttcataattcattgcctctgcttcaacaatgtgcagttcatcctttgcaccagcccctaaactgaccgttcttaaggataact

SEQ ID NO: 16638 - DNA, 446 bp, Homo sapiens
  chr10.fa.O7frz.105202622
  Located on chromosome 10
  Distance between a terminus base of telomere on chromosomal short arm and 5'-terminus of this base sequence : 103239774
  Distance between 3'-terminus of neighbour sequence of sequence listing upward to telomere on chrosomal short arm and 5'-terminus of this base sequence : 286615
gagttgcacattgaatcactactgccgttaaaataagagagaccacaacgtgctgcatgacaagatgtccatgataaagtgttaagtaaaaaattcagacaacaccaaagcacattgagtaaaatccctaatcccttttatgttacacacacacacacacacacacacacacacacacacacacgcaaacatgcacacacacagcctgagcacattaagtctggaaagaatccagcaaactggtaatgccagggatctttggggctgggataacaggggattttcatcttccactttatacaattatgagctactggacttttttttttttttttttttttacaacaagcagcattagtttaatcaacaaaaacaataaaaaatattcccattctgacgataaaataactattcatactattctaggtagacgcaaagtactattg

SEQ ID NO: 16639 - DNA, 138 bp, Homo sapiens
  D10S1736
  Located on chromosome 10
  Distance between a terminus base of telomere on chromosomal short arm and 5'-terminus of this base sequence : 103404130
  Distance between 3'-terminus of neighbour sequence of sequence listing upward to telomere on chrosomal short arm and 5'-terminus of this base sequence : 163910
agacttgtgagtgtgccgtgtgtgtgtgtgtgtgtgtgtgtgtgtgtgtgtgtgtgcgtgtgcatgtatacacccacgcaagcaagttcaggggaagaagagattggagcagaattgtacaatctcagggtcagaacc

SEQ ID NO: 16640 - DNA, 182 bp, Homo sapiens
  D20S208
  Located on chromosome 10
  Distance between a terminus base of telomere on chromosomal short arm and 5'-terminus of this base sequence : 103456393
  Distance between 3'-terminus of neighbour sequence of sequence listing upward to telomere on chrosomal short arm and 5'-terminus of this base sequence : 52125
acaataaacaaaatgggcgaataaatgaatggatggctggacagatggacagacggatggataactggatggatagatggaaagatgaatagttggatagatagatgagtggatggatggatggatggatggatggatgatttgtgtgtgtactcctcgttcagcctgccactaaaatgttg

SEQ ID NO: 16641 - DNA, 454 bp, Homo sapiens
  AL162502.3_81916
  Located on chromosome 10
  Distance between a terminus base of telomere on chromosomal short arm and 5'-terminus of this base sequence : 103565690
  Distance between 3'-terminus of neighbour sequence of sequence listing upward to telomere on chrosomal short arm and 5'-terminus of this base sequence : 109115
acaaggatcataacagtccttccctaaaactaaccccttccttgctcaggggccaaaaaccacctttgtcagactaatgaaaggccacaggaataggattatggtaaaggtctgaactcttataagatgtagacatagttagtttctttctttctttctttctttctttctttctttctttctttctttctttctttctttcctttcttccttccttctttcctttctttctttttctttttcttcctttcctttctttccttccttccttccttcctttctttttcttcctttccttctttctttctctttctttttctttctttctctctctctttctttctttcttttagatgtagacacagtttctataatcccttactgctcatgggtcatgtggccaaaggtcacaagagttgtcactttcccaattgctcctatagataacatcact

SEQ ID NO: 16642 - DNA, 440 bp, Homo sapiens
  chr10.fa.O7frz.105609918
  Located on chromosome 10
  Distance between a terminus base of telomere on chromosomal short arm and 5'-terminus of this base sequence : 103675608
  Distance between 3'-terminus of neighbour sequence of sequence listing upward to telomere on chrosomal short arm and 5'-terminus of this base sequence : 109464
ttgatcacttagttaaggtgctgtctgcctcttttctgtaagatcttcctttcttcctttcttccttccttccttccttccttccttccttccttcctttccttctttttcctttttgtagttaatggctacattgttgggggaggtactttgaggttttgtaaatatcttcttttttttaattatactagtttttcatgcactaattttagcatccattgatgaacattgcctgaaaaaaaattactgtggtgttgaccaaatgattttctatttccataatttcttctacatttatgagttggaattctactgtaaggaagaacttctcttttctccctatgttgttgttttaatatatcagtacgaattcatggattcttatttcattctgtggattataattcattacagtccttgtttacttagcagttcaaatt

SEQ ID NO: 16643 - DNA, 257 bp, Homo sapiens
  D10S1210
  Located on chromosome 10
  Distance between a terminus base of telomere on chromosomal short arm and 5'-terminus of this base sequence : 103781838
  Distance between 3'-terminus of neighbour sequence of sequence listing upward to telomere on chrosomal short arm and 5'-terminus of this base sequence : 105790
gtcccaggagttacttgttttcattcattcattcgtccacttcattcattcattcattcattcattcattcattcatatgttaagtcattaattacaggttcactcaagcatctgctctgagtcaggcagtgctctgggccctggggacagccctgcagtgtacacgaagagccctcctcctccccggcctctgcctccactcaccttatagccgctggggcaggcgcacctgtacacctcaagggggtcgttgtgg

SEQ ID NO: 16644 - DNA, 189 bp, Homo sapiens
  D10S1758
  Located on chromosome 10
  Distance between a terminus base of telomere on chromosomal short arm and 5'-terminus of this base sequence : 103946985
  Distance between 3'-terminus of neighbour sequence of sequence listing upward to telomere on chrosomal short arm and 5'-terminus of this base sequence : 164890
ataatgcacacgctgcccacagaaactcagtttggtaccacctctccccagccctgtaacacacaagcattcacacacacacatacacatgcaccacacacacacacacacacacacacacacacacacacacacttcccatctagattgcatctagattgcaaattctctaaaacctccacgggaatt

SEQ ID NO: 16645 - DNA, 215 bp, Homo sapiens
  D10S577
  Located on chromosome 10
  Distance between a terminus base of telomere on chromosomal short arm and 5'-terminus of this base sequence : 104074529
  Distance between 3'-terminus of neighbour sequence of sequence listing upward to telomere on chrosomal short arm and 5'-terminus of this base sequence : 127355
ttgcacaccagcctaagcaacagagtgagaccctgtctcaaaaaaatgtatatatatatatatatatgcatacacacacacacacacacacacacacacacacacacacacaccccatgagagatttattgaccccttgtcttcccatctcctcgttcttttgcaggggatagagatggggtcttgctgtgttggctggtctccaactcttgggc

SEQ ID NO: 16646 - DNA, 260 bp, Homo sapiens
  AL359388.14_155604
  Located on chromosome 10
  Distance between a terminus base of telomere on chromosomal short arm and 5'-terminus of this base sequence : 104458061
  Distance between 3'-terminus of neighbour sequence of sequence listing upward to telomere on chrosomal short arm and 5'-terminus of this base sequence : 383317
gtttccaagctctagacttcacagatcagtgaaatctgagagaaaaaaaaaatagtatctaacaaagagctgccaaattttatattgctgagtaagaacatttaagaagtaatcatctctcatcataatcatttcatcaaagtgaattatttatttttaaaacttattttatttatttatttatttatttatttatttatttatttattttttgagaccgagtcttactctgccgcccaagctggagtatagtggcacga

SEQ ID NO: 16647 - DNA, 440 bp, Homo sapiens
  AL355315.3_37029
  Located on chromosome 10
  Distance between a terminus base of telomere on chromosomal short arm and 5'-terminus of this base sequence : 104517090
  Distance between 3'-terminus of neighbour sequence of sequence listing upward to telomere on chrosomal short arm and 5'-terminus of this base sequence : 58769
aataccactcacatcaatctgtgtatccatatgtttatttcttaaacaatgtgagtacagcatgatgctaggttctgtcaggcttgaaaagccatgattgttactcttatggcctttataattagctgagtgtggtgacaagtgcctgtggtgccagcactcgggaggttaaggcaagagaactgcttgagcctggttaacagagaccctgtctcaaaacataaataaataaataaataaataaataaataaataaataaataaataaaatgtagtttcttggccaggggaatgacacactacaagcagtattttatgaaaattaatctgacagtgacactcagagatgaccagtgagagattggaagcaaagtaacaaactcagaagttattgtaataatgcaactaacacatcctggaagtttcatgtagcatcagtg

SEQ ID NO: 16648 - DNA, 164 bp, Homo sapiens
  D10S1709
  Located on chromosome 10
  Distance between a terminus base of telomere on chromosomal short arm and 5'-terminus of this base sequence : 104607174
  Distance between 3'-terminus of neighbour sequence of sequence listing upward to telomere on chrosomal short arm and 5'-terminus of this base sequence : 89644
cagtggaatggctcatttgtgtggtaggcttattgtttttattattttaaaattgtctataccccagatgaaatctggtgtgtgtgtgtgtgtgtgtgtgtgtgtgtgtgtgtgtgtgtgttcttgcttgggatttgtaacagagggggtgattctggactcac

SEQ ID NO: 16649 - DNA, 302 bp, Homo sapiens
  chr10.fa.O7frz.106823683
  Located on chromosome 10
  Distance between a terminus base of telomere on chromosomal short arm and 5'-terminus of this base sequence : 104746137
  Distance between 3'-terminus of neighbour sequence of sequence listing upward to telomere on chrosomal short arm and 5'-terminus of this base sequence : 138799
ctgaacgtaaagtgagttgactagtgtgataaaaacgggcctcctccttgcctccaaattctctcacacacacacacacacacacacacacacacacacacacgtatgcacacatacacacactcagagttaccgcaattccaccacctaggtgattagattgagccagaaaatactcatgggagggtaagtggggagacaattccatctgttacagcatattataggttacagagtacttttatagggggctgatcctacattctcagcagacctatgcatcctgctagacagcaaacacc

SEQ ID NO: 16650 - DNA, 369 bp, Homo sapiens
  chr10.fa.O7frz.106953104
  Located on chromosome 10
  Distance between a terminus base of telomere on chromosomal short arm and 5'-terminus of this base sequence : 104877883
  Distance between 3'-terminus of neighbour sequence of sequence listing upward to telomere on chrosomal short arm and 5'-terminus of this base sequence : 131444
tattacctgtgtagccttgagtacagaagactgtgagctccatggagttctggtctatattttattcttctagcccttaacacagtgtttgataaaggaacctgcatatattcactaagattcagtttcctcatctataaagtggggctaacaatatttgtcttaccccaaggtcaaacgagataatatatgtaaaccatgacacagctgttggttttgcatgtacgtgcacacacacacacagagagagagagagagagagagagagagagagagagagagagagtatggctattatctgtagcagaggcagctgcctgggccctggggagccctaggtcttccacccagtttgacaggagctgaatg

SEQ ID NO: 16651 - DNA, 353 bp, Homo sapiens
  chr10.fa.O7frz.107079850
  Located on chromosome 10
  Distance between a terminus base of telomere on chromosomal short arm and 5'-terminus of this base sequence : 104959824
  Distance between 3'-terminus of neighbour sequence of sequence listing upward to telomere on chrosomal short arm and 5'-terminus of this base sequence : 81572
cttgactcttagaatgatttgaatgtgttcttttatagagggccacacatccagcctctggcccctgttatccacagattttgagcagaactaccaggacctagtctgggctctgttttcaggtctctgtgatcttcctctgaaaagaaatagctaggcacagacaaactttctggctttttgagcccccatcaagcctgtaaggttgtgggcccctttgaaaatctggcaaaaattactgaatcatttttctagaaaaatatacaaacacacacatttacacacacacacacacacacacacacacacacacacacacacaccttgagtatactttcaggatcattaggaac

SEQ ID NO: 16652 - DNA, 245 bp, Homo sapiens
  DISD22_0011412
  Located on chromosome 10
  Distance between a terminus base of telomere on chromosomal short arm and 5'-terminus of this base sequence : 105203831
  Distance between 3'-terminus of neighbour sequence of sequence listing upward to telomere on chrosomal short arm and 5'-terminus of this base sequence : 243654
aaatagctgcaaggttgttgatttgtttacaaaaaagaagaagaagaagaagaagaagaagaagaagaagaagaagaagaacaagaagaagaagaagaagaagaagaagaaaggagaagaaaaagaggaagaggaagaagaggaagaggaggaaaaggaagaagaagaagaagaagaagaagaagaagaagaagaagaagaagaagaagaagaagaagaagaaaactgctcagaaaggacaagaa

SEQ ID NO: 16653 - DNA, 339 bp, Homo sapiens
  AL139243.6_46518
  Located on chromosome 10
  Distance between a terminus base of telomere on chromosomal short arm and 5'-terminus of this base sequence : 105371855
  Distance between 3'-terminus of neighbour sequence of sequence listing upward to telomere on chrosomal short arm and 5'-terminus of this base sequence : 167779
cagtgagccgagattacaccactgcactccagcctgggtgacagagcgagactctgtctgaaaaaacaaacaaacaaacaaacaaacaaacaaaaaacagctccagaagatgagcctcaaagcccctgaatttacttcagcaccacagaagtttcattcaaatgctgctctccctgttcatggtgagaacagaggctgcctaaagcccctgtacctagtaggctgcagcttctagggccacagccaccagtgtcttcagccctcccaaatctccttccccacccccccgccacacacacacacaccacacactctgtgcttgattatgtaagaaatgtc

SEQ ID NO: 16654 - DNA, 276 bp, Homo sapiens
  chr10.fa.O7frz.107541562
  Located on chromosome 10
  Distance between a terminus base of telomere on chromosomal short arm and 5'-terminus of this base sequence : 105439389
  Distance between 3'-terminus of neighbour sequence of sequence listing upward to telomere on chrosomal short arm and 5'-terminus of this base sequence : 67195
tatgtacacaggtatgcttcaagttgtcccgaaaacataactatggtgtgtgtgtgtgtgtgtgtgtgtgtgtgtgtgtgtgtgtgtttgtgtgtgtgtgtgcgcacgtgtgtgttgggaaggttcaggatggttggaaggaagtttcttgagatcagggcctgtatctttgcattcccagtgccatagacattgggatttaataaatattctttgattgaataaatgatcaaattaagattcacctcctgaagctgttgagaatgaaataactgc

SEQ ID NO: 16655 - DNA, 233 bp, Homo sapiens
  chr10.fa.O7frz.107776068
  Located on chromosome 10
  Distance between a terminus base of telomere on chromosomal short arm and 5'-terminus of this base sequence : 105670569
  Distance between 3'-terminus of neighbour sequence of sequence listing upward to telomere on chrosomal short arm and 5'-terminus of this base sequence : 230904
atagcacgatttaggaaatatttctccaaattgtgttccatggagtattgttccatggaatgaatgataacttatgttacacatacacacacacacatacatacacacacacacacacacacacacactttaatgattaaacaggactggctacataattttcaggtccccatgaaaaatgaaactatgagtcccctcgttaaaacattattatgaatttcaagatggtgact

SEQ ID NO: 16656 - DNA, 480 bp, Homo sapiens
  chr10.fa.O7frz.107852638
  Located on chromosome 10
  Distance between a terminus base of telomere on chromosomal short arm and 5'-terminus of this base sequence : 105722811
  Distance between 3'-terminus of neighbour sequence of sequence listing upward to telomere on chrosomal short arm and 5'-terminus of this base sequence : 52009
ctttccttgttcaaaactgtaaccatagccaagggaggggaggggaggggagggaaagggaggggagggaggaaggagagagagagagaaggaaggaaggaaggaaggaaggaaggaaggaaggaaggaaggaaagaaggaaggaaggaaagaaggaaagaaggaaagggcaagatggaagaatagaagcctatagcatgtgtctccctgtcccccatcccaagaatatcaaatattaacaactgtttgcacacagaaaatcactgtcacaagaaccaaaaatcaggtgaataatcacactacctggttttaacttcatataactgaaaagaggcattgaagagggtaggagagacagtcttgagtcaccaacaccaaccctcccacatcccctggcagcagccttacggcacggaaagtctgtgcacttgggggagagacagcacagcagatgggggactttacattgaactcagtgct

SEQ ID NO: 16657 - DNA, 238 bp, Homo sapiens
  chr10.fa.O7frz.107945750
  Located on chromosome 10
  Distance between a terminus base of telomere on chromosomal short arm and 5'-terminus of this base sequence : 105815924
  Distance between 3'-terminus of neighbour sequence of sequence listing upward to telomere on chrosomal short arm and 5'-terminus of this base sequence : 92633
aaagaatgtaactggatcgtttgtaactcaaaggataaatgcttgaggggatgaataccacacctgcaaaagggataggttttaaaacaaacacacacacacacacacacacacacacacacacacacatgcatgataaggtctaaagaaatcagccctgaagaaaacggagcaaatagatcctttgttatcttgacatatagtttccatagaaatctgacagtgaatttgatcactt

SEQ ID NO: 16658 - DNA, 396 bp, Homo sapiens
  AL360075.10_52123
  Located on chromosome 10
  Distance between a terminus base of telomere on chromosomal short arm and 5'-terminus of this base sequence : 105856759
  Distance between 3'-terminus of neighbour sequence of sequence listing upward to telomere on chrosomal short arm and 5'-terminus of this base sequence : 40597
taatgctagatgacgaggtagtgggtgcagcgcaccagcatagcacatgtatacatatgtaactaacctgcacattgtgcacatgtaccctaaaacttaaagtataataataaataaataaataaataaataaataaatattttttagtctcaaaaataaaaggaaaaaaacaaacaaacaagcttaagcttttatttatccatttaccaccaaatgccagaattctaccacaaacccataccttctttcctattaatactcatggtatatgatgtgtgcccttgtaagcacaaatagcaggcacaaagttccagaagcacacaccactgtcaatatgccaggcaaaagaacaaagaaattggaagcttcagcatcagtggacactgcagatccta

SEQ ID NO: 16659 - DNA, 200 bp, Homo sapiens
  D10S1726
  Located on chromosome 10
  Distance between a terminus base of telomere on chromosomal short arm and 5'-terminus of this base sequence : 105880073
  Distance between 3'-terminus of neighbour sequence of sequence listing upward to telomere on chrosomal short arm and 5'-terminus of this base sequence : 22918
gtgaggtgctaagcaggtcacctgtttttcccgtggctctgccactccagtgtgtgtaaagagggtgtcaagaaaatgtaagaccattgaggaaggattccccgctcaaaagaatttgtttgtgtgtgtgtgtgtgtgtgtgtgtgtgtgtgtgtgtgtgtgtgtcagggtgggtatagtagggcaaaatgggcaagggt

SEQ ID NO: 16660 - DNA, 469 bp, Homo sapiens
  chr10.fa.O7frz.108144736
  Located on chromosome 10
  Distance between a terminus base of telomere on chromosomal short arm and 5'-terminus of this base sequence : 106059716
  Distance between 3'-terminus of neighbour sequence of sequence listing upward to telomere on chrosomal short arm and 5'-terminus of this base sequence : 179443
acagtggctcatgtctgtattcccagcactttgggaggccgaggcaggaggatcacctgagggcaggagttcaagactagcctggccaacatgatgaaaccccatctctactaaaaatttaaaaattagccagatgtggtggcacatgcttgtaatcccagctactcaggaggctgaagcaagagaatcacttgaacctgggaggcagaggttgcagagagccaagattgtgccattgcactccagcctgggcaacaacagggaaattccgtcttaaaaaagaaaagaaagaaaggaaagaaagaaaggaagaaagaaagaaagaaagaaagaaagaaagaaagaaagaaagaaagagagagagagagagagagagagagagagagagagagagagagagagagagaaagaaagaaagaaagaaagaaagaaagaaagaaaagaaattaccagtaaagaatttatgcat

SEQ ID NO: 16661 - DNA, 363 bp, Homo sapiens
  chr10.fa.O7frz.108267187
  Located on chromosome 10
  Distance between a terminus base of telomere on chromosomal short arm and 5'-terminus of this base sequence : 106183143
  Distance between 3'-terminus of neighbour sequence of sequence listing upward to telomere on chrosomal short arm and 5'-terminus of this base sequence : 122958
gattactggtgaattctaacaaacatttaagggagaaatagtattagttttatacaaactcttcgaggaagtaggagaggagatacctgtccccaatttattctatgatgccagcatggctttgataccaaaaccagaaaaagatattagaaaaaaataaaactactgacaaataaggatactacatcacaacaaagttgggcttatccaggaatataaggttgttttaacattcaaaagcataaatataactcaacatactaacaaattagtacacacacatgcacgcatgcacacatacacacacacacacacacacacacacacacacgactacaatagatgcagtaaagtcatttgata

SEQ ID NO: 16662 - DNA, 193 bp, Homo sapiens
  D10S198
  Located on chromosome 10
  Distance between a terminus base of telomere on chromosomal short arm and 5'-terminus of this base sequence : 106248477
  Distance between 3'-terminus of neighbour sequence of sequence listing upward to telomere on chrosomal short arm and 5'-terminus of this base sequence : 64971
tgagggactcatcttctgttcctttattagttaggtattggttctagaaatggagaaggagcccattcatcaaaagtagaatttgtctctactcttttcttacacacacacacacacacacacacacacacacacagtccttgacatgaacaaaatgtctatatcagggatccctaacatggggatcacagac

SEQ ID NO: 16663 - DNA, 258 bp, Homo sapiens
  chr10.fa.O7frz.108516068
  Located on chromosome 10
  Distance between a terminus base of telomere on chromosomal short arm and 5'-terminus of this base sequence : 106334937
  Distance between 3'-terminus of neighbour sequence of sequence listing upward to telomere on chrosomal short arm and 5'-terminus of this base sequence : 86267
gaagaaccttgctcaaagttaccagctactgagcaggagtgccagtcttcaacccaggaggtctgacactagaagaagcttcccttctgaacacagaggtagaggacacaccgaggccacattagtgtgtgtgtgtgtgtgtgtgtgcatgcacgcacatgccttggaaggcaaacccatctcttcagcacccatcctaagatcaaacttaccctctagcataagcctctaaaacagtgttcctaacttgtcattgac

SEQ ID NO: 16664 - DNA, 210 bp, Homo sapiens
  HUMUT6554
  Located on chromosome 10
  Distance between a terminus base of telomere on chromosomal short arm and 5'-terminus of this base sequence : 106399298
  Distance between 3'-terminus of neighbour sequence of sequence listing upward to telomere on chrosomal short arm and 5'-terminus of this base sequence : 64103
cccgggagattaaagctgcagtgagctatgattacaccactgcactccagcctgggtgacagtgtgaacctgtcaaaagagaaagagtgaaagaaggaaggaaggaaggaaggaaggaaggaaggaaggaaggaaggaaggaaggaaggaagggaaggaaggagccaggcacagtggctcacgcctgtaatccaaacactttgggaggcc

SEQ ID NO: 16665 - DNA, 458 bp, Homo sapiens
  chr10.fa.O7frz.108662486
  Located on chromosome 10
  Distance between a terminus base of telomere on chromosomal short arm and 5'-terminus of this base sequence : 106496779
  Distance between 3'-terminus of neighbour sequence of sequence listing upward to telomere on chrosomal short arm and 5'-terminus of this base sequence : 97271
tactcagttcctacatcgattaactcaacttttacagaaatatcacaaaatgtaagttttttcaaaaacttaaaatccatgctcttatctcattccaattttgtgcccctccccccgaaaggaagacattctttggccatcagagcctaatctaggatttcctctggtttccacctgagccaagatcaaagcgccccatgcccaagaagttggggggaggtgcgggggttgggagaggaggagtggggctgggggtcaaaatagggctatacaaaaaaacaaacaaggcagagtgactccatgacattggagactgaaatactttgcttctagagttaaacacacacacacacacacacacacacatacacacacacagagcagtctccccaggactcacttgctgtaatgtaaaagagtaatcgtcttcctcactcatgaatcattctaactttagg

SEQ ID NO: 16666 - DNA, 274 bp, Homo sapiens
  AL133353.6_9089
  Located on chromosome 10
  Distance between a terminus base of telomere on chromosomal short arm and 5'-terminus of this base sequence : 106588221
  Distance between 3'-terminus of neighbour sequence of sequence listing upward to telomere on chrosomal short arm and 5'-terminus of this base sequence : 90984
tacaaagtgaacttcacagatgaatacacttatccatacattataataacctgaagcttttaaaaaatattaatgtggatctacatgcaccaataagggaaagttataaaataaagtgggggaaagatgcagaacagcaggtatggtggactaccatttgtgtaaaaccgagggaatggatacgcacacacacacacacacacacacacacacacacacagagatatattactgtaaatatattggtgtatatttatgcttgtgtatccgtaga

SEQ ID NO: 16667 - DNA, 322 bp, Homo sapiens
  AL133353.6_48977
  Located on chromosome 10
  Distance between a terminus base of telomere on chromosomal short arm and 5'-terminus of this base sequence : 106628247
  Distance between 3'-terminus of neighbour sequence of sequence listing upward to telomere on chrosomal short arm and 5'-terminus of this base sequence : 39752
gagcatttatgttatccaacgtaccgtgtgtgtgtgtgtgtgtgtatgtgtgtgtgtgtgtgtgtgtgtgtgtgtgtttattgtctgtctcctaccactagaatgtaagcttcctgaggacaggaatttttgtctgttttatttactgcatgattccctggcatctagaacagcacctggcacatagcagacatacaaaccaaaaggaatgattattttggtgagaattacaacaccgagggaggccaatgacaggtttctaaccatcctcttccatctgctctccctgctcatgtcagtcctatgtggagtagaatgaaac

SEQ ID NO: 16668 - DNA, 370 bp, Homo sapiens
  AL133353.6_154640
  Located on chromosome 10
  Distance between a terminus base of telomere on chromosomal short arm and 5'-terminus of this base sequence : 106733862
  Distance between 3'-terminus of neighbour sequence of sequence listing upward to telomere on chrosomal short arm and 5'-terminus of this base sequence : 105293
ctgttggttagattgaataaggacccaaaaaatgtccatgcatgatatttaattgatagtgattttaatctactacagtctctctctctctgtctgtgtgtgtgtgtgtgtgtgtgtgtgtgtgtgtgtcttggtcattccaaaaaaactaggttatttgtcctatttcctgtatttcctgtaaattgatagttagatctaaaggtttgattgatttatatttgatttgggggcgggagtacaaggttgctttcaagtggtgctgtgtgcttcccaaactgcagcgatggtaacttgagcgggcccaggtgctgtcagcctgatccatcccttacaaggtttcctgctagtctttcactagagcagtggt

SEQ ID NO: 16669 - DNA, 141 bp, Homo sapiens
  DISD22_0011422
  Located on chromosome 10
  Distance between a terminus base of telomere on chromosomal short arm and 5'-terminus of this base sequence : 106947611
  Distance between 3'-terminus of neighbour sequence of sequence listing upward to telomere on chrosomal short arm and 5'-terminus of this base sequence : 213379
ccattcttatcactaagggttagagaagtttgataggtttttctgggtgtgtgtgtgtgtgtgtgtgtgtgtgtgtgggtatgtgtgtacatgatttaagaaatgaagcctgtcccttttgtgccatatgccaaagagcaa

SEQ ID NO: 16670 - DNA, 469 bp, Homo sapiens
  AL138921.9_10398
  Located on chromosome 10
  Distance between a terminus base of telomere on chromosomal short arm and 5'-terminus of this base sequence : 107175566
  Distance between 3'-terminus of neighbour sequence of sequence listing upward to telomere on chrosomal short arm and 5'-terminus of this base sequence : 227814
aacttcgattgcctcaataacttcatatgaagaatgaaaacaaaaaatagtatcttcctcatgggaccgccgtgctgactaaatatgataaagcatgcaaaatccttagtagagtatccggcacataaaaggtactcataaatgttagctgtcataataataataataataataataataataataataataataataatgagaattgttattttctcaaactcctgagatcaaatgatcccaaattccaaagtgctgagattataggcgtgagccgccactcctggcctgaaaattgttagacgcgattgcaggagtactttttctctctctctctctctctctctctttttttttttttagagatgggggctcactatctcgggcaagctggtctcgaactcctggcctcatgtgatcctcccatctcagcctgccaaagtgctggtattctagatgtgagccactg

SEQ ID NO: 16671 - DNA, 480 bp, Homo sapiens
  chr10.fa.O7frz.109393646
  Located on chromosome 10
  Distance between a terminus base of telomere on chromosomal short arm and 5'-terminus of this base sequence : 107345958
  Distance between 3'-terminus of neighbour sequence of sequence listing upward to telomere on chrosomal short arm and 5'-terminus of this base sequence : 169923
cattgtagactgagaagtcgatgaacaccactcgagtgcccctgtccagccacagcccctcctgaagggcccggagagcctctgcactaccctgtcgggatcctggaaggtccaggtagtagccacctccgctgtagcttgtgagcctgccccagtgggagaagccccccaactcatcctgcgagtggtatgtccacctgccacagaaaatgccagctgagccagcccaaaagttcatctcccaaggcaatggcaatgctttatcattgtctgggctttacaggtttacatattgtgtgtgtgtgtgtgtgtgtgtgtgtgtgtgtgtgtgtgtgtatgagatatgtgatatatacatatataatgtatcatttattattctgtttgatactaacaaccatttgagaagggagagtgaatattatccacattttgcagaagaggaaactatgaaagaggttaccgagataatccagctat

SEQ ID NO: 16672 - DNA, 245 bp, Homo sapiens
  D10S603
  Located on chromosome 10
  Distance between a terminus base of telomere on chromosomal short arm and 5'-terminus of this base sequence : 107346190
  Distance between 3'-terminus of neighbour sequence of sequence listing upward to telomere on chrosomal short arm and 5'-terminus of this base sequence : -248
gttcatctcccaaggcaatggcaatgctttatcattgtctgggctttacaggtttacatattgtgtgtgtgtgtgtgtgtgtgtgtgtgtgtgtgtgtgtgtgtatgagatatgtgatatatacatatataatgtatcatttattattctgtttgatactaacaaccatttgagaagggagagtgaatattatccacattttgcagaagaggaaactatgaaagaggttaccgagataatccagc

SEQ ID NO: 16673 - DNA, 132 bp, Homo sapiens
  DISD22_0011426
  Located on chromosome 10
  Distance between a terminus base of telomere on chromosomal short arm and 5'-terminus of this base sequence : 107511187
  Distance between 3'-terminus of neighbour sequence of sequence listing upward to telomere on chrosomal short arm and 5'-terminus of this base sequence : 164752
cacagtcctttctggatcccttttggggaccaggctgtgtgtgtgtgtgtgttgtgtgtgtgtgtgtgtgtgtaagtgtgcataggtgggaaaaggttgtggtgtgatgggaggggataggcaagagggagg

SEQ ID NO: 16674 - DNA, 196 bp, Homo sapiens
  D10S192
  Located on chromosome 10
  Distance between a terminus base of telomere on chromosomal short arm and 5'-terminus of this base sequence : 107613329
  Distance between 3'-terminus of neighbour sequence of sequence listing upward to telomere on chrosomal short arm and 5'-terminus of this base sequence : 102010
ttatactaggaaacaaggcttacctagaccttcataatcacagatgtgtccacacacacacacacacacacacacacacacacacacacacacagagagagagagagagagagagagataaaggcaggaaactggtctgaatcaaagtttttgttgttgttttgtctttcaagaaagtgctcattcatttaagccc

SEQ ID NO: 16675 - DNA, 177 bp, Homo sapiens
  Z16555.1_131
  Located on chromosome 10
  Distance between a terminus base of telomere on chromosomal short arm and 5'-terminus of this base sequence : 107613334
  Distance between 3'-terminus of neighbour sequence of sequence listing upward to telomere on chrosomal short arm and 5'-terminus of this base sequence : -191
ctaggaaacaaggcttacctagaccttcataatcacagatgtgtccacacacacacacacacacacacacacacacacacacacacacagagagagagagagagagagagagataaaggcaggaaactggtctgaatcaaagtttttgttgttgttttgtctttcaagaaagtgctc

SEQ ID NO: 16676 - DNA, 161 bp, Homo sapiens
  D10S1266
  Located on chromosome 10
  Distance between a terminus base of telomere on chromosomal short arm and 5'-terminus of this base sequence : 107716011
  Distance between 3'-terminus of neighbour sequence of sequence listing upward to telomere on chrosomal short arm and 5'-terminus of this base sequence : 102500
cagccaacgtatttctgcttttctctctctctctctctctctctctctctgtgtgtatgtgtgtgtgtgtgtgtgtgtgtgtgtgtgtgtgtgtgtgtgtacattcagaattgaaggttctaaggttaaaaatatccttggaaactcctggactaggtgag

SEQ ID NO: 16677 - DNA, 263 bp, Homo sapiens
  D10S1265
  Located on chromosome 10
  Distance between a terminus base of telomere on chromosomal short arm and 5'-terminus of this base sequence : 108021267
  Distance between 3'-terminus of neighbour sequence of sequence listing upward to telomere on chrosomal short arm and 5'-terminus of this base sequence : 305095
tccattgctgacagggatagaaggaaaacagtttttatactgctggtagaaatgcaaatttccacaaccctctataatctggaaacatctttagaaattgaaaatatatattccctttgacccatcaatcacactcttatatcccatagaagagcaaatgccaagagattatacatacatacgtacacacacacacacacacacacacacacacacacacacacacacacacacacatacatattaggattgtttgtactggc

SEQ ID NO: 16678 - DNA, 368 bp, Homo sapiens
  AL133215.16_165542
  Located on chromosome 10
  Distance between a terminus base of telomere on chromosomal short arm and 5'-terminus of this base sequence : 108060104
  Distance between 3'-terminus of neighbour sequence of sequence listing upward to telomere on chrosomal short arm and 5'-terminus of this base sequence : 38574
agatattccagtacagactttcgttcattgttttatatagttggcattttgagtgccagctgtgccaggcactggagagaacagcaatgaaaaaatcagtgtctctgatctcatgaagcccacatgctaatgtagaggagacaaacaataagtgtgtgtgtgtgtgtgtgtgtgtgtgtgcgcgcgcgcgcgcgcgcacatttgtaaatgtattgtgtcagatgataagtgctatgaagaaaacgtagggtaaggtagatacagagagtaccggggtgagagagaaagtttgcttttttaaagtgtaaagtagttgaaggtcttgcggttaaggtaagatccaagtaaaggagtagcttgtcaatgtc

SEQ ID NO: 16679 - DNA, 135 bp, Homo sapiens
  Z67332
  Located on chromosome 10
  Distance between a terminus base of telomere on chromosomal short arm and 5'-terminus of this base sequence : 108090336
  Distance between 3'-terminus of neighbour sequence of sequence listing upward to telomere on chrosomal short arm and 5'-terminus of this base sequence : 29864
caaccttgtttccatgagtatataattttggcagacacctgaattctttgggacactgtgtctgtgtatgtgtgtgtgtgtgtgtgtgtgtgtgtgcgcttgtatcttgaagttgttgcacttcaaaaccacagc

SEQ ID NO: 16680 - DNA, 194 bp, Homo sapiens
  D10S1710
  Located on chromosome 10
  Distance between a terminus base of telomere on chromosomal short arm and 5'-terminus of this base sequence : 108142206
  Distance between 3'-terminus of neighbour sequence of sequence listing upward to telomere on chrosomal short arm and 5'-terminus of this base sequence : 51735
gtctcagtctccaggtgacaatgcatggacacacacacacacacacacacacgctagccagacacgtgcttgctcacatgcacacacacacacacaatcatgcagtcatatcagtacaaaccaggtaccccacagacacgccagtgcacacaccacacagacatacaacacagccccactttgagtaagatgaa

SEQ ID NO: 16681 - DNA, 363 bp, Homo sapiens
  AL133215.16_78657
  Located on chromosome 10
  Distance between a terminus base of telomere on chromosomal short arm and 5'-terminus of this base sequence : 108146938
  Distance between 3'-terminus of neighbour sequence of sequence listing upward to telomere on chrosomal short arm and 5'-terminus of this base sequence : 4538
ctgacctaaggcatgtcacttctcaaatcacccactgggactccagaccctaggagagcctgcattttatccgcagattctcagaggggagcccagaaatagctctggactgtgtgaagggtcttggttcctgtgcttttctgcttccccttctgcttctgcttctgcctcctcctcctcctcctcctcctcctcctcctcctcctcctcctcttcttcttcttcttcttcctcctcttcttctttcttcttcttcttttttttttctttgagacagtctcattctatggccctgactggagtgcagtgatgtgatctcggttcactgcaacctctacttcctgagttcaagcgattcttgtg

SEQ ID NO: 16682 - DNA, 283 bp, Homo sapiens
  AL133215.16_73399
  Located on chromosome 10
  Distance between a terminus base of telomere on chromosomal short arm and 5'-terminus of this base sequence : 108152164
  Distance between 3'-terminus of neighbour sequence of sequence listing upward to telomere on chrosomal short arm and 5'-terminus of this base sequence : 4863
gacaggactctatgctaaagacaccattctctagccaggtgtagtggtgtatgcctgtggtcccagctacacggaaggctgaggcaggagcccaggaggtcgaggctgcagtgacctgtgttcacaccactgcactccagcctgggtgacagagtgagacccctgtctcaaaaaaaaaaaaaaagaaagaaagaaaaagaaaaaaaaagatactgttctccttccttcctaatatgtgtgtgtgtgtgtgtgtgtgtgtgtgtatcagtgctttctgagcttc

SEQ ID NO: 16683 - DNA, 365 bp, Homo sapiens
  AL357395.5_150694
  Located on chromosome 10
  Distance between a terminus base of telomere on chromosomal short arm and 5'-terminus of this base sequence : 108237990
  Distance between 3'-terminus of neighbour sequence of sequence listing upward to telomere on chrosomal short arm and 5'-terminus of this base sequence : 85543
atacctactccataggattgctgtgaaggttaaagtgaactaagtcatgtaaaactcttagaacatcccccagcacatggtaggtgttcaacaaatgttttttattttgtgtatctacgtgagcatgttaatgtttctcatccctttaacaggaggagcaggtggccagacacggtggctcacgcctgtaaccccagtactttgggaatccaagtggggaggatcacttgaagccaggagttaataataataataataataataataataataataataataaaaggaggaacattgtctgacccttcccccattagaggggctttgtggctctgtccatcctttcagtctgtttgtagacactt

SEQ ID NO: 16684 - DNA, 357 bp, Homo sapiens
  AJ009794.1_312
  Located on chromosome 10
  Distance between a terminus base of telomere on chromosomal short arm and 5'-terminus of this base sequence : 108246713
  Distance between 3'-terminus of neighbour sequence of sequence listing upward to telomere on chrosomal short arm and 5'-terminus of this base sequence : 8358
gtacagatgcatgtctgcatagctggacccatgacttcaatgatggtcaatgtgttatgcttacgagtttgcatacacatttttgagagtgaggagtctgtatgtacctctgagtgtgtgtgtgtgtgtgtgtgtttgtctatacatcatgtacaagtcatgtgaaaggcctggttaggaaggtttcccatacccagagcacttagaaaagactcgggagggacactggctaggggaggtggggtaaagagaaggtctaatccttcataaataagcagagggatgttgtggtcagtcagaaatgtctccaggcagattcaggcaggttttcagtatttagcaaagtcacttgtagcc

SEQ ID NO: 16685 - DNA, 333 bp, Homo sapiens
  AL357395.5_133357
  Located on chromosome 10
  Distance between a terminus base of telomere on chromosomal short arm and 5'-terminus of this base sequence : 108255357
  Distance between 3'-terminus of neighbour sequence of sequence listing upward to telomere on chrosomal short arm and 5'-terminus of this base sequence : 8287
aggagttcaagaggtagatcaggcaaatgccaaaagggttggaaggccatctgagctggagatgtgcacctggaaagataggtggtttattttattttattttattttattttatttagttttataaattttaccttcaaccaacccacaccaaaagatggggttttaactgcagcaggtaaaactgtggtgagactaaaaggagtgaggccactaggacccagcctcaaaaaaagctgcagtacccttccccatagttttcagcctcaaacaaggaaaatagctcagattttgagattccagatcaatcttctctgtctatggaacttggag

SEQ ID NO: 16686 - DNA, 333 bp, Homo sapiens; identical to SEQ ID NO: 16685
  AJ009794.1_8946
  Located on chromosome 10
  Distance between a terminus base of telomere on chromosomal short arm and 5'-terminus of this base sequence : 108255357
  Distance between 3'-terminus of neighbour sequence of sequence listing upward to telomere on chrosomal short arm and 5'-terminus of this base sequence : -333

SEQ ID NO: 16687 - DNA, 311 bp, Homo sapiens
  AL135794.5_98183
  Located on chromosome 10
  Distance between a terminus base of telomere on chromosomal short arm and 5'-terminus of this base sequence : 108387391
  Distance between 3'-terminus of neighbour sequence of sequence listing upward to telomere on chrosomal short arm and 5'-terminus of this base sequence : 131701
aataaatgaatagtgagctgagatcgcgccactgcactccagcctgggcaacagagtgagattccatcttaaaaaataaataaataaataaataaataaataaataaataaagacagcccaagtcccagcatattttcagatgttccttgatcagcatgattttaagagagggaagaaaggagacagtttgacaagaaaatgaaagagggagaatgaggacggtgcatggctggggactattgtttgagttgtaagctctcttgctgggacaacgcctgtgattccagtacttcggacgtttatactcaag

SEQ ID NO: 16688 - DNA, 315 bp, Homo sapiens
  chr10.fa.O7frz.110493036
  Located on chromosome 10
  Distance between a terminus base of telomere on chromosomal short arm and 5'-terminus of this base sequence : 108458827
  Distance between 3'-terminus of neighbour sequence of sequence listing upward to telomere on chrosomal short arm and 5'-terminus of this base sequence : 71125
aggttgtatttaggagaaccagggattttaaagaggaaaaagaggcaagagagagagaatctctctctctctttctctctctgtgtgtgtgtgtgtgtgtgtgtgtgtgtgtgtgtgttgtggggggaagaaagagaagaaagagagggagagacagattgattgagattgcaagcttatctcttagtcatgtgggacaaaggatgctattgtgagttcttaaaaatatgataaatacttgttgtgtacctgagctttgatcctgcccagagccatgaatattgcctctctgaccttcaaggtcatttgatgaac

SEQ ID NO: 16689 - DNA, 289 bp, Homo sapiens
  HUMUT7406
  Located on chromosome 10
  Distance between a terminus base of telomere on chromosomal short arm and 5'-terminus of this base sequence : 108564054
  Distance between 3'-terminus of neighbour sequence of sequence listing upward to telomere on chrosomal short arm and 5'-terminus of this base sequence : 104912
ctgggtgtggtggtactcacctgtcccagctatctggaaggccaaggtgggaggtcaaggctgcagtgagccatgattgcgacactgcattctagcctgggtgacagagtgagaccctgtttcaattaaaaaaaatagatagatagatagatagatagatagatagatagatagatagatttatatggccctagaatactttagctatcaagtgtaaccagtaattttaggaaaatcttgagctaagtgaaacgtgatattttaacattagctagggttccatgtcaaa

SEQ ID NO: 16690 - DNA, 462 bp, Homo sapiens
  chr10.fa.O7frz.110606475
  Located on chromosome 10
  Distance between a terminus base of telomere on chromosomal short arm and 5'-terminus of this base sequence : 108660236
  Distance between 3'-terminus of neighbour sequence of sequence listing upward to telomere on chrosomal short arm and 5'-terminus of this base sequence : 95893
tttggccatcacataattatagactaccctgttccttaatgaaaaggataaaagtttgcattagtactgaagctatatgtgtgtgtgtgtgtgtgtgtgtgtgtgtgtgtgtgtgtgcgcgtgtgcgcgcgcgcgcgcttagctatacctatagaaaatgcattccacactactctgggctttgattattttgggggatcagacacgtaataggaccaacaagtctccacagcaccccatcatcacattgatcaaaaggatcttatttgccatcctagatctgggataaaaacacattggaatgcaagcgaattctcacaggccatacaggttcagtcctctgtctccagtatgatgagagagtgatcataacaggatcatcggattccacggtcaggtagaaaatttcaaatgcttttttgaactctgaaatatcagctctgctctgttctttgtcataga

SEQ ID NO: 16691 - DNA, 187 bp, Homo sapiens
  DISO7_10002949
  Located on chromosome 10
  Distance between a terminus base of telomere on chromosomal short arm and 5'-terminus of this base sequence : 108836775
  Distance between 3'-terminus of neighbour sequence of sequence listing upward to telomere on chrosomal short arm and 5'-terminus of this base sequence : 176077
tcaagttgagcgacataagcaaaatacattcagagcaatatatacaaaaatatttaacacaaaacaatattgtaattctttaaggatatgtatatgtgtgtatatatatatatatatatatatatatatatatatatatatatatacgtagaagtacaaaaaatagaacagaattatgcacctcaaa

SEQ ID NO: 16692 - DNA, 206 bp, Homo sapiens
  DISO7_10002950
  Located on chromosome 10
  Distance between a terminus base of telomere on chromosomal short arm and 5'-terminus of this base sequence : 109168499
  Distance between 3'-terminus of neighbour sequence of sequence listing upward to telomere on chrosomal short arm and 5'-terminus of this base sequence : 331537
cactgcacttgactgtctttagaaattcctctggaaagagacccaaggcagaaaatagcagctaagaggccaaaaaaatccgatttaaaataactgaatagagtaatatactactttcaaatttaattgtgtgtacatatatatatatataatatatatatatatatatatatgtaggtaaaacactattgcagatcaaactccaa

SEQ ID NO: 16693 - DNA, 263 bp, Homo sapiens
  DISO7_10002952
  Located on chromosome 10
  Distance between a terminus base of telomere on chromosomal short arm and 5'-terminus of this base sequence : 109206612
  Distance between 3'-terminus of neighbour sequence of sequence listing upward to telomere on chrosomal short arm and 5'-terminus of this base sequence : 37907
ttacatctgggagctgaggaaagtaaaaaaaaaaaaaaaaaaaaaaaaaaaagatggacaaggctgggtgcggtggctcacacctgtaatctcagcactttgggaggcaggaaaatcacttgaaccagggaggcagaggttgcagtgaaccgagatcacgccactgcactccagcctgggcgacagagcaagactccatctccacacacacacacacacacacacaaatatatatatattaggactagatgtctggcttgcct

SEQ ID NO: 16694 - DNA, 250 bp, Homo sapiens
  Z67462
  Located on chromosome 10
  Distance between a terminus base of telomere on chromosomal short arm and 5'-terminus of this base sequence : 109404329
  Distance between 3'-terminus of neighbour sequence of sequence listing upward to telomere on chrosomal short arm and 5'-terminus of this base sequence : 197454
gcaaaaagttggctactagaggttgttttactgctatttagaatgtgaattcatccctatttcctttttacctaattggtatcaggacattgaatcaaatgaacagatggtgaattttcttgaatttttattttgaaataatttcaaatttaaaggtgcaagaataataggtctcccatatgtccttttgctacttacacacacacacacacacacacacacatgcacacacgtatgtatgtatgtatgt

SEQ ID NO: 16695 - DNA, 259 bp, Homo sapiens
  Z67788
  Located on chromosome 10
  Distance between a terminus base of telomere on chromosomal short arm and 5'-terminus of this base sequence : 109432599
  Distance between 3'-terminus of neighbour sequence of sequence listing upward to telomere on chrosomal short arm and 5'-terminus of this base sequence : 28020
ggtgtggtggttcataccaaaataaaaattttatgtaaaacattggttccagaaggattgagatcaggcattctgatctgggatccagcaatgggcttcaggagattaatgaaccttctgaaattatatgcagatttgtgtgtgtgtgtgtgtgtgtgtgtgtgtgtgtgtgtgtgtgtgtacttgatcacctcagtgaaataatattaagaggtgaaataatattaagaggtaccactgtacttctaattctggacaa

SEQ ID NO: 16696 - DNA, 204 bp, Homo sapiens
  chr10.fa.O7frz.111683312
  Located on chromosome 10
  Distance between a terminus base of telomere on chromosomal short arm and 5'-terminus of this base sequence : 109663377
  Distance between 3'-terminus of neighbour sequence of sequence listing upward to telomere on chrosomal short arm and 5'-terminus of this base sequence : 230519
atgcatatgaacacttagcaacagactatgtgaagccttgcacgctagacctgcagatacagtagtgaccaagatacaaccctgcccttgtggggtttatagtctaggctggagatgatgatgatgatgatgatgatgatgatgatgatgatgttgttgatgattttaagacagagtcttgctctgtctcgcttcggttagagt

SEQ ID NO: 16697 - DNA, 195 bp, Homo sapiens
  D10S1697
  Located on chromosome 10
  Distance between a terminus base of telomere on chromosomal short arm and 5'-terminus of this base sequence : 109739625
  Distance between 3'-terminus of neighbour sequence of sequence listing upward to telomere on chrosomal short arm and 5'-terminus of this base sequence : 76044
aacctgtgtcggctgcagatttaatacctcacctagcccacacaaataattcatgcttctgcatcgatgtccagaagaaacaaatcagcagaaaactgggttcttgtgtgtgtgtgtgtgtgtgtgtgtgtgtgtgtgtgtgtgcacgcgcatgtgtgtgtgtgtgtatagcagccgcgtttccatcgaagcagc

SEQ ID NO: 16698 - DNA, 199 bp, Homo sapiens
  D10S1267
  Located on chromosome 10
  Distance between a terminus base of telomere on chromosomal short arm and 5'-terminus of this base sequence : 109746423
  Distance between 3'-terminus of neighbour sequence of sequence listing upward to telomere on chrosomal short arm and 5'-terminus of this base sequence : 6603
ggaggctggaggtaaggacaagcccctgagagttcacaggtcatcattcccaagtgtcctcaggtagcgtgtgtgtgtgtgtgtgtgtgtgtgtgtgtgtgtgtgtgtgtgtgtgtaatgttcaagcacgttttcctgggacagtcgggactggggcctccccaaactgcagaatctacccagttatgtttgacatcct

SEQ ID NO: 16699 - DNA, 419 bp, Homo sapiens
  chr10.fa.O7frz.112701692
  Located on chromosome 10
  Distance between a terminus base of telomere on chromosomal short arm and 5'-terminus of this base sequence : 109791061
  Distance between 3'-terminus of neighbour sequence of sequence listing upward to telomere on chrosomal short arm and 5'-terminus of this base sequence : 44439
gaggtcaggagttggagaccagccaggccaacatggtgaaaccctgtctctagtaagaatacaaaaattagcagggcatgttggtgggtgcctgtaatcccagctacttgggagactgaggcaggagaattgcttgaacctgggaggtggaggttgctgtgagccgagattgcgccactgcactccagcctgggtgacagagcaagactccgtctcaaaataaataaaataaaataaaataaaatataaaataaaataaaataaaataaaataaataaaataaaataaaattaaaataaaataaaataaaataaaatataaaataaaataaaataaaataaaataaataaaataaaataagtctccctgcgtgtttttggaaaattcttccttggaggagctttagaaacagtggtctc

SEQ ID NO: 16700 - DNA, 199 bp, Homo sapiens
  D10S1692
  Located on chromosome 10
  Distance between a terminus base of telomere on chromosomal short arm and 5'-terminus of this base sequence : 109956667
  Distance between 3'-terminus of neighbour sequence of sequence listing upward to telomere on chrosomal short arm and 5'-terminus of this base sequence : 165187
gctgagattgtgccattgcagtccagcctgtgtgaaagagcaagagtctgtctcaaaacacacacacacacacacacacacacacacacacacacacacacaaacaaacagaaaacaaaagataaactcaatcctaccacttctcactgtttccactgctgtggccgtggtttaactcatcaacatctggctttcctgg

SEQ ID NO: 16701 - DNA, 202 bp, Homo sapiens
  AL353727.7_105299
  Located on chromosome 10
  Distance between a terminus base of telomere on chromosomal short arm and 5'-terminus of this base sequence : 110000722
  Distance between 3'-terminus of neighbour sequence of sequence listing upward to telomere on chrosomal short arm and 5'-terminus of this base sequence : 43856
acttttattcatggctacattgagaagttgggagaggctggaatcaagaatgagagccatgatattgttgtgtaggtctatattcttactgttatgactatagcccattttctttattattattattattattattgagatggactctcgctctgtcacccaggccagagtgcagtggcccaatgtcagctcacgataacct

SEQ ID NO: 16702 - DNA, 310 bp, Homo sapiens
  chr10.fa.O7frz.112181637
  Located on chromosome 10
  Distance between a terminus base of telomere on chromosomal short arm and 5'-terminus of this base sequence : 110163628
  Distance between 3'-terminus of neighbour sequence of sequence listing upward to telomere on chrosomal short arm and 5'-terminus of this base sequence : 162704
tggtatagatcctgagtctatcagtcaggatccaaccagagaaacaaaaccaataggacacacacacacacacacactctttcatcaagggatttattataagactctagcttatgtattgtggaggatgtttaagaaagcccaaattgataggacaggtcattaggaagagaagatgacaagcaggctggaatcccacaggcacagtctgaagttgttttctatgggagaaatttcttctctccttcagaaagtcttaaggcccggcttttaaggccttccaactgattaagtcaggtctaccaagagt

SEQ ID NO: 16703 - DNA, 237 bp, Homo sapiens
  AC006186.1_69576
  Located on chromosome 10
  Distance between a terminus base of telomere on chromosomal short arm and 5'-terminus of this base sequence : 110341491
  Distance between 3'-terminus of neighbour sequence of sequence listing upward to telomere on chrosomal short arm and 5'-terminus of this base sequence : 177553
gaatttgttaaggtcatatgttgacatggctgttaaatatttatttatttatttatttatttatttatagagttctcactgtgttgctcaggctggtcttgaattcttgggctcaagtgatcctcccaccttggccttccaaagtgctgagattacaggcatgaaccaccggcacccagccaacatggctgttaagatggtaactttgaaaagctgttagaggaacataagaccaga

SEQ ID NO: 16704 - DNA, 241 bp, Homo sapiens
  D10S205
  Located on chromosome 10
  Distance between a terminus base of telomere on chromosomal short arm and 5'-terminus of this base sequence : 110575246
  Distance between 3'-terminus of neighbour sequence of sequence listing upward to telomere on chrosomal short arm and 5'-terminus of this base sequence : 233518
ggcacttgtaatccccgctactctggaggctgaggtggcagaattgcttgaaaccggaagactgaggactgaggttgcagtaagccaagatcgcgccactgccctccagcctggggaacaaaagcgaaattctgtctgtctcaaaaaaaaaacacacacacacacacacacacacacacacacacacacacacacacacacacacacaaaagcatcttatgaggccaggtgcagtggctca

SEQ ID NO: 16705 - DNA, 438 bp, Homo sapiens
  chr10.fa.O7frz.112485424
  Located on chromosome 10
  Distance between a terminus base of telomere on chromosomal short arm and 5'-terminus of this base sequence : 110594904
  Distance between 3'-terminus of neighbour sequence of sequence listing upward to telomere on chrosomal short arm and 5'-terminus of this base sequence : 19417
ggcaataagagcgaaactccatctcaaaaaaaaaaaaaaagaaagaaagaaaggccaggcgtggtggctcatgcctgtaatcccagcactttgggaggctgaggcgggtggatcatttgaggtcaggaattcgagaccagcctggccaacgtggtgaaaccccgtctctactaaaaatgcaaaaattagctgggcgtggtggtaggtgcctgtaatcccagctactcaggaggctgaggcaggataatcgcatgaacctgggaggcggaggttgcagtgagccaagataatgccattgcactccagcctgggcgacagaggtgagactctgtctcaaaaaataaataaataaataaataaataaataaataaataaataaataaaaagaaaagaaagagaaagaagaaaatatactgtaccttatctgcacatttgaa

SEQ ID NO: 16706 - DNA, 136 bp, Homo sapiens
  DISO7_00027123
  Located on chromosome 10
  Distance between a terminus base of telomere on chromosomal short arm and 5'-terminus of this base sequence : 110687174
  Distance between 3'-terminus of neighbour sequence of sequence listing upward to telomere on chrosomal short arm and 5'-terminus of this base sequence : 91832
ccatgcagactccaagaaaaggagaagctggaggaggaggaccaggaggaacaacaggaggaggaggaggaggaggaggaggaggaggagtctgattcttcccccacttcacagcctggagcttccagcctaactt

SEQ ID NO: 16707 - DNA, 270 bp, Homo sapiens
  D10S222
  Located on chromosome 10
  Distance between a terminus base of telomere on chromosomal short arm and 5'-terminus of this base sequence : 110793997
  Distance between 3'-terminus of neighbour sequence of sequence listing upward to telomere on chrosomal short arm and 5'-terminus of this base sequence : 106687
tctaactgtggattgaagcgactgtgtgttgccgggcctgtgtttccatgcgggggcagccacatctgtggtactctgtgcctgtgccatgcctgtgtgtgtgtgtgtgtgtgtgtgtgtgtgtgtgtgtgtgtgtgtagtggggctggtggtgaggagtcgggctcctctgggaccagcctggcaggagacccatggggaaatgaattcccatttggaaaatggtttaagcggttacacgcttgatctcttccattcggtaggtttcca

SEQ ID NO: 16708 - DNA, 259 bp, Homo sapiens
  Z17132.1_138
  Located on chromosome 10
  Distance between a terminus base of telomere on chromosomal short arm and 5'-terminus of this base sequence : 110794000
  Distance between 3'-terminus of neighbour sequence of sequence listing upward to telomere on chrosomal short arm and 5'-terminus of this base sequence : -267
aactgtggattgaagcgactgtgtgttgccgggcctgtgtttccatgcgggggcagccacatctgtggtactctgtgcctgtgccatgcctgtgtgtgtgtgtgtgtgtgtgtgtgtgtgtgtgtgtgtgtgtgtagtggggctggtggtgaggagtcgggctcctctgggaccagcctggcaggagacccatggggaaatgaattcccatttggaaaatggtttaagcggttacacgcttgatctcttccattcggta

SEQ ID NO: 16709 - DNA, 301 bp, Homo sapiens
  AL133355.12_130752
  Located on chromosome 10
  Distance between a terminus base of telomere on chromosomal short arm and 5'-terminus of this base sequence : 111025011
  Distance between 3'-terminus of neighbour sequence of sequence listing upward to telomere on chrosomal short arm and 5'-terminus of this base sequence : 230752
gcacgtagctagtgctcctccagaggtgccaggaggcacttgaaattccctccagcaggaagagagtgacctggtcacacctgaagcttcacagggtgtgtatacgtacacacacacacacacacacacacacaacactcacctggccaccaccaaagatcccccttcccttcattctccagtttggaggggggcactgtcacccaacacactttccagacaactttcctgttggttatccaaagaggggtaagatgaaggcccagtaggggcagagctgaattttctaagttggaccttt
